United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 43

SEQ ID NO: 1923290 - RNA, 14 nt, Human
agaagagccacagu

SEQ ID NO: 1923291 - RNA, 22 nt, Human
agaagagccacagugagggaga

SEQ ID NO: 1923292 - RNA, 13 nt, Human
agaaucucuuucg

SEQ ID NO: 1923293 - RNA, 17 nt, Human
agaaucucaaauaacua

SEQ ID NO: 1923294 - RNA, 16 nt, Human
agaaugaaagggccca

SEQ ID NO: 1923295 - RNA, 18 nt, Human
agaaugcucuuuacuuca

SEQ ID NO: 1923296 - RNA, 23 nt, Human
agaaugcacaaacagaggccgcc

SEQ ID NO: 1923297 - RNA, 20 nt, Human
agaaugaggcugcuuuccaa

SEQ ID NO: 1923298 - RNA, 14 nt, Human
agaaugaggcugcu

SEQ ID NO: 1923299 - RNA, 13 nt, Human
agaaugaggcugc

SEQ ID NO: 1923300 - RNA, 12 nt, Human
agaaugaggcug

SEQ ID NO: 1923301 - RNA, 22 nt, Human
agaacagugauuaccagggacu

SEQ ID NO: 1923302 - RNA, 14 nt, Human
agaacauaaagcaa

SEQ ID NO: 1923303 - RNA, 16 nt, Human
agaacauaaagcaaau

SEQ ID NO: 1923304 - RNA, 17 nt, Human
agaacauaaagcaaaua

SEQ ID NO: 1923305 - RNA, 13 nt, Human
agaacaucccucc

SEQ ID NO: 1923306 - RNA, 17 nt, Human
agaacaucccuccuggg

SEQ ID NO: 1923307 - RNA, 17 nt, Human
agaaccaaaaagaggcu

SEQ ID NO: 1923308 - RNA, 18 nt, Human
agaaccaaaaagaggcua

SEQ ID NO: 1923309 - RNA, 14 nt, Human
agaacauguagaaa

SEQ ID NO: 1923310 - RNA, 17 nt, Human
agaacauguagaaaaca

SEQ ID NO: 1923311 - RNA, 13 nt, Human
agaacaugugaga

SEQ ID NO: 1923312 - RNA, 18 nt, Human
agaacauguagaaaacaa

SEQ ID NO: 1923313 - RNA, 19 nt, Human
agaacauguagaaaacaaa

SEQ ID NO: 1923314 - RNA, 22 nt, Human
agaacaugugagagguuugacu

SEQ ID NO: 1923315 - RNA, 15 nt, Human
agaacacccucuaaa

SEQ ID NO: 1923316 - RNA, 11 nt, Human
agaacacuggu

SEQ ID NO: 1923317 - RNA, 20 nt, Human
agaacaauauugacuuuguc

SEQ ID NO: 1923318 - RNA, 21 nt, Human
agaacaauauugacuuugucu

SEQ ID NO: 1923319 - RNA, 16 nt, Human
agaacacaaggucauu

SEQ ID NO: 1923320 - RNA, 17 nt, Human
agaacaaccaaaaucuu

SEQ ID NO: 1923321 - RNA, 17 nt, Human
agaacaauauugacuuu

SEQ ID NO: 1923322 - RNA, 19 nt, Human
agaacaauauugacuuugu

SEQ ID NO: 1923323 - RNA, 19 nt, Human
agacaaggaaaaaauaaca

SEQ ID NO: 1923324 - RNA, 20 nt, Human
agacaaugugaaaagaaaaa

SEQ ID NO: 1923325 - RNA, 18 nt, Human
agacgaaacauuuguucu

SEQ ID NO: 1923326 - RNA, 16 nt, Human
agaccuuucaaagcca

SEQ ID NO: 1923327 - RNA, 19 nt, Human
agaccuuucaaagccauuu

SEQ ID NO: 1923328 - RNA, 19 nt, Human
agaccuuuuaacuccucaa

SEQ ID NO: 1923329 - RNA, 14 nt, Human
agaccacguuucua

SEQ ID NO: 1923330 - RNA, 23 nt, Human
agaccaucccugaaggccccgcc

SEQ ID NO: 1923331 - RNA, 17 nt, Human
agacagcuccacccugg

SEQ ID NO: 1923332 - RNA, 21 nt, Human
agacagcccgggcucugccuc

SEQ ID NO: 1923333 - RNA, 14 nt, Human
agacaauuuauuau

SEQ ID NO: 1923334 - RNA, 22 nt, Human
agacagcccgggcucugccucc

SEQ ID NO: 1923335 - RNA, 23 nt, Human
agacagcccgggcucugccuccc

SEQ ID NO: 1923336 - RNA, 15 nt, Human
agacuaucuaaaugu

SEQ ID NO: 1923337 - RNA, 17 nt, Human
agacuauauuguacaca

SEQ ID NO: 1923338 - RNA, 17 nt, Human
agacgcugugcugcccu

SEQ ID NO: 1923339 - RNA, 15 nt, Human
agacgagaggacgag

SEQ ID NO: 1923340 - RNA, 18 nt, Human
agacgcugugcugcccug

SEQ ID NO: 1923341 - RNA, 19 nt, Human
agacgcugugcugcccugc

SEQ ID NO: 1923342 - RNA, 20 nt, Human
agacgcugugcugcccugcc

SEQ ID NO: 1923343 - RNA, 18 nt, Human
agagcccacgcccccacu

SEQ ID NO: 1923344 - RNA, 15 nt, Human
agagaggcaauggcu

SEQ ID NO: 1923345 - RNA, 22 nt, Human
agagaggcagaagaacccuggc

SEQ ID NO: 1923346 - RNA, 11 nt, Human
agagagcaaga

SEQ ID NO: 1923347 - RNA, 19 nt, Human
agagagcaagacgcugugc

SEQ ID NO: 1923348 - RNA, 23 nt, Human
agagagcaagacgcugugcugcc

SEQ ID NO: 1923349 - RNA, 14 nt, Human
agagcccagcucca

SEQ ID NO: 1923350 - RNA, 12 nt, Human
agagcccagcuc

SEQ ID NO: 1923351 - RNA, 13 nt, Human
agagcccagcucc

SEQ ID NO: 1923352 - RNA, 12 nt, Human
agacugaccaau

SEQ ID NO: 1923353 - RNA, 21 nt, Human
agacugaccaauauuguacag

SEQ ID NO: 1923354 - RNA, 14 nt, Human
agagaaauauggaa

SEQ ID NO: 1923355 - RNA, 16 nt, Human
agacucuuuggacacu

SEQ ID NO: 1923356 - RNA, 18 nt, Human
aggaaaaaauaacaauga

SEQ ID NO: 1923357 - RNA, 13 nt, Human
aggaaaaacaggu

SEQ ID NO: 1923358 - RNA, 22 nt, Human
aggaaaaaaaucguccagggag

SEQ ID NO: 1923359 - RNA, 23 nt, Human
agcuuuuuucucugauacagaaa

SEQ ID NO: 1923360 - RNA, 21 nt, Human
agcuuuuuuccuuaauccagc

SEQ ID NO: 1923361 - RNA, 21 nt, Human
aggaaaaaaaucguccaggga

SEQ ID NO: 1923362 - RNA, 22 nt, Human
agcuuuuuucucugauacagaa

SEQ ID NO: 1923363 - RNA, 20 nt, Human
agcuuuuuucucugauacag

SEQ ID NO: 1923364 - RNA, 19 nt, Human
agcuuuuuucucugauaca

SEQ ID NO: 1923365 - RNA, 22 nt, Human
agcuuuguuuguugucagcuga

SEQ ID NO: 1923366 - RNA, 21 nt, Human
agcuuuguuuguugucagcug

SEQ ID NO: 1923367 - RNA, 15 nt, Human
aggaacacuccuuca

SEQ ID NO: 1923368 - RNA, 18 nt, Human
aggaacuugagaacuuua

SEQ ID NO: 1923369 - RNA, 14 nt, Human
aggaacuuccaggu

SEQ ID NO: 1923370 - RNA, 12 nt, Human
aggaacacuccu

SEQ ID NO: 1923371 - RNA, 11 nt, Human
aggaaguacug

SEQ ID NO: 1923372 - RNA, 15 nt, Human
aggaaguacuggaga

SEQ ID NO: 1923373 - RNA, 14 nt, Human
aggaagguagaaau

SEQ ID NO: 1923374 - RNA, 18 nt, Human
aggaagacccaacacaug

SEQ ID NO: 1923375 - RNA, 22 nt, Human
aggaagaacggggcucuucuca

SEQ ID NO: 1923376 - RNA, 18 nt, Human
aggaagaacggggcucuu

SEQ ID NO: 1923377 - RNA, 12 nt, Human
aggaagaacggg

SEQ ID NO: 1923378 - RNA, 21 nt, Human
aggaagaacacccucuaaaug

SEQ ID NO: 1923379 - RNA, 15 nt, Human
agcuguauuuugaaa

SEQ ID NO: 1923380 - RNA, 15 nt, Human
agcuggucccacuca

SEQ ID NO: 1923381 - RNA, 15 nt, Human
agcugcgggcugggu

SEQ ID NO: 1923382 - RNA, 20 nt, Human
agcugguaaucuugcucugc

SEQ ID NO: 1923383 - RNA, 16 nt, Human
agcugguugagguuuc

SEQ ID NO: 1923384 - RNA, 21 nt, Human
agcuggugguaucugaguuga

SEQ ID NO: 1923385 - RNA, 14 nt, Human
agcugccuuggcuc

SEQ ID NO: 1923386 - RNA, 16 nt, Human
agcugccuuggcucag

SEQ ID NO: 1923387 - RNA, 17 nt, Human
agcugccuuggcucaga

SEQ ID NO: 1923388 - RNA, 19 nt, Human
agcugccuuggcucagaca

SEQ ID NO: 1923389 - RNA, 20 nt, Human
agcugccuuggcucagacau

SEQ ID NO: 1923390 - RNA, 15 nt, Human
agcugacuuuucugu

SEQ ID NO: 1923391 - RNA, 21 nt, Human
agcugacuuuucuguccgagc

SEQ ID NO: 1923392 - RNA, 13 nt, Human
agcugacucacac

SEQ ID NO: 1923393 - RNA, 22 nt, Human
agcucuuuccuccuuccaugga

SEQ ID NO: 1923394 - RNA, 23 nt, Human
agcucuuuccuccuuccauggaa

SEQ ID NO: 1923395 - RNA, 14 nt, Human
agcucuuugcacua

SEQ ID NO: 1923396 - RNA, 12 nt, Human
agcucuuuccuc

SEQ ID NO: 1923397 - RNA, 13 nt, Human
agcucuuuccucc

SEQ ID NO: 1923398 - RNA, 15 nt, Human
agcucuuuccuccuu

SEQ ID NO: 1923399 - RNA, 17 nt, Human
agcucuuuccuccuucc

SEQ ID NO: 1923400 - RNA, 16 nt, Human
agcucuuggcuccacu

SEQ ID NO: 1923401 - RNA, 16 nt, Human
agcuccucuccccagc

SEQ ID NO: 1923402 - RNA, 17 nt, Human
agcuccucuccccagcc

SEQ ID NO: 1923403 - RNA, 18 nt, Human
agcuccucuccccagccc

SEQ ID NO: 1923404 - RNA, 19 nt, Human
agcuccucuccccagccca

SEQ ID NO: 1923405 - RNA, 20 nt, Human
agcuccucuccccagcccag

SEQ ID NO: 1923406 - RNA, 21 nt, Human
agcuccucuccccagcccaga

SEQ ID NO: 1923407 - RNA, 22 nt, Human
agcuccucuccccagcccagag

SEQ ID NO: 1923408 - RNA, 23 nt, Human
agcuccucuccccagcccagaga

SEQ ID NO: 1923409 - RNA, 24 nt, Human
agcuccucuccccagcccagagac

SEQ ID NO: 1923410 - RNA, 23 nt, Human
agcucaccagccccagugcccac

SEQ ID NO: 1923411 - RNA, 22 nt, Human
agcucaccagccccagugccca

SEQ ID NO: 1923412 - RNA, 23 nt, Human
agccuggccacgcagccaggaca

SEQ ID NO: 1923413 - RNA, 22 nt, Human
agccuggccacgcagccaggac

SEQ ID NO: 1923414 - RNA, 21 nt, Human
agccuggccacgcagccagga

SEQ ID NO: 1923415 - RNA, 20 nt, Human
agccuggccacgcagccagg

SEQ ID NO: 1923416 - RNA, 12 nt, Human
agccuggccaga

SEQ ID NO: 1923417 - RNA, 13 nt, Human
agccuggccagac

SEQ ID NO: 1923418 - RNA, 16 nt, Human
agccuggccacgcagc

SEQ ID NO: 1923419 - RNA, 14 nt, Human
agccuggacccugu

SEQ ID NO: 1923420 - RNA, 17 nt, Human
agccugcugccugcuuu

SEQ ID NO: 1923421 - RNA, 11 nt, Human
agccuggcucc

SEQ ID NO: 1923422 - RNA, 18 nt, Human
agccugggcaaugugaua

SEQ ID NO: 1923423 - RNA, 21 nt, Human
agccuggccagacacaggccc

SEQ ID NO: 1923424 - RNA, 22 nt, Human
agccuggccagacacaggcccu

SEQ ID NO: 1923425 - RNA, 14 nt, Human
agccuggccagaca

SEQ ID NO: 1923426 - RNA, 15 nt, Human
agccuggccagacac

SEQ ID NO: 1923427 - RNA, 16 nt, Human
agccuggccagacaca

SEQ ID NO: 1923428 - RNA, 18 nt, Human
agccuggccagacacagg

SEQ ID NO: 1923429 - RNA, 15 nt, Human
agccuuucuuuugga

SEQ ID NO: 1923430 - RNA, 13 nt, Human
agccuuuaaugca

SEQ ID NO: 1923431 - RNA, 15 nt, Human
agccuuuaaugcauc

SEQ ID NO: 1923432 - RNA, 14 nt, Human
agccuuuaaugcau

SEQ ID NO: 1923433 - RNA, 13 nt, Human
agcuaaauccuuu

SEQ ID NO: 1923434 - RNA, 18 nt, Human
agcuaaacggauuccaaa

SEQ ID NO: 1923435 - RNA, 19 nt, Human
agcuaacauggaaguacua

SEQ ID NO: 1923436 - RNA, 20 nt, Human
agcuaacauggaaguacuau

SEQ ID NO: 1923437 - RNA, 12 nt, Human
agcuaagaaccu

SEQ ID NO: 1923438 - RNA, 13 nt, Human
agcuaagaaccug

SEQ ID NO: 1923439 - RNA, 14 nt, Human
agcuaagaaaagau

SEQ ID NO: 1923440 - RNA, 15 nt, Human
agcgauucuucugcu

SEQ ID NO: 1923441 - RNA, 17 nt, Human
agcgacagugagacucu

SEQ ID NO: 1923442 - RNA, 19 nt, Human
agcgauucuucugcuucag

SEQ ID NO: 1923443 - RNA, 17 nt, Human
agcgauucuucugcuuc

SEQ ID NO: 1923444 - RNA, 15 nt, Human
agcgacagugagacu

SEQ ID NO: 1923445 - RNA, 13 nt, Human
agcgacagugaga

SEQ ID NO: 1923446 - RNA, 16 nt, Human
agcgaauuuuaaaaga

SEQ ID NO: 1923447 - RNA, 15 nt, Human
agcgaauuuuaaaag

SEQ ID NO: 1923448 - RNA, 13 nt, Human
agcgaauuuuaaa

SEQ ID NO: 1923449 - RNA, 13 nt, Human
agcuacaaaugca

SEQ ID NO: 1923450 - RNA, 22 nt, Human
agcuacaccuuucuccuuugua

SEQ ID NO: 1923451 - RNA, 21 nt, Human
agcuacaccuuucuccuuugu

SEQ ID NO: 1923452 - RNA, 21 nt, Human
agcucaccagccccagugccc

SEQ ID NO: 1923453 - RNA, 15 nt, Human
agcucaccagcccca

SEQ ID NO: 1923454 - RNA, 14 nt, Human
agcucaccagcccc

SEQ ID NO: 1923455 - RNA, 13 nt, Human
agcucaccagccc

SEQ ID NO: 1923456 - RNA, 12 nt, Human
agcuacaaaugc

SEQ ID NO: 1923457 - RNA, 15 nt, Human
agcuaaugggacacu

SEQ ID NO: 1923458 - RNA, 14 nt, Human
agcuaaugggacac

SEQ ID NO: 1923459 - RNA, 13 nt, Human
agcuaaugggaca

SEQ ID NO: 1923460 - RNA, 17 nt, Human
agcuaagaaccuggaac

SEQ ID NO: 1923461 - RNA, 14 nt, Human
agcuaagaaccugg

SEQ ID NO: 1923462 - RNA, 16 nt, Human
agcuaagaaccuggaa

SEQ ID NO: 1923463 - RNA, 15 nt, Human
aggauggcaggacgu

SEQ ID NO: 1923464 - RNA, 22 nt, Human
aggauggcaggacgugggcugg

SEQ ID NO: 1923465 - RNA, 15 nt, Human
aggaguucugcucau

SEQ ID NO: 1923466 - RNA, 18 nt, Human
aggaguuucguuuucaaa

SEQ ID NO: 1923467 - RNA, 14 nt, Human
aggaguucugcuca

SEQ ID NO: 1923468 - RNA, 21 nt, Human
aggagugccguguguugcaug

SEQ ID NO: 1923469 - RNA, 23 nt, Human
aggaguucagggucauagcaugc

SEQ ID NO: 1923470 - RNA, 19 nt, Human
aggaguuccuaaccagccu

SEQ ID NO: 1923471 - RNA, 14 nt, Human
aggagugagcacua

SEQ ID NO: 1923472 - RNA, 12 nt, Human
aggagugagcac

SEQ ID NO: 1923473 - RNA, 15 nt, Human
aggaggucucuaaga

SEQ ID NO: 1923474 - RNA, 21 nt, Human
aggagaccuggcacuggaugc

SEQ ID NO: 1923475 - RNA, 14 nt, Human
aggagacccacagg

SEQ ID NO: 1923476 - RNA, 13 nt, Human
aggagacaggcag

SEQ ID NO: 1923477 - RNA, 18 nt, Human
aggagacaggcagagcug

SEQ ID NO: 1923478 - RNA, 19 nt, Human
aggaaguacuggagaaaau

SEQ ID NO: 1923479 - RNA, 13 nt, Human
aggaaguagagga

SEQ ID NO: 1923480 - RNA, 14 nt, Human
aggaggucucuaag

SEQ ID NO: 1923481 - RNA, 14 nt, Human
aggagggcagcaga

SEQ ID NO: 1923482 - RNA, 21 nt, Human
aggaugguaauucuuauucuu

SEQ ID NO: 1923483 - RNA, 13 nt, Human
aggaugucugggc

SEQ ID NO: 1923484 - RNA, 20 nt, Human
aggaugugauuguggaaugg

SEQ ID NO: 1923485 - RNA, 23 nt, Human
aggccagggggccagucccugag

SEQ ID NO: 1923486 - RNA, 19 nt, Human
aggccagggggccaguccc

SEQ ID NO: 1923487 - RNA, 17 nt, Human
aggccaugggccuccug

SEQ ID NO: 1923488 - RNA, 17 nt, Human
aggcccucugcccacuc

SEQ ID NO: 1923489 - RNA, 16 nt, Human
aggccaugggccuccu

SEQ ID NO: 1923490 - RNA, 14 nt, Human
aggccaugggccuc

SEQ ID NO: 1923491 - RNA, 13 nt, Human
aggccagcugcuu

SEQ ID NO: 1923492 - RNA, 14 nt, Human
aggccagcugcuug

SEQ ID NO: 1923493 - RNA, 16 nt, Human
aggccagcugcuuggg

SEQ ID NO: 1923494 - RNA, 16 nt, Human
aggccaggcccucugc

SEQ ID NO: 1923495 - RNA, 17 nt, Human
aggccaggcccucugcc

SEQ ID NO: 1923496 - RNA, 18 nt, Human
aggccaggcccucugccc

SEQ ID NO: 1923497 - RNA, 19 nt, Human
aggccaggcccucugccca

SEQ ID NO: 1923498 - RNA, 23 nt, Human
aggccaggcccucugcccacucc

SEQ ID NO: 1923499 - RNA, 22 nt, Human
aggcauguucucugaggacacu

SEQ ID NO: 1923500 - RNA, 20 nt, Human
aggcauguucucugaggaca

SEQ ID NO: 1923501 - RNA, 21 nt, Human
aggcauuccccaggaggccag

SEQ ID NO: 1923502 - RNA, 22 nt, Human
aggcauuccccaggaggccagc

SEQ ID NO: 1923503 - RNA, 23 nt, Human
aggcauuccccaggaggccagcc

SEQ ID NO: 1923504 - RNA, 12 nt, Human
aggcauguucuc

SEQ ID NO: 1923505 - RNA, 22 nt, Human
aggcaugugccacccacccaac

SEQ ID NO: 1923506 - RNA, 23 nt, Human
aggcaugugaugagaggaaauca

SEQ ID NO: 1923507 - RNA, 24 nt, Human
aggcaugugaugagaggaaaucac

SEQ ID NO: 1923508 - RNA, 17 nt, Human
aggcagauccaggacua

SEQ ID NO: 1923509 - RNA, 13 nt, Human
aggcagauacagg

SEQ ID NO: 1923510 - RNA, 20 nt, Human
aggcagagguugcagugagc

SEQ ID NO: 1923511 - RNA, 22 nt, Human
aggcagaacucaucuagguaaa

SEQ ID NO: 1923512 - RNA, 14 nt, Human
aggcagccaggcca

SEQ ID NO: 1923513 - RNA, 11 nt, Human
aggcagaucca

SEQ ID NO: 1923514 - RNA, 15 nt, Human
aggcagauccaggac

SEQ ID NO: 1923515 - RNA, 16 nt, Human
aggcagauccaggacu

SEQ ID NO: 1923516 - RNA, 15 nt, Human
aggcagccaggccac

SEQ ID NO: 1923517 - RNA, 16 nt, Human
aggcagccaggccaca

SEQ ID NO: 1923518 - RNA, 22 nt, Human
aggcacuuuagggcuguaaaau

SEQ ID NO: 1923519 - RNA, 20 nt, Human
aggcacuuuagggcuguaaa

SEQ ID NO: 1923520 - RNA, 23 nt, Human
aggcuguaucccaugagccucag

SEQ ID NO: 1923521 - RNA, 17 nt, Human
aggcugcagugagccga

SEQ ID NO: 1923522 - RNA, 19 nt, Human
aggcugcagugagccgaga

SEQ ID NO: 1923523 - RNA, 24 nt, Human
aggcuguaucccaugagccucagc

SEQ ID NO: 1923524 - RNA, 19 nt, Human
aggcugucaauuacaggaa

SEQ ID NO: 1923525 - RNA, 20 nt, Human
aggcuguucccauguagccc

SEQ ID NO: 1923526 - RNA, 12 nt, Human
aggcugucaauu

SEQ ID NO: 1923527 - RNA, 14 nt, Human
aggcuuacacccac

SEQ ID NO: 1923528 - RNA, 14 nt, Human
aggcuuaaacccau

SEQ ID NO: 1923529 - RNA, 18 nt, Human
aggcugaggcaagagaau

SEQ ID NO: 1923530 - RNA, 22 nt, Human
aggcucuggagcccacuguacu

SEQ ID NO: 1923531 - RNA, 16 nt, Human
aggcucuguuuaugcu

SEQ ID NO: 1923532 - RNA, 18 nt, Human
aggcucuguuuaugcuuu

SEQ ID NO: 1923533 - RNA, 21 nt, Human
aggcccucugcccacucccug

SEQ ID NO: 1923534 - RNA, 19 nt, Human
aggcccucugcccacuccc

SEQ ID NO: 1923535 - RNA, 20 nt, Human
aggcccucugcccacucccu

SEQ ID NO: 1923536 - RNA, 13 nt, Human
agggccuggcuca

SEQ ID NO: 1923537 - RNA, 14 nt, Human
agggccuggcucag

SEQ ID NO: 1923538 - RNA, 17 nt, Human
agggauuguuucuguuu

SEQ ID NO: 1923539 - RNA, 22 nt, Human
agggauuuggggcucagagugg

SEQ ID NO: 1923540 - RNA, 18 nt, Human
agggccuggcucaggugg

SEQ ID NO: 1923541 - RNA, 19 nt, Human
agggcguggaaaggggcag

SEQ ID NO: 1923542 - RNA, 13 nt, Human
aggggcaugggaa

SEQ ID NO: 1923543 - RNA, 14 nt, Human
agggaugguguuca

SEQ ID NO: 1923544 - RNA, 15 nt, Human
agggaugcccuggag

SEQ ID NO: 1923545 - RNA, 17 nt, Human
agggaugcccuggaggu

SEQ ID NO: 1923546 - RNA, 19 nt, Human
agggaugcccuggaggugg

SEQ ID NO: 1923547 - RNA, 20 nt, Human
agggaugcccuggagguggc

SEQ ID NO: 1923548 - RNA, 15 nt, Human
agggaugcauggaga

SEQ ID NO: 1923549 - RNA, 21 nt, Human
agggaugcccuggagguggcu

SEQ ID NO: 1923550 - RNA, 19 nt, Human
agggaucuauacuugcuuu

SEQ ID NO: 1923551 - RNA, 22 nt, Human
agggaucugguccuacccaucc

SEQ ID NO: 1923552 - RNA, 18 nt, Human
agggaucuauacuugcuu

SEQ ID NO: 1923553 - RNA, 17 nt, Human
agggacugagaaauuua

SEQ ID NO: 1923554 - RNA, 14 nt, Human
agggacugaagcca

SEQ ID NO: 1923555 - RNA, 15 nt, Human
agggacugagaaauu

SEQ ID NO: 1923556 - RNA, 13 nt, Human
agggacugagaaa

SEQ ID NO: 1923557 - RNA, 14 nt, Human
agggacugagaaau

SEQ ID NO: 1923558 - RNA, 15 nt, Human
gcccuaaaagcacac

SEQ ID NO: 1923559 - RNA, 15 nt, Human
gcccuaaugucugua

SEQ ID NO: 1923560 - RNA, 14 nt, Human
gcccuacuauucag

SEQ ID NO: 1923561 - RNA, 15 nt, Human
gccccugcccggcug

SEQ ID NO: 1923562 - RNA, 16 nt, Human
gccccuggaugcagcc

SEQ ID NO: 1923563 - RNA, 18 nt, Human
gccccuggaugcagccuc

SEQ ID NO: 1923564 - RNA, 22 nt, Human
gccccuggaugcagccucacag

SEQ ID NO: 1923565 - RNA, 22 nt, Human
gcccuaaaguguauuuuuuuac

SEQ ID NO: 1923566 - RNA, 18 nt, Human
gccccaaaacucuccucu

SEQ ID NO: 1923567 - RNA, 19 nt, Human
gccccaaaacucuccucug

SEQ ID NO: 1923568 - RNA, 18 nt, Human
gcccccaggacugggcca

SEQ ID NO: 1923569 - RNA, 14 nt, Human
gccccugcccggcu

SEQ ID NO: 1923570 - RNA, 13 nt, Human
gccccugcccggc

SEQ ID NO: 1923571 - RNA, 13 nt, Human
gcccccaucucau

SEQ ID NO: 1923572 - RNA, 19 nt, Human
gcccacucccugcaaccug

SEQ ID NO: 1923573 - RNA, 14 nt, Human
gcccacucccugca

SEQ ID NO: 1923574 - RNA, 15 nt, Human
gcccacucccugcaa

SEQ ID NO: 1923575 - RNA, 13 nt, Human
gcccacucccugc

SEQ ID NO: 1923576 - RNA, 16 nt, Human
gcccugccuccuuugu

SEQ ID NO: 1923577 - RNA, 22 nt, Human
gcccugccuccuuugugaggaa

SEQ ID NO: 1923578 - RNA, 16 nt, Human
gcccuguugacacagg

SEQ ID NO: 1923579 - RNA, 19 nt, Human
gcccuguugacacaggucu

SEQ ID NO: 1923580 - RNA, 21 nt, Human
gcccuguugacacaggucuuu

SEQ ID NO: 1923581 - RNA, 16 nt, Human
gccgccaugcuccugg

SEQ ID NO: 1923582 - RNA, 14 nt, Human
gccgcccaaggccc

SEQ ID NO: 1923583 - RNA, 16 nt, Human
gcccuuaccugccagg

SEQ ID NO: 1923584 - RNA, 20 nt, Human
gcccuuaccugccaggaagc

SEQ ID NO: 1923585 - RNA, 15 nt, Human
gccgccaugcuccug

SEQ ID NO: 1923586 - RNA, 20 nt, Human
gcccuguugacacaggucuu

SEQ ID NO: 1923587 - RNA, 12 nt, Human
gccggccagccc

SEQ ID NO: 1923588 - RNA, 14 nt, Human
gccggccagccccu

SEQ ID NO: 1923589 - RNA, 12 nt, Human
gccgcugccacc

SEQ ID NO: 1923590 - RNA, 14 nt, Human
gccgcugccaccca

SEQ ID NO: 1923591 - RNA, 17 nt, Human
gccgcugccacccaccu

SEQ ID NO: 1923592 - RNA, 13 nt, Human
gccgccugguacu

SEQ ID NO: 1923593 - RNA, 15 nt, Human
gccgccugguacuca

SEQ ID NO: 1923594 - RNA, 18 nt, Human
gccgccugguacucaagc

SEQ ID NO: 1923595 - RNA, 17 nt, Human
gccgcgucgcccuccca

SEQ ID NO: 1923596 - RNA, 15 nt, Human
gccuggccccucagg

SEQ ID NO: 1923597 - RNA, 16 nt, Human
gccuggccccucaggg

SEQ ID NO: 1923598 - RNA, 17 nt, Human
gccuggccccucagggu

SEQ ID NO: 1923599 - RNA, 21 nt, Human
gccugggaggucaaggcugca

SEQ ID NO: 1923600 - RNA, 22 nt, Human
gccugggaggucaaggcugcag

SEQ ID NO: 1923601 - RNA, 14 nt, Human
gccugggaucccuc

SEQ ID NO: 1923602 - RNA, 13 nt, Human
gccugugucuuua

SEQ ID NO: 1923603 - RNA, 22 nt, Human
gccugugucuuuaaaugcugcu

SEQ ID NO: 1923604 - RNA, 21 nt, Human
gccugggaucccucauccuca

SEQ ID NO: 1923605 - RNA, 18 nt, Human
gccugggaucccucaucc

SEQ ID NO: 1923606 - RNA, 20 nt, Human
gccuggccccucaggguccc

SEQ ID NO: 1923607 - RNA, 22 nt, Human
gccuggccccucagggucccug

SEQ ID NO: 1923608 - RNA, 10 nt, Human
gccuggccug

SEQ ID NO: 1923609 - RNA, 14 nt, Human
gccugcgagggcag

SEQ ID NO: 1923610 - RNA, 21 nt, Human
gccugcgccaccgcccagaga

SEQ ID NO: 1923611 - RNA, 16 nt, Human
gccugccucuucucua

SEQ ID NO: 1923612 - RNA, 18 nt, Human
gccugccuccagggcugg

SEQ ID NO: 1923613 - RNA, 17 nt, Human
gccugccuccagggcug

SEQ ID NO: 1923614 - RNA, 22 nt, Human
gccugccuccagggcuggacug

SEQ ID NO: 1923615 - RNA, 17 nt, Human
gccuacccacccccagg

SEQ ID NO: 1923616 - RNA, 16 nt, Human
gccuacccacccccag

SEQ ID NO: 1923617 - RNA, 19 nt, Human
gccuccuggcccaggugag

SEQ ID NO: 1923618 - RNA, 15 nt, Human
gccuccuggcccagg

SEQ ID NO: 1923619 - RNA, 13 nt, Human
gccuccugugugu

SEQ ID NO: 1923620 - RNA, 15 nt, Human
gccucuggaaagcaa

SEQ ID NO: 1923621 - RNA, 14 nt, Human
gccucugggacugg

SEQ ID NO: 1923622 - RNA, 12 nt, Human
gccucugugccu

SEQ ID NO: 1923623 - RNA, 17 nt, Human
gccucuggaaagcaaag

SEQ ID NO: 1923624 - RNA, 12 nt, Human
gccucugggacu

SEQ ID NO: 1923625 - RNA, 13 nt, Human
gccuccuccagcc

SEQ ID NO: 1923626 - RNA, 18 nt, Human
gccuccugcccuuaccug

SEQ ID NO: 1923627 - RNA, 20 nt, Human
gccugcccaggccccugcca

SEQ ID NO: 1923628 - RNA, 19 nt, Human
gccugcccaggccccugcc

SEQ ID NO: 1923629 - RNA, 16 nt, Human
gccugccuccagggcu

SEQ ID NO: 1923630 - RNA, 11 nt, Human
gccugccucca

SEQ ID NO: 1923631 - RNA, 18 nt, Human
gccugcccaggccccugc

SEQ ID NO: 1923632 - RNA, 17 nt, Human
gccugcccaggccccug

SEQ ID NO: 1923633 - RNA, 12 nt, Human
gccucuucucua

SEQ ID NO: 1923634 - RNA, 23 nt, Human
gccucuucucuacucuagggaaa

SEQ ID NO: 1923635 - RNA, 15 nt, Human
gccaggcccucugcc

SEQ ID NO: 1923636 - RNA, 19 nt, Human
gccaggccacuggccccug

SEQ ID NO: 1923637 - RNA, 13 nt, Human
gccaggccagagg

SEQ ID NO: 1923638 - RNA, 16 nt, Human
gccaggcccucugccc

SEQ ID NO: 1923639 - RNA, 17 nt, Human
gccaggcccucugccca

SEQ ID NO: 1923640 - RNA, 21 nt, Human
gccaggcccucugcccacucc

SEQ ID NO: 1923641 - RNA, 19 nt, Human
gccaggcccucugcccacu

SEQ ID NO: 1923642 - RNA, 20 nt, Human
gccaggcccucugcccacuc

SEQ ID NO: 1923643 - RNA, 12 nt, Human
gccaggccagag

SEQ ID NO: 1923644 - RNA, 20 nt, Human
gccaggauggaacacggcca

SEQ ID NO: 1923645 - RNA, 22 nt, Human
gccaggauggaacacggccaca

SEQ ID NO: 1923646 - RNA, 23 nt, Human
gccaggccacaagacccuugugg

SEQ ID NO: 1923647 - RNA, 13 nt, Human
gccagcaggcucu

SEQ ID NO: 1923648 - RNA, 16 nt, Human
gccagcaggcucucag

SEQ ID NO: 1923649 - RNA, 14 nt, Human
gccagcacuugucc

SEQ ID NO: 1923650 - RNA, 19 nt, Human
gccagcacuuguccagcug

SEQ ID NO: 1923651 - RNA, 20 nt, Human
gccagcacuuguccagcuga

SEQ ID NO: 1923652 - RNA, 17 nt, Human
gccagcaggcucucagg

SEQ ID NO: 1923653 - RNA, 18 nt, Human
gccagcaggcucucaggc

SEQ ID NO: 1923654 - RNA, 19 nt, Human
gccagcaggcucucaggcc

SEQ ID NO: 1923655 - RNA, 20 nt, Human
gccagcaggcucucaggcca

SEQ ID NO: 1923656 - RNA, 21 nt, Human
gccagcaggcucucaggccag

SEQ ID NO: 1923657 - RNA, 23 nt, Human
gccagcaggcucucaggccagcu

SEQ ID NO: 1923658 - RNA, 16 nt, Human
gccagacacaggcccu

SEQ ID NO: 1923659 - RNA, 17 nt, Human
gccagacacaggcccuc

SEQ ID NO: 1923660 - RNA, 22 nt, Human
gccagacaucaacagauaaaua

SEQ ID NO: 1923661 - RNA, 18 nt, Human
gccagacaugccacaagg

SEQ ID NO: 1923662 - RNA, 19 nt, Human
gccagaagaugaacagacu

SEQ ID NO: 1923663 - RNA, 20 nt, Human
gccagaagaugaacagacug

SEQ ID NO: 1923664 - RNA, 13 nt, Human
gccagaccugcag

SEQ ID NO: 1923665 - RNA, 14 nt, Human
gccagaccugcaga

SEQ ID NO: 1923666 - RNA, 21 nt, Human
gccagaccugcagacgcccag

SEQ ID NO: 1923667 - RNA, 17 nt, Human
gccagacccccuggaga

SEQ ID NO: 1923668 - RNA, 12 nt, Human
gccagcacacag

SEQ ID NO: 1923669 - RNA, 13 nt, Human
gccagcacacagg

SEQ ID NO: 1923670 - RNA, 15 nt, Human
gccagcacacagggc

SEQ ID NO: 1923671 - RNA, 16 nt, Human
gccagcacacagggca

SEQ ID NO: 1923672 - RNA, 17 nt, Human
gccagcacacagggcag

SEQ ID NO: 1923673 - RNA, 18 nt, Human
gccagcacacagggcagu

SEQ ID NO: 1923674 - RNA, 22 nt, Human
gccagcacacagggcagugagg

SEQ ID NO: 1923675 - RNA, 20 nt, Human
gccauauucuguuggccagu

SEQ ID NO: 1923676 - RNA, 19 nt, Human
gccauauucuguuggccag

SEQ ID NO: 1923677 - RNA, 14 nt, Human
gccauguuggccag

SEQ ID NO: 1923678 - RNA, 18 nt, Human
gccauguuggccaggcug

SEQ ID NO: 1923679 - RNA, 17 nt, Human
gccauguuggccaggcu

SEQ ID NO: 1923680 - RNA, 16 nt, Human
gccauguuggccaggc

SEQ ID NO: 1923681 - RNA, 15 nt, Human
gccauguuggccagg

SEQ ID NO: 1923682 - RNA, 24 nt, Human
gccauguuggccaggcuggucuca

SEQ ID NO: 1923683 - RNA, 22 nt, Human
gccauguuggccaggcuggucu

SEQ ID NO: 1923684 - RNA, 20 nt, Human
gccauguuggccaggcuggu

SEQ ID NO: 1923685 - RNA, 19 nt, Human
gccauguuggccaggcugg

SEQ ID NO: 1923686 - RNA, 19 nt, Human
gccauguugugccucccug

SEQ ID NO: 1923687 - RNA, 20 nt, Human
gccauguugugccucccugg

SEQ ID NO: 1923688 - RNA, 21 nt, Human
gccauguugugccucccuggu

SEQ ID NO: 1923689 - RNA, 22 nt, Human
gccauguugugccucccuggug

SEQ ID NO: 1923690 - RNA, 23 nt, Human
gccauguugugccucccugguga

SEQ ID NO: 1923691 - RNA, 17 nt, Human
gcccacgcuggagugca

SEQ ID NO: 1923692 - RNA, 16 nt, Human
gcccacgcuggagugc

SEQ ID NO: 1923693 - RNA, 15 nt, Human
gcccacgcuggagug

SEQ ID NO: 1923694 - RNA, 18 nt, Human
gcccaccuuggcucaagu

SEQ ID NO: 1923695 - RNA, 17 nt, Human
gccauucuccacagcaa

SEQ ID NO: 1923696 - RNA, 13 nt, Human
gcccacgccccca

SEQ ID NO: 1923697 - RNA, 14 nt, Human
gcccacgcccccac

SEQ ID NO: 1923698 - RNA, 16 nt, Human
gccacauuccugaugc

SEQ ID NO: 1923699 - RNA, 20 nt, Human
gccacauuccugaugcuucu

SEQ ID NO: 1923700 - RNA, 14 nt, Human
gccacauuuggaau

SEQ ID NO: 1923701 - RNA, 22 nt, Human
gccacauuuggaauacuuuuug

SEQ ID NO: 1923702 - RNA, 19 nt, Human
gccacauuuggaauacuuu

SEQ ID NO: 1923703 - RNA, 22 nt, Human
gccaccaacauacucccaucug

SEQ ID NO: 1923704 - RNA, 19 nt, Human
gccaccaacauacucccau

SEQ ID NO: 1923705 - RNA, 20 nt, Human
gccaccaacauacucccauc

SEQ ID NO: 1923706 - RNA, 21 nt, Human
gccaccaacauacucccaucu

SEQ ID NO: 1923707 - RNA, 23 nt, Human
gccaccccagccuggccacgcag

SEQ ID NO: 1923708 - RNA, 16 nt, Human
gccacccaccucccug

SEQ ID NO: 1923709 - RNA, 17 nt, Human
gccacccaccucccugc

SEQ ID NO: 1923710 - RNA, 18 nt, Human
gccacccaccucccugcc

SEQ ID NO: 1923711 - RNA, 21 nt, Human
gccacccaccucccugccucc

SEQ ID NO: 1923712 - RNA, 18 nt, Human
gccacccugaggccucug

SEQ ID NO: 1923713 - RNA, 23 nt, Human
gccacugcaccgggccacagaga

SEQ ID NO: 1923714 - RNA, 16 nt, Human
gccaccgccuccuaca

SEQ ID NO: 1923715 - RNA, 19 nt, Human
gccacccuggggagaaagu

SEQ ID NO: 1923716 - RNA, 13 nt, Human
gccacccugggga

SEQ ID NO: 1923717 - RNA, 21 nt, Human
gccacugcacuauagccuagg

SEQ ID NO: 1923718 - RNA, 19 nt, Human
gccacugcauaccaaccug

SEQ ID NO: 1923719 - RNA, 23 nt, Human
gccacuucuggguggggcagugg

SEQ ID NO: 1923720 - RNA, 20 nt, Human
gccacuucuggguggggcag

SEQ ID NO: 1923721 - RNA, 14 nt, Human
gccacuucugggug

SEQ ID NO: 1923722 - RNA, 23 nt, Human
gccacuuuuuuuuuuaaucucca

SEQ ID NO: 1923723 - RNA, 18 nt, Human
gccacugugaagagaacc

SEQ ID NO: 1923724 - RNA, 19 nt, Human
gccacugugaagagaacca

SEQ ID NO: 1923725 - RNA, 18 nt, Human
gcuaggaacacuccuuca

SEQ ID NO: 1923726 - RNA, 19 nt, Human
gcuaggaacacuccuucac

SEQ ID NO: 1923727 - RNA, 21 nt, Human
gcuaggaacacuccuucacag

SEQ ID NO: 1923728 - RNA, 15 nt, Human
gcuaggccuggccag

SEQ ID NO: 1923729 - RNA, 14 nt, Human
gcuaggccuggcca

SEQ ID NO: 1923730 - RNA, 16 nt, Human
gcuaguaucaaaagaa

SEQ ID NO: 1923731 - RNA, 16 nt, Human
gcuagucaagcuccuc

SEQ ID NO: 1923732 - RNA, 18 nt, Human
gcuagucaagcuccuccu

SEQ ID NO: 1923733 - RNA, 19 nt, Human
gcuagucaagcuccuccuc

SEQ ID NO: 1923734 - RNA, 21 nt, Human
gcuagucaagcuccuccuccc

SEQ ID NO: 1923735 - RNA, 23 nt, Human
gcuagucaagcuccuccucccug

SEQ ID NO: 1923736 - RNA, 21 nt, Human
gcuauggggauagaugugugg

SEQ ID NO: 1923737 - RNA, 19 nt, Human
gcuauggggauagaugugu

SEQ ID NO: 1923738 - RNA, 14 nt, Human
gccugugucuuuaa

SEQ ID NO: 1923739 - RNA, 19 nt, Human
gccuguucagcuccagcuc

SEQ ID NO: 1923740 - RNA, 20 nt, Human
gccuguucagcuccagcuca

SEQ ID NO: 1923741 - RNA, 14 nt, Human
gccuguucagcucc

SEQ ID NO: 1923742 - RNA, 21 nt, Human
gcucagguggggucacucugg

SEQ ID NO: 1923743 - RNA, 22 nt, Human
gcucagguggggucacucuggc

SEQ ID NO: 1923744 - RNA, 19 nt, Human
gcucaggucccuggggcua

SEQ ID NO: 1923745 - RNA, 17 nt, Human
gcucagggccuggcuca

SEQ ID NO: 1923746 - RNA, 15 nt, Human
gcucaggucccuggg

SEQ ID NO: 1923747 - RNA, 13 nt, Human
gcucagggccugg

SEQ ID NO: 1923748 - RNA, 16 nt, Human
gcucagggccuggcuc

SEQ ID NO: 1923749 - RNA, 21 nt, Human
gcucaggagcccugggaggcu

SEQ ID NO: 1923750 - RNA, 12 nt, Human
gcucagggccug

SEQ ID NO: 1923751 - RNA, 15 nt, Human
gcucaggagcccugg

SEQ ID NO: 1923752 - RNA, 18 nt, Human
gcucaggagcccugggag

SEQ ID NO: 1923753 - RNA, 14 nt, Human
gcucaggagcccug

SEQ ID NO: 1923754 - RNA, 22 nt, Human
gcucagagagggugggaguggg

SEQ ID NO: 1923755 - RNA, 18 nt, Human
gcucagagagggugggag

SEQ ID NO: 1923756 - RNA, 20 nt, Human
gcucagagagggugggagug

SEQ ID NO: 1923757 - RNA, 15 nt, Human
gcucagagagggugg

SEQ ID NO: 1923758 - RNA, 13 nt, Human
gcucaccuuuguu

SEQ ID NO: 1923759 - RNA, 13 nt, Human
gcucucaggccag

SEQ ID NO: 1923760 - RNA, 14 nt, Human
gcucucaggccagc

SEQ ID NO: 1923761 - RNA, 15 nt, Human
gcucucaggccagcu

SEQ ID NO: 1923762 - RNA, 16 nt, Human
gcucucaggccagcug

SEQ ID NO: 1923763 - RNA, 20 nt, Human
gcucccaggcauuccccagg

SEQ ID NO: 1923764 - RNA, 21 nt, Human
gcucccaggcauuccccagga

SEQ ID NO: 1923765 - RNA, 22 nt, Human
gcucccaggcauuccccaggag

SEQ ID NO: 1923766 - RNA, 14 nt, Human
gcuccccagcccca

SEQ ID NO: 1923767 - RNA, 12 nt, Human
gcuccccuccaa

SEQ ID NO: 1923768 - RNA, 17 nt, Human
gcuccugccgcagagcu

SEQ ID NO: 1923769 - RNA, 15 nt, Human
gcuccugccgcagag

SEQ ID NO: 1923770 - RNA, 15 nt, Human
gcucggaggaagccc

SEQ ID NO: 1923771 - RNA, 22 nt, Human
gcuccugccgcagagcuggccg

SEQ ID NO: 1923772 - RNA, 19 nt, Human
gcuccugccgcagagcugg

SEQ ID NO: 1923773 - RNA, 18 nt, Human
gcuccugccgcagagcug

SEQ ID NO: 1923774 - RNA, 23 nt, Human
gcucuggagcccacuguacuugc

SEQ ID NO: 1923775 - RNA, 21 nt, Human
gcugaagcuuauuaaugcuaa

SEQ ID NO: 1923776 - RNA, 22 nt, Human
gcugaagcuuauuaaugcuaag

SEQ ID NO: 1923777 - RNA, 12 nt, Human
gcugaaggcucg

SEQ ID NO: 1923778 - RNA, 20 nt, Human
gcugaaggcucgagcaugcc

SEQ ID NO: 1923779 - RNA, 17 nt, Human
gcugaaugguuuucaaa

SEQ ID NO: 1923780 - RNA, 22 nt, Human
gcugaauacagaggcaacugca

SEQ ID NO: 1923781 - RNA, 15 nt, Human
gcugacagacacagg

SEQ ID NO: 1923782 - RNA, 14 nt, Human
gcugacagacacag

SEQ ID NO: 1923783 - RNA, 14 nt, Human
gcugaauuaucuau

SEQ ID NO: 1923784 - RNA, 16 nt, Human
gcugacagacacaggc

SEQ ID NO: 1923785 - RNA, 14 nt, Human
gcugagcgccagga

SEQ ID NO: 1923786 - RNA, 12 nt, Human
gcucuuccaggc

SEQ ID NO: 1923787 - RNA, 15 nt, Human
gcucuuccaggcugg

SEQ ID NO: 1923788 - RNA, 16 nt, Human
gcucuuccaggcuggg

SEQ ID NO: 1923789 - RNA, 14 nt, Human
gcucuguccuggga

SEQ ID NO: 1923790 - RNA, 15 nt, Human
gcucuguccugggag

SEQ ID NO: 1923791 - RNA, 17 nt, Human
gcucuggccuccaaguc

SEQ ID NO: 1923792 - RNA, 15 nt, Human
gcucuggccuccaag

SEQ ID NO: 1923793 - RNA, 16 nt, Human
gcucuguccugggagu

SEQ ID NO: 1923794 - RNA, 21 nt, Human
gcucugggauagcugacccag

SEQ ID NO: 1923795 - RNA, 20 nt, Human
gcuucacggaagagccuugc

SEQ ID NO: 1923796 - RNA, 15 nt, Human
gcuucacuccugcug

SEQ ID NO: 1923797 - RNA, 16 nt, Human
gcuucacuccugcugu

SEQ ID NO: 1923798 - RNA, 17 nt, Human
gcuucacuccugcugua

SEQ ID NO: 1923799 - RNA, 18 nt, Human
gcuucacuccugcuguaa

SEQ ID NO: 1923800 - RNA, 20 nt, Human
gcuucacuccugcuguaaau

SEQ ID NO: 1923801 - RNA, 17 nt, Human
gcuucagaauuaaaacu

SEQ ID NO: 1923802 - RNA, 22 nt, Human
gcuucaaggauccugagccaga

SEQ ID NO: 1923803 - RNA, 22 nt, Human
gcuuaaacccauauuguaaaac

SEQ ID NO: 1923804 - RNA, 14 nt, Human
gcuuaacuucacau

SEQ ID NO: 1923805 - RNA, 20 nt, Human
gcuucaccccaaucccagcu

SEQ ID NO: 1923806 - RNA, 19 nt, Human
gcuucaccccaaucccagc

SEQ ID NO: 1923807 - RNA, 21 nt, Human
gcugugcucuggacaggcaug

SEQ ID NO: 1923808 - RNA, 12 nt, Human
gcugugcugccc

SEQ ID NO: 1923809 - RNA, 13 nt, Human
gcugugcugcccu

SEQ ID NO: 1923810 - RNA, 19 nt, Human
gcugugcugcccugcccac

SEQ ID NO: 1923811 - RNA, 22 nt, Human
gcugugcugcccugcccaccug

SEQ ID NO: 1923812 - RNA, 22 nt, Human
gcuguuggcugggggccucagu

SEQ ID NO: 1923813 - RNA, 21 nt, Human
gcuguuggcugggggccucag

SEQ ID NO: 1923814 - RNA, 14 nt, Human
gcugguuuuucagu

SEQ ID NO: 1923815 - RNA, 15 nt, Human
gcugguuuuucaguu

SEQ ID NO: 1923816 - RNA, 22 nt, Human
gcuguaaauuuggcuucuguug

SEQ ID NO: 1923817 - RNA, 20 nt, Human
gcuguaaauuuggcuucugu

SEQ ID NO: 1923818 - RNA, 16 nt, Human
gcuguaaaaugcauga

SEQ ID NO: 1923819 - RNA, 20 nt, Human
gcuguaaaaugcaugauuuu

SEQ ID NO: 1923820 - RNA, 17 nt, Human
gcuguaaauuuggcuuc

SEQ ID NO: 1923821 - RNA, 18 nt, Human
gcuguaaauuuggcuucu

SEQ ID NO: 1923822 - RNA, 19 nt, Human
gcuguaaauuuggcuucug

SEQ ID NO: 1923823 - RNA, 23 nt, Human
gcuguaucccaugagccucagca

SEQ ID NO: 1923824 - RNA, 20 nt, Human
gcuguaucccaugagccuca

SEQ ID NO: 1923825 - RNA, 21 nt, Human
gcuggguuggaggguguccca

SEQ ID NO: 1923826 - RNA, 14 nt, Human
gcuggguuggaggg

SEQ ID NO: 1923827 - RNA, 15 nt, Human
gcuggguucuaccca

SEQ ID NO: 1923828 - RNA, 15 nt, Human
gcuggguucugaucc

SEQ ID NO: 1923829 - RNA, 19 nt, Human
gcuugaaacccguggcgcu

SEQ ID NO: 1923830 - RNA, 13 nt, Human
gcuucuuugccaa

SEQ ID NO: 1923831 - RNA, 19 nt, Human
gcuugggcuucauccuccu

SEQ ID NO: 1923832 - RNA, 16 nt, Human
gcuuguacauaaugcg

SEQ ID NO: 1923833 - RNA, 14 nt, Human
gcuuguacauaaug

SEQ ID NO: 1923834 - RNA, 16 nt, Human
gcuuggggcuuccuaa

SEQ ID NO: 1923835 - RNA, 14 nt, Human
gcuggagcucugcc

SEQ ID NO: 1923836 - RNA, 19 nt, Human
gcuggacugaggccugagc

SEQ ID NO: 1923837 - RNA, 18 nt, Human
gcuggacugaggccugag

SEQ ID NO: 1923838 - RNA, 17 nt, Human
gcuggacugaggccuga

SEQ ID NO: 1923839 - RNA, 16 nt, Human
gcuggacugaggccug

SEQ ID NO: 1923840 - RNA, 14 nt, Human
gcuggacugaggcc

SEQ ID NO: 1923841 - RNA, 13 nt, Human
gcuggacugaggc

SEQ ID NO: 1923842 - RNA, 12 nt, Human
gcuggagugcag

SEQ ID NO: 1923843 - RNA, 17 nt, Human
gcuggagcucugcccau

SEQ ID NO: 1923844 - RNA, 19 nt, Human
gcugggauuacagguguga

SEQ ID NO: 1923845 - RNA, 20 nt, Human
gcugggcacacgccucccac

SEQ ID NO: 1923846 - RNA, 22 nt, Human
gcugggcacacgccucccacug

SEQ ID NO: 1923847 - RNA, 18 nt, Human
gcugggauuacaggugug

SEQ ID NO: 1923848 - RNA, 17 nt, Human
gcugggauuacagggau

SEQ ID NO: 1923849 - RNA, 13 nt, Human
gcugggcagagga

SEQ ID NO: 1923850 - RNA, 14 nt, Human
gcugggcagaggaa

SEQ ID NO: 1923851 - RNA, 15 nt, Human
gcugggcagaggaaa

SEQ ID NO: 1923852 - RNA, 16 nt, Human
gcugggauuacaggug

SEQ ID NO: 1923853 - RNA, 18 nt, Human
gcuggccuggccccucag

SEQ ID NO: 1923854 - RNA, 19 nt, Human
gcuggccuggccccucagg

SEQ ID NO: 1923855 - RNA, 15 nt, Human
gcuggagugcaguga

SEQ ID NO: 1923856 - RNA, 14 nt, Human
gcuggagugcagug

SEQ ID NO: 1923857 - RNA, 16 nt, Human
gcuggccuggccccuc

SEQ ID NO: 1923858 - RNA, 17 nt, Human
gcuggccuggccccuca

SEQ ID NO: 1923859 - RNA, 19 nt, Human
gcugggucgcccuggacug

SEQ ID NO: 1923860 - RNA, 15 nt, Human
gcuggguguggcgca

SEQ ID NO: 1923861 - RNA, 17 nt, Human
gcugggucgcccuggac

SEQ ID NO: 1923862 - RNA, 18 nt, Human
gcugggucgcccuggacu

SEQ ID NO: 1923863 - RNA, 16 nt, Human
gcugggucgcccugga

SEQ ID NO: 1923864 - RNA, 14 nt, Human
gcugggcagguugg

SEQ ID NO: 1923865 - RNA, 16 nt, Human
gcugggcagaggaaag

SEQ ID NO: 1923866 - RNA, 17 nt, Human
gcugggcagaggaaagc

SEQ ID NO: 1923867 - RNA, 19 nt, Human
gcugggcagaggaaagcaa

SEQ ID NO: 1923868 - RNA, 12 nt, Human
gcugggcucccu

SEQ ID NO: 1923869 - RNA, 16 nt, Human
gcugggcucccuuccc

SEQ ID NO: 1923870 - RNA, 17 nt, Human
gcugggcucccuuccca

SEQ ID NO: 1923871 - RNA, 20 nt, Human
gcugggcucccuucccaccu

SEQ ID NO: 1923872 - RNA, 14 nt, Human
gcugcaccggcugg

SEQ ID NO: 1923873 - RNA, 16 nt, Human
gcugcaccggcuggcc

SEQ ID NO: 1923874 - RNA, 17 nt, Human
gcugcaccggcuggccu

SEQ ID NO: 1923875 - RNA, 18 nt, Human
gcugcaccggcuggccug

SEQ ID NO: 1923876 - RNA, 19 nt, Human
gcugcaccggcuggccugg

SEQ ID NO: 1923877 - RNA, 22 nt, Human
gcugcaccggcuggccuggccc

SEQ ID NO: 1923878 - RNA, 23 nt, Human
gcugccaucucaccuccugcugg

SEQ ID NO: 1923879 - RNA, 22 nt, Human
gcugccaucucaccuccugcug

SEQ ID NO: 1923880 - RNA, 23 nt, Human
gcugccauccagguucagcuugu

SEQ ID NO: 1923881 - RNA, 21 nt, Human
gcugccauccagguucagcuu

SEQ ID NO: 1923882 - RNA, 19 nt, Human
gcugccagccgagauagcc

SEQ ID NO: 1923883 - RNA, 21 nt, Human
gcugccagccgagauagccaa

SEQ ID NO: 1923884 - RNA, 18 nt, Human
gcugagggugagugggug

SEQ ID NO: 1923885 - RNA, 18 nt, Human
gcugaggcuggcacagga

SEQ ID NO: 1923886 - RNA, 15 nt, Human
gcugaggcuggcaca

SEQ ID NO: 1923887 - RNA, 16 nt, Human
gcugaggcuggcacag

SEQ ID NO: 1923888 - RNA, 12 nt, Human
gcugcugcugcu

SEQ ID NO: 1923889 - RNA, 19 nt, Human
gcugccugggaucccucau

SEQ ID NO: 1923890 - RNA, 19 nt, Human
gcugcuccuagagggaggg

SEQ ID NO: 1923891 - RNA, 21 nt, Human
gcugcuccuagagggaggggc

SEQ ID NO: 1923892 - RNA, 23 nt, Human
gcugcuccuagagggaggggccu

SEQ ID NO: 1923893 - RNA, 16 nt, Human
gcugccugggaucccu

SEQ ID NO: 1923894 - RNA, 18 nt, Human
gcugccugggaucccuca

SEQ ID NO: 1923895 - RNA, 13 nt, Human
gcugccugggauc

SEQ ID NO: 1923896 - RNA, 19 nt, Human
gcuuguacauaaugcgugc

SEQ ID NO: 1923897 - RNA, 21 nt, Human
ggaccccgagccuggcuccaa

SEQ ID NO: 1923898 - RNA, 18 nt, Human
ggaccccuggugguucac

SEQ ID NO: 1923899 - RNA, 20 nt, Human
ggaccggguggaagggaugg

SEQ ID NO: 1923900 - RNA, 19 nt, Human
ggacccugaggcccagagg

SEQ ID NO: 1923901 - RNA, 14 nt, Human
ggacccugaggccc

SEQ ID NO: 1923902 - RNA, 15 nt, Human
ggacccugaggccca

SEQ ID NO: 1923903 - RNA, 18 nt, Human
ggacccugaggcccagag

SEQ ID NO: 1923904 - RNA, 15 nt, Human
ggagagcuagcagca

SEQ ID NO: 1923905 - RNA, 13 nt, Human
ggagagccuucca

SEQ ID NO: 1923906 - RNA, 16 nt, Human
ggagagccuuccaggg

SEQ ID NO: 1923907 - RNA, 22 nt, Human
ggagagccuuccagggguggga

SEQ ID NO: 1923908 - RNA, 17 nt, Human
ggagagccuuccagggg

SEQ ID NO: 1923909 - RNA, 18 nt, Human
ggagagccuuccaggggu

SEQ ID NO: 1923910 - RNA, 15 nt, Human
ggacuuuuauuuugg

SEQ ID NO: 1923911 - RNA, 19 nt, Human
ggagaaaauggacguguua

SEQ ID NO: 1923912 - RNA, 17 nt, Human
ggacuuggaagcuccgc

SEQ ID NO: 1923913 - RNA, 16 nt, Human
ggacuuggagguagcu

SEQ ID NO: 1923914 - RNA, 15 nt, Human
ggacuuggaagcucc

SEQ ID NO: 1923915 - RNA, 23 nt, Human
ggacuuccuguccagcuccaacc

SEQ ID NO: 1923916 - RNA, 18 nt, Human
ggagaaaugaaaaaauau

SEQ ID NO: 1923917 - RNA, 20 nt, Human
ggagaaaauucaauuguaaa

SEQ ID NO: 1923918 - RNA, 22 nt, Human
ggagaaccaaaaagaggcuaug

SEQ ID NO: 1923919 - RNA, 22 nt, Human
ggacucaaugcacugacauugu

SEQ ID NO: 1923920 - RNA, 16 nt, Human
ggacuagagcuuucuu

SEQ ID NO: 1923921 - RNA, 20 nt, Human
ggacuauauuugggccugcu

SEQ ID NO: 1923922 - RNA, 20 nt, Human
ggacuacaggugugagucac

SEQ ID NO: 1923923 - RNA, 12 nt, Human
ggaccucaggcc

SEQ ID NO: 1923924 - RNA, 18 nt, Human
ggacuagagggaccucuc

SEQ ID NO: 1923925 - RNA, 19 nt, Human
ggacuagagggaccucucc

SEQ ID NO: 1923926 - RNA, 21 nt, Human
ggacuagagggaccucuccca

SEQ ID NO: 1923927 - RNA, 11 nt, Human
ggacuuccugu

SEQ ID NO: 1923928 - RNA, 18 nt, Human
ggacuuccuguccagcuc

SEQ ID NO: 1923929 - RNA, 19 nt, Human
ggacuuccuguccagcucc

SEQ ID NO: 1923930 - RNA, 20 nt, Human
ggacuuccuguccagcucca

SEQ ID NO: 1923931 - RNA, 21 nt, Human
ggacuuccuguccagcuccaa

SEQ ID NO: 1923932 - RNA, 22 nt, Human
ggacugugugcucaggagcccu

SEQ ID NO: 1923933 - RNA, 23 nt, Human
ggacugugugcucaggagcccug

SEQ ID NO: 1923934 - RNA, 13 nt, Human
ggagcagccacau

SEQ ID NO: 1923935 - RNA, 21 nt, Human
ggagcagccacauuccugaug

SEQ ID NO: 1923936 - RNA, 15 nt, Human
ggagcccacuguacu

SEQ ID NO: 1923937 - RNA, 21 nt, Human
ggagcaggcggugggcaccca

SEQ ID NO: 1923938 - RNA, 19 nt, Human
ggagguugaucagaucuga

SEQ ID NO: 1923939 - RNA, 18 nt, Human
ggaggucgaggcaggagg

SEQ ID NO: 1923940 - RNA, 16 nt, Human
ggaggugucuguauca

SEQ ID NO: 1923941 - RNA, 15 nt, Human
ggaggucgaggcagg

SEQ ID NO: 1923942 - RNA, 16 nt, Human
ggaggucgaggcagga

SEQ ID NO: 1923943 - RNA, 21 nt, Human
ggaggcucuggagcccacugu

SEQ ID NO: 1923944 - RNA, 19 nt, Human
ggaggcccaguucacccug

SEQ ID NO: 1923945 - RNA, 19 nt, Human
ggaggcugagaugggagaa

SEQ ID NO: 1923946 - RNA, 15 nt, Human
ggaggcugagauggg

SEQ ID NO: 1923947 - RNA, 19 nt, Human
ggagcuuccuguccuccca

SEQ ID NO: 1923948 - RNA, 18 nt, Human
ggagcuggccccgccgcc

SEQ ID NO: 1923949 - RNA, 15 nt, Human
ggagcuggccccgcc

SEQ ID NO: 1923950 - RNA, 16 nt, Human
ggagcuggccccgccg

SEQ ID NO: 1923951 - RNA, 18 nt, Human
ggagcugccuuggcucag

SEQ ID NO: 1923952 - RNA, 21 nt, Human
ggagcugccuuggcucagaca

SEQ ID NO: 1923953 - RNA, 18 nt, Human
ggagcugcuauagccugg

SEQ ID NO: 1923954 - RNA, 19 nt, Human
ggagcugcuauagccuggg

SEQ ID NO: 1923955 - RNA, 12 nt, Human
ggagcuggcccc

SEQ ID NO: 1923956 - RNA, 22 nt, Human
ggagcugccuguucagcuccag

SEQ ID NO: 1923957 - RNA, 17 nt, Human
ggagcugccuuggcuca

SEQ ID NO: 1923958 - RNA, 16 nt, Human
ggagcugaguggggga

SEQ ID NO: 1923959 - RNA, 18 nt, Human
ggagcccacuguacuugc

SEQ ID NO: 1923960 - RNA, 22 nt, Human
ggagcccacuguacuugcucuu

SEQ ID NO: 1923961 - RNA, 12 nt, Human
ggagcccacugu

SEQ ID NO: 1923962 - RNA, 16 nt, Human
ggaggccagugagcca

SEQ ID NO: 1923963 - RNA, 17 nt, Human
ggaggccagugagccac

SEQ ID NO: 1923964 - RNA, 13 nt, Human
ggaggcccaguuc

SEQ ID NO: 1923965 - RNA, 17 nt, Human
ggaggcucuggagccca

SEQ ID NO: 1923966 - RNA, 20 nt, Human
ggaggcucuggagcccacug

SEQ ID NO: 1923967 - RNA, 13 nt, Human
ggaggccagccuu

SEQ ID NO: 1923968 - RNA, 18 nt, Human
ggaggccaaggugggagg

SEQ ID NO: 1923969 - RNA, 20 nt, Human
ggaggccaaggugggaggau

SEQ ID NO: 1923970 - RNA, 12 nt, Human
ggaggaagagaa

SEQ ID NO: 1923971 - RNA, 21 nt, Human
ggagcuuuuuuccuuaaucca

SEQ ID NO: 1923972 - RNA, 21 nt, Human
ggaggcaugugaugagaggaa

SEQ ID NO: 1923973 - RNA, 11 nt, Human
ggaggaagccc

SEQ ID NO: 1923974 - RNA, 15 nt, Human
ggccaaagccaaagc

SEQ ID NO: 1923975 - RNA, 12 nt, Human
ggccaaaggaag

SEQ ID NO: 1923976 - RNA, 13 nt, Human
ggccaaaggaagc

SEQ ID NO: 1923977 - RNA, 21 nt, Human
ggccaaaggaagcacaugccu

SEQ ID NO: 1923978 - RNA, 12 nt, Human
ggcauuguggga

SEQ ID NO: 1923979 - RNA, 14 nt, Human
ggcauuucccccac

SEQ ID NO: 1923980 - RNA, 20 nt, Human
ggccagaugcaccagcccuu

SEQ ID NO: 1923981 - RNA, 19 nt, Human
ggccagaugcaccagcccu

SEQ ID NO: 1923982 - RNA, 12 nt, Human
ggccagauccag

SEQ ID NO: 1923983 - RNA, 13 nt, Human
ggccagauccagc

SEQ ID NO: 1923984 - RNA, 16 nt, Human
ggccagauccagccug

SEQ ID NO: 1923985 - RNA, 18 nt, Human
ggccagcaccaucucuuu

SEQ ID NO: 1923986 - RNA, 23 nt, Human
ggccagagggagugacagaggca

SEQ ID NO: 1923987 - RNA, 16 nt, Human
ggccaaggagggugag

SEQ ID NO: 1923988 - RNA, 16 nt, Human
ggccaaggagcugcua

SEQ ID NO: 1923989 - RNA, 23 nt, Human
ggccaacccuucuccucuuguaa

SEQ ID NO: 1923990 - RNA, 14 nt, Human
ggccaaggagcugc

SEQ ID NO: 1923991 - RNA, 15 nt, Human
ggccaaggagcugcu

SEQ ID NO: 1923992 - RNA, 13 nt, Human
ggccaagguggga

SEQ ID NO: 1923993 - RNA, 14 nt, Human
ggccaacaaagaac

SEQ ID NO: 1923994 - RNA, 13 nt, Human
ggccaacauggua

SEQ ID NO: 1923995 - RNA, 16 nt, Human
ggccaacccuucuccu

SEQ ID NO: 1923996 - RNA, 20 nt, Human
ggccaacccuucuccucuug

SEQ ID NO: 1923997 - RNA, 23 nt, Human
ggcccucccuguuccccagagaa

SEQ ID NO: 1923998 - RNA, 13 nt, Human
ggccucccaaagu

SEQ ID NO: 1923999 - RNA, 16 nt, Human
ggccucccaaagugcu

SEQ ID NO: 1924000 - RNA, 14 nt, Human
ggcccuuccuuuuc

SEQ ID NO: 1924001 - RNA, 13 nt, Human
ggccucccaacuc

SEQ ID NO: 1924002 - RNA, 14 nt, Human
ggccucccaacuca

SEQ ID NO: 1924003 - RNA, 11 nt, Human
ggcccaggccu

SEQ ID NO: 1924004 - RNA, 14 nt, Human
ggcccagggcccag

SEQ ID NO: 1924005 - RNA, 19 nt, Human
ggcccucccuguuccccag

SEQ ID NO: 1924006 - RNA, 20 nt, Human
ggcccucccuguuccccaga

SEQ ID NO: 1924007 - RNA, 21 nt, Human
ggcccucccuguuccccagag

SEQ ID NO: 1924008 - RNA, 22 nt, Human
ggcccucccuguuccccagaga

SEQ ID NO: 1924009 - RNA, 16 nt, Human
ggccccaggaccuggc

SEQ ID NO: 1924010 - RNA, 21 nt, Human
ggccccaggaccuggcugcca

SEQ ID NO: 1924011 - RNA, 18 nt, Human
ggccccaggaaaggccca

SEQ ID NO: 1924012 - RNA, 21 nt, Human
ggcccauucuacuugcucugg

SEQ ID NO: 1924013 - RNA, 22 nt, Human
ggcccauucuacuugcucugga

SEQ ID NO: 1924014 - RNA, 23 nt, Human
ggcccauucuacuugcucuggac

SEQ ID NO: 1924015 - RNA, 14 nt, Human
ggcccauucuacuu

SEQ ID NO: 1924016 - RNA, 15 nt, Human
ggcccauucuacuug

SEQ ID NO: 1924017 - RNA, 18 nt, Human
ggcccauucuacuugcuc

SEQ ID NO: 1924018 - RNA, 19 nt, Human
ggcccauucuacuugcucu

SEQ ID NO: 1924019 - RNA, 12 nt, Human
ggcagaaggaag

SEQ ID NO: 1924020 - RNA, 18 nt, Human
ggcaggacgugggcuggg

SEQ ID NO: 1924021 - RNA, 23 nt, Human
ggcaggaccuucgggcugugccc

SEQ ID NO: 1924022 - RNA, 21 nt, Human
ggcaggaccuucgggcugugc

SEQ ID NO: 1924023 - RNA, 14 nt, Human
ggcagccucccauc

SEQ ID NO: 1924024 - RNA, 21 nt, Human
ggcagccucccauccagggcc

SEQ ID NO: 1924025 - RNA, 22 nt, Human
ggcagccucccauccagggccc

SEQ ID NO: 1924026 - RNA, 14 nt, Human
ggcaggacaggaaa

SEQ ID NO: 1924027 - RNA, 10 nt, Human
ggcagagcag

SEQ ID NO: 1924028 - RNA, 15 nt, Human
ggcagccaggccaca

SEQ ID NO: 1924029 - RNA, 17 nt, Human
ggcagccaggccacaag

SEQ ID NO: 1924030 - RNA, 16 nt, Human
ggcaaccacuaagaau

SEQ ID NO: 1924031 - RNA, 19 nt, Human
ggcaaccacuaagaauuca

SEQ ID NO: 1924032 - RNA, 19 nt, Human
ggcaacagaucuggaaccu

SEQ ID NO: 1924033 - RNA, 14 nt, Human
ggcaacagaucugg

SEQ ID NO: 1924034 - RNA, 15 nt, Human
ggcaacagaucugga

SEQ ID NO: 1924035 - RNA, 19 nt, Human
ggcaaaggguccagaagga

SEQ ID NO: 1924036 - RNA, 12 nt, Human
ggcaaauaaaag

SEQ ID NO: 1924037 - RNA, 22 nt, Human
ggcaaagcacgaaauguuauuu

SEQ ID NO: 1924038 - RNA, 18 nt, Human
ggcaaagcuuuuagaaau

SEQ ID NO: 1924039 - RNA, 13 nt, Human
ggcaaacaggcag

SEQ ID NO: 1924040 - RNA, 23 nt, Human
ggcaaacaggcaguuggccagag

SEQ ID NO: 1924041 - RNA, 23 nt, Human
ggauuaaacuuaaucuaaaugga

SEQ ID NO: 1924042 - RNA, 23 nt, Human
ggauguuucugucacaucagcuc

SEQ ID NO: 1924043 - RNA, 14 nt, Human
ggauuaauaugaaa

SEQ ID NO: 1924044 - RNA, 15 nt, Human
ggauuaauaugaaaa

SEQ ID NO: 1924045 - RNA, 16 nt, Human
ggauuaauaugaaaac

SEQ ID NO: 1924046 - RNA, 11 nt, Human
ggcaaaauaau

SEQ ID NO: 1924047 - RNA, 13 nt, Human
ggcaaaauugcaa

SEQ ID NO: 1924048 - RNA, 21 nt, Human
ggauuuugauccaagcugguc

SEQ ID NO: 1924049 - RNA, 13 nt, Human
ggauguucuggga

SEQ ID NO: 1924050 - RNA, 18 nt, Human
ggaugugauuguggaaug

SEQ ID NO: 1924051 - RNA, 22 nt, Human
ggaugagaaagguugaagcacc

SEQ ID NO: 1924052 - RNA, 12 nt, Human
ggaugagaaagg

SEQ ID NO: 1924053 - RNA, 21 nt, Human
ggaugaauuccaaauucugcu

SEQ ID NO: 1924054 - RNA, 21 nt, Human
ggaugacaugcacucagcucu

SEQ ID NO: 1924055 - RNA, 13 nt, Human
aaaaaaaaaccaa

SEQ ID NO: 1924056 - RNA, 13 nt, Human
aaaaaaacacaaa

SEQ ID NO: 1924057 - RNA, 12 nt, Human
aaaaaagaaaug

SEQ ID NO: 1924058 - RNA, 11 nt, Human
aaaaaaaagag

SEQ ID NO: 1924059 - RNA, 11 nt, Human
aaaaaaaaugg

SEQ ID NO: 1924060 - RNA, 19 nt, Human
aaaaagcuuccaugauucu

SEQ ID NO: 1924061 - RNA, 23 nt, Human
gggaaaaucagccugcuccagcu

SEQ ID NO: 1924062 - RNA, 13 nt, Human
gggaaaagcagcu

SEQ ID NO: 1924063 - RNA, 13 nt, Human
gggaaaaucagcc

SEQ ID NO: 1924064 - RNA, 16 nt, Human
ggcuucaguggcagcu

SEQ ID NO: 1924065 - RNA, 23 nt, Human
ggcuguaucccaugagccucagc

SEQ ID NO: 1924066 - RNA, 15 nt, Human
ggcugucaauuacag

SEQ ID NO: 1924067 - RNA, 22 nt, Human
ggcuguaucccaugagccucag

SEQ ID NO: 1924068 - RNA, 20 nt, Human
ggcuguaucccaugagccuc

SEQ ID NO: 1924069 - RNA, 15 nt, Human
ggcuucaguggcagc

SEQ ID NO: 1924070 - RNA, 14 nt, Human
ggcugucaucugug

SEQ ID NO: 1924071 - RNA, 17 nt, Human
ggcugucaucugugcac

SEQ ID NO: 1924072 - RNA, 16 nt, Human
ggcuggugucaccuga

SEQ ID NO: 1924073 - RNA, 16 nt, Human
ggcugguggcccagga

SEQ ID NO: 1924074 - RNA, 19 nt, Human
ggcuguaucccaugagccu

SEQ ID NO: 1924075 - RNA, 13 nt, Human
ggcugguggccca

SEQ ID NO: 1924076 - RNA, 14 nt, Human
ggcugguggcccag

SEQ ID NO: 1924077 - RNA, 13 nt, Human
ggcugggagagcc

SEQ ID NO: 1924078 - RNA, 18 nt, Human
ggcugggacguggcucag

SEQ ID NO: 1924079 - RNA, 19 nt, Human
ggcugggacguggcucagc

SEQ ID NO: 1924080 - RNA, 23 nt, Human
ggcugggacguggcucagccagc

SEQ ID NO: 1924081 - RNA, 24 nt, Human
ggcuggcuccagaugcagggcagu

SEQ ID NO: 1924082 - RNA, 22 nt, Human
ggcuggcuccagaugcagggca

SEQ ID NO: 1924083 - RNA, 23 nt, Human
ggcugccaucucaccuccugcug

SEQ ID NO: 1924084 - RNA, 21 nt, Human
ggcugccaucucaccuccugc

SEQ ID NO: 1924085 - RNA, 22 nt, Human
ggcugccaucucaccuccugcu

SEQ ID NO: 1924086 - RNA, 17 nt, Human
ggcuggaucugugaggg

SEQ ID NO: 1924087 - RNA, 13 nt, Human
ggcuggcacagga

SEQ ID NO: 1924088 - RNA, 14 nt, Human
ggcuggcacaggac

SEQ ID NO: 1924089 - RNA, 15 nt, Human
ggcuggcacaggaca

SEQ ID NO: 1924090 - RNA, 20 nt, Human
ggcuggcgugcaguggugcg

SEQ ID NO: 1924091 - RNA, 16 nt, Human
ggcuggcgugcagugg

SEQ ID NO: 1924092 - RNA, 14 nt, Human
ggcuggcgugcagu

SEQ ID NO: 1924093 - RNA, 17 nt, Human
ggcuggccuggccccuc

SEQ ID NO: 1924094 - RNA, 22 nt, Human
ggcuggccuggccccucagggu

SEQ ID NO: 1924095 - RNA, 17 nt, Human
ggcucccuucccaccuc

SEQ ID NO: 1924096 - RNA, 18 nt, Human
ggcucccuucccaccucu

SEQ ID NO: 1924097 - RNA, 16 nt, Human
ggcucccuucccaccu

SEQ ID NO: 1924098 - RNA, 19 nt, Human
ggcuccugagggagcucca

SEQ ID NO: 1924099 - RNA, 12 nt, Human
ggcuccucucag

SEQ ID NO: 1924100 - RNA, 20 nt, Human
ggcucccuucccaccucucu

SEQ ID NO: 1924101 - RNA, 22 nt, Human
ggcucccuucccaccucucuca

SEQ ID NO: 1924102 - RNA, 21 nt, Human
ggcugcauacccgggcagggc

SEQ ID NO: 1924103 - RNA, 22 nt, Human
ggcugcaugcgggcuuccuccu

SEQ ID NO: 1924104 - RNA, 20 nt, Human
ggcugcaugcgggcuuccuc

SEQ ID NO: 1924105 - RNA, 17 nt, Human
ggcugcagggaguccga

SEQ ID NO: 1924106 - RNA, 18 nt, Human
ggcucgagcaugccugga

SEQ ID NO: 1924107 - RNA, 23 nt, Human
ggcucuuccaggcugggagagcc

SEQ ID NO: 1924108 - RNA, 24 nt, Human
ggcucuuccaggcugggagagccu

SEQ ID NO: 1924109 - RNA, 20 nt, Human
ggcucuuccaggcugggaga

SEQ ID NO: 1924110 - RNA, 12 nt, Human
ggcucuucucau

SEQ ID NO: 1924111 - RNA, 22 nt, Human
ggcucuucucauuucaccccuc

SEQ ID NO: 1924112 - RNA, 20 nt, Human
ggcucuucucauuucacccc

SEQ ID NO: 1924113 - RNA, 13 nt, Human
ggcucuucucauu

SEQ ID NO: 1924114 - RNA, 15 nt, Human
gggcaaacaggcagu

SEQ ID NO: 1924115 - RNA, 14 nt, Human
gggcaaacaggcag

SEQ ID NO: 1924116 - RNA, 23 nt, Human
gggcagagcagagaccaucccug

SEQ ID NO: 1924117 - RNA, 15 nt, Human
gggauuuccaugaug

SEQ ID NO: 1924118 - RNA, 22 nt, Human
gggauuucaccacucaaaggcc

SEQ ID NO: 1924119 - RNA, 14 nt, Human
gggaggggccuagg

SEQ ID NO: 1924120 - RNA, 18 nt, Human
aaaagggaacugaacauu

SEQ ID NO: 1924121 - RNA, 16 nt, Human
aaaagggacugagaaa

SEQ ID NO: 1924122 - RNA, 20 nt, Human
gggcagcagaaggggguggu

SEQ ID NO: 1924123 - RNA, 15 nt, Human
aaaauaccagccagu

SEQ ID NO: 1924124 - RNA, 14 nt, Human
aaaauaccaaggaa

SEQ ID NO: 1924125 - RNA, 14 nt, Human
aaaauaccagccag

SEQ ID NO: 1924126 - RNA, 23 nt, Human
aaaauaaauauugucuuuuugua

SEQ ID NO: 1924127 - RNA, 12 nt, Human
aaaauaaauuau

SEQ ID NO: 1924128 - RNA, 21 nt, Human
aaaauaaauauugucuuuuug

SEQ ID NO: 1924129 - RNA, 13 nt, Human
aaaauaaaguugg

SEQ ID NO: 1924130 - RNA, 15 nt, Human
aaaaguaaauguaca

SEQ ID NO: 1924131 - RNA, 18 nt, Human
aaaauauauaucaaauau

SEQ ID NO: 1924132 - RNA, 18 nt, Human
aaaauaguggugugauuu

SEQ ID NO: 1924133 - RNA, 23 nt, Human
aaaauaguuaagacaugauuucc

SEQ ID NO: 1924134 - RNA, 12 nt, Human
aaaauagccugc

SEQ ID NO: 1924135 - RNA, 13 nt, Human
gggagaccuggac

SEQ ID NO: 1924136 - RNA, 12 nt, Human
gggacugugugu

SEQ ID NO: 1924137 - RNA, 11 nt, Human
gggaggcagag

SEQ ID NO: 1924138 - RNA, 11 nt, Human
gggagggcucc

SEQ ID NO: 1924139 - RNA, 13 nt, Human
gggagggcuccag

SEQ ID NO: 1924140 - RNA, 19 nt, Human
gggaggccaaggugggagg

SEQ ID NO: 1924141 - RNA, 20 nt, Human
gggaggcagagguugcagug

SEQ ID NO: 1924142 - RNA, 22 nt, Human
aaaagcuccauuuuuagugaaa

SEQ ID NO: 1924143 - RNA, 20 nt, Human
aaaagcuacaguuuugugaa

SEQ ID NO: 1924144 - RNA, 14 nt, Human
aaaagcugggcagg

SEQ ID NO: 1924145 - RNA, 18 nt, Human
aaaagcuguauuuugaaa

SEQ ID NO: 1924146 - RNA, 14 nt, Human
aaaagcuuccauga

SEQ ID NO: 1924147 - RNA, 13 nt, Human
aaaagcugcucag

SEQ ID NO: 1924148 - RNA, 16 nt, Human
aaaagccuguuuaaga

SEQ ID NO: 1924149 - RNA, 18 nt, Human
aaaagccuguuuaagaga

SEQ ID NO: 1924150 - RNA, 21 nt, Human
aaaacuuuaugcuaagugaaa

SEQ ID NO: 1924151 - RNA, 22 nt, Human
aaaacuugauguguuaucucuu

SEQ ID NO: 1924152 - RNA, 22 nt, Human
gggaacagacuggaagcacagc

SEQ ID NO: 1924153 - RNA, 17 nt, Human
aaaaaucucaaauuucu

SEQ ID NO: 1924154 - RNA, 20 nt, Human
aaaaaucucaaauuucuaaa

SEQ ID NO: 1924155 - RNA, 19 nt, Human
aaaaaucucaaauuucuaa

SEQ ID NO: 1924156 - RNA, 14 nt, Human
gggaacagacugga

SEQ ID NO: 1924157 - RNA, 12 nt, Human
aaaaaucuguuu

SEQ ID NO: 1924158 - RNA, 19 nt, Human
aaaacugcucauaugaugu

SEQ ID NO: 1924159 - RNA, 20 nt, Human
aaaacugcugacuguuuucu

SEQ ID NO: 1924160 - RNA, 18 nt, Human
aaaacugauuuuuuuuuc

SEQ ID NO: 1924161 - RNA, 22 nt, Human
aaaacugauuuuuuuuuccuuc

SEQ ID NO: 1924162 - RNA, 21 nt, Human
aaaacguggcugcuucaagga

SEQ ID NO: 1924163 - RNA, 21 nt, Human
aaaacuacaaaucaaguauuu

SEQ ID NO: 1924164 - RNA, 14 nt, Human
aaaacguggcugcu

SEQ ID NO: 1924165 - RNA, 16 nt, Human
aaaacguggcugcuuc

SEQ ID NO: 1924166 - RNA, 17 nt, Human
aaaacguggcugcuuca

SEQ ID NO: 1924167 - RNA, 18 nt, Human
aaaacguggcugcuucaa

SEQ ID NO: 1924168 - RNA, 15 nt, Human
aaaaccaauguucuc

SEQ ID NO: 1924169 - RNA, 19 nt, Human
aaaacauuuucacacaaua

SEQ ID NO: 1924170 - RNA, 22 nt, Human
ggggucgacuucgggcuggcca

SEQ ID NO: 1924171 - RNA, 22 nt, Human
ggggcgccgcaaaccacacugg

SEQ ID NO: 1924172 - RNA, 21 nt, Human
ggggcgaucgcggcggagcug

SEQ ID NO: 1924173 - RNA, 20 nt, Human
ggggucuggaguugaucugg

SEQ ID NO: 1924174 - RNA, 21 nt, Human
ggggucuggaguugaucugga

SEQ ID NO: 1924175 - RNA, 18 nt, Human
gggucagaaacaggaccg

SEQ ID NO: 1924176 - RNA, 16 nt, Human
gggucagaaacaggac

SEQ ID NO: 1924177 - RNA, 16 nt, Human
gggucagccagggccu

SEQ ID NO: 1924178 - RNA, 18 nt, Human
gggucagccagggccugc

SEQ ID NO: 1924179 - RNA, 20 nt, Human
ggguaucaggugcugccauc

SEQ ID NO: 1924180 - RNA, 23 nt, Human
ggggucuguguguuuaugugugu

SEQ ID NO: 1924181 - RNA, 23 nt, Human
gggucucacuauguugcccaggc

SEQ ID NO: 1924182 - RNA, 12 nt, Human
gggucucacucu

SEQ ID NO: 1924183 - RNA, 22 nt, Human
gggucucacuauguugcccagg

SEQ ID NO: 1924184 - RNA, 19 nt, Human
aaacauguuucuuuguaau

SEQ ID NO: 1924185 - RNA, 22 nt, Human
aaacauguuucuuuguaaugaa

SEQ ID NO: 1924186 - RNA, 23 nt, Human
aaacauguuucuuuguaaugaaa

SEQ ID NO: 1924187 - RNA, 20 nt, Human
aaacauuuaccaaucauauu

SEQ ID NO: 1924188 - RNA, 21 nt, Human
aaacauuuaccaaucauauua

SEQ ID NO: 1924189 - RNA, 19 nt, Human
aaacgcucucuacucugcu

SEQ ID NO: 1924190 - RNA, 21 nt, Human
aaaccacauuggagauguuua

SEQ ID NO: 1924191 - RNA, 14 nt, Human
aaaccaccagaagc

SEQ ID NO: 1924192 - RNA, 15 nt, Human
aaacgucuuaaauau

SEQ ID NO: 1924193 - RNA, 16 nt, Human
aaacguggcugcuuca

SEQ ID NO: 1924194 - RNA, 17 nt, Human
aaacguggcugcuucaa

SEQ ID NO: 1924195 - RNA, 20 nt, Human
aaacguggcugcuucaagga

SEQ ID NO: 1924196 - RNA, 18 nt, Human
aaacuaaggcccucuuga

SEQ ID NO: 1924197 - RNA, 17 nt, Human
aaacuacaaaaauuaac

SEQ ID NO: 1924198 - RNA, 11 nt, Human
aaacuccugac

SEQ ID NO: 1924199 - RNA, 16 nt, Human
aaacuggauuaaacuu

SEQ ID NO: 1924200 - RNA, 20 nt, Human
aaacuggggccuccagaacu

SEQ ID NO: 1924201 - RNA, 16 nt, Human
aaacugguauuuuauc

SEQ ID NO: 1924202 - RNA, 22 nt, Human
aaacugguauuuuaucuuugau

SEQ ID NO: 1924203 - RNA, 13 nt, Human
aaacuggcuuugg

SEQ ID NO: 1924204 - RNA, 14 nt, Human
aaacuggcuuuggc

SEQ ID NO: 1924205 - RNA, 17 nt, Human
aaacuggggccuccaga

SEQ ID NO: 1924206 - RNA, 18 nt, Human
aaacuggggccuccagaa

SEQ ID NO: 1924207 - RNA, 15 nt, Human
aaacaagaaaguuuc

SEQ ID NO: 1924208 - RNA, 18 nt, Human
aaacaagaaaguuucccc

SEQ ID NO: 1924209 - RNA, 17 nt, Human
aaacaagaaaguuuccc

SEQ ID NO: 1924210 - RNA, 16 nt, Human
aaacaagaaaguuucc

SEQ ID NO: 1924211 - RNA, 18 nt, Human
aaacaagaccacguuucu

SEQ ID NO: 1924212 - RNA, 13 nt, Human
aaacaaagaaauu

SEQ ID NO: 1924213 - RNA, 15 nt, Human
aaacaaaauuucuau

SEQ ID NO: 1924214 - RNA, 14 nt, Human
aaacaaaauuucua

SEQ ID NO: 1924215 - RNA, 13 nt, Human
aaaauugugauca

SEQ ID NO: 1924216 - RNA, 16 nt, Human
aaaauugugauguguc

SEQ ID NO: 1924217 - RNA, 16 nt, Human
aaaauugguuggagaa

SEQ ID NO: 1924218 - RNA, 17 nt, Human
aaaauugguuggagaau

SEQ ID NO: 1924219 - RNA, 15 nt, Human
aaaauuuuuaaucuu

SEQ ID NO: 1924220 - RNA, 16 nt, Human
aaaauuuuuaaucuuu

SEQ ID NO: 1924221 - RNA, 19 nt, Human
aaaauuuuuaaucuuuaau

SEQ ID NO: 1924222 - RNA, 21 nt, Human
aaaauguaggguuauaauaau

SEQ ID NO: 1924223 - RNA, 21 nt, Human
aaaauggacguguuaugacuc

SEQ ID NO: 1924224 - RNA, 12 nt, Human
aaaauggaauac

SEQ ID NO: 1924225 - RNA, 19 nt, Human
gggcuggacugaggccuga

SEQ ID NO: 1924226 - RNA, 15 nt, Human
gggcuggacugaggc

SEQ ID NO: 1924227 - RNA, 14 nt, Human
gggcuggacugagg

SEQ ID NO: 1924228 - RNA, 22 nt, Human
aaacaugcuacacacugcaugu

SEQ ID NO: 1924229 - RNA, 16 nt, Human
aaacaugcuacacacu

SEQ ID NO: 1924230 - RNA, 19 nt, Human
aaacaagucagucauucag

SEQ ID NO: 1924231 - RNA, 14 nt, Human
aaacauaagugcaa

SEQ ID NO: 1924232 - RNA, 13 nt, Human
ggggaccucaggc

SEQ ID NO: 1924233 - RNA, 15 nt, Human
ggggaccucaggccu

SEQ ID NO: 1924234 - RNA, 16 nt, Human
ggggaccucaggccug

SEQ ID NO: 1924235 - RNA, 17 nt, Human
ggggaccucaggccugg

SEQ ID NO: 1924236 - RNA, 22 nt, Human
ggggaaaggcaagguccggccc

SEQ ID NO: 1924237 - RNA, 17 nt, Human
ggggaaaggcaaggucc

SEQ ID NO: 1924238 - RNA, 18 nt, Human
ggggaacucagauccagg

SEQ ID NO: 1924239 - RNA, 21 nt, Human
ggggaacucagauccagggac

SEQ ID NO: 1924240 - RNA, 24 nt, Human
ggggaaaaucagccugcuccagcu

SEQ ID NO: 1924241 - RNA, 13 nt, Human
ggggccaggcugg

SEQ ID NO: 1924242 - RNA, 14 nt, Human
ggggccaggcuggg

SEQ ID NO: 1924243 - RNA, 16 nt, Human
ggggccaggcuggguc

SEQ ID NO: 1924244 - RNA, 17 nt, Human
ggggccaguuggucccc

SEQ ID NO: 1924245 - RNA, 19 nt, Human
ggggccaguuggucccccu

SEQ ID NO: 1924246 - RNA, 16 nt, Human
ggggcccugccuccuu

SEQ ID NO: 1924247 - RNA, 19 nt, Human
ggggcccugccuccuuugu

SEQ ID NO: 1924248 - RNA, 23 nt, Human
ggggcccugccuccuuugugagg

SEQ ID NO: 1924249 - RNA, 20 nt, Human
gguccagaaggagacaggca

SEQ ID NO: 1924250 - RNA, 20 nt, Human
ggucccaaacagcugccucu

SEQ ID NO: 1924251 - RNA, 22 nt, Human
gguccacccaggagccccgagg

SEQ ID NO: 1924252 - RNA, 20 nt, Human
gguccacccaggagccccga

SEQ ID NO: 1924253 - RNA, 12 nt, Human
ggucccacccca

SEQ ID NO: 1924254 - RNA, 14 nt, Human
aaacuuuaccuuuu

SEQ ID NO: 1924255 - RNA, 23 nt, Human
gguauuggcuagagguucaaaga

SEQ ID NO: 1924256 - RNA, 18 nt, Human
gguauucgcuugagaaaa

SEQ ID NO: 1924257 - RNA, 19 nt, Human
gguccacccaggagccccg

SEQ ID NO: 1924258 - RNA, 20 nt, Human
ggucaugcccuccucuccca

SEQ ID NO: 1924259 - RNA, 15 nt, Human
ggucaugcccuccuc

SEQ ID NO: 1924260 - RNA, 16 nt, Human
ggucaugcccuccucu

SEQ ID NO: 1924261 - RNA, 17 nt, Human
ggucaugcccuccucuc

SEQ ID NO: 1924262 - RNA, 19 nt, Human
aaagaugggugaaggcugg

SEQ ID NO: 1924263 - RNA, 14 nt, Human
aaagaugcaaugua

SEQ ID NO: 1924264 - RNA, 22 nt, Human
aaagauuacuuuuucuuuaugu

SEQ ID NO: 1924265 - RNA, 15 nt, Human
aaagaugagugagca

SEQ ID NO: 1924266 - RNA, 13 nt, Human
aaagaggcuaugu

SEQ ID NO: 1924267 - RNA, 18 nt, Human
aaagaggcuaugugagca

SEQ ID NO: 1924268 - RNA, 15 nt, Human
aaagacuguacaaag

SEQ ID NO: 1924269 - RNA, 19 nt, Human
aaagacuuuuccaacccuc

SEQ ID NO: 1924270 - RNA, 17 nt, Human
aaagagaaaaagaaaug

SEQ ID NO: 1924271 - RNA, 21 nt, Human
aaagagaauugggggcuuagg

SEQ ID NO: 1924272 - RNA, 19 nt, Human
aaagcuugcaacaaaauuc

SEQ ID NO: 1924273 - RNA, 17 nt, Human
aaagcuugaguaaaaua

SEQ ID NO: 1924274 - RNA, 19 nt, Human
aaagcuugaguaaaauaaa

SEQ ID NO: 1924275 - RNA, 17 nt, Human
aaagcuuccaugauucu

SEQ ID NO: 1924276 - RNA, 18 nt, Human
aaagcuuccaugauucua

SEQ ID NO: 1924277 - RNA, 20 nt, Human
aaagcuuccaugauucuauu

SEQ ID NO: 1924278 - RNA, 13 nt, Human
aaaggaauuuaaa

SEQ ID NO: 1924279 - RNA, 11 nt, Human
aaaggaaagag

SEQ ID NO: 1924280 - RNA, 17 nt, Human
aaagcagugcaugcugu

SEQ ID NO: 1924281 - RNA, 20 nt, Human
ggugcccagaaugaggcugc

SEQ ID NO: 1924282 - RNA, 13 nt, Human
ggugcccacaggc

SEQ ID NO: 1924283 - RNA, 14 nt, Human
ggugcccacaggcc

SEQ ID NO: 1924284 - RNA, 20 nt, Human
aaagcacacucauccccuca

SEQ ID NO: 1924285 - RNA, 18 nt, Human
aaagcuaggccuggccag

SEQ ID NO: 1924286 - RNA, 13 nt, Human
aaagcuagaaaug

SEQ ID NO: 1924287 - RNA, 17 nt, Human
aaagcuacuuauuguag

SEQ ID NO: 1924288 - RNA, 16 nt, Human
aaagcuacuuauugua

SEQ ID NO: 1924289 - RNA, 21 nt, Human
aaagcagugcaugcugucccu

SEQ ID NO: 1924290 - RNA, 22 nt, Human
aaagcagugcaugcugucccuu

SEQ ID NO: 1924291 - RNA, 19 nt, Human
aaagcggacaucagcuggu

SEQ ID NO: 1924292 - RNA, 22 nt, Human
ggucuugaacuccuggccucaa

SEQ ID NO: 1924293 - RNA, 21 nt, Human
ggucuugaacuccuggccuca

SEQ ID NO: 1924294 - RNA, 19 nt, Human
ggucuguucuuuccaaagu

SEQ ID NO: 1924295 - RNA, 17 nt, Human
ggucuguucuuuccaaa

SEQ ID NO: 1924296 - RNA, 12 nt, Human
ggucuguucuuu

SEQ ID NO: 1924297 - RNA, 24 nt, Human
ggucugugagaugcuagaacuccc

SEQ ID NO: 1924298 - RNA, 14 nt, Human
ggucugugagaugc

SEQ ID NO: 1924299 - RNA, 16 nt, Human
aaagcaaaaagugaug

SEQ ID NO: 1924300 - RNA, 15 nt, Human
ggucuggcagccucc

SEQ ID NO: 1924301 - RNA, 22 nt, Human
ggucuggcagccucccauccag

SEQ ID NO: 1924302 - RNA, 16 nt, Human
ggugcacaagcuccaa

SEQ ID NO: 1924303 - RNA, 22 nt, Human
ggugcacaagcuccaagcuccc

SEQ ID NO: 1924304 - RNA, 21 nt, Human
ggucuugguuccagccugcca

SEQ ID NO: 1924305 - RNA, 20 nt, Human
ggucuugguuccagccugcc

SEQ ID NO: 1924306 - RNA, 18 nt, Human
ggucuuuccuaaggcugc

SEQ ID NO: 1924307 - RNA, 19 nt, Human
ggucuuuccuaaggcugca

SEQ ID NO: 1924308 - RNA, 24 nt, Human
gaccaugcgacacugggaggccag

SEQ ID NO: 1924309 - RNA, 20 nt, Human
gaccaucccugaaggccccg

SEQ ID NO: 1924310 - RNA, 14 nt, Human
gaccucugcagcaa

SEQ ID NO: 1924311 - RNA, 14 nt, Human
gaccucucccaggg

SEQ ID NO: 1924312 - RNA, 12 nt, Human
gaccucucccag

SEQ ID NO: 1924313 - RNA, 11 nt, Human
gaccugaggcc

SEQ ID NO: 1924314 - RNA, 13 nt, Human
gaccugaggcccu

SEQ ID NO: 1924315 - RNA, 14 nt, Human
gaccugaggcccuu

SEQ ID NO: 1924316 - RNA, 16 nt, Human
gacgccaucccagccc

SEQ ID NO: 1924317 - RNA, 19 nt, Human
gacgccaucccagccccaa

SEQ ID NO: 1924318 - RNA, 17 nt, Human
gacgccaucccagcccc

SEQ ID NO: 1924319 - RNA, 18 nt, Human
gacgccaucccagcccca

SEQ ID NO: 1924320 - RNA, 16 nt, Human
gacgcuacccgggaag

SEQ ID NO: 1924321 - RNA, 18 nt, Human
gacgcuacccgggaaggg

SEQ ID NO: 1924322 - RNA, 19 nt, Human
gacgcuacccgggaagggg

SEQ ID NO: 1924323 - RNA, 15 nt, Human
gacgcucucuggccu

SEQ ID NO: 1924324 - RNA, 17 nt, Human
gacgcucucuggccuuc

SEQ ID NO: 1924325 - RNA, 16 nt, Human
gacgcucucuggccuu

SEQ ID NO: 1924326 - RNA, 22 nt, Human
gacuuuaucuaauaccucugug

SEQ ID NO: 1924327 - RNA, 21 nt, Human
gacuuuaucuaauaccucugu

SEQ ID NO: 1924328 - RNA, 15 nt, Human
gacuuucauuggaaa

SEQ ID NO: 1924329 - RNA, 20 nt, Human
gacucugcacaugucuugua

SEQ ID NO: 1924330 - RNA, 19 nt, Human
gacucugucucaaaaaaac

SEQ ID NO: 1924331 - RNA, 22 nt, Human
gacugugugcucaggagcccug

SEQ ID NO: 1924332 - RNA, 21 nt, Human
gacuguguguugccacaggac

SEQ ID NO: 1924333 - RNA, 22 nt, Human
gacuguguguugccacaggaca

SEQ ID NO: 1924334 - RNA, 20 nt, Human
gacuguugucccugcacucu

SEQ ID NO: 1924335 - RNA, 13 nt, Human
gacuguugucccu

SEQ ID NO: 1924336 - RNA, 14 nt, Human
gacuguugucccug

SEQ ID NO: 1924337 - RNA, 16 nt, Human
gacuguugucccugca

SEQ ID NO: 1924338 - RNA, 11 nt, Human
gacuguagaaa

SEQ ID NO: 1924339 - RNA, 20 nt, Human
gacugaauuaugaaacuuuu

SEQ ID NO: 1924340 - RNA, 14 nt, Human
gacugaauuucuuu

SEQ ID NO: 1924341 - RNA, 14 nt, Human
gacugaauuaugaa

SEQ ID NO: 1924342 - RNA, 15 nt, Human
gacagaagcagcucu

SEQ ID NO: 1924343 - RNA, 17 nt, Human
gacagcccgggcucugc

SEQ ID NO: 1924344 - RNA, 21 nt, Human
gacagaaagcagaacagugau

SEQ ID NO: 1924345 - RNA, 13 nt, Human
gacagaacacugu

SEQ ID NO: 1924346 - RNA, 15 nt, Human
gacagaacacugucu

SEQ ID NO: 1924347 - RNA, 14 nt, Human
gacagaacacuguc

SEQ ID NO: 1924348 - RNA, 13 nt, Human
gacacagcucuuc

SEQ ID NO: 1924349 - RNA, 11 nt, Human
gacacagaaaa

SEQ ID NO: 1924350 - RNA, 16 nt, Human
gacacagaaaauguug

SEQ ID NO: 1924351 - RNA, 18 nt, Human
gacacagaaaauguugag

SEQ ID NO: 1924352 - RNA, 16 nt, Human
gacacagcucuucucc

SEQ ID NO: 1924353 - RNA, 14 nt, Human
gacacagcucuucu

SEQ ID NO: 1924354 - RNA, 16 nt, Human
gacacaggaugaagca

SEQ ID NO: 1924355 - RNA, 12 nt, Human
gacacaggcccg

SEQ ID NO: 1924356 - RNA, 23 nt, Human
gacacagcucuucuccaggcugu

SEQ ID NO: 1924357 - RNA, 22 nt, Human
gacacagcucuucuccaggcug

SEQ ID NO: 1924358 - RNA, 17 nt, Human
gacacagcucuucucca

SEQ ID NO: 1924359 - RNA, 19 nt, Human
gacauuguuggccaaagcc

SEQ ID NO: 1924360 - RNA, 18 nt, Human
gacauuuaccuuuuugaa

SEQ ID NO: 1924361 - RNA, 16 nt, Human
gacauuucuuugugcu

SEQ ID NO: 1924362 - RNA, 15 nt, Human
gacauugcggacagc

SEQ ID NO: 1924363 - RNA, 14 nt, Human
gacauugcggacag

SEQ ID NO: 1924364 - RNA, 18 nt, Human
gacauuguuaaaauaaag

SEQ ID NO: 1924365 - RNA, 21 nt, Human
gacagugagacucugucucag

SEQ ID NO: 1924366 - RNA, 18 nt, Human
gacauucaccugccccaa

SEQ ID NO: 1924367 - RNA, 21 nt, Human
gacauucaccugccccaacuc

SEQ ID NO: 1924368 - RNA, 23 nt, Human
gacauucaguauauaaaauaugu

SEQ ID NO: 1924369 - RNA, 16 nt, Human
gacagaagcagcucuu

SEQ ID NO: 1924370 - RNA, 20 nt, Human
gacagcccgggcucugccuc

SEQ ID NO: 1924371 - RNA, 13 nt, Human
gacagaagaaggc

SEQ ID NO: 1924372 - RNA, 16 nt, Human
gacagugaauauucaa

SEQ ID NO: 1924373 - RNA, 18 nt, Human
gacagcccgggcucugcc

SEQ ID NO: 1924374 - RNA, 19 nt, Human
gacagcccgggcucugccu

SEQ ID NO: 1924375 - RNA, 20 nt, Human
gaccauaauguuacauuauu

SEQ ID NO: 1924376 - RNA, 20 nt, Human
gaccagggauuuccaugaug

SEQ ID NO: 1924377 - RNA, 14 nt, Human
gaccagggagccuu

SEQ ID NO: 1924378 - RNA, 15 nt, Human
gaccagggagccuuu

SEQ ID NO: 1924379 - RNA, 22 nt, Human
gaccagggagccuuugguucug

SEQ ID NO: 1924380 - RNA, 12 nt, Human
gaccaucccuga

SEQ ID NO: 1924381 - RNA, 13 nt, Human
gaccaucccugaa

SEQ ID NO: 1924382 - RNA, 18 nt, Human
gaccaucccugaaggccc

SEQ ID NO: 1924383 - RNA, 19 nt, Human
gaccaucccugaaggcccc

SEQ ID NO: 1924384 - RNA, 18 nt, Human
gaccagggauuuccauga

SEQ ID NO: 1924385 - RNA, 13 nt, Human
gaccagcucagga

SEQ ID NO: 1924386 - RNA, 14 nt, Human
gaccagcucaggac

SEQ ID NO: 1924387 - RNA, 22 nt, Human
gaccagcucaggacagaugcca

SEQ ID NO: 1924388 - RNA, 12 nt, Human
gaccagcucagg

SEQ ID NO: 1924389 - RNA, 21 nt, Human
gaagcacaugccucucucagg

SEQ ID NO: 1924390 - RNA, 15 nt, Human
gaagcagaggaagga

SEQ ID NO: 1924391 - RNA, 15 nt, Human
gaagcacaugccucu

SEQ ID NO: 1924392 - RNA, 17 nt, Human
gaagcacaugccucucu

SEQ ID NO: 1924393 - RNA, 20 nt, Human
gaagcacaugccucucucag

SEQ ID NO: 1924394 - RNA, 20 nt, Human
gaagcaaugcuucaucccuu

SEQ ID NO: 1924395 - RNA, 23 nt, Human
gaagcaacccaaauguucaucaa

SEQ ID NO: 1924396 - RNA, 17 nt, Human
gaagcaaacacauuaag

SEQ ID NO: 1924397 - RNA, 22 nt, Human
gaagacaaugacuuacuguaca

SEQ ID NO: 1924398 - RNA, 23 nt, Human
gaagacaaugugaaaagaaaaau

SEQ ID NO: 1924399 - RNA, 16 nt, Human
gaagacaaugacuuac

SEQ ID NO: 1924400 - RNA, 13 nt, Human
gaagcaaacacau

SEQ ID NO: 1924401 - RNA, 15 nt, Human
gaagcaaacacauua

SEQ ID NO: 1924402 - RNA, 12 nt, Human
gaacuggcugca

SEQ ID NO: 1924403 - RNA, 11 nt, Human
gaacuggcugc

SEQ ID NO: 1924404 - RNA, 18 nt, Human
gaacuggagccaugggca

SEQ ID NO: 1924405 - RNA, 17 nt, Human
gaacuggagccaugggc

SEQ ID NO: 1924406 - RNA, 20 nt, Human
gaacugcugggcuuggcagc

SEQ ID NO: 1924407 - RNA, 17 nt, Human
gaacugcugggcuuggc

SEQ ID NO: 1924408 - RNA, 21 nt, Human
gaacugccuuuggcagaguuc

SEQ ID NO: 1924409 - RNA, 12 nt, Human
gaacugaacuca

SEQ ID NO: 1924410 - RNA, 23 nt, Human
gaacugaacaccauugaaggcuu

SEQ ID NO: 1924411 - RNA, 22 nt, Human
gaacugaacaccauugaaggcu

SEQ ID NO: 1924412 - RNA, 21 nt, Human
gaacugaacaccauugaaggc

SEQ ID NO: 1924413 - RNA, 12 nt, Human
gaacugaacacc

SEQ ID NO: 1924414 - RNA, 19 nt, Human
gaauauuuauuaccucuga

SEQ ID NO: 1924415 - RNA, 21 nt, Human
gaauauuuauuaccucugaua

SEQ ID NO: 1924416 - RNA, 13 nt, Human
gaauauuuauuac

SEQ ID NO: 1924417 - RNA, 15 nt, Human
gaauauuuauuaccu

SEQ ID NO: 1924418 - RNA, 17 nt, Human
gaauauuuauuaccucu

SEQ ID NO: 1924419 - RNA, 18 nt, Human
gaauauuuauuaccucug

SEQ ID NO: 1924420 - RNA, 19 nt, Human
gaauauugcugauggugca

SEQ ID NO: 1924421 - RNA, 20 nt, Human
gaauauugcugauggugcaa

SEQ ID NO: 1924422 - RNA, 10 nt, Human
gaauauuuau

SEQ ID NO: 1924423 - RNA, 12 nt, Human
gaauauuuauua

SEQ ID NO: 1924424 - RNA, 14 nt, Human
gaauauugcugaug

SEQ ID NO: 1924425 - RNA, 15 nt, Human
gaauauugcugaugg

SEQ ID NO: 1924426 - RNA, 20 nt, Human
gaauauaauauauuugugua

SEQ ID NO: 1924427 - RNA, 16 nt, Human
gaauauaauacuguau

SEQ ID NO: 1924428 - RNA, 19 nt, Human
gaauauaauauauuugugu

SEQ ID NO: 1924429 - RNA, 14 nt, Human
gaauauaaacacua

SEQ ID NO: 1924430 - RNA, 23 nt, Human
gaauagucuagauggcuccucuc

SEQ ID NO: 1924431 - RNA, 21 nt, Human
gaauauaaacacuauauggca

SEQ ID NO: 1924432 - RNA, 22 nt, Human
gaaggggagauaaggguaucug

SEQ ID NO: 1924433 - RNA, 21 nt, Human
gaaggggacccccgcccccug

SEQ ID NO: 1924434 - RNA, 18 nt, Human
gaaggggacccccgcccc

SEQ ID NO: 1924435 - RNA, 20 nt, Human
gaaggggacccccgcccccu

SEQ ID NO: 1924436 - RNA, 24 nt, Human
gaagugugggucugugugugugua

SEQ ID NO: 1924437 - RNA, 21 nt, Human
gaagugugggucugugugugu

SEQ ID NO: 1924438 - RNA, 13 nt, Human
gaauauaaacacu

SEQ ID NO: 1924439 - RNA, 23 nt, Human
gaauaguugaaccuauuucucuu

SEQ ID NO: 1924440 - RNA, 17 nt, Human
gaaguugcagugagcug

SEQ ID NO: 1924441 - RNA, 13 nt, Human
gaaguuaugggaa

SEQ ID NO: 1924442 - RNA, 14 nt, Human
gaaggcuggcauga

SEQ ID NO: 1924443 - RNA, 18 nt, Human
gaaggcuggcaugaucca

SEQ ID NO: 1924444 - RNA, 18 nt, Human
gaaggccucgcaggaaga

SEQ ID NO: 1924445 - RNA, 15 nt, Human
gaaggcuggguucug

SEQ ID NO: 1924446 - RNA, 19 nt, Human
gaaggcuggguucugaucc

SEQ ID NO: 1924447 - RNA, 21 nt, Human
gaaggcucgagcaugccugga

SEQ ID NO: 1924448 - RNA, 14 nt, Human
gaaggccucgcagg

SEQ ID NO: 1924449 - RNA, 15 nt, Human
gaaggccucgcagga

SEQ ID NO: 1924450 - RNA, 18 nt, Human
gaaggccccgcccaggcu

SEQ ID NO: 1924451 - RNA, 19 nt, Human
gaaggccccgcccaggcuu

SEQ ID NO: 1924452 - RNA, 20 nt, Human
gaaggcuggguucugauccu

SEQ ID NO: 1924453 - RNA, 22 nt, Human
gaaggcuggguucugauccuag

SEQ ID NO: 1924454 - RNA, 14 nt, Human
gaagggccagagcc

SEQ ID NO: 1924455 - RNA, 15 nt, Human
gaagggccagagcca

SEQ ID NO: 1924456 - RNA, 16 nt, Human
gaagggccagagccag

SEQ ID NO: 1924457 - RNA, 17 nt, Human
gaagggccagagccagg

SEQ ID NO: 1924458 - RNA, 18 nt, Human
gaagggccagagccaggg

SEQ ID NO: 1924459 - RNA, 21 nt, Human
gaagggcuuggacucaagcaa

SEQ ID NO: 1924460 - RNA, 16 nt, Human
gaaggggacccccgcc

SEQ ID NO: 1924461 - RNA, 19 nt, Human
gaagcucucgggcuaggaa

SEQ ID NO: 1924462 - RNA, 20 nt, Human
gaagcuccucuccccagccc

SEQ ID NO: 1924463 - RNA, 21 nt, Human
gaagcuccucuccccagccca

SEQ ID NO: 1924464 - RNA, 22 nt, Human
gaagcuccucuccccagcccag

SEQ ID NO: 1924465 - RNA, 23 nt, Human
gaagcuccucuccccagcccaga

SEQ ID NO: 1924466 - RNA, 22 nt, Human
gaagcuccgcuuucuacccagc

SEQ ID NO: 1924467 - RNA, 17 nt, Human
gaagcuccucuccccag

SEQ ID NO: 1924468 - RNA, 19 nt, Human
gaagcuccucuccccagcc

SEQ ID NO: 1924469 - RNA, 17 nt, Human
gaaggccccgcccaggc

SEQ ID NO: 1924470 - RNA, 22 nt, Human
gaagcugaggcaggugaauugu

SEQ ID NO: 1924471 - RNA, 18 nt, Human
gaagcucuugaagacacu

SEQ ID NO: 1924472 - RNA, 19 nt, Human
gaagcuccgcuuucuaccc

SEQ ID NO: 1924473 - RNA, 19 nt, Human
gaagcuauaaauuccucuu

SEQ ID NO: 1924474 - RNA, 20 nt, Human
gaagcuaucguaaaauuaag

SEQ ID NO: 1924475 - RNA, 20 nt, Human
gagccuuccaggggugggac

SEQ ID NO: 1924476 - RNA, 18 nt, Human
gagcugccuuggcucaga

SEQ ID NO: 1924477 - RNA, 13 nt, Human
gagccuugaacuu

SEQ ID NO: 1924478 - RNA, 23 nt, Human
gagccuuccaggggugggacacc

SEQ ID NO: 1924479 - RNA, 21 nt, Human
gagcugccuuggcucagacau

SEQ ID NO: 1924480 - RNA, 22 nt, Human
gagcugccuuggcucagacaug

SEQ ID NO: 1924481 - RNA, 18 nt, Human
gagcugcuauagccuggg

SEQ ID NO: 1924482 - RNA, 20 nt, Human
gagcugcuauagccuggggu

SEQ ID NO: 1924483 - RNA, 21 nt, Human
gagcugcuauagccuggggug

SEQ ID NO: 1924484 - RNA, 14 nt, Human
gaggcagggucuca

SEQ ID NO: 1924485 - RNA, 15 nt, Human
gaggacgcucucugg

SEQ ID NO: 1924486 - RNA, 22 nt, Human
gaggacgagcgauugaggugua

SEQ ID NO: 1924487 - RNA, 15 nt, Human
gaggcagggucucac

SEQ ID NO: 1924488 - RNA, 12 nt, Human
gaggcagguccc

SEQ ID NO: 1924489 - RNA, 16 nt, Human
gaggcagguccccaga

SEQ ID NO: 1924490 - RNA, 13 nt, Human
gaggcaggucccc

SEQ ID NO: 1924491 - RNA, 17 nt, Human
gaggccaaggugggagg

SEQ ID NO: 1924492 - RNA, 22 nt, Human
gaggccaaggugggaggauugc

SEQ ID NO: 1924493 - RNA, 14 nt, Human
gaggcauaaagacu

SEQ ID NO: 1924494 - RNA, 18 nt, Human
gaggccacacucagcaca

SEQ ID NO: 1924495 - RNA, 21 nt, Human
gaggccacacucagcacaagg

SEQ ID NO: 1924496 - RNA, 13 nt, Human
gaggccagagaca

SEQ ID NO: 1924497 - RNA, 14 nt, Human
gaggccagagacac

SEQ ID NO: 1924498 - RNA, 19 nt, Human
gaggccagagacacaagcc

SEQ ID NO: 1924499 - RNA, 22 nt, Human
gaggcuagugugguguuuccug

SEQ ID NO: 1924500 - RNA, 23 nt, Human
gaggcuccacuuggucugugaga

SEQ ID NO: 1924501 - RNA, 12 nt, Human
gaggcuccacuu

SEQ ID NO: 1924502 - RNA, 12 nt, Human
gaggcucagguc

SEQ ID NO: 1924503 - RNA, 18 nt, Human
gaggcuacuguaaggcaa

SEQ ID NO: 1924504 - RNA, 10 nt, Human
gaggcucagg

SEQ ID NO: 1924505 - RNA, 18 nt, Human
gaggcuccacuuggucug

SEQ ID NO: 1924506 - RNA, 19 nt, Human
gaggcuccacuuggucugu

SEQ ID NO: 1924507 - RNA, 12 nt, Human
gaggggccucuu

SEQ ID NO: 1924508 - RNA, 17 nt, Human
gaggggccuaggccuca

SEQ ID NO: 1924509 - RNA, 19 nt, Human
gaggggccuaggccucagc

SEQ ID NO: 1924510 - RNA, 22 nt, Human
gaggggccuaggccucagccag

SEQ ID NO: 1924511 - RNA, 23 nt, Human
gaggggccuaggccucagccaga

SEQ ID NO: 1924512 - RNA, 20 nt, Human
gaggcugaggcuggcacagg

SEQ ID NO: 1924513 - RNA, 19 nt, Human
gaggcugcagccaggccac

SEQ ID NO: 1924514 - RNA, 18 nt, Human
gaggcugcagccaggcca

SEQ ID NO: 1924515 - RNA, 15 nt, Human
gaggcugaggcuggc

SEQ ID NO: 1924516 - RNA, 16 nt, Human
gaggcugaggcuggca

SEQ ID NO: 1924517 - RNA, 19 nt, Human
gaggcugaggcuggcacag

SEQ ID NO: 1924518 - RNA, 23 nt, Human
gaggugaacaagcaaacccagac

SEQ ID NO: 1924519 - RNA, 23 nt, Human
gaggugaccccagguuucuaugu

SEQ ID NO: 1924520 - RNA, 15 nt, Human
gaggucgaggcagga

SEQ ID NO: 1924521 - RNA, 20 nt, Human
gagugacagaggcagcccca

SEQ ID NO: 1924522 - RNA, 19 nt, Human
gagugcaaugacacagucu

SEQ ID NO: 1924523 - RNA, 21 nt, Human
gagugcaagccccugcuccag

SEQ ID NO: 1924524 - RNA, 23 nt, Human
gagugcagccguuugagaagaaa

SEQ ID NO: 1924525 - RNA, 16 nt, Human
gagugcagccguuuga

SEQ ID NO: 1924526 - RNA, 15 nt, Human
gaguugauucagcuc

SEQ ID NO: 1924527 - RNA, 17 nt, Human
gaguugaucuggaaccc

SEQ ID NO: 1924528 - RNA, 19 nt, Human
gaguugaucuggaacccag

SEQ ID NO: 1924529 - RNA, 20 nt, Human
gaguugaucuggaacccaga

SEQ ID NO: 1924530 - RNA, 21 nt, Human
gaguugaucuggaacccagac

SEQ ID NO: 1924531 - RNA, 16 nt, Human
gaguugauucagcucu

SEQ ID NO: 1924532 - RNA, 17 nt, Human
gaguugauucagcucug

SEQ ID NO: 1924533 - RNA, 14 nt, Human
gaguugaucuggaa

SEQ ID NO: 1924534 - RNA, 16 nt, Human
gaguugaucuggaacc

SEQ ID NO: 1924535 - RNA, 18 nt, Human
gagugacagaggcagccc

SEQ ID NO: 1924536 - RNA, 12 nt, Human
gagucccaccuu

SEQ ID NO: 1924537 - RNA, 22 nt, Human
gagucagaaguuucugccgcag

SEQ ID NO: 1924538 - RNA, 18 nt, Human
gagucagggagagcugaa

SEQ ID NO: 1924539 - RNA, 16 nt, Human
gagucaccaagcccag

SEQ ID NO: 1924540 - RNA, 17 nt, Human
gagucaccaagcccagu

SEQ ID NO: 1924541 - RNA, 20 nt, Human
gagguggaagagggcugcaa

SEQ ID NO: 1924542 - RNA, 17 nt, Human
gagguggaagagggcug

SEQ ID NO: 1924543 - RNA, 16 nt, Human
gaguuuaaauuguaau

SEQ ID NO: 1924544 - RNA, 18 nt, Human
gaguugauucagcucugc

SEQ ID NO: 1924545 - RNA, 22 nt, Human
gaguuguuacauuuuuaagugc

SEQ ID NO: 1924546 - RNA, 13 nt, Human
gaguuggcuggga

SEQ ID NO: 1924547 - RNA, 17 nt, Human
gauucuccugccucagc

SEQ ID NO: 1924548 - RNA, 15 nt, Human
gauucuccugccuca

SEQ ID NO: 1924549 - RNA, 18 nt, Human
gauucuccugccucagcc

SEQ ID NO: 1924550 - RNA, 15 nt, Human
gauucugcaguaaau

SEQ ID NO: 1924551 - RNA, 16 nt, Human
gauucugcaguaaauc

SEQ ID NO: 1924552 - RNA, 17 nt, Human
gauucuuccucccuccc

SEQ ID NO: 1924553 - RNA, 18 nt, Human
gauucuuccucccucccu

SEQ ID NO: 1924554 - RNA, 18 nt, Human
gauucugcaguaaaucuu

SEQ ID NO: 1924555 - RNA, 19 nt, Human
gauucugcaguaaaucuuu

SEQ ID NO: 1924556 - RNA, 21 nt, Human
gauucugcaguaaaucuuuua

SEQ ID NO: 1924557 - RNA, 19 nt, Human
gauucuucccauucuccau

SEQ ID NO: 1924558 - RNA, 20 nt, Human
gauuuaggagaagccaggaa

SEQ ID NO: 1924559 - RNA, 16 nt, Human
gauuuagauaugcaaa

SEQ ID NO: 1924560 - RNA, 12 nt, Human
gauuauuggaaa

SEQ ID NO: 1924561 - RNA, 14 nt, Human
gauuauauuaugaa

SEQ ID NO: 1924562 - RNA, 14 nt, Human
gauuauggagcuuu

SEQ ID NO: 1924563 - RNA, 16 nt, Human
gaugagugagcaugcc

SEQ ID NO: 1924564 - RNA, 15 nt, Human
gaugaucuaggaaga

SEQ ID NO: 1924565 - RNA, 21 nt, Human
gaugaucuaggaagacuuugg

SEQ ID NO: 1924566 - RNA, 18 nt, Human
gauguaaaagacuuuuuu

SEQ ID NO: 1924567 - RNA, 18 nt, Human
gauguagaggagaaacug

SEQ ID NO: 1924568 - RNA, 17 nt, Human
gauguagaggagaaacu

SEQ ID NO: 1924569 - RNA, 18 nt, Human
gaugauacauccaaagca

SEQ ID NO: 1924570 - RNA, 12 nt, Human
gaugcugccccu

SEQ ID NO: 1924571 - RNA, 13 nt, Human
gaugcugccccuc

SEQ ID NO: 1924572 - RNA, 12 nt, Human
gauggacagacu

SEQ ID NO: 1924573 - RNA, 14 nt, Human
gcaccgggccacag

SEQ ID NO: 1924574 - RNA, 23 nt, Human
gcacaucagcacgauuucuguuu

SEQ ID NO: 1924575 - RNA, 22 nt, Human
gcacaucagcacgauuucuguu

SEQ ID NO: 1924576 - RNA, 23 nt, Human
gcaccgggccacagagaaaguac

SEQ ID NO: 1924577 - RNA, 13 nt, Human
gcacaucucugcu

SEQ ID NO: 1924578 - RNA, 17 nt, Human
gcacucagaagacacug

SEQ ID NO: 1924579 - RNA, 17 nt, Human
gcacuccccugcugggu

SEQ ID NO: 1924580 - RNA, 16 nt, Human
gcacucagaagacacu

SEQ ID NO: 1924581 - RNA, 13 nt, Human
gcacucagaagac

SEQ ID NO: 1924582 - RNA, 22 nt, Human
gcacuccccugcuggguguggc

SEQ ID NO: 1924583 - RNA, 16 nt, Human
gcacuccccugcuggg

SEQ ID NO: 1924584 - RNA, 19 nt, Human
gauuuuuugcauuccugac

SEQ ID NO: 1924585 - RNA, 18 nt, Human
gcaagucagaauagaaau

SEQ ID NO: 1924586 - RNA, 13 nt, Human
gcaagucaggguu

SEQ ID NO: 1924587 - RNA, 14 nt, Human
gcacaccgggcacu

SEQ ID NO: 1924588 - RNA, 15 nt, Human
gcacacccagguuug

SEQ ID NO: 1924589 - RNA, 14 nt, Human
gcacacauuuuuua

SEQ ID NO: 1924590 - RNA, 22 nt, Human
gcacaagcugcacccucaggca

SEQ ID NO: 1924591 - RNA, 20 nt, Human
cuucuucagagacuccugca

SEQ ID NO: 1924592 - RNA, 21 nt, Human
cuucuucagagacuccugcag

SEQ ID NO: 1924593 - RNA, 22 nt, Human
cuucuucagagacuccugcagg

SEQ ID NO: 1924594 - RNA, 20 nt, Human
cuugaaugaugccaugagga

SEQ ID NO: 1924595 - RNA, 12 nt, Human
cuugacagggca

SEQ ID NO: 1924596 - RNA, 20 nt, Human
cuugccgucuaccugagggg

SEQ ID NO: 1924597 - RNA, 23 nt, Human
cuugccgucuaccugaggggccu

SEQ ID NO: 1924598 - RNA, 23 nt, Human
cuugaaugaugccaugaggaaca

SEQ ID NO: 1924599 - RNA, 14 nt, Human
cuugacaacaucug

SEQ ID NO: 1924600 - RNA, 17 nt, Human
cuugacagaacacuguc

SEQ ID NO: 1924601 - RNA, 16 nt, Human
cuugacagaacacugu

SEQ ID NO: 1924602 - RNA, 14 nt, Human
cuugacagaacacu

SEQ ID NO: 1924603 - RNA, 12 nt, Human
cuugcucugcug

SEQ ID NO: 1924604 - RNA, 23 nt, Human
cuugccucuguccccuucucuca

SEQ ID NO: 1924605 - RNA, 19 nt, Human
cuugccucuguccccuucu

SEQ ID NO: 1924606 - RNA, 15 nt, Human
cuuuucaaaacauuu

SEQ ID NO: 1924607 - RNA, 20 nt, Human
cuuuuagggagcuggucuga

SEQ ID NO: 1924608 - RNA, 15 nt, Human
cuuuggugaacauug

SEQ ID NO: 1924609 - RNA, 20 nt, Human
cuuuggucuacacugugcug

SEQ ID NO: 1924610 - RNA, 16 nt, Human
cuuuggucuacacugu

SEQ ID NO: 1924611 - RNA, 21 nt, Human
cuuuggggcuuuuacaccagu

SEQ ID NO: 1924612 - RNA, 20 nt, Human
cuuuggggcuuuuacaccag

SEQ ID NO: 1924613 - RNA, 16 nt, Human
cuuuuaggccaaaaaa

SEQ ID NO: 1924614 - RNA, 16 nt, Human
cuuuuagcaguaaaau

SEQ ID NO: 1924615 - RNA, 15 nt, Human
cuuuuagaaauacug

SEQ ID NO: 1924616 - RNA, 19 nt, Human
cuuuuagaaauacugcaag

SEQ ID NO: 1924617 - RNA, 21 nt, Human
cuuuuagaaauacugcaagaa

SEQ ID NO: 1924618 - RNA, 23 nt, Human
cuuuuagaaauacugcaagaaaa

SEQ ID NO: 1924619 - RNA, 18 nt, Human
cuuuuaggccaaaaaaau

SEQ ID NO: 1924620 - RNA, 15 nt, Human
cuuuuauaaacuuua

SEQ ID NO: 1924621 - RNA, 18 nt, Human
cuuuuauaaacuuuaccu

SEQ ID NO: 1924622 - RNA, 16 nt, Human
cuuuuauaaacuuuac

SEQ ID NO: 1924623 - RNA, 17 nt, Human
cuuuuauuucuuaaaca

SEQ ID NO: 1924624 - RNA, 23 nt, Human
cuuucuagcuguugagcuguuuu

SEQ ID NO: 1924625 - RNA, 24 nt, Human
cuuucuccccugcccccaggacug

SEQ ID NO: 1924626 - RNA, 23 nt, Human
cuuucuccccugcccccaggacu

SEQ ID NO: 1924627 - RNA, 22 nt, Human
cuuucuccccugcccccaggac

SEQ ID NO: 1924628 - RNA, 23 nt, Human
cuuucuccuuuguacuuugugcu

SEQ ID NO: 1924629 - RNA, 19 nt, Human
cuuucuccccugcccccag

SEQ ID NO: 1924630 - RNA, 18 nt, Human
cuuucuccccugccccca

SEQ ID NO: 1924631 - RNA, 14 nt, Human
cuuucuccccugcc

SEQ ID NO: 1924632 - RNA, 14 nt, Human
cuuugagguggaag

SEQ ID NO: 1924633 - RNA, 17 nt, Human
cuuugagguggaagagg

SEQ ID NO: 1924634 - RNA, 16 nt, Human
cuuugagguggaagag

SEQ ID NO: 1924635 - RNA, 18 nt, Human
cuuugacgccaucccagc

SEQ ID NO: 1924636 - RNA, 19 nt, Human
cuuugacgccaucccagcc

SEQ ID NO: 1924637 - RNA, 21 nt, Human
cuuugacgccaucccagcccc

SEQ ID NO: 1924638 - RNA, 22 nt, Human
cuuugacgccaucccagcccca

SEQ ID NO: 1924639 - RNA, 15 nt, Human
cuuugauucuccuuc

SEQ ID NO: 1924640 - RNA, 14 nt, Human
cuuugauucuccuu

SEQ ID NO: 1924641 - RNA, 13 nt, Human
cuuugauucuccu

SEQ ID NO: 1924642 - RNA, 21 nt, Human
cuuugauucauaguaacuucu

SEQ ID NO: 1924643 - RNA, 12 nt, Human
cuuugauucaua

SEQ ID NO: 1924644 - RNA, 19 nt, Human
cuuugauucauaguaacuu

SEQ ID NO: 1924645 - RNA, 22 nt, Human
cuuugagguggaagagggcugc

SEQ ID NO: 1924646 - RNA, 17 nt, Human
cuuugagguugcuuugu

SEQ ID NO: 1924647 - RNA, 15 nt, Human
cuuugagguugcuuu

SEQ ID NO: 1924648 - RNA, 22 nt, Human
cuugugacuagugcugaagcuu

SEQ ID NO: 1924649 - RNA, 15 nt, Human
cuugugauuauuuau

SEQ ID NO: 1924650 - RNA, 17 nt, Human
cuugugauuauuuauua

SEQ ID NO: 1924651 - RNA, 13 nt, Human
cuuguggacacag

SEQ ID NO: 1924652 - RNA, 15 nt, Human
cuuguggacacagcu

SEQ ID NO: 1924653 - RNA, 14 nt, Human
cuuguggacacagc

SEQ ID NO: 1924654 - RNA, 14 nt, Human
cuuuaaaugcugcu

SEQ ID NO: 1924655 - RNA, 15 nt, Human
cuuuaaaugcugcuu

SEQ ID NO: 1924656 - RNA, 16 nt, Human
cuuguggacacagcuc

SEQ ID NO: 1924657 - RNA, 20 nt, Human
cuuucaauaggaaaaacuga

SEQ ID NO: 1924658 - RNA, 21 nt, Human
cuuucaauaggaaaaacugau

SEQ ID NO: 1924659 - RNA, 22 nt, Human
cuuucaauaggaaaaacugauu

SEQ ID NO: 1924660 - RNA, 22 nt, Human
cuuuacaagauggguccaggau

SEQ ID NO: 1924661 - RNA, 12 nt, Human
cuuuaauauaaa

SEQ ID NO: 1924662 - RNA, 19 nt, Human
cuuaccucggugccuuccu

SEQ ID NO: 1924663 - RNA, 21 nt, Human
cuuaccucggugccuuccucu

SEQ ID NO: 1924664 - RNA, 13 nt, Human
cuuaccugccagg

SEQ ID NO: 1924665 - RNA, 20 nt, Human
cuuagauguuccaguaaucu

SEQ ID NO: 1924666 - RNA, 13 nt, Human
cuuaccucggugc

SEQ ID NO: 1924667 - RNA, 19 nt, Human
cuuacccucauguucuuaa

SEQ ID NO: 1924668 - RNA, 18 nt, Human
cuuacccucauguucuua

SEQ ID NO: 1924669 - RNA, 17 nt, Human
cuuacccucauguucuu

SEQ ID NO: 1924670 - RNA, 21 nt, Human
cuuaaagaguguggcaaaaua

SEQ ID NO: 1924671 - RNA, 15 nt, Human
cuuaaagaguguggc

SEQ ID NO: 1924672 - RNA, 14 nt, Human
cuuaaacaaaugua

SEQ ID NO: 1924673 - RNA, 13 nt, Human
cuuacacaauggu

SEQ ID NO: 1924674 - RNA, 11 nt, Human
cuuacacccac

SEQ ID NO: 1924675 - RNA, 20 nt, Human
cuuacacccacaguggaaag

SEQ ID NO: 1924676 - RNA, 11 nt, Human
cuuaaaaugau

SEQ ID NO: 1924677 - RNA, 16 nt, Human
cuguugggccaggagc

SEQ ID NO: 1924678 - RNA, 17 nt, Human
cuguugggccaggagcc

SEQ ID NO: 1924679 - RNA, 20 nt, Human
cuguugggccaggagccucc

SEQ ID NO: 1924680 - RNA, 14 nt, Human
cuguucagcuccag

SEQ ID NO: 1924681 - RNA, 16 nt, Human
cugugucuguguuuua

SEQ ID NO: 1924682 - RNA, 13 nt, Human
cuguucagcucca

SEQ ID NO: 1924683 - RNA, 19 nt, Human
cugugucuugcaauggcag

SEQ ID NO: 1924684 - RNA, 16 nt, Human
cugugucuugcaaugg

SEQ ID NO: 1924685 - RNA, 20 nt, Human
cugugucuugcaauggcagc

SEQ ID NO: 1924686 - RNA, 19 nt, Human
cugugucugaguggcuuca

SEQ ID NO: 1924687 - RNA, 13 nt, Human
cugugucuguguu

SEQ ID NO: 1924688 - RNA, 18 nt, Human
cugugacuuaagaagccu

SEQ ID NO: 1924689 - RNA, 18 nt, Human
cugugaccuugagaagau

SEQ ID NO: 1924690 - RNA, 14 nt, Human
cugugucuugcaau

SEQ ID NO: 1924691 - RNA, 15 nt, Human
cugugucugaguggc

SEQ ID NO: 1924692 - RNA, 18 nt, Human
cugugucugaguggcuuc

SEQ ID NO: 1924693 - RNA, 14 nt, Human
cugugucucccuuc

SEQ ID NO: 1924694 - RNA, 19 nt, Human
cugugucucccuucauccu

SEQ ID NO: 1924695 - RNA, 19 nt, Human
cugugucagguggggcagc

SEQ ID NO: 1924696 - RNA, 20 nt, Human
cugugucagcauagaaguaa

SEQ ID NO: 1924697 - RNA, 21 nt, Human
cugugucagguggggcagcuu

SEQ ID NO: 1924698 - RNA, 11 nt, Human
cugugcugccc

SEQ ID NO: 1924699 - RNA, 20 nt, Human
cugugcugagucugaaggcu

SEQ ID NO: 1924700 - RNA, 22 nt, Human
cugugcugagucugaaggcugg

SEQ ID NO: 1924701 - RNA, 21 nt, Human
cuuagcagggaaacagcuaau

SEQ ID NO: 1924702 - RNA, 18 nt, Human
cuuagcagggaaacagcu

SEQ ID NO: 1924703 - RNA, 14 nt, Human
cuuauggaauugau

SEQ ID NO: 1924704 - RNA, 14 nt, Human
cuuaugggcugggu

SEQ ID NO: 1924705 - RNA, 21 nt, Human
cuuaugggcuggguucuaccc

SEQ ID NO: 1924706 - RNA, 16 nt, Human
cuuauggaauugauuu

SEQ ID NO: 1924707 - RNA, 17 nt, Human
cuuauggaauugauuug

SEQ ID NO: 1924708 - RNA, 19 nt, Human
cuuauggaauugauuugca

SEQ ID NO: 1924709 - RNA, 20 nt, Human
cuuauggaauugauuugcau

SEQ ID NO: 1924710 - RNA, 21 nt, Human
cuuauggaauugauuugcauu

SEQ ID NO: 1924711 - RNA, 23 nt, Human
cuuauggaauugauuugcauuga

SEQ ID NO: 1924712 - RNA, 19 nt, Human
cuuauuaaugcuaagggca

SEQ ID NO: 1924713 - RNA, 15 nt, Human
cuuauuaaugcuaag

SEQ ID NO: 1924714 - RNA, 19 nt, Human
cuuauuaaauggaaacuga

SEQ ID NO: 1924715 - RNA, 14 nt, Human
cuuauuaaugcuaa

SEQ ID NO: 1924716 - RNA, 13 nt, Human
cuuauugcccacg

SEQ ID NO: 1924717 - RNA, 12 nt, Human
cuuauugcccac

SEQ ID NO: 1924718 - RNA, 22 nt, Human
cuuaugggcuggguucuaccca

SEQ ID NO: 1924719 - RNA, 23 nt, Human
cuuaugggcuggguucuacccag

SEQ ID NO: 1924720 - RNA, 14 nt, Human
cuuccaugugaggg

SEQ ID NO: 1924721 - RNA, 14 nt, Human
cuuccaugauucua

SEQ ID NO: 1924722 - RNA, 17 nt, Human
cuuccaugauucuauuu

SEQ ID NO: 1924723 - RNA, 16 nt, Human
cuuccauggacuuugu

SEQ ID NO: 1924724 - RNA, 17 nt, Human
cuuccauggacuuuguu

SEQ ID NO: 1924725 - RNA, 18 nt, Human
cuuccagugaggcucugc

SEQ ID NO: 1924726 - RNA, 17 nt, Human
cuuccagugaggcucug

SEQ ID NO: 1924727 - RNA, 19 nt, Human
cuuccagugaggcucugcc

SEQ ID NO: 1924728 - RNA, 20 nt, Human
cuuccagugaggcucugccc

SEQ ID NO: 1924729 - RNA, 11 nt, Human
cuucauccucu

SEQ ID NO: 1924730 - RNA, 15 nt, Human
cuucaucgaaucuac

SEQ ID NO: 1924731 - RNA, 17 nt, Human
cuucaucgaaucuacua

SEQ ID NO: 1924732 - RNA, 16 nt, Human
cuucauccuccucaga

SEQ ID NO: 1924733 - RNA, 13 nt, Human
cuucaucucccac

SEQ ID NO: 1924734 - RNA, 19 nt, Human
cuucaucucccaccuagca

SEQ ID NO: 1924735 - RNA, 20 nt, Human
cuucaucucccaccuagcag

SEQ ID NO: 1924736 - RNA, 13 nt, Human
cuucauggauggg

SEQ ID NO: 1924737 - RNA, 18 nt, Human
cuucaguggcagcugcuu

SEQ ID NO: 1924738 - RNA, 23 nt, Human
cuucagagacuccugcaggcagc

SEQ ID NO: 1924739 - RNA, 24 nt, Human
cuucagagacuccugcaggcagcc

SEQ ID NO: 1924740 - RNA, 13 nt, Human
cuucaucccucug

SEQ ID NO: 1924741 - RNA, 15 nt, Human
cuucauccuccucag

SEQ ID NO: 1924742 - RNA, 16 nt, Human
cuuauuaaugcuaagg

SEQ ID NO: 1924743 - RNA, 18 nt, Human
cuuauugcccacgcugga

SEQ ID NO: 1924744 - RNA, 14 nt, Human
cuucaccuuugucc

SEQ ID NO: 1924745 - RNA, 16 nt, Human
cuucaccuccuuucaa

SEQ ID NO: 1924746 - RNA, 14 nt, Human
cuucaccucugcua

SEQ ID NO: 1924747 - RNA, 17 nt, Human
cuucaccuuugucccca

SEQ ID NO: 1924748 - RNA, 20 nt, Human
cuucaccuuuguccccaccg

SEQ ID NO: 1924749 - RNA, 18 nt, Human
cuucacuguccuccaagc

SEQ ID NO: 1924750 - RNA, 21 nt, Human
cuucacuguccuccaagccag

SEQ ID NO: 1924751 - RNA, 19 nt, Human
cuucacugugaccuugaga

SEQ ID NO: 1924752 - RNA, 16 nt, Human
cuucagagacuccugc

SEQ ID NO: 1924753 - RNA, 21 nt, Human
cuucagagacuccugcaggca

SEQ ID NO: 1924754 - RNA, 22 nt, Human
cuucagagacuccugcaggcag

SEQ ID NO: 1924755 - RNA, 11 nt, Human
cuucagacaua

SEQ ID NO: 1924756 - RNA, 20 nt, Human
cuucagaaagugugcuuuau

SEQ ID NO: 1924757 - RNA, 14 nt, Human
cugcauuuaaaaga

SEQ ID NO: 1924758 - RNA, 13 nt, Human
cugcauuggcuuu

SEQ ID NO: 1924759 - RNA, 12 nt, Human
cugcccuuaccu

SEQ ID NO: 1924760 - RNA, 16 nt, Human
cugcccuuaccugcca

SEQ ID NO: 1924761 - RNA, 17 nt, Human
cugcccuuaccugccag

SEQ ID NO: 1924762 - RNA, 19 nt, Human
cugcccugugggcccccaa

SEQ ID NO: 1924763 - RNA, 23 nt, Human
cugccagggacagaggggguggc

SEQ ID NO: 1924764 - RNA, 11 nt, Human
cugccagggcc

SEQ ID NO: 1924765 - RNA, 18 nt, Human
cugcauuuaaaagauaca

SEQ ID NO: 1924766 - RNA, 17 nt, Human
cugcauuuaaaagauac

SEQ ID NO: 1924767 - RNA, 20 nt, Human
cugccagggacagagggggu

SEQ ID NO: 1924768 - RNA, 22 nt, Human
cugccagggacagagggggugg

SEQ ID NO: 1924769 - RNA, 14 nt, Human
cugcccccgcaucc

SEQ ID NO: 1924770 - RNA, 15 nt, Human
cugcccccgcauccc

SEQ ID NO: 1924771 - RNA, 16 nt, Human
cugcccccgcaucccc

SEQ ID NO: 1924772 - RNA, 18 nt, Human
cugcccccgcauccccug

SEQ ID NO: 1924773 - RNA, 16 nt, Human
cugcccccaggacugg

SEQ ID NO: 1924774 - RNA, 15 nt, Human
cugcccccaggacug

SEQ ID NO: 1924775 - RNA, 14 nt, Human
cugcccccaggacu

SEQ ID NO: 1924776 - RNA, 13 nt, Human
cugcccccaggac

SEQ ID NO: 1924777 - RNA, 18 nt, Human
cugcccccaggacugggc

SEQ ID NO: 1924778 - RNA, 17 nt, Human
cugcccccaggacuggg

SEQ ID NO: 1924779 - RNA, 19 nt, Human
cugcccccaggacugggcc

SEQ ID NO: 1924780 - RNA, 20 nt, Human
cugcccccgcauccccugcc

SEQ ID NO: 1924781 - RNA, 21 nt, Human
cugcccccgcauccccugccu

SEQ ID NO: 1924782 - RNA, 22 nt, Human
cugcccccgcauccccugccuc

SEQ ID NO: 1924783 - RNA, 23 nt, Human
cugcccccgcauccccugccucc

SEQ ID NO: 1924784 - RNA, 19 nt, Human
cugccauccagguucagcu

SEQ ID NO: 1924785 - RNA, 18 nt, Human
cugccauccagguucagc

SEQ ID NO: 1924786 - RNA, 16 nt, Human
cugccauccagguuca

SEQ ID NO: 1924787 - RNA, 16 nt, Human
cugccauauucuguug

SEQ ID NO: 1924788 - RNA, 17 nt, Human
cugcaggccaggccagc

SEQ ID NO: 1924789 - RNA, 18 nt, Human
cugcaggccaggccagcu

SEQ ID NO: 1924790 - RNA, 23 nt, Human
cugcaggccaggccagcugccuc

SEQ ID NO: 1924791 - RNA, 12 nt, Human
cugcagcuuugu

SEQ ID NO: 1924792 - RNA, 17 nt, Human
cugcaggaaauggcugu

SEQ ID NO: 1924793 - RNA, 19 nt, Human
cugcaggacuugagaagac

SEQ ID NO: 1924794 - RNA, 23 nt, Human
cugcaggacuugagaagaccuca

SEQ ID NO: 1924795 - RNA, 13 nt, Human
cugcaggcagcca

SEQ ID NO: 1924796 - RNA, 14 nt, Human
cugcaggcagccag

SEQ ID NO: 1924797 - RNA, 15 nt, Human
cugcaggcagccagg

SEQ ID NO: 1924798 - RNA, 16 nt, Human
cugcaggcagccaggc

SEQ ID NO: 1924799 - RNA, 17 nt, Human
cugcaggcagccaggcc

SEQ ID NO: 1924800 - RNA, 18 nt, Human
cugcaggcagccaggcca

SEQ ID NO: 1924801 - RNA, 19 nt, Human
cugcaggcagccaggccac

SEQ ID NO: 1924802 - RNA, 20 nt, Human
cugcaggcagccaggccaca

SEQ ID NO: 1924803 - RNA, 23 nt, Human
cugcacuauagccuaggugacag

SEQ ID NO: 1924804 - RNA, 22 nt, Human
cugcacuauagccuaggugaca

SEQ ID NO: 1924805 - RNA, 13 nt, Human
cugcacuccagcc

SEQ ID NO: 1924806 - RNA, 15 nt, Human
cugcacuccagccug

SEQ ID NO: 1924807 - RNA, 16 nt, Human
cugcacuccagccuga

SEQ ID NO: 1924808 - RNA, 20 nt, Human
cugcacuccagccugagcga

SEQ ID NO: 1924809 - RNA, 17 nt, Human
cugcacuccagccugag

SEQ ID NO: 1924810 - RNA, 20 nt, Human
cugcacuauagccuagguga

SEQ ID NO: 1924811 - RNA, 18 nt, Human
cugcacuauagccuaggu

SEQ ID NO: 1924812 - RNA, 17 nt, Human
cugcacuauagccuagg

SEQ ID NO: 1924813 - RNA, 16 nt, Human
cugcacuauagccuag

SEQ ID NO: 1924814 - RNA, 23 nt, Human
cugcagccucaaccuccugggcu

SEQ ID NO: 1924815 - RNA, 19 nt, Human
cugcacuccagccugggug

SEQ ID NO: 1924816 - RNA, 24 nt, Human
cugcagccucaaccuccugggcua

SEQ ID NO: 1924817 - RNA, 18 nt, Human
cugcacuccagccugggu

SEQ ID NO: 1924818 - RNA, 16 nt, Human
cugcacuccagccugg

SEQ ID NO: 1924819 - RNA, 17 nt, Human
cugcacuccagccuggg

SEQ ID NO: 1924820 - RNA, 22 nt, Human
cugcaaaggguaucaggugcug

SEQ ID NO: 1924821 - RNA, 14 nt, Human
cugcaaaggacaga

SEQ ID NO: 1924822 - RNA, 16 nt, Human
cugcaaaggacagauc

SEQ ID NO: 1924823 - RNA, 23 nt, Human
cugcaaaggacagauccagggac

SEQ ID NO: 1924824 - RNA, 21 nt, Human
cugcaaaggguaucaggugcu

SEQ ID NO: 1924825 - RNA, 23 nt, Human
cugaugggcaacccccagccugc

SEQ ID NO: 1924826 - RNA, 22 nt, Human
cugaugggcaacccccagccug

SEQ ID NO: 1924827 - RNA, 24 nt, Human
cugaugggcaacccccagccugcu

SEQ ID NO: 1924828 - RNA, 21 nt, Human
cugaugggcaacccccagccu

SEQ ID NO: 1924829 - RNA, 18 nt, Human
cugaugggcaacccccag

SEQ ID NO: 1924830 - RNA, 18 nt, Human
cugaugcuucuucagaga

SEQ ID NO: 1924831 - RNA, 19 nt, Human
cugaugcuucuucagagac

SEQ ID NO: 1924832 - RNA, 20 nt, Human
cugaugcuucuucagagacu

SEQ ID NO: 1924833 - RNA, 14 nt, Human
cucuuaugggcugg

SEQ ID NO: 1924834 - RNA, 18 nt, Human
cucuuauaucuauauuuu

SEQ ID NO: 1924835 - RNA, 15 nt, Human
cucuuauaucuauau

SEQ ID NO: 1924836 - RNA, 22 nt, Human
cucuuauagaauauuuauuacc

SEQ ID NO: 1924837 - RNA, 15 nt, Human
cucuuaugggcuggg

SEQ ID NO: 1924838 - RNA, 14 nt, Human
cugaugacucaaga

SEQ ID NO: 1924839 - RNA, 15 nt, Human
cugaugacucaagau

SEQ ID NO: 1924840 - RNA, 18 nt, Human
cugaugacucaagauucc

SEQ ID NO: 1924841 - RNA, 20 nt, Human
cugaugacucaagauuccca

SEQ ID NO: 1924842 - RNA, 22 nt, Human
cugaugacucaagauucccagg

SEQ ID NO: 1924843 - RNA, 23 nt, Human
cugaugacucaagauucccagga

SEQ ID NO: 1924844 - RNA, 14 nt, Human
cugaugacuugcuu

SEQ ID NO: 1924845 - RNA, 16 nt, Human
cugaugcuucuucaga

SEQ ID NO: 1924846 - RNA, 17 nt, Human
cugaugcuucuucagag

SEQ ID NO: 1924847 - RNA, 12 nt, Human
cugaugcugaca

SEQ ID NO: 1924848 - RNA, 14 nt, Human
cugaugcugccccu

SEQ ID NO: 1924849 - RNA, 23 nt, Human
cugcaccgggccacagagaaagu

SEQ ID NO: 1924850 - RNA, 18 nt, Human
cugcaagguuuaggcugg

SEQ ID NO: 1924851 - RNA, 20 nt, Human
cugcaagguuuaggcuggug

SEQ ID NO: 1924852 - RNA, 22 nt, Human
cugcaagguuuaggcugguggc

SEQ ID NO: 1924853 - RNA, 23 nt, Human
cugcaagguuuaggcugguggcc

SEQ ID NO: 1924854 - RNA, 17 nt, Human
cugcaccguacugugga

SEQ ID NO: 1924855 - RNA, 12 nt, Human
cugcaagggagu

SEQ ID NO: 1924856 - RNA, 20 nt, Human
cugcaagaauugaagcagga

SEQ ID NO: 1924857 - RNA, 21 nt, Human
cugcaagaaaaugauguguac

SEQ ID NO: 1924858 - RNA, 22 nt, Human
cugcaaccuccgccucuugggu

SEQ ID NO: 1924859 - RNA, 14 nt, Human
cugcaaccugauug

SEQ ID NO: 1924860 - RNA, 19 nt, Human
cugcaaccugauugugucu

SEQ ID NO: 1924861 - RNA, 21 nt, Human
cugcaaccugauugugucucu

SEQ ID NO: 1924862 - RNA, 20 nt, Human
cugcaaccuccgccucuugg

SEQ ID NO: 1924863 - RNA, 19 nt, Human
cugcaaauccuugugggaa

SEQ ID NO: 1924864 - RNA, 16 nt, Human
cugcaaauccuugugg

SEQ ID NO: 1924865 - RNA, 22 nt, Human
cugcaaccugauugugucucuu

SEQ ID NO: 1924866 - RNA, 14 nt, Human
cugcaacuucugcc

SEQ ID NO: 1924867 - RNA, 15 nt, Human
cugcaacuucugccu

SEQ ID NO: 1924868 - RNA, 18 nt, Human
cugcaagaauugaagcag

SEQ ID NO: 1924869 - RNA, 22 nt, Human
cuggaugcagccucacaguccu

SEQ ID NO: 1924870 - RNA, 19 nt, Human
cuggacugugugcucagga

SEQ ID NO: 1924871 - RNA, 22 nt, Human
cuggacugugugcucaggagcc

SEQ ID NO: 1924872 - RNA, 14 nt, Human
cugcuuaaugaaaa

SEQ ID NO: 1924873 - RNA, 20 nt, Human
cugcuuagaauccaaacuug

SEQ ID NO: 1924874 - RNA, 23 nt, Human
cuggacugugugcucaggagccc

SEQ ID NO: 1924875 - RNA, 16 nt, Human
cuggaguucugguucc

SEQ ID NO: 1924876 - RNA, 17 nt, Human
cuggaguucugguuccu

SEQ ID NO: 1924877 - RNA, 14 nt, Human
cuggaucugugagg

SEQ ID NO: 1924878 - RNA, 15 nt, Human
cuggaguugaucugg

SEQ ID NO: 1924879 - RNA, 16 nt, Human
cuggaguugaucugga

SEQ ID NO: 1924880 - RNA, 17 nt, Human
cuggaguugaucuggaa

SEQ ID NO: 1924881 - RNA, 18 nt, Human
cuggaguugaucuggaac

SEQ ID NO: 1924882 - RNA, 15 nt, Human
cuggaguucugguuc

SEQ ID NO: 1924883 - RNA, 20 nt, Human
cugcuuaacuucacauauug

SEQ ID NO: 1924884 - RNA, 14 nt, Human
cugcucacauaucu

SEQ ID NO: 1924885 - RNA, 19 nt, Human
cugcucacauaucugucau

SEQ ID NO: 1924886 - RNA, 16 nt, Human
cugcucacauaucugu

SEQ ID NO: 1924887 - RNA, 12 nt, Human
cugcugaaggcu

SEQ ID NO: 1924888 - RNA, 12 nt, Human
cugcugacagug

SEQ ID NO: 1924889 - RNA, 15 nt, Human
cugcugaaggcucga

SEQ ID NO: 1924890 - RNA, 13 nt, Human
cugcugaaggcuc

SEQ ID NO: 1924891 - RNA, 14 nt, Human
cugcugaaggcucg

SEQ ID NO: 1924892 - RNA, 15 nt, Human
cugcugacaguguug

SEQ ID NO: 1924893 - RNA, 13 nt, Human
cugcugacagugu

SEQ ID NO: 1924894 - RNA, 16 nt, Human
cugcugaaggcucauu

SEQ ID NO: 1924895 - RNA, 12 nt, Human
cuggcccuuccu

SEQ ID NO: 1924896 - RNA, 13 nt, Human
cuggcccugugcc

SEQ ID NO: 1924897 - RNA, 14 nt, Human
cuggcuaugcauuu

SEQ ID NO: 1924898 - RNA, 13 nt, Human
cuggcuaugcauu

SEQ ID NO: 1924899 - RNA, 16 nt, Human
cuggcuaugcauuuga

SEQ ID NO: 1924900 - RNA, 15 nt, Human
cuggcuaugcauuug

SEQ ID NO: 1924901 - RNA, 22 nt, Human
cuggcuaugcauuugaaaauuu

SEQ ID NO: 1924902 - RNA, 16 nt, Human
cugggacuacaggcac

SEQ ID NO: 1924903 - RNA, 15 nt, Human
cugggacuacaggca

SEQ ID NO: 1924904 - RNA, 13 nt, Human
cugggacuacagg

SEQ ID NO: 1924905 - RNA, 20 nt, Human
cugggacguggcucagccag

SEQ ID NO: 1924906 - RNA, 16 nt, Human
cugggagaaaugaaaa

SEQ ID NO: 1924907 - RNA, 21 nt, Human
cugggacguggcucagccagc

SEQ ID NO: 1924908 - RNA, 23 nt, Human
cugggacguggcucagccagcac

SEQ ID NO: 1924909 - RNA, 17 nt, Human
cugggagaaaugaaaaa

SEQ ID NO: 1924910 - RNA, 22 nt, Human
cugggagaaccaaaaagaggcu

SEQ ID NO: 1924911 - RNA, 14 nt, Human
cugggacaugggaa

SEQ ID NO: 1924912 - RNA, 18 nt, Human
cugggacaugggaaaggg

SEQ ID NO: 1924913 - RNA, 22 nt, Human
cugggacaugggaaaggggaag

SEQ ID NO: 1924914 - RNA, 21 nt, Human
cuggugccucaccccuugcca

SEQ ID NO: 1924915 - RNA, 12 nt, Human
cuggugccucac

SEQ ID NO: 1924916 - RNA, 15 nt, Human
cuggguguggcgcag

SEQ ID NO: 1924917 - RNA, 14 nt, Human
cuggguguggcgca

SEQ ID NO: 1924918 - RNA, 21 nt, Human
cuggguggcaccagcagccug

SEQ ID NO: 1924919 - RNA, 17 nt, Human
cugggcccacaaaggca

SEQ ID NO: 1924920 - RNA, 22 nt, Human
cugggccauucuccacagcaac

SEQ ID NO: 1924921 - RNA, 19 nt, Human
cugggccauucuccacagc

SEQ ID NO: 1924922 - RNA, 19 nt, Human
cugggccauguugugccuc

SEQ ID NO: 1924923 - RNA, 20 nt, Human
cugggccauguugugccucc

SEQ ID NO: 1924924 - RNA, 20 nt, Human
cugggccauucuccacagca

SEQ ID NO: 1924925 - RNA, 21 nt, Human
cugggccauucuccacagcaa

SEQ ID NO: 1924926 - RNA, 20 nt, Human
cugggcagguuggugggggc

SEQ ID NO: 1924927 - RNA, 12 nt, Human
cugggcagagga

SEQ ID NO: 1924928 - RNA, 13 nt, Human
cugggcagaggaa

SEQ ID NO: 1924929 - RNA, 16 nt, Human
cugggcagaggaaagc

SEQ ID NO: 1924930 - RNA, 20 nt, Human
cugggcagaggaaagcaaag

SEQ ID NO: 1924931 - RNA, 13 nt, Human
cuggggagaaagu

SEQ ID NO: 1924932 - RNA, 18 nt, Human
cuggguggcaccagcagc

SEQ ID NO: 1924933 - RNA, 20 nt, Human
cuggguggcaccagcagccu

SEQ ID NO: 1924934 - RNA, 13 nt, Human
cugggugacagag

SEQ ID NO: 1924935 - RNA, 22 nt, Human
cugggugacagagcaagacucu

SEQ ID NO: 1924936 - RNA, 23 nt, Human
cugggugacagagcaagacucug

SEQ ID NO: 1924937 - RNA, 19 nt, Human
cugggugacagagcaagac

SEQ ID NO: 1924938 - RNA, 23 nt, Human
cacggacgcuggcuccccaaagg

SEQ ID NO: 1924939 - RNA, 16 nt, Human
cacggacgcuggcucc

SEQ ID NO: 1924940 - RNA, 19 nt, Human
cacggacgcuggcucccca

SEQ ID NO: 1924941 - RNA, 17 nt, Human
cacgcuuucuagcuguu

SEQ ID NO: 1924942 - RNA, 16 nt, Human
cacggaagagccuugc

SEQ ID NO: 1924943 - RNA, 22 nt, Human
cacggaagagccuugcggaagg

SEQ ID NO: 1924944 - RNA, 14 nt, Human
cacuacauucuguu

SEQ ID NO: 1924945 - RNA, 13 nt, Human
cacuacauucugu

SEQ ID NO: 1924946 - RNA, 15 nt, Human
cacuacauucuguua

SEQ ID NO: 1924947 - RNA, 15 nt, Human
cacuacauucauuua

SEQ ID NO: 1924948 - RNA, 15 nt, Human
cacgcuggagugcag

SEQ ID NO: 1924949 - RNA, 20 nt, Human
cacgcuggagugcagugagc

SEQ ID NO: 1924950 - RNA, 18 nt, Human
cacgcuggagugcaguga

SEQ ID NO: 1924951 - RNA, 17 nt, Human
cacgcuggagugcagug

SEQ ID NO: 1924952 - RNA, 16 nt, Human
cacgcuggagugcagu

SEQ ID NO: 1924953 - RNA, 21 nt, Human
cacgcuggagugcagugagcc

SEQ ID NO: 1924954 - RNA, 14 nt, Human
cacgcuuucuagcu

SEQ ID NO: 1924955 - RNA, 18 nt, Human
cacgcuuucagcgaauga

SEQ ID NO: 1924956 - RNA, 21 nt, Human
cacuccagugagacagcucug

SEQ ID NO: 1924957 - RNA, 16 nt, Human
cacuccagugagacag

SEQ ID NO: 1924958 - RNA, 12 nt, Human
cacccugcucuc

SEQ ID NO: 1924959 - RNA, 21 nt, Human
cacccuggccgaguccaagcu

SEQ ID NO: 1924960 - RNA, 22 nt, Human
cacccuggccgaguccaagcug

SEQ ID NO: 1924961 - RNA, 19 nt, Human
cacccugaggccucuggaa

SEQ ID NO: 1924962 - RNA, 22 nt, Human
cacccugauuuaggagaagcca

SEQ ID NO: 1924963 - RNA, 12 nt, Human
cacccuccuuuc

SEQ ID NO: 1924964 - RNA, 18 nt, Human
caccugccccucaacucu

SEQ ID NO: 1924965 - RNA, 21 nt, Human
caccugccccucaacucuccu

SEQ ID NO: 1924966 - RNA, 11 nt, Human
caccugccagg

SEQ ID NO: 1924967 - RNA, 12 nt, Human
caccugccaggg

SEQ ID NO: 1924968 - RNA, 15 nt, Human
cacccuggugggcca

SEQ ID NO: 1924969 - RNA, 16 nt, Human
cacccuggugggccaa

SEQ ID NO: 1924970 - RNA, 16 nt, Human
caccugcggugcuauc

SEQ ID NO: 1924971 - RNA, 17 nt, Human
caccugcggugcuaucu

SEQ ID NO: 1924972 - RNA, 19 nt, Human
caccugcggugcuaucucc

SEQ ID NO: 1924973 - RNA, 20 nt, Human
caccugcggugcuaucuccc

SEQ ID NO: 1924974 - RNA, 22 nt, Human
cacaucuugcucugcugacaga

SEQ ID NO: 1924975 - RNA, 21 nt, Human
cacaucuugcucugcugacag

SEQ ID NO: 1924976 - RNA, 20 nt, Human
cacaucuugcucugcugaca

SEQ ID NO: 1924977 - RNA, 15 nt, Human
cacaucuugcucugc

SEQ ID NO: 1924978 - RNA, 14 nt, Human
cacaucuugcucug

SEQ ID NO: 1924979 - RNA, 13 nt, Human
cacaucuugcucu

SEQ ID NO: 1924980 - RNA, 12 nt, Human
cacccagcccac

SEQ ID NO: 1924981 - RNA, 22 nt, Human
caccagccccagugcccacagg

SEQ ID NO: 1924982 - RNA, 21 nt, Human
caccagccccagugcccacag

SEQ ID NO: 1924983 - RNA, 18 nt, Human
caccagccccagugccca

SEQ ID NO: 1924984 - RNA, 19 nt, Human
caccagcccuuagcaggga

SEQ ID NO: 1924985 - RNA, 17 nt, Human
caccagccccagugccc

SEQ ID NO: 1924986 - RNA, 18 nt, Human
cacauuuauucugcucac

SEQ ID NO: 1924987 - RNA, 17 nt, Human
cacauuuauucugcuca

SEQ ID NO: 1924988 - RNA, 23 nt, Human
cacaucuugcucugcugacagac

SEQ ID NO: 1924989 - RNA, 22 nt, Human
caauuucacgacacacuuugau

SEQ ID NO: 1924990 - RNA, 14 nt, Human
caauuucagacucc

SEQ ID NO: 1924991 - RNA, 12 nt, Human
cacaaggacuuc

SEQ ID NO: 1924992 - RNA, 14 nt, Human
cacaaggacuuccu

SEQ ID NO: 1924993 - RNA, 16 nt, Human
cacaaggacuuccugu

SEQ ID NO: 1924994 - RNA, 22 nt, Human
cacaaggacuuccuguccagcu

SEQ ID NO: 1924995 - RNA, 17 nt, Human
cacaaggauagaugcug

SEQ ID NO: 1924996 - RNA, 18 nt, Human
cacaaggauagaugcugg

SEQ ID NO: 1924997 - RNA, 21 nt, Human
cacaaggauagaugcuggccc

SEQ ID NO: 1924998 - RNA, 22 nt, Human
cacaaggauagaugcuggccca

SEQ ID NO: 1924999 - RNA, 20 nt, Human
caauuuauuauggcacauca

SEQ ID NO: 1925000 - RNA, 17 nt, Human
caauuucaaauuacucu

SEQ ID NO: 1925001 - RNA, 13 nt, Human
caauuuauuaugg

SEQ ID NO: 1925002 - RNA, 15 nt, Human
cacaaggccaucugg

SEQ ID NO: 1925003 - RNA, 14 nt, Human
caaucaaaucugcu

SEQ ID NO: 1925004 - RNA, 15 nt, Human
caauggcagccuugg

SEQ ID NO: 1925005 - RNA, 14 nt, Human
caauggcagccuug

SEQ ID NO: 1925006 - RNA, 13 nt, Human
caauggcagccuu

SEQ ID NO: 1925007 - RNA, 14 nt, Human
caaugcugauuugg

SEQ ID NO: 1925008 - RNA, 16 nt, Human
caaugcugauuuggug

SEQ ID NO: 1925009 - RNA, 21 nt, Human
caaugcugauuuggugaccaa

SEQ ID NO: 1925010 - RNA, 16 nt, Human
caauggcagccuuggc

SEQ ID NO: 1925011 - RNA, 12 nt, Human
caaugcuggcug

SEQ ID NO: 1925012 - RNA, 20 nt, Human
caauuggauacgacaacuug

SEQ ID NO: 1925013 - RNA, 14 nt, Human
caauuguaaauuga

SEQ ID NO: 1925014 - RNA, 16 nt, Human
caauauuguacaguuu

SEQ ID NO: 1925015 - RNA, 15 nt, Human
caauauuguacaguu

SEQ ID NO: 1925016 - RNA, 18 nt, Human
caauauuguacaguuuuu

SEQ ID NO: 1925017 - RNA, 17 nt, Human
caauauuguacaguuuu

SEQ ID NO: 1925018 - RNA, 12 nt, Human
caauauuuauua

SEQ ID NO: 1925019 - RNA, 14 nt, Human
caauauuuauuauu

SEQ ID NO: 1925020 - RNA, 13 nt, Human
caauauuuauuau

SEQ ID NO: 1925021 - RNA, 15 nt, Human
caauauuuuccauga

SEQ ID NO: 1925022 - RNA, 13 nt, Human
caauauuuuccau

SEQ ID NO: 1925023 - RNA, 11 nt, Human
caauauuuucc

SEQ ID NO: 1925024 - RNA, 22 nt, Human
caauauuuuccaugaaaaugca

SEQ ID NO: 1925025 - RNA, 20 nt, Human
caauauuuuccaugaaaaug

SEQ ID NO: 1925026 - RNA, 19 nt, Human
caauauuuuccaugaaaau

SEQ ID NO: 1925027 - RNA, 16 nt, Human
caauauuuuccaugaa

SEQ ID NO: 1925028 - RNA, 14 nt, Human
caauauuuuuagau

SEQ ID NO: 1925029 - RNA, 16 nt, Human
caauauuuucuuuaau

SEQ ID NO: 1925030 - RNA, 19 nt, Human
caauauuuucuuuaaugcu

SEQ ID NO: 1925031 - RNA, 20 nt, Human
caauauuuucuuuaaugcuu

SEQ ID NO: 1925032 - RNA, 16 nt, Human
caagcucugcuccucu

SEQ ID NO: 1925033 - RNA, 23 nt, Human
caagcuccuccucccugcaucug

SEQ ID NO: 1925034 - RNA, 14 nt, Human
caagcuccuccucc

SEQ ID NO: 1925035 - RNA, 15 nt, Human
caagcuccuccuccc

SEQ ID NO: 1925036 - RNA, 16 nt, Human
caagcuccuccucccu

SEQ ID NO: 1925037 - RNA, 17 nt, Human
caagcuccuccucccug

SEQ ID NO: 1925038 - RNA, 15 nt, Human
caagcucugcuccuc

SEQ ID NO: 1925039 - RNA, 12 nt, Human
caagcucccagg

SEQ ID NO: 1925040 - RNA, 14 nt, Human
caagcucccaggca

SEQ ID NO: 1925041 - RNA, 15 nt, Human
caagcucccaggcau

SEQ ID NO: 1925042 - RNA, 17 nt, Human
caagcucccaggcauuc

SEQ ID NO: 1925043 - RNA, 19 nt, Human
caagcuccaagcucccagg

SEQ ID NO: 1925044 - RNA, 21 nt, Human
caagcuccaagcucccaggca

SEQ ID NO: 1925045 - RNA, 17 nt, Human
caagcuccaagcuccca

SEQ ID NO: 1925046 - RNA, 18 nt, Human
caagcuccaagcucccag

SEQ ID NO: 1925047 - RNA, 20 nt, Human
caaggauugcuacuguccua

SEQ ID NO: 1925048 - RNA, 19 nt, Human
caaggauugcuacuguccu

SEQ ID NO: 1925049 - RNA, 22 nt, Human
caagcuccuccucccugcaucu

SEQ ID NO: 1925050 - RNA, 14 nt, Human
caaggcaaggcugu

SEQ ID NO: 1925051 - RNA, 15 nt, Human
caaggccauccuucc

SEQ ID NO: 1925052 - RNA, 22 nt, Human
caaguauuauaccuuuuuuaga

SEQ ID NO: 1925053 - RNA, 17 nt, Human
caaguauuauaccuuuu

SEQ ID NO: 1925054 - RNA, 16 nt, Human
caaggcccagaugugg

SEQ ID NO: 1925055 - RNA, 14 nt, Human
caaggccaucuggg

SEQ ID NO: 1925056 - RNA, 17 nt, Human
caaggccaucugggcuc

SEQ ID NO: 1925057 - RNA, 17 nt, Human
caaggccauccuucccu

SEQ ID NO: 1925058 - RNA, 23 nt, Human
caaggccauccuucccugucugc

SEQ ID NO: 1925059 - RNA, 24 nt, Human
caagguuuaggcugguggcccagg

SEQ ID NO: 1925060 - RNA, 21 nt, Human
caagguuuaggcugguggccc

SEQ ID NO: 1925061 - RNA, 22 nt, Human
caagguuuaggcugguggccca

SEQ ID NO: 1925062 - RNA, 23 nt, Human
caagguuuaggcugguggcccag

SEQ ID NO: 1925063 - RNA, 20 nt, Human
caaguuauuuuuaauuuggu

SEQ ID NO: 1925064 - RNA, 19 nt, Human
caaguauuugggaagugaa

SEQ ID NO: 1925065 - RNA, 22 nt, Human
caaguauuugggaagugaagac

SEQ ID NO: 1925066 - RNA, 14 nt, Human
caagcaaacccaga

SEQ ID NO: 1925067 - RNA, 17 nt, Human
caagcaaacccagacgg

SEQ ID NO: 1925068 - RNA, 15 nt, Human
caagcaaaugugaau

SEQ ID NO: 1925069 - RNA, 17 nt, Human
caagcaaaugugaauca

SEQ ID NO: 1925070 - RNA, 19 nt, Human
caagcaaaugugaaucauu

SEQ ID NO: 1925071 - RNA, 14 nt, Human
caagcaagacugag

SEQ ID NO: 1925072 - RNA, 13 nt, Human
caagcaagacuga

SEQ ID NO: 1925073 - RNA, 16 nt, Human
caagaccacguuucua

SEQ ID NO: 1925074 - RNA, 14 nt, Human
caagaccacguuuc

SEQ ID NO: 1925075 - RNA, 19 nt, Human
caagaccaccacuucgaaa

SEQ ID NO: 1925076 - RNA, 18 nt, Human
caagaugaaggagaggca

SEQ ID NO: 1925077 - RNA, 13 nt, Human
caagcaccuccug

SEQ ID NO: 1925078 - RNA, 12 nt, Human
caagcacagcag

SEQ ID NO: 1925079 - RNA, 13 nt, Human
caagcacagcagc

SEQ ID NO: 1925080 - RNA, 14 nt, Human
caagcacagcagcc

SEQ ID NO: 1925081 - RNA, 17 nt, Human
caagcacagcagccugg

SEQ ID NO: 1925082 - RNA, 14 nt, Human
caagcaccuccugc

SEQ ID NO: 1925083 - RNA, 16 nt, Human
caaccccuucgcuccu

SEQ ID NO: 1925084 - RNA, 14 nt, Human
caaccccuucgcuc

SEQ ID NO: 1925085 - RNA, 17 nt, Human
caaccccuucgcuccug

SEQ ID NO: 1925086 - RNA, 13 nt, Human
caacuauggccug

SEQ ID NO: 1925087 - RNA, 14 nt, Human
caacccccagccug

SEQ ID NO: 1925088 - RNA, 13 nt, Human
caaccccaggcug

SEQ ID NO: 1925089 - RNA, 14 nt, Human
caacuauggccugu

SEQ ID NO: 1925090 - RNA, 16 nt, Human
caacuauggaucagaa

SEQ ID NO: 1925091 - RNA, 17 nt, Human
caacuauggaucagaau

SEQ ID NO: 1925092 - RNA, 15 nt, Human
caagaagcccaggaa

SEQ ID NO: 1925093 - RNA, 18 nt, Human
caagaagcccaggaaagg

SEQ ID NO: 1925094 - RNA, 17 nt, Human
caagaaggaugauucaa

SEQ ID NO: 1925095 - RNA, 15 nt, Human
auuugcacaaguuuu

SEQ ID NO: 1925096 - RNA, 21 nt, Human
auuucuguuuagauaauacac

SEQ ID NO: 1925097 - RNA, 21 nt, Human
auuucuuaaacaaauguauga

SEQ ID NO: 1925098 - RNA, 13 nt, Human
auuucuuaaacaa

SEQ ID NO: 1925099 - RNA, 13 nt, Human
auuucugcauaug

SEQ ID NO: 1925100 - RNA, 19 nt, Human
auuucuguuuagauaauac

SEQ ID NO: 1925101 - RNA, 20 nt, Human
auuucuguuuagauaauaca

SEQ ID NO: 1925102 - RNA, 16 nt, Human
auuucucuuucuuuac

SEQ ID NO: 1925103 - RNA, 18 nt, Human
auuucucuuucuuuacaa

SEQ ID NO: 1925104 - RNA, 15 nt, Human
auuuaagauaauuau

SEQ ID NO: 1925105 - RNA, 16 nt, Human
auuuaaguaacuuuaa

SEQ ID NO: 1925106 - RNA, 22 nt, Human
auuuaauagguuuggacaaaau

SEQ ID NO: 1925107 - RNA, 15 nt, Human
auuuauauauguauu

SEQ ID NO: 1925108 - RNA, 14 nt, Human
auuuauauauguau

SEQ ID NO: 1925109 - RNA, 15 nt, Human
auuuauauaaauuuu

SEQ ID NO: 1925110 - RNA, 12 nt, Human
auuucacucucc

SEQ ID NO: 1925111 - RNA, 20 nt, Human
auuucaccccucccuuucuc

SEQ ID NO: 1925112 - RNA, 15 nt, Human
auuucaccccucccu

SEQ ID NO: 1925113 - RNA, 21 nt, Human
auuucaccccucccuuucucc

SEQ ID NO: 1925114 - RNA, 21 nt, Human
auuucaccacucaaaggccag

SEQ ID NO: 1925115 - RNA, 23 nt, Human
auuucaccacucaaaggccagac

SEQ ID NO: 1925116 - RNA, 14 nt, Human
auuucacucuccuu

SEQ ID NO: 1925117 - RNA, 21 nt, Human
auuucaauuuccaagagcuga

SEQ ID NO: 1925118 - RNA, 17 nt, Human
auugaggggauuaauau

SEQ ID NO: 1925119 - RNA, 22 nt, Human
auugaggggauuaauaugaaaa

SEQ ID NO: 1925120 - RNA, 19 nt, Human
auuuucuauaauuuaaaua

SEQ ID NO: 1925121 - RNA, 13 nt, Human
auuuuauaaacaa

SEQ ID NO: 1925122 - RNA, 18 nt, Human
auuuucuauaauuuaaau

SEQ ID NO: 1925123 - RNA, 17 nt, Human
auuuucuauaauuuaaa

SEQ ID NO: 1925124 - RNA, 13 nt, Human
auuuugaaaaacu

SEQ ID NO: 1925125 - RNA, 15 nt, Human
auuuugaaaaacugc

SEQ ID NO: 1925126 - RNA, 19 nt, Human
auuuguucuauagcuuuuc

SEQ ID NO: 1925127 - RNA, 12 nt, Human
auuuguuaaugg

SEQ ID NO: 1925128 - RNA, 14 nt, Human
auuuguuauaauga

SEQ ID NO: 1925129 - RNA, 22 nt, Human
auuuguguugaagagguuuuaa

SEQ ID NO: 1925130 - RNA, 18 nt, Human
auuuguguugaagagguu

SEQ ID NO: 1925131 - RNA, 15 nt, Human
auuuguguugaagag

SEQ ID NO: 1925132 - RNA, 14 nt, Human
auuuguguugaaga

SEQ ID NO: 1925133 - RNA, 20 nt, Human
caaaagguuaauaaaguaau

SEQ ID NO: 1925134 - RNA, 13 nt, Human
caaaagcauguga

SEQ ID NO: 1925135 - RNA, 19 nt, Human
caaaagcaucuaugugaga

SEQ ID NO: 1925136 - RNA, 21 nt, Human
caaaagguauuuuaaucacca

SEQ ID NO: 1925137 - RNA, 15 nt, Human
auuuuuuuuguuuca

SEQ ID NO: 1925138 - RNA, 15 nt, Human
auuuuuuuuaaacaa

SEQ ID NO: 1925139 - RNA, 16 nt, Human
auuuuuauuaaauuau

SEQ ID NO: 1925140 - RNA, 15 nt, Human
auuuuuuucugaauu

SEQ ID NO: 1925141 - RNA, 17 nt, Human
auuuuuuucugaaauuu

SEQ ID NO: 1925142 - RNA, 16 nt, Human
auuuuuuucugaaauu

SEQ ID NO: 1925143 - RNA, 22 nt, Human
auuuuguuuuugucuuaaaaag

SEQ ID NO: 1925144 - RNA, 12 nt, Human
auuuuuauccau

SEQ ID NO: 1925145 - RNA, 17 nt, Human
caaaccaucauugaaau

SEQ ID NO: 1925146 - RNA, 14 nt, Human
caaaccaucauuga

SEQ ID NO: 1925147 - RNA, 16 nt, Human
caaaccaucauugaaa

SEQ ID NO: 1925148 - RNA, 18 nt, Human
caaacaugugguuaaugc

SEQ ID NO: 1925149 - RNA, 23 nt, Human
auuaaugcuaagggcaggcccaa

SEQ ID NO: 1925150 - RNA, 15 nt, Human
auuaaugcuaagggc

SEQ ID NO: 1925151 - RNA, 14 nt, Human
auuaaugcuaaggg

SEQ ID NO: 1925152 - RNA, 22 nt, Human
auuacaagcgugagccacugca

SEQ ID NO: 1925153 - RNA, 15 nt, Human
auuacaggcuugagc

SEQ ID NO: 1925154 - RNA, 15 nt, Human
auuacagggcacagg

SEQ ID NO: 1925155 - RNA, 16 nt, Human
auuacagggcacaggc

SEQ ID NO: 1925156 - RNA, 21 nt, Human
auuaacaugaauauuuagugu

SEQ ID NO: 1925157 - RNA, 11 nt, Human
auuaacacugc

SEQ ID NO: 1925158 - RNA, 14 nt, Human
auucauauuuacuu

SEQ ID NO: 1925159 - RNA, 17 nt, Human
auucauggccuggggga

SEQ ID NO: 1925160 - RNA, 14 nt, Human
auucauauugaaua

SEQ ID NO: 1925161 - RNA, 17 nt, Human
auucauauugaauauaa

SEQ ID NO: 1925162 - RNA, 13 nt, Human
auucauauugaau

SEQ ID NO: 1925163 - RNA, 19 nt, Human
auucauaguaacuucuuau

SEQ ID NO: 1925164 - RNA, 13 nt, Human
auuaugugccaga

SEQ ID NO: 1925165 - RNA, 21 nt, Human
auuaugugccagauuuaugca

SEQ ID NO: 1925166 - RNA, 23 nt, Human
auuaugugccagauuuaugcaua

SEQ ID NO: 1925167 - RNA, 12 nt, Human
auucaauaaaaa

SEQ ID NO: 1925168 - RNA, 18 nt, Human
auucaauaaaaaaaagaa

SEQ ID NO: 1925169 - RNA, 21 nt, Human
auucaauaaaaaaaagaaaug

SEQ ID NO: 1925170 - RNA, 20 nt, Human
auuagaucuucaaacagaau

SEQ ID NO: 1925171 - RNA, 18 nt, Human
auuagaucuucaaacaga

SEQ ID NO: 1925172 - RNA, 19 nt, Human
auuagaucuucaaacagaa

SEQ ID NO: 1925173 - RNA, 22 nt, Human
auucaauaaaaaaaagaaauga

SEQ ID NO: 1925174 - RNA, 20 nt, Human
auucucuaguuugauuaaau

SEQ ID NO: 1925175 - RNA, 13 nt, Human
auucguucugugg

SEQ ID NO: 1925176 - RNA, 23 nt, Human
auucgguguggugcagugugaaa

SEQ ID NO: 1925177 - RNA, 23 nt, Human
auucucuaguuugauuaaauucu

SEQ ID NO: 1925178 - RNA, 14 nt, Human
auucucuccaaaaa

SEQ ID NO: 1925179 - RNA, 15 nt, Human
auucucuccaaaaau

SEQ ID NO: 1925180 - RNA, 19 nt, Human
auucucuccaaaaaugcac

SEQ ID NO: 1925181 - RNA, 12 nt, Human
auucucuuaucc

SEQ ID NO: 1925182 - RNA, 14 nt, Human
auucucuuauccaa

SEQ ID NO: 1925183 - RNA, 14 nt, Human
auucgcuugagaaa

SEQ ID NO: 1925184 - RNA, 15 nt, Human
auucucuuauccaac

SEQ ID NO: 1925185 - RNA, 19 nt, Human
auugagcugcagaaacgaa

SEQ ID NO: 1925186 - RNA, 17 nt, Human
caggaccuccaagccac

SEQ ID NO: 1925187 - RNA, 19 nt, Human
caggaccuccaagccacug

SEQ ID NO: 1925188 - RNA, 20 nt, Human
caggaccuccaagccacuga

SEQ ID NO: 1925189 - RNA, 23 nt, Human
caggaccuccaagccacugagca

SEQ ID NO: 1925190 - RNA, 16 nt, Human
caggaccucaggugag

SEQ ID NO: 1925191 - RNA, 23 nt, Human
caggaccucaggugagaagcaga

SEQ ID NO: 1925192 - RNA, 13 nt, Human
caggaccagcuca

SEQ ID NO: 1925193 - RNA, 12 nt, Human
caggaccagcuc

SEQ ID NO: 1925194 - RNA, 14 nt, Human
caggaccagcucag

SEQ ID NO: 1925195 - RNA, 22 nt, Human
caggaggccagccuugaccauu

SEQ ID NO: 1925196 - RNA, 18 nt, Human
caggaggccagccuugac

SEQ ID NO: 1925197 - RNA, 19 nt, Human
caggaggccagccuugacc

SEQ ID NO: 1925198 - RNA, 19 nt, Human
caggaggaucacuugaguc

SEQ ID NO: 1925199 - RNA, 17 nt, Human
caggcaaugcuggcugu

SEQ ID NO: 1925200 - RNA, 16 nt, Human
caggcaaugcuggcug

SEQ ID NO: 1925201 - RNA, 15 nt, Human
caggcaaugcuggcu

SEQ ID NO: 1925202 - RNA, 14 nt, Human
caggcaaugcuggc

SEQ ID NO: 1925203 - RNA, 11 nt, Human
caggccaggcc

SEQ ID NO: 1925204 - RNA, 12 nt, Human
caggccaggccc

SEQ ID NO: 1925205 - RNA, 14 nt, Human
caggccaggccagc

SEQ ID NO: 1925206 - RNA, 21 nt, Human
cagggagaccuggacacaggc

SEQ ID NO: 1925207 - RNA, 20 nt, Human
cagggagaccuggacacagg

SEQ ID NO: 1925208 - RNA, 19 nt, Human
cagggagacccguccauuu

SEQ ID NO: 1925209 - RNA, 22 nt, Human
caggcugggagagccuuccagg

SEQ ID NO: 1925210 - RNA, 23 nt, Human
caggcugggagagccuuccaggg

SEQ ID NO: 1925211 - RNA, 19 nt, Human
cagggagcauuuuccucca

SEQ ID NO: 1925212 - RNA, 21 nt, Human
cagggagcaggcggugggcac

SEQ ID NO: 1925213 - RNA, 16 nt, Human
cagggcuuacggcccu

SEQ ID NO: 1925214 - RNA, 18 nt, Human
cagggcuuacggcccugg

SEQ ID NO: 1925215 - RNA, 20 nt, Human
cagggcuuacggcccuggcc

SEQ ID NO: 1925216 - RNA, 23 nt, Human
cagggcuuacggcccuggccuug

SEQ ID NO: 1925217 - RNA, 17 nt, Human
caggggaaaaucagccu

SEQ ID NO: 1925218 - RNA, 14 nt, Human
caggggaaaagagg

SEQ ID NO: 1925219 - RNA, 16 nt, Human
caggggaaaagaggag

SEQ ID NO: 1925220 - RNA, 12 nt, Human
caggccuccuac

SEQ ID NO: 1925221 - RNA, 14 nt, Human
caggccuccuacag

SEQ ID NO: 1925222 - RNA, 16 nt, Human
caggccuuaucuccaa

SEQ ID NO: 1925223 - RNA, 17 nt, Human
caggccuuaucuccaag

SEQ ID NO: 1925224 - RNA, 22 nt, Human
caggccuuaucuccaagaccag

SEQ ID NO: 1925225 - RNA, 21 nt, Human
caggcugggagagccuuccag

SEQ ID NO: 1925226 - RNA, 23 nt, Human
caggcuaaacauccaauauuuuc

SEQ ID NO: 1925227 - RNA, 19 nt, Human
caggaaaggcuccaggagc

SEQ ID NO: 1925228 - RNA, 20 nt, Human
caggaaaggcuccaggagca

SEQ ID NO: 1925229 - RNA, 16 nt, Human
caggaaaggcuccagg

SEQ ID NO: 1925230 - RNA, 17 nt, Human
caggaaaggcuccagga

SEQ ID NO: 1925231 - RNA, 21 nt, Human
cagcugacuuuucuguccgag

SEQ ID NO: 1925232 - RNA, 18 nt, Human
cagcugagcgccaggaug

SEQ ID NO: 1925233 - RNA, 14 nt, Human
cagcugagcgccag

SEQ ID NO: 1925234 - RNA, 16 nt, Human
cagcugagcgccagga

SEQ ID NO: 1925235 - RNA, 17 nt, Human
cagccugcuccagcugu

SEQ ID NO: 1925236 - RNA, 19 nt, Human
cagccugcuccagcuguuc

SEQ ID NO: 1925237 - RNA, 14 nt, Human
cagcgccuuuccca

SEQ ID NO: 1925238 - RNA, 22 nt, Human
cagcgccuuucccaacucuagc

SEQ ID NO: 1925239 - RNA, 16 nt, Human
cagccugcuccagcug

SEQ ID NO: 1925240 - RNA, 15 nt, Human
cagcuaacauggaag

SEQ ID NO: 1925241 - RNA, 21 nt, Human
cagcggaaagcccugugcucc

SEQ ID NO: 1925242 - RNA, 20 nt, Human
cagcgcuggccgggaccccg

SEQ ID NO: 1925243 - RNA, 19 nt, Human
cagacaguguuuucuggga

SEQ ID NO: 1925244 - RNA, 19 nt, Human
cagacucccauuccugaag

SEQ ID NO: 1925245 - RNA, 20 nt, Human
cagacucccauuccugaaga

SEQ ID NO: 1925246 - RNA, 23 nt, Human
cagacuccugacugucucccggg

SEQ ID NO: 1925247 - RNA, 17 nt, Human
cagacucuacagaggcc

SEQ ID NO: 1925248 - RNA, 22 nt, Human
cagacucgauucauauugaaua

SEQ ID NO: 1925249 - RNA, 23 nt, Human
cagacaggcaagcaccuccugcc

SEQ ID NO: 1925250 - RNA, 22 nt, Human
cagacaggcaagcaccuccugc

SEQ ID NO: 1925251 - RNA, 18 nt, Human
cagacaggcaaauaaaag

SEQ ID NO: 1925252 - RNA, 15 nt, Human
cagacaggccccgug

SEQ ID NO: 1925253 - RNA, 20 nt, Human
cagacaggccccgugaggca

SEQ ID NO: 1925254 - RNA, 21 nt, Human
cagacucuacagaggccaugg

SEQ ID NO: 1925255 - RNA, 20 nt, Human
cagacucuacagaggccaug

SEQ ID NO: 1925256 - RNA, 19 nt, Human
cagacucuacagaggccau

SEQ ID NO: 1925257 - RNA, 18 nt, Human
cagacucuacagaggcca

SEQ ID NO: 1925258 - RNA, 23 nt, Human
cagacucuacagaggccaugggc

SEQ ID NO: 1925259 - RNA, 13 nt, Human
cagacugaccuug

SEQ ID NO: 1925260 - RNA, 22 nt, Human
cagacugaccuugaugagcugu

SEQ ID NO: 1925261 - RNA, 17 nt, Human
cagacugaucaggaccu

SEQ ID NO: 1925262 - RNA, 16 nt, Human
cagacugaucaggacc

SEQ ID NO: 1925263 - RNA, 13 nt, Human
cagacuggaagca

SEQ ID NO: 1925264 - RNA, 18 nt, Human
cagacuggaagcacagcu

SEQ ID NO: 1925265 - RNA, 17 nt, Human
cagacuggaagcacagc

SEQ ID NO: 1925266 - RNA, 16 nt, Human
cagacuggaagcacag

SEQ ID NO: 1925267 - RNA, 14 nt, Human
cagacuggaagcac

SEQ ID NO: 1925268 - RNA, 21 nt, Human
cagacuggaagcacagcuuca

SEQ ID NO: 1925269 - RNA, 20 nt, Human
cagacuggaagcacagcuuc

SEQ ID NO: 1925270 - RNA, 21 nt, Human
cagacaggcaagcaccuccug

SEQ ID NO: 1925271 - RNA, 20 nt, Human
cagacaggcaagcaccuccu

SEQ ID NO: 1925272 - RNA, 18 nt, Human
cagacaggcaagcaccuc

SEQ ID NO: 1925273 - RNA, 13 nt, Human
cagacaggcaagc

SEQ ID NO: 1925274 - RNA, 11 nt, Human
cagacaggcaa

SEQ ID NO: 1925275 - RNA, 17 nt, Human
cagacaggaccagggau

SEQ ID NO: 1925276 - RNA, 24 nt, Human
cagacaggaccagggauuuccaug

SEQ ID NO: 1925277 - RNA, 13 nt, Human
cagacaggaccag

SEQ ID NO: 1925278 - RNA, 21 nt, Human
cagacagcuccacccuggccg

SEQ ID NO: 1925279 - RNA, 15 nt, Human
cagacaggaccaggg

SEQ ID NO: 1925280 - RNA, 16 nt, Human
cagacaggaccaggga

SEQ ID NO: 1925281 - RNA, 15 nt, Human
cagacagcugccugg

SEQ ID NO: 1925282 - RNA, 16 nt, Human
cagacagcugccuggg

SEQ ID NO: 1925283 - RNA, 17 nt, Human
cagacagcugccuggga

SEQ ID NO: 1925284 - RNA, 18 nt, Human
cagacagcugccugggau

SEQ ID NO: 1925285 - RNA, 13 nt, Human
cagacagcugccu

SEQ ID NO: 1925286 - RNA, 14 nt, Human
cagacagcugccug

SEQ ID NO: 1925287 - RNA, 16 nt, Human
cagacuguugucccug

SEQ ID NO: 1925288 - RNA, 18 nt, Human
cagacuguugucccugca

SEQ ID NO: 1925289 - RNA, 15 nt, Human
cagauccagggacug

SEQ ID NO: 1925290 - RNA, 14 nt, Human
cagauaugauucaa

SEQ ID NO: 1925291 - RNA, 12 nt, Human
cagauccaggac

SEQ ID NO: 1925292 - RNA, 13 nt, Human
cagauccaggacu

SEQ ID NO: 1925293 - RNA, 13 nt, Human
cagauccagggac

SEQ ID NO: 1925294 - RNA, 14 nt, Human
cagauccagggaca

SEQ ID NO: 1925295 - RNA, 15 nt, Human
cagauccagggacag

SEQ ID NO: 1925296 - RNA, 23 nt, Human
cagauccagggacagaggcccca

SEQ ID NO: 1925297 - RNA, 22 nt, Human
cagauauaaaagacugaccaau

SEQ ID NO: 1925298 - RNA, 19 nt, Human
cagauagauauaugcucug

SEQ ID NO: 1925299 - RNA, 14 nt, Human
cagaggggguggcc

SEQ ID NO: 1925300 - RNA, 16 nt, Human
cagaggggguggccuc

SEQ ID NO: 1925301 - RNA, 19 nt, Human
cagauacuuggggggcuga

SEQ ID NO: 1925302 - RNA, 20 nt, Human
cagaggaaagcaaaggagau

SEQ ID NO: 1925303 - RNA, 13 nt, Human
cagaggggguggc

SEQ ID NO: 1925304 - RNA, 17 nt, Human
cagaggaaagcaaagga

SEQ ID NO: 1925305 - RNA, 19 nt, Human
cagaggaaagcaaaggaga

SEQ ID NO: 1925306 - RNA, 23 nt, Human
cagagaggguggugaccucugcc

SEQ ID NO: 1925307 - RNA, 23 nt, Human
cagagagggugggagugggccca

SEQ ID NO: 1925308 - RNA, 20 nt, Human
cagagagguuaaggugggua

SEQ ID NO: 1925309 - RNA, 13 nt, Human
cagagcugccacc

SEQ ID NO: 1925310 - RNA, 22 nt, Human
cagagaggguggugaccucugc

SEQ ID NO: 1925311 - RNA, 20 nt, Human
cagagaggguggugaccucu

SEQ ID NO: 1925312 - RNA, 17 nt, Human
cagagaggguggugacc

SEQ ID NO: 1925313 - RNA, 13 nt, Human
cagagaggguggg

SEQ ID NO: 1925314 - RNA, 12 nt, Human
cagagagggugg

SEQ ID NO: 1925315 - RNA, 17 nt, Human
cagcacguguggccugu

SEQ ID NO: 1925316 - RNA, 15 nt, Human
cagcacgauuucugu

SEQ ID NO: 1925317 - RNA, 14 nt, Human
cagcacgauuucug

SEQ ID NO: 1925318 - RNA, 18 nt, Human
cagccaggccacuggccc

SEQ ID NO: 1925319 - RNA, 15 nt, Human
cagccaggccccagg

SEQ ID NO: 1925320 - RNA, 18 nt, Human
cagauugcaacaggcugg

SEQ ID NO: 1925321 - RNA, 20 nt, Human
cagauugcaacaggcugggc

SEQ ID NO: 1925322 - RNA, 19 nt, Human
cagauugcaacaggcuggg

SEQ ID NO: 1925323 - RNA, 22 nt, Human
cagauuggcucacacugagaau

SEQ ID NO: 1925324 - RNA, 21 nt, Human
cagauuggcucacacugagaa

SEQ ID NO: 1925325 - RNA, 13 nt, Human
cagauuuaugcau

SEQ ID NO: 1925326 - RNA, 13 nt, Human
cagauuucacucu

SEQ ID NO: 1925327 - RNA, 20 nt, Human
cagauuucacucuccuuggu

SEQ ID NO: 1925328 - RNA, 19 nt, Human
cagauuugaacucuucaau

SEQ ID NO: 1925329 - RNA, 17 nt, Human
cagcaccaucucuccuc

SEQ ID NO: 1925330 - RNA, 19 nt, Human
cagauuucacucuccuugg

SEQ ID NO: 1925331 - RNA, 16 nt, Human
cagauuuccagucucc

SEQ ID NO: 1925332 - RNA, 24 nt, Human
cagauuuccagucuccaccaggaa

SEQ ID NO: 1925333 - RNA, 19 nt, Human
cagcaccaucucuccuccu

SEQ ID NO: 1925334 - RNA, 18 nt, Human
caguuugagacaggagac

SEQ ID NO: 1925335 - RNA, 16 nt, Human
caguuugagacaggag

SEQ ID NO: 1925336 - RNA, 15 nt, Human
caguuugagacagga

SEQ ID NO: 1925337 - RNA, 24 nt, Human
caguuugaaugcagucuguccagg

SEQ ID NO: 1925338 - RNA, 23 nt, Human
caguuuguuaguaugaggcauuu

SEQ ID NO: 1925339 - RNA, 21 nt, Human
caguuuguuaguaugaggcau

SEQ ID NO: 1925340 - RNA, 16 nt, Human
caguuuuaacuagaau

SEQ ID NO: 1925341 - RNA, 18 nt, Human
caguuguuagugugucuu

SEQ ID NO: 1925342 - RNA, 22 nt, Human
caguuguuagugugucuuagug

SEQ ID NO: 1925343 - RNA, 17 nt, Human
cauaauguuacauuauu

SEQ ID NO: 1925344 - RNA, 22 nt, Human
cauaaugggguccuggccaucc

SEQ ID NO: 1925345 - RNA, 14 nt, Human
cauaaugggguccu

SEQ ID NO: 1925346 - RNA, 23 nt, Human
cauaaugcgugcauaccacuuuu

SEQ ID NO: 1925347 - RNA, 15 nt, Human
caguuuuaucauuuu

SEQ ID NO: 1925348 - RNA, 23 nt, Human
caguuuucaagucaaauuaauaa

SEQ ID NO: 1925349 - RNA, 11 nt, Human
caguuuuccuu

SEQ ID NO: 1925350 - RNA, 22 nt, Human
caguuuucaagucaaauuaaua

SEQ ID NO: 1925351 - RNA, 18 nt, Human
cauaauguuacauuauua

SEQ ID NO: 1925352 - RNA, 18 nt, Human
cauaauuauuauuuggcc

SEQ ID NO: 1925353 - RNA, 23 nt, Human
cauacaggaagguagaaauaucu

SEQ ID NO: 1925354 - RNA, 16 nt, Human
cauacagggauggugu

SEQ ID NO: 1925355 - RNA, 16 nt, Human
cauacaguuugcacuu

SEQ ID NO: 1925356 - RNA, 19 nt, Human
cauacagggaugguguuca

SEQ ID NO: 1925357 - RNA, 21 nt, Human
cauauguaccauguacaugaa

SEQ ID NO: 1925358 - RNA, 15 nt, Human
cauauguaccaugua

SEQ ID NO: 1925359 - RNA, 22 nt, Human
cauauuaccacagacauacuaa

SEQ ID NO: 1925360 - RNA, 18 nt, Human
cauauguugaauacuuuu

SEQ ID NO: 1925361 - RNA, 19 nt, Human
cauauguugaauacuuuuu

SEQ ID NO: 1925362 - RNA, 16 nt, Human
cauauguugaauacuu

SEQ ID NO: 1925363 - RNA, 17 nt, Human
cauauguugaauacuuu

SEQ ID NO: 1925364 - RNA, 21 nt, Human
cauauuauuuuauguugcaua

SEQ ID NO: 1925365 - RNA, 16 nt, Human
cauagguuuaauaauu

SEQ ID NO: 1925366 - RNA, 23 nt, Human
cauagcagagaaugaaagggccc

SEQ ID NO: 1925367 - RNA, 19 nt, Human
cauagcagcuuauucacaa

SEQ ID NO: 1925368 - RNA, 20 nt, Human
cauagcagcuuauucacaag

SEQ ID NO: 1925369 - RNA, 16 nt, Human
cauagcagauuuuaau

SEQ ID NO: 1925370 - RNA, 17 nt, Human
cauagcagauuuuaauu

SEQ ID NO: 1925371 - RNA, 18 nt, Human
cauagcagauuuuaauuu

SEQ ID NO: 1925372 - RNA, 17 nt, Human
caucugguuaggauggc

SEQ ID NO: 1925373 - RNA, 17 nt, Human
caucuguaccucugccu

SEQ ID NO: 1925374 - RNA, 22 nt, Human
caucguuuucuucacuguccuc

SEQ ID NO: 1925375 - RNA, 19 nt, Human
cauccugaggcuccacuug

SEQ ID NO: 1925376 - RNA, 18 nt, Human
cauccugaggcuccacuu

SEQ ID NO: 1925377 - RNA, 12 nt, Human
cauccugcaggc

SEQ ID NO: 1925378 - RNA, 18 nt, Human
caucagcuaaacaccacg

SEQ ID NO: 1925379 - RNA, 20 nt, Human
caucagcuaaacaccacguc

SEQ ID NO: 1925380 - RNA, 19 nt, Human
caucccaaacccuucagug

SEQ ID NO: 1925381 - RNA, 21 nt, Human
caucagcacgauuucuguuua

SEQ ID NO: 1925382 - RNA, 20 nt, Human
caucccaaacccuucagugc

SEQ ID NO: 1925383 - RNA, 13 nt, Human
caucccaacuguc

SEQ ID NO: 1925384 - RNA, 15 nt, Human
caucccacaaguggu

SEQ ID NO: 1925385 - RNA, 11 nt, Human
caucccagccc

SEQ ID NO: 1925386 - RNA, 12 nt, Human
caucccagcccc

SEQ ID NO: 1925387 - RNA, 22 nt, Human
cauccucuguacagagcccacg

SEQ ID NO: 1925388 - RNA, 23 nt, Human
caguucauauguaccauguacau

SEQ ID NO: 1925389 - RNA, 22 nt, Human
caguucauguauguucagaaga

SEQ ID NO: 1925390 - RNA, 15 nt, Human
caguucagcuugggg

SEQ ID NO: 1925391 - RNA, 14 nt, Human
caguucagcuuggg

SEQ ID NO: 1925392 - RNA, 22 nt, Human
caguuauuauauuuacaaaugg

SEQ ID NO: 1925393 - RNA, 13 nt, Human
caguucacccuga

SEQ ID NO: 1925394 - RNA, 21 nt, Human
caguuauuauauuuacaaaug

SEQ ID NO: 1925395 - RNA, 17 nt, Human
caguuauuauauuuaca

SEQ ID NO: 1925396 - RNA, 19 nt, Human
caguggugcgaucuggguu

SEQ ID NO: 1925397 - RNA, 21 nt, Human
cagugguaugaucacggcuca

SEQ ID NO: 1925398 - RNA, 20 nt, Human
caguuacucagaauucucua

SEQ ID NO: 1925399 - RNA, 23 nt, Human
cagucugauucccaagcucugcu

SEQ ID NO: 1925400 - RNA, 22 nt, Human
cagugauuaccagggacugagg

SEQ ID NO: 1925401 - RNA, 22 nt, Human
cagugcccacaggaucagucug

SEQ ID NO: 1925402 - RNA, 18 nt, Human
cagugcccacaggaucag

SEQ ID NO: 1925403 - RNA, 21 nt, Human
cagugcccacaggaucagucu

SEQ ID NO: 1925404 - RNA, 15 nt, Human
cagugcaacacugaa

SEQ ID NO: 1925405 - RNA, 18 nt, Human
cagugggagcugccuguu

SEQ ID NO: 1925406 - RNA, 17 nt, Human
cagugggagcugccugu

SEQ ID NO: 1925407 - RNA, 16 nt, Human
cagugggagcugccug

SEQ ID NO: 1925408 - RNA, 20 nt, Human
cagugguaugaucacggcuc

SEQ ID NO: 1925409 - RNA, 22 nt, Human
cagucugauucccaagcucugc

SEQ ID NO: 1925410 - RNA, 21 nt, Human
cagucugauucccaagcucug

SEQ ID NO: 1925411 - RNA, 16 nt, Human
cagucuauuugagacu

SEQ ID NO: 1925412 - RNA, 21 nt, Human
caugaaucccacccacaugug

SEQ ID NO: 1925413 - RNA, 21 nt, Human
caugaauauuuaguguucaua

SEQ ID NO: 1925414 - RNA, 16 nt, Human
caugaauuugugaagg

SEQ ID NO: 1925415 - RNA, 13 nt, Human
caugacaaagacu

SEQ ID NO: 1925416 - RNA, 15 nt, Human
caugaugcgggccag

SEQ ID NO: 1925417 - RNA, 20 nt, Human
caugaugcgggccagugcuc

SEQ ID NO: 1925418 - RNA, 14 nt, Human
caugaugcgggcca

SEQ ID NO: 1925419 - RNA, 15 nt, Human
caugauggcaacaga

SEQ ID NO: 1925420 - RNA, 19 nt, Human
caugauggcaacagaucug

SEQ ID NO: 1925421 - RNA, 15 nt, Human
caugcaaggucauuu

SEQ ID NO: 1925422 - RNA, 12 nt, Human
caugcaagguca

SEQ ID NO: 1925423 - RNA, 16 nt, Human
cauggccuaugcacau

SEQ ID NO: 1925424 - RNA, 21 nt, Human
cauggccucuucagaucucua

SEQ ID NO: 1925425 - RNA, 19 nt, Human
cauggccuaugcacauaug

SEQ ID NO: 1925426 - RNA, 17 nt, Human
cauggccuaugcacaua

SEQ ID NO: 1925427 - RNA, 22 nt, Human
cauggccucuucagaucucuaa

SEQ ID NO: 1925428 - RNA, 16 nt, Human
caugggaaggugggcg

SEQ ID NO: 1925429 - RNA, 18 nt, Human
caugggaaaggggaaguu

SEQ ID NO: 1925430 - RNA, 20 nt, Human
caugcuccuggcccacugca

SEQ ID NO: 1925431 - RNA, 17 nt, Human
caugcuccuggcccacu

SEQ ID NO: 1925432 - RNA, 14 nt, Human
caugcuccuggccc

SEQ ID NO: 1925433 - RNA, 16 nt, Human
caugcuccuggcccac

SEQ ID NO: 1925434 - RNA, 22 nt, Human
cauguaugucuuggacacugua

SEQ ID NO: 1925435 - RNA, 21 nt, Human
cauguaugucuuggacacugu

SEQ ID NO: 1925436 - RNA, 18 nt, Human
cauguaugucuuggacac

SEQ ID NO: 1925437 - RNA, 17 nt, Human
cauguaugucuuggaca

SEQ ID NO: 1925438 - RNA, 13 nt, Human
cauguaugucuug

SEQ ID NO: 1925439 - RNA, 19 nt, Human
cauguuggccaggcugguc

SEQ ID NO: 1925440 - RNA, 17 nt, Human
cauguuggccaggcugg

SEQ ID NO: 1925441 - RNA, 18 nt, Human
cauguuggccaggcuggu

SEQ ID NO: 1925442 - RNA, 18 nt, Human
cauguucuuaauucuuag

SEQ ID NO: 1925443 - RNA, 14 nt, Human
cauguucugcuuuc

SEQ ID NO: 1925444 - RNA, 21 nt, Human
cauguuacauaagauaaaugu

SEQ ID NO: 1925445 - RNA, 16 nt, Human
cauguucuuaauucuu

SEQ ID NO: 1925446 - RNA, 13 nt, Human
cauguucuuaauu

SEQ ID NO: 1925447 - RNA, 15 nt, Human
cauguccaagaagcc

SEQ ID NO: 1925448 - RNA, 16 nt, Human
cauguccaagaagccc

SEQ ID NO: 1925449 - RNA, 16 nt, Human
cauguuacauaagaua

SEQ ID NO: 1925450 - RNA, 17 nt, Human
cauguuacauaagauaa

SEQ ID NO: 1925451 - RNA, 13 nt, Human
cauuauuaucaac

SEQ ID NO: 1925452 - RNA, 17 nt, Human
cauucuccaccugccag

SEQ ID NO: 1925453 - RNA, 18 nt, Human
cauucuccaccugccagg

SEQ ID NO: 1925454 - RNA, 19 nt, Human
cauucuccaccugccaggg

SEQ ID NO: 1925455 - RNA, 21 nt, Human
cauucuccaccugccagggac

SEQ ID NO: 1925456 - RNA, 20 nt, Human
cauucuccuuguguuacuaa

SEQ ID NO: 1925457 - RNA, 14 nt, Human
ccaacucagaaggg

SEQ ID NO: 1925458 - RNA, 21 nt, Human
ccaacucaccccagccccaaa

SEQ ID NO: 1925459 - RNA, 15 nt, Human
ccaagcucugcuccu

SEQ ID NO: 1925460 - RNA, 14 nt, Human
ccaagcucugcucc

SEQ ID NO: 1925461 - RNA, 16 nt, Human
ccaagcucugcuccuc

SEQ ID NO: 1925462 - RNA, 16 nt, Human
ccaaaucauaguggcu

SEQ ID NO: 1925463 - RNA, 23 nt, Human
ccaaaucagcugcuacuacuccu

SEQ ID NO: 1925464 - RNA, 15 nt, Human
ccaaaucagcugcua

SEQ ID NO: 1925465 - RNA, 14 nt, Human
ccaacuauggccug

SEQ ID NO: 1925466 - RNA, 15 nt, Human
ccaacuauggccugu

SEQ ID NO: 1925467 - RNA, 16 nt, Human
ccaacuauggccugug

SEQ ID NO: 1925468 - RNA, 13 nt, Human
ccaacucacccca

SEQ ID NO: 1925469 - RNA, 23 nt, Human
ccaauggacuaacuugucuuugg

SEQ ID NO: 1925470 - RNA, 14 nt, Human
ccaaugggagcuca

SEQ ID NO: 1925471 - RNA, 11 nt, Human
ccaauucuuac

SEQ ID NO: 1925472 - RNA, 19 nt, Human
ccaauucgaacuuuuucca

SEQ ID NO: 1925473 - RNA, 14 nt, Human
ccaauucagacagg

SEQ ID NO: 1925474 - RNA, 16 nt, Human
ccaauucagacaggca

SEQ ID NO: 1925475 - RNA, 20 nt, Human
ccaaggagggugagugcaag

SEQ ID NO: 1925476 - RNA, 23 nt, Human
ccaaggagaugaagcaaacacau

SEQ ID NO: 1925477 - RNA, 14 nt, Human
ccaaggagaugaag

SEQ ID NO: 1925478 - RNA, 12 nt, Human
ccaaggagcugc

SEQ ID NO: 1925479 - RNA, 13 nt, Human
ccaaggagcugcu

SEQ ID NO: 1925480 - RNA, 14 nt, Human
ccaaggagcugcua

SEQ ID NO: 1925481 - RNA, 15 nt, Human
ccaaggagcugcuau

SEQ ID NO: 1925482 - RNA, 16 nt, Human
ccaaggagcugcuaua

SEQ ID NO: 1925483 - RNA, 22 nt, Human
ccaaggagcugcuauagccugg

SEQ ID NO: 1925484 - RNA, 14 nt, Human
ccaaagugcuggga

SEQ ID NO: 1925485 - RNA, 22 nt, Human
ccaaaguacacuguuucaaacu

SEQ ID NO: 1925486 - RNA, 21 nt, Human
cauuuggugguuucagaaaug

SEQ ID NO: 1925487 - RNA, 21 nt, Human
cauuuggcagggguggcugcc

SEQ ID NO: 1925488 - RNA, 23 nt, Human
cauuuuuuuuaagaaaaaggaug

SEQ ID NO: 1925489 - RNA, 14 nt, Human
ccaaaaggcagaag

SEQ ID NO: 1925490 - RNA, 14 nt, Human
ccaaaagcugcuca

SEQ ID NO: 1925491 - RNA, 23 nt, Human
ccaaaaaagcuguauuuugaaaa

SEQ ID NO: 1925492 - RNA, 22 nt, Human
ccaaaaaagcuguauuuugaaa

SEQ ID NO: 1925493 - RNA, 20 nt, Human
ccaaaaaagcuguauuuuga

SEQ ID NO: 1925494 - RNA, 18 nt, Human
cauuuaggugaggaagca

SEQ ID NO: 1925495 - RNA, 16 nt, Human
cauuuaggugaggaag

SEQ ID NO: 1925496 - RNA, 20 nt, Human
cauugggugagguaauaaac

SEQ ID NO: 1925497 - RNA, 16 nt, Human
cauuggagauguuuag

SEQ ID NO: 1925498 - RNA, 20 nt, Human
cauuggauucugagagcugu

SEQ ID NO: 1925499 - RNA, 15 nt, Human
cauuggauucugaga

SEQ ID NO: 1925500 - RNA, 19 nt, Human
cccugaagcugugcggagc

SEQ ID NO: 1925501 - RNA, 17 nt, Human
cccugaaggggccauga

SEQ ID NO: 1925502 - RNA, 14 nt, Human
cccugacaacacuc

SEQ ID NO: 1925503 - RNA, 20 nt, Human
cccugaaggccccgcccagg

SEQ ID NO: 1925504 - RNA, 22 nt, Human
cccugaaggccccgcccaggcu

SEQ ID NO: 1925505 - RNA, 16 nt, Human
cccugacaacacucau

SEQ ID NO: 1925506 - RNA, 22 nt, Human
cccugacaacacucauugaccu

SEQ ID NO: 1925507 - RNA, 20 nt, Human
cccugaauuuaaauagcuuu

SEQ ID NO: 1925508 - RNA, 17 nt, Human
cccugaagcugugcgga

SEQ ID NO: 1925509 - RNA, 14 nt, Human
cccugaaggaacca

SEQ ID NO: 1925510 - RNA, 12 nt, Human
cccugaaggccc

SEQ ID NO: 1925511 - RNA, 13 nt, Human
cccugaaggcccc

SEQ ID NO: 1925512 - RNA, 14 nt, Human
cccugaaggccccg

SEQ ID NO: 1925513 - RNA, 16 nt, Human
cccugaaggccccgcc

SEQ ID NO: 1925514 - RNA, 19 nt, Human
cccugaaggccccgcccag

SEQ ID NO: 1925515 - RNA, 18 nt, Human
cccugaaagcccugagcu

SEQ ID NO: 1925516 - RNA, 21 nt, Human
cccucgcuuggacggcugggc

SEQ ID NO: 1925517 - RNA, 23 nt, Human
cccucgcuuggacggcugggcac

SEQ ID NO: 1925518 - RNA, 17 nt, Human
cccuccuacccugcgcc

SEQ ID NO: 1925519 - RNA, 18 nt, Human
cccuccuacccugcgccc

SEQ ID NO: 1925520 - RNA, 22 nt, Human
cccucgaggcggaucuuuggac

SEQ ID NO: 1925521 - RNA, 23 nt, Human
cccucgaggcggaucuuuggaca

SEQ ID NO: 1925522 - RNA, 14 nt, Human
cccuccucucccau

SEQ ID NO: 1925523 - RNA, 13 nt, Human
cccuccucuccca

SEQ ID NO: 1925524 - RNA, 20 nt, Human
cccugcccaccuggccucug

SEQ ID NO: 1925525 - RNA, 16 nt, Human
cccugagcuuucugcu

SEQ ID NO: 1925526 - RNA, 20 nt, Human
cccugaccugugagcccagc

SEQ ID NO: 1925527 - RNA, 18 nt, Human
cccugagaucucugcagg

SEQ ID NO: 1925528 - RNA, 12 nt, Human
cccugacccugu

SEQ ID NO: 1925529 - RNA, 19 nt, Human
cccugacccuguggaagca

SEQ ID NO: 1925530 - RNA, 16 nt, Human
cccugacccuguauau

SEQ ID NO: 1925531 - RNA, 15 nt, Human
cccugacccugugga

SEQ ID NO: 1925532 - RNA, 16 nt, Human
cccugaccugugagcc

SEQ ID NO: 1925533 - RNA, 17 nt, Human
cccugaccucccucuaa

SEQ ID NO: 1925534 - RNA, 17 nt, Human
cccugcccggcugcgga

SEQ ID NO: 1925535 - RNA, 14 nt, Human
cccugcccggcugc

SEQ ID NO: 1925536 - RNA, 14 nt, Human
cccugcccuccccu

SEQ ID NO: 1925537 - RNA, 22 nt, Human
cccugcccaccuggccucugca

SEQ ID NO: 1925538 - RNA, 23 nt, Human
cccugcccccaggacugggccac

SEQ ID NO: 1925539 - RNA, 22 nt, Human
cccugcccccaggacugggcca

SEQ ID NO: 1925540 - RNA, 20 nt, Human
cccugcccccaggacugggc

SEQ ID NO: 1925541 - RNA, 18 nt, Human
cccugcccccaggacugg

SEQ ID NO: 1925542 - RNA, 17 nt, Human
cccugcccccaggacug

SEQ ID NO: 1925543 - RNA, 16 nt, Human
cccugcccccaggacu

SEQ ID NO: 1925544 - RNA, 14 nt, Human
cccugcccccagga

SEQ ID NO: 1925545 - RNA, 13 nt, Human
cccugcccccagg

SEQ ID NO: 1925546 - RNA, 13 nt, Human
cccuggccucugu

SEQ ID NO: 1925547 - RNA, 15 nt, Human
cccuggccucugugc

SEQ ID NO: 1925548 - RNA, 18 nt, Human
cccuggccucugugccuu

SEQ ID NO: 1925549 - RNA, 19 nt, Human
cccuggccucugugccuuc

SEQ ID NO: 1925550 - RNA, 21 nt, Human
cccuggccucugugccuucuu

SEQ ID NO: 1925551 - RNA, 15 nt, Human
cccugcccuccccuc

SEQ ID NO: 1925552 - RNA, 13 nt, Human
cccuggagguggc

SEQ ID NO: 1925553 - RNA, 13 nt, Human
cccuggaugcagc

SEQ ID NO: 1925554 - RNA, 17 nt, Human
cccuggaugcagccuca

SEQ ID NO: 1925555 - RNA, 21 nt, Human
cccuggaugcagccucacagu

SEQ ID NO: 1925556 - RNA, 20 nt, Human
cccuggccgaguccaagcug

SEQ ID NO: 1925557 - RNA, 14 nt, Human
ccuaaucuucugaa

SEQ ID NO: 1925558 - RNA, 21 nt, Human
ccuaauccaggcagauccagg

SEQ ID NO: 1925559 - RNA, 19 nt, Human
ccuaauccaggcagaucca

SEQ ID NO: 1925560 - RNA, 20 nt, Human
ccuaauccaggcagauccag

SEQ ID NO: 1925561 - RNA, 18 nt, Human
ccuaauccaggcagaucc

SEQ ID NO: 1925562 - RNA, 20 nt, Human
ccuagccugugccucuggga

SEQ ID NO: 1925563 - RNA, 17 nt, Human
ccuagcacuuugggagg

SEQ ID NO: 1925564 - RNA, 12 nt, Human
ccuagcagcacc

SEQ ID NO: 1925565 - RNA, 19 nt, Human
ccuagcauacguacacauu

SEQ ID NO: 1925566 - RNA, 20 nt, Human
ccuagcagcaccguucugug

SEQ ID NO: 1925567 - RNA, 21 nt, Human
ccuagcagcaccguucugugc

SEQ ID NO: 1925568 - RNA, 23 nt, Human
ccuagcagcaccguucugugcac

SEQ ID NO: 1925569 - RNA, 14 nt, Human
ccggcuccaggcuc

SEQ ID NO: 1925570 - RNA, 13 nt, Human
ccggcuccaggcu

SEQ ID NO: 1925571 - RNA, 12 nt, Human
ccggcuccaggc

SEQ ID NO: 1925572 - RNA, 15 nt, Human
ccggcuccaggcucc

SEQ ID NO: 1925573 - RNA, 14 nt, Human
ccgucuaccugagg

SEQ ID NO: 1925574 - RNA, 15 nt, Human
ccgucuaccugaggg

SEQ ID NO: 1925575 - RNA, 17 nt, Human
ccgucuaccugaggggc

SEQ ID NO: 1925576 - RNA, 12 nt, Human
ccgugaggccag

SEQ ID NO: 1925577 - RNA, 13 nt, Human
ccgugaggccaga

SEQ ID NO: 1925578 - RNA, 14 nt, Human
ccgugaggccagag

SEQ ID NO: 1925579 - RNA, 16 nt, Human
ccgugaggccagagac

SEQ ID NO: 1925580 - RNA, 20 nt, Human
ccuaacgaaguauccuucag

SEQ ID NO: 1925581 - RNA, 15 nt, Human
ccggccccugcuggu

SEQ ID NO: 1925582 - RNA, 16 nt, Human
ccggccaccugcggug

SEQ ID NO: 1925583 - RNA, 21 nt, Human
ccggcccuccuacccugcgcc

SEQ ID NO: 1925584 - RNA, 18 nt, Human
ccggcaggguccuagaaa

SEQ ID NO: 1925585 - RNA, 13 nt, Human
cccugucuaauga

SEQ ID NO: 1925586 - RNA, 23 nt, Human
cccugugauggggcccugccucc

SEQ ID NO: 1925587 - RNA, 22 nt, Human
cccugugcaaccucuuggccug

SEQ ID NO: 1925588 - RNA, 21 nt, Human
cccugugauggggcccugccu

SEQ ID NO: 1925589 - RNA, 22 nt, Human
cccugugauggggcccugccuc

SEQ ID NO: 1925590 - RNA, 12 nt, Human
ccgcccaggcuu

SEQ ID NO: 1925591 - RNA, 22 nt, Human
ccgcccagagacccaagcugcc

SEQ ID NO: 1925592 - RNA, 16 nt, Human
ccgcagacaggaccag

SEQ ID NO: 1925593 - RNA, 17 nt, Human
ccgcagacaggaccagg

SEQ ID NO: 1925594 - RNA, 15 nt, Human
cccuuccucuuucca

SEQ ID NO: 1925595 - RNA, 19 nt, Human
ccgaaagggacuuggaagc

SEQ ID NO: 1925596 - RNA, 16 nt, Human
ccgaaaacguggcugc

SEQ ID NO: 1925597 - RNA, 17 nt, Human
ccgaaaacguggcugcu

SEQ ID NO: 1925598 - RNA, 17 nt, Human
ccgaccagacaccuuga

SEQ ID NO: 1925599 - RNA, 13 nt, Human
ccgaccagacacc

SEQ ID NO: 1925600 - RNA, 18 nt, Human
ccgaccagacaccuugac

SEQ ID NO: 1925601 - RNA, 17 nt, Human
ccgaauagcugggacua

SEQ ID NO: 1925602 - RNA, 16 nt, Human
ccgaauagcugggacu

SEQ ID NO: 1925603 - RNA, 23 nt, Human
ccgaaggugaggagcuugaaacc

SEQ ID NO: 1925604 - RNA, 13 nt, Human
ccgaagucuuuug

SEQ ID NO: 1925605 - RNA, 20 nt, Human
ccucugccugaagucacaca

SEQ ID NO: 1925606 - RNA, 11 nt, Human
ccucugccuga

SEQ ID NO: 1925607 - RNA, 23 nt, Human
ccucugccucugacacacagcuc

SEQ ID NO: 1925608 - RNA, 21 nt, Human
ccucugccucugacacacagc

SEQ ID NO: 1925609 - RNA, 20 nt, Human
ccucugccucugacacacag

SEQ ID NO: 1925610 - RNA, 16 nt, Human
ccucucugcagguccc

SEQ ID NO: 1925611 - RNA, 17 nt, Human
ccucucugcaggucccu

SEQ ID NO: 1925612 - RNA, 18 nt, Human
ccucucugcaggucccua

SEQ ID NO: 1925613 - RNA, 19 nt, Human
ccucucugcaggucccuaa

SEQ ID NO: 1925614 - RNA, 12 nt, Human
ccucucucacuc

SEQ ID NO: 1925615 - RNA, 15 nt, Human
ccucuccuuccugug

SEQ ID NO: 1925616 - RNA, 13 nt, Human
ccucuccuuccug

SEQ ID NO: 1925617 - RNA, 16 nt, Human
ccuccuacccugcgcc

SEQ ID NO: 1925618 - RNA, 15 nt, Human
ccucgaacuggcugc

SEQ ID NO: 1925619 - RNA, 16 nt, Human
ccucgaacuggcugca

SEQ ID NO: 1925620 - RNA, 16 nt, Human
ccucgagguuucucaa

SEQ ID NO: 1925621 - RNA, 13 nt, Human
ccucgaauuuugu

SEQ ID NO: 1925622 - RNA, 18 nt, Human
ccucgaauuuuguuuucu

SEQ ID NO: 1925623 - RNA, 18 nt, Human
ccuccuuugugaggaagc

SEQ ID NO: 1925624 - RNA, 19 nt, Human
ccuccuuugugaggaagcc

SEQ ID NO: 1925625 - RNA, 20 nt, Human
ccuccuuugugaggaagccg

SEQ ID NO: 1925626 - RNA, 20 nt, Human
ccucccuggugagagggccg

SEQ ID NO: 1925627 - RNA, 18 nt, Human
ccucccuguuccccagag

SEQ ID NO: 1925628 - RNA, 19 nt, Human
ccucccuguuccccagaga

SEQ ID NO: 1925629 - RNA, 20 nt, Human
ccucccuguuccccagagaa

SEQ ID NO: 1925630 - RNA, 15 nt, Human
ccucagccuccugag

SEQ ID NO: 1925631 - RNA, 11 nt, Human
ccucagccugg

SEQ ID NO: 1925632 - RNA, 12 nt, Human
ccucagccuggc

SEQ ID NO: 1925633 - RNA, 13 nt, Human
ccucagccuggcc

SEQ ID NO: 1925634 - RNA, 14 nt, Human
ccucagccuggcca

SEQ ID NO: 1925635 - RNA, 19 nt, Human
ccucaggaggcaggaccuu

SEQ ID NO: 1925636 - RNA, 19 nt, Human
ccucagccuggccagacac

SEQ ID NO: 1925637 - RNA, 15 nt, Human
ccucagccuggccag

SEQ ID NO: 1925638 - RNA, 16 nt, Human
ccucagccuggccaga

SEQ ID NO: 1925639 - RNA, 17 nt, Human
ccucagccuggccagac

SEQ ID NO: 1925640 - RNA, 18 nt, Human
ccucagccuggccagaca

SEQ ID NO: 1925641 - RNA, 11 nt, Human
ccucaggcagg

SEQ ID NO: 1925642 - RNA, 17 nt, Human
ccucccaacucacccca

SEQ ID NO: 1925643 - RNA, 20 nt, Human
ccucccaacucaccccagcc

SEQ ID NO: 1925644 - RNA, 21 nt, Human
ccucccaacucaccccagccc

SEQ ID NO: 1925645 - RNA, 23 nt, Human
ccucccaacucaccccagcccca

SEQ ID NO: 1925646 - RNA, 15 nt, Human
ccucccacugggguc

SEQ ID NO: 1925647 - RNA, 13 nt, Human
ccucccacugggg

SEQ ID NO: 1925648 - RNA, 17 nt, Human
ccugaggcugggcuccc

SEQ ID NO: 1925649 - RNA, 19 nt, Human
ccugaggcugggcucccuu

SEQ ID NO: 1925650 - RNA, 21 nt, Human
ccugaggcugggcucccuucc

SEQ ID NO: 1925651 - RNA, 22 nt, Human
ccugaccugugagcccagcugg

SEQ ID NO: 1925652 - RNA, 21 nt, Human
ccucuuugcuuugcuuucugc

SEQ ID NO: 1925653 - RNA, 14 nt, Human
ccugaccugugagc

SEQ ID NO: 1925654 - RNA, 18 nt, Human
ccugaccugugagcccag

SEQ ID NO: 1925655 - RNA, 19 nt, Human
ccugaccugugagcccagc

SEQ ID NO: 1925656 - RNA, 20 nt, Human
ccugaccugugagcccagcu

SEQ ID NO: 1925657 - RNA, 21 nt, Human
ccugaccugugagcccagcug

SEQ ID NO: 1925658 - RNA, 12 nt, Human
ccugaggggccu

SEQ ID NO: 1925659 - RNA, 16 nt, Human
ccugaggggccucuua

SEQ ID NO: 1925660 - RNA, 15 nt, Human
ccugcaggcagccag

SEQ ID NO: 1925661 - RNA, 12 nt, Human
ccugcagagggc

SEQ ID NO: 1925662 - RNA, 16 nt, Human
ccugcaggcagccagg

SEQ ID NO: 1925663 - RNA, 17 nt, Human
ccugcaggcagccaggc

SEQ ID NO: 1925664 - RNA, 18 nt, Human
ccugaguuccuagccacc

SEQ ID NO: 1925665 - RNA, 14 nt, Human
ccugaguuccuagc

SEQ ID NO: 1925666 - RNA, 17 nt, Human
ccugcagagcugcgggc

SEQ ID NO: 1925667 - RNA, 14 nt, Human
ccugcagagcugcg

SEQ ID NO: 1925668 - RNA, 13 nt, Human
ccugcagagcugc

SEQ ID NO: 1925669 - RNA, 12 nt, Human
ccugcagagcug

SEQ ID NO: 1925670 - RNA, 14 nt, Human
ccugcagagggcac

SEQ ID NO: 1925671 - RNA, 23 nt, Human
ccugcaggcagccaggccacaag

SEQ ID NO: 1925672 - RNA, 18 nt, Human
ccugcaggcagccaggcc

SEQ ID NO: 1925673 - RNA, 19 nt, Human
ccugcaggcagccaggcca

SEQ ID NO: 1925674 - RNA, 20 nt, Human
ccugcaggcagccaggccac

SEQ ID NO: 1925675 - RNA, 21 nt, Human
ccugcaggcagccaggccaca

SEQ ID NO: 1925676 - RNA, 21 nt, Human
ccucugccugaagucacacag

SEQ ID NO: 1925677 - RNA, 13 nt, Human
ccucugcucccca

SEQ ID NO: 1925678 - RNA, 16 nt, Human
ccucuuugagugaagc

SEQ ID NO: 1925679 - RNA, 11 nt, Human
ccucuuugcuu

SEQ ID NO: 1925680 - RNA, 19 nt, Human
ccucuuuggucuacacugu

SEQ ID NO: 1925681 - RNA, 13 nt, Human
ccucuuugcuuug

SEQ ID NO: 1925682 - RNA, 14 nt, Human
ccucuuugcuuugc

SEQ ID NO: 1925683 - RNA, 15 nt, Human
ccucuuugcuuugcu

SEQ ID NO: 1925684 - RNA, 17 nt, Human
ccucuuugcuuugcuuu

SEQ ID NO: 1925685 - RNA, 15 nt, Human
ccucuuggcugccuu

SEQ ID NO: 1925686 - RNA, 13 nt, Human
ccucuuggccuga

SEQ ID NO: 1925687 - RNA, 15 nt, Human
ccucuucuggcucaa

SEQ ID NO: 1925688 - RNA, 22 nt, Human
ccugcugcaguugccagucacc

SEQ ID NO: 1925689 - RNA, 11 nt, Human
ccugcugcagu

SEQ ID NO: 1925690 - RNA, 12 nt, Human
ccugcugcaguu

SEQ ID NO: 1925691 - RNA, 16 nt, Human
ccugcugcaguugcca

SEQ ID NO: 1925692 - RNA, 20 nt, Human
ccugccucucugcagguccc

SEQ ID NO: 1925693 - RNA, 21 nt, Human
ccugccucucugcaggucccu

SEQ ID NO: 1925694 - RNA, 15 nt, Human
ccugccucuucucua

SEQ ID NO: 1925695 - RNA, 17 nt, Human
ccugccucucugcaggu

SEQ ID NO: 1925696 - RNA, 23 nt, Human
ccugccuccuuugugaggaagcc

SEQ ID NO: 1925697 - RNA, 21 nt, Human
ccugccuccuuugugaggaag

SEQ ID NO: 1925698 - RNA, 22 nt, Human
ccugccuccuuugugaggaagc

SEQ ID NO: 1925699 - RNA, 13 nt, Human
ccugccuccuuug

SEQ ID NO: 1925700 - RNA, 15 nt, Human
ccugccuccuuugug

SEQ ID NO: 1925701 - RNA, 19 nt, Human
ccugccuccuuugugagga

SEQ ID NO: 1925702 - RNA, 20 nt, Human
ccugccuccuuugugaggaa

SEQ ID NO: 1925703 - RNA, 22 nt, Human
ccagagagccuggugcugcugc

SEQ ID NO: 1925704 - RNA, 21 nt, Human
ccagagagccuggugcugcug

SEQ ID NO: 1925705 - RNA, 13 nt, Human
ccagagagggugg

SEQ ID NO: 1925706 - RNA, 14 nt, Human
ccagaugcaccagc

SEQ ID NO: 1925707 - RNA, 13 nt, Human
ccagaugcaccag

SEQ ID NO: 1925708 - RNA, 23 nt, Human
ccagaucuacuugguugucaagu

SEQ ID NO: 1925709 - RNA, 16 nt, Human
ccagagacacaagccu

SEQ ID NO: 1925710 - RNA, 18 nt, Human
ccagagacacaagccuuc

SEQ ID NO: 1925711 - RNA, 17 nt, Human
ccagagacauacuugaa

SEQ ID NO: 1925712 - RNA, 18 nt, Human
ccagagacauacuugaag

SEQ ID NO: 1925713 - RNA, 20 nt, Human
ccagagacauacuugaaggg

SEQ ID NO: 1925714 - RNA, 22 nt, Human
ccagagacauacuugaagggcc

SEQ ID NO: 1925715 - RNA, 23 nt, Human
ccagagacauacuugaagggcca

SEQ ID NO: 1925716 - RNA, 15 nt, Human
ccagacuuccuugag

SEQ ID NO: 1925717 - RNA, 13 nt, Human
ccagacuuccuug

SEQ ID NO: 1925718 - RNA, 14 nt, Human
ccagacuuccuuga

SEQ ID NO: 1925719 - RNA, 20 nt, Human
ccagacuccugacugucucc

SEQ ID NO: 1925720 - RNA, 21 nt, Human
ccagacuccugacugucuccc

SEQ ID NO: 1925721 - RNA, 16 nt, Human
ccagagaaaggggagc

SEQ ID NO: 1925722 - RNA, 16 nt, Human
ccagagaaagcgcaga

SEQ ID NO: 1925723 - RNA, 19 nt, Human
ccagagaaaggggagccca

SEQ ID NO: 1925724 - RNA, 20 nt, Human
ccagagaaaggggagcccac

SEQ ID NO: 1925725 - RNA, 23 nt, Human
ccagagaaaggggagcccacugu

SEQ ID NO: 1925726 - RNA, 12 nt, Human
ccagagaagcua

SEQ ID NO: 1925727 - RNA, 15 nt, Human
ccagacggcuccacu

SEQ ID NO: 1925728 - RNA, 20 nt, Human
ccagacggcuccacuaggac

SEQ ID NO: 1925729 - RNA, 18 nt, Human
ccagacuccaccaagccu

SEQ ID NO: 1925730 - RNA, 14 nt, Human
ccagacuccaccaa

SEQ ID NO: 1925731 - RNA, 24 nt, Human
ccagaccugauccuggaggcccag

SEQ ID NO: 1925732 - RNA, 14 nt, Human
ccagaccugcagac

SEQ ID NO: 1925733 - RNA, 16 nt, Human
ccagaccugcagacgc

SEQ ID NO: 1925734 - RNA, 20 nt, Human
ccagaccugcagacgcccag

SEQ ID NO: 1925735 - RNA, 21 nt, Human
ccagaccugcagacgcccaga

SEQ ID NO: 1925736 - RNA, 20 nt, Human
ccagaccuguuagcagacag

SEQ ID NO: 1925737 - RNA, 21 nt, Human
ccagaccuguuagcagacagg

SEQ ID NO: 1925738 - RNA, 23 nt, Human
ccagaccuguuagcagacaggcc

SEQ ID NO: 1925739 - RNA, 17 nt, Human
ccagacccggcugcgug

SEQ ID NO: 1925740 - RNA, 15 nt, Human
ccagaccugauccug

SEQ ID NO: 1925741 - RNA, 16 nt, Human
ccagaccugauccugg

SEQ ID NO: 1925742 - RNA, 17 nt, Human
ccagaccugauccugga

SEQ ID NO: 1925743 - RNA, 18 nt, Human
ccagaccugauccuggag

SEQ ID NO: 1925744 - RNA, 19 nt, Human
ccagaccugauccuggagg

SEQ ID NO: 1925745 - RNA, 20 nt, Human
ccagaccugauccuggaggc

SEQ ID NO: 1925746 - RNA, 21 nt, Human
ccagaccugauccuggaggcc

SEQ ID NO: 1925747 - RNA, 23 nt, Human
ccagaccugauccuggaggccca

SEQ ID NO: 1925748 - RNA, 22 nt, Human
ccacuuuuguucuugguuugua

SEQ ID NO: 1925749 - RNA, 21 nt, Human
ccacuuuuguucuugguuugu

SEQ ID NO: 1925750 - RNA, 15 nt, Human
ccacuuuuguucuug

SEQ ID NO: 1925751 - RNA, 14 nt, Human
ccacuuuuguucuu

SEQ ID NO: 1925752 - RNA, 19 nt, Human
ccacuuggucugugagaug

SEQ ID NO: 1925753 - RNA, 17 nt, Human
ccacuuggucugugaga

SEQ ID NO: 1925754 - RNA, 16 nt, Human
ccacuuggucugugag

SEQ ID NO: 1925755 - RNA, 15 nt, Human
ccacuuggucuguga

SEQ ID NO: 1925756 - RNA, 22 nt, Human
ccacuuggucugugagaugcua

SEQ ID NO: 1925757 - RNA, 20 nt, Human
ccacuuggucugugagaugc

SEQ ID NO: 1925758 - RNA, 20 nt, Human
ccacuuucuagccagaggag

SEQ ID NO: 1925759 - RNA, 18 nt, Human
ccacuuucuagccagagg

SEQ ID NO: 1925760 - RNA, 19 nt, Human
ccacuuucuagccagagga

SEQ ID NO: 1925761 - RNA, 13 nt, Human
ccacuuucuagcc

SEQ ID NO: 1925762 - RNA, 17 nt, Human
ccacugacugcagggac

SEQ ID NO: 1925763 - RNA, 16 nt, Human
ccacugacugcaggga

SEQ ID NO: 1925764 - RNA, 13 nt, Human
ccacugaccagaa

SEQ ID NO: 1925765 - RNA, 19 nt, Human
ccacugcaccgggccacag

SEQ ID NO: 1925766 - RNA, 17 nt, Human
ccacugcaccgggccac

SEQ ID NO: 1925767 - RNA, 14 nt, Human
ccacugcaccgggc

SEQ ID NO: 1925768 - RNA, 13 nt, Human
ccacugcaccggg

SEQ ID NO: 1925769 - RNA, 20 nt, Human
ccacugcacuauagccuagg

SEQ ID NO: 1925770 - RNA, 19 nt, Human
ccacugcacuauagccuag

SEQ ID NO: 1925771 - RNA, 18 nt, Human
ccacugcacuccagccug

SEQ ID NO: 1925772 - RNA, 23 nt, Human
ccacuucauucuugaaagcugug

SEQ ID NO: 1925773 - RNA, 12 nt, Human
ccacuuggucug

SEQ ID NO: 1925774 - RNA, 15 nt, Human
ccacuucuggguggg

SEQ ID NO: 1925775 - RNA, 19 nt, Human
ccagucaccccggccaccu

SEQ ID NO: 1925776 - RNA, 17 nt, Human
ccagucaccccggccac

SEQ ID NO: 1925777 - RNA, 18 nt, Human
ccagucaccccggccacc

SEQ ID NO: 1925778 - RNA, 13 nt, Human
ccaguccuuccac

SEQ ID NO: 1925779 - RNA, 17 nt, Human
ccaguccuuccaccucg

SEQ ID NO: 1925780 - RNA, 21 nt, Human
ccaggcugaccacagcacagc

SEQ ID NO: 1925781 - RNA, 23 nt, Human
ccaggcugaccacagcacagcca

SEQ ID NO: 1925782 - RNA, 20 nt, Human
ccaggggugggacacccugu

SEQ ID NO: 1925783 - RNA, 21 nt, Human
ccaggggugggacacccugug

SEQ ID NO: 1925784 - RNA, 22 nt, Human
ccaggggugggacacccuguga

SEQ ID NO: 1925785 - RNA, 13 nt, Human
ccaguaucuugaa

SEQ ID NO: 1925786 - RNA, 19 nt, Human
ccaguaucuugaagacuuu

SEQ ID NO: 1925787 - RNA, 22 nt, Human
ccaguaucuugaagacuuuucu

SEQ ID NO: 1925788 - RNA, 16 nt, Human
ccagucaccccggcca

SEQ ID NO: 1925789 - RNA, 19 nt, Human
ccaggcagggccaacccuu

SEQ ID NO: 1925790 - RNA, 23 nt, Human
ccaggcagggccaacccuucucc

SEQ ID NO: 1925791 - RNA, 13 nt, Human
ccaggcugaagca

SEQ ID NO: 1925792 - RNA, 20 nt, Human
ccaggcugaagcagguuccc

SEQ ID NO: 1925793 - RNA, 15 nt, Human
ccaggcugaccacag

SEQ ID NO: 1925794 - RNA, 16 nt, Human
ccaggcugaccacagc

SEQ ID NO: 1925795 - RNA, 17 nt, Human
ccaggcugaccacagca

SEQ ID NO: 1925796 - RNA, 18 nt, Human
ccaggcugaccacagcac

SEQ ID NO: 1925797 - RNA, 19 nt, Human
ccaggcugaccacagcaca

SEQ ID NO: 1925798 - RNA, 20 nt, Human
ccaggcugaccacagcacag

SEQ ID NO: 1925799 - RNA, 15 nt, Human
ccaggaguucugcuc

SEQ ID NO: 1925800 - RNA, 16 nt, Human
ccaggaguucugcuca

SEQ ID NO: 1925801 - RNA, 17 nt, Human
ccaggaguucugcucau

SEQ ID NO: 1925802 - RNA, 15 nt, Human
ccagcggacaguggc

SEQ ID NO: 1925803 - RNA, 16 nt, Human
ccagcggacaguggca

SEQ ID NO: 1925804 - RNA, 17 nt, Human
ccagcggacaguggcag

SEQ ID NO: 1925805 - RNA, 18 nt, Human
ccagcggacaguggcagg

SEQ ID NO: 1925806 - RNA, 19 nt, Human
ccagcggacaguggcagga

SEQ ID NO: 1925807 - RNA, 21 nt, Human
ccagcggacaguggcaggaca

SEQ ID NO: 1925808 - RNA, 17 nt, Human
ccagcgggaauggcagc

SEQ ID NO: 1925809 - RNA, 23 nt, Human
ccagcgggaauggcagcugccac

SEQ ID NO: 1925810 - RNA, 20 nt, Human
ccaggaaaggcuccaggagc

SEQ ID NO: 1925811 - RNA, 17 nt, Human
ccagcuuguuauuuaua

SEQ ID NO: 1925812 - RNA, 15 nt, Human
ccagcuuguuauuua

SEQ ID NO: 1925813 - RNA, 16 nt, Human
ccagcuuguuauuuau

SEQ ID NO: 1925814 - RNA, 17 nt, Human
ccaggaaaggcuccagg

SEQ ID NO: 1925815 - RNA, 18 nt, Human
ccaggaaaggcuccagga

SEQ ID NO: 1925816 - RNA, 19 nt, Human
ccaggaaaggcuccaggag

SEQ ID NO: 1925817 - RNA, 21 nt, Human
ccagcgagcccugguggcagu

SEQ ID NO: 1925818 - RNA, 18 nt, Human
ccagccccuucugaccca

SEQ ID NO: 1925819 - RNA, 18 nt, Human
ccagccccuggaugcagc

SEQ ID NO: 1925820 - RNA, 15 nt, Human
ccagccccuucugac

SEQ ID NO: 1925821 - RNA, 16 nt, Human
ccagccccuucugacc

SEQ ID NO: 1925822 - RNA, 17 nt, Human
ccagccccuucugaccc

SEQ ID NO: 1925823 - RNA, 13 nt, Human
ccagcagccugga

SEQ ID NO: 1925824 - RNA, 23 nt, Human
ccagccccauccucuguacagag

SEQ ID NO: 1925825 - RNA, 13 nt, Human
ccagccccuggau

SEQ ID NO: 1925826 - RNA, 14 nt, Human
ccagccccuggaug

SEQ ID NO: 1925827 - RNA, 15 nt, Human
ccagccccuggaugc

SEQ ID NO: 1925828 - RNA, 22 nt, Human
ccagcagaaaugccuuacccuc

SEQ ID NO: 1925829 - RNA, 17 nt, Human
ccagcagaaaugccuua

SEQ ID NO: 1925830 - RNA, 16 nt, Human
ccagcagaaaugccuu

SEQ ID NO: 1925831 - RNA, 11 nt, Human
ccagcagccug

SEQ ID NO: 1925832 - RNA, 12 nt, Human
ccagcagccugg

SEQ ID NO: 1925833 - RNA, 20 nt, Human
cccauccagucucccaacuu

SEQ ID NO: 1925834 - RNA, 13 nt, Human
cccauccagggcc

SEQ ID NO: 1925835 - RNA, 14 nt, Human
cccauccucuguac

SEQ ID NO: 1925836 - RNA, 20 nt, Human
cccaggcuggcgugcagugg

SEQ ID NO: 1925837 - RNA, 19 nt, Human
cccaggcuggcgugcagug

SEQ ID NO: 1925838 - RNA, 18 nt, Human
cccaggcuggcgugcagu

SEQ ID NO: 1925839 - RNA, 17 nt, Human
cccagcugggucaggca

SEQ ID NO: 1925840 - RNA, 19 nt, Human
cccagcugggucaggcagg

SEQ ID NO: 1925841 - RNA, 22 nt, Human
cccagcuggggccaggcugggu

SEQ ID NO: 1925842 - RNA, 23 nt, Human
cccagcuggggccaggcuggguc

SEQ ID NO: 1925843 - RNA, 20 nt, Human
cccauccucuguacagagcc

SEQ ID NO: 1925844 - RNA, 15 nt, Human
cccauccucuguaca

SEQ ID NO: 1925845 - RNA, 19 nt, Human
cccauccucuguacagagc

SEQ ID NO: 1925846 - RNA, 19 nt, Human
cccagcccacuucugccau

SEQ ID NO: 1925847 - RNA, 11 nt, Human
cccagcccaga

SEQ ID NO: 1925848 - RNA, 12 nt, Human
cccagcccagag

SEQ ID NO: 1925849 - RNA, 13 nt, Human
cccagcccagaga

SEQ ID NO: 1925850 - RNA, 14 nt, Human
cccagcccagagac

SEQ ID NO: 1925851 - RNA, 15 nt, Human
cccagcccagagaca

SEQ ID NO: 1925852 - RNA, 21 nt, Human
cccagccccaaaacucuccuc

SEQ ID NO: 1925853 - RNA, 16 nt, Human
cccagcccagagacau

SEQ ID NO: 1925854 - RNA, 23 nt, Human
cccagccccaaaacucuccucug

SEQ ID NO: 1925855 - RNA, 20 nt, Human
cccagcuggggccaggcugg

SEQ ID NO: 1925856 - RNA, 21 nt, Human
ccccaaaacucuccucugcug

SEQ ID NO: 1925857 - RNA, 20 nt, Human
ccccaaaacucuccucugcu

SEQ ID NO: 1925858 - RNA, 18 nt, Human
ccccagcaggugcugacu

SEQ ID NO: 1925859 - RNA, 18 nt, Human
ccccaaaacucuccucug

SEQ ID NO: 1925860 - RNA, 14 nt, Human
cccauugucccucu

SEQ ID NO: 1925861 - RNA, 14 nt, Human
cccauucuuuugua

SEQ ID NO: 1925862 - RNA, 17 nt, Human
cccauucuuuuguaauu

SEQ ID NO: 1925863 - RNA, 20 nt, Human
cccauucuuuuguaauuuaa

SEQ ID NO: 1925864 - RNA, 21 nt, Human
cccauucuuuuguaauuuaaa

SEQ ID NO: 1925865 - RNA, 22 nt, Human
cccauucuuuuguaauuuaaau

SEQ ID NO: 1925866 - RNA, 21 nt, Human
ccccauucugccugcccaggc

SEQ ID NO: 1925867 - RNA, 14 nt, Human
ccccagccccaucc

SEQ ID NO: 1925868 - RNA, 14 nt, Human
ccccagccccaaaa

SEQ ID NO: 1925869 - RNA, 10 nt, Human
ccccagcccc

SEQ ID NO: 1925870 - RNA, 12 nt, Human
ccccagccccaa

SEQ ID NO: 1925871 - RNA, 14 nt, Human
ccccggccaccugc

SEQ ID NO: 1925872 - RNA, 18 nt, Human
ccccggccaccugcggug

SEQ ID NO: 1925873 - RNA, 13 nt, Human
ccccggccaccug

SEQ ID NO: 1925874 - RNA, 14 nt, Human
ccccgcccaggcuu

SEQ ID NO: 1925875 - RNA, 21 nt, Human
ccccgcccccugcccuccccu

SEQ ID NO: 1925876 - RNA, 13 nt, Human
ccccgcccccugc

SEQ ID NO: 1925877 - RNA, 17 nt, Human
ccccgcccccugcccuc

SEQ ID NO: 1925878 - RNA, 18 nt, Human
ccccgcccccugcccucc

SEQ ID NO: 1925879 - RNA, 12 nt, Human
ccccgcccaggc

SEQ ID NO: 1925880 - RNA, 16 nt, Human
ccccgcauccccugcc

SEQ ID NO: 1925881 - RNA, 17 nt, Human
ccccgcauccccugccu

SEQ ID NO: 1925882 - RNA, 19 nt, Human
ccccgcauccccugccucc

SEQ ID NO: 1925883 - RNA, 14 nt, Human
cccccuuccaugga

SEQ ID NO: 1925884 - RNA, 11 nt, Human
cccccuuccac

SEQ ID NO: 1925885 - RNA, 15 nt, Human
ccccauuguggucac

SEQ ID NO: 1925886 - RNA, 15 nt, Human
ccccauucuuuugua

SEQ ID NO: 1925887 - RNA, 14 nt, Human
cccaagcagagaag

SEQ ID NO: 1925888 - RNA, 17 nt, Human
cccaagcucugcuccuc

SEQ ID NO: 1925889 - RNA, 12 nt, Human
cccaagcucaga

SEQ ID NO: 1925890 - RNA, 14 nt, Human
cccaagcuuagaac

SEQ ID NO: 1925891 - RNA, 18 nt, Human
cccacccaagggccuggc

SEQ ID NO: 1925892 - RNA, 15 nt, Human
cccacccaagggccu

SEQ ID NO: 1925893 - RNA, 22 nt, Human
ccauuguggucacaggaaguag

SEQ ID NO: 1925894 - RNA, 15 nt, Human
ccauugucccucugc

SEQ ID NO: 1925895 - RNA, 17 nt, Human
ccauugucccucugccc

SEQ ID NO: 1925896 - RNA, 19 nt, Human
ccauugucccucugcccca

SEQ ID NO: 1925897 - RNA, 22 nt, Human
ccauugucccucugccccaucc

SEQ ID NO: 1925898 - RNA, 13 nt, Human
ccauugguguuga

SEQ ID NO: 1925899 - RNA, 20 nt, Human
cccaacucuccccugaccug

SEQ ID NO: 1925900 - RNA, 15 nt, Human
cccaacucuccccug

SEQ ID NO: 1925901 - RNA, 11 nt, Human
cccaacugucu

SEQ ID NO: 1925902 - RNA, 15 nt, Human
cccaacugucuuuuu

SEQ ID NO: 1925903 - RNA, 13 nt, Human
cccaacugucuuu

SEQ ID NO: 1925904 - RNA, 15 nt, Human
ccauuuaaaaacagg

SEQ ID NO: 1925905 - RNA, 18 nt, Human
cccacuguacuugcucuu

SEQ ID NO: 1925906 - RNA, 19 nt, Human
cccacuguacuugcucuug

SEQ ID NO: 1925907 - RNA, 23 nt, Human
cccacuguacuugcucuugaugc

SEQ ID NO: 1925908 - RNA, 15 nt, Human
cccaccgcagacagg

SEQ ID NO: 1925909 - RNA, 18 nt, Human
cccaccgcagacaggacc

SEQ ID NO: 1925910 - RNA, 18 nt, Human
cccacccuggugggccaa

SEQ ID NO: 1925911 - RNA, 22 nt, Human
cccacuguccugggccugcaga

SEQ ID NO: 1925912 - RNA, 15 nt, Human
cccacuguccugggc

SEQ ID NO: 1925913 - RNA, 16 nt, Human
cccacuguccugggcc

SEQ ID NO: 1925914 - RNA, 13 nt, Human
ccaugagccucag

SEQ ID NO: 1925915 - RNA, 16 nt, Human
ccaugaggaacaaggc

SEQ ID NO: 1925916 - RNA, 17 nt, Human
ccaugaggaacaaggca

SEQ ID NO: 1925917 - RNA, 18 nt, Human
ccaugaggaacaaggcaa

SEQ ID NO: 1925918 - RNA, 21 nt, Human
ccaugggcacaaagggcccag

SEQ ID NO: 1925919 - RNA, 23 nt, Human
ccaugagaugauacauccaaagc

SEQ ID NO: 1925920 - RNA, 20 nt, Human
ccaugagauagcauuagcug

SEQ ID NO: 1925921 - RNA, 13 nt, Human
ccaugucugcauu

SEQ ID NO: 1925922 - RNA, 21 nt, Human
ccaugugaaaaggcaaaaagc

SEQ ID NO: 1925923 - RNA, 17 nt, Human
ccaugggccuccugugu

SEQ ID NO: 1925924 - RNA, 15 nt, Human
cgggcccagaggagc

SEQ ID NO: 1925925 - RNA, 14 nt, Human
cgggcccagaggag

SEQ ID NO: 1925926 - RNA, 18 nt, Human
cgggccagugcuccagcc

SEQ ID NO: 1925927 - RNA, 14 nt, Human
cgggccagugcucc

SEQ ID NO: 1925928 - RNA, 19 nt, Human
cgggcucagcaaaagaugc

SEQ ID NO: 1925929 - RNA, 12 nt, Human
cgggcucugccu

SEQ ID NO: 1925930 - RNA, 13 nt, Human
cgggcucugccuc

SEQ ID NO: 1925931 - RNA, 22 nt, Human
cguacacauuuuauuuuauuau

SEQ ID NO: 1925932 - RNA, 20 nt, Human
cgguggcucacgccuguaau

SEQ ID NO: 1925933 - RNA, 15 nt, Human
cggugggcacccacc

SEQ ID NO: 1925934 - RNA, 18 nt, Human
cggugggcacccacccug

SEQ ID NO: 1925935 - RNA, 12 nt, Human
cgggcugugccc

SEQ ID NO: 1925936 - RNA, 20 nt, Human
cgguggcuagucaagcuccu

SEQ ID NO: 1925937 - RNA, 21 nt, Human
cgguggcuagucaagcuccuc

SEQ ID NO: 1925938 - RNA, 22 nt, Human
cgguggcuagucaagcuccucc

SEQ ID NO: 1925939 - RNA, 17 nt, Human
cguaaagcuagaaauga

SEQ ID NO: 1925940 - RNA, 19 nt, Human
cggugggcacccacccugg

SEQ ID NO: 1925941 - RNA, 23 nt, Human
cggugggcacccacccugggacc

SEQ ID NO: 1925942 - RNA, 23 nt, Human
cggagucccaccuuggcugcagg

SEQ ID NO: 1925943 - RNA, 22 nt, Human
cggagucccaccuuggcugcag

SEQ ID NO: 1925944 - RNA, 21 nt, Human
cggagucccaccuuggcugca

SEQ ID NO: 1925945 - RNA, 17 nt, Human
cggagggauuccccuaa

SEQ ID NO: 1925946 - RNA, 17 nt, Human
cggagacggagucccac

SEQ ID NO: 1925947 - RNA, 20 nt, Human
cggagacggagucccaccuu

SEQ ID NO: 1925948 - RNA, 15 nt, Human
cgcaguggcccugag

SEQ ID NO: 1925949 - RNA, 17 nt, Human
cgcagugugcacuaagg

SEQ ID NO: 1925950 - RNA, 22 nt, Human
cgcagugugcacuaaggggccc

SEQ ID NO: 1925951 - RNA, 23 nt, Human
cgcagugugcacuaaggggcccg

SEQ ID NO: 1925952 - RNA, 14 nt, Human
cgccacagcccagc

SEQ ID NO: 1925953 - RNA, 21 nt, Human
cgccacagcccagccacggac

SEQ ID NO: 1925954 - RNA, 20 nt, Human
ccuuuucgcaggauucuucc

SEQ ID NO: 1925955 - RNA, 19 nt, Human
cgcugccccuggcagcccc

SEQ ID NO: 1925956 - RNA, 20 nt, Human
cgcugccccuggcagccccu

SEQ ID NO: 1925957 - RNA, 19 nt, Human
cgcucuguugcccaggcug

SEQ ID NO: 1925958 - RNA, 22 nt, Human
cgcucuguugcccaggcuggag

SEQ ID NO: 1925959 - RNA, 18 nt, Human
cgcuggagugcagugagc

SEQ ID NO: 1925960 - RNA, 17 nt, Human
cgcuggagugcagugag

SEQ ID NO: 1925961 - RNA, 20 nt, Human
cuaagaaauaugcacaauag

SEQ ID NO: 1925962 - RNA, 22 nt, Human
cuaagaaagcccuuaggaagaa

SEQ ID NO: 1925963 - RNA, 16 nt, Human
cuaacuuuccuucauu

SEQ ID NO: 1925964 - RNA, 14 nt, Human
cuaagaaccuggaa

SEQ ID NO: 1925965 - RNA, 15 nt, Human
cuaagaaccuggaac

SEQ ID NO: 1925966 - RNA, 16 nt, Human
cuaagaaccuggaacu

SEQ ID NO: 1925967 - RNA, 14 nt, Human
cuaacuugucuuug

SEQ ID NO: 1925968 - RNA, 22 nt, Human
cuaacuugucuuuggacccuga

SEQ ID NO: 1925969 - RNA, 15 nt, Human
cuaaaguaugaagca

SEQ ID NO: 1925970 - RNA, 19 nt, Human
cuaaagguguugucccuuc

SEQ ID NO: 1925971 - RNA, 20 nt, Human
cuaaagguguugucccuucu

SEQ ID NO: 1925972 - RNA, 23 nt, Human
cuaaaguaaaaacaaagaaauua

SEQ ID NO: 1925973 - RNA, 19 nt, Human
cuaaaguguauuuuuuuac

SEQ ID NO: 1925974 - RNA, 20 nt, Human
cuaacgaaguauccuucagc

SEQ ID NO: 1925975 - RNA, 15 nt, Human
cgugagugcagaccc

SEQ ID NO: 1925976 - RNA, 16 nt, Human
cgugaggccagagaca

SEQ ID NO: 1925977 - RNA, 14 nt, Human
cgugaucaaagcca

SEQ ID NO: 1925978 - RNA, 19 nt, Human
cgugaguccuggcauggga

SEQ ID NO: 1925979 - RNA, 18 nt, Human
cgugaguccuggcauggg

SEQ ID NO: 1925980 - RNA, 15 nt, Human
cguguuaugacucca

SEQ ID NO: 1925981 - RNA, 18 nt, Human
cgugaucaaagccacacu

SEQ ID NO: 1925982 - RNA, 21 nt, Human
cgugaucaaagccacacucug

SEQ ID NO: 1925983 - RNA, 19 nt, Human
cguguuaugacuccagaau

SEQ ID NO: 1925984 - RNA, 14 nt, Human
cuaaagcagccagc

SEQ ID NO: 1925985 - RNA, 11 nt, Human
cuaaagcugcc

SEQ ID NO: 1925986 - RNA, 15 nt, Human
cgugacaacacuugu

SEQ ID NO: 1925987 - RNA, 14 nt, Human
cgugacaacacuug

SEQ ID NO: 1925988 - RNA, 20 nt, Human
cgugagccacugcaccgggc

SEQ ID NO: 1925989 - RNA, 15 nt, Human
cgugagccacugcac

SEQ ID NO: 1925990 - RNA, 14 nt, Human
cgugagccacugca

SEQ ID NO: 1925991 - RNA, 14 nt, Human
cgugaggccagaga

SEQ ID NO: 1925992 - RNA, 22 nt, Human
cgugagccacugcaccgggcca

SEQ ID NO: 1925993 - RNA, 23 nt, Human
cuaauaaaauaucauucagcaac

SEQ ID NO: 1925994 - RNA, 22 nt, Human
cuaauaaaauaucauucagcaa

SEQ ID NO: 1925995 - RNA, 21 nt, Human
cuaauaaaauaucauucagca

SEQ ID NO: 1925996 - RNA, 20 nt, Human
cuaauaaaauaucauucagc

SEQ ID NO: 1925997 - RNA, 19 nt, Human
cuaauaaaauaucauucag

SEQ ID NO: 1925998 - RNA, 18 nt, Human
cuaauaaaauaucauuca

SEQ ID NO: 1925999 - RNA, 17 nt, Human
cuaauaaaauaucauuc

SEQ ID NO: 1926000 - RNA, 16 nt, Human
cuaauaaaauaucauu

SEQ ID NO: 1926001 - RNA, 15 nt, Human
cuaauaaaauaucau

SEQ ID NO: 1926002 - RNA, 14 nt, Human
cuaauaaaauauca

SEQ ID NO: 1926003 - RNA, 13 nt, Human
cuaauaaaauauc

SEQ ID NO: 1926004 - RNA, 20 nt, Human
cuaauaaaauuuaaaagucu

SEQ ID NO: 1926005 - RNA, 12 nt, Human
cuaauuugcauu

SEQ ID NO: 1926006 - RNA, 13 nt, Human
cuaauuugcauua

SEQ ID NO: 1926007 - RNA, 14 nt, Human
cuaauuugcauuaa

SEQ ID NO: 1926008 - RNA, 19 nt, Human
cuacaaaaagcauaaaaau

SEQ ID NO: 1926009 - RNA, 19 nt, Human
cuaauuugcauuaaauuca

SEQ ID NO: 1926010 - RNA, 21 nt, Human
cuaauuugcauuaaauucaca

SEQ ID NO: 1926011 - RNA, 22 nt, Human
cuaauuugcauuaaauucacaa

SEQ ID NO: 1926012 - RNA, 14 nt, Human
cuaaguuuuuaugg

SEQ ID NO: 1926013 - RNA, 17 nt, Human
cuaagaauucaaacugg

SEQ ID NO: 1926014 - RNA, 23 nt, Human
ccuuaggccuuccucucuccaga

SEQ ID NO: 1926015 - RNA, 13 nt, Human
ccuuaggccuucc

SEQ ID NO: 1926016 - RNA, 14 nt, Human
ccuuaggccuuccu

SEQ ID NO: 1926017 - RNA, 15 nt, Human
ccuuaggccuuccuc

SEQ ID NO: 1926018 - RNA, 12 nt, Human
ccuuauggaaca

SEQ ID NO: 1926019 - RNA, 16 nt, Human
ccuuaucuccaagacc

SEQ ID NO: 1926020 - RNA, 22 nt, Human
ccuuaucuccaagaccagagau

SEQ ID NO: 1926021 - RNA, 22 nt, Human
ccuuauggaacacucugagacu

SEQ ID NO: 1926022 - RNA, 19 nt, Human
ccuuaugcuucuuucaaau

SEQ ID NO: 1926023 - RNA, 19 nt, Human
ccuuauggaacacucugag

SEQ ID NO: 1926024 - RNA, 20 nt, Human
ccuuauggaacacucugaga

SEQ ID NO: 1926025 - RNA, 14 nt, Human
ccuuauggaacacu

SEQ ID NO: 1926026 - RNA, 16 nt, Human
ccuuauggaacacucu

SEQ ID NO: 1926027 - RNA, 17 nt, Human
ccuuauggaacacucug

SEQ ID NO: 1926028 - RNA, 18 nt, Human
ccuuauggaacacucuga

SEQ ID NO: 1926029 - RNA, 12 nt, Human
ccuucccaccuc

SEQ ID NO: 1926030 - RNA, 14 nt, Human
ccuucccaccucuc

SEQ ID NO: 1926031 - RNA, 19 nt, Human
ccuucccaccucucucacu

SEQ ID NO: 1926032 - RNA, 19 nt, Human
ccuguucagcuccagcuca

SEQ ID NO: 1926033 - RNA, 16 nt, Human
ccuguucagcuccagc

SEQ ID NO: 1926034 - RNA, 15 nt, Human
ccuguucagcuccag

SEQ ID NO: 1926035 - RNA, 14 nt, Human
ccuguucagcucca

SEQ ID NO: 1926036 - RNA, 21 nt, Human
ccuguucagcuccagcucacc

SEQ ID NO: 1926037 - RNA, 20 nt, Human
ccuguucagcuccagcucac

SEQ ID NO: 1926038 - RNA, 23 nt, Human
ccuguucagcuccagcucaccag

SEQ ID NO: 1926039 - RNA, 17 nt, Human
ccuguugacacaggucu

SEQ ID NO: 1926040 - RNA, 19 nt, Human
ccuguugacacaggucuuu

SEQ ID NO: 1926041 - RNA, 22 nt, Human
ccuguugacacaggucuuuccu

SEQ ID NO: 1926042 - RNA, 13 nt, Human
ccuguucugaacu

SEQ ID NO: 1926043 - RNA, 14 nt, Human
ccuguucugaacug

SEQ ID NO: 1926044 - RNA, 21 nt, Human
ccuguucugaacuguggggug

SEQ ID NO: 1926045 - RNA, 12 nt, Human
ccuguucuggca

SEQ ID NO: 1926046 - RNA, 17 nt, Human
ccuguucuggcagaguu

SEQ ID NO: 1926047 - RNA, 13 nt, Human
ccuguuccccaga

SEQ ID NO: 1926048 - RNA, 18 nt, Human
ccuguucccaugagauga

SEQ ID NO: 1926049 - RNA, 15 nt, Human
ccuguuccccagaga

SEQ ID NO: 1926050 - RNA, 16 nt, Human
ccuguuccccagagaa

SEQ ID NO: 1926051 - RNA, 23 nt, Human
ccuguuccccagagaaaggggag

SEQ ID NO: 1926052 - RNA, 16 nt, Human
ccuguugggccaggag

SEQ ID NO: 1926053 - RNA, 17 nt, Human
ccuguugggccaggagc

SEQ ID NO: 1926054 - RNA, 18 nt, Human
ccuguugggccaggagcc

SEQ ID NO: 1926055 - RNA, 19 nt, Human
ccuguugggccaggagccu

SEQ ID NO: 1926056 - RNA, 20 nt, Human
ccuguugggccaggagccuc

SEQ ID NO: 1926057 - RNA, 20 nt, Human
ccuuagcagggaaacagcua

SEQ ID NO: 1926058 - RNA, 19 nt, Human
ccuuagcagggaaacagcu

SEQ ID NO: 1926059 - RNA, 16 nt, Human
ccuuagcaaauucugu

SEQ ID NO: 1926060 - RNA, 13 nt, Human
ccuguucagcucc

SEQ ID NO: 1926061 - RNA, 15 nt, Human
ccuguuagcagacag

SEQ ID NO: 1926062 - RNA, 16 nt, Human
ccuguuagcagacagg

SEQ ID NO: 1926063 - RNA, 21 nt, Human
ccuucuguccuacucuguguc

SEQ ID NO: 1926064 - RNA, 20 nt, Human
ccuucuguccuacucugugu

SEQ ID NO: 1926065 - RNA, 17 nt, Human
ccuucucuucacaguca

SEQ ID NO: 1926066 - RNA, 22 nt, Human
ccuucuguccuacucuguguca

SEQ ID NO: 1926067 - RNA, 16 nt, Human
ccuucucugaaggaca

SEQ ID NO: 1926068 - RNA, 14 nt, Human
ccuucucugaagga

SEQ ID NO: 1926069 - RNA, 21 nt, Human
ccuucucuccagccccuggau

SEQ ID NO: 1926070 - RNA, 23 nt, Human
ccuucucuccagccccuggaugc

SEQ ID NO: 1926071 - RNA, 20 nt, Human
ccuucucuccagccccugga

SEQ ID NO: 1926072 - RNA, 24 nt, Human
ccuucccucaccuuggcaccagac

SEQ ID NO: 1926073 - RNA, 18 nt, Human
ccuucccugucugccagg

SEQ ID NO: 1926074 - RNA, 23 nt, Human
ccuucccucaccuuggcaccaga

SEQ ID NO: 1926075 - RNA, 15 nt, Human
ccuuucaauaggaaa

SEQ ID NO: 1926076 - RNA, 16 nt, Human
ccuuucaaagccauuu

SEQ ID NO: 1926077 - RNA, 23 nt, Human
ccuuuauuacccccuccuucaga

SEQ ID NO: 1926078 - RNA, 18 nt, Human
ccuuucaauaggaaaaac

SEQ ID NO: 1926079 - RNA, 17 nt, Human
ccuuucaauaggaaaaa

SEQ ID NO: 1926080 - RNA, 12 nt, Human
ccuugccagaga

SEQ ID NO: 1926081 - RNA, 13 nt, Human
ccuugccagagau

SEQ ID NO: 1926082 - RNA, 16 nt, Human
ccuugccagagaucca

SEQ ID NO: 1926083 - RNA, 14 nt, Human
ccuugcauaauggu

SEQ ID NO: 1926084 - RNA, 19 nt, Human
cucaauguuacuaucugcu

SEQ ID NO: 1926085 - RNA, 23 nt, Human
cucaauuauuuugcauuuuuucu

SEQ ID NO: 1926086 - RNA, 22 nt, Human
cucaauauuuuccaugaaaaug

SEQ ID NO: 1926087 - RNA, 21 nt, Human
cucaagugauucuccugccuc

SEQ ID NO: 1926088 - RNA, 20 nt, Human
cuauguuuacaaauggacau

SEQ ID NO: 1926089 - RNA, 19 nt, Human
cucaauauuuuccaugaaa

SEQ ID NO: 1926090 - RNA, 18 nt, Human
cucaauauuuuccaugaa

SEQ ID NO: 1926091 - RNA, 14 nt, Human
cuauguugcccagg

SEQ ID NO: 1926092 - RNA, 18 nt, Human
cuauguucuaagaaguga

SEQ ID NO: 1926093 - RNA, 17 nt, Human
cuaugugagcacaaagg

SEQ ID NO: 1926094 - RNA, 22 nt, Human
cuauguugcccaggcaggucuu

SEQ ID NO: 1926095 - RNA, 21 nt, Human
cuauguugcccaggcaggucu

SEQ ID NO: 1926096 - RNA, 19 nt, Human
cuauguugcccaggcaggu

SEQ ID NO: 1926097 - RNA, 18 nt, Human
cuauguugcccaggcagg

SEQ ID NO: 1926098 - RNA, 14 nt, Human
cuaugugagaccau

SEQ ID NO: 1926099 - RNA, 13 nt, Human
cuaugucuuguuu

SEQ ID NO: 1926100 - RNA, 13 nt, Human
cuaucucccccag

SEQ ID NO: 1926101 - RNA, 14 nt, Human
cuaucucccccagc

SEQ ID NO: 1926102 - RNA, 16 nt, Human
cuaucaccuauuucca

SEQ ID NO: 1926103 - RNA, 17 nt, Human
cuaucaccuauuuccau

SEQ ID NO: 1926104 - RNA, 20 nt, Human
cuacaaacaaaauuucuauu

SEQ ID NO: 1926105 - RNA, 17 nt, Human
cuacaaacaaaauuucu

SEQ ID NO: 1926106 - RNA, 15 nt, Human
cuacaaacaaaauuu

SEQ ID NO: 1926107 - RNA, 13 nt, Human
cuacaaacaaaau

SEQ ID NO: 1926108 - RNA, 16 nt, Human
cuacaaaaauuaacug

SEQ ID NO: 1926109 - RNA, 23 nt, Human
cucagaagacacugaugggcaac

SEQ ID NO: 1926110 - RNA, 16 nt, Human
cucagaccagcucuuc

SEQ ID NO: 1926111 - RNA, 14 nt, Human
cucagaccagcucu

SEQ ID NO: 1926112 - RNA, 15 nt, Human
cucagaccagcucuu

SEQ ID NO: 1926113 - RNA, 22 nt, Human
cucagccucccgaauagcuggg

SEQ ID NO: 1926114 - RNA, 21 nt, Human
cucagccucccgaauagcugg

SEQ ID NO: 1926115 - RNA, 19 nt, Human
cucagccucccgaauagcu

SEQ ID NO: 1926116 - RNA, 22 nt, Human
cucagaagacacugaugggcaa

SEQ ID NO: 1926117 - RNA, 20 nt, Human
cucagaagacacugaugggc

SEQ ID NO: 1926118 - RNA, 17 nt, Human
cucagaagacacugaug

SEQ ID NO: 1926119 - RNA, 15 nt, Human
cucagaagacacuga

SEQ ID NO: 1926120 - RNA, 13 nt, Human
cucagaagacacu

SEQ ID NO: 1926121 - RNA, 17 nt, Human
cucaccuuucccaucuu

SEQ ID NO: 1926122 - RNA, 22 nt, Human
cucaggccugggggcugggcag

SEQ ID NO: 1926123 - RNA, 11 nt, Human
cucaggccugg

SEQ ID NO: 1926124 - RNA, 20 nt, Human
cucaggccugacucucagca

SEQ ID NO: 1926125 - RNA, 13 nt, Human
cucaggccucugu

SEQ ID NO: 1926126 - RNA, 18 nt, Human
cucaggccucugugccgc

SEQ ID NO: 1926127 - RNA, 16 nt, Human
cucaggccagcugcuu

SEQ ID NO: 1926128 - RNA, 17 nt, Human
cucaggccagcugcuug

SEQ ID NO: 1926129 - RNA, 18 nt, Human
cucaggccagcugcuugg

SEQ ID NO: 1926130 - RNA, 23 nt, Human
cucaggccgaaggaggagucagg

SEQ ID NO: 1926131 - RNA, 21 nt, Human
cucaggccaaacucaccugcc

SEQ ID NO: 1926132 - RNA, 20 nt, Human
cucaggccaagaaacgucuu

SEQ ID NO: 1926133 - RNA, 19 nt, Human
cucaggccaaacucaccug

SEQ ID NO: 1926134 - RNA, 20 nt, Human
cucaggccaaacucaccugc

SEQ ID NO: 1926135 - RNA, 13 nt, Human
cucagccuggcca

SEQ ID NO: 1926136 - RNA, 14 nt, Human
cucagccuggccag

SEQ ID NO: 1926137 - RNA, 15 nt, Human
cucagccuggccaga

SEQ ID NO: 1926138 - RNA, 16 nt, Human
cucagccuggccagac

SEQ ID NO: 1926139 - RNA, 17 nt, Human
cucagccuggccagaca

SEQ ID NO: 1926140 - RNA, 19 nt, Human
cucagccuggccagacaca

SEQ ID NO: 1926141 - RNA, 20 nt, Human
cucagccuggccagacacag

SEQ ID NO: 1926142 - RNA, 23 nt, Human
cucagggaaaagcagcucucccc

SEQ ID NO: 1926143 - RNA, 17 nt, Human
cucagggaaaagcagcu

SEQ ID NO: 1926144 - RNA, 20 nt, Human
cucagggaaaagcagcucuc

SEQ ID NO: 1926145 - RNA, 22 nt, Human
cucagggaaaagcagcucuccc

SEQ ID NO: 1926146 - RNA, 17 nt, Human
cucaguccauagcagag

SEQ ID NO: 1926147 - RNA, 15 nt, Human
cucaguccauagcag

SEQ ID NO: 1926148 - RNA, 13 nt, Human
cucagucauaauc

SEQ ID NO: 1926149 - RNA, 16 nt, Human
cucaguccaugaagau

SEQ ID NO: 1926150 - RNA, 20 nt, Human
cucagucuggcccuuccuuu

SEQ ID NO: 1926151 - RNA, 22 nt, Human
cucagucuggcccuuccuuuuc

SEQ ID NO: 1926152 - RNA, 23 nt, Human
cucaugauagaaggcuaugggga

SEQ ID NO: 1926153 - RNA, 23 nt, Human
cucaggugucccugcacuugcag

SEQ ID NO: 1926154 - RNA, 14 nt, Human
cucugcacaugucu

SEQ ID NO: 1926155 - RNA, 13 nt, Human
cucugcacauguc

SEQ ID NO: 1926156 - RNA, 15 nt, Human
cucugcacuccccug

SEQ ID NO: 1926157 - RNA, 16 nt, Human
cucugcacuccccugc

SEQ ID NO: 1926158 - RNA, 20 nt, Human
cucugcacaagcugcacccu

SEQ ID NO: 1926159 - RNA, 21 nt, Human
cucugcacaagcugcacccuc

SEQ ID NO: 1926160 - RNA, 13 nt, Human
cucugcagggccg

SEQ ID NO: 1926161 - RNA, 19 nt, Human
cucugcagggccgccaggg

SEQ ID NO: 1926162 - RNA, 13 nt, Human
cucugcagguccc

SEQ ID NO: 1926163 - RNA, 21 nt, Human
cucugcuccucuccccagcaa

SEQ ID NO: 1926164 - RNA, 17 nt, Human
cucugcacuccccugcu

SEQ ID NO: 1926165 - RNA, 20 nt, Human
cucugcaggaaauggcugug

SEQ ID NO: 1926166 - RNA, 23 nt, Human
cucugcugacagacacaggcccg

SEQ ID NO: 1926167 - RNA, 13 nt, Human
cucugcugcuggc

SEQ ID NO: 1926168 - RNA, 20 nt, Human
cucugcugacagacacaggc

SEQ ID NO: 1926169 - RNA, 22 nt, Human
cucugcugacagacacaggccc

SEQ ID NO: 1926170 - RNA, 21 nt, Human
cucugcugacagacacaggcc

SEQ ID NO: 1926171 - RNA, 13 nt, Human
cucuguccuggga

SEQ ID NO: 1926172 - RNA, 23 nt, Human
cucuguccccuucucucaucucu

SEQ ID NO: 1926173 - RNA, 19 nt, Human
cucuuaggaagagaaacca

SEQ ID NO: 1926174 - RNA, 16 nt, Human
cucuuauagaauauuu

SEQ ID NO: 1926175 - RNA, 17 nt, Human
cucuuauagaauauuua

SEQ ID NO: 1926176 - RNA, 18 nt, Human
cucuuauagaauauuuau

SEQ ID NO: 1926177 - RNA, 20 nt, Human
cucuuauagaauauuuauua

SEQ ID NO: 1926178 - RNA, 21 nt, Human
cucuuauagaauauuuauuac

SEQ ID NO: 1926179 - RNA, 16 nt, Human
cucuguacagagccca

SEQ ID NO: 1926180 - RNA, 21 nt, Human
cucuguccccuucucucaucu

SEQ ID NO: 1926181 - RNA, 18 nt, Human
cucuguccccuucucuca

SEQ ID NO: 1926182 - RNA, 17 nt, Human
cucuguccccuucucuc

SEQ ID NO: 1926183 - RNA, 15 nt, Human
cucuguccccuucuc

SEQ ID NO: 1926184 - RNA, 14 nt, Human
cucuguccccuucu

SEQ ID NO: 1926185 - RNA, 16 nt, Human
cucugcugcuggcugg

SEQ ID NO: 1926186 - RNA, 14 nt, Human
cucugcugcuggcu

SEQ ID NO: 1926187 - RNA, 15 nt, Human
cucugcugcuggcug

SEQ ID NO: 1926188 - RNA, 14 nt, Human
cucuguacagagcc

SEQ ID NO: 1926189 - RNA, 15 nt, Human
cucuguacagagccc

SEQ ID NO: 1926190 - RNA, 13 nt, Human
cucuguacagagc

SEQ ID NO: 1926191 - RNA, 19 nt, Human
cucuauguucuaagaagug

SEQ ID NO: 1926192 - RNA, 16 nt, Human
cucucccccacccccu

SEQ ID NO: 1926193 - RNA, 13 nt, Human
cucucccccaccc

SEQ ID NO: 1926194 - RNA, 21 nt, Human
cucuccccucagagugcaagc

SEQ ID NO: 1926195 - RNA, 13 nt, Human
cucuccuccagag

SEQ ID NO: 1926196 - RNA, 15 nt, Human
cucuccuccagaguc

SEQ ID NO: 1926197 - RNA, 12 nt, Human
cucuccuccaga

SEQ ID NO: 1926198 - RNA, 12 nt, Human
cucucccugacc

SEQ ID NO: 1926199 - RNA, 13 nt, Human
cucucccugaccc

SEQ ID NO: 1926200 - RNA, 14 nt, Human
cucucccugacccu

SEQ ID NO: 1926201 - RNA, 20 nt, Human
cucucccugacccuguauau

SEQ ID NO: 1926202 - RNA, 16 nt, Human
cucuccuccagaguca

SEQ ID NO: 1926203 - RNA, 13 nt, Human
cucucuggccuuc

SEQ ID NO: 1926204 - RNA, 16 nt, Human
cucucuggccuucggc

SEQ ID NO: 1926205 - RNA, 14 nt, Human
cucucuggccuucg

SEQ ID NO: 1926206 - RNA, 18 nt, Human
cucucuuauagaauauuu

SEQ ID NO: 1926207 - RNA, 19 nt, Human
cucucuuauagaauauuua

SEQ ID NO: 1926208 - RNA, 21 nt, Human
cucucuuauagaauauuuauu

SEQ ID NO: 1926209 - RNA, 23 nt, Human
cucucuuauagaauauuuauuac

SEQ ID NO: 1926210 - RNA, 17 nt, Human
cucgguguggagaagcg

SEQ ID NO: 1926211 - RNA, 23 nt, Human
cucgguguggagaagcggcuggc

SEQ ID NO: 1926212 - RNA, 16 nt, Human
cucgguguggagaagc

SEQ ID NO: 1926213 - RNA, 13 nt, Human
cuccuuuguacuu

SEQ ID NO: 1926214 - RNA, 14 nt, Human
cuccuuuguacuuu

SEQ ID NO: 1926215 - RNA, 17 nt, Human
cuccuuuguacuuugug

SEQ ID NO: 1926216 - RNA, 20 nt, Human
cuccuuuguacuuugugcuu

SEQ ID NO: 1926217 - RNA, 17 nt, Human
cuccuuugugaggaagc

SEQ ID NO: 1926218 - RNA, 18 nt, Human
cuccuuugugaggaagcc

SEQ ID NO: 1926219 - RNA, 12 nt, Human
cucccaggacac

SEQ ID NO: 1926220 - RNA, 11 nt, Human
cucccaggaca

SEQ ID NO: 1926221 - RNA, 18 nt, Human
cucccccccaugcacugu

SEQ ID NO: 1926222 - RNA, 20 nt, Human
cucccccccaugcacuguga

SEQ ID NO: 1926223 - RNA, 21 nt, Human
cucccccccaugcacugugaa

SEQ ID NO: 1926224 - RNA, 16 nt, Human
cucccccuagccauuu

SEQ ID NO: 1926225 - RNA, 19 nt, Human
cucccucuacugggagccu

SEQ ID NO: 1926226 - RNA, 13 nt, Human
cucccucuacugg

SEQ ID NO: 1926227 - RNA, 18 nt, Human
cucccugaagccuuugca

SEQ ID NO: 1926228 - RNA, 20 nt, Human
cucccucuuucccucccuuc

SEQ ID NO: 1926229 - RNA, 14 nt, Human
cucccucuauuuau

SEQ ID NO: 1926230 - RNA, 20 nt, Human
cucccucuacugggagccua

SEQ ID NO: 1926231 - RNA, 22 nt, Human
cuccaggcuguaucccaugagc

SEQ ID NO: 1926232 - RNA, 20 nt, Human
cuccaggcuguaucccauga

SEQ ID NO: 1926233 - RNA, 23 nt, Human
cuccaggcuccuuuagcgcccag

SEQ ID NO: 1926234 - RNA, 15 nt, Human
cuccaggcuccuuua

SEQ ID NO: 1926235 - RNA, 23 nt, Human
cuccaggugcacaagcuccaagc

SEQ ID NO: 1926236 - RNA, 23 nt, Human
cucccacugggguccagggagca

SEQ ID NO: 1926237 - RNA, 12 nt, Human
cuccuggcccag

SEQ ID NO: 1926238 - RNA, 19 nt, Human
cuccuggcccacugcaucg

SEQ ID NO: 1926239 - RNA, 14 nt, Human
cuccuggcccaggu

SEQ ID NO: 1926240 - RNA, 19 nt, Human
cuccuggccucaagugauu

SEQ ID NO: 1926241 - RNA, 18 nt, Human
cuccugggcuaagugauc

SEQ ID NO: 1926242 - RNA, 15 nt, Human
cuccucugcugcugg

SEQ ID NO: 1926243 - RNA, 13 nt, Human
cuccucugcugcu

SEQ ID NO: 1926244 - RNA, 14 nt, Human
cuccucugcugcug

SEQ ID NO: 1926245 - RNA, 16 nt, Human
cuccuguaccucuuga

SEQ ID NO: 1926246 - RNA, 15 nt, Human
cuccuuucaccacau

SEQ ID NO: 1926247 - RNA, 15 nt, Human
cuccuuguuccuaga

SEQ ID NO: 1926248 - RNA, 12 nt, Human
cuccuuguuccu

SEQ ID NO: 1926249 - RNA, 13 nt, Human
cuccuuguuccua

SEQ ID NO: 1926250 - RNA, 14 nt, Human
cuccuuguuccuag

SEQ ID NO: 1926251 - RNA, 14 nt, Human
cuccuuguguuacu

SEQ ID NO: 1926252 - RNA, 21 nt, Human
cuccggcccuccuacccugcg

SEQ ID NO: 1926253 - RNA, 23 nt, Human
cuccgcuuucuacccagcgagcc

SEQ ID NO: 1926254 - RNA, 15 nt, Human
cuccuacccugcgcc

SEQ ID NO: 1926255 - RNA, 18 nt, Human
cuccuacccugcgcccag

SEQ ID NO: 1926256 - RNA, 20 nt, Human
aaauuaucaagcuaauaaaa

SEQ ID NO: 1926257 - RNA, 19 nt, Human
aaauuaucaagcuaauaaa

SEQ ID NO: 1926258 - RNA, 18 nt, Human
aaauuaucaagcuaauaa

SEQ ID NO: 1926259 - RNA, 17 nt, Human
aaauuaucaagcuaaua

SEQ ID NO: 1926260 - RNA, 16 nt, Human
aaauuaucaagcuaau

SEQ ID NO: 1926261 - RNA, 15 nt, Human
aaauuaucaagcuaa

SEQ ID NO: 1926262 - RNA, 14 nt, Human
aaauuagaugaacu

SEQ ID NO: 1926263 - RNA, 12 nt, Human
aaauuagaaaau

SEQ ID NO: 1926264 - RNA, 11 nt, Human
aaauuagaaaa

SEQ ID NO: 1926265 - RNA, 20 nt, Human
aaauuagaaaauguuauuua

SEQ ID NO: 1926266 - RNA, 14 nt, Human
aaauucaugcugcu

SEQ ID NO: 1926267 - RNA, 22 nt, Human
guauuggcuagagguucaaaga

SEQ ID NO: 1926268 - RNA, 20 nt, Human
guauuuaauagguuuggaca

SEQ ID NO: 1926269 - RNA, 16 nt, Human
guauuuaauucauguu

SEQ ID NO: 1926270 - RNA, 23 nt, Human
aaauuaacuuuuauaaacuuuac

SEQ ID NO: 1926271 - RNA, 22 nt, Human
aaauuaacuuuuauaaacuuua

SEQ ID NO: 1926272 - RNA, 20 nt, Human
aaauuacucaggaagaacac

SEQ ID NO: 1926273 - RNA, 14 nt, Human
aaauuacucuuucu

SEQ ID NO: 1926274 - RNA, 15 nt, Human
aaauuacucuuucuc

SEQ ID NO: 1926275 - RNA, 19 nt, Human
aaauuaacuuuuauaaacu

SEQ ID NO: 1926276 - RNA, 15 nt, Human
aaauguuauuuaaca

SEQ ID NO: 1926277 - RNA, 21 nt, Human
aaauuaacuuuuauaaacuuu

SEQ ID NO: 1926278 - RNA, 18 nt, Human
aaauuucagcagcugcag

SEQ ID NO: 1926279 - RNA, 17 nt, Human
aaauuucagcagcugca

SEQ ID NO: 1926280 - RNA, 20 nt, Human
aaauuuaguauuuuguuuca

SEQ ID NO: 1926281 - RNA, 14 nt, Human
aaauuccucuuugc

SEQ ID NO: 1926282 - RNA, 18 nt, Human
aaauuccucuuugcuuug

SEQ ID NO: 1926283 - RNA, 19 nt, Human
aaauuccucuuugcuuugc

SEQ ID NO: 1926284 - RNA, 20 nt, Human
aaauuccucuuugcuuugcu

SEQ ID NO: 1926285 - RNA, 14 nt, Human
aaauuuccacucag

SEQ ID NO: 1926286 - RNA, 22 nt, Human
aaauuuccacucaggucuguuu

SEQ ID NO: 1926287 - RNA, 15 nt, Human
guauuuuuuuacuaa

SEQ ID NO: 1926288 - RNA, 14 nt, Human
guauuuuuuuacua

SEQ ID NO: 1926289 - RNA, 22 nt, Human
aaauuuccugggagcuuuugua

SEQ ID NO: 1926290 - RNA, 20 nt, Human
gucacacaguauuacuucug

SEQ ID NO: 1926291 - RNA, 16 nt, Human
gucacacacuuuggcu

SEQ ID NO: 1926292 - RNA, 19 nt, Human
gucaacucauauuuucaug

SEQ ID NO: 1926293 - RNA, 13 nt, Human
gucacacacugau

SEQ ID NO: 1926294 - RNA, 22 nt, Human
gucaaaugguaggcauuuccua

SEQ ID NO: 1926295 - RNA, 21 nt, Human
guauuuuuuuacuaauagaca

SEQ ID NO: 1926296 - RNA, 17 nt, Human
guauuuuuuuacuaaua

SEQ ID NO: 1926297 - RNA, 15 nt, Human
guauuuuuuaaagcu

SEQ ID NO: 1926298 - RNA, 20 nt, Human
gucaaaaaguuugguucugu

SEQ ID NO: 1926299 - RNA, 19 nt, Human
gucaaaguggugagaggca

SEQ ID NO: 1926300 - RNA, 18 nt, Human
gucaaaguggugagaggc

SEQ ID NO: 1926301 - RNA, 23 nt, Human
gucaaaaaguuugguucuguguc

SEQ ID NO: 1926302 - RNA, 17 nt, Human
guauaaaagccuguuua

SEQ ID NO: 1926303 - RNA, 20 nt, Human
aaauguaccuucagaauaag

SEQ ID NO: 1926304 - RNA, 16 nt, Human
aaaugggggugcauuu

SEQ ID NO: 1926305 - RNA, 15 nt, Human
aaaugggggugcauu

SEQ ID NO: 1926306 - RNA, 13 nt, Human
aaauggggccaga

SEQ ID NO: 1926307 - RNA, 16 nt, Human
aaauggggccagaucc

SEQ ID NO: 1926308 - RNA, 17 nt, Human
aaauggggccagaucca

SEQ ID NO: 1926309 - RNA, 21 nt, Human
aaauggggccagauccagccu

SEQ ID NO: 1926310 - RNA, 22 nt, Human
aaauggggccagauccagccug

SEQ ID NO: 1926311 - RNA, 18 nt, Human
aaaugggggugcauuuga

SEQ ID NO: 1926312 - RNA, 17 nt, Human
aaaugggggugcauuug

SEQ ID NO: 1926313 - RNA, 19 nt, Human
aaaugggggugcauuugag

SEQ ID NO: 1926314 - RNA, 22 nt, Human
guauauugauccagaaagaaaa

SEQ ID NO: 1926315 - RNA, 18 nt, Human
guauaaaagggacugaga

SEQ ID NO: 1926316 - RNA, 14 nt, Human
guauaaacaaaguu

SEQ ID NO: 1926317 - RNA, 18 nt, Human
guauaaaagccuguuuaa

SEQ ID NO: 1926318 - RNA, 21 nt, Human
guauaaaagccuguuuaagag

SEQ ID NO: 1926319 - RNA, 15 nt, Human
guauucuuauuuaau

SEQ ID NO: 1926320 - RNA, 13 nt, Human
guaugguggcugg

SEQ ID NO: 1926321 - RNA, 15 nt, Human
guaugggagagaaga

SEQ ID NO: 1926322 - RNA, 15 nt, Human
guauguggaagugug

SEQ ID NO: 1926323 - RNA, 17 nt, Human
guauguggaaguguggg

SEQ ID NO: 1926324 - RNA, 16 nt, Human
guauguggaagugugg

SEQ ID NO: 1926325 - RNA, 20 nt, Human
guaugugggggucugugugu

SEQ ID NO: 1926326 - RNA, 19 nt, Human
guaugugggggucugugug

SEQ ID NO: 1926327 - RNA, 21 nt, Human
guauguggaagugugggucug

SEQ ID NO: 1926328 - RNA, 18 nt, Human
guauguggaagugugggu

SEQ ID NO: 1926329 - RNA, 15 nt, Human
guaucccuacuguaa

SEQ ID NO: 1926330 - RNA, 22 nt, Human
guaugaucacggcucacugcag

SEQ ID NO: 1926331 - RNA, 21 nt, Human
guaucacucugugucugagug

SEQ ID NO: 1926332 - RNA, 19 nt, Human
guaucaauaccaaauagcu

SEQ ID NO: 1926333 - RNA, 17 nt, Human
guaucacugucuuuccu

SEQ ID NO: 1926334 - RNA, 18 nt, Human
guaucacugucuuuccua

SEQ ID NO: 1926335 - RNA, 20 nt, Human
guaucacugucuuuccuaga

SEQ ID NO: 1926336 - RNA, 14 nt, Human
guaugggagagaag

SEQ ID NO: 1926337 - RNA, 18 nt, Human
guauggagagaaaacaga

SEQ ID NO: 1926338 - RNA, 16 nt, Human
aaauccuuuacuguua

SEQ ID NO: 1926339 - RNA, 13 nt, Human
aaaucgaugcagu

SEQ ID NO: 1926340 - RNA, 15 nt, Human
aaaucccauuuaaaa

SEQ ID NO: 1926341 - RNA, 18 nt, Human
aaaucccuuaccucggug

SEQ ID NO: 1926342 - RNA, 17 nt, Human
aaaugaaaaucgugaca

SEQ ID NO: 1926343 - RNA, 19 nt, Human
aaaucucaaauuucuaaau

SEQ ID NO: 1926344 - RNA, 17 nt, Human
aaaucucaaauuucuaa

SEQ ID NO: 1926345 - RNA, 16 nt, Human
aaaucucaaauuucua

SEQ ID NO: 1926346 - RNA, 15 nt, Human
aaaucucaaauuucu

SEQ ID NO: 1926347 - RNA, 19 nt, Human
aaaucuacacuccagugag

SEQ ID NO: 1926348 - RNA, 14 nt, Human
aaaucuacaguaca

SEQ ID NO: 1926349 - RNA, 22 nt, Human
aaaucggaucuggggcucuggg

SEQ ID NO: 1926350 - RNA, 23 nt, Human
aaaucggaucuggggcucuggga

SEQ ID NO: 1926351 - RNA, 16 nt, Human
aaaucuaggaaaauau

SEQ ID NO: 1926352 - RNA, 20 nt, Human
aaaucuaggaaaauauuuug

SEQ ID NO: 1926353 - RNA, 18 nt, Human
aaaucuaggaaaauauuu

SEQ ID NO: 1926354 - RNA, 16 nt, Human
aaaucuaugauuccag

SEQ ID NO: 1926355 - RNA, 14 nt, Human
aaaucuaugauucc

SEQ ID NO: 1926356 - RNA, 14 nt, Human
aaaucuauauuuug

SEQ ID NO: 1926357 - RNA, 18 nt, Human
guaggacccaagcagaga

SEQ ID NO: 1926358 - RNA, 15 nt, Human
guaggacuguagaaa

SEQ ID NO: 1926359 - RNA, 18 nt, Human
guaggaagguuaauguuc

SEQ ID NO: 1926360 - RNA, 15 nt, Human
guaggaagacuuugg

SEQ ID NO: 1926361 - RNA, 16 nt, Human
guaggaacugcugggc

SEQ ID NO: 1926362 - RNA, 14 nt, Human
guaggagcugccuu

SEQ ID NO: 1926363 - RNA, 22 nt, Human
guaggagcugccuuggcucaga

SEQ ID NO: 1926364 - RNA, 23 nt, Human
guaggagcugccuuggcucagac

SEQ ID NO: 1926365 - RNA, 13 nt, Human
guaggauuacuag

SEQ ID NO: 1926366 - RNA, 14 nt, Human
guaggcauuuccua

SEQ ID NO: 1926367 - RNA, 21 nt, Human
guagcugggacuacaggcacc

SEQ ID NO: 1926368 - RNA, 19 nt, Human
guagcugggacuacaggca

SEQ ID NO: 1926369 - RNA, 18 nt, Human
guagcugggacuacaggc

SEQ ID NO: 1926370 - RNA, 12 nt, Human
guagcugggacu

SEQ ID NO: 1926371 - RNA, 17 nt, Human
guagcuggauuacaggc

SEQ ID NO: 1926372 - RNA, 17 nt, Human
aaaggagagcuagcagc

SEQ ID NO: 1926373 - RNA, 16 nt, Human
aaaggagucaaaacua

SEQ ID NO: 1926374 - RNA, 17 nt, Human
guagcugcaaaggacag

SEQ ID NO: 1926375 - RNA, 19 nt, Human
aaaggaucuuuguggccaa

SEQ ID NO: 1926376 - RNA, 18 nt, Human
aaaggaucuuuguggcca

SEQ ID NO: 1926377 - RNA, 14 nt, Human
aaaugcauuucuaa

SEQ ID NO: 1926378 - RNA, 13 nt, Human
aaaugcccagccc

SEQ ID NO: 1926379 - RNA, 14 nt, Human
aaaugcccagcccc

SEQ ID NO: 1926380 - RNA, 15 nt, Human
aaaugcccagccccu

SEQ ID NO: 1926381 - RNA, 18 nt, Human
aaaugcccagccccuucu

SEQ ID NO: 1926382 - RNA, 13 nt, Human
aaaugcccagcuu

SEQ ID NO: 1926383 - RNA, 15 nt, Human
aaaugggcagagcag

SEQ ID NO: 1926384 - RNA, 16 nt, Human
aaaugggacuuaacuc

SEQ ID NO: 1926385 - RNA, 18 nt, Human
aaaugggcagagcagaga

SEQ ID NO: 1926386 - RNA, 20 nt, Human
aaaugggcagagcagagacc

SEQ ID NO: 1926387 - RNA, 14 nt, Human
aaaugcaccuggaa

SEQ ID NO: 1926388 - RNA, 16 nt, Human
aaaugcaacaacaugu

SEQ ID NO: 1926389 - RNA, 15 nt, Human
aaaugcaaaaaucuc

SEQ ID NO: 1926390 - RNA, 16 nt, Human
aaaugcaaaaaucucu

SEQ ID NO: 1926391 - RNA, 16 nt, Human
aaaugaucuuuucaag

SEQ ID NO: 1926392 - RNA, 18 nt, Human
aaaugauguguacccaaa

SEQ ID NO: 1926393 - RNA, 22 nt, Human
aaaugcaccuggaauauauaac

SEQ ID NO: 1926394 - RNA, 18 nt, Human
aaaugcaccuggaauaua

SEQ ID NO: 1926395 - RNA, 20 nt, Human
aaaugcacccaacuagcucu

SEQ ID NO: 1926396 - RNA, 13 nt, Human
aaaugcauguugc

SEQ ID NO: 1926397 - RNA, 20 nt, Human
aaaugcaugauuuuguaacc

SEQ ID NO: 1926398 - RNA, 21 nt, Human
aaaugcaugauuuuguaaccc

SEQ ID NO: 1926399 - RNA, 14 nt, Human
aaaugcaugauuuu

SEQ ID NO: 1926400 - RNA, 18 nt, Human
aaaugcaugauuuuguaa

SEQ ID NO: 1926401 - RNA, 14 nt, Human
aaaugaaagugaga

SEQ ID NO: 1926402 - RNA, 22 nt, Human
aaaugaaagcagggacuugaac

SEQ ID NO: 1926403 - RNA, 21 nt, Human
aaaugaaagcagggacuugaa

SEQ ID NO: 1926404 - RNA, 23 nt, Human
aaaugaacgauauguagcagaaa

SEQ ID NO: 1926405 - RNA, 22 nt, Human
aaaugaacgauauguagcagaa

SEQ ID NO: 1926406 - RNA, 19 nt, Human
aaaugaacgauauguagca

SEQ ID NO: 1926407 - RNA, 11 nt, Human
aaaugagaaau

SEQ ID NO: 1926408 - RNA, 19 nt, Human
aaaugaggucagagccugc

SEQ ID NO: 1926409 - RNA, 17 nt, Human
aaaugaggucagagccu

SEQ ID NO: 1926410 - RNA, 16 nt, Human
aaaugagguacucucc

SEQ ID NO: 1926411 - RNA, 23 nt, Human
aaaugagguacucuccuggaaau

SEQ ID NO: 1926412 - RNA, 23 nt, Human
aaaugauccccagcuguuuaugc

SEQ ID NO: 1926413 - RNA, 21 nt, Human
aaaugaguuaccuacauuuua

SEQ ID NO: 1926414 - RNA, 9 nt, Human
aaaugaggg

SEQ ID NO: 1926415 - RNA, 13 nt, Human
aaaugagaaaucu

SEQ ID NO: 1926416 - RNA, 14 nt, Human
aaaugagaaaucua

SEQ ID NO: 1926417 - RNA, 16 nt, Human
aaaugagaaaucuaaa

SEQ ID NO: 1926418 - RNA, 13 nt, Human
aaaugagccuggc

SEQ ID NO: 1926419 - RNA, 19 nt, Human
aaaugagccuggcaagaau

SEQ ID NO: 1926420 - RNA, 13 nt, Human
aaaugagccauga

SEQ ID NO: 1926421 - RNA, 17 nt, Human
aacccagucacugugag

SEQ ID NO: 1926422 - RNA, 17 nt, Human
aacccagcucuggucca

SEQ ID NO: 1926423 - RNA, 20 nt, Human
aacccauauuuguacaccaa

SEQ ID NO: 1926424 - RNA, 21 nt, Human
aacccauauuguaaaacaggu

SEQ ID NO: 1926425 - RNA, 17 nt, Human
aacccauauuguaaaac

SEQ ID NO: 1926426 - RNA, 13 nt, Human
aacccaaauguuc

SEQ ID NO: 1926427 - RNA, 16 nt, Human
aaccauggugcuuguu

SEQ ID NO: 1926428 - RNA, 13 nt, Human
aacccagcucugg

SEQ ID NO: 1926429 - RNA, 14 nt, Human
aacccagcucuggu

SEQ ID NO: 1926430 - RNA, 11 nt, Human
aacccagcucu

SEQ ID NO: 1926431 - RNA, 18 nt, Human
aacccaaauguucaucaa

SEQ ID NO: 1926432 - RNA, 15 nt, Human
aacccccagccugcu

SEQ ID NO: 1926433 - RNA, 14 nt, Human
aacccccagccugc

SEQ ID NO: 1926434 - RNA, 13 nt, Human
aacccccagccug

SEQ ID NO: 1926435 - RNA, 20 nt, Human
aacccccacuggacugaccu

SEQ ID NO: 1926436 - RNA, 15 nt, Human
aaccuauuuugaagu

SEQ ID NO: 1926437 - RNA, 15 nt, Human
aaccuauuucucuuu

SEQ ID NO: 1926438 - RNA, 18 nt, Human
aaccuauuucucuuucuu

SEQ ID NO: 1926439 - RNA, 12 nt, Human
aaccuauuucuc

SEQ ID NO: 1926440 - RNA, 14 nt, Human
aaccuccugggcua

SEQ ID NO: 1926441 - RNA, 17 nt, Human
aaccuccgccucuuggg

SEQ ID NO: 1926442 - RNA, 16 nt, Human
aaccucagccuggcca

SEQ ID NO: 1926443 - RNA, 13 nt, Human
aaccucagccugg

SEQ ID NO: 1926444 - RNA, 14 nt, Human
aaccucagccuggc

SEQ ID NO: 1926445 - RNA, 11 nt, Human
aaccucagccu

SEQ ID NO: 1926446 - RNA, 12 nt, Human
aaccucagccug

SEQ ID NO: 1926447 - RNA, 18 nt, Human
aaccacaucuugcucugc

SEQ ID NO: 1926448 - RNA, 21 nt, Human
aaccacaccacaucuaagccu

SEQ ID NO: 1926449 - RNA, 23 nt, Human
aaccacaccacaucuaagccuga

SEQ ID NO: 1926450 - RNA, 13 nt, Human
aaccacaccacau

SEQ ID NO: 1926451 - RNA, 16 nt, Human
aaccaaucuacaaucu

SEQ ID NO: 1926452 - RNA, 19 nt, Human
aaccaaagcgaauuuuaaa

SEQ ID NO: 1926453 - RNA, 22 nt, Human
aaccacaucuugcucugcugac

SEQ ID NO: 1926454 - RNA, 20 nt, Human
aaccacaucuugcucugcug

SEQ ID NO: 1926455 - RNA, 19 nt, Human
aaccaucauugaaaucuuu

SEQ ID NO: 1926456 - RNA, 20 nt, Human
aaccaucauugaaaucuuuu

SEQ ID NO: 1926457 - RNA, 23 nt, Human
aaccaucauugaaaucuuuuugc

SEQ ID NO: 1926458 - RNA, 21 nt, Human
aaccaucauugaaaucuuuuu

SEQ ID NO: 1926459 - RNA, 13 nt, Human
aacauuuuuggua

SEQ ID NO: 1926460 - RNA, 13 nt, Human
gucuccuggcggu

SEQ ID NO: 1926461 - RNA, 15 nt, Human
guccuucucauucau

SEQ ID NO: 1926462 - RNA, 18 nt, Human
aaccucucacuucacccu

SEQ ID NO: 1926463 - RNA, 21 nt, Human
aaccucuccucauguucugcu

SEQ ID NO: 1926464 - RNA, 17 nt, Human
aaccucuucuggcucaa

SEQ ID NO: 1926465 - RNA, 14 nt, Human
gucuggcugcagag

SEQ ID NO: 1926466 - RNA, 13 nt, Human
gucuggcugcaga

SEQ ID NO: 1926467 - RNA, 12 nt, Human
gucuggcugcag

SEQ ID NO: 1926468 - RNA, 15 nt, Human
gucuuagauguauau

SEQ ID NO: 1926469 - RNA, 24 nt, Human
gucuuuucuugcaugaggcuagug

SEQ ID NO: 1926470 - RNA, 14 nt, Human
gucuuuucuugcau

SEQ ID NO: 1926471 - RNA, 19 nt, Human
gucuuuucuugcaugaggc

SEQ ID NO: 1926472 - RNA, 18 nt, Human
gucuuuggacccugaggc

SEQ ID NO: 1926473 - RNA, 17 nt, Human
gucuuucuuuuuggaca

SEQ ID NO: 1926474 - RNA, 17 nt, Human
gucuuuggacccugagg

SEQ ID NO: 1926475 - RNA, 14 nt, Human
gucuuuggacccug

SEQ ID NO: 1926476 - RNA, 15 nt, Human
gucuuuggacccuga

SEQ ID NO: 1926477 - RNA, 15 nt, Human
aacguggcugcuuca

SEQ ID NO: 1926478 - RNA, 22 nt, Human
aacguggcugcuucaaggaucc

SEQ ID NO: 1926479 - RNA, 15 nt, Human
aacuaaacucauuua

SEQ ID NO: 1926480 - RNA, 16 nt, Human
aacuaaacucauuuau

SEQ ID NO: 1926481 - RNA, 16 nt, Human
aacguggcugcuucaa

SEQ ID NO: 1926482 - RNA, 19 nt, Human
aacguggcugcuucaagga

SEQ ID NO: 1926483 - RNA, 17 nt, Human
aacuaaacucauuuaua

SEQ ID NO: 1926484 - RNA, 18 nt, Human
aacuaaacucauuuauaa

SEQ ID NO: 1926485 - RNA, 19 nt, Human
aacuacaaacaaaauuucu

SEQ ID NO: 1926486 - RNA, 15 nt, Human
aacuacaaacaaaau

SEQ ID NO: 1926487 - RNA, 19 nt, Human
aacuacagaaaaaccagag

SEQ ID NO: 1926488 - RNA, 13 nt, Human
aacuacaaaucaa

SEQ ID NO: 1926489 - RNA, 13 nt, Human
aacuacaugagaa

SEQ ID NO: 1926490 - RNA, 14 nt, Human
aacuagauggugcu

SEQ ID NO: 1926491 - RNA, 17 nt, Human
aacuagauggugcugag

SEQ ID NO: 1926492 - RNA, 20 nt, Human
aacuagauggugcugagaag

SEQ ID NO: 1926493 - RNA, 18 nt, Human
aacuagcuuggaaacugg

SEQ ID NO: 1926494 - RNA, 20 nt, Human
aacuagcucuauguuuacaa

SEQ ID NO: 1926495 - RNA, 19 nt, Human
gugaaccaccacacccagc

SEQ ID NO: 1926496 - RNA, 23 nt, Human
aacucuagcugggggugggccag

SEQ ID NO: 1926497 - RNA, 12 nt, Human
aacucuagcugg

SEQ ID NO: 1926498 - RNA, 19 nt, Human
aacucuagcuggggguggg

SEQ ID NO: 1926499 - RNA, 14 nt, Human
aacucccuuucaac

SEQ ID NO: 1926500 - RNA, 13 nt, Human
aacucccuuucaa

SEQ ID NO: 1926501 - RNA, 22 nt, Human
gucauuugcugagcauguacug

SEQ ID NO: 1926502 - RNA, 21 nt, Human
gucauuugcugagcauguacu

SEQ ID NO: 1926503 - RNA, 22 nt, Human
gucauuugagcagggcucagcg

SEQ ID NO: 1926504 - RNA, 21 nt, Human
gucauuugagcagggcucagc

SEQ ID NO: 1926505 - RNA, 21 nt, Human
aacacuguucucugcccucca

SEQ ID NO: 1926506 - RNA, 12 nt, Human
guccaauguggc

SEQ ID NO: 1926507 - RNA, 22 nt, Human
guccauuuggcagggguggcug

SEQ ID NO: 1926508 - RNA, 15 nt, Human
guccaagcugggaga

SEQ ID NO: 1926509 - RNA, 15 nt, Human
aacacuguucucugc

SEQ ID NO: 1926510 - RNA, 20 nt, Human
aacacuguucucugcccucc

SEQ ID NO: 1926511 - RNA, 16 nt, Human
aacacugucuugaaga

SEQ ID NO: 1926512 - RNA, 14 nt, Human
aacacugcuugugu

SEQ ID NO: 1926513 - RNA, 23 nt, Human
aacacugauuuccccuuuugcau

SEQ ID NO: 1926514 - RNA, 17 nt, Human
aacacugcuuguguuuu

SEQ ID NO: 1926515 - RNA, 16 nt, Human
aacacucuuuugcuuu

SEQ ID NO: 1926516 - RNA, 19 nt, Human
aacacucuuuugcuuuauu

SEQ ID NO: 1926517 - RNA, 14 nt, Human
aacacugauuuccc

SEQ ID NO: 1926518 - RNA, 15 nt, Human
aacacugauuucccc

SEQ ID NO: 1926519 - RNA, 22 nt, Human
aacacugauuuccccuuuugca

SEQ ID NO: 1926520 - RNA, 14 nt, Human
aacacucugagacu

SEQ ID NO: 1926521 - RNA, 12 nt, Human
aacacucuuuug

SEQ ID NO: 1926522 - RNA, 12 nt, Human
aacacucugaga

SEQ ID NO: 1926523 - RNA, 13 nt, Human
aacacucugagac

SEQ ID NO: 1926524 - RNA, 12 nt, Human
aacacuccuuca

SEQ ID NO: 1926525 - RNA, 11 nt, Human
aacacucugag

SEQ ID NO: 1926526 - RNA, 21 nt, Human
aacacucauugaccugaggcc

SEQ ID NO: 1926527 - RNA, 21 nt, Human
aacaagccuccuuuuaaagua

SEQ ID NO: 1926528 - RNA, 20 nt, Human
aacaagaccacguuucuaaa

SEQ ID NO: 1926529 - RNA, 19 nt, Human
aacaagaccacguuucuaa

SEQ ID NO: 1926530 - RNA, 17 nt, Human
aacaagaccacguuucu

SEQ ID NO: 1926531 - RNA, 16 nt, Human
aacaagaccacguuuc

SEQ ID NO: 1926532 - RNA, 15 nt, Human
gucacaggcaggucc

SEQ ID NO: 1926533 - RNA, 13 nt, Human
gucacaggcaggu

SEQ ID NO: 1926534 - RNA, 16 nt, Human
gucacaggcaggucca

SEQ ID NO: 1926535 - RNA, 23 nt, Human
aaauuuuuaaucuuuaauuuuac

SEQ ID NO: 1926536 - RNA, 23 nt, Human
aacaauuuuaggaggaccagagc

SEQ ID NO: 1926537 - RNA, 20 nt, Human
aacaaugacuaauucuugca

SEQ ID NO: 1926538 - RNA, 21 nt, Human
aacaaugacuaauucuugcau

SEQ ID NO: 1926539 - RNA, 23 nt, Human
aacaaggcaaggcugucaauuac

SEQ ID NO: 1926540 - RNA, 15 nt, Human
aacaagucagucauu

SEQ ID NO: 1926541 - RNA, 18 nt, Human
aacaagucagucauucag

SEQ ID NO: 1926542 - RNA, 16 nt, Human
aacaauauugucugaa

SEQ ID NO: 1926543 - RNA, 18 nt, Human
aacaauaggcuguuccca

SEQ ID NO: 1926544 - RNA, 15 nt, Human
guccgaucuuugacu

SEQ ID NO: 1926545 - RNA, 13 nt, Human
guccgagcuuuga

SEQ ID NO: 1926546 - RNA, 19 nt, Human
gucccaaacagcugccucu

SEQ ID NO: 1926547 - RNA, 21 nt, Human
guccggucccugucccagugc

SEQ ID NO: 1926548 - RNA, 21 nt, Human
aacagaaauguacagcaagga

SEQ ID NO: 1926549 - RNA, 11 nt, Human
aacagaaaugu

SEQ ID NO: 1926550 - RNA, 10 nt, Human
aacagaaaug

SEQ ID NO: 1926551 - RNA, 18 nt, Human
aacagaccuaaugcuccu

SEQ ID NO: 1926552 - RNA, 22 nt, Human
aacaguagugauaguuguaccg

SEQ ID NO: 1926553 - RNA, 23 nt, Human
aacaggcugggcuucaguggcag

SEQ ID NO: 1926554 - RNA, 13 nt, Human
aacaggcugggcu

SEQ ID NO: 1926555 - RNA, 22 nt, Human
aacaggcugggcuucaguggca

SEQ ID NO: 1926556 - RNA, 19 nt, Human
aacagacuggaagcacagc

SEQ ID NO: 1926557 - RNA, 19 nt, Human
aacagacucgauucauauu

SEQ ID NO: 1926558 - RNA, 19 nt, Human
aacaguuguguuugaagca

SEQ ID NO: 1926559 - RNA, 17 nt, Human
aacauugcaauagaaau

SEQ ID NO: 1926560 - RNA, 20 nt, Human
aacauuuguucuauagcuuu

SEQ ID NO: 1926561 - RNA, 16 nt, Human
aacauugcaauagaaa

SEQ ID NO: 1926562 - RNA, 15 nt, Human
aacauugcaauagaa

SEQ ID NO: 1926563 - RNA, 14 nt, Human
aacauugcaauaga

SEQ ID NO: 1926564 - RNA, 14 nt, Human
aacauacucccauc

SEQ ID NO: 1926565 - RNA, 15 nt, Human
aacauacucccaucu

SEQ ID NO: 1926566 - RNA, 14 nt, Human
guccuuccaccucg

SEQ ID NO: 1926567 - RNA, 13 nt, Human
guccucugaauga

SEQ ID NO: 1926568 - RNA, 17 nt, Human
guccucugaaugaaccu

SEQ ID NO: 1926569 - RNA, 18 nt, Human
guccucugucagucacag

SEQ ID NO: 1926570 - RNA, 19 nt, Human
guccucugucagucacagc

SEQ ID NO: 1926571 - RNA, 20 nt, Human
guccucugucagucacagcc

SEQ ID NO: 1926572 - RNA, 23 nt, Human
guccucugucagucacagccacc

SEQ ID NO: 1926573 - RNA, 20 nt, Human
aagcuuauuaaugcuaaggg

SEQ ID NO: 1926574 - RNA, 18 nt, Human
aagcuuauuaaugcuaag

SEQ ID NO: 1926575 - RNA, 17 nt, Human
aagcuuauuaaugcuaa

SEQ ID NO: 1926576 - RNA, 16 nt, Human
aagcuuauuaaugcua

SEQ ID NO: 1926577 - RNA, 15 nt, Human
aagcuuauuaaugcu

SEQ ID NO: 1926578 - RNA, 14 nt, Human
aagcuuauuaaugc

SEQ ID NO: 1926579 - RNA, 19 nt, Human
aagcuuauuaaugcuaagg

SEQ ID NO: 1926580 - RNA, 15 nt, Human
aagcuuccaugauuc

SEQ ID NO: 1926581 - RNA, 20 nt, Human
aagcuuccaugauucuauuu

SEQ ID NO: 1926582 - RNA, 17 nt, Human
aagcuaucguaaaauua

SEQ ID NO: 1926583 - RNA, 22 nt, Human
aagcuauucaguaauaacucua

SEQ ID NO: 1926584 - RNA, 18 nt, Human
aagcuccucuccccagcc

SEQ ID NO: 1926585 - RNA, 21 nt, Human
aagcucuacugaggugcuaug

SEQ ID NO: 1926586 - RNA, 19 nt, Human
aagcuccucuccccagccc

SEQ ID NO: 1926587 - RNA, 20 nt, Human
aagcuccucuccccagccca

SEQ ID NO: 1926588 - RNA, 21 nt, Human
aagcuccucuccccagcccag

SEQ ID NO: 1926589 - RNA, 22 nt, Human
aagcuccucuccccagcccaga

SEQ ID NO: 1926590 - RNA, 23 nt, Human
aagcuccucuccccagcccagag

SEQ ID NO: 1926591 - RNA, 20 nt, Human
guuccauggccucuucagau

SEQ ID NO: 1926592 - RNA, 19 nt, Human
guucccaagcucagaggcg

SEQ ID NO: 1926593 - RNA, 21 nt, Human
guucccauccucuucuuuuag

SEQ ID NO: 1926594 - RNA, 17 nt, Human
guucccauguagccccc

SEQ ID NO: 1926595 - RNA, 16 nt, Human
aagcuuccaugauucu

SEQ ID NO: 1926596 - RNA, 15 nt, Human
aagcuuuaccagcug

SEQ ID NO: 1926597 - RNA, 20 nt, Human
guucccauuugcuccuuucu

SEQ ID NO: 1926598 - RNA, 16 nt, Human
guucccauuugcuccu

SEQ ID NO: 1926599 - RNA, 23 nt, Human
guucccauccucuucuuuuagca

SEQ ID NO: 1926600 - RNA, 18 nt, Human
guucccauguagcccccu

SEQ ID NO: 1926601 - RNA, 19 nt, Human
guucccauguagcccccug

SEQ ID NO: 1926602 - RNA, 13 nt, Human
guucucuccuucu

SEQ ID NO: 1926603 - RNA, 12 nt, Human
guucucuagaaa

SEQ ID NO: 1926604 - RNA, 14 nt, Human
guucucuagaaaga

SEQ ID NO: 1926605 - RNA, 15 nt, Human
guucucuagaaagaa

SEQ ID NO: 1926606 - RNA, 20 nt, Human
guucccuuugacgccauccc

SEQ ID NO: 1926607 - RNA, 21 nt, Human
guucccuuugacgccauccca

SEQ ID NO: 1926608 - RNA, 22 nt, Human
guucccuuugacgccaucccag

SEQ ID NO: 1926609 - RNA, 16 nt, Human
guucuacccaggugcu

SEQ ID NO: 1926610 - RNA, 22 nt, Human
guugaugaucuuugcagacagg

SEQ ID NO: 1926611 - RNA, 17 nt, Human
guucuuaguuugcaguu

SEQ ID NO: 1926612 - RNA, 19 nt, Human
guucuuaguugcuguaugu

SEQ ID NO: 1926613 - RNA, 21 nt, Human
guucuugguuuguaaauuaac

SEQ ID NO: 1926614 - RNA, 14 nt, Human
guucuucaucuaag

SEQ ID NO: 1926615 - RNA, 22 nt, Human
guucauauguaccauguacaug

SEQ ID NO: 1926616 - RNA, 15 nt, Human
aagccucgacacaga

SEQ ID NO: 1926617 - RNA, 21 nt, Human
aagccugaaggggcgucuguu

SEQ ID NO: 1926618 - RNA, 19 nt, Human
guucauauguaccauguac

SEQ ID NO: 1926619 - RNA, 19 nt, Human
aagccuccuccagccgcca

SEQ ID NO: 1926620 - RNA, 17 nt, Human
aagccugggauugacag

SEQ ID NO: 1926621 - RNA, 15 nt, Human
aagccuggucagccc

SEQ ID NO: 1926622 - RNA, 22 nt, Human
aagcuaggccuggccagaugca

SEQ ID NO: 1926623 - RNA, 17 nt, Human
aagccuggucagcccaa

SEQ ID NO: 1926624 - RNA, 21 nt, Human
aagcuauaaauuccucuuugc

SEQ ID NO: 1926625 - RNA, 18 nt, Human
aagcuaggccuggccaga

SEQ ID NO: 1926626 - RNA, 17 nt, Human
aagcuaggccuggccag

SEQ ID NO: 1926627 - RNA, 17 nt, Human
guucagcuccagcucac

SEQ ID NO: 1926628 - RNA, 16 nt, Human
guucagcuccagcuca

SEQ ID NO: 1926629 - RNA, 18 nt, Human
guucagcuccagcucacc

SEQ ID NO: 1926630 - RNA, 23 nt, Human
guuauuuaacagcugaauuaucu

SEQ ID NO: 1926631 - RNA, 19 nt, Human
guucaggguuggccccugc

SEQ ID NO: 1926632 - RNA, 18 nt, Human
guucaggguuggccccug

SEQ ID NO: 1926633 - RNA, 17 nt, Human
guucaggguuggccccu

SEQ ID NO: 1926634 - RNA, 18 nt, Human
guguuuuaaaaugagaaa

SEQ ID NO: 1926635 - RNA, 14 nt, Human
guuaagcuuugaca

SEQ ID NO: 1926636 - RNA, 11 nt, Human
guguuuguguu

SEQ ID NO: 1926637 - RNA, 16 nt, Human
guuaagcuuugacacu

SEQ ID NO: 1926638 - RNA, 18 nt, Human
guuaaugauagcuacugu

SEQ ID NO: 1926639 - RNA, 15 nt, Human
guuaaugcuuucuga

SEQ ID NO: 1926640 - RNA, 14 nt, Human
guuaaguucuauug

SEQ ID NO: 1926641 - RNA, 22 nt, Human
guuaaguuuuucccuucaucug

SEQ ID NO: 1926642 - RNA, 12 nt, Human
guuagucauuug

SEQ ID NO: 1926643 - RNA, 22 nt, Human
guuagucauuugcugagcaugu

SEQ ID NO: 1926644 - RNA, 20 nt, Human
guuaguaugaggcauuuguu

SEQ ID NO: 1926645 - RNA, 22 nt, Human
guuagucucuuguauuaaacuc

SEQ ID NO: 1926646 - RNA, 17 nt, Human
guuaguaugaggcauuu

SEQ ID NO: 1926647 - RNA, 23 nt, Human
guuaguaacaugaggggacauuu

SEQ ID NO: 1926648 - RNA, 17 nt, Human
guuacacagugugaaua

SEQ ID NO: 1926649 - RNA, 18 nt, Human
guuagcagacaggccccg

SEQ ID NO: 1926650 - RNA, 13 nt, Human
guuagcagacagg

SEQ ID NO: 1926651 - RNA, 13 nt, Human
guuaaugcuuucu

SEQ ID NO: 1926652 - RNA, 15 nt, Human
guuugauuucauuaa

SEQ ID NO: 1926653 - RNA, 22 nt, Human
guuugauucagacagcugccug

SEQ ID NO: 1926654 - RNA, 23 nt, Human
guuucuaaaggcuaccuuuguau

SEQ ID NO: 1926655 - RNA, 22 nt, Human
guuucuaaaggcuaccuuugua

SEQ ID NO: 1926656 - RNA, 16 nt, Human
guuugccucugccucu

SEQ ID NO: 1926657 - RNA, 13 nt, Human
guuugccucugcc

SEQ ID NO: 1926658 - RNA, 16 nt, Human
guuugggaccccuggu

SEQ ID NO: 1926659 - RNA, 19 nt, Human
guuugggauccuauugaac

SEQ ID NO: 1926660 - RNA, 22 nt, Human
guuugggaccccuggugguuca

SEQ ID NO: 1926661 - RNA, 18 nt, Human
guuugccgguggugcagg

SEQ ID NO: 1926662 - RNA, 19 nt, Human
guuugccgguggugcaggu

SEQ ID NO: 1926663 - RNA, 15 nt, Human
guuugcaaggaagcc

SEQ ID NO: 1926664 - RNA, 14 nt, Human
guuugcaaggaagc

SEQ ID NO: 1926665 - RNA, 13 nt, Human
guuugcaaggaag

SEQ ID NO: 1926666 - RNA, 22 nt, Human
guuugcaaggaagccacagcug

SEQ ID NO: 1926667 - RNA, 17 nt, Human
guuugcaaggaagccac

SEQ ID NO: 1926668 - RNA, 18 nt, Human
guuuggggaugagaaagg

SEQ ID NO: 1926669 - RNA, 22 nt, Human
guuuuaauuuauacuggcaugc

SEQ ID NO: 1926670 - RNA, 15 nt, Human
guuuuacugcagcuu

SEQ ID NO: 1926671 - RNA, 12 nt, Human
guuuuacauugu

SEQ ID NO: 1926672 - RNA, 21 nt, Human
guuuuacauuguugagcuauu

SEQ ID NO: 1926673 - RNA, 23 nt, Human
guuuuaggucuagccuaugugga

SEQ ID NO: 1926674 - RNA, 20 nt, Human
guuuucuuaaccagaucauu

SEQ ID NO: 1926675 - RNA, 12 nt, Human
guuuucuguucu

SEQ ID NO: 1926676 - RNA, 16 nt, Human
guuuucuuaacuuaaa

SEQ ID NO: 1926677 - RNA, 11 nt, Human
guuuucuguuc

SEQ ID NO: 1926678 - RNA, 16 nt, Human
aaggguaucaggugcu

SEQ ID NO: 1926679 - RNA, 17 nt, Human
aagguaauuucuugugc

SEQ ID NO: 1926680 - RNA, 13 nt, Human
aaguaaaaacaaa

SEQ ID NO: 1926681 - RNA, 20 nt, Human
aaguaaaaacaaagaaauua

SEQ ID NO: 1926682 - RNA, 22 nt, Human
aaguaaaaacaaagaaauuaug

SEQ ID NO: 1926683 - RNA, 12 nt, Human
aaguaauaugca

SEQ ID NO: 1926684 - RNA, 19 nt, Human
guuucuaaaggcuaccuuu

SEQ ID NO: 1926685 - RNA, 16 nt, Human
aaguaauaugcacaca

SEQ ID NO: 1926686 - RNA, 15 nt, Human
aaguaauaugcacac

SEQ ID NO: 1926687 - RNA, 13 nt, Human
aagggccuggccu

SEQ ID NO: 1926688 - RNA, 23 nt, Human
aaggggaauguuugccucugccu

SEQ ID NO: 1926689 - RNA, 22 nt, Human
aaggggaauguuugccucugcc

SEQ ID NO: 1926690 - RNA, 19 nt, Human
aagggccuggccugagcug

SEQ ID NO: 1926691 - RNA, 14 nt, Human
aagggccuggccug

SEQ ID NO: 1926692 - RNA, 17 nt, Human
aagggccuggccugagc

SEQ ID NO: 1926693 - RNA, 13 nt, Human
guuggguggaugc

SEQ ID NO: 1926694 - RNA, 21 nt, Human
guugcuguuuuccucccuucu

SEQ ID NO: 1926695 - RNA, 23 nt, Human
guugcuguuuuccucccuucugc

SEQ ID NO: 1926696 - RNA, 18 nt, Human
guuggucccccuuccaug

SEQ ID NO: 1926697 - RNA, 17 nt, Human
guugcuguuuuccuccc

SEQ ID NO: 1926698 - RNA, 18 nt, Human
guugcuguuuuccucccu

SEQ ID NO: 1926699 - RNA, 19 nt, Human
guugcuguuuuccucccuu

SEQ ID NO: 1926700 - RNA, 18 nt, Human
guuguaccgcaaugugac

SEQ ID NO: 1926701 - RNA, 14 nt, Human
guuguacuucauuu

SEQ ID NO: 1926702 - RNA, 23 nt, Human
guuguauacuuccuuaugcuucu

SEQ ID NO: 1926703 - RNA, 18 nt, Human
guuguaucagcacgugug

SEQ ID NO: 1926704 - RNA, 16 nt, Human
guuuaugugugugugu

SEQ ID NO: 1926705 - RNA, 13 nt, Human
guuuaugugugug

SEQ ID NO: 1926706 - RNA, 14 nt, Human
guuuaauuuaaagc

SEQ ID NO: 1926707 - RNA, 15 nt, Human
guuuaauuuaaagcc

SEQ ID NO: 1926708 - RNA, 19 nt, Human
guuuaauuuuauaaacaaa

SEQ ID NO: 1926709 - RNA, 20 nt, Human
guuuacaaauggacauagga

SEQ ID NO: 1926710 - RNA, 18 nt, Human
guuuacaagcccccccuu

SEQ ID NO: 1926711 - RNA, 19 nt, Human
guuuacaagcccccccuuc

SEQ ID NO: 1926712 - RNA, 22 nt, Human
guuuacaagcccccccuuccac

SEQ ID NO: 1926713 - RNA, 21 nt, Human
guugcccaggcuggcgugcag

SEQ ID NO: 1926714 - RNA, 19 nt, Human
guugcccaggcaggucuug

SEQ ID NO: 1926715 - RNA, 18 nt, Human
guugcccaggcaggucuu

SEQ ID NO: 1926716 - RNA, 17 nt, Human
guugcccaggcaggucu

SEQ ID NO: 1926717 - RNA, 14 nt, Human
aaggcuccaggagc

SEQ ID NO: 1926718 - RNA, 18 nt, Human
aaggccaaaggaagcaca

SEQ ID NO: 1926719 - RNA, 15 nt, Human
aaggaugugauugug

SEQ ID NO: 1926720 - RNA, 17 nt, Human
aaggaugugauugugga

SEQ ID NO: 1926721 - RNA, 22 nt, Human
aaggaugugauuguggaaugga

SEQ ID NO: 1926722 - RNA, 17 nt, Human
aaggccagaccugcaga

SEQ ID NO: 1926723 - RNA, 18 nt, Human
aaggccagaccugcagac

SEQ ID NO: 1926724 - RNA, 20 nt, Human
aaggccagaccugcagacgc

SEQ ID NO: 1926725 - RNA, 19 nt, Human
aaggcuaccuuuguauucu

SEQ ID NO: 1926726 - RNA, 23 nt, Human
aaggcuauggggauagaugugug

SEQ ID NO: 1926727 - RNA, 23 nt, Human
guugaugaucuuugcagacaggc

SEQ ID NO: 1926728 - RNA, 22 nt, Human
guugaucuggaacccagacuca

SEQ ID NO: 1926729 - RNA, 14 nt, Human
aaggauccugagcc

SEQ ID NO: 1926730 - RNA, 13 nt, Human
aaggauccugagc

SEQ ID NO: 1926731 - RNA, 15 nt, Human
aaggauccugagcca

SEQ ID NO: 1926732 - RNA, 17 nt, Human
aaggauccugagccaga

SEQ ID NO: 1926733 - RNA, 18 nt, Human
aaggaugaucuaggaaga

SEQ ID NO: 1926734 - RNA, 23 nt, Human
aaggaugaucuaggaagacuuug

SEQ ID NO: 1926735 - RNA, 19 nt, Human
aaggaugcuuguacauaau

SEQ ID NO: 1926736 - RNA, 17 nt, Human
aaggaugcuuguacaua

SEQ ID NO: 1926737 - RNA, 16 nt, Human
aaggaugcuuguacau

SEQ ID NO: 1926738 - RNA, 15 nt, Human
aaggaugcuuguaca

SEQ ID NO: 1926739 - RNA, 18 nt, Human
aaggaugcacagaguugu

SEQ ID NO: 1926740 - RNA, 15 nt, Human
aagaccucagggcac

SEQ ID NO: 1926741 - RNA, 17 nt, Human
aagaccucaccuagaaa

SEQ ID NO: 1926742 - RNA, 16 nt, Human
aagaccucaccuagaa

SEQ ID NO: 1926743 - RNA, 17 nt, Human
aagaccuggcagcucug

SEQ ID NO: 1926744 - RNA, 16 nt, Human
aagacuaucuaaaugu

SEQ ID NO: 1926745 - RNA, 17 nt, Human
aagacuaucuaaauguu

SEQ ID NO: 1926746 - RNA, 22 nt, Human
aagacccuuguggucccacccc

SEQ ID NO: 1926747 - RNA, 18 nt, Human
aagacccuugugguccca

SEQ ID NO: 1926748 - RNA, 21 nt, Human
aagacccuuguggucccaccc

SEQ ID NO: 1926749 - RNA, 22 nt, Human
aagacugaguacguugugcauu

SEQ ID NO: 1926750 - RNA, 21 nt, Human
aagacugaguacguugugcau

SEQ ID NO: 1926751 - RNA, 17 nt, Human
aagacuguacaaaguag

SEQ ID NO: 1926752 - RNA, 17 nt, Human
aagacugaguacguugu

SEQ ID NO: 1926753 - RNA, 18 nt, Human
aagacuaucuaaauguug

SEQ ID NO: 1926754 - RNA, 14 nt, Human
guggguacgggagg

SEQ ID NO: 1926755 - RNA, 20 nt, Human
gugggggaucacagccucug

SEQ ID NO: 1926756 - RNA, 16 nt, Human
guggggggcuucauac

SEQ ID NO: 1926757 - RNA, 15 nt, Human
guggggggcuucaua

SEQ ID NO: 1926758 - RNA, 14 nt, Human
guggugguuuucug

SEQ ID NO: 1926759 - RNA, 16 nt, Human
gugguuucagaaaugu

SEQ ID NO: 1926760 - RNA, 19 nt, Human
guggugguaacccuggugg

SEQ ID NO: 1926761 - RNA, 20 nt, Human
guggugguaacccugguggu

SEQ ID NO: 1926762 - RNA, 16 nt, Human
guggugguaacccugg

SEQ ID NO: 1926763 - RNA, 13 nt, Human
gugggucugugug

SEQ ID NO: 1926764 - RNA, 16 nt, Human
gugggucugugugugu

SEQ ID NO: 1926765 - RNA, 13 nt, Human
gugggagugggcc

SEQ ID NO: 1926766 - RNA, 14 nt, Human
gugggagugggccc

SEQ ID NO: 1926767 - RNA, 13 nt, Human
gugggauccucca

SEQ ID NO: 1926768 - RNA, 14 nt, Human
gugggaguguguaa

SEQ ID NO: 1926769 - RNA, 13 nt, Human
gugggagugugua

SEQ ID NO: 1926770 - RNA, 13 nt, Human
gugggagggggag

SEQ ID NO: 1926771 - RNA, 23 nt, Human
guggcgcagcauauucaggaagc

SEQ ID NO: 1926772 - RNA, 22 nt, Human
gugggacacccugugauggggc

SEQ ID NO: 1926773 - RNA, 13 nt, Human
aagcaagacugag

SEQ ID NO: 1926774 - RNA, 15 nt, Human
aagcaagauuucaga

SEQ ID NO: 1926775 - RNA, 12 nt, Human
aagcaaaggaga

SEQ ID NO: 1926776 - RNA, 13 nt, Human
aagcaaaggagau

SEQ ID NO: 1926777 - RNA, 14 nt, Human
aagcaaagggcucc

SEQ ID NO: 1926778 - RNA, 14 nt, Human
aagaugugacaugu

SEQ ID NO: 1926779 - RNA, 18 nt, Human
aagaugugacauguuuua

SEQ ID NO: 1926780 - RNA, 18 nt, Human
aagagguuuuaaaaaaau

SEQ ID NO: 1926781 - RNA, 18 nt, Human
aagagguuuuaaagcuuc

SEQ ID NO: 1926782 - RNA, 14 nt, Human
aagagguuuuaaag

SEQ ID NO: 1926783 - RNA, 17 nt, Human
gugguuuucuguucuuu

SEQ ID NO: 1926784 - RNA, 20 nt, Human
guggugguuuucuguucuuu

SEQ ID NO: 1926785 - RNA, 12 nt, Human
aagaugcagccg

SEQ ID NO: 1926786 - RNA, 20 nt, Human
aagaucuguuuugaaggcaa

SEQ ID NO: 1926787 - RNA, 21 nt, Human
aagaucuguuuugaaggcaaa

SEQ ID NO: 1926788 - RNA, 22 nt, Human
aagaucuguuuugaaggcaaaa

SEQ ID NO: 1926789 - RNA, 19 nt, Human
aagaucuguccucagccuu

SEQ ID NO: 1926790 - RNA, 20 nt, Human
aagaucuguccucagccuug

SEQ ID NO: 1926791 - RNA, 12 nt, Human
guguguaugugg

SEQ ID NO: 1926792 - RNA, 23 nt, Human
guguuuccuggcacugcuuccag

SEQ ID NO: 1926793 - RNA, 14 nt, Human
guguugucccuucu

SEQ ID NO: 1926794 - RNA, 15 nt, Human
guguuguguguggga

SEQ ID NO: 1926795 - RNA, 15 nt, Human
guguugccacaggac

SEQ ID NO: 1926796 - RNA, 17 nt, Human
guguugccacaggacac

SEQ ID NO: 1926797 - RNA, 18 nt, Human
guguugccacaggacaca

SEQ ID NO: 1926798 - RNA, 18 nt, Human
gugucuuuuuucacuaca

SEQ ID NO: 1926799 - RNA, 17 nt, Human
gugugacuacuccccca

SEQ ID NO: 1926800 - RNA, 14 nt, Human
guguguaauuuaaa

SEQ ID NO: 1926801 - RNA, 18 nt, Human
gugucuugcaauggcagc

SEQ ID NO: 1926802 - RNA, 17 nt, Human
gugucuugcaauggcag

SEQ ID NO: 1926803 - RNA, 17 nt, Human
gugucuuuccacuccuc

SEQ ID NO: 1926804 - RNA, 14 nt, Human
gugccucauugcuu

SEQ ID NO: 1926805 - RNA, 12 nt, Human
gugccucuggga

SEQ ID NO: 1926806 - RNA, 13 nt, Human
gugccucugggac

SEQ ID NO: 1926807 - RNA, 14 nt, Human
gugccucugggacu

SEQ ID NO: 1926808 - RNA, 14 nt, Human
gugccuuauggaac

SEQ ID NO: 1926809 - RNA, 21 nt, Human
gugccuuauggaacacucuga

SEQ ID NO: 1926810 - RNA, 23 nt, Human
gugccuuauggaacacucugaga

SEQ ID NO: 1926811 - RNA, 20 nt, Human
gugccguguguugcaugcag

SEQ ID NO: 1926812 - RNA, 15 nt, Human
gugccucaagagaag

SEQ ID NO: 1926813 - RNA, 21 nt, Human
gugaaccaccacacccagccc

SEQ ID NO: 1926814 - RNA, 13 nt, Human
aacuuuaccuuuu

SEQ ID NO: 1926815 - RNA, 13 nt, Human
aacuuuaaauuau

SEQ ID NO: 1926816 - RNA, 13 nt, Human
aacuuuaagagga

SEQ ID NO: 1926817 - RNA, 15 nt, Human
aacuuuaagaggaca

SEQ ID NO: 1926818 - RNA, 21 nt, Human
aacuuggggaguuaagaccug

SEQ ID NO: 1926819 - RNA, 22 nt, Human
aacuuggggaguuaagaccugg

SEQ ID NO: 1926820 - RNA, 11 nt, Human
gugccuuaugg

SEQ ID NO: 1926821 - RNA, 15 nt, Human
aacuuguauuaugug

SEQ ID NO: 1926822 - RNA, 23 nt, Human
aacuuggggaguuaagaccuggc

SEQ ID NO: 1926823 - RNA, 16 nt, Human
aacuuguauuaugugu

SEQ ID NO: 1926824 - RNA, 22 nt, Human
aacuugucuuuggacccugagg

SEQ ID NO: 1926825 - RNA, 20 nt, Human
aacuugucaaaaaacaaaaa

SEQ ID NO: 1926826 - RNA, 18 nt, Human
aacuugucuuuggacccu

SEQ ID NO: 1926827 - RNA, 18 nt, Human
gugcuaggaacacuccuu

SEQ ID NO: 1926828 - RNA, 22 nt, Human
gugcuaggaacacuccuucaca

SEQ ID NO: 1926829 - RNA, 21 nt, Human
gugcuaucucccccagcccca

SEQ ID NO: 1926830 - RNA, 22 nt, Human
aagaagugaaaaucuacacucc

SEQ ID NO: 1926831 - RNA, 16 nt, Human
aagaagugaaaaucua

SEQ ID NO: 1926832 - RNA, 19 nt, Human
aagaagugugucacccuua

SEQ ID NO: 1926833 - RNA, 19 nt, Human
aagaaggcagcagguggca

SEQ ID NO: 1926834 - RNA, 16 nt, Human
aagaaggcaaaaaugu

SEQ ID NO: 1926835 - RNA, 17 nt, Human
aagaaggaaaaggcagg

SEQ ID NO: 1926836 - RNA, 14 nt, Human
aagaaggcaaaaau

SEQ ID NO: 1926837 - RNA, 13 nt, Human
aagaaauauaccu

SEQ ID NO: 1926838 - RNA, 23 nt, Human
aagaaauaucugagcucuuugca

SEQ ID NO: 1926839 - RNA, 20 nt, Human
aagaaagacuaucuaaaugu

SEQ ID NO: 1926840 - RNA, 22 nt, Human
aagaaagacuaucuaaauguug

SEQ ID NO: 1926841 - RNA, 18 nt, Human
aagaaaaaggaugcacag

SEQ ID NO: 1926842 - RNA, 17 nt, Human
aagaaaaaggaugcaca

SEQ ID NO: 1926843 - RNA, 15 nt, Human
aagaaaaaggaugca

SEQ ID NO: 1926844 - RNA, 21 nt, Human
guggaugccugguggcagcug

SEQ ID NO: 1926845 - RNA, 17 nt, Human
guggauuauuucauuuu

SEQ ID NO: 1926846 - RNA, 21 nt, Human
guggaccuuaggccuuccucu

SEQ ID NO: 1926847 - RNA, 17 nt, Human
guggaccuuaggccuuc

SEQ ID NO: 1926848 - RNA, 18 nt, Human
guggaccuuaggccuucc

SEQ ID NO: 1926849 - RNA, 22 nt, Human
guggaccaucgcugucaugagu

SEQ ID NO: 1926850 - RNA, 22 nt, Human
guggacacagcucuucuccagg

SEQ ID NO: 1926851 - RNA, 18 nt, Human
guggacacagcucuucuc

SEQ ID NO: 1926852 - RNA, 23 nt, Human
guggacacagcucuucuccaggc

SEQ ID NO: 1926853 - RNA, 19 nt, Human
guggaauuauuuuaaaaga

SEQ ID NO: 1926854 - RNA, 22 nt, Human
guggaagugugggucugugugu

SEQ ID NO: 1926855 - RNA, 21 nt, Human
guggaagugugggucugugug

SEQ ID NO: 1926856 - RNA, 18 nt, Human
guggaauuauuuuaaaag

SEQ ID NO: 1926857 - RNA, 16 nt, Human
guggaauuauuuuaaa

SEQ ID NO: 1926858 - RNA, 15 nt, Human
guggaauuauuuuaa

SEQ ID NO: 1926859 - RNA, 20 nt, Human
gugcugggauuacaggugug

SEQ ID NO: 1926860 - RNA, 19 nt, Human
guggaaguaguggagcccc

SEQ ID NO: 1926861 - RNA, 20 nt, Human
guggaagugugggucugugu

SEQ ID NO: 1926862 - RNA, 19 nt, Human
guggaagugugggucugug

SEQ ID NO: 1926863 - RNA, 15 nt, Human
guggaaguguggguc

SEQ ID NO: 1926864 - RNA, 14 nt, Human
guggaagugugggu

SEQ ID NO: 1926865 - RNA, 22 nt, Human
gugcugggauuacaagcgugag

SEQ ID NO: 1926866 - RNA, 21 nt, Human
gugcugggauuacaagcguga

SEQ ID NO: 1926867 - RNA, 15 nt, Human
gugcucaggagcccu

SEQ ID NO: 1926868 - RNA, 12 nt, Human
gugcuauguucu

SEQ ID NO: 1926869 - RNA, 23 nt, Human
gugcuauuguagagccagagguc

SEQ ID NO: 1926870 - RNA, 22 nt, Human
gugcuaucucccccagccccau

SEQ ID NO: 1926871 - RNA, 19 nt, Human
guggauuuaacagaaaugu

SEQ ID NO: 1926872 - RNA, 18 nt, Human
guggauuuaacagaaaug

SEQ ID NO: 1926873 - RNA, 20 nt, Human
guggauuuaacagaaaugua

SEQ ID NO: 1926874 - RNA, 19 nt, Human
guggcaccagcagccugga

SEQ ID NO: 1926875 - RNA, 18 nt, Human
guggcaccagcagccugg

SEQ ID NO: 1926876 - RNA, 20 nt, Human
guggcagcucaccucucccu

SEQ ID NO: 1926877 - RNA, 14 nt, Human
guggcagcucaccu

SEQ ID NO: 1926878 - RNA, 16 nt, Human
guggcagcucaccucu

SEQ ID NO: 1926879 - RNA, 16 nt, Human
aagaauugaagcagga

SEQ ID NO: 1926880 - RNA, 16 nt, Human
aagacaaaaagcuacu

SEQ ID NO: 1926881 - RNA, 23 nt, Human
aagacaaaaagcuacuuauugua

SEQ ID NO: 1926882 - RNA, 20 nt, Human
aagacaaaaagcuacuuauu

SEQ ID NO: 1926883 - RNA, 20 nt, Human
aagaauugucuuucugucuc

SEQ ID NO: 1926884 - RNA, 19 nt, Human
aaugcagucuguccaggcu

SEQ ID NO: 1926885 - RNA, 20 nt, Human
aaugcagucuguccaggcuc

SEQ ID NO: 1926886 - RNA, 16 nt, Human
uacaaacaaaauuucu

SEQ ID NO: 1926887 - RNA, 14 nt, Human
aaugcccagccccu

SEQ ID NO: 1926888 - RNA, 15 nt, Human
aaugcccagccccuu

SEQ ID NO: 1926889 - RNA, 13 nt, Human
aaugcugugcccu

SEQ ID NO: 1926890 - RNA, 21 nt, Human
aaugccccugaauuuaaauag

SEQ ID NO: 1926891 - RNA, 21 nt, Human
aaugcugugcccuaaagugua

SEQ ID NO: 1926892 - RNA, 20 nt, Human
aaugcugugcccuaaagugu

SEQ ID NO: 1926893 - RNA, 20 nt, Human
aaugcccagccccuucugac

SEQ ID NO: 1926894 - RNA, 22 nt, Human
aaugcccagccccuucugaccc

SEQ ID NO: 1926895 - RNA, 23 nt, Human
aaugcccagccccuucugaccca

SEQ ID NO: 1926896 - RNA, 24 nt, Human
aaugcccagccccuucugacccau

SEQ ID NO: 1926897 - RNA, 16 nt, Human
aauggacguguuauga

SEQ ID NO: 1926898 - RNA, 19 nt, Human
aauggacauaggacucaaa

SEQ ID NO: 1926899 - RNA, 13 nt, Human
aaugcuuucugaa

SEQ ID NO: 1926900 - RNA, 17 nt, Human
aaugcuuucugaagcuu

SEQ ID NO: 1926901 - RNA, 19 nt, Human
aaugcuuuuuauuucugca

SEQ ID NO: 1926902 - RNA, 20 nt, Human
aaugcuuuuuauuucugcau

SEQ ID NO: 1926903 - RNA, 15 nt, Human
uaauuccacaccuuu

SEQ ID NO: 1926904 - RNA, 17 nt, Human
uaauuccacaccuuuua

SEQ ID NO: 1926905 - RNA, 23 nt, Human
uaauuuaucuugucucugggcuu

SEQ ID NO: 1926906 - RNA, 14 nt, Human
uaauuuauacuggc

SEQ ID NO: 1926907 - RNA, 16 nt, Human
uaauuuaaaauuguga

SEQ ID NO: 1926908 - RNA, 15 nt, Human
uaauuuaaaauugug

SEQ ID NO: 1926909 - RNA, 17 nt, Human
uaauuguuugucuuuaa

SEQ ID NO: 1926910 - RNA, 15 nt, Human
uacaaaagcauguga

SEQ ID NO: 1926911 - RNA, 12 nt, Human
uacaaaacuucc

SEQ ID NO: 1926912 - RNA, 20 nt, Human
uacaaaaagcauaaaaauua

SEQ ID NO: 1926913 - RNA, 15 nt, Human
uacaaaaagcauaaa

SEQ ID NO: 1926914 - RNA, 15 nt, Human
uaauuucaaaaugcu

SEQ ID NO: 1926915 - RNA, 16 nt, Human
uaauuucaaaaugcuu

SEQ ID NO: 1926916 - RNA, 20 nt, Human
uaauuucaaaaugcuuuuua

SEQ ID NO: 1926917 - RNA, 21 nt, Human
uaauuucagcuucuauauauu

SEQ ID NO: 1926918 - RNA, 20 nt, Human
uaauuuauuaauugcuuuga

SEQ ID NO: 1926919 - RNA, 19 nt, Human
uaauuuauacuggcaugcu

SEQ ID NO: 1926920 - RNA, 17 nt, Human
uaauuuauuaauugcuu

SEQ ID NO: 1926921 - RNA, 18 nt, Human
uaauuuauuaauugcuuu

SEQ ID NO: 1926922 - RNA, 19 nt, Human
uaauuuauuaauugcuuug

SEQ ID NO: 1926923 - RNA, 12 nt, Human
uaauuucaaaau

SEQ ID NO: 1926924 - RNA, 19 nt, Human
aauggacuuuuguacauag

SEQ ID NO: 1926925 - RNA, 21 nt, Human
aauggacguguuaugacucca

SEQ ID NO: 1926926 - RNA, 19 nt, Human
uacacauuuuucagauaua

SEQ ID NO: 1926927 - RNA, 21 nt, Human
uacacauuuuucagauauaaa

SEQ ID NO: 1926928 - RNA, 17 nt, Human
uacacauuuuucagaua

SEQ ID NO: 1926929 - RNA, 15 nt, Human
uacacauuuuucaga

SEQ ID NO: 1926930 - RNA, 20 nt, Human
aauggagauucaguuuucau

SEQ ID NO: 1926931 - RNA, 18 nt, Human
uacaccacuacauucugu

SEQ ID NO: 1926932 - RNA, 17 nt, Human
uacaccacuacauucug

SEQ ID NO: 1926933 - RNA, 16 nt, Human
uacaccacuacauucu

SEQ ID NO: 1926934 - RNA, 15 nt, Human
uacaccacuacauuc

SEQ ID NO: 1926935 - RNA, 20 nt, Human
uacaccacuacauucuguua

SEQ ID NO: 1926936 - RNA, 19 nt, Human
uacaccacuacauucuguu

SEQ ID NO: 1926937 - RNA, 17 nt, Human
uacaccagcauuccuuu

SEQ ID NO: 1926938 - RNA, 20 nt, Human
uacaccagcauuccuuuuga

SEQ ID NO: 1926939 - RNA, 18 nt, Human
uacaccagcauuccuuuu

SEQ ID NO: 1926940 - RNA, 18 nt, Human
uacagaggccaugggccu

SEQ ID NO: 1926941 - RNA, 18 nt, Human
uacagaggacaguauuug

SEQ ID NO: 1926942 - RNA, 23 nt, Human
uacagagcccacgcccccacugg

SEQ ID NO: 1926943 - RNA, 14 nt, Human
uacagaggacagua

SEQ ID NO: 1926944 - RNA, 14 nt, Human
uacacuccagugag

SEQ ID NO: 1926945 - RNA, 11 nt, Human
aaugugauaug

SEQ ID NO: 1926946 - RNA, 12 nt, Human
aauguggcuuga

SEQ ID NO: 1926947 - RNA, 16 nt, Human
aauguggcuugagaaa

SEQ ID NO: 1926948 - RNA, 21 nt, Human
aauguggcuugagaaauaugg

SEQ ID NO: 1926949 - RNA, 14 nt, Human
aaugugacucaaga

SEQ ID NO: 1926950 - RNA, 13 nt, Human
aauguauuuucuu

SEQ ID NO: 1926951 - RNA, 23 nt, Human
aauguauuuucuucaccucugcu

SEQ ID NO: 1926952 - RNA, 14 nt, Human
aauguacugcauau

SEQ ID NO: 1926953 - RNA, 18 nt, Human
aauguacugcauaugaaa

SEQ ID NO: 1926954 - RNA, 21 nt, Human
aauguaugcuucauacaggga

SEQ ID NO: 1926955 - RNA, 18 nt, Human
aauguaugcuucauacag

SEQ ID NO: 1926956 - RNA, 12 nt, Human
aauguaugugua

SEQ ID NO: 1926957 - RNA, 14 nt, Human
aauguauguguaag

SEQ ID NO: 1926958 - RNA, 17 nt, Human
uacauaaugcgugcaua

SEQ ID NO: 1926959 - RNA, 15 nt, Human
uacaguaucucaggg

SEQ ID NO: 1926960 - RNA, 20 nt, Human
uacauaaugcgugcauacca

SEQ ID NO: 1926961 - RNA, 19 nt, Human
uacauaaugcgugcauacc

SEQ ID NO: 1926962 - RNA, 23 nt, Human
uacauagcaugacauuucuuugu

SEQ ID NO: 1926963 - RNA, 12 nt, Human
aauguacugcau

SEQ ID NO: 1926964 - RNA, 20 nt, Human
aauguacuaggauacugcug

SEQ ID NO: 1926965 - RNA, 18 nt, Human
aauguacgaugagaaauu

SEQ ID NO: 1926966 - RNA, 19 nt, Human
uacauauaagugauugcug

SEQ ID NO: 1926967 - RNA, 20 nt, Human
aaugacucaggacauccccc

SEQ ID NO: 1926968 - RNA, 22 nt, Human
aaugacagguuugggaccccug

SEQ ID NO: 1926969 - RNA, 15 nt, Human
aaugaaaaccacauu

SEQ ID NO: 1926970 - RNA, 17 nt, Human
aaugacuuacuguacau

SEQ ID NO: 1926971 - RNA, 14 nt, Human
aaugacuuacugua

SEQ ID NO: 1926972 - RNA, 18 nt, Human
aaugacuuacuguacaug

SEQ ID NO: 1926973 - RNA, 13 nt, Human
aaugagaaucuac

SEQ ID NO: 1926974 - RNA, 15 nt, Human
aaugagccuggcaag

SEQ ID NO: 1926975 - RNA, 13 nt, Human
uaaugaggaaacu

SEQ ID NO: 1926976 - RNA, 15 nt, Human
uaaugguuugaauau

SEQ ID NO: 1926977 - RNA, 12 nt, Human
aaucuuuuacaa

SEQ ID NO: 1926978 - RNA, 21 nt, Human
aaucuuuuacaacugccucga

SEQ ID NO: 1926979 - RNA, 18 nt, Human
uaaucaauguuucuucua

SEQ ID NO: 1926980 - RNA, 14 nt, Human
uaaucaaguugaau

SEQ ID NO: 1926981 - RNA, 21 nt, Human
uaauagcgucauaacuagaac

SEQ ID NO: 1926982 - RNA, 14 nt, Human
uaauacuguauuug

SEQ ID NO: 1926983 - RNA, 14 nt, Human
uaauagguuuggac

SEQ ID NO: 1926984 - RNA, 19 nt, Human
uaauagguuuggacaaaau

SEQ ID NO: 1926985 - RNA, 13 nt, Human
aaucuucugaacu

SEQ ID NO: 1926986 - RNA, 20 nt, Human
aaucuucugaacuuggcgcu

SEQ ID NO: 1926987 - RNA, 20 nt, Human
aaucuuauuagggagaaaau

SEQ ID NO: 1926988 - RNA, 12 nt, Human
uaauacuguauu

SEQ ID NO: 1926989 - RNA, 14 nt, Human
uaauacuaccuuga

SEQ ID NO: 1926990 - RNA, 15 nt, Human
uaauacuaccuugaa

SEQ ID NO: 1926991 - RNA, 20 nt, Human
uaauacgaauuguuucacaa

SEQ ID NO: 1926992 - RNA, 12 nt, Human
uaauacuauauu

SEQ ID NO: 1926993 - RNA, 22 nt, Human
uaaucauauaauaaauguacau

SEQ ID NO: 1926994 - RNA, 20 nt, Human
uaaucauauaauaaauguac

SEQ ID NO: 1926995 - RNA, 15 nt, Human
uaaucauauaauaaa

SEQ ID NO: 1926996 - RNA, 14 nt, Human
uaaugaaacuugga

SEQ ID NO: 1926997 - RNA, 14 nt, Human
uaaugaaagacugu

SEQ ID NO: 1926998 - RNA, 17 nt, Human
uaaugaaagacuguaca

SEQ ID NO: 1926999 - RNA, 18 nt, Human
uaaugaaagacuguacaa

SEQ ID NO: 1927000 - RNA, 19 nt, Human
uaaugaaagacuguacaaa

SEQ ID NO: 1927001 - RNA, 20 nt, Human
uaaugaccacaccugccucu

SEQ ID NO: 1927002 - RNA, 15 nt, Human
uaaugacuuaagcac

SEQ ID NO: 1927003 - RNA, 21 nt, Human
uaaugacuuaagcacacuuga

SEQ ID NO: 1927004 - RNA, 22 nt, Human
uaaugaaagacuguacaaagua

SEQ ID NO: 1927005 - RNA, 23 nt, Human
uaaugaaagacuguacaaaguag

SEQ ID NO: 1927006 - RNA, 15 nt, Human
uaaugaaacuuggau

SEQ ID NO: 1927007 - RNA, 16 nt, Human
uaaguuugauuucauu

SEQ ID NO: 1927008 - RNA, 14 nt, Human
uaaguuucugggac

SEQ ID NO: 1927009 - RNA, 20 nt, Human
uaaguuuuuauggcuuuugu

SEQ ID NO: 1927010 - RNA, 14 nt, Human
aaucagacuaugaa

SEQ ID NO: 1927011 - RNA, 17 nt, Human
aaucagacuaugaaguu

SEQ ID NO: 1927012 - RNA, 18 nt, Human
uaauaaaauaucauucag

SEQ ID NO: 1927013 - RNA, 17 nt, Human
uaauaaaauaucauuca

SEQ ID NO: 1927014 - RNA, 16 nt, Human
uaauaaaauaucauuc

SEQ ID NO: 1927015 - RNA, 15 nt, Human
uaauaaaauaucauu

SEQ ID NO: 1927016 - RNA, 12 nt, Human
uaauaaaauauc

SEQ ID NO: 1927017 - RNA, 17 nt, Human
uaauaaaaguacauguu

SEQ ID NO: 1927018 - RNA, 21 nt, Human
uaauaaaauaucauucagcaa

SEQ ID NO: 1927019 - RNA, 20 nt, Human
uaauaaaauaucauucagca

SEQ ID NO: 1927020 - RNA, 15 nt, Human
aaucaucaagucuuu

SEQ ID NO: 1927021 - RNA, 17 nt, Human
aaucauggugcucagag

SEQ ID NO: 1927022 - RNA, 16 nt, Human
aaucuuauaauuuaaa

SEQ ID NO: 1927023 - RNA, 14 nt, Human
aaucuuauaauuua

SEQ ID NO: 1927024 - RNA, 14 nt, Human
aaucucaaauuucu

SEQ ID NO: 1927025 - RNA, 12 nt, Human
aaucucaaauuu

SEQ ID NO: 1927026 - RNA, 15 nt, Human
aaucucaaauaacua

SEQ ID NO: 1927027 - RNA, 16 nt, Human
aaucuaggaaaauauu

SEQ ID NO: 1927028 - RNA, 18 nt, Human
aaucuaggaaaauauuuu

SEQ ID NO: 1927029 - RNA, 17 nt, Human
aaucuacuaauuccaca

SEQ ID NO: 1927030 - RNA, 20 nt, Human
aaucuacugugguguuuugu

SEQ ID NO: 1927031 - RNA, 15 nt, Human
aaucuaaauggaacc

SEQ ID NO: 1927032 - RNA, 13 nt, Human
aaucuaaauggaa

SEQ ID NO: 1927033 - RNA, 18 nt, Human
aaucuaaauggaaccacu

SEQ ID NO: 1927034 - RNA, 15 nt, Human
aaucuacuaauucca

SEQ ID NO: 1927035 - RNA, 16 nt, Human
aaucuacuaauuccac

SEQ ID NO: 1927036 - RNA, 12 nt, Human
aaucuaaaugga

SEQ ID NO: 1927037 - RNA, 15 nt, Human
aauccuaccuguuuu

SEQ ID NO: 1927038 - RNA, 17 nt, Human
aauccuaccuguuuugu

SEQ ID NO: 1927039 - RNA, 16 nt, Human
aauaucauucagcaac

SEQ ID NO: 1927040 - RNA, 15 nt, Human
aauaucauucagcaa

SEQ ID NO: 1927041 - RNA, 14 nt, Human
aauaucauucagca

SEQ ID NO: 1927042 - RNA, 13 nt, Human
aauaucauucagc

SEQ ID NO: 1927043 - RNA, 14 nt, Human
uaacuaaaagguau

SEQ ID NO: 1927044 - RNA, 15 nt, Human
uaacuaaaagguaug

SEQ ID NO: 1927045 - RNA, 16 nt, Human
uaacauggaaguacua

SEQ ID NO: 1927046 - RNA, 15 nt, Human
uaacauggaaguacu

SEQ ID NO: 1927047 - RNA, 16 nt, Human
uaaccucuaaauucuu

SEQ ID NO: 1927048 - RNA, 14 nt, Human
uaacauggaaguac

SEQ ID NO: 1927049 - RNA, 14 nt, Human
uaacaugauuuggg

SEQ ID NO: 1927050 - RNA, 18 nt, Human
aauaggcguaacuaauuu

SEQ ID NO: 1927051 - RNA, 19 nt, Human
aauaggaaaaacugauuuu

SEQ ID NO: 1927052 - RNA, 24 nt, Human
aauagcuuuuuucucugauacaga

SEQ ID NO: 1927053 - RNA, 15 nt, Human
aauagcuuuuguguc

SEQ ID NO: 1927054 - RNA, 17 nt, Human
aauaggaaaaacugauu

SEQ ID NO: 1927055 - RNA, 18 nt, Human
aauaggaaaaacugauuu

SEQ ID NO: 1927056 - RNA, 15 nt, Human
aauaggaaaaacuga

SEQ ID NO: 1927057 - RNA, 16 nt, Human
aauaggaaaaacugau

SEQ ID NO: 1927058 - RNA, 18 nt, Human
aauagauacagcagaggc

SEQ ID NO: 1927059 - RNA, 23 nt, Human
aauagacaauuuauuauggcaca

SEQ ID NO: 1927060 - RNA, 23 nt, Human
aauagacacuccccgaagucuuu

SEQ ID NO: 1927061 - RNA, 22 nt, Human
aauagacacuccccgaagucuu

SEQ ID NO: 1927062 - RNA, 18 nt, Human
aauagacaauuuauuaug

SEQ ID NO: 1927063 - RNA, 15 nt, Human
uaaauuuugugucuc

SEQ ID NO: 1927064 - RNA, 14 nt, Human
aauagcugggacua

SEQ ID NO: 1927065 - RNA, 13 nt, Human
aauagcugggacu

SEQ ID NO: 1927066 - RNA, 20 nt, Human
aauagccugccucuucucua

SEQ ID NO: 1927067 - RNA, 23 nt, Human
aauagccacugcauaccaaccug

SEQ ID NO: 1927068 - RNA, 20 nt, Human
aauagccacauuuggaauac

SEQ ID NO: 1927069 - RNA, 22 nt, Human
aauagccacauuuggaauacuu

SEQ ID NO: 1927070 - RNA, 23 nt, Human
aauagccacauuuggaauacuuu

SEQ ID NO: 1927071 - RNA, 13 nt, Human
aauauuguacagu

SEQ ID NO: 1927072 - RNA, 21 nt, Human
aauauuuuccaugaaaaugca

SEQ ID NO: 1927073 - RNA, 11 nt, Human
aaucagaacuc

SEQ ID NO: 1927074 - RNA, 12 nt, Human
aaucagaacuca

SEQ ID NO: 1927075 - RNA, 23 nt, Human
aaucagaacucaaauggggccag

SEQ ID NO: 1927076 - RNA, 11 nt, Human
aauauugcuga

SEQ ID NO: 1927077 - RNA, 12 nt, Human
aauauugcugau

SEQ ID NO: 1927078 - RNA, 13 nt, Human
aauauugcugaug

SEQ ID NO: 1927079 - RNA, 15 nt, Human
aauauugcugauggu

SEQ ID NO: 1927080 - RNA, 18 nt, Human
aauauugcugauggugca

SEQ ID NO: 1927081 - RNA, 21 nt, Human
aauauugcugauggugcaaug

SEQ ID NO: 1927082 - RNA, 22 nt, Human
aauauugcugauggugcaauga

SEQ ID NO: 1927083 - RNA, 18 nt, Human
aauauugauaugcuuaua

SEQ ID NO: 1927084 - RNA, 17 nt, Human
aauauugauaugcuuau

SEQ ID NO: 1927085 - RNA, 15 nt, Human
aauaugcacacauuu

SEQ ID NO: 1927086 - RNA, 16 nt, Human
aauaucugaaaaugua

SEQ ID NO: 1927087 - RNA, 17 nt, Human
aauaucugaaaauguau

SEQ ID NO: 1927088 - RNA, 18 nt, Human
aauaucugaaaauguaug

SEQ ID NO: 1927089 - RNA, 19 nt, Human
aauaucugaaaauguaugu

SEQ ID NO: 1927090 - RNA, 21 nt, Human
aauaucuccgucaacucauau

SEQ ID NO: 1927091 - RNA, 16 nt, Human
aauaucuccgucaacu

SEQ ID NO: 1927092 - RNA, 12 nt, Human
aauauccuuugc

SEQ ID NO: 1927093 - RNA, 11 nt, Human
uaagaccuggc

SEQ ID NO: 1927094 - RNA, 13 nt, Human
uaagaccuggcag

SEQ ID NO: 1927095 - RNA, 20 nt, Human
aauaucugaaaauguaugug

SEQ ID NO: 1927096 - RNA, 19 nt, Human
aauaucuuuuuuuuaauaa

SEQ ID NO: 1927097 - RNA, 13 nt, Human
aauaugaaaacuu

SEQ ID NO: 1927098 - RNA, 14 nt, Human
aauaugaaaacuua

SEQ ID NO: 1927099 - RNA, 20 nt, Human
uaagacaugauuuccuugaa

SEQ ID NO: 1927100 - RNA, 21 nt, Human
uaagacaugauuuccuugaau

SEQ ID NO: 1927101 - RNA, 18 nt, Human
uaagaauauuugaaugua

SEQ ID NO: 1927102 - RNA, 18 nt, Human
uaacuuuuauaaacuuua

SEQ ID NO: 1927103 - RNA, 17 nt, Human
uaacuuuuauaaacuuu

SEQ ID NO: 1927104 - RNA, 15 nt, Human
uaacuuuuauaaacu

SEQ ID NO: 1927105 - RNA, 21 nt, Human
aauacaaagaaccaagaaaaa

SEQ ID NO: 1927106 - RNA, 13 nt, Human
aauacaaaacuuc

SEQ ID NO: 1927107 - RNA, 20 nt, Human
aauacaaaaauuagccgggc

SEQ ID NO: 1927108 - RNA, 12 nt, Human
aauacaaaacuu

SEQ ID NO: 1927109 - RNA, 12 nt, Human
uaaauaaaguuu

SEQ ID NO: 1927110 - RNA, 21 nt, Human
uaaauaaaguuuguugaaaca

SEQ ID NO: 1927111 - RNA, 19 nt, Human
uaaauaaugugaaacugga

SEQ ID NO: 1927112 - RNA, 12 nt, Human
aauaacuuuuuu

SEQ ID NO: 1927113 - RNA, 13 nt, Human
aauaagaauagaa

SEQ ID NO: 1927114 - RNA, 18 nt, Human
aauaagaauagaaauaaa

SEQ ID NO: 1927115 - RNA, 16 nt, Human
aauaauugcagaacua

SEQ ID NO: 1927116 - RNA, 21 nt, Human
aauaauugcagaacuaaacuc

SEQ ID NO: 1927117 - RNA, 18 nt, Human
uaaaucuccaaaauaaaa

SEQ ID NO: 1927118 - RNA, 15 nt, Human
uaaaucuccaaaaua

SEQ ID NO: 1927119 - RNA, 14 nt, Human
uaaaucuccaaaau

SEQ ID NO: 1927120 - RNA, 15 nt, Human
uaaaucugacccagu

SEQ ID NO: 1927121 - RNA, 16 nt, Human
uaaaucugacccagug

SEQ ID NO: 1927122 - RNA, 17 nt, Human
uaaaucugacccagugc

SEQ ID NO: 1927123 - RNA, 20 nt, Human
uaaaucugcuggaguuucau

SEQ ID NO: 1927124 - RNA, 14 nt, Human
uaaaucugacccag

SEQ ID NO: 1927125 - RNA, 23 nt, Human
uaaaugcaccuggaauauauaac

SEQ ID NO: 1927126 - RNA, 14 nt, Human
uaaaucuuuuacaa

SEQ ID NO: 1927127 - RNA, 15 nt, Human
uaaauguugaaagau

SEQ ID NO: 1927128 - RNA, 23 nt, Human
uaaauguuuuuuuuuaaagacuu

SEQ ID NO: 1927129 - RNA, 20 nt, Human
uaaauguugaaagaucaaaa

SEQ ID NO: 1927130 - RNA, 24 nt, Human
uaaauguuuuuuuuuaaagacuuu

SEQ ID NO: 1927131 - RNA, 14 nt, Human
uaaauuaacuuuua

SEQ ID NO: 1927132 - RNA, 12 nt, Human
uaaauuaacuuu

SEQ ID NO: 1927133 - RNA, 16 nt, Human
uaaauuaacuuuuaua

SEQ ID NO: 1927134 - RNA, 15 nt, Human
uaaauuaacuuuuau

SEQ ID NO: 1927135 - RNA, 17 nt, Human
uaaauuaacuuuuauaa

SEQ ID NO: 1927136 - RNA, 18 nt, Human
uaaauuaacuuuuauaaa

SEQ ID NO: 1927137 - RNA, 20 nt, Human
aauaaauuguaauuguaaag

SEQ ID NO: 1927138 - RNA, 21 nt, Human
aauaacaaugaaaguugauaa

SEQ ID NO: 1927139 - RNA, 20 nt, Human
aauaaauguaucuuauucac

SEQ ID NO: 1927140 - RNA, 21 nt, Human
aauaaauguaucuuauucaca

SEQ ID NO: 1927141 - RNA, 15 nt, Human
aauaacgauaaaaga

SEQ ID NO: 1927142 - RNA, 17 nt, Human
aauaaccggauauauac

SEQ ID NO: 1927143 - RNA, 17 nt, Human
aauaaccaaucuacaau

SEQ ID NO: 1927144 - RNA, 18 nt, Human
aauaaauuugguucuaau

SEQ ID NO: 1927145 - RNA, 18 nt, Human
aauaaaacuuuuuaaaau

SEQ ID NO: 1927146 - RNA, 15 nt, Human
aauaaaacuggcuuu

SEQ ID NO: 1927147 - RNA, 15 nt, Human
aauaaaacuuuuuaa

SEQ ID NO: 1927148 - RNA, 14 nt, Human
aauaaaacuuuuua

SEQ ID NO: 1927149 - RNA, 12 nt, Human
aauaaaacuuuu

SEQ ID NO: 1927150 - RNA, 16 nt, Human
aauaaaucauaaaacu

SEQ ID NO: 1927151 - RNA, 15 nt, Human
aauaaaucugaccca

SEQ ID NO: 1927152 - RNA, 23 nt, Human
aauaaauauugucuuuuuguaug

SEQ ID NO: 1927153 - RNA, 16 nt, Human
aauaaaucugacccag

SEQ ID NO: 1927154 - RNA, 17 nt, Human
aauaaaucugacccagu

SEQ ID NO: 1927155 - RNA, 20 nt, Human
aauaaaucugacccagugcc

SEQ ID NO: 1927156 - RNA, 19 nt, Human
aauaaaguuggucuuuuga

SEQ ID NO: 1927157 - RNA, 16 nt, Human
aauaaauauugucuuu

SEQ ID NO: 1927158 - RNA, 21 nt, Human
aauaaauauugucuuuuugua

SEQ ID NO: 1927159 - RNA, 15 nt, Human
aaguuuuguaaauuu

SEQ ID NO: 1927160 - RNA, 20 nt, Human
aaguuuuuauggcuuuugug

SEQ ID NO: 1927161 - RNA, 17 nt, Human
aauaaaacauuuucaca

SEQ ID NO: 1927162 - RNA, 19 nt, Human
aauaaaacauuuucacaca

SEQ ID NO: 1927163 - RNA, 22 nt, Human
uaaagguucaugcaaacuuuau

SEQ ID NO: 1927164 - RNA, 19 nt, Human
uaaaguaaaaacaaagaaa

SEQ ID NO: 1927165 - RNA, 21 nt, Human
uaaaguaaaaacaaagaaauu

SEQ ID NO: 1927166 - RNA, 22 nt, Human
uaaaguaaaaacaaagaaauua

SEQ ID NO: 1927167 - RNA, 18 nt, Human
guuuugaagcuacugugu

SEQ ID NO: 1927168 - RNA, 19 nt, Human
guuuugaagcuacugugug

SEQ ID NO: 1927169 - RNA, 15 nt, Human
guuuugaaggcaaaa

SEQ ID NO: 1927170 - RNA, 15 nt, Human
acaagcaaacccaga

SEQ ID NO: 1927171 - RNA, 14 nt, Human
acaagcccccccuu

SEQ ID NO: 1927172 - RNA, 17 nt, Human
acaagcccccccuucca

SEQ ID NO: 1927173 - RNA, 18 nt, Human
acaagcccccccuuccac

SEQ ID NO: 1927174 - RNA, 17 nt, Human
acaagcgugagccacug

SEQ ID NO: 1927175 - RNA, 13 nt, Human
acaagcuccaagc

SEQ ID NO: 1927176 - RNA, 17 nt, Human
acaagaccacguuucua

SEQ ID NO: 1927177 - RNA, 19 nt, Human
acaagaccaccacuucgaa

SEQ ID NO: 1927178 - RNA, 16 nt, Human
acaagaccacguuucu

SEQ ID NO: 1927179 - RNA, 22 nt, Human
acaagagcccaggccuccuaca

SEQ ID NO: 1927180 - RNA, 21 nt, Human
acaaauucugucucuggauua

SEQ ID NO: 1927181 - RNA, 15 nt, Human
acaaauggacauagg

SEQ ID NO: 1927182 - RNA, 17 nt, Human
acaaauuuacagagaca

SEQ ID NO: 1927183 - RNA, 13 nt, Human
acaaauguaugau

SEQ ID NO: 1927184 - RNA, 14 nt, Human
acaacauguauaau

SEQ ID NO: 1927185 - RNA, 17 nt, Human
acaacaucuuuuucuac

SEQ ID NO: 1927186 - RNA, 16 nt, Human
uagcuacuaauuuuaa

SEQ ID NO: 1927187 - RNA, 21 nt, Human
acaaucucccuucacaaguuu

SEQ ID NO: 1927188 - RNA, 16 nt, Human
uagcucaggugucccu

SEQ ID NO: 1927189 - RNA, 15 nt, Human
acaauauugacuuug

SEQ ID NO: 1927190 - RNA, 18 nt, Human
acaauauugacuuugucu

SEQ ID NO: 1927191 - RNA, 17 nt, Human
acaaucucccuucacaa

SEQ ID NO: 1927192 - RNA, 18 nt, Human
acaagcgugagccacugc

SEQ ID NO: 1927193 - RNA, 22 nt, Human
acaagcuccaagcucccaggca

SEQ ID NO: 1927194 - RNA, 15 nt, Human
acaagcuccaagcuc

SEQ ID NO: 1927195 - RNA, 16 nt, Human
acaagcuccaagcucc

SEQ ID NO: 1927196 - RNA, 17 nt, Human
acaagcuccaagcuccc

SEQ ID NO: 1927197 - RNA, 19 nt, Human
acaagcuccaagcucccag

SEQ ID NO: 1927198 - RNA, 15 nt, Human
uagaugaacucaacu

SEQ ID NO: 1927199 - RNA, 16 nt, Human
uagaugaaguuuuaca

SEQ ID NO: 1927200 - RNA, 22 nt, Human
uagauaggucagugcaaauacu

SEQ ID NO: 1927201 - RNA, 17 nt, Human
uagauaguuagaaccug

SEQ ID NO: 1927202 - RNA, 14 nt, Human
acaaaacuuuucua

SEQ ID NO: 1927203 - RNA, 11 nt, Human
acaaaacuucc

SEQ ID NO: 1927204 - RNA, 15 nt, Human
aauuuuuuuuuccuu

SEQ ID NO: 1927205 - RNA, 17 nt, Human
acaaaacuacaugagaa

SEQ ID NO: 1927206 - RNA, 23 nt, Human
acaaaacuacaugagaacaaaca

SEQ ID NO: 1927207 - RNA, 20 nt, Human
acaaagcccaagggaucugg

SEQ ID NO: 1927208 - RNA, 21 nt, Human
acaaagcgugguggacaugca

SEQ ID NO: 1927209 - RNA, 14 nt, Human
acaaagcagccacg

SEQ ID NO: 1927210 - RNA, 11 nt, Human
acaaagcccaa

SEQ ID NO: 1927211 - RNA, 13 nt, Human
acaaagcccaagg

SEQ ID NO: 1927212 - RNA, 21 nt, Human
acaaaguuacuagguaacuuc

SEQ ID NO: 1927213 - RNA, 23 nt, Human
acaaaguuacuagguaacuucau

SEQ ID NO: 1927214 - RNA, 19 nt, Human
acaaaguuccaaaaugcca

SEQ ID NO: 1927215 - RNA, 19 nt, Human
acaaaguggcauaaaaaac

SEQ ID NO: 1927216 - RNA, 22 nt, Human
aauuuuuaaucuuuaauuuuac

SEQ ID NO: 1927217 - RNA, 19 nt, Human
aauuuuguuuucuugauuu

SEQ ID NO: 1927218 - RNA, 22 nt, Human
aauuuuuuuaucgucacugcuu

SEQ ID NO: 1927219 - RNA, 14 nt, Human
aauuuuuguaauuu

SEQ ID NO: 1927220 - RNA, 16 nt, Human
aauuuguuauaaugaa

SEQ ID NO: 1927221 - RNA, 21 nt, Human
aauuugguuuucacauuggaa

SEQ ID NO: 1927222 - RNA, 15 nt, Human
aauuugguuuucaca

SEQ ID NO: 1927223 - RNA, 23 nt, Human
aauuugcauuaaauucacaaacu

SEQ ID NO: 1927224 - RNA, 13 nt, Human
aauuugguuuuca

SEQ ID NO: 1927225 - RNA, 22 nt, Human
aauuugguucuaauagaacuca

SEQ ID NO: 1927226 - RNA, 17 nt, Human
aauuugguucuaggccg

SEQ ID NO: 1927227 - RNA, 16 nt, Human
aauuugguucuaauag

SEQ ID NO: 1927228 - RNA, 13 nt, Human
uacuuuuuccugg

SEQ ID NO: 1927229 - RNA, 14 nt, Human
uacuuuguucugcu

SEQ ID NO: 1927230 - RNA, 22 nt, Human
uacuuuguucugcuguucucua

SEQ ID NO: 1927231 - RNA, 13 nt, Human
uacuuuuuguuau

SEQ ID NO: 1927232 - RNA, 15 nt, Human
aauuugcauuaaauu

SEQ ID NO: 1927233 - RNA, 17 nt, Human
aauuugcauuaaauuca

SEQ ID NO: 1927234 - RNA, 18 nt, Human
aauuugcauuaaauucac

SEQ ID NO: 1927235 - RNA, 21 nt, Human
aauuugcauuaaauucacaaa

SEQ ID NO: 1927236 - RNA, 22 nt, Human
aauuuauaaacuuuuuucuuac

SEQ ID NO: 1927237 - RNA, 22 nt, Human
aauuuauaaaaagguguuuuga

SEQ ID NO: 1927238 - RNA, 16 nt, Human
aauuuauaaaaaggug

SEQ ID NO: 1927239 - RNA, 17 nt, Human
aauuuauuaauugcuuu

SEQ ID NO: 1927240 - RNA, 18 nt, Human
aauuuauuaauugcuuug

SEQ ID NO: 1927241 - RNA, 19 nt, Human
aauuuauuaauugcuuuga

SEQ ID NO: 1927242 - RNA, 17 nt, Human
aauuucuaggacugaau

SEQ ID NO: 1927243 - RNA, 22 nt, Human
aauuucuaggacugaauuauga

SEQ ID NO: 1927244 - RNA, 18 nt, Human
aauuucuaggacugaauu

SEQ ID NO: 1927245 - RNA, 14 nt, Human
aauuuauuauggca

SEQ ID NO: 1927246 - RNA, 13 nt, Human
aauuuauuauggc

SEQ ID NO: 1927247 - RNA, 23 nt, Human
aauuucuaggacugaauuaugaa

SEQ ID NO: 1927248 - RNA, 13 nt, Human
aauuucuauuaaa

SEQ ID NO: 1927249 - RNA, 15 nt, Human
aauuuacauacucug

SEQ ID NO: 1927250 - RNA, 17 nt, Human
aauuuaccugaagucuu

SEQ ID NO: 1927251 - RNA, 18 nt, Human
aauuuacagagacagaaa

SEQ ID NO: 1927252 - RNA, 17 nt, Human
aauuuacagagacagaa

SEQ ID NO: 1927253 - RNA, 13 nt, Human
aauuuaguauuuu

SEQ ID NO: 1927254 - RNA, 11 nt, Human
aauugcuuuga

SEQ ID NO: 1927255 - RNA, 10 nt, Human
aauugcuuug

SEQ ID NO: 1927256 - RNA, 15 nt, Human
aauuugaaacacuuu

SEQ ID NO: 1927257 - RNA, 12 nt, Human
aauuugauugau

SEQ ID NO: 1927258 - RNA, 13 nt, Human
aauuugauugauu

SEQ ID NO: 1927259 - RNA, 14 nt, Human
aauuugauugauuu

SEQ ID NO: 1927260 - RNA, 15 nt, Human
aauuugauugauuug

SEQ ID NO: 1927261 - RNA, 16 nt, Human
aauuugauugauuuga

SEQ ID NO: 1927262 - RNA, 17 nt, Human
aauuugauugauuugaa

SEQ ID NO: 1927263 - RNA, 20 nt, Human
aauuugauugauuugaagaa

SEQ ID NO: 1927264 - RNA, 18 nt, Human
uacuucuccacccugcuc

SEQ ID NO: 1927265 - RNA, 13 nt, Human
uacuucuccaccc

SEQ ID NO: 1927266 - RNA, 22 nt, Human
uacuuccuuaugcuucuuucaa

SEQ ID NO: 1927267 - RNA, 15 nt, Human
uacuucugcuacaua

SEQ ID NO: 1927268 - RNA, 20 nt, Human
uacuucuccacccugcucuc

SEQ ID NO: 1927269 - RNA, 16 nt, Human
uacuucuuauacauuu

SEQ ID NO: 1927270 - RNA, 14 nt, Human
uacuucuugaaggu

SEQ ID NO: 1927271 - RNA, 14 nt, Human
uacuucuuauacau

SEQ ID NO: 1927272 - RNA, 15 nt, Human
uacuucuuauacauu

SEQ ID NO: 1927273 - RNA, 15 nt, Human
uacuugaaaauuaac

SEQ ID NO: 1927274 - RNA, 16 nt, Human
uacgucugacaggcaa

SEQ ID NO: 1927275 - RNA, 13 nt, Human
uacgugaguccug

SEQ ID NO: 1927276 - RNA, 14 nt, Human
uacuaaaaauacaa

SEQ ID NO: 1927277 - RNA, 18 nt, Human
uacuaaaaauacaaaaaa

SEQ ID NO: 1927278 - RNA, 18 nt, Human
uacuagggaaaugccuuu

SEQ ID NO: 1927279 - RNA, 15 nt, Human
uacuaggauacugcu

SEQ ID NO: 1927280 - RNA, 13 nt, Human
uacuagguaacuu

SEQ ID NO: 1927281 - RNA, 22 nt, Human
uacucuacccucuuagaaaaac

SEQ ID NO: 1927282 - RNA, 15 nt, Human
uacgucugacaggca

SEQ ID NO: 1927283 - RNA, 13 nt, Human
uacggacaccccc

SEQ ID NO: 1927284 - RNA, 14 nt, Human
uacggacacccccu

SEQ ID NO: 1927285 - RNA, 14 nt, Human
uacgcuuugauuca

SEQ ID NO: 1927286 - RNA, 15 nt, Human
uacgcuuugauucau

SEQ ID NO: 1927287 - RNA, 21 nt, Human
aauugaaucaguauaaacaaa

SEQ ID NO: 1927288 - RNA, 22 nt, Human
aaugugucuuucuuuuuggaca

SEQ ID NO: 1927289 - RNA, 16 nt, Human
aauguguggccugcac

SEQ ID NO: 1927290 - RNA, 19 nt, Human
uacuguacagacagaaaaa

SEQ ID NO: 1927291 - RNA, 13 nt, Human
uacuguaauuccu

SEQ ID NO: 1927292 - RNA, 15 nt, Human
uacuguaauuccuca

SEQ ID NO: 1927293 - RNA, 16 nt, Human
uacuguaauuccucaa

SEQ ID NO: 1927294 - RNA, 23 nt, Human
uacuguacagacagaaaaaacug

SEQ ID NO: 1927295 - RNA, 12 nt, Human
uacuguaauuuu

SEQ ID NO: 1927296 - RNA, 14 nt, Human
uacuguaauuuuau

SEQ ID NO: 1927297 - RNA, 20 nt, Human
uacuguaauuuuauaugaag

SEQ ID NO: 1927298 - RNA, 18 nt, Human
uacuguacaugaaaacac

SEQ ID NO: 1927299 - RNA, 21 nt, Human
aauugacuuauuuauauaaau

SEQ ID NO: 1927300 - RNA, 18 nt, Human
aauugagcugcagaaacg

SEQ ID NO: 1927301 - RNA, 11 nt, Human
aauugcauuga

SEQ ID NO: 1927302 - RNA, 14 nt, Human
aauugcagaacuaa

SEQ ID NO: 1927303 - RNA, 23 nt, Human
aauugauuugcauugaacacaaa

SEQ ID NO: 1927304 - RNA, 14 nt, Human
aauugcaaaucuug

SEQ ID NO: 1927305 - RNA, 18 nt, Human
aauugcaaaucuugaaau

SEQ ID NO: 1927306 - RNA, 13 nt, Human
aauugauuugcau

SEQ ID NO: 1927307 - RNA, 14 nt, Human
aauugauuugcauu

SEQ ID NO: 1927308 - RNA, 16 nt, Human
aauugauuugcauuga

SEQ ID NO: 1927309 - RNA, 20 nt, Human
aauugauuugcauugaacac

SEQ ID NO: 1927310 - RNA, 22 nt, Human
aauugauuugcauugaacacaa

SEQ ID NO: 1927311 - RNA, 17 nt, Human
aauugaggggauuaaua

SEQ ID NO: 1927312 - RNA, 15 nt, Human
uacuguaauuuguga

SEQ ID NO: 1927313 - RNA, 17 nt, Human
uacuguaauuugugaua

SEQ ID NO: 1927314 - RNA, 16 nt, Human
uacuguaauuugugau

SEQ ID NO: 1927315 - RNA, 19 nt, Human
uacugagagugaacaaauu

SEQ ID NO: 1927316 - RNA, 16 nt, Human
uacugggagccuaccc

SEQ ID NO: 1927317 - RNA, 20 nt, Human
uacugggccauguugugccu

SEQ ID NO: 1927318 - RNA, 17 nt, Human
uacugagagugaacaaa

SEQ ID NO: 1927319 - RNA, 17 nt, Human
uacugacugagaauaua

SEQ ID NO: 1927320 - RNA, 22 nt, Human
uacugaaauaaacgucuuaaau

SEQ ID NO: 1927321 - RNA, 19 nt, Human
uacugaaauaaacgucuua

SEQ ID NO: 1927322 - RNA, 14 nt, Human
uacucuagaugaag

SEQ ID NO: 1927323 - RNA, 13 nt, Human
uacucuuucugua

SEQ ID NO: 1927324 - RNA, 14 nt, Human
uacucuuucuguau

SEQ ID NO: 1927325 - RNA, 15 nt, Human
uacucuuucuguaua

SEQ ID NO: 1927326 - RNA, 16 nt, Human
uacucuuucuguauau

SEQ ID NO: 1927327 - RNA, 16 nt, Human
acacucuuuguaagag

SEQ ID NO: 1927328 - RNA, 12 nt, Human
acacucuuugua

SEQ ID NO: 1927329 - RNA, 20 nt, Human
acacucugggcuccagagug

SEQ ID NO: 1927330 - RNA, 21 nt, Human
acacucuuuugcuuuauucca

SEQ ID NO: 1927331 - RNA, 17 nt, Human
acacugaaauauacaca

SEQ ID NO: 1927332 - RNA, 18 nt, Human
acacugaaauauacacac

SEQ ID NO: 1927333 - RNA, 20 nt, Human
acacugaaauauacacacag

SEQ ID NO: 1927334 - RNA, 21 nt, Human
acacugaaauauacacacagc

SEQ ID NO: 1927335 - RNA, 14 nt, Human
acacuguucucugc

SEQ ID NO: 1927336 - RNA, 15 nt, Human
acacuguucucugcc

SEQ ID NO: 1927337 - RNA, 22 nt, Human
acacuguucucugcccuccaag

SEQ ID NO: 1927338 - RNA, 23 nt, Human
acacuguucucugcccuccaaga

SEQ ID NO: 1927339 - RNA, 22 nt, Human
acacugaaauauacacacagca

SEQ ID NO: 1927340 - RNA, 21 nt, Human
acacugaagcucuugaagaca

SEQ ID NO: 1927341 - RNA, 16 nt, Human
acacuguucucugccc

SEQ ID NO: 1927342 - RNA, 17 nt, Human
acacuguucucugcccu

SEQ ID NO: 1927343 - RNA, 18 nt, Human
acacuguucucugcccuc

SEQ ID NO: 1927344 - RNA, 20 nt, Human
acacuguucucugcccucca

SEQ ID NO: 1927345 - RNA, 11 nt, Human
acacucugaga

SEQ ID NO: 1927346 - RNA, 13 nt, Human
acacucugagacu

SEQ ID NO: 1927347 - RNA, 13 nt, Human
acacuccuucaca

SEQ ID NO: 1927348 - RNA, 14 nt, Human
acacuccagugaga

SEQ ID NO: 1927349 - RNA, 15 nt, Human
acacucacuucucuu

SEQ ID NO: 1927350 - RNA, 19 nt, Human
acacucaccucuaaaacag

SEQ ID NO: 1927351 - RNA, 18 nt, Human
acacucaccucuaaaaca

SEQ ID NO: 1927352 - RNA, 16 nt, Human
acacucagcacaaggc

SEQ ID NO: 1927353 - RNA, 13 nt, Human
acacucagcacaa

SEQ ID NO: 1927354 - RNA, 16 nt, Human
acacucacccaacaau

SEQ ID NO: 1927355 - RNA, 12 nt, Human
uauauuuacaaa

SEQ ID NO: 1927356 - RNA, 17 nt, Human
acagacacaggcccggc

SEQ ID NO: 1927357 - RNA, 19 nt, Human
acagaaagcagaacaguga

SEQ ID NO: 1927358 - RNA, 22 nt, Human
acagacacaggcccggcuccag

SEQ ID NO: 1927359 - RNA, 18 nt, Human
acagacacaggcccggcu

SEQ ID NO: 1927360 - RNA, 22 nt, Human
acagacuggaagcacagcuuca

SEQ ID NO: 1927361 - RNA, 21 nt, Human
acagacuggaagcacagcuuc

SEQ ID NO: 1927362 - RNA, 19 nt, Human
acagacuggaagcacagcu

SEQ ID NO: 1927363 - RNA, 17 nt, Human
acagacuggaagcacag

SEQ ID NO: 1927364 - RNA, 23 nt, Human
acacuguuucaaacuuuacuaug

SEQ ID NO: 1927365 - RNA, 15 nt, Human
acacuguuucaaacu

SEQ ID NO: 1927366 - RNA, 16 nt, Human
acacuguuucaaacuu

SEQ ID NO: 1927367 - RNA, 15 nt, Human
acacuuaaaaauggu

SEQ ID NO: 1927368 - RNA, 13 nt, Human
acacuuaaaaaug

SEQ ID NO: 1927369 - RNA, 18 nt, Human
acagaaaauucuucucca

SEQ ID NO: 1927370 - RNA, 15 nt, Human
acagaaaccuuuuua

SEQ ID NO: 1927371 - RNA, 20 nt, Human
acagaaaccuuuuuaaaaau

SEQ ID NO: 1927372 - RNA, 16 nt, Human
acagaugggcaaauua

SEQ ID NO: 1927373 - RNA, 20 nt, Human
acagauguaaaagacuuuuu

SEQ ID NO: 1927374 - RNA, 23 nt, Human
acagaugggugcuuggaggaagg

SEQ ID NO: 1927375 - RNA, 20 nt, Human
acagauacuccuccaagguu

SEQ ID NO: 1927376 - RNA, 20 nt, Human
acagauagauauaugcucug

SEQ ID NO: 1927377 - RNA, 22 nt, Human
acagaguuguuacauuuuuaag

SEQ ID NO: 1927378 - RNA, 21 nt, Human
acagaguuguuacauuuuuaa

SEQ ID NO: 1927379 - RNA, 15 nt, Human
acagaguuguuacau

SEQ ID NO: 1927380 - RNA, 18 nt, Human
uaucuuugauucuccuuc

SEQ ID NO: 1927381 - RNA, 17 nt, Human
uaucuuugauucuccuu

SEQ ID NO: 1927382 - RNA, 16 nt, Human
uaucuuugauucuccu

SEQ ID NO: 1927383 - RNA, 14 nt, Human
uaucuuuauuaauc

SEQ ID NO: 1927384 - RNA, 15 nt, Human
uaucuuuauuaauca

SEQ ID NO: 1927385 - RNA, 15 nt, Human
uaucuugucucuggg

SEQ ID NO: 1927386 - RNA, 17 nt, Human
uaucuugucucugggcu

SEQ ID NO: 1927387 - RNA, 16 nt, Human
acagcaaggagauuua

SEQ ID NO: 1927388 - RNA, 21 nt, Human
acagcccgggcucugccuccc

SEQ ID NO: 1927389 - RNA, 22 nt, Human
acagcccgggcucugccuccca

SEQ ID NO: 1927390 - RNA, 23 nt, Human
acagcccgggcucugccucccau

SEQ ID NO: 1927391 - RNA, 14 nt, Human
acagcaaccccagg

SEQ ID NO: 1927392 - RNA, 16 nt, Human
acagaguuguuacauu

SEQ ID NO: 1927393 - RNA, 21 nt, Human
acagagcugggauguuucugu

SEQ ID NO: 1927394 - RNA, 18 nt, Human
acagagcugggauguuuc

SEQ ID NO: 1927395 - RNA, 10 nt, Human
acagagcugg

SEQ ID NO: 1927396 - RNA, 14 nt, Human
acagagcugggaug

SEQ ID NO: 1927397 - RNA, 20 nt, Human
acagaguuguuacauuuuua

SEQ ID NO: 1927398 - RNA, 19 nt, Human
acagaguuguuacauuuuu

SEQ ID NO: 1927399 - RNA, 18 nt, Human
acagaguuguuacauuuu

SEQ ID NO: 1927400 - RNA, 17 nt, Human
acagaguuguuacauuu

SEQ ID NO: 1927401 - RNA, 21 nt, Human
acagagcaagugagacccugu

SEQ ID NO: 1927402 - RNA, 15 nt, Human
acagagcaagacucu

SEQ ID NO: 1927403 - RNA, 13 nt, Human
uaucucagggccu

SEQ ID NO: 1927404 - RNA, 15 nt, Human
uaucucagggccugg

SEQ ID NO: 1927405 - RNA, 20 nt, Human
uaucccuacuguaauuugug

SEQ ID NO: 1927406 - RNA, 19 nt, Human
uaucccuacuguaauuugu

SEQ ID NO: 1927407 - RNA, 16 nt, Human
uauauuuauacuguau

SEQ ID NO: 1927408 - RNA, 18 nt, Human
uaguucagguaacaggca

SEQ ID NO: 1927409 - RNA, 10 nt, Human
uaguuuuugu

SEQ ID NO: 1927410 - RNA, 12 nt, Human
uaguuuugcaua

SEQ ID NO: 1927411 - RNA, 20 nt, Human
uauaaaaauaaaaaacacug

SEQ ID NO: 1927412 - RNA, 21 nt, Human
uauaaaaauaaaaaacacugg

SEQ ID NO: 1927413 - RNA, 14 nt, Human
uauaaaagacugac

SEQ ID NO: 1927414 - RNA, 12 nt, Human
uauaaaacuucu

SEQ ID NO: 1927415 - RNA, 13 nt, Human
acacccagcccac

SEQ ID NO: 1927416 - RNA, 12 nt, Human
acacccagccca

SEQ ID NO: 1927417 - RNA, 13 nt, Human
acacauuuuauuu

SEQ ID NO: 1927418 - RNA, 21 nt, Human
acacauguccaagaagcccag

SEQ ID NO: 1927419 - RNA, 22 nt, Human
acacauguccaagaagcccagg

SEQ ID NO: 1927420 - RNA, 13 nt, Human
acacauguccaag

SEQ ID NO: 1927421 - RNA, 18 nt, Human
acacauguccaagaagcc

SEQ ID NO: 1927422 - RNA, 19 nt, Human
acacauguccaagaagccc

SEQ ID NO: 1927423 - RNA, 18 nt, Human
acaccucugcacaagcug

SEQ ID NO: 1927424 - RNA, 16 nt, Human
acaccuugacagggca

SEQ ID NO: 1927425 - RNA, 15 nt, Human
acaccuugacagggc

SEQ ID NO: 1927426 - RNA, 14 nt, Human
acaccuugacaggg

SEQ ID NO: 1927427 - RNA, 19 nt, Human
acaccucugcacaagcugc

SEQ ID NO: 1927428 - RNA, 19 nt, Human
acacuaaccacgcuggacc

SEQ ID NO: 1927429 - RNA, 17 nt, Human
acacuaaccacgcugga

SEQ ID NO: 1927430 - RNA, 16 nt, Human
acacuaaccacgcugg

SEQ ID NO: 1927431 - RNA, 22 nt, Human
uauaaccaguguuguggauuua

SEQ ID NO: 1927432 - RNA, 15 nt, Human
acaaugguuuucuug

SEQ ID NO: 1927433 - RNA, 13 nt, Human
acaauggcagaug

SEQ ID NO: 1927434 - RNA, 17 nt, Human
acaaugcugauuuggug

SEQ ID NO: 1927435 - RNA, 21 nt, Human
uagcuucaccccaaucccagc

SEQ ID NO: 1927436 - RNA, 21 nt, Human
acaaugguuuucuuguguguu

SEQ ID NO: 1927437 - RNA, 14 nt, Human
acacacacauacac

SEQ ID NO: 1927438 - RNA, 12 nt, Human
acacacagcucu

SEQ ID NO: 1927439 - RNA, 11 nt, Human
acacacagcuc

SEQ ID NO: 1927440 - RNA, 13 nt, Human
acacagugagucg

SEQ ID NO: 1927441 - RNA, 21 nt, Human
uagguuggcaaaaaggcagga

SEQ ID NO: 1927442 - RNA, 17 nt, Human
uaguaaggaguucauuu

SEQ ID NO: 1927443 - RNA, 11 nt, Human
acacagugagu

SEQ ID NO: 1927444 - RNA, 19 nt, Human
acacagucuuggcucacug

SEQ ID NO: 1927445 - RNA, 13 nt, Human
uaguagagacagg

SEQ ID NO: 1927446 - RNA, 18 nt, Human
uagucuagauggcuccuc

SEQ ID NO: 1927447 - RNA, 20 nt, Human
uagucuagauggcuccucuc

SEQ ID NO: 1927448 - RNA, 19 nt, Human
uagucuagauggcuccucu

SEQ ID NO: 1927449 - RNA, 20 nt, Human
accaaucauuuuaauuauua

SEQ ID NO: 1927450 - RNA, 13 nt, Human
accaaucauuuua

SEQ ID NO: 1927451 - RNA, 15 nt, Human
accaauugcuuuguc

SEQ ID NO: 1927452 - RNA, 22 nt, Human
accacacguaaugaaacuugga

SEQ ID NO: 1927453 - RNA, 13 nt, Human
accacacuggacu

SEQ ID NO: 1927454 - RNA, 16 nt, Human
accacacuggacuccg

SEQ ID NO: 1927455 - RNA, 21 nt, Human
accacacuggacuccggcccu

SEQ ID NO: 1927456 - RNA, 15 nt, Human
ucaauuccucuggga

SEQ ID NO: 1927457 - RNA, 16 nt, Human
ucaauuccucugggaa

SEQ ID NO: 1927458 - RNA, 11 nt, Human
ucacaaauaaa

SEQ ID NO: 1927459 - RNA, 15 nt, Human
ucaauucuugccaaa

SEQ ID NO: 1927460 - RNA, 15 nt, Human
ucaagugaaaaagga

SEQ ID NO: 1927461 - RNA, 15 nt, Human
ucaagucaaauuaau

SEQ ID NO: 1927462 - RNA, 23 nt, Human
ucaagugaaaaaggaggaagaga

SEQ ID NO: 1927463 - RNA, 19 nt, Human
accaacauacucccaucug

SEQ ID NO: 1927464 - RNA, 21 nt, Human
accaacauacucccaucugug

SEQ ID NO: 1927465 - RNA, 22 nt, Human
accaacauacucccaucuguga

SEQ ID NO: 1927466 - RNA, 17 nt, Human
accaauauuguacaguu

SEQ ID NO: 1927467 - RNA, 16 nt, Human
accaauauuguacagu

SEQ ID NO: 1927468 - RNA, 14 nt, Human
accaauauuguaca

SEQ ID NO: 1927469 - RNA, 15 nt, Human
accaauauuguacag

SEQ ID NO: 1927470 - RNA, 19 nt, Human
accaauauuguacaguuuu

SEQ ID NO: 1927471 - RNA, 18 nt, Human
accaauauuguacaguuu

SEQ ID NO: 1927472 - RNA, 15 nt, Human
accaauguucucucu

SEQ ID NO: 1927473 - RNA, 15 nt, Human
ucacaguucucuccu

SEQ ID NO: 1927474 - RNA, 15 nt, Human
ucacauaucugucau

SEQ ID NO: 1927475 - RNA, 12 nt, Human
ucacauaucugu

SEQ ID NO: 1927476 - RNA, 23 nt, Human
ucacacugagaauguaagaacua

SEQ ID NO: 1927477 - RNA, 21 nt, Human
ucacacugagaauguaagaac

SEQ ID NO: 1927478 - RNA, 20 nt, Human
ucacacugagaauguaagaa

SEQ ID NO: 1927479 - RNA, 19 nt, Human
ucacacugagaauguaaga

SEQ ID NO: 1927480 - RNA, 12 nt, Human
ucacacugagaa

SEQ ID NO: 1927481 - RNA, 11 nt, Human
ucacacugaga

SEQ ID NO: 1927482 - RNA, 15 nt, Human
ucaccccggccaccu

SEQ ID NO: 1927483 - RNA, 13 nt, Human
ucaccccagcccc

SEQ ID NO: 1927484 - RNA, 14 nt, Human
ucaccccagcccca

SEQ ID NO: 1927485 - RNA, 20 nt, Human
ucaccccagccccaaaacuc

SEQ ID NO: 1927486 - RNA, 16 nt, Human
ucaccuucaguaaccc

SEQ ID NO: 1927487 - RNA, 21 nt, Human
ucaccuguuuuuaagcuguuu

SEQ ID NO: 1927488 - RNA, 22 nt, Human
ucaccuguuuuuaagcuguuuc

SEQ ID NO: 1927489 - RNA, 18 nt, Human
ucaccuguuuuuaagcug

SEQ ID NO: 1927490 - RNA, 19 nt, Human
ucaccuguuuuuaagcugu

SEQ ID NO: 1927491 - RNA, 20 nt, Human
ucaccuguuuuuaagcuguu

SEQ ID NO: 1927492 - RNA, 21 nt, Human
ucacuacgggggggagaagga

SEQ ID NO: 1927493 - RNA, 22 nt, Human
ucacuacgggggggagaaggaa

SEQ ID NO: 1927494 - RNA, 20 nt, Human
ucacuauguugcccaggcag

SEQ ID NO: 1927495 - RNA, 19 nt, Human
ucacuauguugcccaggca

SEQ ID NO: 1927496 - RNA, 17 nt, Human
ucacuauguugcccagg

SEQ ID NO: 1927497 - RNA, 18 nt, Human
ucacuauguugcccaggc

SEQ ID NO: 1927498 - RNA, 17 nt, Human
accagagcccaccuugg

SEQ ID NO: 1927499 - RNA, 14 nt, Human
accagggacugagg

SEQ ID NO: 1927500 - RNA, 18 nt, Human
accaggcuugccugcagg

SEQ ID NO: 1927501 - RNA, 18 nt, Human
accaggcuggagugcagu

SEQ ID NO: 1927502 - RNA, 16 nt, Human
ucaccugaagacucau

SEQ ID NO: 1927503 - RNA, 17 nt, Human
ucaccuccugcugggca

SEQ ID NO: 1927504 - RNA, 15 nt, Human
ucaccucucccuugg

SEQ ID NO: 1927505 - RNA, 19 nt, Human
accaggcuugccugcaggc

SEQ ID NO: 1927506 - RNA, 20 nt, Human
ucaccucuaaaacaguccuu

SEQ ID NO: 1927507 - RNA, 15 nt, Human
ucaccugccccucaa

SEQ ID NO: 1927508 - RNA, 16 nt, Human
ucaccugccccaacuc

SEQ ID NO: 1927509 - RNA, 13 nt, Human
ucaccugccccuc

SEQ ID NO: 1927510 - RNA, 12 nt, Human
ucaccucugcua

SEQ ID NO: 1927511 - RNA, 11 nt, Human
accagacaggu

SEQ ID NO: 1927512 - RNA, 14 nt, Human
accagacaccuuga

SEQ ID NO: 1927513 - RNA, 16 nt, Human
accagacacccaggac

SEQ ID NO: 1927514 - RNA, 17 nt, Human
accagacacccaggacu

SEQ ID NO: 1927515 - RNA, 16 nt, Human
accagagcccaccuug

SEQ ID NO: 1927516 - RNA, 14 nt, Human
accagagcccaccu

SEQ ID NO: 1927517 - RNA, 12 nt, Human
accagagcccac

SEQ ID NO: 1927518 - RNA, 22 nt, Human
accacuuuuguucuugguuugu

SEQ ID NO: 1927519 - RNA, 13 nt, Human
accagaagcccag

SEQ ID NO: 1927520 - RNA, 16 nt, Human
accagaagcccagaau

SEQ ID NO: 1927521 - RNA, 14 nt, Human
accagaagcccaga

SEQ ID NO: 1927522 - RNA, 14 nt, Human
accagacacccagg

SEQ ID NO: 1927523 - RNA, 15 nt, Human
accagacacccagga

SEQ ID NO: 1927524 - RNA, 17 nt, Human
ucaccccggccaccugc

SEQ ID NO: 1927525 - RNA, 18 nt, Human
ucaccccggccaccugcg

SEQ ID NO: 1927526 - RNA, 17 nt, Human
accacugcacuccagcc

SEQ ID NO: 1927527 - RNA, 20 nt, Human
accacugcacuccagccugg

SEQ ID NO: 1927528 - RNA, 18 nt, Human
accacugcacucuagccu

SEQ ID NO: 1927529 - RNA, 21 nt, Human
accacugcacuccagccuggg

SEQ ID NO: 1927530 - RNA, 22 nt, Human
ucaccccggccaccugcggugc

SEQ ID NO: 1927531 - RNA, 21 nt, Human
accacuuuuguucuugguuug

SEQ ID NO: 1927532 - RNA, 16 nt, Human
accacuuuuguucuug

SEQ ID NO: 1927533 - RNA, 15 nt, Human
accacuuuuguucuu

SEQ ID NO: 1927534 - RNA, 13 nt, Human
accacuucauucu

SEQ ID NO: 1927535 - RNA, 17 nt, Human
accacuucauucuugaa

SEQ ID NO: 1927536 - RNA, 13 nt, Human
accacuucgaaac

SEQ ID NO: 1927537 - RNA, 21 nt, Human
ucagaagggagcuagccagag

SEQ ID NO: 1927538 - RNA, 23 nt, Human
ucagaagggagcuagccagagga

SEQ ID NO: 1927539 - RNA, 19 nt, Human
ucagaaguuucugccgcag

SEQ ID NO: 1927540 - RNA, 22 nt, Human
ucagaaguuucugccgcagccc

SEQ ID NO: 1927541 - RNA, 14 nt, Human
ucagaagacacuga

SEQ ID NO: 1927542 - RNA, 16 nt, Human
acccagccccuugaga

SEQ ID NO: 1927543 - RNA, 17 nt, Human
acccagccccuugagaa

SEQ ID NO: 1927544 - RNA, 20 nt, Human
acccagccccuugagaaacc

SEQ ID NO: 1927545 - RNA, 21 nt, Human
acccagccccuugagaaaccu

SEQ ID NO: 1927546 - RNA, 18 nt, Human
ucagagccugcaguuauu

SEQ ID NO: 1927547 - RNA, 15 nt, Human
ucagagccugcaguu

SEQ ID NO: 1927548 - RNA, 14 nt, Human
ucagagccugcagu

SEQ ID NO: 1927549 - RNA, 13 nt, Human
ucagagccugcag

SEQ ID NO: 1927550 - RNA, 12 nt, Human
ucagagccugca

SEQ ID NO: 1927551 - RNA, 23 nt, Human
ucagagagggugggagugggccc

SEQ ID NO: 1927552 - RNA, 16 nt, Human
ucagagagggugggag

SEQ ID NO: 1927553 - RNA, 21 nt, Human
ucagagagggugggagugggc

SEQ ID NO: 1927554 - RNA, 17 nt, Human
ucagaaucucucuucuu

SEQ ID NO: 1927555 - RNA, 18 nt, Human
ucagaaucucaaauaacu

SEQ ID NO: 1927556 - RNA, 19 nt, Human
ucagaaucucaaauaacua

SEQ ID NO: 1927557 - RNA, 21 nt, Human
ucagagacuccugcaggcagc

SEQ ID NO: 1927558 - RNA, 17 nt, Human
ucagagacuccugcagg

SEQ ID NO: 1927559 - RNA, 20 nt, Human
ucagagacuccugcaggcag

SEQ ID NO: 1927560 - RNA, 11 nt, Human
accauguacau

SEQ ID NO: 1927561 - RNA, 17 nt, Human
accauguacaugaagaa

SEQ ID NO: 1927562 - RNA, 22 nt, Human
accauggucggaaaacaugcua

SEQ ID NO: 1927563 - RNA, 18 nt, Human
ucacucuucucagccacu

SEQ ID NO: 1927564 - RNA, 17 nt, Human
ucacucuucucagccac

SEQ ID NO: 1927565 - RNA, 23 nt, Human
ucacucuuauugcccacgcugga

SEQ ID NO: 1927566 - RNA, 21 nt, Human
ucacucuuauugcccacgcug

SEQ ID NO: 1927567 - RNA, 13 nt, Human
ucacucuuggagc

SEQ ID NO: 1927568 - RNA, 13 nt, Human
ucacucuucucag

SEQ ID NO: 1927569 - RNA, 14 nt, Human
ucacucuucucagc

SEQ ID NO: 1927570 - RNA, 16 nt, Human
accauugaaggcuuaa

SEQ ID NO: 1927571 - RNA, 15 nt, Human
accauugaacuguac

SEQ ID NO: 1927572 - RNA, 21 nt, Human
accauucagugauuacuguca

SEQ ID NO: 1927573 - RNA, 13 nt, Human
accauugaaggcu

SEQ ID NO: 1927574 - RNA, 18 nt, Human
accauuaugaagaagaga

SEQ ID NO: 1927575 - RNA, 20 nt, Human
accauguuuguggcuauuaa

SEQ ID NO: 1927576 - RNA, 17 nt, Human
acccagacggcuccacu

SEQ ID NO: 1927577 - RNA, 22 nt, Human
acccagaccuguuagcagacag

SEQ ID NO: 1927578 - RNA, 21 nt, Human
acccagacggcuccacuagga

SEQ ID NO: 1927579 - RNA, 22 nt, Human
acccagacggcuccacuaggac

SEQ ID NO: 1927580 - RNA, 15 nt, Human
acccagacucagaca

SEQ ID NO: 1927581 - RNA, 11 nt, Human
acccacugcuu

SEQ ID NO: 1927582 - RNA, 15 nt, Human
acccacugcucuggu

SEQ ID NO: 1927583 - RNA, 14 nt, Human
acccacugcucugg

SEQ ID NO: 1927584 - RNA, 13 nt, Human
acccacugcucug

SEQ ID NO: 1927585 - RNA, 23 nt, Human
accauuucuugagguaaaagcau

SEQ ID NO: 1927586 - RNA, 11 nt, Human
acccacugcuc

SEQ ID NO: 1927587 - RNA, 10 nt, Human
acccacugcu

SEQ ID NO: 1927588 - RNA, 16 nt, Human
acccccaaauuuucuu

SEQ ID NO: 1927589 - RNA, 20 nt, Human
accccaggcugaagcagguu

SEQ ID NO: 1927590 - RNA, 23 nt, Human
accccagcuggggccaggcuggg

SEQ ID NO: 1927591 - RNA, 24 nt, Human
acccagcgagcccugguggcagug

SEQ ID NO: 1927592 - RNA, 17 nt, Human
acccaggaguguggcca

SEQ ID NO: 1927593 - RNA, 19 nt, Human
acccaggcuagagugcaau

SEQ ID NO: 1927594 - RNA, 22 nt, Human
ucagccaagaauucuuaaauau

SEQ ID NO: 1927595 - RNA, 14 nt, Human
ucagccagggccug

SEQ ID NO: 1927596 - RNA, 18 nt, Human
ucagcauugauauuugug

SEQ ID NO: 1927597 - RNA, 23 nt, Human
acccagcgagcccugguggcagu

SEQ ID NO: 1927598 - RNA, 19 nt, Human
acccagcgagcccuggugg

SEQ ID NO: 1927599 - RNA, 23 nt, Human
ucagccguguaaccauggaccca

SEQ ID NO: 1927600 - RNA, 22 nt, Human
ucagcccaaaccaccagaagcc

SEQ ID NO: 1927601 - RNA, 21 nt, Human
ucagcccaaaccaccagaagc

SEQ ID NO: 1927602 - RNA, 14 nt, Human
ucagcggggacagc

SEQ ID NO: 1927603 - RNA, 20 nt, Human
ucagcuuguaaauagcucag

SEQ ID NO: 1927604 - RNA, 12 nt, Human
ucagcucaugga

SEQ ID NO: 1927605 - RNA, 15 nt, Human
accccuucgcuccug

SEQ ID NO: 1927606 - RNA, 14 nt, Human
accccuucgcuccu

SEQ ID NO: 1927607 - RNA, 16 nt, Human
accccuucgcuccugu

SEQ ID NO: 1927608 - RNA, 14 nt, Human
ucagccuugccaga

SEQ ID NO: 1927609 - RNA, 15 nt, Human
ucagccuugccagag

SEQ ID NO: 1927610 - RNA, 16 nt, Human
ucagccuugccagaga

SEQ ID NO: 1927611 - RNA, 17 nt, Human
ucagccuugccagagau

SEQ ID NO: 1927612 - RNA, 12 nt, Human
acccccacccaa

SEQ ID NO: 1927613 - RNA, 14 nt, Human
accccccagcacug

SEQ ID NO: 1927614 - RNA, 13 nt, Human
accccccagcacu

SEQ ID NO: 1927615 - RNA, 19 nt, Human
accccccagcacugaggaa

SEQ ID NO: 1927616 - RNA, 17 nt, Human
accccccagcacugagg

SEQ ID NO: 1927617 - RNA, 15 nt, Human
accccccagcacuga

SEQ ID NO: 1927618 - RNA, 13 nt, Human
acccccgcccccu

SEQ ID NO: 1927619 - RNA, 22 nt, Human
accccugguucucaucuuucuu

SEQ ID NO: 1927620 - RNA, 20 nt, Human
accccugguucucaucuuuc

SEQ ID NO: 1927621 - RNA, 16 nt, Human
accccugguucucauc

SEQ ID NO: 1927622 - RNA, 15 nt, Human
accccugguucucau

SEQ ID NO: 1927623 - RNA, 14 nt, Human
accccugguucuca

SEQ ID NO: 1927624 - RNA, 22 nt, Human
ucaaaggagagucacagaacaa

SEQ ID NO: 1927625 - RNA, 14 nt, Human
ucaaaggccagacc

SEQ ID NO: 1927626 - RNA, 18 nt, Human
ucaaagcugcuuuauuca

SEQ ID NO: 1927627 - RNA, 12 nt, Human
ucaaaggccaga

SEQ ID NO: 1927628 - RNA, 14 nt, Human
ucaaagcugaaaug

SEQ ID NO: 1927629 - RNA, 15 nt, Human
ucaaagccacacucu

SEQ ID NO: 1927630 - RNA, 19 nt, Human
ucaaacaaacucucugaac

SEQ ID NO: 1927631 - RNA, 16 nt, Human
acaugaagaagcuaaa

SEQ ID NO: 1927632 - RNA, 13 nt, Human
acaugaagaagcu

SEQ ID NO: 1927633 - RNA, 18 nt, Human
ucaaauaacuaaaaggua

SEQ ID NO: 1927634 - RNA, 20 nt, Human
acaugagcaucaggccaggc

SEQ ID NO: 1927635 - RNA, 22 nt, Human
acaugcuacacacugcauguuu

SEQ ID NO: 1927636 - RNA, 15 nt, Human
acaugaucuucuuua

SEQ ID NO: 1927637 - RNA, 17 nt, Human
acaugaucuucuuuaua

SEQ ID NO: 1927638 - RNA, 17 nt, Human
acaugagcaucaggcca

SEQ ID NO: 1927639 - RNA, 18 nt, Human
acaugagcaucaggccag

SEQ ID NO: 1927640 - RNA, 19 nt, Human
acaugagcaucaggccagg

SEQ ID NO: 1927641 - RNA, 19 nt, Human
acaugauccugcaauucca

SEQ ID NO: 1927642 - RNA, 16 nt, Human
ucaaaauuguuacaaa

SEQ ID NO: 1927643 - RNA, 19 nt, Human
ucaaaauuguuacaaauug

SEQ ID NO: 1927644 - RNA, 12 nt, Human
ucaaaaugcuuu

SEQ ID NO: 1927645 - RNA, 17 nt, Human
ucaaaaugcuuuuuauu

SEQ ID NO: 1927646 - RNA, 19 nt, Human
ucaaaaugcuuuuuauuuc

SEQ ID NO: 1927647 - RNA, 18 nt, Human
ucaaaagaaagaaaauca

SEQ ID NO: 1927648 - RNA, 13 nt, Human
uauuuuuauuugu

SEQ ID NO: 1927649 - RNA, 17 nt, Human
uauuuuuaauuaaauaa

SEQ ID NO: 1927650 - RNA, 17 nt, Human
uauuuguguauuuaaca

SEQ ID NO: 1927651 - RNA, 18 nt, Human
uauuuguguauuuaacag

SEQ ID NO: 1927652 - RNA, 13 nt, Human
uauuuguguauuu

SEQ ID NO: 1927653 - RNA, 15 nt, Human
uauuuguguauuuaa

SEQ ID NO: 1927654 - RNA, 16 nt, Human
uauuuguaaauuuaug

SEQ ID NO: 1927655 - RNA, 22 nt, Human
uauuuguaaauuuaugugaugg

SEQ ID NO: 1927656 - RNA, 17 nt, Human
uauuuguaaauuuaugu

SEQ ID NO: 1927657 - RNA, 18 nt, Human
uauuugugauagcacuuu

SEQ ID NO: 1927658 - RNA, 13 nt, Human
uauuugugcauuu

SEQ ID NO: 1927659 - RNA, 17 nt, Human
uauuugugcauuuucua

SEQ ID NO: 1927660 - RNA, 13 nt, Human
acauucaggagcu

SEQ ID NO: 1927661 - RNA, 13 nt, Human
acauucaccugcc

SEQ ID NO: 1927662 - RNA, 14 nt, Human
acauucaccugccc

SEQ ID NO: 1927663 - RNA, 20 nt, Human
acauucaccugccccaacuc

SEQ ID NO: 1927664 - RNA, 21 nt, Human
acauguccaagaagcccagga

SEQ ID NO: 1927665 - RNA, 16 nt, Human
ucaacagguuuuccug

SEQ ID NO: 1927666 - RNA, 17 nt, Human
ucaaauuucuaaaucuc

SEQ ID NO: 1927667 - RNA, 12 nt, Human
acauucuguuaa

SEQ ID NO: 1927668 - RNA, 16 nt, Human
ucaaauuucuaaaucu

SEQ ID NO: 1927669 - RNA, 15 nt, Human
ucaaauuucuaaauc

SEQ ID NO: 1927670 - RNA, 15 nt, Human
acauucuguuaauca

SEQ ID NO: 1927671 - RNA, 13 nt, Human
acauucuuaaaaa

SEQ ID NO: 1927672 - RNA, 14 nt, Human
ucaaauuucuaaau

SEQ ID NO: 1927673 - RNA, 16 nt, Human
ucaagaucaaugaaau

SEQ ID NO: 1927674 - RNA, 22 nt, Human
ucaagaucaaugaaaugauguc

SEQ ID NO: 1927675 - RNA, 21 nt, Human
ucaagauacugcuacuguaau

SEQ ID NO: 1927676 - RNA, 22 nt, Human
ucaagauacugcuacuguaauu

SEQ ID NO: 1927677 - RNA, 15 nt, Human
ucaagauucccagga

SEQ ID NO: 1927678 - RNA, 17 nt, Human
ucaaggcugcuuagaau

SEQ ID NO: 1927679 - RNA, 18 nt, Human
ucaaggcugcuuagaauc

SEQ ID NO: 1927680 - RNA, 11 nt, Human
ucaaguauuau

SEQ ID NO: 1927681 - RNA, 15 nt, Human
ucaaguauuauaccu

SEQ ID NO: 1927682 - RNA, 13 nt, Human
ucaaguagcauuu

SEQ ID NO: 1927683 - RNA, 21 nt, Human
ucaaguauuauaccuuuuuua

SEQ ID NO: 1927684 - RNA, 16 nt, Human
ucaaguauuauaccuu

SEQ ID NO: 1927685 - RNA, 23 nt, Human
ucaaguauuauaccuuuuuuaga

SEQ ID NO: 1927686 - RNA, 12 nt, Human
ucaaguauuugg

SEQ ID NO: 1927687 - RNA, 15 nt, Human
ucaagacuuccagag

SEQ ID NO: 1927688 - RNA, 22 nt, Human
ucaagaaauaaaaggaagccaa

SEQ ID NO: 1927689 - RNA, 20 nt, Human
ucaagaaauaaaaggaagcc

SEQ ID NO: 1927690 - RNA, 21 nt, Human
ucaagaaauaaaaggaagcca

SEQ ID NO: 1927691 - RNA, 12 nt, Human
ucaacaucuuuu

SEQ ID NO: 1927692 - RNA, 14 nt, Human
ucaacauucuuugc

SEQ ID NO: 1927693 - RNA, 18 nt, Human
acauaugcaccuuguguc

SEQ ID NO: 1927694 - RNA, 17 nt, Human
acauaugcaccuugugu

SEQ ID NO: 1927695 - RNA, 16 nt, Human
acauaugcaccuugug

SEQ ID NO: 1927696 - RNA, 15 nt, Human
acauaugcaccuugu

SEQ ID NO: 1927697 - RNA, 20 nt, Human
acauaugcaccuugugucug

SEQ ID NO: 1927698 - RNA, 19 nt, Human
acauaugcaccuugugucu

SEQ ID NO: 1927699 - RNA, 23 nt, Human
acauauggacucugcacaugaau

SEQ ID NO: 1927700 - RNA, 14 nt, Human
acauaugaggggga

SEQ ID NO: 1927701 - RNA, 16 nt, Human
acauaucuuuauuaau

SEQ ID NO: 1927702 - RNA, 18 nt, Human
acauaucuuuauuaauca

SEQ ID NO: 1927703 - RNA, 19 nt, Human
acauaucuuuauuaaucac

SEQ ID NO: 1927704 - RNA, 15 nt, Human
acauaucuuuauuaa

SEQ ID NO: 1927705 - RNA, 16 nt, Human
acauauugauuuccgu

SEQ ID NO: 1927706 - RNA, 14 nt, Human
acauauugauuucc

SEQ ID NO: 1927707 - RNA, 23 nt, Human
acauauugauuuccguuaaaaua

SEQ ID NO: 1927708 - RNA, 22 nt, Human
acauauugauuuccguuaaaau

SEQ ID NO: 1927709 - RNA, 18 nt, Human
acauauugauuuccguua

SEQ ID NO: 1927710 - RNA, 23 nt, Human
acauauaauguuguuauuuaaag

SEQ ID NO: 1927711 - RNA, 16 nt, Human
acauaggacucaaagu

SEQ ID NO: 1927712 - RNA, 21 nt, Human
acauagcuuacaagccagcug

SEQ ID NO: 1927713 - RNA, 19 nt, Human
acauagcgaauacaaaauu

SEQ ID NO: 1927714 - RNA, 16 nt, Human
acauagcaugacauuu

SEQ ID NO: 1927715 - RNA, 18 nt, Human
acauagcaugacauuucu

SEQ ID NO: 1927716 - RNA, 19 nt, Human
acauagcaugacauuucuu

SEQ ID NO: 1927717 - RNA, 21 nt, Human
acauagcaugacauuucuuug

SEQ ID NO: 1927718 - RNA, 18 nt, Human
acauagaauuaacacaug

SEQ ID NO: 1927719 - RNA, 14 nt, Human
acauagaauuaaca

SEQ ID NO: 1927720 - RNA, 16 nt, Human
acaucaacaucuuggu

SEQ ID NO: 1927721 - RNA, 18 nt, Human
acaucaacaucuugguca

SEQ ID NO: 1927722 - RNA, 18 nt, Human
acaucaacccgagucauu

SEQ ID NO: 1927723 - RNA, 13 nt, Human
acaucaacagaua

SEQ ID NO: 1927724 - RNA, 12 nt, Human
acaucaaagagg

SEQ ID NO: 1927725 - RNA, 23 nt, Human
acaucuauuuuggauuguauauu

SEQ ID NO: 1927726 - RNA, 21 nt, Human
acaucuaagccugaaggggcg

SEQ ID NO: 1927727 - RNA, 14 nt, Human
acaucuauucucuc

SEQ ID NO: 1927728 - RNA, 18 nt, Human
acaucuauuuuggauugu

SEQ ID NO: 1927729 - RNA, 19 nt, Human
acaucuauuuuggauugua

SEQ ID NO: 1927730 - RNA, 14 nt, Human
acaucuugcucugc

SEQ ID NO: 1927731 - RNA, 13 nt, Human
acaucuugcucug

SEQ ID NO: 1927732 - RNA, 12 nt, Human
acaucugauaac

SEQ ID NO: 1927733 - RNA, 12 nt, Human
acaucucugcuu

SEQ ID NO: 1927734 - RNA, 15 nt, Human
acaucucugcuugag

SEQ ID NO: 1927735 - RNA, 19 nt, Human
acaucuugcucugcugaca

SEQ ID NO: 1927736 - RNA, 18 nt, Human
acaucuugcucugcugac

SEQ ID NO: 1927737 - RNA, 21 nt, Human
acaucuugcucugcugacaga

SEQ ID NO: 1927738 - RNA, 17 nt, Human
acaugaaaacacauuuu

SEQ ID NO: 1927739 - RNA, 19 nt, Human
acaugaaaacacauuuuuc

SEQ ID NO: 1927740 - RNA, 18 nt, Human
acaugaaaacacauuuuu

SEQ ID NO: 1927741 - RNA, 23 nt, Human
uauuuccuauauuguuuucagug

SEQ ID NO: 1927742 - RNA, 22 nt, Human
uauuucccucaccuuucccauc

SEQ ID NO: 1927743 - RNA, 22 nt, Human
uauuucccugaaggaaccaaag

SEQ ID NO: 1927744 - RNA, 18 nt, Human
uauuuccauucaacaaga

SEQ ID NO: 1927745 - RNA, 19 nt, Human
uaugaagauaaguguauuu

SEQ ID NO: 1927746 - RNA, 15 nt, Human
uaugaagaagagagu

SEQ ID NO: 1927747 - RNA, 20 nt, Human
acaguugaaaaacagcugag

SEQ ID NO: 1927748 - RNA, 22 nt, Human
acaguucuuugggccagacaug

SEQ ID NO: 1927749 - RNA, 15 nt, Human
acaguugaaaaacag

SEQ ID NO: 1927750 - RNA, 16 nt, Human
acaguugaaaaacagc

SEQ ID NO: 1927751 - RNA, 21 nt, Human
acaguucuuugggccagacau

SEQ ID NO: 1927752 - RNA, 14 nt, Human
acaguugggugaga

SEQ ID NO: 1927753 - RNA, 13 nt, Human
acauacuaaccag

SEQ ID NO: 1927754 - RNA, 16 nt, Human
acauaccuaagcaaac

SEQ ID NO: 1927755 - RNA, 10 nt, Human
acauacauug

SEQ ID NO: 1927756 - RNA, 12 nt, Human
acaguuuuuaaa

SEQ ID NO: 1927757 - RNA, 14 nt, Human
acaguuuuuaaacu

SEQ ID NO: 1927758 - RNA, 13 nt, Human
acauacucccauc

SEQ ID NO: 1927759 - RNA, 22 nt, Human
acauacuaaccagcagaaaugc

SEQ ID NO: 1927760 - RNA, 21 nt, Human
acauacuaaccagcagaaaug

SEQ ID NO: 1927761 - RNA, 17 nt, Human
acauacucccaucugug

SEQ ID NO: 1927762 - RNA, 14 nt, Human
acauacucugcuua

SEQ ID NO: 1927763 - RNA, 15 nt, Human
acauacuugaagggc

SEQ ID NO: 1927764 - RNA, 16 nt, Human
acauacuugaagggcc

SEQ ID NO: 1927765 - RNA, 17 nt, Human
acauacuugaagggcca

SEQ ID NO: 1927766 - RNA, 18 nt, Human
acauacuugaagggccag

SEQ ID NO: 1927767 - RNA, 19 nt, Human
acauacuugaagggccaga

SEQ ID NO: 1927768 - RNA, 20 nt, Human
acauacuugaagggccagag

SEQ ID NO: 1927769 - RNA, 21 nt, Human
acauacuugaagggccagagc

SEQ ID NO: 1927770 - RNA, 22 nt, Human
acauacuugaagggccagagcc

SEQ ID NO: 1927771 - RNA, 23 nt, Human
acauacuugaagggccagagcca

SEQ ID NO: 1927772 - RNA, 20 nt, Human
acaguuuguuaguaugaggc

SEQ ID NO: 1927773 - RNA, 16 nt, Human
acaguuuguuaguaug

SEQ ID NO: 1927774 - RNA, 15 nt, Human
acaguuuuuauugcu

SEQ ID NO: 1927775 - RNA, 13 nt, Human
acaguuuugugaa

SEQ ID NO: 1927776 - RNA, 22 nt, Human
accugccacccugggccuggca

SEQ ID NO: 1927777 - RNA, 12 nt, Human
accugccaggaa

SEQ ID NO: 1927778 - RNA, 14 nt, Human
accugccaggaagc

SEQ ID NO: 1927779 - RNA, 15 nt, Human
accugccaggaagcc

SEQ ID NO: 1927780 - RNA, 18 nt, Human
uccaaccccccagcacug

SEQ ID NO: 1927781 - RNA, 17 nt, Human
uccaaccccccagcacu

SEQ ID NO: 1927782 - RNA, 14 nt, Human
uccaaccccccagc

SEQ ID NO: 1927783 - RNA, 23 nt, Human
uccaacccucaucaccaacgucu

SEQ ID NO: 1927784 - RNA, 16 nt, Human
uccaacccucaucacc

SEQ ID NO: 1927785 - RNA, 17 nt, Human
uccaacccucaucacca

SEQ ID NO: 1927786 - RNA, 14 nt, Human
uccaacccucauca

SEQ ID NO: 1927787 - RNA, 22 nt, Human
uccaaccccccagcacugagga

SEQ ID NO: 1927788 - RNA, 21 nt, Human
uccaaccccccagcacugagg

SEQ ID NO: 1927789 - RNA, 20 nt, Human
uccaaccccccagcacugag

SEQ ID NO: 1927790 - RNA, 19 nt, Human
uccaaccccccagcacuga

SEQ ID NO: 1927791 - RNA, 23 nt, Human
uccaaccccccagcacugaggaa

SEQ ID NO: 1927792 - RNA, 21 nt, Human
uccaagcuggucccacucagu

SEQ ID NO: 1927793 - RNA, 19 nt, Human
uccaaguccacaguggaac

SEQ ID NO: 1927794 - RNA, 20 nt, Human
uccaagcuggucccacucag

SEQ ID NO: 1927795 - RNA, 16 nt, Human
uccaagcuggucccac

SEQ ID NO: 1927796 - RNA, 12 nt, Human
uccaagaagccc

SEQ ID NO: 1927797 - RNA, 21 nt, Human
uccaaccuggggggcaguggu

SEQ ID NO: 1927798 - RNA, 21 nt, Human
uccaaccugcaaagaucuguc

SEQ ID NO: 1927799 - RNA, 13 nt, Human
uccaaccuuccca

SEQ ID NO: 1927800 - RNA, 15 nt, Human
uccacccaggagccc

SEQ ID NO: 1927801 - RNA, 14 nt, Human
uccacccaggagcc

SEQ ID NO: 1927802 - RNA, 12 nt, Human
uccacccaggag

SEQ ID NO: 1927803 - RNA, 19 nt, Human
uccacccaccucagccucc

SEQ ID NO: 1927804 - RNA, 18 nt, Human
uccacccaccucagccuc

SEQ ID NO: 1927805 - RNA, 17 nt, Human
uccacccaccucagccu

SEQ ID NO: 1927806 - RNA, 14 nt, Human
accuggccucugca

SEQ ID NO: 1927807 - RNA, 17 nt, Human
accuggcagcucuggac

SEQ ID NO: 1927808 - RNA, 16 nt, Human
accuggccucugcacu

SEQ ID NO: 1927809 - RNA, 17 nt, Human
accuggccucugcacuc

SEQ ID NO: 1927810 - RNA, 14 nt, Human
accuggcagcucug

SEQ ID NO: 1927811 - RNA, 23 nt, Human
accuggccucugcacuccccugc

SEQ ID NO: 1927812 - RNA, 18 nt, Human
accuggccucugcacucc

SEQ ID NO: 1927813 - RNA, 20 nt, Human
accuggccucugcacucccc

SEQ ID NO: 1927814 - RNA, 19 nt, Human
accuguuucugcagccacu

SEQ ID NO: 1927815 - RNA, 16 nt, Human
accuguuuuuaagcug

SEQ ID NO: 1927816 - RNA, 18 nt, Human
accuguuuuuaagcuguu

SEQ ID NO: 1927817 - RNA, 19 nt, Human
accuguuuuuaagcuguuu

SEQ ID NO: 1927818 - RNA, 20 nt, Human
accuguuuuuaagcuguuuc

SEQ ID NO: 1927819 - RNA, 18 nt, Human
accuguuuuuuuucuuuu

SEQ ID NO: 1927820 - RNA, 18 nt, Human
accuuagacagucccugc

SEQ ID NO: 1927821 - RNA, 19 nt, Human
accuuagacagucccugcc

SEQ ID NO: 1927822 - RNA, 20 nt, Human
accuuagacagucccugcca

SEQ ID NO: 1927823 - RNA, 14 nt, Human
acgagaaaacaaua

SEQ ID NO: 1927824 - RNA, 22 nt, Human
accuuuuuuauacauaaacaag

SEQ ID NO: 1927825 - RNA, 21 nt, Human
accuuuuuuauacauaaacaa

SEQ ID NO: 1927826 - RNA, 21 nt, Human
uccaggcuguaucccaugagc

SEQ ID NO: 1927827 - RNA, 20 nt, Human
accuuuuuuauacauaaaca

SEQ ID NO: 1927828 - RNA, 19 nt, Human
accuuuuuuauacauaaac

SEQ ID NO: 1927829 - RNA, 16 nt, Human
acgagcaggcuucuuc

SEQ ID NO: 1927830 - RNA, 19 nt, Human
acgccagauucuuuccuga

SEQ ID NO: 1927831 - RNA, 17 nt, Human
acgccagauucuuuccu

SEQ ID NO: 1927832 - RNA, 14 nt, Human
uccagccccuggau

SEQ ID NO: 1927833 - RNA, 13 nt, Human
uccagccccugga

SEQ ID NO: 1927834 - RNA, 13 nt, Human
uccaggcagaucc

SEQ ID NO: 1927835 - RNA, 12 nt, Human
uccagccccugg

SEQ ID NO: 1927836 - RNA, 14 nt, Human
uccaggcuguaucc

SEQ ID NO: 1927837 - RNA, 18 nt, Human
uccaggccagggggccag

SEQ ID NO: 1927838 - RNA, 16 nt, Human
uccaggccagggggcc

SEQ ID NO: 1927839 - RNA, 14 nt, Human
uccaggcagaucca

SEQ ID NO: 1927840 - RNA, 15 nt, Human
uccaggcagauccag

SEQ ID NO: 1927841 - RNA, 16 nt, Human
uccaggcagauccagg

SEQ ID NO: 1927842 - RNA, 17 nt, Human
uccaggcagauccagga

SEQ ID NO: 1927843 - RNA, 18 nt, Human
uccaggcagauccaggac

SEQ ID NO: 1927844 - RNA, 19 nt, Human
uccaggcagauccaggacu

SEQ ID NO: 1927845 - RNA, 20 nt, Human
uccaggcagauccaggacua

SEQ ID NO: 1927846 - RNA, 21 nt, Human
uccaggcagauccaggacuau

SEQ ID NO: 1927847 - RNA, 14 nt, Human
accuuuugagugcc

SEQ ID NO: 1927848 - RNA, 17 nt, Human
accuuuugagugccuua

SEQ ID NO: 1927849 - RNA, 20 nt, Human
accuuuugagugccuuacac

SEQ ID NO: 1927850 - RNA, 20 nt, Human
accuuauuguaccucucuua

SEQ ID NO: 1927851 - RNA, 22 nt, Human
accuuauuguaccucucuuaua

SEQ ID NO: 1927852 - RNA, 17 nt, Human
accuuauuuaaguaacu

SEQ ID NO: 1927853 - RNA, 14 nt, Human
accuuauuguaccu

SEQ ID NO: 1927854 - RNA, 17 nt, Human
accuuauuguaccucuc

SEQ ID NO: 1927855 - RNA, 18 nt, Human
accuuauuguaccucucu

SEQ ID NO: 1927856 - RNA, 22 nt, Human
accuuuugggaauguuuuaaau

SEQ ID NO: 1927857 - RNA, 16 nt, Human
accuuuugggaauguu

SEQ ID NO: 1927858 - RNA, 19 nt, Human
accuuuugggaauguuuua

SEQ ID NO: 1927859 - RNA, 17 nt, Human
uccacucaggucuguuu

SEQ ID NO: 1927860 - RNA, 15 nt, Human
uccacucaguugcaa

SEQ ID NO: 1927861 - RNA, 18 nt, Human
uccacuccuccuagccac

SEQ ID NO: 1927862 - RNA, 15 nt, Human
uccacuccuccuagc

SEQ ID NO: 1927863 - RNA, 18 nt, Human
uccagacccggcugcgug

SEQ ID NO: 1927864 - RNA, 15 nt, Human
uccagacccggcugc

SEQ ID NO: 1927865 - RNA, 19 nt, Human
uccagacccggcugcgugg

SEQ ID NO: 1927866 - RNA, 11 nt, Human
uccagaccuga

SEQ ID NO: 1927867 - RNA, 14 nt, Human
uccagagacuggga

SEQ ID NO: 1927868 - RNA, 14 nt, Human
uccagacuuccuug

SEQ ID NO: 1927869 - RNA, 19 nt, Human
uccagacuuccuugagaca

SEQ ID NO: 1927870 - RNA, 20 nt, Human
uccagacuuccuugagacac

SEQ ID NO: 1927871 - RNA, 13 nt, Human
uccagaccugauc

SEQ ID NO: 1927872 - RNA, 18 nt, Human
uccagaccugauccugga

SEQ ID NO: 1927873 - RNA, 19 nt, Human
uccagaccugauccuggag

SEQ ID NO: 1927874 - RNA, 22 nt, Human
uccagaccugauccuggaggcc

SEQ ID NO: 1927875 - RNA, 16 nt, Human
uccagaauuucccaaa

SEQ ID NO: 1927876 - RNA, 21 nt, Human
uccacuccuccuagccaccca

SEQ ID NO: 1927877 - RNA, 20 nt, Human
uccagaauuucccaaagcag

SEQ ID NO: 1927878 - RNA, 22 nt, Human
uccagaauuucccaaagcagug

SEQ ID NO: 1927879 - RNA, 13 nt, Human
uccagacacaugu

SEQ ID NO: 1927880 - RNA, 14 nt, Human
uccagacccggcug

SEQ ID NO: 1927881 - RNA, 18 nt, Human
uccacuggggauugggcc

SEQ ID NO: 1927882 - RNA, 20 nt, Human
accuacaguguacagucuug

SEQ ID NO: 1927883 - RNA, 18 nt, Human
accuacaguguacagucu

SEQ ID NO: 1927884 - RNA, 17 nt, Human
accuacaguguacaguc

SEQ ID NO: 1927885 - RNA, 16 nt, Human
accuacaguguacagu

SEQ ID NO: 1927886 - RNA, 15 nt, Human
accuacaguguacag

SEQ ID NO: 1927887 - RNA, 20 nt, Human
accuaaugcuccuuguuccu

SEQ ID NO: 1927888 - RNA, 22 nt, Human
accuaauccaggcagauccagg

SEQ ID NO: 1927889 - RNA, 22 nt, Human
accucaaagcaccugaacaguu

SEQ ID NO: 1927890 - RNA, 12 nt, Human
ucaggaagcuca

SEQ ID NO: 1927891 - RNA, 13 nt, Human
ucaggaagcucag

SEQ ID NO: 1927892 - RNA, 14 nt, Human
ucaggaagcucagg

SEQ ID NO: 1927893 - RNA, 15 nt, Human
ucaggaagcucaggg

SEQ ID NO: 1927894 - RNA, 16 nt, Human
accuaaauaaccaauc

SEQ ID NO: 1927895 - RNA, 20 nt, Human
accgcgacuaauuucaaaau

SEQ ID NO: 1927896 - RNA, 16 nt, Human
accgcgacuaauuuca

SEQ ID NO: 1927897 - RNA, 17 nt, Human
accgcgacuaauuucaa

SEQ ID NO: 1927898 - RNA, 12 nt, Human
accuccugccuc

SEQ ID NO: 1927899 - RNA, 13 nt, Human
accuccugccucg

SEQ ID NO: 1927900 - RNA, 13 nt, Human
accucccugccuc

SEQ ID NO: 1927901 - RNA, 14 nt, Human
accucccugccucc

SEQ ID NO: 1927902 - RNA, 22 nt, Human
accucaacccccauuucuauuu

SEQ ID NO: 1927903 - RNA, 16 nt, Human
accucaaccaaugcca

SEQ ID NO: 1927904 - RNA, 19 nt, Human
accucaacccccauuucua

SEQ ID NO: 1927905 - RNA, 21 nt, Human
accucaacccccauuucuauu

SEQ ID NO: 1927906 - RNA, 11 nt, Human
accuccugcug

SEQ ID NO: 1927907 - RNA, 12 nt, Human
accuccugcugg

SEQ ID NO: 1927908 - RNA, 23 nt, Human
accuccugccucgaacuggcugc

SEQ ID NO: 1927909 - RNA, 17 nt, Human
ucauccccucacuugcc

SEQ ID NO: 1927910 - RNA, 15 nt, Human
ucauccuaagcuauu

SEQ ID NO: 1927911 - RNA, 18 nt, Human
ucauccuauucuuucgaa

SEQ ID NO: 1927912 - RNA, 14 nt, Human
ucauccuucuggaa

SEQ ID NO: 1927913 - RNA, 13 nt, Human
ucauccugcaggc

SEQ ID NO: 1927914 - RNA, 12 nt, Human
ucauccugcagg

SEQ ID NO: 1927915 - RNA, 18 nt, Human
ucauccucauacccaccc

SEQ ID NO: 1927916 - RNA, 13 nt, Human
ucauccuccucag

SEQ ID NO: 1927917 - RNA, 19 nt, Human
ucauccuccucagaucuuc

SEQ ID NO: 1927918 - RNA, 18 nt, Human
ucaucuagguaaauuaca

SEQ ID NO: 1927919 - RNA, 14 nt, Human
ucaucuaggauuuu

SEQ ID NO: 1927920 - RNA, 22 nt, Human
ucauccuucuggaauaaggaga

SEQ ID NO: 1927921 - RNA, 12 nt, Human
ucauucuucugu

SEQ ID NO: 1927922 - RNA, 17 nt, Human
ucauucuugaaagcugu

SEQ ID NO: 1927923 - RNA, 18 nt, Human
ucauucuugaaagcugug

SEQ ID NO: 1927924 - RNA, 12 nt, Human
ucauugaaaucu

SEQ ID NO: 1927925 - RNA, 13 nt, Human
ucauugaaaucuu

SEQ ID NO: 1927926 - RNA, 13 nt, Human
ucauuaauucuau

SEQ ID NO: 1927927 - RNA, 14 nt, Human
ucauuaauucuaua

SEQ ID NO: 1927928 - RNA, 13 nt, Human
ucauuaccacagg

SEQ ID NO: 1927929 - RNA, 14 nt, Human
accuccugcugggc

SEQ ID NO: 1927930 - RNA, 16 nt, Human
accuccugcugggcag

SEQ ID NO: 1927931 - RNA, 13 nt, Human
accuccugcuggg

SEQ ID NO: 1927932 - RNA, 23 nt, Human
ucauugcugagccucugcucccc

SEQ ID NO: 1927933 - RNA, 17 nt, Human
ucauugcugagccucug

SEQ ID NO: 1927934 - RNA, 22 nt, Human
ucauugcugagccucugcuccc

SEQ ID NO: 1927935 - RNA, 13 nt, Human
accuccugggcua

SEQ ID NO: 1927936 - RNA, 19 nt, Human
accucggugccuuccucuu

SEQ ID NO: 1927937 - RNA, 22 nt, Human
accuccuuucaagguaacugua

SEQ ID NO: 1927938 - RNA, 18 nt, Human
accucuaaaacaguccuu

SEQ ID NO: 1927939 - RNA, 22 nt, Human
ucauugaaaucuuuuugcuuug

SEQ ID NO: 1927940 - RNA, 12 nt, Human
ucauugaccuga

SEQ ID NO: 1927941 - RNA, 14 nt, Human
ucauugaccugagg

SEQ ID NO: 1927942 - RNA, 15 nt, Human
ucauugaccugaggc

SEQ ID NO: 1927943 - RNA, 18 nt, Human
ucauugaauuauaaaagc

SEQ ID NO: 1927944 - RNA, 20 nt, Human
ucauugaauuauaaaagcca

SEQ ID NO: 1927945 - RNA, 15 nt, Human
ucauugcugagccuc

SEQ ID NO: 1927946 - RNA, 16 nt, Human
ucauugcugagccucu

SEQ ID NO: 1927947 - RNA, 15 nt, Human
accugauugugucuc

SEQ ID NO: 1927948 - RNA, 17 nt, Human
accugauugugucucuu

SEQ ID NO: 1927949 - RNA, 18 nt, Human
accugauugugucucuug

SEQ ID NO: 1927950 - RNA, 22 nt, Human
accugaggcccuucucuccagc

SEQ ID NO: 1927951 - RNA, 15 nt, Human
accugaggcccuucu

SEQ ID NO: 1927952 - RNA, 16 nt, Human
accugaggcccuucuc

SEQ ID NO: 1927953 - RNA, 20 nt, Human
accugaggcccuucucucca

SEQ ID NO: 1927954 - RNA, 21 nt, Human
accugaggcccuucucuccag

SEQ ID NO: 1927955 - RNA, 14 nt, Human
accugaggcccuuc

SEQ ID NO: 1927956 - RNA, 19 nt, Human
accugacguagcugcaaag

SEQ ID NO: 1927957 - RNA, 13 nt, Human
accucucccaggg

SEQ ID NO: 1927958 - RNA, 14 nt, Human
accucuaaauucuu

SEQ ID NO: 1927959 - RNA, 17 nt, Human
acuaacauauaauguug

SEQ ID NO: 1927960 - RNA, 15 nt, Human
acuaacauauaaugu

SEQ ID NO: 1927961 - RNA, 12 nt, Human
acuaaccacgcu

SEQ ID NO: 1927962 - RNA, 21 nt, Human
acuacaaacaaaauuucuauu

SEQ ID NO: 1927963 - RNA, 22 nt, Human
acuacaaacaaaauuucuauua

SEQ ID NO: 1927964 - RNA, 11 nt, Human
acuacaaauca

SEQ ID NO: 1927965 - RNA, 13 nt, Human
acuacaaaucaag

SEQ ID NO: 1927966 - RNA, 19 nt, Human
acuacaaaucaaguauuug

SEQ ID NO: 1927967 - RNA, 11 nt, Human
acuacaggcac

SEQ ID NO: 1927968 - RNA, 22 nt, Human
acuacaauuuaaagcaaaggag

SEQ ID NO: 1927969 - RNA, 17 nt, Human
acuacaauuuaaagcaa

SEQ ID NO: 1927970 - RNA, 15 nt, Human
acuacaggcacccac

SEQ ID NO: 1927971 - RNA, 14 nt, Human
acuacaguuuguua

SEQ ID NO: 1927972 - RNA, 13 nt, Human
acuacaguuuguu

SEQ ID NO: 1927973 - RNA, 17 nt, Human
ucccagcugugcucugg

SEQ ID NO: 1927974 - RNA, 12 nt, Human
ucccagccccaa

SEQ ID NO: 1927975 - RNA, 14 nt, Human
acuacauucuguua

SEQ ID NO: 1927976 - RNA, 23 nt, Human
ucccagauuggcucacacugaga

SEQ ID NO: 1927977 - RNA, 12 nt, Human
ucccagcaauuu

SEQ ID NO: 1927978 - RNA, 16 nt, Human
ucccagcacuuuggga

SEQ ID NO: 1927979 - RNA, 18 nt, Human
ucccagcacuuugggagg

SEQ ID NO: 1927980 - RNA, 19 nt, Human
ucccagcacuuugggaggc

SEQ ID NO: 1927981 - RNA, 13 nt, Human
acuacauucuguu

SEQ ID NO: 1927982 - RNA, 12 nt, Human
acuacauucugu

SEQ ID NO: 1927983 - RNA, 11 nt, Human
acuacauucug

SEQ ID NO: 1927984 - RNA, 15 nt, Human
acuacaguuuguuag

SEQ ID NO: 1927985 - RNA, 21 nt, Human
uccccaccagugaaugaaagu

SEQ ID NO: 1927986 - RNA, 13 nt, Human
uccccaccaguga

SEQ ID NO: 1927987 - RNA, 15 nt, Human
ucccauccccugugg

SEQ ID NO: 1927988 - RNA, 18 nt, Human
ucccauccucuucuuuua

SEQ ID NO: 1927989 - RNA, 13 nt, Human
ucccauccagggc

SEQ ID NO: 1927990 - RNA, 14 nt, Human
ucccauccagggcc

SEQ ID NO: 1927991 - RNA, 15 nt, Human
ucccaucacccgcua

SEQ ID NO: 1927992 - RNA, 22 nt, Human
ucccauaugccugggcagaagg

SEQ ID NO: 1927993 - RNA, 15 nt, Human
acuacauucuguuaa

SEQ ID NO: 1927994 - RNA, 15 nt, Human
uccccauggagccag

SEQ ID NO: 1927995 - RNA, 16 nt, Human
uccccauggagccagc

SEQ ID NO: 1927996 - RNA, 22 nt, Human
uccccaccgcagacaggaccag

SEQ ID NO: 1927997 - RNA, 19 nt, Human
uccccaucuucuaaaccca

SEQ ID NO: 1927998 - RNA, 13 nt, Human
uccccauggagcc

SEQ ID NO: 1927999 - RNA, 17 nt, Human
uccccaccgcagacagg

SEQ ID NO: 1928000 - RNA, 18 nt, Human
uccccaccgcagacagga

SEQ ID NO: 1928001 - RNA, 21 nt, Human
uccccaccgcagacaggacca

SEQ ID NO: 1928002 - RNA, 17 nt, Human
acgggcagccuggcucc

SEQ ID NO: 1928003 - RNA, 22 nt, Human
acgggcagccuggcucccagga

SEQ ID NO: 1928004 - RNA, 13 nt, Human
ucccacagcgcug

SEQ ID NO: 1928005 - RNA, 20 nt, Human
acgggaggguaaggcugugg

SEQ ID NO: 1928006 - RNA, 16 nt, Human
ucccacaaaggagagc

SEQ ID NO: 1928007 - RNA, 15 nt, Human
ucccaccccacacac

SEQ ID NO: 1928008 - RNA, 20 nt, Human
ucccaccccacacacgccag

SEQ ID NO: 1928009 - RNA, 14 nt, Human
ucccacaaguggug

SEQ ID NO: 1928010 - RNA, 16 nt, Human
ucccacaagugguggu

SEQ ID NO: 1928011 - RNA, 19 nt, Human
acgugggcaaacaggcagu

SEQ ID NO: 1928012 - RNA, 23 nt, Human
acgugggcugggcccacaaaggc

SEQ ID NO: 1928013 - RNA, 20 nt, Human
acgugggcauucaaauguau

SEQ ID NO: 1928014 - RNA, 17 nt, Human
acgugggcauucaaaug

SEQ ID NO: 1928015 - RNA, 18 nt, Human
acguguacuacaauuuaa

SEQ ID NO: 1928016 - RNA, 14 nt, Human
acguuccuaagcug

SEQ ID NO: 1928017 - RNA, 16 nt, Human
acgugggcaaacaggc

SEQ ID NO: 1928018 - RNA, 23 nt, Human
acguggcugcuucaaggauccug

SEQ ID NO: 1928019 - RNA, 20 nt, Human
acguauguuuuuguguauuu

SEQ ID NO: 1928020 - RNA, 16 nt, Human
acguagcugcaaagga

SEQ ID NO: 1928021 - RNA, 20 nt, Human
acguagcugcaaaggacaga

SEQ ID NO: 1928022 - RNA, 22 nt, Human
acguauaaaagccuguuuaaga

SEQ ID NO: 1928023 - RNA, 15 nt, Human
acgguuuuacugcag

SEQ ID NO: 1928024 - RNA, 17 nt, Human
acgguuuuacugcagcu

SEQ ID NO: 1928025 - RNA, 16 nt, Human
ucccaaagcagugcau

SEQ ID NO: 1928026 - RNA, 15 nt, Human
ucccaaacgccuccc

SEQ ID NO: 1928027 - RNA, 21 nt, Human
ucccaaacgccuccccugccc

SEQ ID NO: 1928028 - RNA, 18 nt, Human
ucccaaacccuucagugc

SEQ ID NO: 1928029 - RNA, 23 nt, Human
uccauuuuuucaagguaauuucu

SEQ ID NO: 1928030 - RNA, 14 nt, Human
ucccaaagugcugg

SEQ ID NO: 1928031 - RNA, 13 nt, Human
ucccaaagugcug

SEQ ID NO: 1928032 - RNA, 20 nt, Human
ucccaaguagcugggauuac

SEQ ID NO: 1928033 - RNA, 21 nt, Human
ucccaaguagcugggauuaca

SEQ ID NO: 1928034 - RNA, 21 nt, Human
ucccaaagcagugcaugcugu

SEQ ID NO: 1928035 - RNA, 17 nt, Human
ucccaaagcagugcaug

SEQ ID NO: 1928036 - RNA, 18 nt, Human
ucccaaagcagugcaugc

SEQ ID NO: 1928037 - RNA, 22 nt, Human
acgccagauucuuuccugaggc

SEQ ID NO: 1928038 - RNA, 23 nt, Human
acgccagauucuuuccugaggcu

SEQ ID NO: 1928039 - RNA, 21 nt, Human
uccauccugaggcuccacuug

SEQ ID NO: 1928040 - RNA, 20 nt, Human
uccauccugaggcuccacuu

SEQ ID NO: 1928041 - RNA, 21 nt, Human
uccaugaagauguagaggaga

SEQ ID NO: 1928042 - RNA, 13 nt, Human
uccaugaagaugu

SEQ ID NO: 1928043 - RNA, 16 nt, Human
uccaugaaaaugcaac

SEQ ID NO: 1928044 - RNA, 15 nt, Human
uccaugaaaaugcaa

SEQ ID NO: 1928045 - RNA, 19 nt, Human
uccauucuuucugauaacu

SEQ ID NO: 1928046 - RNA, 12 nt, Human
uccauucuuucu

SEQ ID NO: 1928047 - RNA, 14 nt, Human
uccauucuuucuga

SEQ ID NO: 1928048 - RNA, 18 nt, Human
uccauucuuucugauaac

SEQ ID NO: 1928049 - RNA, 19 nt, Human
uccauucucaccuauccac

SEQ ID NO: 1928050 - RNA, 12 nt, Human
acucaccccagc

SEQ ID NO: 1928051 - RNA, 21 nt, Human
acuacucauacuuaagcaaaa

SEQ ID NO: 1928052 - RNA, 21 nt, Human
acuacuagggaaaugccuuug

SEQ ID NO: 1928053 - RNA, 17 nt, Human
acuacucccccaggugg

SEQ ID NO: 1928054 - RNA, 17 nt, Human
ucccgaguagcugggac

SEQ ID NO: 1928055 - RNA, 16 nt, Human
ucccgaguagcuggga

SEQ ID NO: 1928056 - RNA, 18 nt, Human
ucccgaguagcugggacu

SEQ ID NO: 1928057 - RNA, 15 nt, Human
ucccgaguagcuggg

SEQ ID NO: 1928058 - RNA, 20 nt, Human
ucccgaauagcugggacuac

SEQ ID NO: 1928059 - RNA, 17 nt, Human
uccccuuuauguacagg

SEQ ID NO: 1928060 - RNA, 20 nt, Human
uccccuuuauguacaggaug

SEQ ID NO: 1928061 - RNA, 16 nt, Human
uccccucuccuuccug

SEQ ID NO: 1928062 - RNA, 15 nt, Human
uccccucuccuuccu

SEQ ID NO: 1928063 - RNA, 20 nt, Human
uccccuugucugaacuggag

SEQ ID NO: 1928064 - RNA, 17 nt, Human
ucccugaaggccccgcc

SEQ ID NO: 1928065 - RNA, 16 nt, Human
ucccugaaggccccgc

SEQ ID NO: 1928066 - RNA, 11 nt, Human
ucccugaggca

SEQ ID NO: 1928067 - RNA, 22 nt, Human
ucccugaggcagguccccagac

SEQ ID NO: 1928068 - RNA, 21 nt, Human
ucccugaggcagguccccaga

SEQ ID NO: 1928069 - RNA, 20 nt, Human
ucccugaggcagguccccag

SEQ ID NO: 1928070 - RNA, 22 nt, Human
acucacuggggccuacagcuuu

SEQ ID NO: 1928071 - RNA, 11 nt, Human
ucccugaaggc

SEQ ID NO: 1928072 - RNA, 15 nt, Human
ucccugaaggccccg

SEQ ID NO: 1928073 - RNA, 21 nt, Human
ucccucuuucccucccuuccu

SEQ ID NO: 1928074 - RNA, 20 nt, Human
ucccugaaggaaccaaagcg

SEQ ID NO: 1928075 - RNA, 18 nt, Human
ucccucuuucccucccuu

SEQ ID NO: 1928076 - RNA, 20 nt, Human
ucccucuuucccucccuucc

SEQ ID NO: 1928077 - RNA, 14 nt, Human
ucccucuuucccuc

SEQ ID NO: 1928078 - RNA, 19 nt, Human
ucccuuuuaauccuggcug

SEQ ID NO: 1928079 - RNA, 23 nt, Human
ucccuuucuccccugcccccagg

SEQ ID NO: 1928080 - RNA, 12 nt, Human
ucccuuuuccuu

SEQ ID NO: 1928081 - RNA, 17 nt, Human
uccggucccugucccag

SEQ ID NO: 1928082 - RNA, 19 nt, Human
uccuaaauauauuuuaaga

SEQ ID NO: 1928083 - RNA, 16 nt, Human
uccuagaaauucccca

SEQ ID NO: 1928084 - RNA, 15 nt, Human
ucccugguggcagcu

SEQ ID NO: 1928085 - RNA, 12 nt, Human
ucccugucccag

SEQ ID NO: 1928086 - RNA, 21 nt, Human
acuccugcaggcagccaggcc

SEQ ID NO: 1928087 - RNA, 14 nt, Human
ucccuggggugggg

SEQ ID NO: 1928088 - RNA, 19 nt, Human
ucccuggugagagggccgg

SEQ ID NO: 1928089 - RNA, 21 nt, Human
ucccuggugagagggccgggc

SEQ ID NO: 1928090 - RNA, 23 nt, Human
ucccuggugagagggccgggcag

SEQ ID NO: 1928091 - RNA, 17 nt, Human
ucccuuacgugaguccu

SEQ ID NO: 1928092 - RNA, 18 nt, Human
ucccuuucuccccugccc

SEQ ID NO: 1928093 - RNA, 17 nt, Human
ucccuuucuccccugcc

SEQ ID NO: 1928094 - RNA, 16 nt, Human
ucccuuucuccccugc

SEQ ID NO: 1928095 - RNA, 15 nt, Human
ucccuuucuccccug

SEQ ID NO: 1928096 - RNA, 14 nt, Human
ucccuuucuccccu

SEQ ID NO: 1928097 - RNA, 15 nt, Human
acucauucuucugua

SEQ ID NO: 1928098 - RNA, 14 nt, Human
acucauugaccuga

SEQ ID NO: 1928099 - RNA, 15 nt, Human
acucauguuauuuuu

SEQ ID NO: 1928100 - RNA, 15 nt, Human
acucauugaccugag

SEQ ID NO: 1928101 - RNA, 15 nt, Human
acuccagaauuuccc

SEQ ID NO: 1928102 - RNA, 17 nt, Human
acuccagaauuucccaa

SEQ ID NO: 1928103 - RNA, 18 nt, Human
acuccugcaggcagccag

SEQ ID NO: 1928104 - RNA, 19 nt, Human
acuccugcaggcagccagg

SEQ ID NO: 1928105 - RNA, 15 nt, Human
acuccugaccucaag

SEQ ID NO: 1928106 - RNA, 17 nt, Human
acuccugcaggcagcca

SEQ ID NO: 1928107 - RNA, 23 nt, Human
acuccagaauuucccaaagcagu

SEQ ID NO: 1928108 - RNA, 12 nt, Human
acuccagccugg

SEQ ID NO: 1928109 - RNA, 13 nt, Human
acuccagccuggg

SEQ ID NO: 1928110 - RNA, 14 nt, Human
acuccuccuagcca

SEQ ID NO: 1928111 - RNA, 18 nt, Human
acuccuccuagccaccca

SEQ ID NO: 1928112 - RNA, 16 nt, Human
acuccuccuagccacc

SEQ ID NO: 1928113 - RNA, 15 nt, Human
acuccuccuagccac

SEQ ID NO: 1928114 - RNA, 20 nt, Human
ucuaaagccauuguaguccu

SEQ ID NO: 1928115 - RNA, 13 nt, Human
ucuaaagcugcca

SEQ ID NO: 1928116 - RNA, 14 nt, Human
ucuaaagcugccag

SEQ ID NO: 1928117 - RNA, 16 nt, Human
ucuaaagcugccagcc

SEQ ID NO: 1928118 - RNA, 15 nt, Human
ucuaaagcugccagc

SEQ ID NO: 1928119 - RNA, 21 nt, Human
acuguucucugcccuccaaga

SEQ ID NO: 1928120 - RNA, 15 nt, Human
acuguucucugcccu

SEQ ID NO: 1928121 - RNA, 20 nt, Human
acuguucucugcccuccaag

SEQ ID NO: 1928122 - RNA, 14 nt, Human
acuguucucugccc

SEQ ID NO: 1928123 - RNA, 19 nt, Human
acuguucccugagguggga

SEQ ID NO: 1928124 - RNA, 16 nt, Human
acuguucccugaggug

SEQ ID NO: 1928125 - RNA, 19 nt, Human
acuguuauccuauuuagau

SEQ ID NO: 1928126 - RNA, 17 nt, Human
acuuaauaauguguaca

SEQ ID NO: 1928127 - RNA, 13 nt, Human
acuuaauaaugug

SEQ ID NO: 1928128 - RNA, 17 nt, Human
acuuaauacuaccuuga

SEQ ID NO: 1928129 - RNA, 18 nt, Human
acuuaauacuaccuugaa

SEQ ID NO: 1928130 - RNA, 19 nt, Human
acuuaauacuaccuugaaa

SEQ ID NO: 1928131 - RNA, 21 nt, Human
acuuaauacuaccuugaaaau

SEQ ID NO: 1928132 - RNA, 15 nt, Human
acuuaaauaauguga

SEQ ID NO: 1928133 - RNA, 16 nt, Human
acuuaaauaaugugaa

SEQ ID NO: 1928134 - RNA, 18 nt, Human
acuuaaauaaugugaaac

SEQ ID NO: 1928135 - RNA, 17 nt, Human
acuuaaauaaugugaaa

SEQ ID NO: 1928136 - RNA, 18 nt, Human
acuguugcccaggcuggc

SEQ ID NO: 1928137 - RNA, 17 nt, Human
acuguugcccaggcugg

SEQ ID NO: 1928138 - RNA, 14 nt, Human
acuguugcccaggc

SEQ ID NO: 1928139 - RNA, 13 nt, Human
acuguugcccagg

SEQ ID NO: 1928140 - RNA, 12 nt, Human
acuguugcccag

SEQ ID NO: 1928141 - RNA, 16 nt, Human
acuuaaucuaaaugga

SEQ ID NO: 1928142 - RNA, 15 nt, Human
acuuaaucuaaaugg

SEQ ID NO: 1928143 - RNA, 13 nt, Human
acuuaaucuaaau

SEQ ID NO: 1928144 - RNA, 23 nt, Human
acuuacauuguucaauuagaaua

SEQ ID NO: 1928145 - RNA, 11 nt, Human
ucgggcaugac

SEQ ID NO: 1928146 - RNA, 12 nt, Human
ucgggcaugaca

SEQ ID NO: 1928147 - RNA, 17 nt, Human
ucgggaggucgaggcag

SEQ ID NO: 1928148 - RNA, 19 nt, Human
ucgggaggucgaggcagga

SEQ ID NO: 1928149 - RNA, 21 nt, Human
ucgggaggucgaggcaggagg

SEQ ID NO: 1928150 - RNA, 13 nt, Human
ucguaaaauuaag

SEQ ID NO: 1928151 - RNA, 22 nt, Human
ucguuuucaaaauuguuacaaa

SEQ ID NO: 1928152 - RNA, 16 nt, Human
ucguaaaauuaagaaa

SEQ ID NO: 1928153 - RNA, 11 nt, Human
ucuaaaagaaa

SEQ ID NO: 1928154 - RNA, 13 nt, Human
ucuaaaaugaguu

SEQ ID NO: 1928155 - RNA, 17 nt, Human
acuguccuacccacccu

SEQ ID NO: 1928156 - RNA, 23 nt, Human
acuguccuacccacccuccuuuc

SEQ ID NO: 1928157 - RNA, 18 nt, Human
acuguccuacccacccuc

SEQ ID NO: 1928158 - RNA, 16 nt, Human
acugggagaaaugaaa

SEQ ID NO: 1928159 - RNA, 24 nt, Human
acugucacucauugcugagccucu

SEQ ID NO: 1928160 - RNA, 23 nt, Human
acugucacucauugcugagccuc

SEQ ID NO: 1928161 - RNA, 15 nt, Human
acugugugcucagga

SEQ ID NO: 1928162 - RNA, 19 nt, Human
acugugugcucaggagccc

SEQ ID NO: 1928163 - RNA, 20 nt, Human
acugugugcucaggagcccu

SEQ ID NO: 1928164 - RNA, 21 nt, Human
acugugugcucaggagcccug

SEQ ID NO: 1928165 - RNA, 12 nt, Human
acugugugcuca

SEQ ID NO: 1928166 - RNA, 18 nt, Human
acuggaugcagaaacagu

SEQ ID NO: 1928167 - RNA, 17 nt, Human
acuggaugcagaaacag

SEQ ID NO: 1928168 - RNA, 15 nt, Human
acuggauuaaacuua

SEQ ID NO: 1928169 - RNA, 14 nt, Human
acugcuuuuggucu

SEQ ID NO: 1928170 - RNA, 18 nt, Human
acugcuuguguuuuuaac

SEQ ID NO: 1928171 - RNA, 21 nt, Human
acugcuugugaaaggaaagag

SEQ ID NO: 1928172 - RNA, 16 nt, Human
acugcuuguguuuuua

SEQ ID NO: 1928173 - RNA, 17 nt, Human
acugcuuccagugaggc

SEQ ID NO: 1928174 - RNA, 20 nt, Human
acugcuuaacuucacauauu

SEQ ID NO: 1928175 - RNA, 18 nt, Human
acugcuuaacuucacaua

SEQ ID NO: 1928176 - RNA, 18 nt, Human
acugcuaagaauauuuga

SEQ ID NO: 1928177 - RNA, 16 nt, Human
acugcuaagaauauuu

SEQ ID NO: 1928178 - RNA, 23 nt, Human
acugcuacaaauacucuuaggaa

SEQ ID NO: 1928179 - RNA, 13 nt, Human
acugcuacuguaa

SEQ ID NO: 1928180 - RNA, 15 nt, Human
acugccucucacagc

SEQ ID NO: 1928181 - RNA, 16 nt, Human
acugccuauuuuaaua

SEQ ID NO: 1928182 - RNA, 21 nt, Human
acugccuauuuuaauaaacac

SEQ ID NO: 1928183 - RNA, 17 nt, Human
acugccucgaaacacag

SEQ ID NO: 1928184 - RNA, 19 nt, Human
acugccucgaaacacagaa

SEQ ID NO: 1928185 - RNA, 22 nt, Human
acugccucucacagcugaguug

SEQ ID NO: 1928186 - RNA, 21 nt, Human
uccuagaaauuccccacccug

SEQ ID NO: 1928187 - RNA, 22 nt, Human
uccuagaaauuccccacccuga

SEQ ID NO: 1928188 - RNA, 16 nt, Human
acugcauaugaaagga

SEQ ID NO: 1928189 - RNA, 17 nt, Human
uccuagagggaggggcc

SEQ ID NO: 1928190 - RNA, 20 nt, Human
uccuagagggaggggccuag

SEQ ID NO: 1928191 - RNA, 21 nt, Human
uccuagagggaggggccuagg

SEQ ID NO: 1928192 - RNA, 22 nt, Human
acugcauaccaaccugggcaau

SEQ ID NO: 1928193 - RNA, 20 nt, Human
acugcaucaagaugugacau

SEQ ID NO: 1928194 - RNA, 22 nt, Human
acugcaucaagaugugacaugu

SEQ ID NO: 1928195 - RNA, 13 nt, Human
acugcaugcugcu

SEQ ID NO: 1928196 - RNA, 16 nt, Human
acugcaugcugcugga

SEQ ID NO: 1928197 - RNA, 17 nt, Human
acugcaugcugcuggac

SEQ ID NO: 1928198 - RNA, 16 nt, Human
acugcauguuugugau

SEQ ID NO: 1928199 - RNA, 15 nt, Human
acugcauguuuguga

SEQ ID NO: 1928200 - RNA, 15 nt, Human
uccuuccagcccaga

SEQ ID NO: 1928201 - RNA, 12 nt, Human
uccuuccaccuc

SEQ ID NO: 1928202 - RNA, 16 nt, Human
uccuucagugccuuau

SEQ ID NO: 1928203 - RNA, 17 nt, Human
uccuucagugccuuaug

SEQ ID NO: 1928204 - RNA, 21 nt, Human
uccuuccaguguccuuagaac

SEQ ID NO: 1928205 - RNA, 19 nt, Human
uccuuccuguucugaacug

SEQ ID NO: 1928206 - RNA, 14 nt, Human
uccuucagugccuu

SEQ ID NO: 1928207 - RNA, 15 nt, Human
uccuucagugccuua

SEQ ID NO: 1928208 - RNA, 23 nt, Human
acuggccaguggcuggaucugug

SEQ ID NO: 1928209 - RNA, 19 nt, Human
uccuuuagcgcccaguugg

SEQ ID NO: 1928210 - RNA, 15 nt, Human
uccuuuagcgcccag

SEQ ID NO: 1928211 - RNA, 21 nt, Human
uccuuuaauuuuuuacuauuu

SEQ ID NO: 1928212 - RNA, 23 nt, Human
uccuuguguuacuaaguuuuuau

SEQ ID NO: 1928213 - RNA, 14 nt, Human
uccuuguguuacua

SEQ ID NO: 1928214 - RNA, 14 nt, Human
uccuuguuccuaga

SEQ ID NO: 1928215 - RNA, 15 nt, Human
uccuuguagccuuuu

SEQ ID NO: 1928216 - RNA, 19 nt, Human
uccuuguagccuuuugacu

SEQ ID NO: 1928217 - RNA, 20 nt, Human
uccuuguagccuuuugacuu

SEQ ID NO: 1928218 - RNA, 17 nt, Human
ucgacuucgggcuggcc

SEQ ID NO: 1928219 - RNA, 22 nt, Human
ucgaauuuuguuuucuugauuu

SEQ ID NO: 1928220 - RNA, 18 nt, Human
ucgagaaacagccugugu

SEQ ID NO: 1928221 - RNA, 14 nt, Human
ucgagaacuuucau

SEQ ID NO: 1928222 - RNA, 20 nt, Human
ucgaaucuacuaauuccaca

SEQ ID NO: 1928223 - RNA, 13 nt, Human
ucgagaccagccu

SEQ ID NO: 1928224 - RNA, 16 nt, Human
ucgagaacuuucauuu

SEQ ID NO: 1928225 - RNA, 15 nt, Human
ucgagaacuuucauu

SEQ ID NO: 1928226 - RNA, 22 nt, Human
ucgagaacuuucauuuuuuucc

SEQ ID NO: 1928227 - RNA, 18 nt, Human
ucgagaccagccuggcca

SEQ ID NO: 1928228 - RNA, 14 nt, Human
ucgagaccagccug

SEQ ID NO: 1928229 - RNA, 17 nt, Human
ucgagaccagccuggcc

SEQ ID NO: 1928230 - RNA, 23 nt, Human
uccuuuagcgcccaguugggugg

SEQ ID NO: 1928231 - RNA, 22 nt, Human
uccuuuagcgcccaguugggug

SEQ ID NO: 1928232 - RNA, 13 nt, Human
ucgaggacaggga

SEQ ID NO: 1928233 - RNA, 16 nt, Human
ucgcgacaaugcaaac

SEQ ID NO: 1928234 - RNA, 19 nt, Human
ucgcgacaaugcaaaccau

SEQ ID NO: 1928235 - RNA, 16 nt, Human
ucgagcaugccuggau

SEQ ID NO: 1928236 - RNA, 18 nt, Human
ucgagcaugccuggaugg

SEQ ID NO: 1928237 - RNA, 16 nt, Human
ucgcggcggagcuggc

SEQ ID NO: 1928238 - RNA, 18 nt, Human
ucgcggcggagcuggccc

SEQ ID NO: 1928239 - RNA, 19 nt, Human
ucgcggcggagcuggcccc

SEQ ID NO: 1928240 - RNA, 20 nt, Human
ucgcggcggagcuggccccg

SEQ ID NO: 1928241 - RNA, 13 nt, Human
acuggcuuuggcu

SEQ ID NO: 1928242 - RNA, 15 nt, Human
acuggcuuuggcuuc

SEQ ID NO: 1928243 - RNA, 16 nt, Human
acuggcuuuggcuucu

SEQ ID NO: 1928244 - RNA, 18 nt, Human
acuggcuuuggcuucuug

SEQ ID NO: 1928245 - RNA, 13 nt, Human
agaaacaggaccg

SEQ ID NO: 1928246 - RNA, 16 nt, Human
agaaaccuuauuguac

SEQ ID NO: 1928247 - RNA, 18 nt, Human
agaaaccuuauuguaccu

SEQ ID NO: 1928248 - RNA, 20 nt, Human
agaaacgaagccaucuuucu

SEQ ID NO: 1928249 - RNA, 15 nt, Human
agaaacgucuucuaa

SEQ ID NO: 1928250 - RNA, 18 nt, Human
agaaaccuuuuuaaaaau

SEQ ID NO: 1928251 - RNA, 20 nt, Human
agaaaccuuauuguaccucu

SEQ ID NO: 1928252 - RNA, 16 nt, Human
agaaacgucuucuaaa

SEQ ID NO: 1928253 - RNA, 18 nt, Human
agaaacgucuucuaaacu

SEQ ID NO: 1928254 - RNA, 21 nt, Human
agaaacgucuucuaaacuucc

SEQ ID NO: 1928255 - RNA, 17 nt, Human
agaaaaaggaugcacag

SEQ ID NO: 1928256 - RNA, 15 nt, Human
agaaaaagaaaugca

SEQ ID NO: 1928257 - RNA, 21 nt, Human
agaaaacuuguauuaugugug

SEQ ID NO: 1928258 - RNA, 19 nt, Human
agaaaacuuguauuaugug

SEQ ID NO: 1928259 - RNA, 21 nt, Human
ucucuuuaaugucacaggcag

SEQ ID NO: 1928260 - RNA, 20 nt, Human
ucucuuuaaugucacaggca

SEQ ID NO: 1928261 - RNA, 13 nt, Human
agaaaaagaaaaa

SEQ ID NO: 1928262 - RNA, 19 nt, Human
agaaaaaccagaggcagcu

SEQ ID NO: 1928263 - RNA, 14 nt, Human
agaaaaagaaaugc

SEQ ID NO: 1928264 - RNA, 16 nt, Human
ucucuugggaacugaa

SEQ ID NO: 1928265 - RNA, 23 nt, Human
ucucuugggaacugaacucacuu

SEQ ID NO: 1928266 - RNA, 14 nt, Human
ucucuugauucaua

SEQ ID NO: 1928267 - RNA, 16 nt, Human
ucucuugauucauaau

SEQ ID NO: 1928268 - RNA, 18 nt, Human
ucucuugagccugggagg

SEQ ID NO: 1928269 - RNA, 17 nt, Human
ucucuugagccugggag

SEQ ID NO: 1928270 - RNA, 23 nt, Human
ucucuggccuucggccuccaucc

SEQ ID NO: 1928271 - RNA, 22 nt, Human
ucucuggccuucggccuccauc

SEQ ID NO: 1928272 - RNA, 21 nt, Human
ucucuggccuucggccuccau

SEQ ID NO: 1928273 - RNA, 15 nt, Human
ucucuggaauuugaa

SEQ ID NO: 1928274 - RNA, 18 nt, Human
ucucugcuugagucaggu

SEQ ID NO: 1928275 - RNA, 19 nt, Human
ucucugcuugagucagguu

SEQ ID NO: 1928276 - RNA, 14 nt, Human
ucucugcuuuaaag

SEQ ID NO: 1928277 - RNA, 19 nt, Human
ucucuggaauuugaaacac

SEQ ID NO: 1928278 - RNA, 12 nt, Human
ucucuggccuuc

SEQ ID NO: 1928279 - RNA, 17 nt, Human
ucucuccuguaccucuu

SEQ ID NO: 1928280 - RNA, 16 nt, Human
ucucuccuguaccucu

SEQ ID NO: 1928281 - RNA, 14 nt, Human
ucucuccuguaccu

SEQ ID NO: 1928282 - RNA, 11 nt, Human
ucucugcccuc

SEQ ID NO: 1928283 - RNA, 15 nt, Human
ucucugcccuccaag

SEQ ID NO: 1928284 - RNA, 16 nt, Human
ucucugcccuccaaga

SEQ ID NO: 1928285 - RNA, 17 nt, Human
ucucugcccuccaagac

SEQ ID NO: 1928286 - RNA, 13 nt, Human
ucucucacuccuu

SEQ ID NO: 1928287 - RNA, 15 nt, Human
ucucucacuccuuga

SEQ ID NO: 1928288 - RNA, 17 nt, Human
ucucucacuuguuuuau

SEQ ID NO: 1928289 - RNA, 18 nt, Human
acuuugaccucugcagca

SEQ ID NO: 1928290 - RNA, 16 nt, Human
acuuugaccucugcag

SEQ ID NO: 1928291 - RNA, 15 nt, Human
acuuugaccucugca

SEQ ID NO: 1928292 - RNA, 17 nt, Human
ucucuccagccccugga

SEQ ID NO: 1928293 - RNA, 16 nt, Human
ucucuccagccccugg

SEQ ID NO: 1928294 - RNA, 18 nt, Human
ucucuccagccccuggau

SEQ ID NO: 1928295 - RNA, 19 nt, Human
ucucuccagccccuggaug

SEQ ID NO: 1928296 - RNA, 22 nt, Human
ucucucaucucuuagcuccccu

SEQ ID NO: 1928297 - RNA, 23 nt, Human
ucucucaucucuuagcuccccuc

SEQ ID NO: 1928298 - RNA, 19 nt, Human
ucucucaucucuuagcucc

SEQ ID NO: 1928299 - RNA, 14 nt, Human
ucucucaucucuua

SEQ ID NO: 1928300 - RNA, 12 nt, Human
ucugacacacag

SEQ ID NO: 1928301 - RNA, 18 nt, Human
agaaaugaaaaaauauau

SEQ ID NO: 1928302 - RNA, 23 nt, Human
agaaaugaaaaaauauauaucaa

SEQ ID NO: 1928303 - RNA, 14 nt, Human
agaaaugaaagcag

SEQ ID NO: 1928304 - RNA, 14 nt, Human
agaaagaaaaucag

SEQ ID NO: 1928305 - RNA, 12 nt, Human
agaaaucuaaaa

SEQ ID NO: 1928306 - RNA, 15 nt, Human
agaaaucuaaaaaac

SEQ ID NO: 1928307 - RNA, 17 nt, Human
agaaaugaaaaaauaua

SEQ ID NO: 1928308 - RNA, 14 nt, Human
agaaauauaauuga

SEQ ID NO: 1928309 - RNA, 19 nt, Human
agaaauaucugaaaaugua

SEQ ID NO: 1928310 - RNA, 20 nt, Human
agaaauaucugaaaauguau

SEQ ID NO: 1928311 - RNA, 18 nt, Human
ucugauucccaagcucug

SEQ ID NO: 1928312 - RNA, 18 nt, Human
ucugcacuccccugcugg

SEQ ID NO: 1928313 - RNA, 19 nt, Human
ucugcacuccccugcuggg

SEQ ID NO: 1928314 - RNA, 22 nt, Human
ucugauaacuagauggugcuga

SEQ ID NO: 1928315 - RNA, 13 nt, Human
ucugauacagaaa

SEQ ID NO: 1928316 - RNA, 14 nt, Human
ucugauaacuagau

SEQ ID NO: 1928317 - RNA, 20 nt, Human
ucugauaacuagauggugcu

SEQ ID NO: 1928318 - RNA, 21 nt, Human
ucugauaacuagauggugcug

SEQ ID NO: 1928319 - RNA, 23 nt, Human
ucugagacucgcgacaaugcaaa

SEQ ID NO: 1928320 - RNA, 12 nt, Human
ucugagagcugu

SEQ ID NO: 1928321 - RNA, 14 nt, Human
ucugcaggucccua

SEQ ID NO: 1928322 - RNA, 18 nt, Human
ucugcaggucccuaauaa

SEQ ID NO: 1928323 - RNA, 13 nt, Human
agaaauuaugugc

SEQ ID NO: 1928324 - RNA, 21 nt, Human
agaaauuaugugccagauuua

SEQ ID NO: 1928325 - RNA, 22 nt, Human
agaaauuaugugccagauuuau

SEQ ID NO: 1928326 - RNA, 16 nt, Human
agaaauuuauaaacuu

SEQ ID NO: 1928327 - RNA, 17 nt, Human
agaaauuuauaaacuuu

SEQ ID NO: 1928328 - RNA, 15 nt, Human
ucugcaggucccuaa

SEQ ID NO: 1928329 - RNA, 16 nt, Human
ucugcaggucccuaau

SEQ ID NO: 1928330 - RNA, 17 nt, Human
ucugcaggucccuaaua

SEQ ID NO: 1928331 - RNA, 20 nt, Human
ucugcacuccccugcugggu

SEQ ID NO: 1928332 - RNA, 18 nt, Human
ucugcagcaauaaagcag

SEQ ID NO: 1928333 - RNA, 22 nt, Human
ucugcacuccccugcugggugu

SEQ ID NO: 1928334 - RNA, 14 nt, Human
acuucgggcuggcc

SEQ ID NO: 1928335 - RNA, 22 nt, Human
acuucgggaggucgaggcagga

SEQ ID NO: 1928336 - RNA, 18 nt, Human
acuuccuuaugcuucuuu

SEQ ID NO: 1928337 - RNA, 23 nt, Human
acuuccuguccagcuccaaccug

SEQ ID NO: 1928338 - RNA, 14 nt, Human
acuuccuugagaca

SEQ ID NO: 1928339 - RNA, 22 nt, Human
acuuccuugagacacggagccc

SEQ ID NO: 1928340 - RNA, 12 nt, Human
ucucacucuguc

SEQ ID NO: 1928341 - RNA, 16 nt, Human
ucucacucugucgccc

SEQ ID NO: 1928342 - RNA, 18 nt, Human
acuuccuguccagcucca

SEQ ID NO: 1928343 - RNA, 22 nt, Human
acuuccuguccagcuccaaccu

SEQ ID NO: 1928344 - RNA, 16 nt, Human
ucucacuauguugccc

SEQ ID NO: 1928345 - RNA, 13 nt, Human
ucucacuccuuga

SEQ ID NO: 1928346 - RNA, 14 nt, Human
acuucuccacccug

SEQ ID NO: 1928347 - RNA, 11 nt, Human
acuucagcuga

SEQ ID NO: 1928348 - RNA, 16 nt, Human
acuucagcugacuuuu

SEQ ID NO: 1928349 - RNA, 11 nt, Human
ucucacuccuu

SEQ ID NO: 1928350 - RNA, 19 nt, Human
ucucaccuccugcugggca

SEQ ID NO: 1928351 - RNA, 21 nt, Human
ucucacagcuccaagaauuuc

SEQ ID NO: 1928352 - RNA, 16 nt, Human
acuucuccacccugcu

SEQ ID NO: 1928353 - RNA, 15 nt, Human
acuucuccacccugc

SEQ ID NO: 1928354 - RNA, 20 nt, Human
acuugaacccgggaggcaga

SEQ ID NO: 1928355 - RNA, 19 nt, Human
acuugaacccgggaggcag

SEQ ID NO: 1928356 - RNA, 21 nt, Human
acuugaacccauauuuguaca

SEQ ID NO: 1928357 - RNA, 19 nt, Human
acuugagcccagagugaac

SEQ ID NO: 1928358 - RNA, 21 nt, Human
acuugaacccgggaggcagag

SEQ ID NO: 1928359 - RNA, 15 nt, Human
acuugaagggccaga

SEQ ID NO: 1928360 - RNA, 17 nt, Human
acuugaagggccagagc

SEQ ID NO: 1928361 - RNA, 18 nt, Human
acuugaagggccagagcc

SEQ ID NO: 1928362 - RNA, 19 nt, Human
acuugaagggccagagcca

SEQ ID NO: 1928363 - RNA, 20 nt, Human
acuugaagggccagagccag

SEQ ID NO: 1928364 - RNA, 21 nt, Human
acuugaagggccagagccagg

SEQ ID NO: 1928365 - RNA, 22 nt, Human
acuugaagggccagagccaggg

SEQ ID NO: 1928366 - RNA, 18 nt, Human
acuuguggacacagcucu

SEQ ID NO: 1928367 - RNA, 17 nt, Human
acuuguggacacagcuc

SEQ ID NO: 1928368 - RNA, 16 nt, Human
acuuguggacacagcu

SEQ ID NO: 1928369 - RNA, 14 nt, Human
acuugcucuugaug

SEQ ID NO: 1928370 - RNA, 16 nt, Human
acuugcucuggaccug

SEQ ID NO: 1928371 - RNA, 17 nt, Human
acuugcucuggaccugc

SEQ ID NO: 1928372 - RNA, 18 nt, Human
acuugcucuggaccugcc

SEQ ID NO: 1928373 - RNA, 19 nt, Human
acuugcucuggaccugccc

SEQ ID NO: 1928374 - RNA, 12 nt, Human
acuugcucugga

SEQ ID NO: 1928375 - RNA, 14 nt, Human
acuugcucuggacc

SEQ ID NO: 1928376 - RNA, 15 nt, Human
acuugcucuggaccu

SEQ ID NO: 1928377 - RNA, 21 nt, Human
ucuccagggucagaaacagga

SEQ ID NO: 1928378 - RNA, 18 nt, Human
ucuccagggucagaaaca

SEQ ID NO: 1928379 - RNA, 16 nt, Human
ucuccaggcuguaucc

SEQ ID NO: 1928380 - RNA, 22 nt, Human
ucuccaaaauaaaacuuuuuaa

SEQ ID NO: 1928381 - RNA, 19 nt, Human
ucuccaaaauaaaacuuuu

SEQ ID NO: 1928382 - RNA, 17 nt, Human
ucuccaaaauaaaacuu

SEQ ID NO: 1928383 - RNA, 22 nt, Human
ucuccaaccccccagcacugag

SEQ ID NO: 1928384 - RNA, 21 nt, Human
ucuccaaccccccagcacuga

SEQ ID NO: 1928385 - RNA, 23 nt, Human
ucuccaaccccccagcacugagg

SEQ ID NO: 1928386 - RNA, 20 nt, Human
ucuccaaccccccagcacug

SEQ ID NO: 1928387 - RNA, 19 nt, Human
ucuccaaccccccagcacu

SEQ ID NO: 1928388 - RNA, 18 nt, Human
ucuccaaccccccagcac

SEQ ID NO: 1928389 - RNA, 17 nt, Human
ucuccaaccccccagca

SEQ ID NO: 1928390 - RNA, 19 nt, Human
ucucagggccuggucguuu

SEQ ID NO: 1928391 - RNA, 14 nt, Human
ucucagggccuggu

SEQ ID NO: 1928392 - RNA, 15 nt, Human
ucucagggccugguc

SEQ ID NO: 1928393 - RNA, 20 nt, Human
ucucauugaauuauaaaagc

SEQ ID NO: 1928394 - RNA, 16 nt, Human
ucucauuccagaggaa

SEQ ID NO: 1928395 - RNA, 12 nt, Human
ucucagggccug

SEQ ID NO: 1928396 - RNA, 13 nt, Human
ucucagggccugg

SEQ ID NO: 1928397 - RNA, 21 nt, Human
ucuccuccuuuucacaguucu

SEQ ID NO: 1928398 - RNA, 14 nt, Human
acuuugaccucugc

SEQ ID NO: 1928399 - RNA, 16 nt, Human
acuuucuagccagagg

SEQ ID NO: 1928400 - RNA, 17 nt, Human
acuuucuagccagagga

SEQ ID NO: 1928401 - RNA, 14 nt, Human
acuuuaagaggaca

SEQ ID NO: 1928402 - RNA, 16 nt, Human
ucuccauguuugaugu

SEQ ID NO: 1928403 - RNA, 19 nt, Human
ucucccacuagacaagucc

SEQ ID NO: 1928404 - RNA, 14 nt, Human
ucucccaccuagca

SEQ ID NO: 1928405 - RNA, 18 nt, Human
ucucccauugucccucug

SEQ ID NO: 1928406 - RNA, 19 nt, Human
ucucccauugucccucugc

SEQ ID NO: 1928407 - RNA, 17 nt, Human
ucucccauugucccucu

SEQ ID NO: 1928408 - RNA, 17 nt, Human
ucugggguuaugauggc

SEQ ID NO: 1928409 - RNA, 19 nt, Human
ucugggcuuggggcuuccu

SEQ ID NO: 1928410 - RNA, 21 nt, Human
ucugggcuuggggcuuccuaa

SEQ ID NO: 1928411 - RNA, 20 nt, Human
agaauuauaauuaguuccuc

SEQ ID NO: 1928412 - RNA, 14 nt, Human
agaauuagcugcuu

SEQ ID NO: 1928413 - RNA, 20 nt, Human
agaauucucagaaucucaaa

SEQ ID NO: 1928414 - RNA, 14 nt, Human
agaauucucuaguu

SEQ ID NO: 1928415 - RNA, 13 nt, Human
ucugggcuccaga

SEQ ID NO: 1928416 - RNA, 19 nt, Human
agaauuaguggcacuugcu

SEQ ID NO: 1928417 - RNA, 16 nt, Human
agaauuagcugcuucu

SEQ ID NO: 1928418 - RNA, 21 nt, Human
agaauguguuuaaacuugguu

SEQ ID NO: 1928419 - RNA, 19 nt, Human
agaaugucaguauguggaa

SEQ ID NO: 1928420 - RNA, 17 nt, Human
agaaugucaguaugugg

SEQ ID NO: 1928421 - RNA, 22 nt, Human
agaaauuuccacucaggucugu

SEQ ID NO: 1928422 - RNA, 16 nt, Human
agaaauuuccacucag

SEQ ID NO: 1928423 - RNA, 23 nt, Human
agaaccccaggguccuguagccc

SEQ ID NO: 1928424 - RNA, 22 nt, Human
agaaccccuggcuccaggccag

SEQ ID NO: 1928425 - RNA, 16 nt, Human
agaaugucaguaugug

SEQ ID NO: 1928426 - RNA, 15 nt, Human
agaaugucaguaugu

SEQ ID NO: 1928427 - RNA, 18 nt, Human
ucuguacgucugacaggc

SEQ ID NO: 1928428 - RNA, 14 nt, Human
ucuguaucuuuucu

SEQ ID NO: 1928429 - RNA, 15 nt, Human
ucuguauauacuuuu

SEQ ID NO: 1928430 - RNA, 17 nt, Human
ucuguaucacucugugu

SEQ ID NO: 1928431 - RNA, 18 nt, Human
ucugugaauugagcugca

SEQ ID NO: 1928432 - RNA, 22 nt, Human
ucuguccccuucucucaucucu

SEQ ID NO: 1928433 - RNA, 21 nt, Human
ucuguccccuucucucaucuc

SEQ ID NO: 1928434 - RNA, 20 nt, Human
ucuguccccuucucucaucu

SEQ ID NO: 1928435 - RNA, 19 nt, Human
ucuguccccuucucucauc

SEQ ID NO: 1928436 - RNA, 15 nt, Human
ucuguccccuucucu

SEQ ID NO: 1928437 - RNA, 19 nt, Human
ucuguuuagauaauacacc

SEQ ID NO: 1928438 - RNA, 16 nt, Human
ucuguuuagauaauac

SEQ ID NO: 1928439 - RNA, 23 nt, Human
ucuguuuagauaauacaccacua

SEQ ID NO: 1928440 - RNA, 16 nt, Human
ucuguuuaugcuuuug

SEQ ID NO: 1928441 - RNA, 20 nt, Human
ucuuaaucuuuucacaaaua

SEQ ID NO: 1928442 - RNA, 19 nt, Human
ucuuaaucuuuucacaaau

SEQ ID NO: 1928443 - RNA, 20 nt, Human
agacaguugggugagaacaa

SEQ ID NO: 1928444 - RNA, 22 nt, Human
ucuuaaucuuuucacaaauaaa

SEQ ID NO: 1928445 - RNA, 21 nt, Human
ucuuaaucuuuucacaaauaa

SEQ ID NO: 1928446 - RNA, 14 nt, Human
ucuuacaaacaugu

SEQ ID NO: 1928447 - RNA, 13 nt, Human
agacagucccugc

SEQ ID NO: 1928448 - RNA, 14 nt, Human
agacagucccugcc

SEQ ID NO: 1928449 - RNA, 18 nt, Human
agacaguccuaacaauau

SEQ ID NO: 1928450 - RNA, 15 nt, Human
agacagcugccuggg

SEQ ID NO: 1928451 - RNA, 16 nt, Human
agacagcugccuggga

SEQ ID NO: 1928452 - RNA, 12 nt, Human
agacagucccug

SEQ ID NO: 1928453 - RNA, 19 nt, Human
ucuuacugucuuuuuucua

SEQ ID NO: 1928454 - RNA, 14 nt, Human
ucuuagauguauau

SEQ ID NO: 1928455 - RNA, 18 nt, Human
ucuuagauggauucucca

SEQ ID NO: 1928456 - RNA, 22 nt, Human
ucuuagauggauucuccacuca

SEQ ID NO: 1928457 - RNA, 17 nt, Human
ucuuauuagggagaaaa

SEQ ID NO: 1928458 - RNA, 12 nt, Human
ucuuagauguau

SEQ ID NO: 1928459 - RNA, 17 nt, Human
agacacaggcccggcuc

SEQ ID NO: 1928460 - RNA, 22 nt, Human
agacacaggcccggcuccaggc

SEQ ID NO: 1928461 - RNA, 21 nt, Human
agacacaggcccggcuccagg

SEQ ID NO: 1928462 - RNA, 20 nt, Human
agacacaggcccggcuccag

SEQ ID NO: 1928463 - RNA, 19 nt, Human
agacacaggcccggcucca

SEQ ID NO: 1928464 - RNA, 14 nt, Human
agacacaagccuuc

SEQ ID NO: 1928465 - RNA, 13 nt, Human
agacacaagccuu

SEQ ID NO: 1928466 - RNA, 19 nt, Human
agaauucucuaguuugauu

SEQ ID NO: 1928467 - RNA, 18 nt, Human
agaauucucuaguuugau

SEQ ID NO: 1928468 - RNA, 17 nt, Human
agaauucucuuauccaa

SEQ ID NO: 1928469 - RNA, 22 nt, Human
agacaccuugacagggcacacc

SEQ ID NO: 1928470 - RNA, 24 nt, Human
agacacauguccaagaagcccagg

SEQ ID NO: 1928471 - RNA, 19 nt, Human
agacaccuugacagggcac

SEQ ID NO: 1928472 - RNA, 23 nt, Human
agacacaggcccggcuccaggcu

SEQ ID NO: 1928473 - RNA, 13 nt, Human
agacacaggcccu

SEQ ID NO: 1928474 - RNA, 21 nt, Human
agacacauguccaagaagccc

SEQ ID NO: 1928475 - RNA, 22 nt, Human
agacacauguccaagaagccca

SEQ ID NO: 1928476 - RNA, 13 nt, Human
agacagcugccug

SEQ ID NO: 1928477 - RNA, 14 nt, Human
agacagcugccugg

SEQ ID NO: 1928478 - RNA, 12 nt, Human
agacagaaaaaa

SEQ ID NO: 1928479 - RNA, 21 nt, Human
agacacggagcccagcccucc

SEQ ID NO: 1928480 - RNA, 13 nt, Human
agaccucagggca

SEQ ID NO: 1928481 - RNA, 14 nt, Human
agaccucagggcac

SEQ ID NO: 1928482 - RNA, 15 nt, Human
agaccucagggcaca

SEQ ID NO: 1928483 - RNA, 14 nt, Human
agacccggcugcgu

SEQ ID NO: 1928484 - RNA, 19 nt, Human
agaccuggacacaggccug

SEQ ID NO: 1928485 - RNA, 13 nt, Human
agacucaaaugcu

SEQ ID NO: 1928486 - RNA, 20 nt, Human
agacucacaaccugaaccua

SEQ ID NO: 1928487 - RNA, 16 nt, Human
agaccuggacacaggc

SEQ ID NO: 1928488 - RNA, 18 nt, Human
agaccuggacacaggccu

SEQ ID NO: 1928489 - RNA, 15 nt, Human
agacucauucuucug

SEQ ID NO: 1928490 - RNA, 17 nt, Human
ucuugagccuugaacuu

SEQ ID NO: 1928491 - RNA, 15 nt, Human
agacucauauuacug

SEQ ID NO: 1928492 - RNA, 22 nt, Human
agacucauauuacugguaggaa

SEQ ID NO: 1928493 - RNA, 19 nt, Human
ucuugagccuugaacuuug

SEQ ID NO: 1928494 - RNA, 18 nt, Human
ucuugagccuugaacuuu

SEQ ID NO: 1928495 - RNA, 20 nt, Human
ucuugagccuugaacuuuga

SEQ ID NO: 1928496 - RNA, 23 nt, Human
ucuucuguacgucugacaggcaa

SEQ ID NO: 1928497 - RNA, 23 nt, Human
agacauacuaaccagcagaaaug

SEQ ID NO: 1928498 - RNA, 13 nt, Human
agacauacuugaa

SEQ ID NO: 1928499 - RNA, 14 nt, Human
agacauacuugaag

SEQ ID NO: 1928500 - RNA, 16 nt, Human
agacauacuugaaggg

SEQ ID NO: 1928501 - RNA, 17 nt, Human
agacauacuugaagggc

SEQ ID NO: 1928502 - RNA, 19 nt, Human
agacauacuugaagggcca

SEQ ID NO: 1928503 - RNA, 14 nt, Human
agacauagaauuaa

SEQ ID NO: 1928504 - RNA, 20 nt, Human
agacauacuugaagggccag

SEQ ID NO: 1928505 - RNA, 21 nt, Human
agacauacuugaagggccaga

SEQ ID NO: 1928506 - RNA, 23 nt, Human
agacauacuugaagggccagagc

SEQ ID NO: 1928507 - RNA, 15 nt, Human
agacaugauuuccuu

SEQ ID NO: 1928508 - RNA, 22 nt, Human
agacaugauuuccuugaaugug

SEQ ID NO: 1928509 - RNA, 19 nt, Human
agacaugcagccuaaggcu

SEQ ID NO: 1928510 - RNA, 23 nt, Human
agacaugccacaaggacuuccug

SEQ ID NO: 1928511 - RNA, 21 nt, Human
agacauuugcuaugagcuggg

SEQ ID NO: 1928512 - RNA, 22 nt, Human
ucuucugcuucagccucccgag

SEQ ID NO: 1928513 - RNA, 22 nt, Human
ucuucuguacgucugacaggca

SEQ ID NO: 1928514 - RNA, 21 nt, Human
ucuucuguacgucugacaggc

SEQ ID NO: 1928515 - RNA, 18 nt, Human
ucuucuggcucaaaaaga

SEQ ID NO: 1928516 - RNA, 21 nt, Human
ucuucuggcucaaaaagagaa

SEQ ID NO: 1928517 - RNA, 12 nt, Human
ucuucuggcuca

SEQ ID NO: 1928518 - RNA, 13 nt, Human
ucuucuggcucaa

SEQ ID NO: 1928519 - RNA, 17 nt, Human
ucuuauuuaaugaaaga

SEQ ID NO: 1928520 - RNA, 18 nt, Human
ucuuauucaaagaaauau

SEQ ID NO: 1928521 - RNA, 21 nt, Human
ucuuauucuuucguucaguua

SEQ ID NO: 1928522 - RNA, 14 nt, Human
ucuuauucuuucgu

SEQ ID NO: 1928523 - RNA, 15 nt, Human
agagacacaagccuu

SEQ ID NO: 1928524 - RNA, 24 nt, Human
agagacagaaagcagaacagugau

SEQ ID NO: 1928525 - RNA, 13 nt, Human
agagaaaaagaaa

SEQ ID NO: 1928526 - RNA, 14 nt, Human
agagaaaaagaaau

SEQ ID NO: 1928527 - RNA, 22 nt, Human
agagaaaaaauauuuuccugcc

SEQ ID NO: 1928528 - RNA, 20 nt, Human
agacucgcgacaaugcaaac

SEQ ID NO: 1928529 - RNA, 23 nt, Human
agacucgauucauauugaauaua

SEQ ID NO: 1928530 - RNA, 15 nt, Human
agacuguacaaagua

SEQ ID NO: 1928531 - RNA, 16 nt, Human
agacuguacaaaguag

SEQ ID NO: 1928532 - RNA, 15 nt, Human
agacuuccagagccu

SEQ ID NO: 1928533 - RNA, 14 nt, Human
agacuuaucaacau

SEQ ID NO: 1928534 - RNA, 14 nt, Human
agacuuccuugaga

SEQ ID NO: 1928535 - RNA, 16 nt, Human
agacuuccuugagaca

SEQ ID NO: 1928536 - RNA, 19 nt, Human
agacuguugucccugcacu

SEQ ID NO: 1928537 - RNA, 19 nt, Human
agacucgagaacuuucauu

SEQ ID NO: 1928538 - RNA, 20 nt, Human
agacucgauucauauugaau

SEQ ID NO: 1928539 - RNA, 18 nt, Human
agacucgagaacuuucau

SEQ ID NO: 1928540 - RNA, 15 nt, Human
agacucgagaacuuu

SEQ ID NO: 1928541 - RNA, 14 nt, Human
agacucgagaacuu

SEQ ID NO: 1928542 - RNA, 15 nt, Human
agacucgcgacaaug

SEQ ID NO: 1928543 - RNA, 17 nt, Human
agacucgcgacaaugca

SEQ ID NO: 1928544 - RNA, 18 nt, Human
agacucgcgacaaugcaa

SEQ ID NO: 1928545 - RNA, 19 nt, Human
agacucgcgacaaugcaaa

SEQ ID NO: 1928546 - RNA, 19 nt, Human
ucuuucuggcuaugcauuu

SEQ ID NO: 1928547 - RNA, 22 nt, Human
ucuuucugcagaaacagaaagg

SEQ ID NO: 1928548 - RNA, 18 nt, Human
ucuuucuggcuaugcauu

SEQ ID NO: 1928549 - RNA, 20 nt, Human
ucuuuauaauucuacuuuga

SEQ ID NO: 1928550 - RNA, 13 nt, Human
ucuuucugcuuug

SEQ ID NO: 1928551 - RNA, 14 nt, Human
ucuugguuuguaaa

SEQ ID NO: 1928552 - RNA, 19 nt, Human
ucuugguuccagccugcca

SEQ ID NO: 1928553 - RNA, 18 nt, Human
ucuugguuccagccugcc

SEQ ID NO: 1928554 - RNA, 17 nt, Human
ucuugguuccagccugc

SEQ ID NO: 1928555 - RNA, 19 nt, Human
ucuugaucaacaucuuuuc

SEQ ID NO: 1928556 - RNA, 18 nt, Human
ucuugaucaacaucuuuu

SEQ ID NO: 1928557 - RNA, 17 nt, Human
ucuugaucaacaucuuu

SEQ ID NO: 1928558 - RNA, 23 nt, Human
ucuugaucaacaucuuuucuugc

SEQ ID NO: 1928559 - RNA, 20 nt, Human
ucuugaucaacaucuuuucu

SEQ ID NO: 1928560 - RNA, 13 nt, Human
ucuugguuccagc

SEQ ID NO: 1928561 - RNA, 20 nt, Human
ucuuuaaugucacaggcagg

SEQ ID NO: 1928562 - RNA, 18 nt, Human
ucuuguaaauaaagcccu

SEQ ID NO: 1928563 - RNA, 16 nt, Human
ucuugguuuguaaauu

SEQ ID NO: 1928564 - RNA, 13 nt, Human
ucuuguaaauaaa

SEQ ID NO: 1928565 - RNA, 17 nt, Human
ucuuguaaauaaagccc

SEQ ID NO: 1928566 - RNA, 22 nt, Human
ucuuuaaugucacaggcagguc

SEQ ID NO: 1928567 - RNA, 14 nt, Human
ucuuuaauuuuaca

SEQ ID NO: 1928568 - RNA, 15 nt, Human
ucuuuaguuuuugug

SEQ ID NO: 1928569 - RNA, 21 nt, Human
agaucauccagaaguuccuca

SEQ ID NO: 1928570 - RNA, 12 nt, Human
agaucauuguga

SEQ ID NO: 1928571 - RNA, 18 nt, Human
agaucaguguaccauuug

SEQ ID NO: 1928572 - RNA, 21 nt, Human
agaucaguguaccauuugccu

SEQ ID NO: 1928573 - RNA, 13 nt, Human
agaucagccuggg

SEQ ID NO: 1928574 - RNA, 15 nt, Human
agaucagccugggca

SEQ ID NO: 1928575 - RNA, 15 nt, Human
agaucaguguaccau

SEQ ID NO: 1928576 - RNA, 21 nt, Human
ugacauuguuggccaaagcca

SEQ ID NO: 1928577 - RNA, 20 nt, Human
ugacauuguuggccaaagcc

SEQ ID NO: 1928578 - RNA, 18 nt, Human
ugaccaauauuguacagu

SEQ ID NO: 1928579 - RNA, 17 nt, Human
ugaccaauauuguacag

SEQ ID NO: 1928580 - RNA, 21 nt, Human
ugaccaauauuguacaguuuu

SEQ ID NO: 1928581 - RNA, 19 nt, Human
ugaccaauauuguacaguu

SEQ ID NO: 1928582 - RNA, 18 nt, Human
ugaccaaugauggucacc

SEQ ID NO: 1928583 - RNA, 20 nt, Human
ugacagggcacaccgggcac

SEQ ID NO: 1928584 - RNA, 21 nt, Human
ugacagggcacaccgggcacu

SEQ ID NO: 1928585 - RNA, 21 nt, Human
ugacaguggccgcccaaggcc

SEQ ID NO: 1928586 - RNA, 16 nt, Human
ugacagggcacaccgg

SEQ ID NO: 1928587 - RNA, 11 nt, Human
ugacagggcac

SEQ ID NO: 1928588 - RNA, 21 nt, Human
ugacacacagcucuguccugg

SEQ ID NO: 1928589 - RNA, 18 nt, Human
ugacacagaaaauguuga

SEQ ID NO: 1928590 - RNA, 19 nt, Human
ugacacagaaaauguugag

SEQ ID NO: 1928591 - RNA, 20 nt, Human
ugacaggcaaugcuggcugu

SEQ ID NO: 1928592 - RNA, 23 nt, Human
ugacagcugcuccuagagggagg

SEQ ID NO: 1928593 - RNA, 12 nt, Human
ugacagcugcuc

SEQ ID NO: 1928594 - RNA, 13 nt, Human
ugacagcugcucc

SEQ ID NO: 1928595 - RNA, 14 nt, Human
ugacagcugcuccu

SEQ ID NO: 1928596 - RNA, 15 nt, Human
ugacagcugcuccua

SEQ ID NO: 1928597 - RNA, 18 nt, Human
ugacagcugcuccuagag

SEQ ID NO: 1928598 - RNA, 21 nt, Human
ugacagcugcuccuagaggga

SEQ ID NO: 1928599 - RNA, 22 nt, Human
ugacagcugcuccuagagggag

SEQ ID NO: 1928600 - RNA, 15 nt, Human
agaugccugaagcca

SEQ ID NO: 1928601 - RNA, 15 nt, Human
agaugcuagaacucc

SEQ ID NO: 1928602 - RNA, 14 nt, Human
agaugcuagaacuc

SEQ ID NO: 1928603 - RNA, 23 nt, Human
agaugcuggcccagggcccagag

SEQ ID NO: 1928604 - RNA, 20 nt, Human
agaugcuggcccagggccca

SEQ ID NO: 1928605 - RNA, 21 nt, Human
agaugcuggcccagggcccag

SEQ ID NO: 1928606 - RNA, 22 nt, Human
agaugcuggcccagggcccaga

SEQ ID NO: 1928607 - RNA, 15 nt, Human
agaugcaccagcccu

SEQ ID NO: 1928608 - RNA, 14 nt, Human
agaugcaccagccc

SEQ ID NO: 1928609 - RNA, 16 nt, Human
agauccagggacugaa

SEQ ID NO: 1928610 - RNA, 19 nt, Human
agauccagggacagaggcc

SEQ ID NO: 1928611 - RNA, 22 nt, Human
agauccagggacagaggcccca

SEQ ID NO: 1928612 - RNA, 23 nt, Human
ugaccauucuccaccugccaggg

SEQ ID NO: 1928613 - RNA, 17 nt, Human
ugacccacaagaaauga

SEQ ID NO: 1928614 - RNA, 14 nt, Human
agauguucuacuuu

SEQ ID NO: 1928615 - RNA, 15 nt, Human
agauguucuacuuug

SEQ ID NO: 1928616 - RNA, 22 nt, Human
agauguucuacuuuguucugcu

SEQ ID NO: 1928617 - RNA, 13 nt, Human
ugacccacugcuu

SEQ ID NO: 1928618 - RNA, 12 nt, Human
ugacccacugcu

SEQ ID NO: 1928619 - RNA, 15 nt, Human
agaugcuucucacug

SEQ ID NO: 1928620 - RNA, 17 nt, Human
agauguggaaaagccaa

SEQ ID NO: 1928621 - RNA, 22 nt, Human
agauguggaaaagccaagaggc

SEQ ID NO: 1928622 - RNA, 18 nt, Human
agaucacgccacugcacu

SEQ ID NO: 1928623 - RNA, 17 nt, Human
agaucacgccacugcac

SEQ ID NO: 1928624 - RNA, 15 nt, Human
ugaauuucuuuugcc

SEQ ID NO: 1928625 - RNA, 16 nt, Human
ugaauuuuacauggcu

SEQ ID NO: 1928626 - RNA, 20 nt, Human
ugacacacagcucuguccug

SEQ ID NO: 1928627 - RNA, 16 nt, Human
agaucacgccacugca

SEQ ID NO: 1928628 - RNA, 15 nt, Human
agaucacgccacugc

SEQ ID NO: 1928629 - RNA, 14 nt, Human
agaucacgccacug

SEQ ID NO: 1928630 - RNA, 13 nt, Human
agauaugcaaaag

SEQ ID NO: 1928631 - RNA, 17 nt, Human
agauaaagguucaugca

SEQ ID NO: 1928632 - RNA, 12 nt, Human
agauaaauauua

SEQ ID NO: 1928633 - RNA, 12 nt, Human
agauaaaugugc

SEQ ID NO: 1928634 - RNA, 14 nt, Human
agauaaauauuaua

SEQ ID NO: 1928635 - RNA, 13 nt, Human
agauaaagccaga

SEQ ID NO: 1928636 - RNA, 23 nt, Human
agauacugcuacuguaauuuuau

SEQ ID NO: 1928637 - RNA, 19 nt, Human
agauacugcuacuguaauu

SEQ ID NO: 1928638 - RNA, 15 nt, Human
agauacugaaauaaa

SEQ ID NO: 1928639 - RNA, 13 nt, Human
agauacugaaaua

SEQ ID NO: 1928640 - RNA, 12 nt, Human
agauacugaaau

SEQ ID NO: 1928641 - RNA, 13 nt, Human
agauaaauuauaa

SEQ ID NO: 1928642 - RNA, 22 nt, Human
agaguugauacuacaguuuguu

SEQ ID NO: 1928643 - RNA, 20 nt, Human
agaguugauacuacaguuug

SEQ ID NO: 1928644 - RNA, 17 nt, Human
agaguugauacuacagu

SEQ ID NO: 1928645 - RNA, 20 nt, Human
agaguugaugguuguacaua

SEQ ID NO: 1928646 - RNA, 12 nt, Human
agaguuguuaca

SEQ ID NO: 1928647 - RNA, 16 nt, Human
agaguuguuacauuuu

SEQ ID NO: 1928648 - RNA, 20 nt, Human
agaguugugacaacuuccug

SEQ ID NO: 1928649 - RNA, 21 nt, Human
agaguuguuacauuuuuaagu

SEQ ID NO: 1928650 - RNA, 19 nt, Human
ugaaugucagugugacuga

SEQ ID NO: 1928651 - RNA, 20 nt, Human
ugaaugguuuucaaaauaaa

SEQ ID NO: 1928652 - RNA, 17 nt, Human
ugaagcacagaccccuu

SEQ ID NO: 1928653 - RNA, 18 nt, Human
ugaauguggcuugagaaa

SEQ ID NO: 1928654 - RNA, 17 nt, Human
ugaacucaacuuugaca

SEQ ID NO: 1928655 - RNA, 18 nt, Human
ugaacucacuuuccuccu

SEQ ID NO: 1928656 - RNA, 12 nt, Human
ugaacuccuggc

SEQ ID NO: 1928657 - RNA, 15 nt, Human
ugaacuccuggccuc

SEQ ID NO: 1928658 - RNA, 14 nt, Human
ugaacuccuggccu

SEQ ID NO: 1928659 - RNA, 21 nt, Human
ugaacuaggauuguaguccca

SEQ ID NO: 1928660 - RNA, 20 nt, Human
ugaacgauauguagcagaaa

SEQ ID NO: 1928661 - RNA, 21 nt, Human
ugaacgauauguagcagaaag

SEQ ID NO: 1928662 - RNA, 22 nt, Human
ugaaccgaugagaaauaaaguu

SEQ ID NO: 1928663 - RNA, 16 nt, Human
ugaaccuauuucucuu

SEQ ID NO: 1928664 - RNA, 21 nt, Human
ugaaccuaggagugccccauu

SEQ ID NO: 1928665 - RNA, 22 nt, Human
ugaaccuaggagugccccauuc

SEQ ID NO: 1928666 - RNA, 15 nt, Human
ugaaauuuuuauuaa

SEQ ID NO: 1928667 - RNA, 20 nt, Human
ugaacaaauuuacagagaca

SEQ ID NO: 1928668 - RNA, 19 nt, Human
ugaacaaauuuacagagac

SEQ ID NO: 1928669 - RNA, 14 nt, Human
agagcugcgggcug

SEQ ID NO: 1928670 - RNA, 22 nt, Human
ugaacuuugaccucugcagcaa

SEQ ID NO: 1928671 - RNA, 20 nt, Human
ugaacuuugaccucugcagc

SEQ ID NO: 1928672 - RNA, 19 nt, Human
ugaacuuugaccucugcag

SEQ ID NO: 1928673 - RNA, 24 nt, Human
agaggcagccccauucugccugcc

SEQ ID NO: 1928674 - RNA, 17 nt, Human
agaggcagcuucuuugc

SEQ ID NO: 1928675 - RNA, 19 nt, Human
agaggcagccccauucugc

SEQ ID NO: 1928676 - RNA, 13 nt, Human
agaggcagcccca

SEQ ID NO: 1928677 - RNA, 14 nt, Human
agagcuuucuuuca

SEQ ID NO: 1928678 - RNA, 12 nt, Human
agagcuuucuuu

SEQ ID NO: 1928679 - RNA, 16 nt, Human
agagcuuucuuucaca

SEQ ID NO: 1928680 - RNA, 13 nt, Human
agaggcagggucu

SEQ ID NO: 1928681 - RNA, 10 nt, Human
agaggcaggg

SEQ ID NO: 1928682 - RNA, 19 nt, Human
agaggccaugggccuccug

SEQ ID NO: 1928683 - RNA, 17 nt, Human
agaggcuaugugagcac

SEQ ID NO: 1928684 - RNA, 16 nt, Human
agaggcugaggcuggc

SEQ ID NO: 1928685 - RNA, 15 nt, Human
agagguugcagugag

SEQ ID NO: 1928686 - RNA, 22 nt, Human
ugaagcacagugaucaaguuau

SEQ ID NO: 1928687 - RNA, 17 nt, Human
agaguagaauugcauug

SEQ ID NO: 1928688 - RNA, 18 nt, Human
agaguagaauugcauuga

SEQ ID NO: 1928689 - RNA, 12 nt, Human
agagguuuuaaa

SEQ ID NO: 1928690 - RNA, 22 nt, Human
agagguuugacuagaugaugga

SEQ ID NO: 1928691 - RNA, 15 nt, Human
agaguagaauugcau

SEQ ID NO: 1928692 - RNA, 16 nt, Human
agaguagaauugcauu

SEQ ID NO: 1928693 - RNA, 23 nt, Human
ugaaagucuugugacuagugcug

SEQ ID NO: 1928694 - RNA, 22 nt, Human
ugaaagucuugugacuagugcu

SEQ ID NO: 1928695 - RNA, 21 nt, Human
ugaaagucuugugacuagugc

SEQ ID NO: 1928696 - RNA, 20 nt, Human
ugaaagucuugugacuagug

SEQ ID NO: 1928697 - RNA, 18 nt, Human
ugaaagucuugugacuag

SEQ ID NO: 1928698 - RNA, 23 nt, Human
ugaaauaagccagacaucaacag

SEQ ID NO: 1928699 - RNA, 20 nt, Human
ugaaauaagccagacaucaa

SEQ ID NO: 1928700 - RNA, 18 nt, Human
ugaaauaagccagacauc

SEQ ID NO: 1928701 - RNA, 17 nt, Human
ugaaauaagccagacau

SEQ ID NO: 1928702 - RNA, 17 nt, Human
ugaaagucuugugacua

SEQ ID NO: 1928703 - RNA, 18 nt, Human
agagcugccaccugccug

SEQ ID NO: 1928704 - RNA, 15 nt, Human
ugaaauuguauuaca

SEQ ID NO: 1928705 - RNA, 18 nt, Human
ugaaauaugcuggcugga

SEQ ID NO: 1928706 - RNA, 15 nt, Human
ugaaauauacacaca

SEQ ID NO: 1928707 - RNA, 16 nt, Human
ugaaauauacacacag

SEQ ID NO: 1928708 - RNA, 17 nt, Human
ugaaauauacacacagc

SEQ ID NO: 1928709 - RNA, 23 nt, Human
ugaaauuuccugggagcuuuugu

SEQ ID NO: 1928710 - RNA, 17 nt, Human
ucuuuggacccugaggc

SEQ ID NO: 1928711 - RNA, 21 nt, Human
ucuuuggacccugaggcccag

SEQ ID NO: 1928712 - RNA, 12 nt, Human
agagcagagacc

SEQ ID NO: 1928713 - RNA, 15 nt, Human
agagcaagacucugu

SEQ ID NO: 1928714 - RNA, 18 nt, Human
agagcaagacucugucua

SEQ ID NO: 1928715 - RNA, 21 nt, Human
agagcaagacucugucuaaaa

SEQ ID NO: 1928716 - RNA, 11 nt, Human
agagccuugcg

SEQ ID NO: 1928717 - RNA, 21 nt, Human
agagccuugcggaagguucua

SEQ ID NO: 1928718 - RNA, 20 nt, Human
agagccacaggucuuuaugu

SEQ ID NO: 1928719 - RNA, 17 nt, Human
agagccacaggucuuua

SEQ ID NO: 1928720 - RNA, 16 nt, Human
agagcagugggccugg

SEQ ID NO: 1928721 - RNA, 20 nt, Human
agagcagagaccaucccuga

SEQ ID NO: 1928722 - RNA, 17 nt, Human
agagcagagaccauccc

SEQ ID NO: 1928723 - RNA, 18 nt, Human
agagcagagaccaucccu

SEQ ID NO: 1928724 - RNA, 21 nt, Human
ugagugcagaccccuuggcca

SEQ ID NO: 1928725 - RNA, 19 nt, Human
ugagugcagccguuugaga

SEQ ID NO: 1928726 - RNA, 13 nt, Human
ugagugcagaccc

SEQ ID NO: 1928727 - RNA, 17 nt, Human
ugagugcagcucuggag

SEQ ID NO: 1928728 - RNA, 13 nt, Human
ugagugccuuaca

SEQ ID NO: 1928729 - RNA, 14 nt, Human
ugagugccuuacac

SEQ ID NO: 1928730 - RNA, 16 nt, Human
ugagugccuuacacaa

SEQ ID NO: 1928731 - RNA, 19 nt, Human
ugaguggcuucacuccugc

SEQ ID NO: 1928732 - RNA, 22 nt, Human
ugaguggcuucacuccugcugu

SEQ ID NO: 1928733 - RNA, 23 nt, Human
ugaguggcuucacuccugcugua

SEQ ID NO: 1928734 - RNA, 18 nt, Human
ugagucaccaagcccagu

SEQ ID NO: 1928735 - RNA, 20 nt, Human
ugaguacguugugcauuugg

SEQ ID NO: 1928736 - RNA, 14 nt, Human
ugaguacuacaguc

SEQ ID NO: 1928737 - RNA, 20 nt, Human
ugagucagguuugaguagag

SEQ ID NO: 1928738 - RNA, 18 nt, Human
ugaguucauacccuguua

SEQ ID NO: 1928739 - RNA, 16 nt, Human
ugaguuacagccuguu

SEQ ID NO: 1928740 - RNA, 23 nt, Human
ugaguuacaccagaccuguucug

SEQ ID NO: 1928741 - RNA, 18 nt, Human
ugaguuccuagccaccgc

SEQ ID NO: 1928742 - RNA, 24 nt, Human
ugaguuacuugcugcccugugcuc

SEQ ID NO: 1928743 - RNA, 14 nt, Human
ugaguuccuagcca

SEQ ID NO: 1928744 - RNA, 21 nt, Human
ugagugggggaucacagccuc

SEQ ID NO: 1928745 - RNA, 15 nt, Human
ugauacaaugcugug

SEQ ID NO: 1928746 - RNA, 14 nt, Human
ugauacaaugcugu

SEQ ID NO: 1928747 - RNA, 19 nt, Human
agcauaaaaauuagccaag

SEQ ID NO: 1928748 - RNA, 13 nt, Human
agcaguaaaauag

SEQ ID NO: 1928749 - RNA, 23 nt, Human
agcagguucccaagcucagaggc

SEQ ID NO: 1928750 - RNA, 16 nt, Human
agcagguucccaagcu

SEQ ID NO: 1928751 - RNA, 17 nt, Human
agcagguucccaagcuc

SEQ ID NO: 1928752 - RNA, 18 nt, Human
agcagguucccaagcuca

SEQ ID NO: 1928753 - RNA, 19 nt, Human
ugaguacguugugcauuug

SEQ ID NO: 1928754 - RNA, 18 nt, Human
ugaguacguugugcauuu

SEQ ID NO: 1928755 - RNA, 17 nt, Human
ugaguacguugugcauu

SEQ ID NO: 1928756 - RNA, 16 nt, Human
ugaguacguugugcau

SEQ ID NO: 1928757 - RNA, 23 nt, Human
agcauaaaaauuagccaagugug

SEQ ID NO: 1928758 - RNA, 22 nt, Human
agcaguuuucaagucaaauuaa

SEQ ID NO: 1928759 - RNA, 13 nt, Human
agcaguuuucaag

SEQ ID NO: 1928760 - RNA, 17 nt, Human
agcaguuuucaagucaa

SEQ ID NO: 1928761 - RNA, 18 nt, Human
agcaguuuucaagucaaa

SEQ ID NO: 1928762 - RNA, 21 nt, Human
agcaguuuucaagucaaauua

SEQ ID NO: 1928763 - RNA, 12 nt, Human
agcauacaacuu

SEQ ID NO: 1928764 - RNA, 16 nt, Human
agcagcagggagggcu

SEQ ID NO: 1928765 - RNA, 19 nt, Human
agcagcagccuuuaaugca

SEQ ID NO: 1928766 - RNA, 13 nt, Human
agcaggacaugga

SEQ ID NO: 1928767 - RNA, 15 nt, Human
agcagccacauuccu

SEQ ID NO: 1928768 - RNA, 11 nt, Human
agcagccacau

SEQ ID NO: 1928769 - RNA, 20 nt, Human
ugacccaugcugcccuguga

SEQ ID NO: 1928770 - RNA, 19 nt, Human
agcagcaccguucugugca

SEQ ID NO: 1928771 - RNA, 23 nt, Human
ugacccagccccuugagaaaccu

SEQ ID NO: 1928772 - RNA, 20 nt, Human
agcagcaccguucugugcac

SEQ ID NO: 1928773 - RNA, 17 nt, Human
ugacccaugcugcccug

SEQ ID NO: 1928774 - RNA, 18 nt, Human
ugacccagccccuugaga

SEQ ID NO: 1928775 - RNA, 19 nt, Human
ugacccagccccuugagaa

SEQ ID NO: 1928776 - RNA, 21 nt, Human
ugacccagccccuugagaaac

SEQ ID NO: 1928777 - RNA, 18 nt, Human
ugacccaugcugcccugu

SEQ ID NO: 1928778 - RNA, 19 nt, Human
ugacccaugcugcccugug

SEQ ID NO: 1928779 - RNA, 15 nt, Human
agcagggcucagcgg

SEQ ID NO: 1928780 - RNA, 14 nt, Human
agcagggcucagcg

SEQ ID NO: 1928781 - RNA, 13 nt, Human
agcagggcucagc

SEQ ID NO: 1928782 - RNA, 24 nt, Human
agcagggaugcccuggagguggcu

SEQ ID NO: 1928783 - RNA, 20 nt, Human
agcagggagggcuucugcca

SEQ ID NO: 1928784 - RNA, 21 nt, Human
agcagggaaaaugcagcaggg

SEQ ID NO: 1928785 - RNA, 17 nt, Human
agcagggaugcccugga

SEQ ID NO: 1928786 - RNA, 22 nt, Human
agcagggaugcccuggaggugg

SEQ ID NO: 1928787 - RNA, 22 nt, Human
agcagggcucagcggggacagc

SEQ ID NO: 1928788 - RNA, 21 nt, Human
agcagguccccagcuuuggcu

SEQ ID NO: 1928789 - RNA, 20 nt, Human
agcagguccccagcuuuggc

SEQ ID NO: 1928790 - RNA, 13 nt, Human
agcaggugcugac

SEQ ID NO: 1928791 - RNA, 15 nt, Human
agcagggaaacagcu

SEQ ID NO: 1928792 - RNA, 14 nt, Human
agcagggaaacagc

SEQ ID NO: 1928793 - RNA, 13 nt, Human
agcagggaaacag

SEQ ID NO: 1928794 - RNA, 21 nt, Human
agcaggcucucaggccagcug

SEQ ID NO: 1928795 - RNA, 22 nt, Human
agcaggcucucaggccagcugc

SEQ ID NO: 1928796 - RNA, 23 nt, Human
agcaggcucucaggccagcugcu

SEQ ID NO: 1928797 - RNA, 17 nt, Human
agcaggcucgggcuccc

SEQ ID NO: 1928798 - RNA, 13 nt, Human
agcaggcucucag

SEQ ID NO: 1928799 - RNA, 14 nt, Human
agcaggcucucagg

SEQ ID NO: 1928800 - RNA, 15 nt, Human
agcaggcucucaggc

SEQ ID NO: 1928801 - RNA, 16 nt, Human
agcaggcucucaggcc

SEQ ID NO: 1928802 - RNA, 17 nt, Human
agcaggcucucaggcca

SEQ ID NO: 1928803 - RNA, 18 nt, Human
agcaggcucucaggccag

SEQ ID NO: 1928804 - RNA, 19 nt, Human
agcaggcucucaggccagc

SEQ ID NO: 1928805 - RNA, 12 nt, Human
ugauggccacaa

SEQ ID NO: 1928806 - RNA, 17 nt, Human
ugauggcccauucuacu

SEQ ID NO: 1928807 - RNA, 18 nt, Human
ugauggcccauucuacuu

SEQ ID NO: 1928808 - RNA, 19 nt, Human
ugauggcccauucuacuug

SEQ ID NO: 1928809 - RNA, 23 nt, Human
ugauggcaacagaucuggaaccu

SEQ ID NO: 1928810 - RNA, 21 nt, Human
ugaugaucuuugcagacaggc

SEQ ID NO: 1928811 - RNA, 16 nt, Human
ugauggcaacagaucu

SEQ ID NO: 1928812 - RNA, 18 nt, Human
ugauggcaacagaucugg

SEQ ID NO: 1928813 - RNA, 19 nt, Human
ugauggcaacagaucugga

SEQ ID NO: 1928814 - RNA, 22 nt, Human
ugaugggcaacccccagccugc

SEQ ID NO: 1928815 - RNA, 13 nt, Human
ugauggggcccug

SEQ ID NO: 1928816 - RNA, 21 nt, Human
ugaugggcaacccccagccug

SEQ ID NO: 1928817 - RNA, 21 nt, Human
ugauggcccauucuacuugcu

SEQ ID NO: 1928818 - RNA, 20 nt, Human
ugauggcccauucuacuugc

SEQ ID NO: 1928819 - RNA, 20 nt, Human
ugaugaucuuugcagacagg

SEQ ID NO: 1928820 - RNA, 19 nt, Human
ugaugaucuuugcagacag

SEQ ID NO: 1928821 - RNA, 23 nt, Human
ugaugaaaugaggucagagccug

SEQ ID NO: 1928822 - RNA, 22 nt, Human
ugaugaaaugaggucagagccu

SEQ ID NO: 1928823 - RNA, 18 nt, Human
ugaugaaaauauuuaaag

SEQ ID NO: 1928824 - RNA, 14 nt, Human
ugaucuaggaagac

SEQ ID NO: 1928825 - RNA, 15 nt, Human
ugaucuaggaagacu

SEQ ID NO: 1928826 - RNA, 16 nt, Human
agccacggccaggcca

SEQ ID NO: 1928827 - RNA, 16 nt, Human
ugauuaaauucuugca

SEQ ID NO: 1928828 - RNA, 13 nt, Human
ugauuaaauucuu

SEQ ID NO: 1928829 - RNA, 17 nt, Human
ugauuaaauucuugcaa

SEQ ID NO: 1928830 - RNA, 23 nt, Human
ugauguuuuccaugaguccccug

SEQ ID NO: 1928831 - RNA, 19 nt, Human
ugauguuuuccaugagucc

SEQ ID NO: 1928832 - RNA, 21 nt, Human
ugauguuuuaaggaugcuugu

SEQ ID NO: 1928833 - RNA, 17 nt, Human
ugauguuuuccaugagu

SEQ ID NO: 1928834 - RNA, 22 nt, Human
ugauggggcccugccuccuuug

SEQ ID NO: 1928835 - RNA, 15 nt, Human
ugaugggucaguugu

SEQ ID NO: 1928836 - RNA, 23 nt, Human
ugauccagaaagaaaacuuguau

SEQ ID NO: 1928837 - RNA, 13 nt, Human
agccaccccugag

SEQ ID NO: 1928838 - RNA, 13 nt, Human
ugauccagaaaga

SEQ ID NO: 1928839 - RNA, 20 nt, Human
ugauccucccaccucagccu

SEQ ID NO: 1928840 - RNA, 19 nt, Human
ugauccucccaccucagcc

SEQ ID NO: 1928841 - RNA, 13 nt, Human
ugaucuaggaaga

SEQ ID NO: 1928842 - RNA, 18 nt, Human
ugauccucccaccucagc

SEQ ID NO: 1928843 - RNA, 21 nt, Human
agccacaggccugagauuuca

SEQ ID NO: 1928844 - RNA, 17 nt, Human
agccacaggccugagau

SEQ ID NO: 1928845 - RNA, 16 nt, Human
agccacaggccugaga

SEQ ID NO: 1928846 - RNA, 14 nt, Human
agccacaggccuga

SEQ ID NO: 1928847 - RNA, 23 nt, Human
agccacaggccugagauuucauc

SEQ ID NO: 1928848 - RNA, 22 nt, Human
agccacaggccugagauuucau

SEQ ID NO: 1928849 - RNA, 22 nt, Human
agccacagugagggagauccca

SEQ ID NO: 1928850 - RNA, 20 nt, Human
agccacagugagggagaucc

SEQ ID NO: 1928851 - RNA, 13 nt, Human
agccacaggccug

SEQ ID NO: 1928852 - RNA, 13 nt, Human
agccacagcuggu

SEQ ID NO: 1928853 - RNA, 21 nt, Human
agccacacucugggcuccaga

SEQ ID NO: 1928854 - RNA, 16 nt, Human
agccaauucagacagg

SEQ ID NO: 1928855 - RNA, 17 nt, Human
agccaauucagacaggc

SEQ ID NO: 1928856 - RNA, 18 nt, Human
agccaauucagacaggca

SEQ ID NO: 1928857 - RNA, 17 nt, Human
agccacaaccacauaca

SEQ ID NO: 1928858 - RNA, 16 nt, Human
agcauuugucaacaaa

SEQ ID NO: 1928859 - RNA, 14 nt, Human
agcauuuauaaauu

SEQ ID NO: 1928860 - RNA, 16 nt, Human
agcauuuacugugucu

SEQ ID NO: 1928861 - RNA, 12 nt, Human
agcauuuuccuc

SEQ ID NO: 1928862 - RNA, 13 nt, Human
agcauuuuccucu

SEQ ID NO: 1928863 - RNA, 18 nt, Human
agcauuuguguugaagag

SEQ ID NO: 1928864 - RNA, 17 nt, Human
agcauuuguguugaaga

SEQ ID NO: 1928865 - RNA, 16 nt, Human
agccaaaacagaucca

SEQ ID NO: 1928866 - RNA, 15 nt, Human
agcauuuuuuaaaaa

SEQ ID NO: 1928867 - RNA, 15 nt, Human
agcauuuugcuaaau

SEQ ID NO: 1928868 - RNA, 22 nt, Human
agcauuuuccucugcuuugaaa

SEQ ID NO: 1928869 - RNA, 14 nt, Human
agcauuuuccucug

SEQ ID NO: 1928870 - RNA, 17 nt, Human
agcauuuuccucugcuu

SEQ ID NO: 1928871 - RNA, 18 nt, Human
agcauuuuccucugcuuu

SEQ ID NO: 1928872 - RNA, 21 nt, Human
agcauuuuccucugcuuugaa

SEQ ID NO: 1928873 - RNA, 22 nt, Human
agcauuuugcuaaaugugaaug

SEQ ID NO: 1928874 - RNA, 15 nt, Human
agcauuuuguauuug

SEQ ID NO: 1928875 - RNA, 14 nt, Human
agcauuccuuuuga

SEQ ID NO: 1928876 - RNA, 19 nt, Human
agcauggcugccaauggga

SEQ ID NO: 1928877 - RNA, 16 nt, Human
agcauggguucauccu

SEQ ID NO: 1928878 - RNA, 19 nt, Human
agcauuaugauguggguca

SEQ ID NO: 1928879 - RNA, 14 nt, Human
ugaucacggcucac

SEQ ID NO: 1928880 - RNA, 13 nt, Human
ugaucacggcuca

SEQ ID NO: 1928881 - RNA, 15 nt, Human
ugaucacggcucacu

SEQ ID NO: 1928882 - RNA, 18 nt, Human
ugaucacggcucacugca

SEQ ID NO: 1928883 - RNA, 17 nt, Human
agcauauucaggaagcu

SEQ ID NO: 1928884 - RNA, 19 nt, Human
agcauauucaggaagcuca

SEQ ID NO: 1928885 - RNA, 21 nt, Human
agcauauucaggaagcucagg

SEQ ID NO: 1928886 - RNA, 18 nt, Human
ugauacaaugcugugccc

SEQ ID NO: 1928887 - RNA, 21 nt, Human
ugauacagaaaaguugaauuu

SEQ ID NO: 1928888 - RNA, 16 nt, Human
ugauacauccaaagca

SEQ ID NO: 1928889 - RNA, 22 nt, Human
ugauacauccaaagcagacagc

SEQ ID NO: 1928890 - RNA, 13 nt, Human
agcauggcugcca

SEQ ID NO: 1928891 - RNA, 15 nt, Human
agcauccuggaauau

SEQ ID NO: 1928892 - RNA, 14 nt, Human
agcauccuggaaua

SEQ ID NO: 1928893 - RNA, 13 nt, Human
agcauccuggaau

SEQ ID NO: 1928894 - RNA, 23 nt, Human
agcaucaggccaggcccucugcc

SEQ ID NO: 1928895 - RNA, 22 nt, Human
agcaucaggccaggcccucugc

SEQ ID NO: 1928896 - RNA, 21 nt, Human
agcaucaggccaggcccucug

SEQ ID NO: 1928897 - RNA, 17 nt, Human
agcaucacuugggauua

SEQ ID NO: 1928898 - RNA, 16 nt, Human
agcauauucaggaagc

SEQ ID NO: 1928899 - RNA, 23 nt, Human
ugcacaugucuuguacaugugua

SEQ ID NO: 1928900 - RNA, 16 nt, Human
agcccugggaucacug

SEQ ID NO: 1928901 - RNA, 18 nt, Human
agcccugggaucacugug

SEQ ID NO: 1928902 - RNA, 22 nt, Human
ugcacaugucuuguacaugugu

SEQ ID NO: 1928903 - RNA, 17 nt, Human
agcccugggaggcucug

SEQ ID NO: 1928904 - RNA, 18 nt, Human
agcccugggaggcucugg

SEQ ID NO: 1928905 - RNA, 20 nt, Human
agcccugggaggcucuggag

SEQ ID NO: 1928906 - RNA, 13 nt, Human
ugcaccagcccuu

SEQ ID NO: 1928907 - RNA, 21 nt, Human
ugcaccacugcacuccagccu

SEQ ID NO: 1928908 - RNA, 22 nt, Human
ugcagaagacaguauggcagcu

SEQ ID NO: 1928909 - RNA, 16 nt, Human
ugcacuccagccuggg

SEQ ID NO: 1928910 - RNA, 15 nt, Human
ugcacuccagccugg

SEQ ID NO: 1928911 - RNA, 17 nt, Human
ugcacuccagccugagc

SEQ ID NO: 1928912 - RNA, 14 nt, Human
ugcaccggcuggcc

SEQ ID NO: 1928913 - RNA, 15 nt, Human
ugcaccggcuggccu

SEQ ID NO: 1928914 - RNA, 16 nt, Human
ugcaccggcuggccug

SEQ ID NO: 1928915 - RNA, 14 nt, Human
ugcacucagcucuu

SEQ ID NO: 1928916 - RNA, 14 nt, Human
ugcacuccagccug

SEQ ID NO: 1928917 - RNA, 15 nt, Human
ugcacuccagccuga

SEQ ID NO: 1928918 - RNA, 18 nt, Human
agccccgugggguuccuc

SEQ ID NO: 1928919 - RNA, 20 nt, Human
agccccugucuagagaggga

SEQ ID NO: 1928920 - RNA, 21 nt, Human
agccccugucuagagagggag

SEQ ID NO: 1928921 - RNA, 22 nt, Human
agccccugucuagagagggagg

SEQ ID NO: 1928922 - RNA, 23 nt, Human
agccccugucuagagagggaggc

SEQ ID NO: 1928923 - RNA, 14 nt, Human
agccccgaggccuu

SEQ ID NO: 1928924 - RNA, 14 nt, Human
agcccaggccuccu

SEQ ID NO: 1928925 - RNA, 19 nt, Human
agcccaggccuccuacagc

SEQ ID NO: 1928926 - RNA, 16 nt, Human
agcccccuggccucug

SEQ ID NO: 1928927 - RNA, 17 nt, Human
agcccccuggccucugu

SEQ ID NO: 1928928 - RNA, 19 nt, Human
agcccccuggccucugugc

SEQ ID NO: 1928929 - RNA, 16 nt, Human
agcccgggcucugccu

SEQ ID NO: 1928930 - RNA, 18 nt, Human
agcccugaguuccuagcc

SEQ ID NO: 1928931 - RNA, 23 nt, Human
agcccugaguuccuagccaccgc

SEQ ID NO: 1928932 - RNA, 20 nt, Human
agcccugaguuccuagccac

SEQ ID NO: 1928933 - RNA, 14 nt, Human
agcccugcagaggg

SEQ ID NO: 1928934 - RNA, 15 nt, Human
agcccugcagagggc

SEQ ID NO: 1928935 - RNA, 16 nt, Human
agcccugcagagggca

SEQ ID NO: 1928936 - RNA, 19 nt, Human
agcccugcagagggcacag

SEQ ID NO: 1928937 - RNA, 14 nt, Human
agccccuucugacc

SEQ ID NO: 1928938 - RNA, 15 nt, Human
agccccuucugaccc

SEQ ID NO: 1928939 - RNA, 16 nt, Human
agccccuucugaccca

SEQ ID NO: 1928940 - RNA, 19 nt, Human
agccccuucugacccaugc

SEQ ID NO: 1928941 - RNA, 13 nt, Human
agcccgggcucug

SEQ ID NO: 1928942 - RNA, 14 nt, Human
agcccgggcucugc

SEQ ID NO: 1928943 - RNA, 15 nt, Human
agcccgggcucugcc

SEQ ID NO: 1928944 - RNA, 13 nt, Human
ugcaacaaaauuc

SEQ ID NO: 1928945 - RNA, 15 nt, Human
ugcaacaacauguau

SEQ ID NO: 1928946 - RNA, 13 nt, Human
ugcaacaacaugu

SEQ ID NO: 1928947 - RNA, 13 nt, Human
ugcaacaggcugg

SEQ ID NO: 1928948 - RNA, 14 nt, Human
ugcaaaucuugaaa

SEQ ID NO: 1928949 - RNA, 23 nt, Human
ugcaagccccugcuccagaagau

SEQ ID NO: 1928950 - RNA, 19 nt, Human
ugcaaggaagccacagcug

SEQ ID NO: 1928951 - RNA, 20 nt, Human
ugcaaggaagccacagcugg

SEQ ID NO: 1928952 - RNA, 15 nt, Human
ugcaaggucauuuuu

SEQ ID NO: 1928953 - RNA, 23 nt, Human
ugcaagguuuaggcugguggccc

SEQ ID NO: 1928954 - RNA, 21 nt, Human
ugcaagggacuguguguugcc

SEQ ID NO: 1928955 - RNA, 16 nt, Human
ugcaagggacugugug

SEQ ID NO: 1928956 - RNA, 13 nt, Human
ugcaaggcaaaga

SEQ ID NO: 1928957 - RNA, 12 nt, Human
agcccaggccuc

SEQ ID NO: 1928958 - RNA, 19 nt, Human
ugcaauaaaucugacccag

SEQ ID NO: 1928959 - RNA, 17 nt, Human
ugauuucauuucaacug

SEQ ID NO: 1928960 - RNA, 13 nt, Human
ugauuucauuuca

SEQ ID NO: 1928961 - RNA, 20 nt, Human
ugauuucagcaccuacagug

SEQ ID NO: 1928962 - RNA, 13 nt, Human
ugauuucauucaa

SEQ ID NO: 1928963 - RNA, 18 nt, Human
agccacggccaggccaga

SEQ ID NO: 1928964 - RNA, 17 nt, Human
agccacggccaggccag

SEQ ID NO: 1928965 - RNA, 23 nt, Human
ugauuuccccuuuugcauucucc

SEQ ID NO: 1928966 - RNA, 17 nt, Human
ugauuuccccuuuugca

SEQ ID NO: 1928967 - RNA, 12 nt, Human
ugauuugcauug

SEQ ID NO: 1928968 - RNA, 15 nt, Human
ugauuugcauugaac

SEQ ID NO: 1928969 - RNA, 13 nt, Human
ugauuugcauuga

SEQ ID NO: 1928970 - RNA, 14 nt, Human
ugauuugcauugaa

SEQ ID NO: 1928971 - RNA, 18 nt, Human
ugauuugcauugaacaca

SEQ ID NO: 1928972 - RNA, 12 nt, Human
ugcaaaccauca

SEQ ID NO: 1928973 - RNA, 13 nt, Human
ugcaaaccaucau

SEQ ID NO: 1928974 - RNA, 20 nt, Human
ugcaaaguaucccuacugua

SEQ ID NO: 1928975 - RNA, 21 nt, Human
ugcaaaggguaucaggugcug

SEQ ID NO: 1928976 - RNA, 13 nt, Human
ugcaaaggacaga

SEQ ID NO: 1928977 - RNA, 15 nt, Human
ugcaaaggacagauc

SEQ ID NO: 1928978 - RNA, 18 nt, Human
ugcaaaccaucauugaaa

SEQ ID NO: 1928979 - RNA, 20 nt, Human
ugcaaaccaucauugaaauc

SEQ ID NO: 1928980 - RNA, 23 nt, Human
ugcaaagaucuguccucagccuu

SEQ ID NO: 1928981 - RNA, 12 nt, Human
ugcaaagaucug

SEQ ID NO: 1928982 - RNA, 21 nt, Human
agccugugcauguaugucuug

SEQ ID NO: 1928983 - RNA, 17 nt, Human
agccugugccucuggga

SEQ ID NO: 1928984 - RNA, 18 nt, Human
agccugugccucugggac

SEQ ID NO: 1928985 - RNA, 19 nt, Human
agccugugccucugggacu

SEQ ID NO: 1928986 - RNA, 21 nt, Human
agccugguuuagccuggaugu

SEQ ID NO: 1928987 - RNA, 19 nt, Human
agccugagucaccugcaga

SEQ ID NO: 1928988 - RNA, 16 nt, Human
agccugagucaccugc

SEQ ID NO: 1928989 - RNA, 13 nt, Human
ugcauggacugug

SEQ ID NO: 1928990 - RNA, 14 nt, Human
agccuuaccacgca

SEQ ID NO: 1928991 - RNA, 22 nt, Human
agccuuagaagucacacaguau

SEQ ID NO: 1928992 - RNA, 20 nt, Human
agccuuagaagucacacagu

SEQ ID NO: 1928993 - RNA, 15 nt, Human
agccuguuuaagaga

SEQ ID NO: 1928994 - RNA, 13 nt, Human
agccuugaacuuu

SEQ ID NO: 1928995 - RNA, 18 nt, Human
agccuugaccauucucca

SEQ ID NO: 1928996 - RNA, 19 nt, Human
agccuugaccauucuccac

SEQ ID NO: 1928997 - RNA, 21 nt, Human
agccuugaccauucuccaccu

SEQ ID NO: 1928998 - RNA, 19 nt, Human
agccuugcggaagguucua

SEQ ID NO: 1928999 - RNA, 13 nt, Human
ugccauaauuacu

SEQ ID NO: 1929000 - RNA, 17 nt, Human
ugccagccgagauagcc

SEQ ID NO: 1929001 - RNA, 22 nt, Human
ugccagccgagauagccaaggc

SEQ ID NO: 1929002 - RNA, 12 nt, Human
ugccacaggaca

SEQ ID NO: 1929003 - RNA, 13 nt, Human
ugccacaggacac

SEQ ID NO: 1929004 - RNA, 14 nt, Human
ugccacaggacaca

SEQ ID NO: 1929005 - RNA, 18 nt, Human
ugccacaggacacaguca

SEQ ID NO: 1929006 - RNA, 20 nt, Human
ugccacaggacacagucaga

SEQ ID NO: 1929007 - RNA, 16 nt, Human
ugcauuuaaaagauac

SEQ ID NO: 1929008 - RNA, 18 nt, Human
ugccaaugggagcucaug

SEQ ID NO: 1929009 - RNA, 13 nt, Human
ugccaauggacua

SEQ ID NO: 1929010 - RNA, 14 nt, Human
ugccaaugggagcu

SEQ ID NO: 1929011 - RNA, 21 nt, Human
ugccaauauuaaaucugcugg

SEQ ID NO: 1929012 - RNA, 16 nt, Human
ugcaggugaaacccag

SEQ ID NO: 1929013 - RNA, 18 nt, Human
ugcagguagaccugucuc

SEQ ID NO: 1929014 - RNA, 22 nt, Human
ugcagguagaccugucuccugg

SEQ ID NO: 1929015 - RNA, 11 nt, Human
ugcaggucccu

SEQ ID NO: 1929016 - RNA, 15 nt, Human
ugcagguagaccugu

SEQ ID NO: 1929017 - RNA, 22 nt, Human
ugcaggucccuaauaaagcugu

SEQ ID NO: 1929018 - RNA, 18 nt, Human
ugcagccucacaguccuu

SEQ ID NO: 1929019 - RNA, 17 nt, Human
ugcagccucacaguccu

SEQ ID NO: 1929020 - RNA, 21 nt, Human
ugcagccucacaguccuuacc

SEQ ID NO: 1929021 - RNA, 21 nt, Human
ugcagacaggcaagcaccucc

SEQ ID NO: 1929022 - RNA, 13 nt, Human
ugcagacaggcaa

SEQ ID NO: 1929023 - RNA, 12 nt, Human
ugcagacaggca

SEQ ID NO: 1929024 - RNA, 13 nt, Human
agccuccugcccu

SEQ ID NO: 1929025 - RNA, 14 nt, Human
agccuccugcccuu

SEQ ID NO: 1929026 - RNA, 18 nt, Human
agccuccugcccuuaccu

SEQ ID NO: 1929027 - RNA, 18 nt, Human
agccucgacacagagugg

SEQ ID NO: 1929028 - RNA, 17 nt, Human
agccucgacacagagug

SEQ ID NO: 1929029 - RNA, 20 nt, Human
ugcauaccacuuuuguucuu

SEQ ID NO: 1929030 - RNA, 18 nt, Human
ugcauaccacuuuuguuc

SEQ ID NO: 1929031 - RNA, 16 nt, Human
ugcauaccacuuuugu

SEQ ID NO: 1929032 - RNA, 13 nt, Human
ugcaguaaaucuu

SEQ ID NO: 1929033 - RNA, 16 nt, Human
ugcaguaucaugcccu

SEQ ID NO: 1929034 - RNA, 21 nt, Human
ugcaguaucaugcccugugca

SEQ ID NO: 1929035 - RNA, 17 nt, Human
ugcauagaauaaaauuu

SEQ ID NO: 1929036 - RNA, 17 nt, Human
ugcauagagccacguau

SEQ ID NO: 1929037 - RNA, 19 nt, Human
ugcauacucauuaggaugg

SEQ ID NO: 1929038 - RNA, 13 nt, Human
ugcauacucauua

SEQ ID NO: 1929039 - RNA, 19 nt, Human
ugcauagagccacguaugu

SEQ ID NO: 1929040 - RNA, 18 nt, Human
ugcaucuagauuauggag

SEQ ID NO: 1929041 - RNA, 18 nt, Human
ugcaugaagguuucugaa

SEQ ID NO: 1929042 - RNA, 13 nt, Human
ugcaugaagguuu

SEQ ID NO: 1929043 - RNA, 21 nt, Human
ugcaugaagguuucugaaaau

SEQ ID NO: 1929044 - RNA, 19 nt, Human
ugcaugaagguuucugaaa

SEQ ID NO: 1929045 - RNA, 18 nt, Human
ugcaugcugucccuuacg

SEQ ID NO: 1929046 - RNA, 14 nt, Human
ugcaugauuuugua

SEQ ID NO: 1929047 - RNA, 18 nt, Human
ugcaugauuuuguaaccc

SEQ ID NO: 1929048 - RNA, 19 nt, Human
ugcaugcugucccuuacgu

SEQ ID NO: 1929049 - RNA, 21 nt, Human
ugcaugcugucccuuacguga

SEQ ID NO: 1929050 - RNA, 17 nt, Human
ugcaugcugcuggacag

SEQ ID NO: 1929051 - RNA, 15 nt, Human
aggacgugggcuggg

SEQ ID NO: 1929052 - RNA, 19 nt, Human
aggacgugggcugggccca

SEQ ID NO: 1929053 - RNA, 20 nt, Human
aggacuauauuugggccugc

SEQ ID NO: 1929054 - RNA, 14 nt, Human
aggacgcucucugg

SEQ ID NO: 1929055 - RNA, 13 nt, Human
aggacgcucucug

SEQ ID NO: 1929056 - RNA, 20 nt, Human
aggaccuucgggcugugccc

SEQ ID NO: 1929057 - RNA, 20 nt, Human
aggacgaacauccaaccuuc

SEQ ID NO: 1929058 - RNA, 20 nt, Human
aggacgcucucuggccuucg

SEQ ID NO: 1929059 - RNA, 19 nt, Human
aggacgcucucuggccuuc

SEQ ID NO: 1929060 - RNA, 17 nt, Human
aggacgcucucuggccu

SEQ ID NO: 1929061 - RNA, 16 nt, Human
aggacgcucucuggcc

SEQ ID NO: 1929062 - RNA, 19 nt, Human
aggaccuucgggcugugcc

SEQ ID NO: 1929063 - RNA, 18 nt, Human
aggaccuucgggcugugc

SEQ ID NO: 1929064 - RNA, 21 nt, Human
aggaccuguggccaaguucuu

SEQ ID NO: 1929065 - RNA, 13 nt, Human
aggacacagucag

SEQ ID NO: 1929066 - RNA, 17 nt, Human
aggagagucacagaaca

SEQ ID NO: 1929067 - RNA, 15 nt, Human
aggagcacacccagc

SEQ ID NO: 1929068 - RNA, 20 nt, Human
aggagauggaaguugcagug

SEQ ID NO: 1929069 - RNA, 12 nt, Human
aggagcagccac

SEQ ID NO: 1929070 - RNA, 13 nt, Human
aggagcagccaca

SEQ ID NO: 1929071 - RNA, 17 nt, Human
aggagccccgaggccuu

SEQ ID NO: 1929072 - RNA, 23 nt, Human
aggagcccugggaggcucuggag

SEQ ID NO: 1929073 - RNA, 16 nt, Human
aggagccuccugcccu

SEQ ID NO: 1929074 - RNA, 15 nt, Human
aggagccuaggccag

SEQ ID NO: 1929075 - RNA, 19 nt, Human
aggacuuuucuuuguggcu

SEQ ID NO: 1929076 - RNA, 17 nt, Human
aggacuuuucuuugugg

SEQ ID NO: 1929077 - RNA, 22 nt, Human
aggacuuuucuuuguggcuucc

SEQ ID NO: 1929078 - RNA, 19 nt, Human
aggagaaacuggaacucuc

SEQ ID NO: 1929079 - RNA, 18 nt, Human
aggagaaacuggaacucu

SEQ ID NO: 1929080 - RNA, 22 nt, Human
aggacuuccuguccagcuccaa

SEQ ID NO: 1929081 - RNA, 15 nt, Human
aggacugggccacuu

SEQ ID NO: 1929082 - RNA, 12 nt, Human
aggacugggcca

SEQ ID NO: 1929083 - RNA, 11 nt, Human
aggacugggcc

SEQ ID NO: 1929084 - RNA, 18 nt, Human
ugcuuuuggucuguguga

SEQ ID NO: 1929085 - RNA, 20 nt, Human
ugcuuuugucuaugggacuc

SEQ ID NO: 1929086 - RNA, 23 nt, Human
ugcuuuuuaauauugauaugcuu

SEQ ID NO: 1929087 - RNA, 22 nt, Human
ugcuuugugauuuuuguaauuu

SEQ ID NO: 1929088 - RNA, 17 nt, Human
ugcuuugugauuuuugu

SEQ ID NO: 1929089 - RNA, 17 nt, Human
ugcuuuggcuuacuugu

SEQ ID NO: 1929090 - RNA, 14 nt, Human
ugcuuuguguucuu

SEQ ID NO: 1929091 - RNA, 17 nt, Human
aggagccuccugcccuu

SEQ ID NO: 1929092 - RNA, 16 nt, Human
aggagccuaggccagg

SEQ ID NO: 1929093 - RNA, 15 nt, Human
ugcuugagcucagga

SEQ ID NO: 1929094 - RNA, 15 nt, Human
ugcuugacaacaucu

SEQ ID NO: 1929095 - RNA, 16 nt, Human
ugcuugacaacaucug

SEQ ID NO: 1929096 - RNA, 15 nt, Human
ugcuuugggaagccg

SEQ ID NO: 1929097 - RNA, 16 nt, Human
uggaagacagcucuua

SEQ ID NO: 1929098 - RNA, 15 nt, Human
uggaagagggcugca

SEQ ID NO: 1929099 - RNA, 21 nt, Human
uggaaauuuguuauaaugaau

SEQ ID NO: 1929100 - RNA, 23 nt, Human
uggaaauuuguuauaaugaauga

SEQ ID NO: 1929101 - RNA, 17 nt, Human
ugcuuuuucucaaaaug

SEQ ID NO: 1929102 - RNA, 18 nt, Human
ugcuuuuuauuucugcau

SEQ ID NO: 1929103 - RNA, 19 nt, Human
ugcuuuuuauuucugcaua

SEQ ID NO: 1929104 - RNA, 16 nt, Human
ugcuuuuuauggccug

SEQ ID NO: 1929105 - RNA, 15 nt, Human
ugcuuuuuauuucug

SEQ ID NO: 1929106 - RNA, 22 nt, Human
aggaugcacagaguuguuacau

SEQ ID NO: 1929107 - RNA, 22 nt, Human
aggaugaucuaggaagacuuug

SEQ ID NO: 1929108 - RNA, 23 nt, Human
aggaugaucuaggaagacuuugg

SEQ ID NO: 1929109 - RNA, 17 nt, Human
aggauucuuccucccuc

SEQ ID NO: 1929110 - RNA, 19 nt, Human
aggauucuuccucccuccc

SEQ ID NO: 1929111 - RNA, 13 nt, Human
aggaucagucuga

SEQ ID NO: 1929112 - RNA, 18 nt, Human
aggaucuuuugaacccag

SEQ ID NO: 1929113 - RNA, 15 nt, Human
aggauagaugcuggc

SEQ ID NO: 1929114 - RNA, 18 nt, Human
aggauagaugcuggccca

SEQ ID NO: 1929115 - RNA, 19 nt, Human
aggauagaugcuggcccag

SEQ ID NO: 1929116 - RNA, 20 nt, Human
aggauagaugcuggcccagg

SEQ ID NO: 1929117 - RNA, 21 nt, Human
aggauagaugcuggcccaggg

SEQ ID NO: 1929118 - RNA, 22 nt, Human
aggauagaugcuggcccagggc

SEQ ID NO: 1929119 - RNA, 23 nt, Human
aggcccaaauuaucaagcuaaua

SEQ ID NO: 1929120 - RNA, 22 nt, Human
aggcccaaauuaucaagcuaau

SEQ ID NO: 1929121 - RNA, 13 nt, Human
aggcccagagggc

SEQ ID NO: 1929122 - RNA, 13 nt, Human
aggcccggcucca

SEQ ID NO: 1929123 - RNA, 14 nt, Human
aggccccgcccagg

SEQ ID NO: 1929124 - RNA, 23 nt, Human
aggcccccgggugugaagcacag

SEQ ID NO: 1929125 - RNA, 20 nt, Human
uggcacccggccccugcugg

SEQ ID NO: 1929126 - RNA, 19 nt, Human
uggcacccggccccugcug

SEQ ID NO: 1929127 - RNA, 18 nt, Human
uggcacccggccccugcu

SEQ ID NO: 1929128 - RNA, 14 nt, Human
uggcaccagacacc

SEQ ID NO: 1929129 - RNA, 16 nt, Human
uggcaccagacaccca

SEQ ID NO: 1929130 - RNA, 13 nt, Human
uggcagcucagag

SEQ ID NO: 1929131 - RNA, 23 nt, Human
uggcagcucaccucucccuugga

SEQ ID NO: 1929132 - RNA, 21 nt, Human
uggcagcucaccucucccuug

SEQ ID NO: 1929133 - RNA, 22 nt, Human
uggcagcucaccucucccuugg

SEQ ID NO: 1929134 - RNA, 13 nt, Human
aggccagccuuga

SEQ ID NO: 1929135 - RNA, 12 nt, Human
aggccagcugcu

SEQ ID NO: 1929136 - RNA, 21 nt, Human
aggcccaaauuaucaagcuaa

SEQ ID NO: 1929137 - RNA, 13 nt, Human
aggccagcugccu

SEQ ID NO: 1929138 - RNA, 15 nt, Human
aggccagccuugacc

SEQ ID NO: 1929139 - RNA, 14 nt, Human
uggaguugaaaauc

SEQ ID NO: 1929140 - RNA, 13 nt, Human
uggaguggccacu

SEQ ID NO: 1929141 - RNA, 14 nt, Human
uggagugcagugag

SEQ ID NO: 1929142 - RNA, 17 nt, Human
uggagugcaaugacaca

SEQ ID NO: 1929143 - RNA, 16 nt, Human
aggcauuugcugaaua

SEQ ID NO: 1929144 - RNA, 20 nt, Human
aggcauuugcugaauacaga

SEQ ID NO: 1929145 - RNA, 15 nt, Human
uggaguucuugugcc

SEQ ID NO: 1929146 - RNA, 14 nt, Human
uggaguucuugugc

SEQ ID NO: 1929147 - RNA, 16 nt, Human
uggaguucuugugcca

SEQ ID NO: 1929148 - RNA, 15 nt, Human
uggaguugaucugga

SEQ ID NO: 1929149 - RNA, 17 nt, Human
uggaguugaucuggaac

SEQ ID NO: 1929150 - RNA, 19 nt, Human
uggaguugaucuggaaccc

SEQ ID NO: 1929151 - RNA, 23 nt, Human
uggaugccugguggcagcugcgg

SEQ ID NO: 1929152 - RNA, 21 nt, Human
uggaugccugguggcagcugc

SEQ ID NO: 1929153 - RNA, 23 nt, Human
uggaugcggaacccaaauuacgu

SEQ ID NO: 1929154 - RNA, 22 nt, Human
uggaguugaucuggaacccaga

SEQ ID NO: 1929155 - RNA, 13 nt, Human
uggauuauuucau

SEQ ID NO: 1929156 - RNA, 23 nt, Human
uggcacaucagcacgauuucugu

SEQ ID NO: 1929157 - RNA, 17 nt, Human
uggauucugagagcugu

SEQ ID NO: 1929158 - RNA, 16 nt, Human
uggauucugagagcug

SEQ ID NO: 1929159 - RNA, 17 nt, Human
aggcaagcaccuccugc

SEQ ID NO: 1929160 - RNA, 13 nt, Human
uggagccagcucc

SEQ ID NO: 1929161 - RNA, 19 nt, Human
aggcaagcaccuccugccu

SEQ ID NO: 1929162 - RNA, 18 nt, Human
aggcaagcaccuccugcc

SEQ ID NO: 1929163 - RNA, 20 nt, Human
aggcaagcaccuccugccuc

SEQ ID NO: 1929164 - RNA, 12 nt, Human
aggcaagcccug

SEQ ID NO: 1929165 - RNA, 17 nt, Human
aggcaaggcugucaauu

SEQ ID NO: 1929166 - RNA, 16 nt, Human
aggcaaggcugucaau

SEQ ID NO: 1929167 - RNA, 17 nt, Human
aggauugcuacuguccu

SEQ ID NO: 1929168 - RNA, 15 nt, Human
aggauugcuacuguc

SEQ ID NO: 1929169 - RNA, 18 nt, Human
aggauugcuacuguccua

SEQ ID NO: 1929170 - RNA, 16 nt, Human
uggacuguucccugag

SEQ ID NO: 1929171 - RNA, 14 nt, Human
uggagaaaauggac

SEQ ID NO: 1929172 - RNA, 17 nt, Human
uggacuguucccugagg

SEQ ID NO: 1929173 - RNA, 22 nt, Human
aggcauaaagucagggguuccc

SEQ ID NO: 1929174 - RNA, 18 nt, Human
aggcauugugggaagggg

SEQ ID NO: 1929175 - RNA, 20 nt, Human
aggcauuuaggccaugggac

SEQ ID NO: 1929176 - RNA, 12 nt, Human
aggcauuuccua

SEQ ID NO: 1929177 - RNA, 22 nt, Human
aggcaggucuugaacuccuggc

SEQ ID NO: 1929178 - RNA, 18 nt, Human
aggcaggugaauuguuug

SEQ ID NO: 1929179 - RNA, 12 nt, Human
aggcagggucuc

SEQ ID NO: 1929180 - RNA, 15 nt, Human
aggcauaaagucagg

SEQ ID NO: 1929181 - RNA, 17 nt, Human
aggcaggugggauggau

SEQ ID NO: 1929182 - RNA, 20 nt, Human
aggcagcuuuuucucuccca

SEQ ID NO: 1929183 - RNA, 16 nt, Human
ugccauagucacaugg

SEQ ID NO: 1929184 - RNA, 17 nt, Human
ugccauagucacauggc

SEQ ID NO: 1929185 - RNA, 18 nt, Human
ugccauacuguaugcagu

SEQ ID NO: 1929186 - RNA, 16 nt, Human
ugccaucauguuuaca

SEQ ID NO: 1929187 - RNA, 15 nt, Human
agcucccaggugcag

SEQ ID NO: 1929188 - RNA, 23 nt, Human
agcucccaggcauuccccaggag

SEQ ID NO: 1929189 - RNA, 20 nt, Human
agcucccaggugcagccaga

SEQ ID NO: 1929190 - RNA, 21 nt, Human
agcucccaggugcagccagag

SEQ ID NO: 1929191 - RNA, 22 nt, Human
agcucccaggugcagccagagg

SEQ ID NO: 1929192 - RNA, 15 nt, Human
agcuccuucuguccu

SEQ ID NO: 1929193 - RNA, 13 nt, Human
agcucccaggcau

SEQ ID NO: 1929194 - RNA, 13 nt, Human
agcuccaguucga

SEQ ID NO: 1929195 - RNA, 21 nt, Human
agcuccuucuguccuacucug

SEQ ID NO: 1929196 - RNA, 16 nt, Human
agcuccuucuguccua

SEQ ID NO: 1929197 - RNA, 13 nt, Human
agcucgcuaaagu

SEQ ID NO: 1929198 - RNA, 12 nt, Human
agcucuggucca

SEQ ID NO: 1929199 - RNA, 17 nt, Human
agcucugguccauagag

SEQ ID NO: 1929200 - RNA, 18 nt, Human
ugcccuuaccugccagga

SEQ ID NO: 1929201 - RNA, 13 nt, Human
ugccucagccucc

SEQ ID NO: 1929202 - RNA, 12 nt, Human
ugccucagccuc

SEQ ID NO: 1929203 - RNA, 12 nt, Human
ugccgcagcccu

SEQ ID NO: 1929204 - RNA, 14 nt, Human
ugccgcagcccugc

SEQ ID NO: 1929205 - RNA, 16 nt, Human
ugccucagcccugacc

SEQ ID NO: 1929206 - RNA, 17 nt, Human
ugccgcagagcuggccg

SEQ ID NO: 1929207 - RNA, 15 nt, Human
ugccgcagagcuggc

SEQ ID NO: 1929208 - RNA, 14 nt, Human
ugccgcagagcugg

SEQ ID NO: 1929209 - RNA, 13 nt, Human
ugccgcagagcug

SEQ ID NO: 1929210 - RNA, 21 nt, Human
ugccgauauacucuagaugaa

SEQ ID NO: 1929211 - RNA, 23 nt, Human
agcucuguccugggagugagcug

SEQ ID NO: 1929212 - RNA, 13 nt, Human
agcugcaaaggac

SEQ ID NO: 1929213 - RNA, 14 nt, Human
agcugcaaaggaca

SEQ ID NO: 1929214 - RNA, 15 nt, Human
agcugcaaaggacag

SEQ ID NO: 1929215 - RNA, 16 nt, Human
agcugcaaaggacaga

SEQ ID NO: 1929216 - RNA, 19 nt, Human
agcugcaaaggacagaucc

SEQ ID NO: 1929217 - RNA, 21 nt, Human
agcucuguccugggagugagc

SEQ ID NO: 1929218 - RNA, 16 nt, Human
agcucuguccugggag

SEQ ID NO: 1929219 - RNA, 11 nt, Human
agcugcacuga

SEQ ID NO: 1929220 - RNA, 17 nt, Human
agcugcacugaugcugc

SEQ ID NO: 1929221 - RNA, 19 nt, Human
agcugcacugaugcugccc

SEQ ID NO: 1929222 - RNA, 20 nt, Human
agcugccagccgagauagcc

SEQ ID NO: 1929223 - RNA, 20 nt, Human
agcugcacugaugcugcccc

SEQ ID NO: 1929224 - RNA, 22 nt, Human
agcugcacugaugcugccccuc

SEQ ID NO: 1929225 - RNA, 21 nt, Human
agcugcagaaacgaagccauc

SEQ ID NO: 1929226 - RNA, 14 nt, Human
agcugcaggggcau

SEQ ID NO: 1929227 - RNA, 19 nt, Human
agcuguuacugucuucagu

SEQ ID NO: 1929228 - RNA, 14 nt, Human
ugccuguggaacug

SEQ ID NO: 1929229 - RNA, 21 nt, Human
ugccuuacccucauguucuua

SEQ ID NO: 1929230 - RNA, 16 nt, Human
ugccuuggggacaaga

SEQ ID NO: 1929231 - RNA, 20 nt, Human
ugccuuacccucauguucuu

SEQ ID NO: 1929232 - RNA, 16 nt, Human
ugccuguugggccagg

SEQ ID NO: 1929233 - RNA, 17 nt, Human
ugccuguugggccagga

SEQ ID NO: 1929234 - RNA, 16 nt, Human
agcugggacuacaggu

SEQ ID NO: 1929235 - RNA, 20 nt, Human
agcugggguggggaccucag

SEQ ID NO: 1929236 - RNA, 23 nt, Human
agcugggacuacaggcacccacc

SEQ ID NO: 1929237 - RNA, 20 nt, Human
agcugggacuacaggcaccc

SEQ ID NO: 1929238 - RNA, 22 nt, Human
agcugggguggggaccucaggc

SEQ ID NO: 1929239 - RNA, 23 nt, Human
agcugggguggggaccucaggcc

SEQ ID NO: 1929240 - RNA, 19 nt, Human
agcugggguucaugacaau

SEQ ID NO: 1929241 - RNA, 14 nt, Human
agcugggucaggca

SEQ ID NO: 1929242 - RNA, 18 nt, Human
agcugugcucuggacagg

SEQ ID NO: 1929243 - RNA, 17 nt, Human
agcugugcucuggacag

SEQ ID NO: 1929244 - RNA, 18 nt, Human
agcuguuacugucuucag

SEQ ID NO: 1929245 - RNA, 16 nt, Human
agcugccuguucagcu

SEQ ID NO: 1929246 - RNA, 14 nt, Human
agcugccuguucag

SEQ ID NO: 1929247 - RNA, 18 nt, Human
agcugccuguucagcucc

SEQ ID NO: 1929248 - RNA, 19 nt, Human
agcugccuguucagcucca

SEQ ID NO: 1929249 - RNA, 16 nt, Human
ugccuggauggggcug

SEQ ID NO: 1929250 - RNA, 17 nt, Human
ugccuggauggggcugc

SEQ ID NO: 1929251 - RNA, 20 nt, Human
ugccuggauggggcugcacc

SEQ ID NO: 1929252 - RNA, 21 nt, Human
ugccuggauggggcugcaccg

SEQ ID NO: 1929253 - RNA, 20 nt, Human
agcugcuugggcuucauccu

SEQ ID NO: 1929254 - RNA, 16 nt, Human
agcugcuugggcuuca

SEQ ID NO: 1929255 - RNA, 22 nt, Human
agcuggccgcgccaaauaaugu

SEQ ID NO: 1929256 - RNA, 17 nt, Human
ugccucugccucugaca

SEQ ID NO: 1929257 - RNA, 21 nt, Human
ugccuccagggcuggacugag

SEQ ID NO: 1929258 - RNA, 20 nt, Human
ugccuccagggcuggacuga

SEQ ID NO: 1929259 - RNA, 19 nt, Human
ugccuccagggcuggacug

SEQ ID NO: 1929260 - RNA, 18 nt, Human
ugccuccagggcuggacu

SEQ ID NO: 1929261 - RNA, 20 nt, Human
ugccucugccucugacacac

SEQ ID NO: 1929262 - RNA, 18 nt, Human
ugccucugccucugacac

SEQ ID NO: 1929263 - RNA, 14 nt, Human
ugccucagccuccc

SEQ ID NO: 1929264 - RNA, 19 nt, Human
ugccucagcccugacccug

SEQ ID NO: 1929265 - RNA, 17 nt, Human
ugccuccagggcuggac

SEQ ID NO: 1929266 - RNA, 16 nt, Human
ugccuccagggcugga

SEQ ID NO: 1929267 - RNA, 15 nt, Human
ugccuccagggcugg

SEQ ID NO: 1929268 - RNA, 14 nt, Human
ugccuccagggcug

SEQ ID NO: 1929269 - RNA, 12 nt, Human
ugccuccagggc

SEQ ID NO: 1929270 - RNA, 19 nt, Human
ugccuccaggaaccacacc

SEQ ID NO: 1929271 - RNA, 20 nt, Human
ugccuccaggaaccacacca

SEQ ID NO: 1929272 - RNA, 14 nt, Human
ugccuccaggaacc

SEQ ID NO: 1929273 - RNA, 17 nt, Human
ugccuccaggaaccaca

SEQ ID NO: 1929274 - RNA, 23 nt, Human
ugccugcccaggccccugccacc

SEQ ID NO: 1929275 - RNA, 22 nt, Human
ugccugcccaggccccugccac

SEQ ID NO: 1929276 - RNA, 20 nt, Human
ugccugcccaggccccugcc

SEQ ID NO: 1929277 - RNA, 23 nt, Human
ugccuccagggcuggacugaggc

SEQ ID NO: 1929278 - RNA, 24 nt, Human
ugccugcccaggccccugccaccc

SEQ ID NO: 1929279 - RNA, 22 nt, Human
ugccugcuuuuuauggccugug

SEQ ID NO: 1929280 - RNA, 20 nt, Human
ugccugcuuuuuauggccug

SEQ ID NO: 1929281 - RNA, 21 nt, Human
ugccugcuuuuuauggccugu

SEQ ID NO: 1929282 - RNA, 21 nt, Human
aggaagaucucugcagggccg

SEQ ID NO: 1929283 - RNA, 20 nt, Human
aggaagaucucugcagggcc

SEQ ID NO: 1929284 - RNA, 13 nt, Human
aggaagccagcag

SEQ ID NO: 1929285 - RNA, 15 nt, Human
aggaagccaaagagu

SEQ ID NO: 1929286 - RNA, 13 nt, Human
aggaagcucaggg

SEQ ID NO: 1929287 - RNA, 14 nt, Human
aggaagcucagggc

SEQ ID NO: 1929288 - RNA, 23 nt, Human
aggaauuaaguuagggaauggca

SEQ ID NO: 1929289 - RNA, 16 nt, Human
aggaauguguggccug

SEQ ID NO: 1929290 - RNA, 15 nt, Human
aggaagcucagggcc

SEQ ID NO: 1929291 - RNA, 16 nt, Human
aggaagcucagggccu

SEQ ID NO: 1929292 - RNA, 16 nt, Human
aggaagccacagcugg

SEQ ID NO: 1929293 - RNA, 15 nt, Human
aggaagccacagcug

SEQ ID NO: 1929294 - RNA, 18 nt, Human
aggaagccacagcuggug

SEQ ID NO: 1929295 - RNA, 20 nt, Human
ugcugagccucugcucccca

SEQ ID NO: 1929296 - RNA, 16 nt, Human
ugcugagccucugcuc

SEQ ID NO: 1929297 - RNA, 17 nt, Human
ugcugagccucugcucc

SEQ ID NO: 1929298 - RNA, 12 nt, Human
ugcugagccucu

SEQ ID NO: 1929299 - RNA, 14 nt, Human
ugcugagccucugc

SEQ ID NO: 1929300 - RNA, 14 nt, Human
ugcugagagaaaua

SEQ ID NO: 1929301 - RNA, 17 nt, Human
ugcugagaagcuuuuga

SEQ ID NO: 1929302 - RNA, 23 nt, Human
ugcugagagaaauauggaacuua

SEQ ID NO: 1929303 - RNA, 16 nt, Human
ugcucugcugacagac

SEQ ID NO: 1929304 - RNA, 15 nt, Human
ugcucugcugacaga

SEQ ID NO: 1929305 - RNA, 14 nt, Human
ugcucugcugacag

SEQ ID NO: 1929306 - RNA, 14 nt, Human
ugcugagaagcuuu

SEQ ID NO: 1929307 - RNA, 21 nt, Human
ugcuccagcuguucagcuggu

SEQ ID NO: 1929308 - RNA, 16 nt, Human
aggaaaagcugcugac

SEQ ID NO: 1929309 - RNA, 14 nt, Human
aggaaacaacagcu

SEQ ID NO: 1929310 - RNA, 15 nt, Human
aggaaacaacagcuu

SEQ ID NO: 1929311 - RNA, 13 nt, Human
ugcuaucuccccc

SEQ ID NO: 1929312 - RNA, 14 nt, Human
ugcuaucuccccca

SEQ ID NO: 1929313 - RNA, 17 nt, Human
ugcuaucucccccagcc

SEQ ID NO: 1929314 - RNA, 18 nt, Human
ugcuaucucccccagccc

SEQ ID NO: 1929315 - RNA, 16 nt, Human
ugcuaugagcugggga

SEQ ID NO: 1929316 - RNA, 20 nt, Human
ugcuaugagcuggggauguc

SEQ ID NO: 1929317 - RNA, 19 nt, Human
ugcuaugagcuggggaugu

SEQ ID NO: 1929318 - RNA, 22 nt, Human
ugcuaugagcuggggaugucuc

SEQ ID NO: 1929319 - RNA, 13 nt, Human
ugcuauuugcaau

SEQ ID NO: 1929320 - RNA, 23 nt, Human
ugcuaaucagggaggucauuuug

SEQ ID NO: 1929321 - RNA, 22 nt, Human
ugcuaaucagggaggucauuuu

SEQ ID NO: 1929322 - RNA, 18 nt, Human
ugcgguagccagcacaca

SEQ ID NO: 1929323 - RNA, 21 nt, Human
ugcuaaugucaaacuugaguc

SEQ ID NO: 1929324 - RNA, 15 nt, Human
ugcgguccacccagg

SEQ ID NO: 1929325 - RNA, 14 nt, Human
ugcgguccacccag

SEQ ID NO: 1929326 - RNA, 15 nt, Human
ugcgguagccagcac

SEQ ID NO: 1929327 - RNA, 16 nt, Human
ugcgguagccagcaca

SEQ ID NO: 1929328 - RNA, 17 nt, Human
ugcgguagccagcacac

SEQ ID NO: 1929329 - RNA, 16 nt, Human
ugccuuggugugcugu

SEQ ID NO: 1929330 - RNA, 13 nt, Human
agcuguuuaugca

SEQ ID NO: 1929331 - RNA, 14 nt, Human
agcuguuuccauag

SEQ ID NO: 1929332 - RNA, 16 nt, Human
ugcuaauuuugaaaaa

SEQ ID NO: 1929333 - RNA, 18 nt, Human
ugcuaauuuugaaaaacu

SEQ ID NO: 1929334 - RNA, 19 nt, Human
ugcuaauuuugaaaaacug

SEQ ID NO: 1929335 - RNA, 20 nt, Human
ugcuaauuuugaaaaacugc

SEQ ID NO: 1929336 - RNA, 15 nt, Human
ugcuacaggggccag

SEQ ID NO: 1929337 - RNA, 21 nt, Human
ugcuacaggggccagaagaug

SEQ ID NO: 1929338 - RNA, 14 nt, Human
aggaaaagcugcug

SEQ ID NO: 1929339 - RNA, 20 nt, Human
aggaaaagcggacaucagcu

SEQ ID NO: 1929340 - RNA, 21 nt, Human
agcuuuggcuaugagggccuu

SEQ ID NO: 1929341 - RNA, 13 nt, Human
agcuuugcugcug

SEQ ID NO: 1929342 - RNA, 22 nt, Human
agcuuugcugcugaaggcucau

SEQ ID NO: 1929343 - RNA, 20 nt, Human
agcuuugcuucucucucuaa

SEQ ID NO: 1929344 - RNA, 20 nt, Human
agcuuuggcuaugagggccu

SEQ ID NO: 1929345 - RNA, 22 nt, Human
agcuuugagguggaagagggcu

SEQ ID NO: 1929346 - RNA, 19 nt, Human
agcuuacaagccagcugga

SEQ ID NO: 1929347 - RNA, 17 nt, Human
agcuuacaagccagcug

SEQ ID NO: 1929348 - RNA, 15 nt, Human
agcuuacaagccagc

SEQ ID NO: 1929349 - RNA, 20 nt, Human
agcuugaccgugaggccaga

SEQ ID NO: 1929350 - RNA, 22 nt, Human
agcuugaccgugaggccagaga

SEQ ID NO: 1929351 - RNA, 23 nt, Human
agcuugaccgugaggccagagac

SEQ ID NO: 1929352 - RNA, 20 nt, Human
agcuugcccuggugccucac

SEQ ID NO: 1929353 - RNA, 16 nt, Human
agcuuguuauuuauaa

SEQ ID NO: 1929354 - RNA, 12 nt, Human
ugguuaggaugg

SEQ ID NO: 1929355 - RNA, 22 nt, Human
ugguuaggauggcaggacgugg

SEQ ID NO: 1929356 - RNA, 14 nt, Human
ugguuauggagagg

SEQ ID NO: 1929357 - RNA, 15 nt, Human
ugguuuguaaauuaa

SEQ ID NO: 1929358 - RNA, 14 nt, Human
ugguuuucaaaaua

SEQ ID NO: 1929359 - RNA, 21 nt, Human
ugguuugccgguggugcaggu

SEQ ID NO: 1929360 - RNA, 15 nt, Human
ugguuuucaaaauaa

SEQ ID NO: 1929361 - RNA, 17 nt, Human
ugguuuucaaaauaaaa

SEQ ID NO: 1929362 - RNA, 16 nt, Human
uguaaaggaauuuaaa

SEQ ID NO: 1929363 - RNA, 16 nt, Human
uguaaaggagucaaaa

SEQ ID NO: 1929364 - RNA, 19 nt, Human
uguaaaggagucaaaacua

SEQ ID NO: 1929365 - RNA, 21 nt, Human
uguaaaggagucaaaacuaca

SEQ ID NO: 1929366 - RNA, 15 nt, Human
uguaaaguccccaga

SEQ ID NO: 1929367 - RNA, 13 nt, Human
uguaaauaaagcc

SEQ ID NO: 1929368 - RNA, 14 nt, Human
uguaaauaaagccc

SEQ ID NO: 1929369 - RNA, 21 nt, Human
uguaaaguuauucuugaaguc

SEQ ID NO: 1929370 - RNA, 14 nt, Human
uguaaauaaaaaga

SEQ ID NO: 1929371 - RNA, 17 nt, Human
uguaaauaaaggaacca

SEQ ID NO: 1929372 - RNA, 18 nt, Human
uguaaauaaagcccuggg

SEQ ID NO: 1929373 - RNA, 16 nt, Human
aggugauauauuuaaa

SEQ ID NO: 1929374 - RNA, 16 nt, Human
uguaaauagcucaggu

SEQ ID NO: 1929375 - RNA, 15 nt, Human
uguaaauagcucagg

SEQ ID NO: 1929376 - RNA, 20 nt, Human
aggugugcucugaucaucca

SEQ ID NO: 1929377 - RNA, 15 nt, Human
aggugugcucugauc

SEQ ID NO: 1929378 - RNA, 17 nt, Human
aggugugaaccaccaca

SEQ ID NO: 1929379 - RNA, 13 nt, Human
aggugucuguauc

SEQ ID NO: 1929380 - RNA, 19 nt, Human
agguggggucacucuggca

SEQ ID NO: 1929381 - RNA, 14 nt, Human
agguuuaagcuguu

SEQ ID NO: 1929382 - RNA, 20 nt, Human
aggugcauauuuauaaaaau

SEQ ID NO: 1929383 - RNA, 18 nt, Human
aggugauauauuuaaaaa

SEQ ID NO: 1929384 - RNA, 18 nt, Human
aggugauauccauucuuu

SEQ ID NO: 1929385 - RNA, 19 nt, Human
aggugauauccauucuuuc

SEQ ID NO: 1929386 - RNA, 22 nt, Human
aggugauauccauucuuucuga

SEQ ID NO: 1929387 - RNA, 20 nt, Human
aggugauccacccaccucag

SEQ ID NO: 1929388 - RNA, 14 nt, Human
aggugauccaccca

SEQ ID NO: 1929389 - RNA, 22 nt, Human
aggugcccagaaugaggcugcu

SEQ ID NO: 1929390 - RNA, 18 nt, Human
aggugcccagaaugaggc

SEQ ID NO: 1929391 - RNA, 23 nt, Human
agguggggcagcuugaggguugg

SEQ ID NO: 1929392 - RNA, 18 nt, Human
aggugggauccuccaggu

SEQ ID NO: 1929393 - RNA, 16 nt, Human
aggugggauccuccag

SEQ ID NO: 1929394 - RNA, 17 nt, Human
aggugggauccuccagg

SEQ ID NO: 1929395 - RNA, 15 nt, Human
aggugggauccucca

SEQ ID NO: 1929396 - RNA, 18 nt, Human
aggugccucaagagaagg

SEQ ID NO: 1929397 - RNA, 24 nt, Human
uggugccuggccuggcacacauca

SEQ ID NO: 1929398 - RNA, 23 nt, Human
uggugccuggccuggcacacauc

SEQ ID NO: 1929399 - RNA, 22 nt, Human
uggugccuggccuggcacacau

SEQ ID NO: 1929400 - RNA, 19 nt, Human
uggugccuggccuggcaca

SEQ ID NO: 1929401 - RNA, 18 nt, Human
uggugccuggccuggcac

SEQ ID NO: 1929402 - RNA, 17 nt, Human
uggugccuggccuggca

SEQ ID NO: 1929403 - RNA, 14 nt, Human
uggugccuggccug

SEQ ID NO: 1929404 - RNA, 13 nt, Human
uggugccuggccu

SEQ ID NO: 1929405 - RNA, 12 nt, Human
uggugccuggcc

SEQ ID NO: 1929406 - RNA, 20 nt, Human
aggugauaaaugucaguagu

SEQ ID NO: 1929407 - RNA, 19 nt, Human
uggugcugcugcugcugug

SEQ ID NO: 1929408 - RNA, 15 nt, Human
uggugcugagaagcu

SEQ ID NO: 1929409 - RNA, 13 nt, Human
uggugcugagaag

SEQ ID NO: 1929410 - RNA, 17 nt, Human
uggugcgaucuggguuc

SEQ ID NO: 1929411 - RNA, 16 nt, Human
uggugcgaucuggguu

SEQ ID NO: 1929412 - RNA, 12 nt, Human
ugguggcagugg

SEQ ID NO: 1929413 - RNA, 15 nt, Human
ugguggcagcugcgg

SEQ ID NO: 1929414 - RNA, 13 nt, Human
ugguggcagcugc

SEQ ID NO: 1929415 - RNA, 14 nt, Human
ugguggcagcugcg

SEQ ID NO: 1929416 - RNA, 18 nt, Human
ugguuaggcauuguggga

SEQ ID NO: 1929417 - RNA, 20 nt, Human
ugguuaggcauugugggaag

SEQ ID NO: 1929418 - RNA, 23 nt, Human
uggugugaccacugcagaagaca

SEQ ID NO: 1929419 - RNA, 20 nt, Human
uggugucuccaaccccccag

SEQ ID NO: 1929420 - RNA, 19 nt, Human
uggugucuccaacccccca

SEQ ID NO: 1929421 - RNA, 11 nt, Human
uggugucucca

SEQ ID NO: 1929422 - RNA, 18 nt, Human
aggucagagccugcaguu

SEQ ID NO: 1929423 - RNA, 17 nt, Human
aggucagagccugcagu

SEQ ID NO: 1929424 - RNA, 15 nt, Human
aggucagagccugca

SEQ ID NO: 1929425 - RNA, 14 nt, Human
aggucagagccugc

SEQ ID NO: 1929426 - RNA, 13 nt, Human
aggucagagccug

SEQ ID NO: 1929427 - RNA, 16 nt, Human
uggucagauuugaacu

SEQ ID NO: 1929428 - RNA, 15 nt, Human
uggucagauuugaac

SEQ ID NO: 1929429 - RNA, 16 nt, Human
aggucuugaacuccug

SEQ ID NO: 1929430 - RNA, 15 nt, Human
aggucaggaguuccu

SEQ ID NO: 1929431 - RNA, 20 nt, Human
aggucaggaguuccuaacca

SEQ ID NO: 1929432 - RNA, 16 nt, Human
aggucaggaguuccua

SEQ ID NO: 1929433 - RNA, 15 nt, Human
aggugacagagugag

SEQ ID NO: 1929434 - RNA, 13 nt, Human
aggugacagagug

SEQ ID NO: 1929435 - RNA, 17 nt, Human
aggucuugaacuccugg

SEQ ID NO: 1929436 - RNA, 18 nt, Human
aggucuugaacuccuggc

SEQ ID NO: 1929437 - RNA, 20 nt, Human
aggucuucaucgaaucuacu

SEQ ID NO: 1929438 - RNA, 21 nt, Human
aggucuucaucgaaucuacua

SEQ ID NO: 1929439 - RNA, 13 nt, Human
aggugaccccagg

SEQ ID NO: 1929440 - RNA, 22 nt, Human
aggugacagagugagacucugu

SEQ ID NO: 1929441 - RNA, 21 nt, Human
aggugagaagcagaggaagga

SEQ ID NO: 1929442 - RNA, 23 nt, Human
aggugagaagcagaggaaggaga

SEQ ID NO: 1929443 - RNA, 16 nt, Human
aggugagaagcagagg

SEQ ID NO: 1929444 - RNA, 19 nt, Human
uguaugucuuggacacugu

SEQ ID NO: 1929445 - RNA, 14 nt, Human
uguaugucuuggac

SEQ ID NO: 1929446 - RNA, 18 nt, Human
uguaugucucgugguagg

SEQ ID NO: 1929447 - RNA, 12 nt, Human
uguauguggggg

SEQ ID NO: 1929448 - RNA, 20 nt, Human
uguaugugggggucugugug

SEQ ID NO: 1929449 - RNA, 23 nt, Human
uguaucacucugugucugagugg

SEQ ID NO: 1929450 - RNA, 19 nt, Human
uguaucaguggauuuccca

SEQ ID NO: 1929451 - RNA, 17 nt, Human
uguaucaaugaguaaca

SEQ ID NO: 1929452 - RNA, 23 nt, Human
uguauauuugugauagcacuuuc

SEQ ID NO: 1929453 - RNA, 22 nt, Human
uguauauuugugauagcacuuu

SEQ ID NO: 1929454 - RNA, 13 nt, Human
uguauuacaaauc

SEQ ID NO: 1929455 - RNA, 19 nt, Human
uguauguucagaagaaauu

SEQ ID NO: 1929456 - RNA, 22 nt, Human
uguauuacaaauccaaugaaau

SEQ ID NO: 1929457 - RNA, 17 nt, Human
uguauucccaguuacuu

SEQ ID NO: 1929458 - RNA, 17 nt, Human
uguauguuuuuuuucug

SEQ ID NO: 1929459 - RNA, 20 nt, Human
uguauucucuccuguaccuc

SEQ ID NO: 1929460 - RNA, 19 nt, Human
uguauucucuccuguaccu

SEQ ID NO: 1929461 - RNA, 18 nt, Human
ugucaaggcugcuuagaa

SEQ ID NO: 1929462 - RNA, 19 nt, Human
ugucaaggcugcuuagaau

SEQ ID NO: 1929463 - RNA, 18 nt, Human
aguauuacuucugcuaca

SEQ ID NO: 1929464 - RNA, 17 nt, Human
aguaugguggcuggguu

SEQ ID NO: 1929465 - RNA, 15 nt, Human
aguauuacuucugcu

SEQ ID NO: 1929466 - RNA, 16 nt, Human
aguaugguggcugggu

SEQ ID NO: 1929467 - RNA, 15 nt, Human
aguaugguggcuggg

SEQ ID NO: 1929468 - RNA, 19 nt, Human
ugucaauuacaggaaguac

SEQ ID NO: 1929469 - RNA, 17 nt, Human
ugucaauuacaggaagu

SEQ ID NO: 1929470 - RNA, 14 nt, Human
ugucaauuacagga

SEQ ID NO: 1929471 - RNA, 15 nt, Human
ugucaauuacaggaa

SEQ ID NO: 1929472 - RNA, 23 nt, Human
agucacacagugagucgaggaca

SEQ ID NO: 1929473 - RNA, 15 nt, Human
agucacacagugagu

SEQ ID NO: 1929474 - RNA, 19 nt, Human
agucaccccggccaccugc

SEQ ID NO: 1929475 - RNA, 23 nt, Human
agucacacaguauuacuucugcu

SEQ ID NO: 1929476 - RNA, 13 nt, Human
aguaaaauccaca

SEQ ID NO: 1929477 - RNA, 19 nt, Human
aguaaaauaaauauugucu

SEQ ID NO: 1929478 - RNA, 13 nt, Human
agguuuuuauuag

SEQ ID NO: 1929479 - RNA, 15 nt, Human
agguuuuuauuagua

SEQ ID NO: 1929480 - RNA, 20 nt, Human
agguuuuuauuaguaccaua

SEQ ID NO: 1929481 - RNA, 15 nt, Human
aguaauaugcacaca

SEQ ID NO: 1929482 - RNA, 14 nt, Human
aguaauaugcacac

SEQ ID NO: 1929483 - RNA, 22 nt, Human
aguaaaauaaauauugucuuuu

SEQ ID NO: 1929484 - RNA, 20 nt, Human
aguaaaauaaauauugucuu

SEQ ID NO: 1929485 - RNA, 18 nt, Human
uguagagccagggucuca

SEQ ID NO: 1929486 - RNA, 16 nt, Human
uguagagccagggucu

SEQ ID NO: 1929487 - RNA, 23 nt, Human
uguagaaaagggaacugaacauu

SEQ ID NO: 1929488 - RNA, 23 nt, Human
agguuuguuuagaagaagugugu

SEQ ID NO: 1929489 - RNA, 16 nt, Human
uguagaggagaaacug

SEQ ID NO: 1929490 - RNA, 22 nt, Human
uguacuugcucuugaugccugg

SEQ ID NO: 1929491 - RNA, 23 nt, Human
uguacuugcucuugaugccuggc

SEQ ID NO: 1929492 - RNA, 18 nt, Human
agguuuaggcugguggcc

SEQ ID NO: 1929493 - RNA, 20 nt, Human
agguuuaggcugguggccca

SEQ ID NO: 1929494 - RNA, 21 nt, Human
agguuuaggcugguggcccag

SEQ ID NO: 1929495 - RNA, 21 nt, Human
uguagaaaagggaacugaaca

SEQ ID NO: 1929496 - RNA, 20 nt, Human
uguagaaaagggaacugaac

SEQ ID NO: 1929497 - RNA, 19 nt, Human
uguagaaaagggaacugaa

SEQ ID NO: 1929498 - RNA, 18 nt, Human
uguagaaaagggaacuga

SEQ ID NO: 1929499 - RNA, 11 nt, Human
uguacuuugug

SEQ ID NO: 1929500 - RNA, 17 nt, Human
uguaggcauaaagucag

SEQ ID NO: 1929501 - RNA, 20 nt, Human
uguaggcauaaagucagggg

SEQ ID NO: 1929502 - RNA, 19 nt, Human
uguaguaauugacaugugc

SEQ ID NO: 1929503 - RNA, 18 nt, Human
uguaguaauugacaugug

SEQ ID NO: 1929504 - RNA, 11 nt, Human
aguagagacag

SEQ ID NO: 1929505 - RNA, 14 nt, Human
aguagcauuuacug

SEQ ID NO: 1929506 - RNA, 14 nt, Human
aguagaauugcauu

SEQ ID NO: 1929507 - RNA, 15 nt, Human
aguagaauugcauug

SEQ ID NO: 1929508 - RNA, 22 nt, Human
aguagcauuuacugugucuuug

SEQ ID NO: 1929509 - RNA, 14 nt, Human
aguacauguuaaac

SEQ ID NO: 1929510 - RNA, 21 nt, Human
aguagaagucuuagauguaua

SEQ ID NO: 1929511 - RNA, 19 nt, Human
aguagaagucuuagaugua

SEQ ID NO: 1929512 - RNA, 20 nt, Human
aguagaagucuuagauguau

SEQ ID NO: 1929513 - RNA, 14 nt, Human
aguaccauuuauac

SEQ ID NO: 1929514 - RNA, 21 nt, Human
aguaccauuuauacaaauuag

SEQ ID NO: 1929515 - RNA, 18 nt, Human
ugggagaccuguaaucau

SEQ ID NO: 1929516 - RNA, 18 nt, Human
ugggagaaugucaguuca

SEQ ID NO: 1929517 - RNA, 19 nt, Human
ugggagagaagagaaugca

SEQ ID NO: 1929518 - RNA, 21 nt, Human
ugggagagaagagaaugcaca

SEQ ID NO: 1929519 - RNA, 18 nt, Human
ugggaggaucucuugagc

SEQ ID NO: 1929520 - RNA, 16 nt, Human
ugggagagccuuccag

SEQ ID NO: 1929521 - RNA, 20 nt, Human
ugggacucaaugcacugaca

SEQ ID NO: 1929522 - RNA, 21 nt, Human
ugggacguggcucagccagca

SEQ ID NO: 1929523 - RNA, 22 nt, Human
ugggagaaugucaguaugugga

SEQ ID NO: 1929524 - RNA, 20 nt, Human
ugggagaaugucaguaugug

SEQ ID NO: 1929525 - RNA, 19 nt, Human
ugggagaaugucaguaugu

SEQ ID NO: 1929526 - RNA, 23 nt, Human
agggacacgggcagccuggcucc

SEQ ID NO: 1929527 - RNA, 20 nt, Human
agggacacgggcagccuggc

SEQ ID NO: 1929528 - RNA, 19 nt, Human
agggacaaguggacucagg

SEQ ID NO: 1929529 - RNA, 16 nt, Human
agggacagaggcccca

SEQ ID NO: 1929530 - RNA, 19 nt, Human
agggagcaaguccuucccu

SEQ ID NO: 1929531 - RNA, 21 nt, Human
agggagcaaguccuucccuuu

SEQ ID NO: 1929532 - RNA, 15 nt, Human
agggagcugcagggg

SEQ ID NO: 1929533 - RNA, 16 nt, Human
ugggacuacaggcacc

SEQ ID NO: 1929534 - RNA, 15 nt, Human
ugggacuacaggcac

SEQ ID NO: 1929535 - RNA, 14 nt, Human
ugggacuacaggca

SEQ ID NO: 1929536 - RNA, 22 nt, Human
agggaggacgcucucuggccuu

SEQ ID NO: 1929537 - RNA, 21 nt, Human
agggaggacgcucucuggccu

SEQ ID NO: 1929538 - RNA, 23 nt, Human
agggaggacgcucucuggccuuc

SEQ ID NO: 1929539 - RNA, 13 nt, Human
agggaaauuucag

SEQ ID NO: 1929540 - RNA, 22 nt, Human
aggcccucccuguuccccagag

SEQ ID NO: 1929541 - RNA, 23 nt, Human
aggcccucccuguuccccagaga

SEQ ID NO: 1929542 - RNA, 22 nt, Human
aggcccuaucuguuuacagugu

SEQ ID NO: 1929543 - RNA, 20 nt, Human
aggcccucccuguuccccag

SEQ ID NO: 1929544 - RNA, 20 nt, Human
aggcccggcuccaggcuccu

SEQ ID NO: 1929545 - RNA, 18 nt, Human
aggcccggcuccaggcuc

SEQ ID NO: 1929546 - RNA, 21 nt, Human
aggcccggcuccaggcuccuu

SEQ ID NO: 1929547 - RNA, 22 nt, Human
agggaaggauacaaaagcaugu

SEQ ID NO: 1929548 - RNA, 15 nt, Human
agggaauggcacagc

SEQ ID NO: 1929549 - RNA, 16 nt, Human
agggaauugcagagua

SEQ ID NO: 1929550 - RNA, 13 nt, Human
agggacaaagagg

SEQ ID NO: 1929551 - RNA, 22 nt, Human
agggacaaguggacucagggca

SEQ ID NO: 1929552 - RNA, 13 nt, Human
agggaaguuuugu

SEQ ID NO: 1929553 - RNA, 17 nt, Human
agggcagcgccaggcug

SEQ ID NO: 1929554 - RNA, 23 nt, Human
agggcagcgggagccucccugcc

SEQ ID NO: 1929555 - RNA, 16 nt, Human
agggagggcuccagac

SEQ ID NO: 1929556 - RNA, 14 nt, Human
agggagggcuccag

SEQ ID NO: 1929557 - RNA, 15 nt, Human
agggagggcuccaga

SEQ ID NO: 1929558 - RNA, 23 nt, Human
agggcucagcggggacagcuccu

SEQ ID NO: 1929559 - RNA, 22 nt, Human
agggcucagcggggacagcucc

SEQ ID NO: 1929560 - RNA, 20 nt, Human
agggcucagcggggacagcu

SEQ ID NO: 1929561 - RNA, 19 nt, Human
agggcucagcggggacagc

SEQ ID NO: 1929562 - RNA, 11 nt, Human
agggccagagc

SEQ ID NO: 1929563 - RNA, 12 nt, Human
agggccagagcc

SEQ ID NO: 1929564 - RNA, 13 nt, Human
agggccagagcca

SEQ ID NO: 1929565 - RNA, 14 nt, Human
agggccagagccag

SEQ ID NO: 1929566 - RNA, 15 nt, Human
agggccagagccagg

SEQ ID NO: 1929567 - RNA, 16 nt, Human
agggccagagccaggg

SEQ ID NO: 1929568 - RNA, 20 nt, Human
ugggccccugccucucugca

SEQ ID NO: 1929569 - RNA, 15 nt, Human
ugggccccugccaga

SEQ ID NO: 1929570 - RNA, 13 nt, Human
agggaggcaagcc

SEQ ID NO: 1929571 - RNA, 14 nt, Human
agggaggcaagccc

SEQ ID NO: 1929572 - RNA, 16 nt, Human
agggaggcaagcccug

SEQ ID NO: 1929573 - RNA, 15 nt, Human
ugggccccugccucu

SEQ ID NO: 1929574 - RNA, 19 nt, Human
ugggccccugccucucugc

SEQ ID NO: 1929575 - RNA, 15 nt, Human
agggagggagggcuc

SEQ ID NO: 1929576 - RNA, 13 nt, Human
agggagggcucca

SEQ ID NO: 1929577 - RNA, 15 nt, Human
agggaggcaagcccu

SEQ ID NO: 1929578 - RNA, 16 nt, Human
ugggcccccaaaugga

SEQ ID NO: 1929579 - RNA, 21 nt, Human
ugggcccccaaauggaaaugg

SEQ ID NO: 1929580 - RNA, 12 nt, Human
ugggcagaagga

SEQ ID NO: 1929581 - RNA, 11 nt, Human
ugggcagagca

SEQ ID NO: 1929582 - RNA, 12 nt, Human
ugggcagagcag

SEQ ID NO: 1929583 - RNA, 18 nt, Human
ugggccaggagccuccug

SEQ ID NO: 1929584 - RNA, 13 nt, Human
ugggcagagcaga

SEQ ID NO: 1929585 - RNA, 20 nt, Human
ugggaggaucucuugagccu

SEQ ID NO: 1929586 - RNA, 21 nt, Human
ugggaggaucucuugagccug

SEQ ID NO: 1929587 - RNA, 22 nt, Human
ugggaggaucucuugagccugg

SEQ ID NO: 1929588 - RNA, 19 nt, Human
ugggaggccaaggugggag

SEQ ID NO: 1929589 - RNA, 20 nt, Human
ugggaggccaaggugggagg

SEQ ID NO: 1929590 - RNA, 12 nt, Human
ugggcacugaag

SEQ ID NO: 1929591 - RNA, 23 nt, Human
ugggguccuguggggcccccaca

SEQ ID NO: 1929592 - RNA, 22 nt, Human
ugggguccuguggggcccccac

SEQ ID NO: 1929593 - RNA, 19 nt, Human
ugggguccuggccauccca

SEQ ID NO: 1929594 - RNA, 15 nt, Human
ugggguccuggccau

SEQ ID NO: 1929595 - RNA, 16 nt, Human
ugggguccuggccauc

SEQ ID NO: 1929596 - RNA, 13 nt, Human
uggggucccucua

SEQ ID NO: 1929597 - RNA, 12 nt, Human
ugggguccuggc

SEQ ID NO: 1929598 - RNA, 13 nt, Human
uggggucaugccc

SEQ ID NO: 1929599 - RNA, 18 nt, Human
uggggucaugcccuccuc

SEQ ID NO: 1929600 - RNA, 20 nt, Human
uggggucaugcccuccucuc

SEQ ID NO: 1929601 - RNA, 14 nt, Human
ugggguccagggag

SEQ ID NO: 1929602 - RNA, 16 nt, Human
uggggucacucuggca

SEQ ID NO: 1929603 - RNA, 22 nt, Human
uggggucacucuggcagcucag

SEQ ID NO: 1929604 - RNA, 19 nt, Human
ugggguacccacugcucug

SEQ ID NO: 1929605 - RNA, 13 nt, Human
uggggucacucug

SEQ ID NO: 1929606 - RNA, 14 nt, Human
uggggucacucugg

SEQ ID NO: 1929607 - RNA, 18 nt, Human
ugggguacccacugcucu

SEQ ID NO: 1929608 - RNA, 17 nt, Human
ugggguacccacugcuc

SEQ ID NO: 1929609 - RNA, 14 nt, Human
uggggcuggccucc

SEQ ID NO: 1929610 - RNA, 13 nt, Human
aggggaaaagagg

SEQ ID NO: 1929611 - RNA, 18 nt, Human
uggggucuggcagccucc

SEQ ID NO: 1929612 - RNA, 14 nt, Human
uggggucuggcagc

SEQ ID NO: 1929613 - RNA, 17 nt, Human
uggggucuggcagccuc

SEQ ID NO: 1929614 - RNA, 21 nt, Human
uggggucuggaguugaucugg

SEQ ID NO: 1929615 - RNA, 14 nt, Human
aggggaacagacug

SEQ ID NO: 1929616 - RNA, 18 nt, Human
aggggaaaaucagccugc

SEQ ID NO: 1929617 - RNA, 22 nt, Human
aggggaaaaucagccugcucca

SEQ ID NO: 1929618 - RNA, 13 nt, Human
aggggaauguuug

SEQ ID NO: 1929619 - RNA, 12 nt, Human
uggggcccugcc

SEQ ID NO: 1929620 - RNA, 14 nt, Human
uggggccuccagaa

SEQ ID NO: 1929621 - RNA, 20 nt, Human
uggggccuccagaacucacu

SEQ ID NO: 1929622 - RNA, 21 nt, Human
uggggccaguuggucccccuu

SEQ ID NO: 1929623 - RNA, 22 nt, Human
uggggagggauuuggggcucag

SEQ ID NO: 1929624 - RNA, 22 nt, Human
uggggcugcaccggcuggccug

SEQ ID NO: 1929625 - RNA, 23 nt, Human
uggggcugcaccggcuggccugg

SEQ ID NO: 1929626 - RNA, 15 nt, Human
uggggcucagagugg

SEQ ID NO: 1929627 - RNA, 12 nt, Human
agggcuccagac

SEQ ID NO: 1929628 - RNA, 15 nt, Human
agggcuccagacaca

SEQ ID NO: 1929629 - RNA, 14 nt, Human
uggggaccucaggc

SEQ ID NO: 1929630 - RNA, 15 nt, Human
uggggaccucaggcc

SEQ ID NO: 1929631 - RNA, 16 nt, Human
uggggaccucaggccu

SEQ ID NO: 1929632 - RNA, 17 nt, Human
uggggaccucaggccug

SEQ ID NO: 1929633 - RNA, 16 nt, Human
uggggaggaaauagaa

SEQ ID NO: 1929634 - RNA, 14 nt, Human
uggggagggauuug

SEQ ID NO: 1929635 - RNA, 16 nt, Human
uggggagccaacagaa

SEQ ID NO: 1929636 - RNA, 22 nt, Human
uggggagccaacagaagcuucc

SEQ ID NO: 1929637 - RNA, 15 nt, Human
agggguaugucuuua

SEQ ID NO: 1929638 - RNA, 20 nt, Human
aggggguggccucccaacuc

SEQ ID NO: 1929639 - RNA, 18 nt, Human
aggggugggacacccugu

SEQ ID NO: 1929640 - RNA, 16 nt, Human
agggucucacucuguc

SEQ ID NO: 1929641 - RNA, 15 nt, Human
agggucucacucugu

SEQ ID NO: 1929642 - RNA, 14 nt, Human
agggucucacucug

SEQ ID NO: 1929643 - RNA, 15 nt, Human
aggguaaggcugugg

SEQ ID NO: 1929644 - RNA, 20 nt, Human
agggguggcugccucauuua

SEQ ID NO: 1929645 - RNA, 21 nt, Human
agggguggcugccucauuuag

SEQ ID NO: 1929646 - RNA, 21 nt, Human
aggggaauguuugccucugcc

SEQ ID NO: 1929647 - RNA, 20 nt, Human
aggggaauguuugccucugc

SEQ ID NO: 1929648 - RNA, 19 nt, Human
aggggaauguuugccucug

SEQ ID NO: 1929649 - RNA, 18 nt, Human
aggggagcaugggaagug

SEQ ID NO: 1929650 - RNA, 15 nt, Human
aggggaaucagaacu

SEQ ID NO: 1929651 - RNA, 16 nt, Human
aggggaaucagaacuc

SEQ ID NO: 1929652 - RNA, 12 nt, Human
aggggagcccac

SEQ ID NO: 1929653 - RNA, 13 nt, Human
aggggagcccacu

SEQ ID NO: 1929654 - RNA, 17 nt, Human
aggggagcccacugucc

SEQ ID NO: 1929655 - RNA, 21 nt, Human
aggggagcccacuguccuggg

SEQ ID NO: 1929656 - RNA, 24 nt, Human
aggggagcccacuguccugggccu

SEQ ID NO: 1929657 - RNA, 16 nt, Human
aggguggugaccucug

SEQ ID NO: 1929658 - RNA, 21 nt, Human
agggucuugguuccagccugc

SEQ ID NO: 1929659 - RNA, 16 nt, Human
ugggucgcccuggacu

SEQ ID NO: 1929660 - RNA, 18 nt, Human
ugggucgcccuggacugu

SEQ ID NO: 1929661 - RNA, 19 nt, Human
ugggugaaggcuggcauga

SEQ ID NO: 1929662 - RNA, 14 nt, Human
ugggugacagagca

SEQ ID NO: 1929663 - RNA, 17 nt, Human
ugggugacagagcaaga

SEQ ID NO: 1929664 - RNA, 13 nt, Human
ugggugagaacaa

SEQ ID NO: 1929665 - RNA, 16 nt, Human
ugggugagguaauaaa

SEQ ID NO: 1929666 - RNA, 20 nt, Human
ugguagagugugccugaagu

SEQ ID NO: 1929667 - RNA, 17 nt, Human
uggguggcaccagcagc

SEQ ID NO: 1929668 - RNA, 20 nt, Human
uggguggcaccagcagccug

SEQ ID NO: 1929669 - RNA, 21 nt, Human
uggguggcaccagcagccugg

SEQ ID NO: 1929670 - RNA, 18 nt, Human
uuaaguugcugaugaacu

SEQ ID NO: 1929671 - RNA, 17 nt, Human
uuaauaaacacucuuga

SEQ ID NO: 1929672 - RNA, 13 nt, Human
uuaauaaacacuc

SEQ ID NO: 1929673 - RNA, 14 nt, Human
uuaauaaagacagg

SEQ ID NO: 1929674 - RNA, 13 nt, Human
uuaauaaagacag

SEQ ID NO: 1929675 - RNA, 23 nt, Human
uuaaugaaagacuguacaaagua

SEQ ID NO: 1929676 - RNA, 20 nt, Human
uuaaugaaagacuguacaaa

SEQ ID NO: 1929677 - RNA, 15 nt, Human
uuaauucuuagcuca

SEQ ID NO: 1929678 - RNA, 14 nt, Human
uuaauuuaaagcca

SEQ ID NO: 1929679 - RNA, 15 nt, Human
uuaauuccuuuccag

SEQ ID NO: 1929680 - RNA, 20 nt, Human
auaaaauuuuuaaucuuuaa

SEQ ID NO: 1929681 - RNA, 15 nt, Human
auaaacaaaguuacu

SEQ ID NO: 1929682 - RNA, 22 nt, Human
auaaacaagaccacguuucuaa

SEQ ID NO: 1929683 - RNA, 15 nt, Human
auaaacaagaccacg

SEQ ID NO: 1929684 - RNA, 23 nt, Human
auaaacaagaccacguuucuaaa

SEQ ID NO: 1929685 - RNA, 19 nt, Human
uuaauuuuuuugagacaga

SEQ ID NO: 1929686 - RNA, 16 nt, Human
uuaauuuauacuggca

SEQ ID NO: 1929687 - RNA, 17 nt, Human
uuacaaaacuacaugag

SEQ ID NO: 1929688 - RNA, 18 nt, Human
uuacaaaacuacaugaga

SEQ ID NO: 1929689 - RNA, 20 nt, Human
uuacaaaacuacaugagaac

SEQ ID NO: 1929690 - RNA, 13 nt, Human
uuaagaggcaggg

SEQ ID NO: 1929691 - RNA, 12 nt, Human
uuaagaaggcaa

SEQ ID NO: 1929692 - RNA, 14 nt, Human
uuaagaaggcaaaa

SEQ ID NO: 1929693 - RNA, 16 nt, Human
uuaagaggcagggucu

SEQ ID NO: 1929694 - RNA, 15 nt, Human
uuaagaggcaggguc

SEQ ID NO: 1929695 - RNA, 18 nt, Human
uuaaguaaggaauuuuau

SEQ ID NO: 1929696 - RNA, 22 nt, Human
uuaagugcugcauuuaaaagau

SEQ ID NO: 1929697 - RNA, 22 nt, Human
uuaaguuacacauuuuucagau

SEQ ID NO: 1929698 - RNA, 18 nt, Human
uuaaguuagggaauggca

SEQ ID NO: 1929699 - RNA, 17 nt, Human
uuaaguacuauguauca

SEQ ID NO: 1929700 - RNA, 21 nt, Human
auaaaaguacauguuaaacuu

SEQ ID NO: 1929701 - RNA, 15 nt, Human
auaaaaguacauguu

SEQ ID NO: 1929702 - RNA, 17 nt, Human
auaaaaucugauaugua

SEQ ID NO: 1929703 - RNA, 18 nt, Human
uuaccugggcauucuugu

SEQ ID NO: 1929704 - RNA, 20 nt, Human
uuacauaagauaaaugugcu

SEQ ID NO: 1929705 - RNA, 18 nt, Human
uuacaucaaggcuucaaa

SEQ ID NO: 1929706 - RNA, 23 nt, Human
uuacucagaauucucuaguuuga

SEQ ID NO: 1929707 - RNA, 18 nt, Human
uuacucagaauucucuag

SEQ ID NO: 1929708 - RNA, 19 nt, Human
uuacugagcuucucuguga

SEQ ID NO: 1929709 - RNA, 13 nt, Human
uuacugagcuucu

SEQ ID NO: 1929710 - RNA, 14 nt, Human
uuacugagcuucuc

SEQ ID NO: 1929711 - RNA, 16 nt, Human
uuacugagcuucucug

SEQ ID NO: 1929712 - RNA, 17 nt, Human
uuacugagcuucucugu

SEQ ID NO: 1929713 - RNA, 18 nt, Human
uuacugagcuucucugug

SEQ ID NO: 1929714 - RNA, 11 nt, Human
uuagacagagu

SEQ ID NO: 1929715 - RNA, 12 nt, Human
uuagaacauuuu

SEQ ID NO: 1929716 - RNA, 15 nt, Human
uuagaagaagugugu

SEQ ID NO: 1929717 - RNA, 14 nt, Human
uuagaagaagugug

SEQ ID NO: 1929718 - RNA, 18 nt, Human
uuagaacauuuuaauuca

SEQ ID NO: 1929719 - RNA, 16 nt, Human
uuagaagaaguguguc

SEQ ID NO: 1929720 - RNA, 11 nt, Human
uuagaaauaua

SEQ ID NO: 1929721 - RNA, 12 nt, Human
uuagaaauauaa

SEQ ID NO: 1929722 - RNA, 14 nt, Human
uuagaaauauaauu

SEQ ID NO: 1929723 - RNA, 20 nt, Human
uuacugguaggaacuugaga

SEQ ID NO: 1929724 - RNA, 24 nt, Human
uuacugguaggaacuugagaacuu

SEQ ID NO: 1929725 - RNA, 15 nt, Human
auaaauguacauuaa

SEQ ID NO: 1929726 - RNA, 14 nt, Human
auaacuaaauaaag

SEQ ID NO: 1929727 - RNA, 16 nt, Human
auaacuaaaagguaug

SEQ ID NO: 1929728 - RNA, 15 nt, Human
auaaauguaucuuau

SEQ ID NO: 1929729 - RNA, 18 nt, Human
auaaauguaucuuauuca

SEQ ID NO: 1929730 - RNA, 19 nt, Human
auaacuagaacugaauuuu

SEQ ID NO: 1929731 - RNA, 19 nt, Human
auaacuagauggugcugag

SEQ ID NO: 1929732 - RNA, 20 nt, Human
auaacuagauggugcugaga

SEQ ID NO: 1929733 - RNA, 21 nt, Human
auaacuagauggugcugagaa

SEQ ID NO: 1929734 - RNA, 14 nt, Human
uuacaggaaguacu

SEQ ID NO: 1929735 - RNA, 15 nt, Human
uuacagucuauuuga

SEQ ID NO: 1929736 - RNA, 14 nt, Human
auaaauaacuuuuu

SEQ ID NO: 1929737 - RNA, 19 nt, Human
auaaaguuugcuuagaaaa

SEQ ID NO: 1929738 - RNA, 12 nt, Human
auaaaguuugcu

SEQ ID NO: 1929739 - RNA, 22 nt, Human
auaaauauuauauuauauauau

SEQ ID NO: 1929740 - RNA, 12 nt, Human
auaaauauuaua

SEQ ID NO: 1929741 - RNA, 20 nt, Human
aguugcguggacucugcaca

SEQ ID NO: 1929742 - RNA, 21 nt, Human
aguucuuaguugcuguauguc

SEQ ID NO: 1929743 - RNA, 20 nt, Human
aguucuuaguugcuguaugu

SEQ ID NO: 1929744 - RNA, 16 nt, Human
aguugcguggacucug

SEQ ID NO: 1929745 - RNA, 16 nt, Human
aguuggccagagagcc

SEQ ID NO: 1929746 - RNA, 16 nt, Human
aguuggcuaggacccc

SEQ ID NO: 1929747 - RNA, 21 nt, Human
aguuggguggaugccuggugg

SEQ ID NO: 1929748 - RNA, 18 nt, Human
aguuggucccccuuccau

SEQ ID NO: 1929749 - RNA, 21 nt, Human
aguuguuugauucagacagcu

SEQ ID NO: 1929750 - RNA, 23 nt, Human
aguuguuugauucagacagcugc

SEQ ID NO: 1929751 - RNA, 12 nt, Human
aguuuaaaaaaa

SEQ ID NO: 1929752 - RNA, 14 nt, Human
aguuuaaaaaaauu

SEQ ID NO: 1929753 - RNA, 17 nt, Human
aguuucacugccauaua

SEQ ID NO: 1929754 - RNA, 13 nt, Human
uuaacagggaggg

SEQ ID NO: 1929755 - RNA, 15 nt, Human
uuaaauuucuaccgc

SEQ ID NO: 1929756 - RNA, 20 nt, Human
uuaaauucuugcaaaguauc

SEQ ID NO: 1929757 - RNA, 13 nt, Human
uuaaauaauguga

SEQ ID NO: 1929758 - RNA, 12 nt, Human
uuaaaggaaaaa

SEQ ID NO: 1929759 - RNA, 18 nt, Human
uuaaaauugugauguguc

SEQ ID NO: 1929760 - RNA, 13 nt, Human
uuaaaauugugau

SEQ ID NO: 1929761 - RNA, 18 nt, Human
uguuucuuuguaaugaaa

SEQ ID NO: 1929762 - RNA, 19 nt, Human
uguuucuuuguaaugaaaa

SEQ ID NO: 1929763 - RNA, 17 nt, Human
uguuugauucagacagc

SEQ ID NO: 1929764 - RNA, 22 nt, Human
uguuugauucagacagcugccu

SEQ ID NO: 1929765 - RNA, 21 nt, Human
uguuugacgggaaacaaaacu

SEQ ID NO: 1929766 - RNA, 17 nt, Human
uguuuauugucaaagug

SEQ ID NO: 1929767 - RNA, 19 nt, Human
uguuuauugucaaaguggu

SEQ ID NO: 1929768 - RNA, 16 nt, Human
uguuuaugugugugug

SEQ ID NO: 1929769 - RNA, 13 nt, Human
uguuuaugugugu

SEQ ID NO: 1929770 - RNA, 19 nt, Human
uguugcccaggcaggucuu

SEQ ID NO: 1929771 - RNA, 19 nt, Human
uguugccuugcauaauggu

SEQ ID NO: 1929772 - RNA, 21 nt, Human
uguuuuauuuuaauucaguug

SEQ ID NO: 1929773 - RNA, 21 nt, Human
uguuuuauuuaaccucuaaau

SEQ ID NO: 1929774 - RNA, 20 nt, Human
uguuuuccaugaguccccug

SEQ ID NO: 1929775 - RNA, 12 nt, Human
uguuuucccuga

SEQ ID NO: 1929776 - RNA, 17 nt, Human
uguuuugaaggcaaaau

SEQ ID NO: 1929777 - RNA, 14 nt, Human
uguuuucuugauuu

SEQ ID NO: 1929778 - RNA, 16 nt, Human
uguuuucccugaccuc

SEQ ID NO: 1929779 - RNA, 14 nt, Human
aguucugguuccua

SEQ ID NO: 1929780 - RNA, 16 nt, Human
aguucuuaguugcugu

SEQ ID NO: 1929781 - RNA, 21 nt, Human
aguucugcucauucuaaugau

SEQ ID NO: 1929782 - RNA, 15 nt, Human
aguucugcucauucu

SEQ ID NO: 1929783 - RNA, 16 nt, Human
aguucugcagauaaac

SEQ ID NO: 1929784 - RNA, 21 nt, Human
aguucugcagauaaacaguag

SEQ ID NO: 1929785 - RNA, 16 nt, Human
agugcugaagcuuauu

SEQ ID NO: 1929786 - RNA, 15 nt, Human
agugcugaagcuuau

SEQ ID NO: 1929787 - RNA, 13 nt, Human
agugcugaagcuu

SEQ ID NO: 1929788 - RNA, 12 nt, Human
agugcugaagcu

SEQ ID NO: 1929789 - RNA, 22 nt, Human
agugcugaagcuuauuaaugcu

SEQ ID NO: 1929790 - RNA, 21 nt, Human
agugcugaagcuuauuaaugc

SEQ ID NO: 1929791 - RNA, 23 nt, Human
agugcugaagcuuauuaaugcua

SEQ ID NO: 1929792 - RNA, 13 nt, Human
agugcugcauuua

SEQ ID NO: 1929793 - RNA, 12 nt, Human
agugcugcauuu

SEQ ID NO: 1929794 - RNA, 22 nt, Human
agugaguugauagcacagaccc

SEQ ID NO: 1929795 - RNA, 23 nt, Human
agugaguugauagcacagacccu

SEQ ID NO: 1929796 - RNA, 21 nt, Human
agugcugggauuacaggugug

SEQ ID NO: 1929797 - RNA, 20 nt, Human
agugcugggauuacaggugu

SEQ ID NO: 1929798 - RNA, 19 nt, Human
agugcugcauuuaaaagau

SEQ ID NO: 1929799 - RNA, 17 nt, Human
agugcugcauuuaaaag

SEQ ID NO: 1929800 - RNA, 16 nt, Human
agugcugcauuuaaaa

SEQ ID NO: 1929801 - RNA, 16 nt, Human
uguggucccaccccac

SEQ ID NO: 1929802 - RNA, 13 nt, Human
uguggucccaccc

SEQ ID NO: 1929803 - RNA, 15 nt, Human
uguggucccacccca

SEQ ID NO: 1929804 - RNA, 20 nt, Human
ugugguguuuccuggcacug

SEQ ID NO: 1929805 - RNA, 21 nt, Human
ugugguguuuccugcaggcca

SEQ ID NO: 1929806 - RNA, 18 nt, Human
uguguaagacaaaaagcu

SEQ ID NO: 1929807 - RNA, 14 nt, Human
ugugguguuuccug

SEQ ID NO: 1929808 - RNA, 16 nt, Human
ugugguguuuccuggc

SEQ ID NO: 1929809 - RNA, 21 nt, Human
uguggguuucuaaagcugcca

SEQ ID NO: 1929810 - RNA, 23 nt, Human
uguggguuucuaaagcugccagc

SEQ ID NO: 1929811 - RNA, 20 nt, Human
uguggucacaggaaguagag

SEQ ID NO: 1929812 - RNA, 19 nt, Human
uguguguuuauugucaaag

SEQ ID NO: 1929813 - RNA, 23 nt, Human
uguguguuuauugucaaaguggu

SEQ ID NO: 1929814 - RNA, 13 nt, Human
ugugugugugaau

SEQ ID NO: 1929815 - RNA, 14 nt, Human
uguguguguaugug

SEQ ID NO: 1929816 - RNA, 20 nt, Human
ugugugugggaguguguaau

SEQ ID NO: 1929817 - RNA, 12 nt, Human
ugugugugggag

SEQ ID NO: 1929818 - RNA, 19 nt, Human
ugugucuuuaaaugcugcu

SEQ ID NO: 1929819 - RNA, 21 nt, Human
ugugucuugcaauggcagccu

SEQ ID NO: 1929820 - RNA, 21 nt, Human
ugugucucuugguccugcugc

SEQ ID NO: 1929821 - RNA, 22 nt, Human
ugugucucuugguccugcugca

SEQ ID NO: 1929822 - RNA, 17 nt, Human
ugugucucuugguccug

SEQ ID NO: 1929823 - RNA, 20 nt, Human
ugugucucuugguccugcug

SEQ ID NO: 1929824 - RNA, 13 nt, Human
uguguugaagagg

SEQ ID NO: 1929825 - RNA, 20 nt, Human
uguuccacaaguuaaauaaa

SEQ ID NO: 1929826 - RNA, 14 nt, Human
uguuccagcaguuu

SEQ ID NO: 1929827 - RNA, 20 nt, Human
agugugucuuagugugugca

SEQ ID NO: 1929828 - RNA, 21 nt, Human
agugugugauuuuuugcauuc

SEQ ID NO: 1929829 - RNA, 16 nt, Human
uguucugggacacagu

SEQ ID NO: 1929830 - RNA, 14 nt, Human
uguuccuagaguag

SEQ ID NO: 1929831 - RNA, 16 nt, Human
uguuccuagaguagag

SEQ ID NO: 1929832 - RNA, 18 nt, Human
uguucccauccucuucuu

SEQ ID NO: 1929833 - RNA, 21 nt, Human
uguuccgugguuaaacucgcu

SEQ ID NO: 1929834 - RNA, 18 nt, Human
uguuccaguaaucuaaua

SEQ ID NO: 1929835 - RNA, 17 nt, Human
uguucccaccugcugga

SEQ ID NO: 1929836 - RNA, 18 nt, Human
uguugcccaggcaggucu

SEQ ID NO: 1929837 - RNA, 17 nt, Human
uguugcccaggcagguc

SEQ ID NO: 1929838 - RNA, 16 nt, Human
uguugcccaggcaggu

SEQ ID NO: 1929839 - RNA, 15 nt, Human
uguugcccaggcagg

SEQ ID NO: 1929840 - RNA, 12 nt, Human
uguugcccaggc

SEQ ID NO: 1929841 - RNA, 13 nt, Human
uguugcccaggca

SEQ ID NO: 1929842 - RNA, 17 nt, Human
uguugcaagugcaauaa

SEQ ID NO: 1929843 - RNA, 15 nt, Human
uguucugugauauaa

SEQ ID NO: 1929844 - RNA, 18 nt, Human
uguucugugauauaagug

SEQ ID NO: 1929845 - RNA, 16 nt, Human
agugugguguuuccug

SEQ ID NO: 1929846 - RNA, 17 nt, Human
agugugcacuaaggggc

SEQ ID NO: 1929847 - RNA, 22 nt, Human
agugugcacuaaggggcccggc

SEQ ID NO: 1929848 - RNA, 23 nt, Human
agugugguguuuccugcaggcca

SEQ ID NO: 1929849 - RNA, 17 nt, Human
agugugguguuuccugg

SEQ ID NO: 1929850 - RNA, 19 nt, Human
agugugguguuuccuggca

SEQ ID NO: 1929851 - RNA, 20 nt, Human
agugugguguuuccuggcac

SEQ ID NO: 1929852 - RNA, 15 nt, Human
aguggugugaucuca

SEQ ID NO: 1929853 - RNA, 14 nt, Human
aguguacucccagg

SEQ ID NO: 1929854 - RNA, 15 nt, Human
aguguacucccaggg

SEQ ID NO: 1929855 - RNA, 21 nt, Human
agugguggugaacagaacaaa

SEQ ID NO: 1929856 - RNA, 20 nt, Human
aguggugguaacccuggugg

SEQ ID NO: 1929857 - RNA, 18 nt, Human
aguggugguaacccuggu

SEQ ID NO: 1929858 - RNA, 19 nt, Human
aguggugguaacccuggug

SEQ ID NO: 1929859 - RNA, 18 nt, Human
aguggugguuuucuguuc

SEQ ID NO: 1929860 - RNA, 17 nt, Human
aguggugguuuucuguu

SEQ ID NO: 1929861 - RNA, 23 nt, Human
aguggugguuuucuguucuuucu

SEQ ID NO: 1929862 - RNA, 21 nt, Human
aguggugguuuucuguucuuu

SEQ ID NO: 1929863 - RNA, 20 nt, Human
aguggugguuuucuguucuu

SEQ ID NO: 1929864 - RNA, 19 nt, Human
aguggugguuuucuguucu

SEQ ID NO: 1929865 - RNA, 17 nt, Human
aguggugcgaucugggu

SEQ ID NO: 1929866 - RNA, 17 nt, Human
aguggaaguaguggagc

SEQ ID NO: 1929867 - RNA, 14 nt, Human
uguuacaaauugua

SEQ ID NO: 1929868 - RNA, 13 nt, Human
ugucuuguacaug

SEQ ID NO: 1929869 - RNA, 19 nt, Human
ugucuuggacacuguacaa

SEQ ID NO: 1929870 - RNA, 22 nt, Human
ugucuuguacauguguagccug

SEQ ID NO: 1929871 - RNA, 20 nt, Human
ugucuuguacauguguagcc

SEQ ID NO: 1929872 - RNA, 17 nt, Human
ugucuuguacaugugua

SEQ ID NO: 1929873 - RNA, 16 nt, Human
ugucuuguacaugugu

SEQ ID NO: 1929874 - RNA, 15 nt, Human
ugugaaaggaaagag

SEQ ID NO: 1929875 - RNA, 18 nt, Human
ugugaaaggaaagaggcu

SEQ ID NO: 1929876 - RNA, 21 nt, Human
ugugaaaggaaagagggaggu

SEQ ID NO: 1929877 - RNA, 15 nt, Human
ugucuuguguuucuu

SEQ ID NO: 1929878 - RNA, 20 nt, Human
ugugaaauaaaacuggcuuu

SEQ ID NO: 1929879 - RNA, 21 nt, Human
ugugaaauaaaacuggcuuug

SEQ ID NO: 1929880 - RNA, 12 nt, Human
ugugaaauuauu

SEQ ID NO: 1929881 - RNA, 13 nt, Human
ugugaaauuccca

SEQ ID NO: 1929882 - RNA, 19 nt, Human
ugugacuagugcugaagcu

SEQ ID NO: 1929883 - RNA, 17 nt, Human
ugugacuagugcugaag

SEQ ID NO: 1929884 - RNA, 16 nt, Human
ugugacuagugcugaa

SEQ ID NO: 1929885 - RNA, 15 nt, Human
ugugacuagugcuga

SEQ ID NO: 1929886 - RNA, 14 nt, Human
ugugacuagugcug

SEQ ID NO: 1929887 - RNA, 19 nt, Human
ugugaccuugagaagauuc

SEQ ID NO: 1929888 - RNA, 23 nt, Human
ugugacuagugcugaagcuuauu

SEQ ID NO: 1929889 - RNA, 22 nt, Human
ugugacuagugcugaagcuuau

SEQ ID NO: 1929890 - RNA, 20 nt, Human
ugugacuagugcugaagcuu

SEQ ID NO: 1929891 - RNA, 14 nt, Human
ugugaagagaacca

SEQ ID NO: 1929892 - RNA, 18 nt, Human
ugugaacuuuauuaaaua

SEQ ID NO: 1929893 - RNA, 21 nt, Human
ugugaaccaccacacccagcc

SEQ ID NO: 1929894 - RNA, 20 nt, Human
ugugaaccaccacacccagc

SEQ ID NO: 1929895 - RNA, 19 nt, Human
ugugaaccaccacacccag

SEQ ID NO: 1929896 - RNA, 20 nt, Human
ugugaacaguuguguuugaa

SEQ ID NO: 1929897 - RNA, 15 nt, Human
ugugaacagcggcug

SEQ ID NO: 1929898 - RNA, 17 nt, Human
agucuugacgaguguga

SEQ ID NO: 1929899 - RNA, 14 nt, Human
agucuugcagcuga

SEQ ID NO: 1929900 - RNA, 18 nt, Human
agucuuguauuaaguugu

SEQ ID NO: 1929901 - RNA, 16 nt, Human
agucuuguauuaaguu

SEQ ID NO: 1929902 - RNA, 15 nt, Human
agucuuggcucacug

SEQ ID NO: 1929903 - RNA, 22 nt, Human
agucuuguauuaaguuguuaau

SEQ ID NO: 1929904 - RNA, 14 nt, Human
agucuuuguacaga

SEQ ID NO: 1929905 - RNA, 15 nt, Human
ugugacugaauuucu

SEQ ID NO: 1929906 - RNA, 16 nt, Human
ugugacugaauuucuu

SEQ ID NO: 1929907 - RNA, 15 nt, Human
ugugagagguuugac

SEQ ID NO: 1929908 - RNA, 16 nt, Human
ugugagagguuugacu

SEQ ID NO: 1929909 - RNA, 19 nt, Human
ugugagaugcuagaacucc

SEQ ID NO: 1929910 - RNA, 15 nt, Human
ugugagaugcuagaa

SEQ ID NO: 1929911 - RNA, 21 nt, Human
ugugccauagucacauggccu

SEQ ID NO: 1929912 - RNA, 18 nt, Human
ugugccauagucacaugg

SEQ ID NO: 1929913 - RNA, 16 nt, Human
ugugccauagucacau

SEQ ID NO: 1929914 - RNA, 18 nt, Human
ugugccagggcaaugaug

SEQ ID NO: 1929915 - RNA, 21 nt, Human
ugugccagggcaaugaugaau

SEQ ID NO: 1929916 - RNA, 20 nt, Human
ugugccagguuuuuggucug

SEQ ID NO: 1929917 - RNA, 20 nt, Human
ugugccagauuuaugcauau

SEQ ID NO: 1929918 - RNA, 16 nt, Human
ugugccaugugccagg

SEQ ID NO: 1929919 - RNA, 12 nt, Human
ugugccaugugc

SEQ ID NO: 1929920 - RNA, 16 nt, Human
ugugccauuuugcauu

SEQ ID NO: 1929921 - RNA, 23 nt, Human
ugugcccacccuccacucuccuc

SEQ ID NO: 1929922 - RNA, 14 nt, Human
ugugcccacccucc

SEQ ID NO: 1929923 - RNA, 18 nt, Human
ugugccagauuuaugcau

SEQ ID NO: 1929924 - RNA, 19 nt, Human
ugugccaaccuauuuugaa

SEQ ID NO: 1929925 - RNA, 19 nt, Human
ugugcauuuucuaaacaga

SEQ ID NO: 1929926 - RNA, 21 nt, Human
ugugcauuuucuaaacagaga

SEQ ID NO: 1929927 - RNA, 13 nt, Human
ugugcauuuucua

SEQ ID NO: 1929928 - RNA, 14 nt, Human
ugugcauuuucuaa

SEQ ID NO: 1929929 - RNA, 15 nt, Human
agugaaagaaaauaa

SEQ ID NO: 1929930 - RNA, 20 nt, Human
agugaacaaauuuacagaga

SEQ ID NO: 1929931 - RNA, 16 nt, Human
agugaacaaauuuaca

SEQ ID NO: 1929932 - RNA, 18 nt, Human
ugugaugagaggaaauca

SEQ ID NO: 1929933 - RNA, 19 nt, Human
ugugauggggcccugccuc

SEQ ID NO: 1929934 - RNA, 20 nt, Human
ugugauggggcccugccucc

SEQ ID NO: 1929935 - RNA, 14 nt, Human
ugugauuguggaau

SEQ ID NO: 1929936 - RNA, 14 nt, Human
ugugauugugccua

SEQ ID NO: 1929937 - RNA, 17 nt, Human
ugugauuguggaaugga

SEQ ID NO: 1929938 - RNA, 17 nt, Human
uguggaguucaucuuga

SEQ ID NO: 1929939 - RNA, 16 nt, Human
uguggagucauucuca

SEQ ID NO: 1929940 - RNA, 21 nt, Human
uguggaguucaucuugaauug

SEQ ID NO: 1929941 - RNA, 23 nt, Human
uguggcaguuuggcaaacucucc

SEQ ID NO: 1929942 - RNA, 21 nt, Human
ugugcccccauguaagcaccc

SEQ ID NO: 1929943 - RNA, 15 nt, Human
agugagucgaggaca

SEQ ID NO: 1929944 - RNA, 21 nt, Human
agugaguugauagcacagacc

SEQ ID NO: 1929945 - RNA, 16 nt, Human
agugagggagauccca

SEQ ID NO: 1929946 - RNA, 19 nt, Human
agugagggagggcugucau

SEQ ID NO: 1929947 - RNA, 21 nt, Human
agugaggcucugcccuugguu

SEQ ID NO: 1929948 - RNA, 19 nt, Human
agugaggcucugcccuugg

SEQ ID NO: 1929949 - RNA, 20 nt, Human
agugaggcucugcccuuggu

SEQ ID NO: 1929950 - RNA, 18 nt, Human
uguggccaaguucuuagu

SEQ ID NO: 1929951 - RNA, 15 nt, Human
uguggccaaggagcu

SEQ ID NO: 1929952 - RNA, 17 nt, Human
uguggccaaggagcugc

SEQ ID NO: 1929953 - RNA, 18 nt, Human
uguggccaaggagcugcu

SEQ ID NO: 1929954 - RNA, 19 nt, Human
uguggccaaggagcugcua

SEQ ID NO: 1929955 - RNA, 20 nt, Human
uguggccaaggagcugcuau

SEQ ID NO: 1929956 - RNA, 21 nt, Human
uguggccaaggagcugcuaua

SEQ ID NO: 1929957 - RNA, 14 nt, Human
uguggccaaggagc

SEQ ID NO: 1929958 - RNA, 15 nt, Human
agugaggcucugccc

SEQ ID NO: 1929959 - RNA, 14 nt, Human
agugaggcucugcc

SEQ ID NO: 1929960 - RNA, 16 nt, Human
agugaggcucugcccu

SEQ ID NO: 1929961 - RNA, 17 nt, Human
agugaggcucugcccuu

SEQ ID NO: 1929962 - RNA, 15 nt, Human
uucuagguucuaaaa

SEQ ID NO: 1929963 - RNA, 23 nt, Human
uucuaggacugaauuaugaaacu

SEQ ID NO: 1929964 - RNA, 13 nt, Human
uucuaggccuggg

SEQ ID NO: 1929965 - RNA, 23 nt, Human
uuccuuuugaacgccccccccca

SEQ ID NO: 1929966 - RNA, 15 nt, Human
uuccuuuugaaagaa

SEQ ID NO: 1929967 - RNA, 23 nt, Human
uuccuuuugaaagaaucagucuu

SEQ ID NO: 1929968 - RNA, 20 nt, Human
uuccuuuugaacgccccccc

SEQ ID NO: 1929969 - RNA, 13 nt, Human
uucuauaaggcca

SEQ ID NO: 1929970 - RNA, 19 nt, Human
uucuauaaaauacugguau

SEQ ID NO: 1929971 - RNA, 14 nt, Human
uucuauaaggccau

SEQ ID NO: 1929972 - RNA, 21 nt, Human
uucuauaaggccauaaaacag

SEQ ID NO: 1929973 - RNA, 23 nt, Human
uucuauaaggccauaaaacaggu

SEQ ID NO: 1929974 - RNA, 22 nt, Human
uucucaagauacugcuacugua

SEQ ID NO: 1929975 - RNA, 23 nt, Human
uucucagaaucucaaauaacuaa

SEQ ID NO: 1929976 - RNA, 19 nt, Human
uucucagaaucucaaauaa

SEQ ID NO: 1929977 - RNA, 22 nt, Human
uucucagaaucucaaauaacua

SEQ ID NO: 1929978 - RNA, 20 nt, Human
uucucacagcuccaagaauu

SEQ ID NO: 1929979 - RNA, 22 nt, Human
aucagaacucaaauggggccag

SEQ ID NO: 1929980 - RNA, 23 nt, Human
aucagaacucaaauggggccaga

SEQ ID NO: 1929981 - RNA, 19 nt, Human
aucagucauaacuaaauaa

SEQ ID NO: 1929982 - RNA, 13 nt, Human
aucagucaauauu

SEQ ID NO: 1929983 - RNA, 18 nt, Human
aucaguauaaacaaaguu

SEQ ID NO: 1929984 - RNA, 18 nt, Human
aucagcacgauuucuguu

SEQ ID NO: 1929985 - RNA, 17 nt, Human
aucagcacgauuucugu

SEQ ID NO: 1929986 - RNA, 16 nt, Human
aucagcacgauuucug

SEQ ID NO: 1929987 - RNA, 15 nt, Human
aucagcacgauuucu

SEQ ID NO: 1929988 - RNA, 15 nt, Human
aucaguggauuuccc

SEQ ID NO: 1929989 - RNA, 19 nt, Human
aucaguguaccauuugccu

SEQ ID NO: 1929990 - RNA, 18 nt, Human
aucaguggauuucccauc

SEQ ID NO: 1929991 - RNA, 16 nt, Human
aucagugucuuuccac

SEQ ID NO: 1929992 - RNA, 16 nt, Human
aucaguggauuuccca

SEQ ID NO: 1929993 - RNA, 17 nt, Human
aucaguggauuucccau

SEQ ID NO: 1929994 - RNA, 13 nt, Human
aucauucagcaac

SEQ ID NO: 1929995 - RNA, 12 nt, Human
aucauucagcaa

SEQ ID NO: 1929996 - RNA, 22 nt, Human
aucauucccuucgacagcauuu

SEQ ID NO: 1929997 - RNA, 14 nt, Human
aucauugaaaucuu

SEQ ID NO: 1929998 - RNA, 15 nt, Human
aucauugaaaucuuu

SEQ ID NO: 1929999 - RNA, 22 nt, Human
aucauuaaagccugaguuugcu

SEQ ID NO: 1930000 - RNA, 14 nt, Human
aucauucauuuucu

SEQ ID NO: 1930001 - RNA, 23 nt, Human
aucauaguggcuuaaaacaacac

SEQ ID NO: 1930002 - RNA, 23 nt, Human
aucauguuuacagaggacaguau

SEQ ID NO: 1930003 - RNA, 18 nt, Human
aucauguuuacagaggac

SEQ ID NO: 1930004 - RNA, 15 nt, Human
aucauuuuaauuauu

SEQ ID NO: 1930005 - RNA, 14 nt, Human
aucauuuuaauuau

SEQ ID NO: 1930006 - RNA, 16 nt, Human
auccagguucagcuug

SEQ ID NO: 1930007 - RNA, 15 nt, Human
auccagguucagcuu

SEQ ID NO: 1930008 - RNA, 15 nt, Human
aucccaacugucuuu

SEQ ID NO: 1930009 - RNA, 17 nt, Human
aucccaacugucuuuuu

SEQ ID NO: 1930010 - RNA, 23 nt, Human
aucccaacugucuuuuuuucccu

SEQ ID NO: 1930011 - RNA, 16 nt, Human
aucccauaugccuggg

SEQ ID NO: 1930012 - RNA, 17 nt, Human
aucccauaugccugggc

SEQ ID NO: 1930013 - RNA, 18 nt, Human
aucccucccccccaugca

SEQ ID NO: 1930014 - RNA, 19 nt, Human
aucccucccccccaugcac

SEQ ID NO: 1930015 - RNA, 21 nt, Human
aucccucccccccaugcacug

SEQ ID NO: 1930016 - RNA, 22 nt, Human
aucccucccccccaugcacugu

SEQ ID NO: 1930017 - RNA, 20 nt, Human
aucauugaaaucuuuuugcu

SEQ ID NO: 1930018 - RNA, 19 nt, Human
aucauugaaaucuuuuugc

SEQ ID NO: 1930019 - RNA, 12 nt, Human
uucucugugaac

SEQ ID NO: 1930020 - RNA, 20 nt, Human
uucucugugaacgauuuaga

SEQ ID NO: 1930021 - RNA, 15 nt, Human
uucugaaagggacgc

SEQ ID NO: 1930022 - RNA, 19 nt, Human
uucugaaaauuaacacugc

SEQ ID NO: 1930023 - RNA, 13 nt, Human
uucucuucacuca

SEQ ID NO: 1930024 - RNA, 21 nt, Human
uucugaaauuuccugggagcu

SEQ ID NO: 1930025 - RNA, 22 nt, Human
uucugggacacaguucaauucu

SEQ ID NO: 1930026 - RNA, 11 nt, Human
uucugggacac

SEQ ID NO: 1930027 - RNA, 10 nt, Human
uucugggaca

SEQ ID NO: 1930028 - RNA, 16 nt, Human
uucugccgcagcccug

SEQ ID NO: 1930029 - RNA, 23 nt, Human
uucugccgcagcccugcagaggg

SEQ ID NO: 1930030 - RNA, 19 nt, Human
uucuggguggggcaguggg

SEQ ID NO: 1930031 - RNA, 13 nt, Human
uucugggaagcaa

SEQ ID NO: 1930032 - RNA, 17 nt, Human
auauugcugauggugca

SEQ ID NO: 1930033 - RNA, 21 nt, Human
auauugcugauggugcaauga

SEQ ID NO: 1930034 - RNA, 22 nt, Human
auauugcugagagaaauaugga

SEQ ID NO: 1930035 - RNA, 13 nt, Human
auauuguguuugu

SEQ ID NO: 1930036 - RNA, 20 nt, Human
auauuguuuucaguguacau

SEQ ID NO: 1930037 - RNA, 17 nt, Human
auauuguguuuguguau

SEQ ID NO: 1930038 - RNA, 21 nt, Human
auauuguguuuguguauuuac

SEQ ID NO: 1930039 - RNA, 22 nt, Human
auauuuaaaggcccuaucuguu

SEQ ID NO: 1930040 - RNA, 20 nt, Human
auauuuguauuuaaaugaaa

SEQ ID NO: 1930041 - RNA, 20 nt, Human
auauuugugauagcacuuuc

SEQ ID NO: 1930042 - RNA, 21 nt, Human
auauuugugauagcacuuucu

SEQ ID NO: 1930043 - RNA, 22 nt, Human
auauuugugauagcacuuucua

SEQ ID NO: 1930044 - RNA, 14 nt, Human
auauuugugcauuu

SEQ ID NO: 1930045 - RNA, 17 nt, Human
auauuugugcauuuucu

SEQ ID NO: 1930046 - RNA, 21 nt, Human
auauuugugcauuuucuaaac

SEQ ID NO: 1930047 - RNA, 18 nt, Human
auauuugugcauuuucua

SEQ ID NO: 1930048 - RNA, 17 nt, Human
auauuuguguauuuaac

SEQ ID NO: 1930049 - RNA, 19 nt, Human
auauuugguuuuccuguau

SEQ ID NO: 1930050 - RNA, 20 nt, Human
auauuuguaaauuuauguga

SEQ ID NO: 1930051 - RNA, 24 nt, Human
auauuaagaaagacuaucuaaaug

SEQ ID NO: 1930052 - RNA, 22 nt, Human
auauuaaggaagacaaugugaa

SEQ ID NO: 1930053 - RNA, 12 nt, Human
auauuaaaucug

SEQ ID NO: 1930054 - RNA, 13 nt, Human
auauuaaaucugc

SEQ ID NO: 1930055 - RNA, 18 nt, Human
auauguuuuaagaggcag

SEQ ID NO: 1930056 - RNA, 20 nt, Human
auauguuuuaagaggcaggg

SEQ ID NO: 1930057 - RNA, 15 nt, Human
auauugauccagaaa

SEQ ID NO: 1930058 - RNA, 22 nt, Human
auauugauccagaaagaaaacu

SEQ ID NO: 1930059 - RNA, 22 nt, Human
auauugauuuccguuaaaauac

SEQ ID NO: 1930060 - RNA, 21 nt, Human
auauugauuuccguuaaaaua

SEQ ID NO: 1930061 - RNA, 13 nt, Human
auauugaugugug

SEQ ID NO: 1930062 - RNA, 18 nt, Human
auauugaauauaauauau

SEQ ID NO: 1930063 - RNA, 21 nt, Human
auauugaauauaauauauuug

SEQ ID NO: 1930064 - RNA, 19 nt, Human
auauugauuuccguuaaaa

SEQ ID NO: 1930065 - RNA, 16 nt, Human
auauucuguuggccag

SEQ ID NO: 1930066 - RNA, 23 nt, Human
auauucuggagucaucauucccu

SEQ ID NO: 1930067 - RNA, 21 nt, Human
auauucucacagcuccaagaa

SEQ ID NO: 1930068 - RNA, 23 nt, Human
auauucucacagcuccaagaauu

SEQ ID NO: 1930069 - RNA, 22 nt, Human
auauucucacagcuccaagaau

SEQ ID NO: 1930070 - RNA, 18 nt, Human
aucaaguauuauaccuuu

SEQ ID NO: 1930071 - RNA, 14 nt, Human
aucaaguauuauac

SEQ ID NO: 1930072 - RNA, 13 nt, Human
aucaaguauuaua

SEQ ID NO: 1930073 - RNA, 16 nt, Human
aucaaguauuugggaa

SEQ ID NO: 1930074 - RNA, 21 nt, Human
aucaagaguugugacaacuuc

SEQ ID NO: 1930075 - RNA, 18 nt, Human
auauuuucauuaaaagcu

SEQ ID NO: 1930076 - RNA, 18 nt, Human
auauuuucuuuaaugcuu

SEQ ID NO: 1930077 - RNA, 12 nt, Human
auauuuugaucu

SEQ ID NO: 1930078 - RNA, 15 nt, Human
auauuuugaucuuca

SEQ ID NO: 1930079 - RNA, 16 nt, Human
auauuuugaucuucaa

SEQ ID NO: 1930080 - RNA, 17 nt, Human
auauuuugaucuucaac

SEQ ID NO: 1930081 - RNA, 19 nt, Human
auauuuugaucuucaacaa

SEQ ID NO: 1930082 - RNA, 22 nt, Human
auauuuugaucuucaacaaauu

SEQ ID NO: 1930083 - RNA, 22 nt, Human
aucacggcucacugcagccuca

SEQ ID NO: 1930084 - RNA, 21 nt, Human
aucacguaaagcuagaaauga

SEQ ID NO: 1930085 - RNA, 14 nt, Human
aucacguaaagcua

SEQ ID NO: 1930086 - RNA, 20 nt, Human
uuccuuuuauuucuucacca

SEQ ID NO: 1930087 - RNA, 17 nt, Human
uuccuuuggaagaaaaa

SEQ ID NO: 1930088 - RNA, 21 nt, Human
aucacugucuuuccuagaugg

SEQ ID NO: 1930089 - RNA, 22 nt, Human
aucacugguugcacuuaugauu

SEQ ID NO: 1930090 - RNA, 12 nt, Human
aucacugucuuu

SEQ ID NO: 1930091 - RNA, 14 nt, Human
aucacugucuuucc

SEQ ID NO: 1930092 - RNA, 15 nt, Human
aucacugucuuuccu

SEQ ID NO: 1930093 - RNA, 16 nt, Human
aucacugucuuuccua

SEQ ID NO: 1930094 - RNA, 18 nt, Human
aucacugucuuuccuaga

SEQ ID NO: 1930095 - RNA, 19 nt, Human
aucacugucuuuccuagau

SEQ ID NO: 1930096 - RNA, 14 nt, Human
auauuuuaagacga

SEQ ID NO: 1930097 - RNA, 13 nt, Human
uuccuaauccucu

SEQ ID NO: 1930098 - RNA, 15 nt, Human
uuccuaauccucuag

SEQ ID NO: 1930099 - RNA, 15 nt, Human
uuccuccuuccaugg

SEQ ID NO: 1930100 - RNA, 12 nt, Human
uuccucugggaa

SEQ ID NO: 1930101 - RNA, 15 nt, Human
uuccucugcuuugaa

SEQ ID NO: 1930102 - RNA, 13 nt, Human
uuccucugcuuug

SEQ ID NO: 1930103 - RNA, 17 nt, Human
uuccuguucccaugaga

SEQ ID NO: 1930104 - RNA, 22 nt, Human
uuccuguguguccaaaacugcc

SEQ ID NO: 1930105 - RNA, 21 nt, Human
uuccuguguguccaaaacugc

SEQ ID NO: 1930106 - RNA, 11 nt, Human
uuccucuuucc

SEQ ID NO: 1930107 - RNA, 15 nt, Human
uuccugggagcuuuu

SEQ ID NO: 1930108 - RNA, 16 nt, Human
uuccugggagcuuuug

SEQ ID NO: 1930109 - RNA, 15 nt, Human
uuccuucagugccuu

SEQ ID NO: 1930110 - RNA, 21 nt, Human
auauuuucaugcuguucauga

SEQ ID NO: 1930111 - RNA, 18 nt, Human
auauuuucaugcuguuca

SEQ ID NO: 1930112 - RNA, 20 nt, Human
uuccuguucuuaagacguga

SEQ ID NO: 1930113 - RNA, 13 nt, Human
uuccuguucugaa

SEQ ID NO: 1930114 - RNA, 15 nt, Human
uuccuguucugaacu

SEQ ID NO: 1930115 - RNA, 11 nt, Human
uuccuucagug

SEQ ID NO: 1930116 - RNA, 14 nt, Human
uuccuucagugccu

SEQ ID NO: 1930117 - RNA, 18 nt, Human
auagcuacuaauuuuaaa

SEQ ID NO: 1930118 - RNA, 19 nt, Human
auagcucaggugucccugc

SEQ ID NO: 1930119 - RNA, 20 nt, Human
auagcuccccgcuucugccu

SEQ ID NO: 1930120 - RNA, 22 nt, Human
auagcucaggugucccugcacu

SEQ ID NO: 1930121 - RNA, 21 nt, Human
auagcucaggugucccugcac

SEQ ID NO: 1930122 - RNA, 20 nt, Human
auagcucaggugucccugca

SEQ ID NO: 1930123 - RNA, 23 nt, Human
auagcuccccgcuucugccugca

SEQ ID NO: 1930124 - RNA, 12 nt, Human
auagcugggacu

SEQ ID NO: 1930125 - RNA, 17 nt, Human
auagcuacuaauuuuaa

SEQ ID NO: 1930126 - RNA, 14 nt, Human
auagcuacuaauuu

SEQ ID NO: 1930127 - RNA, 18 nt, Human
auagcgucauaacuagaa

SEQ ID NO: 1930128 - RNA, 20 nt, Human
auagcgucauaacuagaacu

SEQ ID NO: 1930129 - RNA, 18 nt, Human
auagccugccucuucucu

SEQ ID NO: 1930130 - RNA, 13 nt, Human
auaagauaaaugu

SEQ ID NO: 1930131 - RNA, 17 nt, Human
auaagauaaaugugcug

SEQ ID NO: 1930132 - RNA, 22 nt, Human
uuauuuacugagcuucucugug

SEQ ID NO: 1930133 - RNA, 17 nt, Human
uuauuuacugagcuucu

SEQ ID NO: 1930134 - RNA, 21 nt, Human
uuauuuacugagcuucucugu

SEQ ID NO: 1930135 - RNA, 15 nt, Human
uuauuuacagaugaa

SEQ ID NO: 1930136 - RNA, 20 nt, Human
uuauuuacagaugaauguau

SEQ ID NO: 1930137 - RNA, 16 nt, Human
uuauuuaguuccuuga

SEQ ID NO: 1930138 - RNA, 17 nt, Human
auagcugggacuacagg

SEQ ID NO: 1930139 - RNA, 22 nt, Human
auagcuggucuuauuuguaaag

SEQ ID NO: 1930140 - RNA, 23 nt, Human
auagcuggucuuauuuguaaagc

SEQ ID NO: 1930141 - RNA, 18 nt, Human
uuauuuaaugaaagacug

SEQ ID NO: 1930142 - RNA, 22 nt, Human
uuauuuaaugaaagacuguaca

SEQ ID NO: 1930143 - RNA, 13 nt, Human
uuauuuaacagcu

SEQ ID NO: 1930144 - RNA, 23 nt, Human
uuauuuaacagcugaauuaucua

SEQ ID NO: 1930145 - RNA, 14 nt, Human
uuauuuaaauuuua

SEQ ID NO: 1930146 - RNA, 20 nt, Human
uuauuuaaacucuguugcaa

SEQ ID NO: 1930147 - RNA, 16 nt, Human
uucaaaauggagggaa

SEQ ID NO: 1930148 - RNA, 16 nt, Human
uucaaaauuguuacaa

SEQ ID NO: 1930149 - RNA, 17 nt, Human
uucaaaaugcuuuuuau

SEQ ID NO: 1930150 - RNA, 20 nt, Human
uucaaaaugcuuuuuauuau

SEQ ID NO: 1930151 - RNA, 15 nt, Human
uucaaacauuuacca

SEQ ID NO: 1930152 - RNA, 15 nt, Human
uucaaacuggggccu

SEQ ID NO: 1930153 - RNA, 16 nt, Human
uucaaacuggggccuc

SEQ ID NO: 1930154 - RNA, 21 nt, Human
uucaaacuggggccuccagaa

SEQ ID NO: 1930155 - RNA, 14 nt, Human
uuauuucuaaaaua

SEQ ID NO: 1930156 - RNA, 12 nt, Human
uuauuucugcau

SEQ ID NO: 1930157 - RNA, 13 nt, Human
uuauuucugcaua

SEQ ID NO: 1930158 - RNA, 15 nt, Human
uuauuucugcauaug

SEQ ID NO: 1930159 - RNA, 20 nt, Human
uuauuucugcauauguugaa

SEQ ID NO: 1930160 - RNA, 22 nt, Human
uuauuucugcauauguugaaua

SEQ ID NO: 1930161 - RNA, 16 nt, Human
uucaaaaaacuuguaa

SEQ ID NO: 1930162 - RNA, 21 nt, Human
uucaaaaaaaaaaaaaagaga

SEQ ID NO: 1930163 - RNA, 15 nt, Human
uucaaggauccugag

SEQ ID NO: 1930164 - RNA, 16 nt, Human
uucaaggauccugagc

SEQ ID NO: 1930165 - RNA, 18 nt, Human
uucaaggauccugagcca

SEQ ID NO: 1930166 - RNA, 19 nt, Human
uucaaggauccugagccag

SEQ ID NO: 1930167 - RNA, 21 nt, Human
uucaaggauccugagccagau

SEQ ID NO: 1930168 - RNA, 20 nt, Human
uucaagugauucuccugccu

SEQ ID NO: 1930169 - RNA, 17 nt, Human
uucaaguuaaauuuuau

SEQ ID NO: 1930170 - RNA, 16 nt, Human
uucaauaaagcauuua

SEQ ID NO: 1930171 - RNA, 23 nt, Human
uucaauaaaaaaaagaaaugaaa

SEQ ID NO: 1930172 - RNA, 18 nt, Human
uucaauaaagcauuuaua

SEQ ID NO: 1930173 - RNA, 14 nt, Human
uucaaguucaaucc

SEQ ID NO: 1930174 - RNA, 21 nt, Human
uucaauaaaaaaaagaaauga

SEQ ID NO: 1930175 - RNA, 17 nt, Human
uucaaggccauccuucc

SEQ ID NO: 1930176 - RNA, 16 nt, Human
uucaaggccauccuuc

SEQ ID NO: 1930177 - RNA, 22 nt, Human
auagcuuacaagccagcuggag

SEQ ID NO: 1930178 - RNA, 21 nt, Human
auagcuucaccccaaucccag

SEQ ID NO: 1930179 - RNA, 22 nt, Human
auagcuucaccccaaucccagc

SEQ ID NO: 1930180 - RNA, 19 nt, Human
auaggaacuuaaauaaugu

SEQ ID NO: 1930181 - RNA, 21 nt, Human
auaggaauugacccacaagaa

SEQ ID NO: 1930182 - RNA, 17 nt, Human
auaggcacaggaaacca

SEQ ID NO: 1930183 - RNA, 22 nt, Human
uucaccacaugugcacaugcac

SEQ ID NO: 1930184 - RNA, 14 nt, Human
uucacauuggaaac

SEQ ID NO: 1930185 - RNA, 19 nt, Human
uucacauuguauucagagu

SEQ ID NO: 1930186 - RNA, 13 nt, Human
uucacauuggaaa

SEQ ID NO: 1930187 - RNA, 17 nt, Human
uucacauauugauuucc

SEQ ID NO: 1930188 - RNA, 20 nt, Human
uucaauaaagcauuuauaaa

SEQ ID NO: 1930189 - RNA, 15 nt, Human
auaugcacaauagca

SEQ ID NO: 1930190 - RNA, 13 nt, Human
auaugcacacauu

SEQ ID NO: 1930191 - RNA, 14 nt, Human
auaugucaagccau

SEQ ID NO: 1930192 - RNA, 13 nt, Human
auaugugaacagu

SEQ ID NO: 1930193 - RNA, 18 nt, Human
uucauguaauccucaaga

SEQ ID NO: 1930194 - RNA, 21 nt, Human
uucauguacaagaugaaggag

SEQ ID NO: 1930195 - RNA, 17 nt, Human
uucauguacaagaugaa

SEQ ID NO: 1930196 - RNA, 21 nt, Human
uucauggccuuugauaaaugu

SEQ ID NO: 1930197 - RNA, 22 nt, Human
auaucugaaaauguauguguaa

SEQ ID NO: 1930198 - RNA, 20 nt, Human
auaugauuuaaaucagccgu

SEQ ID NO: 1930199 - RNA, 22 nt, Human
auaugauucaaaugucuauaaa

SEQ ID NO: 1930200 - RNA, 13 nt, Human
auaugauucaaau

SEQ ID NO: 1930201 - RNA, 12 nt, Human
auaugauucaaa

SEQ ID NO: 1930202 - RNA, 18 nt, Human
auauauucagccuggcuu

SEQ ID NO: 1930203 - RNA, 14 nt, Human
auauccuuugccuc

SEQ ID NO: 1930204 - RNA, 22 nt, Human
auaucuauauuuuacauaaauu

SEQ ID NO: 1930205 - RNA, 20 nt, Human
auaucuauauuuuacauaaa

SEQ ID NO: 1930206 - RNA, 16 nt, Human
auaucuauauuuuaca

SEQ ID NO: 1930207 - RNA, 17 nt, Human
auaucuauauuuuacau

SEQ ID NO: 1930208 - RNA, 18 nt, Human
uucaucauccuaagcuau

SEQ ID NO: 1930209 - RNA, 15 nt, Human
uucauauuucuuugg

SEQ ID NO: 1930210 - RNA, 14 nt, Human
uucauauuugcacu

SEQ ID NO: 1930211 - RNA, 15 nt, Human
uucauauuugcacua

SEQ ID NO: 1930212 - RNA, 21 nt, Human
uucaucauccuaagcuauuca

SEQ ID NO: 1930213 - RNA, 14 nt, Human
uucagccugccuuc

SEQ ID NO: 1930214 - RNA, 14 nt, Human
uucaguaauaacuc

SEQ ID NO: 1930215 - RNA, 13 nt, Human
uucagggucauag

SEQ ID NO: 1930216 - RNA, 16 nt, Human
uucauauuuacuucuu

SEQ ID NO: 1930217 - RNA, 21 nt, Human
uucauauuuacuucuuauaca

SEQ ID NO: 1930218 - RNA, 14 nt, Human
uucaguaggaacug

SEQ ID NO: 1930219 - RNA, 17 nt, Human
uucagaucucuaacuuc

SEQ ID NO: 1930220 - RNA, 23 nt, Human
uucagcaccuacaguguacaguc

SEQ ID NO: 1930221 - RNA, 22 nt, Human
uucagcaccuacaguguacagu

SEQ ID NO: 1930222 - RNA, 19 nt, Human
uucagccaagaauucuuaa

SEQ ID NO: 1930223 - RNA, 16 nt, Human
uucagcccucaccccu

SEQ ID NO: 1930224 - RNA, 12 nt, Human
uucagcccucac

SEQ ID NO: 1930225 - RNA, 16 nt, Human
uucagaauaagcuucc

SEQ ID NO: 1930226 - RNA, 22 nt, Human
auauauacauagcaugacauuu

SEQ ID NO: 1930227 - RNA, 14 nt, Human
auauauacauauau

SEQ ID NO: 1930228 - RNA, 22 nt, Human
auauaaauuuuuuuuguuucau

SEQ ID NO: 1930229 - RNA, 17 nt, Human
auauaaauuuuuuuugu

SEQ ID NO: 1930230 - RNA, 19 nt, Human
auauaaauguuaagaaaaa

SEQ ID NO: 1930231 - RNA, 15 nt, Human
auauaaacacuauau

SEQ ID NO: 1930232 - RNA, 13 nt, Human
auauaaacacuau

SEQ ID NO: 1930233 - RNA, 23 nt, Human
uuguaauucuaaaugaauguuua

SEQ ID NO: 1930234 - RNA, 17 nt, Human
uuguaauucuaaaugaa

SEQ ID NO: 1930235 - RNA, 14 nt, Human
uuguaauucuaaau

SEQ ID NO: 1930236 - RNA, 12 nt, Human
uuguaaugaaaa

SEQ ID NO: 1930237 - RNA, 20 nt, Human
uuguaagaguggaaccaaca

SEQ ID NO: 1930238 - RNA, 16 nt, Human
uuguaacccagauuuu

SEQ ID NO: 1930239 - RNA, 22 nt, Human
uuguaacccagauuuugcugua

SEQ ID NO: 1930240 - RNA, 14 nt, Human
uuguaaauuucucu

SEQ ID NO: 1930241 - RNA, 19 nt, Human
uuguaaauuuaugugaugg

SEQ ID NO: 1930242 - RNA, 15 nt, Human
uugguuuuccuguau

SEQ ID NO: 1930243 - RNA, 20 nt, Human
uugguuuucacauuggaaac

SEQ ID NO: 1930244 - RNA, 13 nt, Human
uugguuuuccugu

SEQ ID NO: 1930245 - RNA, 16 nt, Human
augaaugucaguguga

SEQ ID NO: 1930246 - RNA, 18 nt, Human
augaaugucagugugacu

SEQ ID NO: 1930247 - RNA, 19 nt, Human
uuggugguuucagaaaugu

SEQ ID NO: 1930248 - RNA, 18 nt, Human
uuggugguuucagaaaug

SEQ ID NO: 1930249 - RNA, 14 nt, Human
uugguuuguaaauu

SEQ ID NO: 1930250 - RNA, 19 nt, Human
uugguuaagcuuugacacu

SEQ ID NO: 1930251 - RNA, 20 nt, Human
uugguuaagcuuugacacug

SEQ ID NO: 1930252 - RNA, 22 nt, Human
uugguuaagcuuugacacugga

SEQ ID NO: 1930253 - RNA, 13 nt, Human
uugguguugacau

SEQ ID NO: 1930254 - RNA, 17 nt, Human
uuggugucgggcaugac

SEQ ID NO: 1930255 - RNA, 18 nt, Human
uuggugucgggcaugaca

SEQ ID NO: 1930256 - RNA, 19 nt, Human
uuggugucgggcaugacac

SEQ ID NO: 1930257 - RNA, 18 nt, Human
augaaucccacccacaug

SEQ ID NO: 1930258 - RNA, 21 nt, Human
augaaucccacccacauguga

SEQ ID NO: 1930259 - RNA, 15 nt, Human
augaagcaaugcuuc

SEQ ID NO: 1930260 - RNA, 15 nt, Human
augaagcaaacacau

SEQ ID NO: 1930261 - RNA, 17 nt, Human
augaaugaaacauuuug

SEQ ID NO: 1930262 - RNA, 15 nt, Human
augaauguauuuauu

SEQ ID NO: 1930263 - RNA, 17 nt, Human
augaauguauuuauuug

SEQ ID NO: 1930264 - RNA, 20 nt, Human
augaauguauuuauuuggga

SEQ ID NO: 1930265 - RNA, 14 nt, Human
augaagcaaugcuu

SEQ ID NO: 1930266 - RNA, 14 nt, Human
augaagcaaacaca

SEQ ID NO: 1930267 - RNA, 14 nt, Human
augaaccuucuggc

SEQ ID NO: 1930268 - RNA, 17 nt, Human
augaaccuucuggccuc

SEQ ID NO: 1930269 - RNA, 20 nt, Human
augaaagucuugugacuagu

SEQ ID NO: 1930270 - RNA, 19 nt, Human
augaaagucuugugacuag

SEQ ID NO: 1930271 - RNA, 18 nt, Human
augaaagucuugugacua

SEQ ID NO: 1930272 - RNA, 16 nt, Human
augaaagugagacuuu

SEQ ID NO: 1930273 - RNA, 18 nt, Human
uuggagccugcagagcug

SEQ ID NO: 1930274 - RNA, 22 nt, Human
augaaccacaucuugcucugcu

SEQ ID NO: 1930275 - RNA, 23 nt, Human
augaaccacaucuugcucugcug

SEQ ID NO: 1930276 - RNA, 15 nt, Human
aucuuauaauuuaaa

SEQ ID NO: 1930277 - RNA, 16 nt, Human
aucuuauaauuuaaaa

SEQ ID NO: 1930278 - RNA, 14 nt, Human
aucuugcucugcug

SEQ ID NO: 1930279 - RNA, 16 nt, Human
aucuugcucugcugac

SEQ ID NO: 1930280 - RNA, 15 nt, Human
aucuugcucugcuga

SEQ ID NO: 1930281 - RNA, 22 nt, Human
aucuuguggcuuugcaaccauu

SEQ ID NO: 1930282 - RNA, 22 nt, Human
aucugucauuugagcagggcuc

SEQ ID NO: 1930283 - RNA, 22 nt, Human
aucugugaggggcucucucaug

SEQ ID NO: 1930284 - RNA, 21 nt, Human
aucugugaggggcucucucau

SEQ ID NO: 1930285 - RNA, 17 nt, Human
aucugucauuugagcag

SEQ ID NO: 1930286 - RNA, 12 nt, Human
aucugucauuug

SEQ ID NO: 1930287 - RNA, 16 nt, Human
aucugugcacugccca

SEQ ID NO: 1930288 - RNA, 17 nt, Human
aucugugaauugagcug

SEQ ID NO: 1930289 - RNA, 17 nt, Human
uuggaaaauaaauuauu

SEQ ID NO: 1930290 - RNA, 15 nt, Human
uugcuuuguguucuu

SEQ ID NO: 1930291 - RNA, 20 nt, Human
uugcuuugugauuuuuguaa

SEQ ID NO: 1930292 - RNA, 16 nt, Human
uugcuuuguguucuuu

SEQ ID NO: 1930293 - RNA, 18 nt, Human
uuggagaguuuccugaaa

SEQ ID NO: 1930294 - RNA, 15 nt, Human
uuggagccugcagag

SEQ ID NO: 1930295 - RNA, 11 nt, Human
uuggagccugc

SEQ ID NO: 1930296 - RNA, 18 nt, Human
uuggagaauuuagguuuu

SEQ ID NO: 1930297 - RNA, 21 nt, Human
uuggagaguuuccugaaacaa

SEQ ID NO: 1930298 - RNA, 13 nt, Human
uuggagaauuuag

SEQ ID NO: 1930299 - RNA, 14 nt, Human
uugcucuugaugcc

SEQ ID NO: 1930300 - RNA, 17 nt, Human
uugcucuugaugccugg

SEQ ID NO: 1930301 - RNA, 18 nt, Human
uugcucuugaugccuggc

SEQ ID NO: 1930302 - RNA, 16 nt, Human
uugcucuggaccugcc

SEQ ID NO: 1930303 - RNA, 15 nt, Human
uugcuuugugauuuu

SEQ ID NO: 1930304 - RNA, 11 nt, Human
uugcuuugagc

SEQ ID NO: 1930305 - RNA, 15 nt, Human
uugcuuucugcucag

SEQ ID NO: 1930306 - RNA, 20 nt, Human
uugcuuucugcucagcuucu

SEQ ID NO: 1930307 - RNA, 15 nt, Human
uugcuuuauuccaga

SEQ ID NO: 1930308 - RNA, 19 nt, Human
aucugaaaaauacuuuugg

SEQ ID NO: 1930309 - RNA, 22 nt, Human
aucucuuuguucuaaagaugga

SEQ ID NO: 1930310 - RNA, 16 nt, Human
aucucuuguuuaaauu

SEQ ID NO: 1930311 - RNA, 14 nt, Human
aucugacccagugc

SEQ ID NO: 1930312 - RNA, 18 nt, Human
aucugacccagugccccc

SEQ ID NO: 1930313 - RNA, 15 nt, Human
aucucaccuccugcu

SEQ ID NO: 1930314 - RNA, 16 nt, Human
aucucaccuccugcug

SEQ ID NO: 1930315 - RNA, 17 nt, Human
aucucaaauuucuaaau

SEQ ID NO: 1930316 - RNA, 16 nt, Human
aucucaaauuucuaaa

SEQ ID NO: 1930317 - RNA, 23 nt, Human
aucucacacaugagcaucaggcc

SEQ ID NO: 1930318 - RNA, 21 nt, Human
uugauuaaauucuugcaaagu

SEQ ID NO: 1930319 - RNA, 20 nt, Human
uugauuaaauucuugcaaag

SEQ ID NO: 1930320 - RNA, 16 nt, Human
uugauuaaauucuugc

SEQ ID NO: 1930321 - RNA, 15 nt, Human
uugauuaaauucuug

SEQ ID NO: 1930322 - RNA, 16 nt, Human
uugcaacuuuguauaa

SEQ ID NO: 1930323 - RNA, 17 nt, Human
uugcaacuuuguauaaa

SEQ ID NO: 1930324 - RNA, 18 nt, Human
uugcaacuuuguauaaaa

SEQ ID NO: 1930325 - RNA, 23 nt, Human
uugauguucuuucacccuuuucu

SEQ ID NO: 1930326 - RNA, 20 nt, Human
aucugacccagugcccccac

SEQ ID NO: 1930327 - RNA, 21 nt, Human
aucugacccagugcccccacu

SEQ ID NO: 1930328 - RNA, 21 nt, Human
aucugagaaacaaugacuaau

SEQ ID NO: 1930329 - RNA, 23 nt, Human
uugcccaggcuggcgugcagugg

SEQ ID NO: 1930330 - RNA, 14 nt, Human
uugcccaggcuggc

SEQ ID NO: 1930331 - RNA, 12 nt, Human
uugcccaggcug

SEQ ID NO: 1930332 - RNA, 11 nt, Human
uugcccaggcu

SEQ ID NO: 1930333 - RNA, 18 nt, Human
uugcccaggcaggucuug

SEQ ID NO: 1930334 - RNA, 16 nt, Human
uugcccaggcaggucu

SEQ ID NO: 1930335 - RNA, 14 nt, Human
uugcccaggcaggu

SEQ ID NO: 1930336 - RNA, 13 nt, Human
uugcccaggcagg

SEQ ID NO: 1930337 - RNA, 18 nt, Human
uugccacaggacacaguc

SEQ ID NO: 1930338 - RNA, 14 nt, Human
uugcaauggcagcc

SEQ ID NO: 1930339 - RNA, 22 nt, Human
uugcaauagaaauccaauugga

SEQ ID NO: 1930340 - RNA, 15 nt, Human
uugcaauagaaaucc

SEQ ID NO: 1930341 - RNA, 21 nt, Human
uugcaccacugcacuccagcc

SEQ ID NO: 1930342 - RNA, 14 nt, Human
uugcaugaggcuag

SEQ ID NO: 1930343 - RNA, 12 nt, Human
uugcaugaggcu

SEQ ID NO: 1930344 - RNA, 17 nt, Human
uugccaagaccuuucaa

SEQ ID NO: 1930345 - RNA, 14 nt, Human
uugccaagaccuuu

SEQ ID NO: 1930346 - RNA, 15 nt, Human
uugccaagaccuuuc

SEQ ID NO: 1930347 - RNA, 16 nt, Human
uugacaucaacugcau

SEQ ID NO: 1930348 - RNA, 19 nt, Human
uugacagcuuugcugcuga

SEQ ID NO: 1930349 - RNA, 12 nt, Human
uugacagggcac

SEQ ID NO: 1930350 - RNA, 10 nt, Human
uugacagggc

SEQ ID NO: 1930351 - RNA, 19 nt, Human
uugacaggauuauuggaaa

SEQ ID NO: 1930352 - RNA, 22 nt, Human
aucccuuuauuacccccuccuu

SEQ ID NO: 1930353 - RNA, 13 nt, Human
uugacacaggucu

SEQ ID NO: 1930354 - RNA, 19 nt, Human
uugacacaggucuuuccua

SEQ ID NO: 1930355 - RNA, 22 nt, Human
uugacacaggucuuuccuaagg

SEQ ID NO: 1930356 - RNA, 14 nt, Human
uugacacaagugga

SEQ ID NO: 1930357 - RNA, 17 nt, Human
uugacacaaguggaccu

SEQ ID NO: 1930358 - RNA, 16 nt, Human
uugacacagaaaaugu

SEQ ID NO: 1930359 - RNA, 18 nt, Human
uugacacaaguggaccuu

SEQ ID NO: 1930360 - RNA, 13 nt, Human
aucccuuuauuac

SEQ ID NO: 1930361 - RNA, 14 nt, Human
aucccuuuauuacc

SEQ ID NO: 1930362 - RNA, 11 nt, Human
uugagacagag

SEQ ID NO: 1930363 - RNA, 22 nt, Human
uugagacacggagcccagcccu

SEQ ID NO: 1930364 - RNA, 23 nt, Human
uugagaaucccaaauuugauuga

SEQ ID NO: 1930365 - RNA, 23 nt, Human
uugagaaaccuuauuguaccucu

SEQ ID NO: 1930366 - RNA, 12 nt, Human
uugagcagggcu

SEQ ID NO: 1930367 - RNA, 16 nt, Human
uugagcagggcucagc

SEQ ID NO: 1930368 - RNA, 17 nt, Human
uugaccauucuccaccu

SEQ ID NO: 1930369 - RNA, 21 nt, Human
uugagaaaaaaagaauaguug

SEQ ID NO: 1930370 - RNA, 10 nt, Human
uugagaaacc

SEQ ID NO: 1930371 - RNA, 22 nt, Human
uugagaaaccuuauuguaccuc

SEQ ID NO: 1930372 - RNA, 14 nt, Human
uugacauugcguuu

SEQ ID NO: 1930373 - RNA, 18 nt, Human
uugacauugcguuugacc

SEQ ID NO: 1930374 - RNA, 11 nt, Human
uugagugccuu

SEQ ID NO: 1930375 - RNA, 21 nt, Human
uugagugcugucuccauguuu

SEQ ID NO: 1930376 - RNA, 17 nt, Human
uugaguguuuuaagaua

SEQ ID NO: 1930377 - RNA, 18 nt, Human
uugauagcacagacccug

SEQ ID NO: 1930378 - RNA, 17 nt, Human
uugauacuacaguuugu

SEQ ID NO: 1930379 - RNA, 15 nt, Human
uugauacuacaguuu

SEQ ID NO: 1930380 - RNA, 23 nt, Human
aucuaauauguaacaagccaccc

SEQ ID NO: 1930381 - RNA, 20 nt, Human
aucuaauauguaacaagcca

SEQ ID NO: 1930382 - RNA, 23 nt, Human
aucuaauuuauaaaaagguguuu

SEQ ID NO: 1930383 - RNA, 19 nt, Human
aucuaauuuauaaaaaggu

SEQ ID NO: 1930384 - RNA, 15 nt, Human
aucuaauuuauaaaa

SEQ ID NO: 1930385 - RNA, 14 nt, Human
aucuaauuuauaaa

SEQ ID NO: 1930386 - RNA, 13 nt, Human
aucuaauuuauaa

SEQ ID NO: 1930387 - RNA, 18 nt, Human
aucuagauacuguaucau

SEQ ID NO: 1930388 - RNA, 15 nt, Human
aucuacuaauuccac

SEQ ID NO: 1930389 - RNA, 19 nt, Human
aucuacuaauuccacaccu

SEQ ID NO: 1930390 - RNA, 19 nt, Human
aucuagauacuguaucaug

SEQ ID NO: 1930391 - RNA, 19 nt, Human
aucuagauuauggagcuuu

SEQ ID NO: 1930392 - RNA, 16 nt, Human
aucuaggaaaauauuu

SEQ ID NO: 1930393 - RNA, 17 nt, Human
aucuaggaagacuuugg

SEQ ID NO: 1930394 - RNA, 18 nt, Human
aucuaggaagacuuugga

SEQ ID NO: 1930395 - RNA, 19 nt, Human
aucuaggaagacuuuggaa

SEQ ID NO: 1930396 - RNA, 22 nt, Human
aucuauuuuggauuguauauug

SEQ ID NO: 1930397 - RNA, 20 nt, Human
aucuaggaaaauauuuugau

SEQ ID NO: 1930398 - RNA, 17 nt, Human
aucuaggaaaauauuuu

SEQ ID NO: 1930399 - RNA, 19 nt, Human
aucuaggaaaauauuuuga

SEQ ID NO: 1930400 - RNA, 22 nt, Human
aucuaggaaaauauuuugaucu

SEQ ID NO: 1930401 - RNA, 14 nt, Human
aucucaaauuucua

SEQ ID NO: 1930402 - RNA, 23 nt, Human
aucucaaauaacuaaaagguaug

SEQ ID NO: 1930403 - RNA, 14 nt, Human
aucucaaauaacua

SEQ ID NO: 1930404 - RNA, 21 nt, Human
aucucaaauaacuaaaaggua

SEQ ID NO: 1930405 - RNA, 20 nt, Human
augcgacacugggaggccag

SEQ ID NO: 1930406 - RNA, 20 nt, Human
uuuacccuucuuuucugacu

SEQ ID NO: 1930407 - RNA, 22 nt, Human
uuuaccugaagucuuuguacag

SEQ ID NO: 1930408 - RNA, 18 nt, Human
uuuaccugaagucuuugu

SEQ ID NO: 1930409 - RNA, 11 nt, Human
uuuacuuaaac

SEQ ID NO: 1930410 - RNA, 18 nt, Human
uuuacuguuauccuauuu

SEQ ID NO: 1930411 - RNA, 19 nt, Human
uuuacuguuauccuauuua

SEQ ID NO: 1930412 - RNA, 16 nt, Human
uuuacugcagcuuugu

SEQ ID NO: 1930413 - RNA, 14 nt, Human
uuuacugagcuucu

SEQ ID NO: 1930414 - RNA, 17 nt, Human
uuuacugagcuucucug

SEQ ID NO: 1930415 - RNA, 18 nt, Human
uuuacugagcuucucugu

SEQ ID NO: 1930416 - RNA, 21 nt, Human
uuuacugagcuucucugugaa

SEQ ID NO: 1930417 - RNA, 14 nt, Human
uuuacugaagccuu

SEQ ID NO: 1930418 - RNA, 13 nt, Human
uuuacuucuuaua

SEQ ID NO: 1930419 - RNA, 14 nt, Human
uuuacuucuuauac

SEQ ID NO: 1930420 - RNA, 15 nt, Human
uuuacuucuuauaca

SEQ ID NO: 1930421 - RNA, 17 nt, Human
uuuagggguagcauuug

SEQ ID NO: 1930422 - RNA, 20 nt, Human
uuuaggagggaguuaucuaa

SEQ ID NO: 1930423 - RNA, 18 nt, Human
uuuaggcugguggcccag

SEQ ID NO: 1930424 - RNA, 13 nt, Human
uuuauauguacau

SEQ ID NO: 1930425 - RNA, 14 nt, Human
uuuauauguacaug

SEQ ID NO: 1930426 - RNA, 17 nt, Human
uuuauauguacaugaga

SEQ ID NO: 1930427 - RNA, 20 nt, Human
uuuagggcuguaaaaugcau

SEQ ID NO: 1930428 - RNA, 18 nt, Human
augcuacaggauuugaaa

SEQ ID NO: 1930429 - RNA, 20 nt, Human
augcgugcauaccacuuuug

SEQ ID NO: 1930430 - RNA, 22 nt, Human
augcgugcauaccacuuuuguu

SEQ ID NO: 1930431 - RNA, 13 nt, Human
augccucucucag

SEQ ID NO: 1930432 - RNA, 14 nt, Human
augccucucucagg

SEQ ID NO: 1930433 - RNA, 17 nt, Human
augcccggcuaauuuuu

SEQ ID NO: 1930434 - RNA, 16 nt, Human
augccccuggcuggga

SEQ ID NO: 1930435 - RNA, 20 nt, Human
augccccuguacuccagccu

SEQ ID NO: 1930436 - RNA, 13 nt, Human
augcccuccucuc

SEQ ID NO: 1930437 - RNA, 15 nt, Human
augccucucucaggc

SEQ ID NO: 1930438 - RNA, 21 nt, Human
augccaugaggaacaaggcaa

SEQ ID NO: 1930439 - RNA, 15 nt, Human
augcccagccccuuc

SEQ ID NO: 1930440 - RNA, 16 nt, Human
augcccagccccuucu

SEQ ID NO: 1930441 - RNA, 20 nt, Human
augccccugaauuuaaauag

SEQ ID NO: 1930442 - RNA, 15 nt, Human
augccccugaauuua

SEQ ID NO: 1930443 - RNA, 17 nt, Human
augcccagccccuucug

SEQ ID NO: 1930444 - RNA, 21 nt, Human
uuuaaugaaagacuguacaaa

SEQ ID NO: 1930445 - RNA, 23 nt, Human
uuuaaugaaagacuguacaaagu

SEQ ID NO: 1930446 - RNA, 16 nt, Human
uuucccuauuagagaa

SEQ ID NO: 1930447 - RNA, 12 nt, Human
uuucccaacucu

SEQ ID NO: 1930448 - RNA, 12 nt, Human
uuucauguacaa

SEQ ID NO: 1930449 - RNA, 18 nt, Human
uuucauguacaagaugaa

SEQ ID NO: 1930450 - RNA, 12 nt, Human
uuucagaaaugu

SEQ ID NO: 1930451 - RNA, 11 nt, Human
uuucagaaaug

SEQ ID NO: 1930452 - RNA, 19 nt, Human
uuucaugcuguucaugaaa

SEQ ID NO: 1930453 - RNA, 19 nt, Human
uuucaucugcucuccuucc

SEQ ID NO: 1930454 - RNA, 18 nt, Human
uuucaucugcucuccuuc

SEQ ID NO: 1930455 - RNA, 21 nt, Human
uuucaugcuguucaugaaaga

SEQ ID NO: 1930456 - RNA, 20 nt, Human
uuucaucugcucuccuuccu

SEQ ID NO: 1930457 - RNA, 17 nt, Human
uuucaucugcucuccuu

SEQ ID NO: 1930458 - RNA, 16 nt, Human
uuucaucugcucuccu

SEQ ID NO: 1930459 - RNA, 15 nt, Human
uuucaucugcucucc

SEQ ID NO: 1930460 - RNA, 11 nt, Human
uuucaucugcu

SEQ ID NO: 1930461 - RNA, 15 nt, Human
uuucaaacuuuacua

SEQ ID NO: 1930462 - RNA, 12 nt, Human
uuucaaacuuua

SEQ ID NO: 1930463 - RNA, 13 nt, Human
auggaauugauuu

SEQ ID NO: 1930464 - RNA, 14 nt, Human
auggaauugauuug

SEQ ID NO: 1930465 - RNA, 15 nt, Human
auggaauugauuugc

SEQ ID NO: 1930466 - RNA, 16 nt, Human
auggaauugauuugca

SEQ ID NO: 1930467 - RNA, 17 nt, Human
auggaauugauuugcau

SEQ ID NO: 1930468 - RNA, 23 nt, Human
uuucaccuguuuuuaagcuguuu

SEQ ID NO: 1930469 - RNA, 19 nt, Human
uuucacauuggaaacaagu

SEQ ID NO: 1930470 - RNA, 14 nt, Human
uuucacauuggaaa

SEQ ID NO: 1930471 - RNA, 13 nt, Human
uuucacauuggaa

SEQ ID NO: 1930472 - RNA, 22 nt, Human
uuucaccuguuuuuaagcuguu

SEQ ID NO: 1930473 - RNA, 17 nt, Human
auggaagacagcucuua

SEQ ID NO: 1930474 - RNA, 18 nt, Human
auggaagacagcucuuau

SEQ ID NO: 1930475 - RNA, 16 nt, Human
augcuucucacugcca

SEQ ID NO: 1930476 - RNA, 20 nt, Human
augcuucucacugccaugcc

SEQ ID NO: 1930477 - RNA, 20 nt, Human
augcuggcuguuggcugggg

SEQ ID NO: 1930478 - RNA, 19 nt, Human
augcuggcuguuggcuggg

SEQ ID NO: 1930479 - RNA, 23 nt, Human
augcuguucaugaaagauucaau

SEQ ID NO: 1930480 - RNA, 18 nt, Human
augcuggcuguuggcugg

SEQ ID NO: 1930481 - RNA, 14 nt, Human
augcuccuggccca

SEQ ID NO: 1930482 - RNA, 19 nt, Human
augcuccuggcccacugca

SEQ ID NO: 1930483 - RNA, 14 nt, Human
uuuaucagaauucu

SEQ ID NO: 1930484 - RNA, 12 nt, Human
augcucagacca

SEQ ID NO: 1930485 - RNA, 14 nt, Human
augcucagaccagc

SEQ ID NO: 1930486 - RNA, 17 nt, Human
augcucagaccagcucu

SEQ ID NO: 1930487 - RNA, 15 nt, Human
uugugucuguacacg

SEQ ID NO: 1930488 - RNA, 14 nt, Human
uugugucuguacac

SEQ ID NO: 1930489 - RNA, 13 nt, Human
uugugucuguaca

SEQ ID NO: 1930490 - RNA, 13 nt, Human
uuguucaauuaga

SEQ ID NO: 1930491 - RNA, 15 nt, Human
uuguucaauuagaau

SEQ ID NO: 1930492 - RNA, 20 nt, Human
uuguguauuuacgcuuugau

SEQ ID NO: 1930493 - RNA, 22 nt, Human
uuguguauuuacgcuuugauuc

SEQ ID NO: 1930494 - RNA, 23 nt, Human
uuguguauuuacgcuuugauuca

SEQ ID NO: 1930495 - RNA, 22 nt, Human
uugugucaacaugaacaaauuu

SEQ ID NO: 1930496 - RNA, 19 nt, Human
uuguguauuuacgcuuuga

SEQ ID NO: 1930497 - RNA, 21 nt, Human
uuguguauuuaacagggaggg

SEQ ID NO: 1930498 - RNA, 13 nt, Human
uuguguauuuaac

SEQ ID NO: 1930499 - RNA, 14 nt, Human
uuguguauuuaaca

SEQ ID NO: 1930500 - RNA, 23 nt, Human
uugugaucagaccauaauguuac

SEQ ID NO: 1930501 - RNA, 21 nt, Human
uugugauagcacuuucuacaa

SEQ ID NO: 1930502 - RNA, 16 nt, Human
uugugauagcacuuuc

SEQ ID NO: 1930503 - RNA, 19 nt, Human
uugugauagcacuuucuac

SEQ ID NO: 1930504 - RNA, 12 nt, Human
uugugauguguc

SEQ ID NO: 1930505 - RNA, 18 nt, Human
uuguccccaccgcagaca

SEQ ID NO: 1930506 - RNA, 20 nt, Human
uuguccccaccgcagacagg

SEQ ID NO: 1930507 - RNA, 19 nt, Human
uuguccagcugagcgccag

SEQ ID NO: 1930508 - RNA, 15 nt, Human
uuguccccgacccuu

SEQ ID NO: 1930509 - RNA, 16 nt, Human
uuguccccgacccuug

SEQ ID NO: 1930510 - RNA, 20 nt, Human
uugugauacaaugcugugcc

SEQ ID NO: 1930511 - RNA, 15 nt, Human
uugugauagcacuuu

SEQ ID NO: 1930512 - RNA, 17 nt, Human
uugugaggaagccgcug

SEQ ID NO: 1930513 - RNA, 18 nt, Human
uugugaggaagccgcugg

SEQ ID NO: 1930514 - RNA, 13 nt, Human
uugugaggaagcc

SEQ ID NO: 1930515 - RNA, 13 nt, Human
augaguccccugu

SEQ ID NO: 1930516 - RNA, 23 nt, Human
augaguccccuguuuguuucuga

SEQ ID NO: 1930517 - RNA, 18 nt, Human
augaguuggcugggaaua

SEQ ID NO: 1930518 - RNA, 19 nt, Human
augaguuagaauaauaaau

SEQ ID NO: 1930519 - RNA, 23 nt, Human
augaguuagaauaauaaauauuu

SEQ ID NO: 1930520 - RNA, 21 nt, Human
uugucauauaagauucauauu

SEQ ID NO: 1930521 - RNA, 17 nt, Human
uugucacacacuuuggc

SEQ ID NO: 1930522 - RNA, 18 nt, Human
augaggucagagccugca

SEQ ID NO: 1930523 - RNA, 16 nt, Human
augaggucagagccug

SEQ ID NO: 1930524 - RNA, 15 nt, Human
augaggucagagccu

SEQ ID NO: 1930525 - RNA, 20 nt, Human
augaggucagagccugcagu

SEQ ID NO: 1930526 - RNA, 19 nt, Human
augaggucagagccugcag

SEQ ID NO: 1930527 - RNA, 22 nt, Human
augaggucagagccugcaguua

SEQ ID NO: 1930528 - RNA, 15 nt, Human
augagguacugagag

SEQ ID NO: 1930529 - RNA, 18 nt, Human
augagguacugagaguga

SEQ ID NO: 1930530 - RNA, 17 nt, Human
augagguacugagagug

SEQ ID NO: 1930531 - RNA, 18 nt, Human
uuguagcauccuggaaua

SEQ ID NO: 1930532 - RNA, 16 nt, Human
uuguagcauccuggaa

SEQ ID NO: 1930533 - RNA, 15 nt, Human
uuguagccuuuugac

SEQ ID NO: 1930534 - RNA, 16 nt, Human
uuguagccuuuugacu

SEQ ID NO: 1930535 - RNA, 19 nt, Human
uuguagccuuuugacuuuc

SEQ ID NO: 1930536 - RNA, 21 nt, Human
uuuaaauauaugcuaagucuu

SEQ ID NO: 1930537 - RNA, 21 nt, Human
uuuaaaugaaagugagacuuu

SEQ ID NO: 1930538 - RNA, 13 nt, Human
uuuaaaugaaagu

SEQ ID NO: 1930539 - RNA, 14 nt, Human
uuuaaaugcugcuu

SEQ ID NO: 1930540 - RNA, 11 nt, Human
uuuaaaugcac

SEQ ID NO: 1930541 - RNA, 23 nt, Human
uuuaaaaauacagauagauauau

SEQ ID NO: 1930542 - RNA, 14 nt, Human
uuuaagaggcaggg

SEQ ID NO: 1930543 - RNA, 11 nt, Human
uuuaagcuguu

SEQ ID NO: 1930544 - RNA, 14 nt, Human
uuuaagagacagcc

SEQ ID NO: 1930545 - RNA, 12 nt, Human
uuuaagagaaau

SEQ ID NO: 1930546 - RNA, 17 nt, Human
uuuaagacguguuugug

SEQ ID NO: 1930547 - RNA, 19 nt, Human
uuuaagacguguuuguguu

SEQ ID NO: 1930548 - RNA, 19 nt, Human
uuuaaggaugcuuguacau

SEQ ID NO: 1930549 - RNA, 21 nt, Human
uuuaagcuguuacugucuuca

SEQ ID NO: 1930550 - RNA, 12 nt, Human
uuuaagcuguuu

SEQ ID NO: 1930551 - RNA, 13 nt, Human
uuuaagcuguuuc

SEQ ID NO: 1930552 - RNA, 18 nt, Human
uuuaagcuguuuccauag

SEQ ID NO: 1930553 - RNA, 22 nt, Human
uuuaaggaugcuuguacauaau

SEQ ID NO: 1930554 - RNA, 21 nt, Human
uuuaaggaugcuuguacauaa

SEQ ID NO: 1930555 - RNA, 20 nt, Human
uuuaaggaugcuuguacaua

SEQ ID NO: 1930556 - RNA, 22 nt, Human
uuuaagggaguguacucccagg

SEQ ID NO: 1930557 - RNA, 16 nt, Human
uuuaaugaaagacugu

SEQ ID NO: 1930558 - RNA, 14 nt, Human
augauuucauuuca

SEQ ID NO: 1930559 - RNA, 13 nt, Human
augauuucauuca

SEQ ID NO: 1930560 - RNA, 13 nt, Human
augauuuccuuga

SEQ ID NO: 1930561 - RNA, 15 nt, Human
augauuuccuugaau

SEQ ID NO: 1930562 - RNA, 16 nt, Human
augauuuccuugaaug

SEQ ID NO: 1930563 - RNA, 17 nt, Human
augauuuccuugaaugu

SEQ ID NO: 1930564 - RNA, 18 nt, Human
augauuuccuugaaugug

SEQ ID NO: 1930565 - RNA, 19 nt, Human
augauuuccuugaaugugg

SEQ ID NO: 1930566 - RNA, 20 nt, Human
augauuuccuugaauguggc

SEQ ID NO: 1930567 - RNA, 11 nt, Human
augcaaaaauc

SEQ ID NO: 1930568 - RNA, 20 nt, Human
uuguucuugguuuguaaauu

SEQ ID NO: 1930569 - RNA, 16 nt, Human
augauuuacagagaag

SEQ ID NO: 1930570 - RNA, 19 nt, Human
uuguucuugguuuguaaau

SEQ ID NO: 1930571 - RNA, 17 nt, Human
uuguucuugguuuguaa

SEQ ID NO: 1930572 - RNA, 21 nt, Human
augcaccuugugucuguacac

SEQ ID NO: 1930573 - RNA, 21 nt, Human
augcacuuuguucuggcucuu

SEQ ID NO: 1930574 - RNA, 20 nt, Human
augcacugugaaggacccuu

SEQ ID NO: 1930575 - RNA, 18 nt, Human
augcacugugaaggaccc

SEQ ID NO: 1930576 - RNA, 19 nt, Human
augcacugugaaggacccu

SEQ ID NO: 1930577 - RNA, 12 nt, Human
augcacugugaa

SEQ ID NO: 1930578 - RNA, 13 nt, Human
augcacugugaag

SEQ ID NO: 1930579 - RNA, 14 nt, Human
augcacucagcucu

SEQ ID NO: 1930580 - RNA, 18 nt, Human
uuuaaaaaaauuccaagu

SEQ ID NO: 1930581 - RNA, 23 nt, Human
augcacuuuguucuggcucuucc

SEQ ID NO: 1930582 - RNA, 15 nt, Human
auuucaugauuucau

SEQ ID NO: 1930583 - RNA, 21 nt, Human
auuucaucugcucuccuuccu

SEQ ID NO: 1930584 - RNA, 20 nt, Human
auuucaucugcucuccuucc

SEQ ID NO: 1930585 - RNA, 19 nt, Human
auuucaucugcucuccuuc

SEQ ID NO: 1930586 - RNA, 18 nt, Human
auuucaucugcucuccuu

SEQ ID NO: 1930587 - RNA, 21 nt, Human
auuuccuaaauauauuuuaag

SEQ ID NO: 1930588 - RNA, 18 nt, Human
auuuccuaucaccuauuu

SEQ ID NO: 1930589 - RNA, 14 nt, Human
auuuccuaaauaua

SEQ ID NO: 1930590 - RNA, 17 nt, Human
auuuccguuaaaauacc

SEQ ID NO: 1930591 - RNA, 14 nt, Human
auuucccaaagcag

SEQ ID NO: 1930592 - RNA, 16 nt, Human
auuucccaaagcagug

SEQ ID NO: 1930593 - RNA, 17 nt, Human
auuucuaaaauauaaga

SEQ ID NO: 1930594 - RNA, 23 nt, Human
auuuccuugaauguggcuugaga

SEQ ID NO: 1930595 - RNA, 23 nt, Human
auuuauuggccccccgaccuugu

SEQ ID NO: 1930596 - RNA, 14 nt, Human
auuuauuaccucug

SEQ ID NO: 1930597 - RNA, 15 nt, Human
auuuauuaccucuga

SEQ ID NO: 1930598 - RNA, 16 nt, Human
auuguaguccuguaau

SEQ ID NO: 1930599 - RNA, 17 nt, Human
auuguagagccagaggu

SEQ ID NO: 1930600 - RNA, 17 nt, Human
auuguagcauccuggaa

SEQ ID NO: 1930601 - RNA, 18 nt, Human
auuguagagccagagguc

SEQ ID NO: 1930602 - RNA, 17 nt, Human
auuguuuucaguguaca

SEQ ID NO: 1930603 - RNA, 20 nt, Human
auuguagcauccuggaauau

SEQ ID NO: 1930604 - RNA, 17 nt, Human
auuuaaaaaaaaaccug

SEQ ID NO: 1930605 - RNA, 18 nt, Human
auuguuuucaguguacau

SEQ ID NO: 1930606 - RNA, 19 nt, Human
auuguuuucaguguacaug

SEQ ID NO: 1930607 - RNA, 14 nt, Human
auuuaaaaaaaauc

SEQ ID NO: 1930608 - RNA, 15 nt, Human
auuuaaaauugugau

SEQ ID NO: 1930609 - RNA, 16 nt, Human
auuuaaauagcuuuuu

SEQ ID NO: 1930610 - RNA, 16 nt, Human
auuuacagagaaguga

SEQ ID NO: 1930611 - RNA, 19 nt, Human
auuuacagaugaauguauu

SEQ ID NO: 1930612 - RNA, 13 nt, Human
auuuacugagcuu

SEQ ID NO: 1930613 - RNA, 20 nt, Human
auuuacugagcuucucugug

SEQ ID NO: 1930614 - RNA, 21 nt, Human
auuuacugagcuucucuguga

SEQ ID NO: 1930615 - RNA, 22 nt, Human
auuuauaaauauauuuaagaua

SEQ ID NO: 1930616 - RNA, 15 nt, Human
auuuauaaacuuuuu

SEQ ID NO: 1930617 - RNA, 21 nt, Human
auuuauaaaacuucucaagau

SEQ ID NO: 1930618 - RNA, 14 nt, Human
auuuauaaaacuuc

SEQ ID NO: 1930619 - RNA, 15 nt, Human
auuuauaaaacuucu

SEQ ID NO: 1930620 - RNA, 17 nt, Human
auuuauaaagcuaaaau

SEQ ID NO: 1930621 - RNA, 21 nt, Human
auuuauaaagcuaaaauaacc

SEQ ID NO: 1930622 - RNA, 13 nt, Human
auuuauguuugca

SEQ ID NO: 1930623 - RNA, 16 nt, Human
auuuauuaauugcuuu

SEQ ID NO: 1930624 - RNA, 17 nt, Human
auuuauuaauugcuuug

SEQ ID NO: 1930625 - RNA, 18 nt, Human
auuuauuaauugcuuuga

SEQ ID NO: 1930626 - RNA, 16 nt, Human
auuuaguguucauaaa

SEQ ID NO: 1930627 - RNA, 19 nt, Human
auuuacuucuuauacauuu

SEQ ID NO: 1930628 - RNA, 20 nt, Human
auuuacuucuuauacauuug

SEQ ID NO: 1930629 - RNA, 17 nt, Human
auuuaguguucauaaau

SEQ ID NO: 1930630 - RNA, 23 nt, Human
auuuauaaaaauaaaaaacacug

SEQ ID NO: 1930631 - RNA, 21 nt, Human
auuuggugguuucagaaaugu

SEQ ID NO: 1930632 - RNA, 16 nt, Human
auuugguucauuaauu

SEQ ID NO: 1930633 - RNA, 21 nt, Human
auuugguucauuaauucuaua

SEQ ID NO: 1930634 - RNA, 18 nt, Human
auuugguuuagaacauaa

SEQ ID NO: 1930635 - RNA, 15 nt, Human
auuugguucuaauag

SEQ ID NO: 1930636 - RNA, 18 nt, Human
auuugguucuaggccggg

SEQ ID NO: 1930637 - RNA, 14 nt, Human
auuugguuuucaca

SEQ ID NO: 1930638 - RNA, 12 nt, Human
auuugguuuuca

SEQ ID NO: 1930639 - RNA, 21 nt, Human
auuugaggucuguucuuucca

SEQ ID NO: 1930640 - RNA, 19 nt, Human
auuugauaugugaacaguu

SEQ ID NO: 1930641 - RNA, 18 nt, Human
auuugauaugugaacagu

SEQ ID NO: 1930642 - RNA, 20 nt, Human
auuugauaguauugugcaua

SEQ ID NO: 1930643 - RNA, 16 nt, Human
auuugagcagggcuca

SEQ ID NO: 1930644 - RNA, 15 nt, Human
auuugagcagggcuc

SEQ ID NO: 1930645 - RNA, 18 nt, Human
auuugaggucuguucuuu

SEQ ID NO: 1930646 - RNA, 17 nt, Human
auuugaggucuguucuu

SEQ ID NO: 1930647 - RNA, 14 nt, Human
auuugagaauauaa

SEQ ID NO: 1930648 - RNA, 21 nt, Human
auuugagaauauaaaaaacuu

SEQ ID NO: 1930649 - RNA, 16 nt, Human
auuucuuccacaagag

SEQ ID NO: 1930650 - RNA, 20 nt, Human
auuucuugagguaaaagcau

SEQ ID NO: 1930651 - RNA, 16 nt, Human
auuucuucaccagauu

SEQ ID NO: 1930652 - RNA, 23 nt, Human
auuugaauguaugcuucauacag

SEQ ID NO: 1930653 - RNA, 13 nt, Human
auuucuucaccag

SEQ ID NO: 1930654 - RNA, 13 nt, Human
auuucuugugccu

SEQ ID NO: 1930655 - RNA, 20 nt, Human
auugccuucauuuuaugaua

SEQ ID NO: 1930656 - RNA, 13 nt, Human
auugccuucauuu

SEQ ID NO: 1930657 - RNA, 13 nt, Human
auuggaaacaagu

SEQ ID NO: 1930658 - RNA, 14 nt, Human
auuggaaacaaguc

SEQ ID NO: 1930659 - RNA, 15 nt, Human
auuggaacagugaau

SEQ ID NO: 1930660 - RNA, 11 nt, Human
auugcauugac

SEQ ID NO: 1930661 - RNA, 16 nt, Human
auugcauauauacaua

SEQ ID NO: 1930662 - RNA, 22 nt, Human
auuggcuagagguucaaagaua

SEQ ID NO: 1930663 - RNA, 20 nt, Human
auuggcuagagguucaaaga

SEQ ID NO: 1930664 - RNA, 19 nt, Human
auuggcuagagguucaaag

SEQ ID NO: 1930665 - RNA, 23 nt, Human
auuggcuagagguucaaagauau

SEQ ID NO: 1930666 - RNA, 16 nt, Human
auuggcucacacugag

SEQ ID NO: 1930667 - RNA, 15 nt, Human
auuggcucacacuga

SEQ ID NO: 1930668 - RNA, 13 nt, Human
auuggcucacacu

SEQ ID NO: 1930669 - RNA, 14 nt, Human
auugauuugaagaa

SEQ ID NO: 1930670 - RNA, 16 nt, Human
auugauuugaagaaca

SEQ ID NO: 1930671 - RNA, 12 nt, Human
auugauuugcau

SEQ ID NO: 1930672 - RNA, 13 nt, Human
auugauuugcauu

SEQ ID NO: 1930673 - RNA, 15 nt, Human
auugauuugcauuga

SEQ ID NO: 1930674 - RNA, 16 nt, Human
auugauuugcauugaa

SEQ ID NO: 1930675 - RNA, 20 nt, Human
auugauuugcauugaacaca

SEQ ID NO: 1930676 - RNA, 19 nt, Human
auugcaacaggcugggcuu

SEQ ID NO: 1930677 - RNA, 12 nt, Human
auugcaccacug

SEQ ID NO: 1930678 - RNA, 18 nt, Human
auugcaacaggcugggcu

SEQ ID NO: 1930679 - RNA, 17 nt, Human
auugcaacaggcugggc

SEQ ID NO: 1930680 - RNA, 14 nt, Human
auugaacacaaacu

SEQ ID NO: 1930681 - RNA, 19 nt, Human
auugaaggcuuaaacccau

SEQ ID NO: 1930682 - RNA, 15 nt, Human
auugaaggcuuaaac

SEQ ID NO: 1930683 - RNA, 15 nt, Human
auugaacacaaacug

SEQ ID NO: 1930684 - RNA, 16 nt, Human
auugaacacaaacugu

SEQ ID NO: 1930685 - RNA, 17 nt, Human
auugaacacaaacugua

SEQ ID NO: 1930686 - RNA, 18 nt, Human
auugaacacaaacuguaa

SEQ ID NO: 1930687 - RNA, 19 nt, Human
auugaacacaaacuguaaa

SEQ ID NO: 1930688 - RNA, 20 nt, Human
auugaacacaaacuguaaau

SEQ ID NO: 1930689 - RNA, 14 nt, Human
auugaacagcaaag

SEQ ID NO: 1930690 - RNA, 10 nt, Human
auugaaucua

SEQ ID NO: 1930691 - RNA, 14 nt, Human
auugaaucuauuua

SEQ ID NO: 1930692 - RNA, 16 nt, Human
auugaaucuauuuaag

SEQ ID NO: 1930693 - RNA, 23 nt, Human
auugaauauaauauauuugugua

SEQ ID NO: 1930694 - RNA, 13 nt, Human
auugaaucaguau

SEQ ID NO: 1930695 - RNA, 20 nt, Human
auugaaucaguauaaacaaa

SEQ ID NO: 1930696 - RNA, 17 nt, Human
auuggcucacacugaga

SEQ ID NO: 1930697 - RNA, 18 nt, Human
auugaaucuauuuaagua

SEQ ID NO: 1930698 - RNA, 13 nt, Human
auuacuguuugga

SEQ ID NO: 1930699 - RNA, 13 nt, Human
auuaaguuguuaa

SEQ ID NO: 1930700 - RNA, 13 nt, Human
auuaaucacuauu

SEQ ID NO: 1930701 - RNA, 16 nt, Human
auuaaucacuauuguu

SEQ ID NO: 1930702 - RNA, 13 nt, Human
auuacuucugcua

SEQ ID NO: 1930703 - RNA, 12 nt, Human
auuacuucugcu

SEQ ID NO: 1930704 - RNA, 14 nt, Human
auuacuucugcuac

SEQ ID NO: 1930705 - RNA, 13 nt, Human
auuagagaagaga

SEQ ID NO: 1930706 - RNA, 15 nt, Human
uuuuugaagcuguau

SEQ ID NO: 1930707 - RNA, 16 nt, Human
uuuuucaauauuuauu

SEQ ID NO: 1930708 - RNA, 12 nt, Human
uuuuuauuucug

SEQ ID NO: 1930709 - RNA, 19 nt, Human
uuuuuauuuguuugugcau

SEQ ID NO: 1930710 - RNA, 13 nt, Human
uuuuuggacauuu

SEQ ID NO: 1930711 - RNA, 12 nt, Human
uuuuuguauguu

SEQ ID NO: 1930712 - RNA, 15 nt, Human
auuaagccuuccaca

SEQ ID NO: 1930713 - RNA, 13 nt, Human
auuaaggaagaca

SEQ ID NO: 1930714 - RNA, 18 nt, Human
auuaaguacuauguauca

SEQ ID NO: 1930715 - RNA, 19 nt, Human
auuaaguacuauguaucaa

SEQ ID NO: 1930716 - RNA, 12 nt, Human
uuuuuaauuauu

SEQ ID NO: 1930717 - RNA, 16 nt, Human
uuuuguuuuugucuua

SEQ ID NO: 1930718 - RNA, 23 nt, Human
uuuuguucgcauggucacacacu

SEQ ID NO: 1930719 - RNA, 19 nt, Human
uuuuguuccccuccuccac

SEQ ID NO: 1930720 - RNA, 15 nt, Human
uuuuguuccccuccu

SEQ ID NO: 1930721 - RNA, 14 nt, Human
uuuuguuccccucc

SEQ ID NO: 1930722 - RNA, 22 nt, Human
uuuuguucccauccucuucuuu

SEQ ID NO: 1930723 - RNA, 21 nt, Human
uuuugugaaguuuaauugacu

SEQ ID NO: 1930724 - RNA, 17 nt, Human
auuccaagugauugaaa

SEQ ID NO: 1930725 - RNA, 17 nt, Human
auucccaagcucugcuc

SEQ ID NO: 1930726 - RNA, 20 nt, Human
auuccagaaugcuguacauc

SEQ ID NO: 1930727 - RNA, 23 nt, Human
auuccagaaugcuguacaucuau

SEQ ID NO: 1930728 - RNA, 14 nt, Human
auuccagaaugcug

SEQ ID NO: 1930729 - RNA, 15 nt, Human
auuccagaaugcugu

SEQ ID NO: 1930730 - RNA, 19 nt, Human
auuccagaaugcuguacau

SEQ ID NO: 1930731 - RNA, 19 nt, Human
auucccaagcucugcuccu

SEQ ID NO: 1930732 - RNA, 18 nt, Human
auucccaagcucugcucc

SEQ ID NO: 1930733 - RNA, 20 nt, Human
auuccccaggaggccagccu

SEQ ID NO: 1930734 - RNA, 22 nt, Human
auuccccaggaggccagccuug

SEQ ID NO: 1930735 - RNA, 14 nt, Human
auucagccuggcuu

SEQ ID NO: 1930736 - RNA, 13 nt, Human
auucacuucacgc

SEQ ID NO: 1930737 - RNA, 12 nt, Human
auucacuucacg

SEQ ID NO: 1930738 - RNA, 15 nt, Human
auucagugauuacug

SEQ ID NO: 1930739 - RNA, 17 nt, Human
auucagugauuacuguc

SEQ ID NO: 1930740 - RNA, 19 nt, Human
auucagugauuacugucaa

SEQ ID NO: 1930741 - RNA, 19 nt, Human
auucaguggcgagaaauaa

SEQ ID NO: 1930742 - RNA, 20 nt, Human
auuauauggcuugaguuuaa

SEQ ID NO: 1930743 - RNA, 18 nt, Human
auuaguuuugcauaauuu

SEQ ID NO: 1930744 - RNA, 19 nt, Human
auucaccugccccaacucu

SEQ ID NO: 1930745 - RNA, 23 nt, Human
auucaccuuccagugucucggag

SEQ ID NO: 1930746 - RNA, 17 nt, Human
auucaaacuggggccuc

SEQ ID NO: 1930747 - RNA, 19 nt, Human
auucaaacuggggccucca

SEQ ID NO: 1930748 - RNA, 22 nt, Human
auucaaacuggggccuccagaa

SEQ ID NO: 1930749 - RNA, 14 nt, Human
auucaaagaaauau

SEQ ID NO: 1930750 - RNA, 16 nt, Human
auucaaagaaauaucu

SEQ ID NO: 1930751 - RNA, 15 nt, Human
auucagccuggcuuc

SEQ ID NO: 1930752 - RNA, 13 nt, Human
uuugagacaggag

SEQ ID NO: 1930753 - RNA, 13 nt, Human
uuugagacagagu

SEQ ID NO: 1930754 - RNA, 14 nt, Human
uuugagaagaaaac

SEQ ID NO: 1930755 - RNA, 18 nt, Human
uuugagaagaaaacaucu

SEQ ID NO: 1930756 - RNA, 18 nt, Human
uuugaccucugcagcaau

SEQ ID NO: 1930757 - RNA, 23 nt, Human
uuugaccuguugggagugaggau

SEQ ID NO: 1930758 - RNA, 13 nt, Human
uuugaccuuuuau

SEQ ID NO: 1930759 - RNA, 14 nt, Human
uuugacuuucauug

SEQ ID NO: 1930760 - RNA, 15 nt, Human
uuugauccaagcugg

SEQ ID NO: 1930761 - RNA, 12 nt, Human
uuugaucuucaa

SEQ ID NO: 1930762 - RNA, 15 nt, Human
uuugaucuucaacaa

SEQ ID NO: 1930763 - RNA, 18 nt, Human
uuugaucuucaacaaauu

SEQ ID NO: 1930764 - RNA, 15 nt, Human
uuugauucagacagc

SEQ ID NO: 1930765 - RNA, 18 nt, Human
uuugacaaagguaaauca

SEQ ID NO: 1930766 - RNA, 14 nt, Human
uuugacaaggggca

SEQ ID NO: 1930767 - RNA, 21 nt, Human
uuugaccucugcagcaauaaa

SEQ ID NO: 1930768 - RNA, 19 nt, Human
uuugaccucugcagcaaua

SEQ ID NO: 1930769 - RNA, 23 nt, Human
uuucccucccuuccucuuuccau

SEQ ID NO: 1930770 - RNA, 13 nt, Human
uuucccugaccuc

SEQ ID NO: 1930771 - RNA, 22 nt, Human
uuucccugcuuaaugaaaagcu

SEQ ID NO: 1930772 - RNA, 15 nt, Human
uuucccuugaggaaa

SEQ ID NO: 1930773 - RNA, 14 nt, Human
uuucccuucaucug

SEQ ID NO: 1930774 - RNA, 14 nt, Human
uuugauuucauuaa

SEQ ID NO: 1930775 - RNA, 18 nt, Human
uuugauucagacagcugc

SEQ ID NO: 1930776 - RNA, 15 nt, Human
uuugauugauuugaa

SEQ ID NO: 1930777 - RNA, 22 nt, Human
uuugcuggggccgaaagaacag

SEQ ID NO: 1930778 - RNA, 19 nt, Human
uuugcuggggccgaaagaa

SEQ ID NO: 1930779 - RNA, 20 nt, Human
uuugcuggagcucugcccau

SEQ ID NO: 1930780 - RNA, 22 nt, Human
uuugcuaacuagcuuggaaacu

SEQ ID NO: 1930781 - RNA, 22 nt, Human
uuuggauuggaugaauuccaaa

SEQ ID NO: 1930782 - RNA, 20 nt, Human
uuuggauuggggucccucua

SEQ ID NO: 1930783 - RNA, 14 nt, Human
uuuggauuguauau

SEQ ID NO: 1930784 - RNA, 16 nt, Human
uuuggauuugacauug

SEQ ID NO: 1930785 - RNA, 22 nt, Human
uuugggguacccacugcucugg

SEQ ID NO: 1930786 - RNA, 21 nt, Human
uuugggguacccacugcucug

SEQ ID NO: 1930787 - RNA, 13 nt, Human
uuuggggaagaac

SEQ ID NO: 1930788 - RNA, 23 nt, Human
auguauaauauuuuuaauuaaau

SEQ ID NO: 1930789 - RNA, 14 nt, Human
auguauaauauuuu

SEQ ID NO: 1930790 - RNA, 17 nt, Human
auguauauaaacaugcu

SEQ ID NO: 1930791 - RNA, 12 nt, Human
uuuggcugcuga

SEQ ID NO: 1930792 - RNA, 13 nt, Human
uuuggcugcugaa

SEQ ID NO: 1930793 - RNA, 14 nt, Human
uuuggauuugacau

SEQ ID NO: 1930794 - RNA, 18 nt, Human
uuuggcaaacucuccacc

SEQ ID NO: 1930795 - RNA, 11 nt, Human
augugacacau

SEQ ID NO: 1930796 - RNA, 18 nt, Human
augugacauucuuaaaaa

SEQ ID NO: 1930797 - RNA, 23 nt, Human
augugacauucuuaaaaaaagaa

SEQ ID NO: 1930798 - RNA, 23 nt, Human
augucgucaaagcugaaauggac

SEQ ID NO: 1930799 - RNA, 14 nt, Human
augugagacugguu

SEQ ID NO: 1930800 - RNA, 16 nt, Human
augugagagguuugac

SEQ ID NO: 1930801 - RNA, 13 nt, Human
augugagaccauu

SEQ ID NO: 1930802 - RNA, 17 nt, Human
augugagagguuugacu

SEQ ID NO: 1930803 - RNA, 16 nt, Human
auguccaagaagccca

SEQ ID NO: 1930804 - RNA, 17 nt, Human
auguccaagaagcccag

SEQ ID NO: 1930805 - RNA, 12 nt, Human
auguaucaauga

SEQ ID NO: 1930806 - RNA, 19 nt, Human
auguauauuuuauaucaau

SEQ ID NO: 1930807 - RNA, 22 nt, Human
auguauauauuuuuuaaaaauc

SEQ ID NO: 1930808 - RNA, 15 nt, Human
augugaugagaggaa

SEQ ID NO: 1930809 - RNA, 16 nt, Human
uuuguaauuuuuuuau

SEQ ID NO: 1930810 - RNA, 14 nt, Human
uuuguacagacaac

SEQ ID NO: 1930811 - RNA, 14 nt, Human
uuuguuucugaaag

SEQ ID NO: 1930812 - RNA, 16 nt, Human
uuuguuucugaaaggg

SEQ ID NO: 1930813 - RNA, 15 nt, Human
uuuguuuguuuuccu

SEQ ID NO: 1930814 - RNA, 13 nt, Human
uuuguuucauauu

SEQ ID NO: 1930815 - RNA, 22 nt, Human
uuugugcauuaucuagauacug

SEQ ID NO: 1930816 - RNA, 13 nt, Human
uuugugcauuuuc

SEQ ID NO: 1930817 - RNA, 15 nt, Human
uuugugcauuuucua

SEQ ID NO: 1930818 - RNA, 19 nt, Human
uuugugcauuaucuagaua

SEQ ID NO: 1930819 - RNA, 15 nt, Human
uuugugauacaaugc

SEQ ID NO: 1930820 - RNA, 22 nt, Human
uuugugauacaaugcugugccc

SEQ ID NO: 1930821 - RNA, 16 nt, Human
uuugugauacaaugcu

SEQ ID NO: 1930822 - RNA, 23 nt, Human
uuugucuuaaaaaguggaaaaau

SEQ ID NO: 1930823 - RNA, 13 nt, Human
uuugucuuaaaaa

SEQ ID NO: 1930824 - RNA, 14 nt, Human
uuugucuuaaaaag

SEQ ID NO: 1930825 - RNA, 18 nt, Human
uuuucuggaauguaauca

SEQ ID NO: 1930826 - RNA, 21 nt, Human
uuuucuuaaccagaucauugu

SEQ ID NO: 1930827 - RNA, 13 nt, Human
uuuucuguucuuu

SEQ ID NO: 1930828 - RNA, 23 nt, Human
uuuucuguuacuuuguuuuuuaa

SEQ ID NO: 1930829 - RNA, 21 nt, Human
auguuuacacucuuuguaaga

SEQ ID NO: 1930830 - RNA, 19 nt, Human
auguuuacacucuuuguaa

SEQ ID NO: 1930831 - RNA, 18 nt, Human
auguuuacacucuuugua

SEQ ID NO: 1930832 - RNA, 16 nt, Human
auguuuacacucuuug

SEQ ID NO: 1930833 - RNA, 16 nt, Human
auguuuacaaauggac

SEQ ID NO: 1930834 - RNA, 17 nt, Human
auguuggccaggcuggu

SEQ ID NO: 1930835 - RNA, 19 nt, Human
auuaaaacacaacaucuuu

SEQ ID NO: 1930836 - RNA, 23 nt, Human
auuaaaaaucucaaauuucuaaa

SEQ ID NO: 1930837 - RNA, 15 nt, Human
auguuuuuuuuuaaa

SEQ ID NO: 1930838 - RNA, 22 nt, Human
auguuuuuuaaaauauuuaucu

SEQ ID NO: 1930839 - RNA, 14 nt, Human
auuaaaaaaaaaga

SEQ ID NO: 1930840 - RNA, 20 nt, Human
auuaaaaaaaaagaucuguu

SEQ ID NO: 1930841 - RNA, 16 nt, Human
uuuucuauaauuuaaa

SEQ ID NO: 1930842 - RNA, 15 nt, Human
uuuucuacuguuuua

SEQ ID NO: 1930843 - RNA, 12 nt, Human
uuuuccaggcug

SEQ ID NO: 1930844 - RNA, 17 nt, Human
uuuucucugauacagaa

SEQ ID NO: 1930845 - RNA, 14 nt, Human
uuuucaguguacau

SEQ ID NO: 1930846 - RNA, 15 nt, Human
uuuuaguagagacag

SEQ ID NO: 1930847 - RNA, 21 nt, Human
uuuuagacagucucacuuugu

SEQ ID NO: 1930848 - RNA, 19 nt, Human
uuuuauggcuuuugugcau

SEQ ID NO: 1930849 - RNA, 18 nt, Human
uuuuauggcuuuugugca

SEQ ID NO: 1930850 - RNA, 21 nt, Human
uuuuauggcuuuugugcauua

SEQ ID NO: 1930851 - RNA, 12 nt, Human
uuuuauuaaauu

SEQ ID NO: 1930852 - RNA, 16 nt, Human
uuuuauugacacagaa

SEQ ID NO: 1930853 - RNA, 19 nt, Human
uuuuauugaaucuauuuaa

SEQ ID NO: 1930854 - RNA, 18 nt, Human
uuuuauugacacagaaaa

SEQ ID NO: 1930855 - RNA, 20 nt, Human
auguuauuuuuuaauuauua

SEQ ID NO: 1930856 - RNA, 12 nt, Human
auguugaaagau

SEQ ID NO: 1930857 - RNA, 15 nt, Human
auguugcccaggcag

SEQ ID NO: 1930858 - RNA, 14 nt, Human
auguugcccaggca

SEQ ID NO: 1930859 - RNA, 13 nt, Human
auguugcccaggc

SEQ ID NO: 1930860 - RNA, 18 nt, Human
auguugaaagaucaaaag

SEQ ID NO: 1930861 - RNA, 17 nt, Human
uuuuagaguugauacua

SEQ ID NO: 1930862 - RNA, 21 nt, Human
uuuuagacccuauugcugcuu

SEQ ID NO: 1930863 - RNA, 16 nt, Human
auguugcccaggcagg

SEQ ID NO: 1930864 - RNA, 20 nt, Human
auguugcugugcacggugga

SEQ ID NO: 1930865 - RNA, 19 nt, Human
auguuauuuuuuaauuauu

SEQ ID NO: 1930866 - RNA, 17 nt, Human
auguuauuuuuuaauua

SEQ ID NO: 1930867 - RNA, 13 nt, Human
auguuauuuaaca

SEQ ID NO: 1930868 - RNA, 23 nt, Human
auguuauuuaacagcugaauuau

SEQ ID NO: 1930869 - RNA, 14 nt, Human
auguuacauuauua

SEQ ID NO: 1930870 - RNA, 20 nt, Human
auguuacauaagauaaaugu

SEQ ID NO: 1930871 - RNA, 14 nt, Human
auguuacauuguuu

SEQ ID NO: 1930872 - RNA, 19 nt, Human
auguuacauaagauaaaug

SEQ ID NO: 1930873 - RNA, 15 nt, Human
auguguguuuuaaaa

SEQ ID NO: 1930874 - RNA, 18 nt, Human
auguguuuaugugagcug

SEQ ID NO: 1930875 - RNA, 23 nt, Human
auguguguguguuguguguggga

SEQ ID NO: 1930876 - RNA, 22 nt, Human
auguguguguguuguguguggg

SEQ ID NO: 1930877 - RNA, 23 nt, Human
auguggaaaagccaagaggcugc

SEQ ID NO: 1930878 - RNA, 14 nt, Human
auguguggccugca

SEQ ID NO: 1930879 - RNA, 21 nt, Human
augugccagguuuuuggucug

SEQ ID NO: 1930880 - RNA, 20 nt, Human
augugccagggcaaugauga

SEQ ID NO: 1930881 - RNA, 21 nt, Human
augugccagggcaaugaugaa

SEQ ID NO: 1930882 - RNA, 21 nt, Human
uuuuaaaaaacugcugacugu

SEQ ID NO: 1930883 - RNA, 18 nt, Human
uuuuaaaaaacugcugac

SEQ ID NO: 1930884 - RNA, 20 nt, Human
cacccaagaccucagggcac

SEQ ID NO: 1930885 - RNA, 13 nt, Human
cacccaagggccu

SEQ ID NO: 1930886 - RNA, 17 nt, Human
caccauuuaaaaacagg

SEQ ID NO: 1930887 - RNA, 16 nt, Human
caccauugaaggcuua

SEQ ID NO: 1930888 - RNA, 15 nt, Human
caccauugaacugua

SEQ ID NO: 1930889 - RNA, 15 nt, Human
caccauugaaggcuu

SEQ ID NO: 1930890 - RNA, 14 nt, Human
caccauugaaggcu

SEQ ID NO: 1930891 - RNA, 13 nt, Human
caccauucagguc

SEQ ID NO: 1930892 - RNA, 13 nt, Human
caccauugaaggc

SEQ ID NO: 1930893 - RNA, 23 nt, Human
cacagcccagccacggacgcugg

SEQ ID NO: 1930894 - RNA, 16 nt, Human
cacagcccagccacgg

SEQ ID NO: 1930895 - RNA, 13 nt, Human
cacagcccagcca

SEQ ID NO: 1930896 - RNA, 12 nt, Human
cacagcccagcc

SEQ ID NO: 1930897 - RNA, 18 nt, Human
cacagcucuucuccaggc

SEQ ID NO: 1930898 - RNA, 19 nt, Human
cacagcccaaagaaggaaa

SEQ ID NO: 1930899 - RNA, 12 nt, Human
cacagcacagcc

SEQ ID NO: 1930900 - RNA, 15 nt, Human
cacagcacagccaac

SEQ ID NO: 1930901 - RNA, 22 nt, Human
cacacggacacucaaaagcugg

SEQ ID NO: 1930902 - RNA, 17 nt, Human
cacacgccucccacugg

SEQ ID NO: 1930903 - RNA, 20 nt, Human
cacacgccucccacuggggu

SEQ ID NO: 1930904 - RNA, 14 nt, Human
cacagcaaccccag

SEQ ID NO: 1930905 - RNA, 17 nt, Human
cacagcaaccccaggcu

SEQ ID NO: 1930906 - RNA, 18 nt, Human
cacagcaaccccaggcug

SEQ ID NO: 1930907 - RNA, 20 nt, Human
cacacguaaugaaacuugga

SEQ ID NO: 1930908 - RNA, 19 nt, Human
cacacguaaugaaacuugg

SEQ ID NO: 1930909 - RNA, 20 nt, Human
cacagcucuucuccaggcug

SEQ ID NO: 1930910 - RNA, 19 nt, Human
cacagcucuucuccaggcu

SEQ ID NO: 1930911 - RNA, 21 nt, Human
cacagcucuucuccaggcugu

SEQ ID NO: 1930912 - RNA, 16 nt, Human
cacaggacacagucag

SEQ ID NO: 1930913 - RNA, 17 nt, Human
cacaggacacagucaga

SEQ ID NO: 1930914 - RNA, 19 nt, Human
cacaggacacagucagauu

SEQ ID NO: 1930915 - RNA, 20 nt, Human
cacaggacaugcgguagcca

SEQ ID NO: 1930916 - RNA, 22 nt, Human
cacaggacaugcgguagccagc

SEQ ID NO: 1930917 - RNA, 23 nt, Human
cacaggacaugcgguagccagca

SEQ ID NO: 1930918 - RNA, 17 nt, Human
cacaggaucagucugau

SEQ ID NO: 1930919 - RNA, 16 nt, Human
cacaggaugaagcauu

SEQ ID NO: 1930920 - RNA, 14 nt, Human
cacaggcccggcuc

SEQ ID NO: 1930921 - RNA, 23 nt, Human
cacaguccuuaccagcagagcac

SEQ ID NO: 1930922 - RNA, 19 nt, Human
cacaggcagguccaggguu

SEQ ID NO: 1930923 - RNA, 24 nt, Human
cacaugaaucccacccacauguga

SEQ ID NO: 1930924 - RNA, 15 nt, Human
cacaugagauaauau

SEQ ID NO: 1930925 - RNA, 13 nt, Human
cacaugagcauca

SEQ ID NO: 1930926 - RNA, 17 nt, Human
cacaugagcaucaggcc

SEQ ID NO: 1930927 - RNA, 18 nt, Human
cacaugagcaucaggcca

SEQ ID NO: 1930928 - RNA, 19 nt, Human
cacaugagcaucaggccag

SEQ ID NO: 1930929 - RNA, 20 nt, Human
cacaugagcaucaggccagg

SEQ ID NO: 1930930 - RNA, 21 nt, Human
cacaugagcaucaggccaggc

SEQ ID NO: 1930931 - RNA, 19 nt, Human
cacagugagggagauccca

SEQ ID NO: 1930932 - RNA, 15 nt, Human
cacagugaagugcug

SEQ ID NO: 1930933 - RNA, 21 nt, Human
cacaugccucucucaggccaa

SEQ ID NO: 1930934 - RNA, 20 nt, Human
cacaugccucucucaggcca

SEQ ID NO: 1930935 - RNA, 18 nt, Human
cacaugcccuaaugucug

SEQ ID NO: 1930936 - RNA, 19 nt, Human
cacaugcccuaaugucugu

SEQ ID NO: 1930937 - RNA, 20 nt, Human
cacaugcccuaaugucugua

SEQ ID NO: 1930938 - RNA, 16 nt, Human
cacauguccaagaagc

SEQ ID NO: 1930939 - RNA, 17 nt, Human
cacauguccaagaagcc

SEQ ID NO: 1930940 - RNA, 18 nt, Human
cacaugcacgugugugca

SEQ ID NO: 1930941 - RNA, 20 nt, Human
cacaugcaaggucauuuuuu

SEQ ID NO: 1930942 - RNA, 19 nt, Human
cacaugcaaggucauuuuu

SEQ ID NO: 1930943 - RNA, 17 nt, Human
cacaugcaaggucauuu

SEQ ID NO: 1930944 - RNA, 16 nt, Human
cacaugagauaauaug

SEQ ID NO: 1930945 - RNA, 22 nt, Human
caccagugaaugaaagucuugu

SEQ ID NO: 1930946 - RNA, 20 nt, Human
caccagugaaugaaagucuu

SEQ ID NO: 1930947 - RNA, 16 nt, Human
caccagguagaacaca

SEQ ID NO: 1930948 - RNA, 16 nt, Human
caccagucauuuuuca

SEQ ID NO: 1930949 - RNA, 13 nt, Human
caccaucaagcca

SEQ ID NO: 1930950 - RNA, 14 nt, Human
caccaucaagccac

SEQ ID NO: 1930951 - RNA, 15 nt, Human
caccaucaagccacc

SEQ ID NO: 1930952 - RNA, 21 nt, Human
caccauauuaccacagacaua

SEQ ID NO: 1930953 - RNA, 18 nt, Human
caccaguuccuuucaaug

SEQ ID NO: 1930954 - RNA, 18 nt, Human
caccaucaugucuggcua

SEQ ID NO: 1930955 - RNA, 17 nt, Human
caccaucaugucuggcu

SEQ ID NO: 1930956 - RNA, 15 nt, Human
caccaucaugucugg

SEQ ID NO: 1930957 - RNA, 16 nt, Human
caccaucaagccacca

SEQ ID NO: 1930958 - RNA, 17 nt, Human
caccaucaagccaccaa

SEQ ID NO: 1930959 - RNA, 19 nt, Human
caccaucaagccaccaaca

SEQ ID NO: 1930960 - RNA, 24 nt, Human
caccaucaagccaccaacauacuc

SEQ ID NO: 1930961 - RNA, 19 nt, Human
caccauguuggccaggcug

SEQ ID NO: 1930962 - RNA, 20 nt, Human
caccauguugcccaggcugg

SEQ ID NO: 1930963 - RNA, 15 nt, Human
caccagagcccaccu

SEQ ID NO: 1930964 - RNA, 19 nt, Human
caccagacacccaggacuu

SEQ ID NO: 1930965 - RNA, 20 nt, Human
caccagacacccaggacuua

SEQ ID NO: 1930966 - RNA, 22 nt, Human
caccagagcccaccuuggcuca

SEQ ID NO: 1930967 - RNA, 20 nt, Human
caccagagcccaccuuggcu

SEQ ID NO: 1930968 - RNA, 18 nt, Human
caccagagcccaccuugg

SEQ ID NO: 1930969 - RNA, 17 nt, Human
caccagagcccaccuug

SEQ ID NO: 1930970 - RNA, 19 nt, Human
caccacacccagcccacuu

SEQ ID NO: 1930971 - RNA, 14 nt, Human
caccacacucagcc

SEQ ID NO: 1930972 - RNA, 19 nt, Human
caccacacugauccagccc

SEQ ID NO: 1930973 - RNA, 15 nt, Human
caccacacucagccc

SEQ ID NO: 1930974 - RNA, 15 nt, Human
caccagacacccagg

SEQ ID NO: 1930975 - RNA, 16 nt, Human
caccagacacccagga

SEQ ID NO: 1930976 - RNA, 17 nt, Human
caccagacacccaggac

SEQ ID NO: 1930977 - RNA, 18 nt, Human
caccagacacccaggacu

SEQ ID NO: 1930978 - RNA, 23 nt, Human
cacauguccaagaagcccaggaa

SEQ ID NO: 1930979 - RNA, 17 nt, Human
caccaacgucugugcca

SEQ ID NO: 1930980 - RNA, 13 nt, Human
caccaagcacagc

SEQ ID NO: 1930981 - RNA, 14 nt, Human
caccaagcacagca

SEQ ID NO: 1930982 - RNA, 15 nt, Human
caccaagcacagcag

SEQ ID NO: 1930983 - RNA, 16 nt, Human
caccaagcacagcagc

SEQ ID NO: 1930984 - RNA, 17 nt, Human
caccaagcacagcagcc

SEQ ID NO: 1930985 - RNA, 18 nt, Human
cacauguccaagaagccc

SEQ ID NO: 1930986 - RNA, 19 nt, Human
cacauguccaagaagccca

SEQ ID NO: 1930987 - RNA, 21 nt, Human
cacauguccaagaagcccagg

SEQ ID NO: 1930988 - RNA, 22 nt, Human
cacauguccaagaagcccagga

SEQ ID NO: 1930989 - RNA, 12 nt, Human
caccaagcccag

SEQ ID NO: 1930990 - RNA, 18 nt, Human
caccaagcacagcagccu

SEQ ID NO: 1930991 - RNA, 19 nt, Human
caccaagcacagcagccug

SEQ ID NO: 1930992 - RNA, 13 nt, Human
caccaagcccagu

SEQ ID NO: 1930993 - RNA, 10 nt, Human
cacaaauaaa

SEQ ID NO: 1930994 - RNA, 13 nt, Human
cacaaaguggcau

SEQ ID NO: 1930995 - RNA, 13 nt, Human
cacaaacuguaaa

SEQ ID NO: 1930996 - RNA, 17 nt, Human
cacaaagguagcuuuuc

SEQ ID NO: 1930997 - RNA, 15 nt, Human
cacaagaaaugaaag

SEQ ID NO: 1930998 - RNA, 13 nt, Human
cacaagaaaugaa

SEQ ID NO: 1930999 - RNA, 13 nt, Human
cacaagugguggu

SEQ ID NO: 1931000 - RNA, 23 nt, Human
cacaagacccaaaaggcagaagc

SEQ ID NO: 1931001 - RNA, 23 nt, Human
cacaagaaaugaaagcagggacu

SEQ ID NO: 1931002 - RNA, 14 nt, Human
caaugcacuuuguu

SEQ ID NO: 1931003 - RNA, 18 nt, Human
caaugguuuucuugugug

SEQ ID NO: 1931004 - RNA, 18 nt, Human
caaugguuugcaaggaag

SEQ ID NO: 1931005 - RNA, 17 nt, Human
caaugguuugcaaggaa

SEQ ID NO: 1931006 - RNA, 16 nt, Human
caaugguuugcaagga

SEQ ID NO: 1931007 - RNA, 13 nt, Human
caaugguuugcaa

SEQ ID NO: 1931008 - RNA, 20 nt, Human
caaugguuugcaaggaagcc

SEQ ID NO: 1931009 - RNA, 19 nt, Human
caaugguuugcaaggaagc

SEQ ID NO: 1931010 - RNA, 17 nt, Human
cacaaacgggcucagca

SEQ ID NO: 1931011 - RNA, 12 nt, Human
cacaaacuguaa

SEQ ID NO: 1931012 - RNA, 14 nt, Human
cacacacuuuggcu

SEQ ID NO: 1931013 - RNA, 14 nt, Human
cacacacugaugcu

SEQ ID NO: 1931014 - RNA, 21 nt, Human
cacacagaggcugccucuccc

SEQ ID NO: 1931015 - RNA, 20 nt, Human
cacacaccagagcccaccuu

SEQ ID NO: 1931016 - RNA, 16 nt, Human
cacacaccagagccca

SEQ ID NO: 1931017 - RNA, 15 nt, Human
cacacaccagagccc

SEQ ID NO: 1931018 - RNA, 22 nt, Human
cacaaucucauugaggagcauu

SEQ ID NO: 1931019 - RNA, 19 nt, Human
cacacaaggauagaugcug

SEQ ID NO: 1931020 - RNA, 15 nt, Human
cacacagcucugucc

SEQ ID NO: 1931021 - RNA, 14 nt, Human
cacacagcucuguc

SEQ ID NO: 1931022 - RNA, 13 nt, Human
cacacagcucugu

SEQ ID NO: 1931023 - RNA, 19 nt, Human
cacacagcaagucaggguu

SEQ ID NO: 1931024 - RNA, 22 nt, Human
cacaccagagcccaccuuggcu

SEQ ID NO: 1931025 - RNA, 21 nt, Human
cacaccagagcccaccuuggc

SEQ ID NO: 1931026 - RNA, 16 nt, Human
cacacagcucuguccu

SEQ ID NO: 1931027 - RNA, 20 nt, Human
cacacccagcccacuucugc

SEQ ID NO: 1931028 - RNA, 14 nt, Human
cacacccagcccac

SEQ ID NO: 1931029 - RNA, 14 nt, Human
caauauuauaauuu

SEQ ID NO: 1931030 - RNA, 22 nt, Human
caauauuauaauuuuuuucaau

SEQ ID NO: 1931031 - RNA, 14 nt, Human
caauaucagacuuu

SEQ ID NO: 1931032 - RNA, 14 nt, Human
caauauuaaaucug

SEQ ID NO: 1931033 - RNA, 15 nt, Human
caauauuaaaucugc

SEQ ID NO: 1931034 - RNA, 13 nt, Human
caauauuauaauu

SEQ ID NO: 1931035 - RNA, 14 nt, Human
caaugcacugacau

SEQ ID NO: 1931036 - RNA, 13 nt, Human
caaugcacuuugu

SEQ ID NO: 1931037 - RNA, 23 nt, Human
caaugcaaaccaucauugaaauc

SEQ ID NO: 1931038 - RNA, 14 nt, Human
caaugauggucacc

SEQ ID NO: 1931039 - RNA, 14 nt, Human
caaugcaaaccauc

SEQ ID NO: 1931040 - RNA, 21 nt, Human
caaugcaaaccaucauugaaa

SEQ ID NO: 1931041 - RNA, 22 nt, Human
caaugcaaaccaucauugaaau

SEQ ID NO: 1931042 - RNA, 14 nt, Human
caaugaccuuucaa

SEQ ID NO: 1931043 - RNA, 13 nt, Human
caaugauggucac

SEQ ID NO: 1931044 - RNA, 15 nt, Human
caaugaccuuucaau

SEQ ID NO: 1931045 - RNA, 16 nt, Human
caaugaccuuucaaua

SEQ ID NO: 1931046 - RNA, 20 nt, Human
caaaggagagucacagaaca

SEQ ID NO: 1931047 - RNA, 14 nt, Human
caaaggagauugga

SEQ ID NO: 1931048 - RNA, 20 nt, Human
caaaggagauuggaaggaac

SEQ ID NO: 1931049 - RNA, 23 nt, Human
caaaggguaucaggugcugccau

SEQ ID NO: 1931050 - RNA, 19 nt, Human
caaagugguauagaaaugc

SEQ ID NO: 1931051 - RNA, 18 nt, Human
caaagugguauagaaaug

SEQ ID NO: 1931052 - RNA, 16 nt, Human
caaaguggugagaggc

SEQ ID NO: 1931053 - RNA, 17 nt, Human
caaaguggugagaggca

SEQ ID NO: 1931054 - RNA, 21 nt, Human
caaaggguaucaggugcugcc

SEQ ID NO: 1931055 - RNA, 20 nt, Human
caaaggguaucaggugcugc

SEQ ID NO: 1931056 - RNA, 12 nt, Human
caaagggcccag

SEQ ID NO: 1931057 - RNA, 14 nt, Human
caaagggcccagau

SEQ ID NO: 1931058 - RNA, 22 nt, Human
caaagggcuccucuccagucug

SEQ ID NO: 1931059 - RNA, 16 nt, Human
caaaggguccagaagg

SEQ ID NO: 1931060 - RNA, 19 nt, Human
caaaguggugagaggcauc

SEQ ID NO: 1931061 - RNA, 13 nt, Human
caaauauuccaga

SEQ ID NO: 1931062 - RNA, 17 nt, Human
caaauauuccagagacu

SEQ ID NO: 1931063 - RNA, 19 nt, Human
caaauugccuucauuuuau

SEQ ID NO: 1931064 - RNA, 17 nt, Human
caaauuguaagcaugca

SEQ ID NO: 1931065 - RNA, 16 nt, Human
caaauuaauaaucuua

SEQ ID NO: 1931066 - RNA, 17 nt, Human
caaauuaauaaucuuau

SEQ ID NO: 1931067 - RNA, 15 nt, Human
caaauuaauaaucuu

SEQ ID NO: 1931068 - RNA, 18 nt, Human
caaauucugucucuggau

SEQ ID NO: 1931069 - RNA, 13 nt, Human
caaagaaauuaug

SEQ ID NO: 1931070 - RNA, 15 nt, Human
caaagaaauuaugug

SEQ ID NO: 1931071 - RNA, 12 nt, Human
caaagaaauuau

SEQ ID NO: 1931072 - RNA, 17 nt, Human
caaagcccaaaguggua

SEQ ID NO: 1931073 - RNA, 15 nt, Human
caaagagaaaaagaa

SEQ ID NO: 1931074 - RNA, 16 nt, Human
caaagagaaaaagaaa

SEQ ID NO: 1931075 - RNA, 14 nt, Human
caaagaguagaauu

SEQ ID NO: 1931076 - RNA, 19 nt, Human
caaagcccaaagugguaua

SEQ ID NO: 1931077 - RNA, 14 nt, Human
caaagcccaaggga

SEQ ID NO: 1931078 - RNA, 14 nt, Human
caaagagguuuuaa

SEQ ID NO: 1931079 - RNA, 21 nt, Human
caaagagguuuuaaaaaaauc

SEQ ID NO: 1931080 - RNA, 14 nt, Human
auuuuaaucaaguu

SEQ ID NO: 1931081 - RNA, 18 nt, Human
auuuuaaucaaguugaau

SEQ ID NO: 1931082 - RNA, 21 nt, Human
auuuuaaugcaccugaauguu

SEQ ID NO: 1931083 - RNA, 21 nt, Human
auuuuaagacguguuuguguu

SEQ ID NO: 1931084 - RNA, 20 nt, Human
caacaggcugggcuucagug

SEQ ID NO: 1931085 - RNA, 15 nt, Human
caaacuggggccucc

SEQ ID NO: 1931086 - RNA, 22 nt, Human
caacaguuuuuuaugcuaauca

SEQ ID NO: 1931087 - RNA, 14 nt, Human
caacauacucccau

SEQ ID NO: 1931088 - RNA, 15 nt, Human
caacauacucccauc

SEQ ID NO: 1931089 - RNA, 16 nt, Human
caacauacucccaucu

SEQ ID NO: 1931090 - RNA, 13 nt, Human
caaccuaaauuug

SEQ ID NO: 1931091 - RNA, 15 nt, Human
caaccuauuuugaag

SEQ ID NO: 1931092 - RNA, 16 nt, Human
caaccuauuuugaagu

SEQ ID NO: 1931093 - RNA, 14 nt, Human
caacaggcugggcu

SEQ ID NO: 1931094 - RNA, 23 nt, Human
caaauuuacagagacagaaagca

SEQ ID NO: 1931095 - RNA, 17 nt, Human
caaauuuacagagacag

SEQ ID NO: 1931096 - RNA, 16 nt, Human
caaauuuacagagaca

SEQ ID NO: 1931097 - RNA, 17 nt, Human
caacaggcugggcuuca

SEQ ID NO: 1931098 - RNA, 17 nt, Human
caacugcaucaagaugu

SEQ ID NO: 1931099 - RNA, 20 nt, Human
caacugcaucaagaugugac

SEQ ID NO: 1931100 - RNA, 23 nt, Human
caacugcaucaagaugugacaug

SEQ ID NO: 1931101 - RNA, 17 nt, Human
caaccugauugugucuc

SEQ ID NO: 1931102 - RNA, 19 nt, Human
caaccugauugugucucuu

SEQ ID NO: 1931103 - RNA, 21 nt, Human
caaccugauugugucucuugg

SEQ ID NO: 1931104 - RNA, 16 nt, Human
caacucuugauuaucc

SEQ ID NO: 1931105 - RNA, 18 nt, Human
caacucuugauuauccau

SEQ ID NO: 1931106 - RNA, 17 nt, Human
caaccugcaaagaucug

SEQ ID NO: 1931107 - RNA, 12 nt, Human
caacucuugauu

SEQ ID NO: 1931108 - RNA, 18 nt, Human
caagccagggugugucuc

SEQ ID NO: 1931109 - RNA, 14 nt, Human
caagccagggugug

SEQ ID NO: 1931110 - RNA, 20 nt, Human
caagcccaguucagcuuggg

SEQ ID NO: 1931111 - RNA, 14 nt, Human
caagcccccccuuc

SEQ ID NO: 1931112 - RNA, 16 nt, Human
caagcccccccuucca

SEQ ID NO: 1931113 - RNA, 17 nt, Human
caaggauccugagccag

SEQ ID NO: 1931114 - RNA, 15 nt, Human
caaggauccugagcc

SEQ ID NO: 1931115 - RNA, 16 nt, Human
caaggauccugagcca

SEQ ID NO: 1931116 - RNA, 21 nt, Human
caaggcugggggaagaagcuc

SEQ ID NO: 1931117 - RNA, 13 nt, Human
caaggcugucaau

SEQ ID NO: 1931118 - RNA, 14 nt, Human
caaggcugucaauu

SEQ ID NO: 1931119 - RNA, 21 nt, Human
caaggcugucaauuacaggaa

SEQ ID NO: 1931120 - RNA, 14 nt, Human
caaggauccugagc

SEQ ID NO: 1931121 - RNA, 17 nt, Human
caagcccccccuuccac

SEQ ID NO: 1931122 - RNA, 14 nt, Human
caagaaaguuuccc

SEQ ID NO: 1931123 - RNA, 23 nt, Human
caagacccuuguggucccacccc

SEQ ID NO: 1931124 - RNA, 21 nt, Human
caagaaauaaaaggaagccaa

SEQ ID NO: 1931125 - RNA, 13 nt, Human
caagaaaguuucc

SEQ ID NO: 1931126 - RNA, 13 nt, Human
caagaaauaaaag

SEQ ID NO: 1931127 - RNA, 19 nt, Human
caagaaauaaaaggaagcc

SEQ ID NO: 1931128 - RNA, 20 nt, Human
caagaaauaaaaggaagcca

SEQ ID NO: 1931129 - RNA, 13 nt, Human
caagaaaugaaag

SEQ ID NO: 1931130 - RNA, 15 nt, Human
caagaccucagggca

SEQ ID NO: 1931131 - RNA, 16 nt, Human
caagaccucagggcac

SEQ ID NO: 1931132 - RNA, 23 nt, Human
caagaccucagggcacaaagaug

SEQ ID NO: 1931133 - RNA, 24 nt, Human
caagaccucagggcacaaagaugg

SEQ ID NO: 1931134 - RNA, 13 nt, Human
caagaccuucucc

SEQ ID NO: 1931135 - RNA, 20 nt, Human
caagacgcugugcugcccug

SEQ ID NO: 1931136 - RNA, 21 nt, Human
caagacgcugugcugcccugc

SEQ ID NO: 1931137 - RNA, 22 nt, Human
caagacgcugugcugcccugcc

SEQ ID NO: 1931138 - RNA, 17 nt, Human
caagagggucugaggaa

SEQ ID NO: 1931139 - RNA, 16 nt, Human
caagagggucugagga

SEQ ID NO: 1931140 - RNA, 12 nt, Human
caagagggucug

SEQ ID NO: 1931141 - RNA, 21 nt, Human
caagcagccugagcaacucuu

SEQ ID NO: 1931142 - RNA, 17 nt, Human
caagagcccaggccucc

SEQ ID NO: 1931143 - RNA, 13 nt, Human
caagagccugaga

SEQ ID NO: 1931144 - RNA, 11 nt, Human
caagagccuga

SEQ ID NO: 1931145 - RNA, 16 nt, Human
caagacuguuagcccu

SEQ ID NO: 1931146 - RNA, 23 nt, Human
caagagccugagagugaggugga

SEQ ID NO: 1931147 - RNA, 21 nt, Human
caaggggaauguuugccucug

SEQ ID NO: 1931148 - RNA, 15 nt, Human
caagggccuggccug

SEQ ID NO: 1931149 - RNA, 13 nt, Human
caagggccuggcc

SEQ ID NO: 1931150 - RNA, 14 nt, Human
caagggccuggccu

SEQ ID NO: 1931151 - RNA, 17 nt, Human
caagggaucugguccua

SEQ ID NO: 1931152 - RNA, 20 nt, Human
caagggaucugguccuaccc

SEQ ID NO: 1931153 - RNA, 21 nt, Human
caagggaucugguccuaccca

SEQ ID NO: 1931154 - RNA, 13 nt, Human
caaggucauuuuu

SEQ ID NO: 1931155 - RNA, 21 nt, Human
caagguuauaugcacuuucuc

SEQ ID NO: 1931156 - RNA, 23 nt, Human
caaggggaauguuugccucugcc

SEQ ID NO: 1931157 - RNA, 18 nt, Human
caaggggaaucagaacuc

SEQ ID NO: 1931158 - RNA, 16 nt, Human
caagguaacuguacug

SEQ ID NO: 1931159 - RNA, 22 nt, Human
caagguaacuguacugggccau

SEQ ID NO: 1931160 - RNA, 22 nt, Human
caagguaauuucuugugccucu

SEQ ID NO: 1931161 - RNA, 18 nt, Human
caagugauucuccugccu

SEQ ID NO: 1931162 - RNA, 19 nt, Human
caagugauucuccugccuc

SEQ ID NO: 1931163 - RNA, 15 nt, Human
caagugagacccugu

SEQ ID NO: 1931164 - RNA, 19 nt, Human
caagugagacccugucuca

SEQ ID NO: 1931165 - RNA, 20 nt, Human
caagugauucuccugccuca

SEQ ID NO: 1931166 - RNA, 22 nt, Human
caagugaaaaaggaggaagaga

SEQ ID NO: 1931167 - RNA, 20 nt, Human
caagguuuaggcugguggcc

SEQ ID NO: 1931168 - RNA, 23 nt, Human
caagugaaaaaggaggaagagaa

SEQ ID NO: 1931169 - RNA, 17 nt, Human
caagguuuaggcuggug

SEQ ID NO: 1931170 - RNA, 14 nt, Human
caagugagacccug

SEQ ID NO: 1931171 - RNA, 16 nt, Human
caagggccuggccuga

SEQ ID NO: 1931172 - RNA, 16 nt, Human
ccaaacagcugccucu

SEQ ID NO: 1931173 - RNA, 17 nt, Human
ccaaacucaccugcccc

SEQ ID NO: 1931174 - RNA, 18 nt, Human
cauuuuucagauauaaaa

SEQ ID NO: 1931175 - RNA, 21 nt, Human
cauuuuucagaccuuuuaacu

SEQ ID NO: 1931176 - RNA, 23 nt, Human
cauuucuauuuauuuacugagcu

SEQ ID NO: 1931177 - RNA, 20 nt, Human
cauuuuucagauauaaaaga

SEQ ID NO: 1931178 - RNA, 23 nt, Human
cauuuuucuuagggaaggauaca

SEQ ID NO: 1931179 - RNA, 19 nt, Human
cauuuuguaacaaaugaac

SEQ ID NO: 1931180 - RNA, 19 nt, Human
cauuuuagggguagcauuu

SEQ ID NO: 1931181 - RNA, 23 nt, Human
cauuuuaggaaaaaaaaaagcau

SEQ ID NO: 1931182 - RNA, 16 nt, Human
cauuuguuuguuuucc

SEQ ID NO: 1931183 - RNA, 18 nt, Human
cauuuguuuguuuuccuu

SEQ ID NO: 1931184 - RNA, 18 nt, Human
cauuugagcagggcucag

SEQ ID NO: 1931185 - RNA, 17 nt, Human
cauuugagcagggcuca

SEQ ID NO: 1931186 - RNA, 20 nt, Human
cauuugagcagggcucagcg

SEQ ID NO: 1931187 - RNA, 20 nt, Human
cauuugcuaacuagcuugga

SEQ ID NO: 1931188 - RNA, 22 nt, Human
cauuuguuugaacugauaaaga

SEQ ID NO: 1931189 - RNA, 20 nt, Human
cauuuguuugaacugauaaa

SEQ ID NO: 1931190 - RNA, 13 nt, Human
cauuugcugaaua

SEQ ID NO: 1931191 - RNA, 17 nt, Human
cauuuguuugaacugau

SEQ ID NO: 1931192 - RNA, 13 nt, Human
cauuugcuccuuu

SEQ ID NO: 1931193 - RNA, 14 nt, Human
cauuugcuccuuuc

SEQ ID NO: 1931194 - RNA, 20 nt, Human
cauuugaaaauuuugauguu

SEQ ID NO: 1931195 - RNA, 22 nt, Human
cauuugaaaauuuugauguuuu

SEQ ID NO: 1931196 - RNA, 19 nt, Human
cauuuccugagaccacaga

SEQ ID NO: 1931197 - RNA, 15 nt, Human
cauuuccuaaauaua

SEQ ID NO: 1931198 - RNA, 23 nt, Human
cauuuccuaucaccuauuuccau

SEQ ID NO: 1931199 - RNA, 17 nt, Human
cauuuaggccaugggac

SEQ ID NO: 1931200 - RNA, 22 nt, Human
cauuuagcuaaacggauuccaa

SEQ ID NO: 1931201 - RNA, 20 nt, Human
cauuuagagaggaaaaguaa

SEQ ID NO: 1931202 - RNA, 21 nt, Human
cauuuagagaggaaaaguaac

SEQ ID NO: 1931203 - RNA, 16 nt, Human
cauuuaaaagauacag

SEQ ID NO: 1931204 - RNA, 15 nt, Human
cauuuaaaagauaca

SEQ ID NO: 1931205 - RNA, 12 nt, Human
cauuuaaaagau

SEQ ID NO: 1931206 - RNA, 18 nt, Human
cauuguuugucugucuuc

SEQ ID NO: 1931207 - RNA, 22 nt, Human
cauuguuugucugucuucauag

SEQ ID NO: 1931208 - RNA, 13 nt, Human
cauuuccuguguc

SEQ ID NO: 1931209 - RNA, 12 nt, Human
cauuuccugugu

SEQ ID NO: 1931210 - RNA, 21 nt, Human
cauuucgguggcuagucaagc

SEQ ID NO: 1931211 - RNA, 13 nt, Human
cauuucuauuuau

SEQ ID NO: 1931212 - RNA, 14 nt, Human
cauuucuauuuauu

SEQ ID NO: 1931213 - RNA, 18 nt, Human
cauuucuauuuauuuacu

SEQ ID NO: 1931214 - RNA, 15 nt, Human
cauuucgguggcuag

SEQ ID NO: 1931215 - RNA, 17 nt, Human
cauuguuggccaaagcc

SEQ ID NO: 1931216 - RNA, 13 nt, Human
cauuguugagcua

SEQ ID NO: 1931217 - RNA, 20 nt, Human
cauuguugagcuauugcugu

SEQ ID NO: 1931218 - RNA, 18 nt, Human
cauuguucaauuagaaua

SEQ ID NO: 1931219 - RNA, 18 nt, Human
cauuguuggccaaagcca

SEQ ID NO: 1931220 - RNA, 23 nt, Human
cauuguauucagaguugaugguu

SEQ ID NO: 1931221 - RNA, 15 nt, Human
cauuguauuagaucu

SEQ ID NO: 1931222 - RNA, 19 nt, Human
cauugucccucugccccau

SEQ ID NO: 1931223 - RNA, 21 nt, Human
cauugucccucugccccaucc

SEQ ID NO: 1931224 - RNA, 19 nt, Human
cauugucccugaagagaag

SEQ ID NO: 1931225 - RNA, 13 nt, Human
cauugucccucug

SEQ ID NO: 1931226 - RNA, 14 nt, Human
cauugucccucugc

SEQ ID NO: 1931227 - RNA, 15 nt, Human
cauugucccucugcc

SEQ ID NO: 1931228 - RNA, 18 nt, Human
cauugucccucugcccca

SEQ ID NO: 1931229 - RNA, 14 nt, Human
cacccaagggccug

SEQ ID NO: 1931230 - RNA, 15 nt, Human
cacccaagggccugg

SEQ ID NO: 1931231 - RNA, 15 nt, Human
ccaagcaagacugag

SEQ ID NO: 1931232 - RNA, 12 nt, Human
ccaagcacagca

SEQ ID NO: 1931233 - RNA, 13 nt, Human
ccaagcacagcag

SEQ ID NO: 1931234 - RNA, 14 nt, Human
ccaagcacagcagc

SEQ ID NO: 1931235 - RNA, 15 nt, Human
ccaagcacagcagcc

SEQ ID NO: 1931236 - RNA, 17 nt, Human
ccaagcacagcagccug

SEQ ID NO: 1931237 - RNA, 18 nt, Human
ccaagcacagcagccugg

SEQ ID NO: 1931238 - RNA, 13 nt, Human
ccaaguauuuugc

SEQ ID NO: 1931239 - RNA, 20 nt, Human
ccaagucaagugaaaaagga

SEQ ID NO: 1931240 - RNA, 20 nt, Human
ccaaguagcugggauuacag

SEQ ID NO: 1931241 - RNA, 18 nt, Human
ccaaggugggaggauugc

SEQ ID NO: 1931242 - RNA, 13 nt, Human
ccaaggugggagg

SEQ ID NO: 1931243 - RNA, 23 nt, Human
ccaagguuuggggaagaacgaag

SEQ ID NO: 1931244 - RNA, 22 nt, Human
ccaaggggaauguuugccucug

SEQ ID NO: 1931245 - RNA, 19 nt, Human
ccaaggggaaucagaacuc

SEQ ID NO: 1931246 - RNA, 19 nt, Human
ccaagggccuggccugagc

SEQ ID NO: 1931247 - RNA, 16 nt, Human
ccaagggccuggccug

SEQ ID NO: 1931248 - RNA, 18 nt, Human
ccaagggccuggccugag

SEQ ID NO: 1931249 - RNA, 15 nt, Human
ccaagggccuggccu

SEQ ID NO: 1931250 - RNA, 13 nt, Human
ccaagggaucugg

SEQ ID NO: 1931251 - RNA, 21 nt, Human
ccaagggaucugguccuaccc

SEQ ID NO: 1931252 - RNA, 18 nt, Human
ccaaggccaaaggaagca

SEQ ID NO: 1931253 - RNA, 21 nt, Human
ccaaggccaaaggaagcacau

SEQ ID NO: 1931254 - RNA, 12 nt, Human
ccaagccacuga

SEQ ID NO: 1931255 - RNA, 13 nt, Human
ccaagccugacca

SEQ ID NO: 1931256 - RNA, 19 nt, Human
ccaagccuuggcucuaccc

SEQ ID NO: 1931257 - RNA, 20 nt, Human
ccaagccuggucagcccaaa

SEQ ID NO: 1931258 - RNA, 19 nt, Human
ccaagccuggucagcccaa

SEQ ID NO: 1931259 - RNA, 14 nt, Human
ccaagcucccaggc

SEQ ID NO: 1931260 - RNA, 15 nt, Human
ccaagcucccaggca

SEQ ID NO: 1931261 - RNA, 16 nt, Human
ccaagcucccaggcau

SEQ ID NO: 1931262 - RNA, 22 nt, Human
ccaagcucccaggcauucccca

SEQ ID NO: 1931263 - RNA, 17 nt, Human
ccaaggccaaaggaagc

SEQ ID NO: 1931264 - RNA, 13 nt, Human
ccaacacgcagga

SEQ ID NO: 1931265 - RNA, 20 nt, Human
ccaacacgcaccugccucag

SEQ ID NO: 1931266 - RNA, 21 nt, Human
ccaacacgcaccugccucagg

SEQ ID NO: 1931267 - RNA, 13 nt, Human
ccaacaccaagca

SEQ ID NO: 1931268 - RNA, 16 nt, Human
ccaacaccaagcacag

SEQ ID NO: 1931269 - RNA, 17 nt, Human
ccaacaccaagcacagc

SEQ ID NO: 1931270 - RNA, 19 nt, Human
ccaacaccaagcacagcag

SEQ ID NO: 1931271 - RNA, 22 nt, Human
ccaacaccaagcacagcagccu

SEQ ID NO: 1931272 - RNA, 23 nt, Human
ccaacaccaagcacagcagccug

SEQ ID NO: 1931273 - RNA, 18 nt, Human
ccaaaguacacuguuuca

SEQ ID NO: 1931274 - RNA, 15 nt, Human
ccaaaguacacuguu

SEQ ID NO: 1931275 - RNA, 17 nt, Human
ccaaauuuucuuuuuau

SEQ ID NO: 1931276 - RNA, 15 nt, Human
ccaaauuugauugau

SEQ ID NO: 1931277 - RNA, 20 nt, Human
ccaaauuugauugauuugaa

SEQ ID NO: 1931278 - RNA, 19 nt, Human
ccaacaaagaacacuaacu

SEQ ID NO: 1931279 - RNA, 20 nt, Human
ccaaaguacacuguuucaaa

SEQ ID NO: 1931280 - RNA, 13 nt, Human
ccaacaucaacau

SEQ ID NO: 1931281 - RNA, 21 nt, Human
ccaacauacucccaucuguga

SEQ ID NO: 1931282 - RNA, 22 nt, Human
ccaacauacucccaucugugaa

SEQ ID NO: 1931283 - RNA, 17 nt, Human
ccaacauacucccaucu

SEQ ID NO: 1931284 - RNA, 18 nt, Human
ccaacauacucccaucug

SEQ ID NO: 1931285 - RNA, 19 nt, Human
ccaacauacucccaucugu

SEQ ID NO: 1931286 - RNA, 20 nt, Human
ccaacauacucccaucugug

SEQ ID NO: 1931287 - RNA, 16 nt, Human
ccaacauacucccauc

SEQ ID NO: 1931288 - RNA, 19 nt, Human
ccaacagaagaacuguguu

SEQ ID NO: 1931289 - RNA, 19 nt, Human
ccaaagccaaagcuaggcc

SEQ ID NO: 1931290 - RNA, 23 nt, Human
ccaaagcagugcaugcugucccu

SEQ ID NO: 1931291 - RNA, 19 nt, Human
ccaaagcagugcaugcugu

SEQ ID NO: 1931292 - RNA, 17 nt, Human
ccaaagccuccuccagc

SEQ ID NO: 1931293 - RNA, 22 nt, Human
ccaaagccuccuccagccgcca

SEQ ID NO: 1931294 - RNA, 14 nt, Human
ccaaagccaaugug

SEQ ID NO: 1931295 - RNA, 20 nt, Human
ccaaacucaccugccccuca

SEQ ID NO: 1931296 - RNA, 15 nt, Human
ccaaagcuaggccug

SEQ ID NO: 1931297 - RNA, 17 nt, Human
ccaaagcgaauuuuaaa

SEQ ID NO: 1931298 - RNA, 17 nt, Human
ccaaagcuaggccuggc

SEQ ID NO: 1931299 - RNA, 16 nt, Human
ccaaagcuaggccugg

SEQ ID NO: 1931300 - RNA, 21 nt, Human
ccaaagcuaggccuggccaga

SEQ ID NO: 1931301 - RNA, 15 nt, Human
ccaaaggaagcacau

SEQ ID NO: 1931302 - RNA, 23 nt, Human
ccaaaggaagcacaugccucucu

SEQ ID NO: 1931303 - RNA, 15 nt, Human
ccaagaagcccagga

SEQ ID NO: 1931304 - RNA, 12 nt, Human
ccaacccucauc

SEQ ID NO: 1931305 - RNA, 20 nt, Human
ccaaccccccagcacugagg

SEQ ID NO: 1931306 - RNA, 19 nt, Human
ccaaccccccagcacugag

SEQ ID NO: 1931307 - RNA, 18 nt, Human
ccaaccccccagcacuga

SEQ ID NO: 1931308 - RNA, 17 nt, Human
ccaaccccccagcacug

SEQ ID NO: 1931309 - RNA, 15 nt, Human
ccaaccccccagcac

SEQ ID NO: 1931310 - RNA, 14 nt, Human
ccaaccccccagca

SEQ ID NO: 1931311 - RNA, 13 nt, Human
ccaaccccccagc

SEQ ID NO: 1931312 - RNA, 21 nt, Human
ccaaccccccagcacugagga

SEQ ID NO: 1931313 - RNA, 19 nt, Human
ccaagaagcccaggaaagg

SEQ ID NO: 1931314 - RNA, 20 nt, Human
ccaagaagcccaggaaaggc

SEQ ID NO: 1931315 - RNA, 15 nt, Human
ccaagaggcugcagc

SEQ ID NO: 1931316 - RNA, 14 nt, Human
ccaagaggcugcag

SEQ ID NO: 1931317 - RNA, 16 nt, Human
ccaagaggcugcagcc

SEQ ID NO: 1931318 - RNA, 11 nt, Human
ccacagggcac

SEQ ID NO: 1931319 - RNA, 19 nt, Human
ccacagggcaccugccacc

SEQ ID NO: 1931320 - RNA, 15 nt, Human
ccacaguagucuuga

SEQ ID NO: 1931321 - RNA, 17 nt, Human
ccacaguagucuugaug

SEQ ID NO: 1931322 - RNA, 12 nt, Human
ccacaggccuga

SEQ ID NO: 1931323 - RNA, 11 nt, Human
ccacaggccug

SEQ ID NO: 1931324 - RNA, 19 nt, Human
ccacaggccugagauuuca

SEQ ID NO: 1931325 - RNA, 14 nt, Human
ccacaggccugaga

SEQ ID NO: 1931326 - RNA, 22 nt, Human
ccacaggccugagauuucaucu

SEQ ID NO: 1931327 - RNA, 20 nt, Human
ccacaguggaaccagcccag

SEQ ID NO: 1931328 - RNA, 19 nt, Human
ccacauacaacacaaagag

SEQ ID NO: 1931329 - RNA, 15 nt, Human
ccacaucuaagccug

SEQ ID NO: 1931330 - RNA, 22 nt, Human
ccacaucuaagccugaaggggc

SEQ ID NO: 1931331 - RNA, 23 nt, Human
ccacaucuaagccugaaggggcg

SEQ ID NO: 1931332 - RNA, 19 nt, Human
ccacaugugacacauaugc

SEQ ID NO: 1931333 - RNA, 15 nt, Human
ccacaugugacacau

SEQ ID NO: 1931334 - RNA, 16 nt, Human
ccacaugugcacaugc

SEQ ID NO: 1931335 - RNA, 16 nt, Human
ccacauuccugaugcu

SEQ ID NO: 1931336 - RNA, 17 nt, Human
ccacaucuugcucugcu

SEQ ID NO: 1931337 - RNA, 18 nt, Human
ccacaucuugcucugcug

SEQ ID NO: 1931338 - RNA, 19 nt, Human
ccacaucuugcucugcuga

SEQ ID NO: 1931339 - RNA, 20 nt, Human
ccacaucuugcucugcugac

SEQ ID NO: 1931340 - RNA, 21 nt, Human
ccaccaagccuggucagccca

SEQ ID NO: 1931341 - RNA, 21 nt, Human
ccaccaacauacucccaucug

SEQ ID NO: 1931342 - RNA, 22 nt, Human
ccacauuuggaauacuuuuugu

SEQ ID NO: 1931343 - RNA, 19 nt, Human
ccacauuuggaauacuuuu

SEQ ID NO: 1931344 - RNA, 13 nt, Human
ccacauuuggaau

SEQ ID NO: 1931345 - RNA, 16 nt, Human
ccacaggaucagucug

SEQ ID NO: 1931346 - RNA, 16 nt, Human
ccacaggacacaguca

SEQ ID NO: 1931347 - RNA, 17 nt, Human
ccacaggacacagucag

SEQ ID NO: 1931348 - RNA, 16 nt, Human
ccacaggccgcccugc

SEQ ID NO: 1931349 - RNA, 17 nt, Human
ccacaggccgcccugcg

SEQ ID NO: 1931350 - RNA, 14 nt, Human
ccacacucagcaca

SEQ ID NO: 1931351 - RNA, 22 nt, Human
ccacacguaaugaaacuuggau

SEQ ID NO: 1931352 - RNA, 22 nt, Human
ccacacccagcccacuucugcc

SEQ ID NO: 1931353 - RNA, 21 nt, Human
ccacacccagcccacuucugc

SEQ ID NO: 1931354 - RNA, 16 nt, Human
ccacacccucacugcu

SEQ ID NO: 1931355 - RNA, 15 nt, Human
ccacacccagcccac

SEQ ID NO: 1931356 - RNA, 20 nt, Human
ccacacccagcccacuucug

SEQ ID NO: 1931357 - RNA, 13 nt, Human
ccacaccacaucu

SEQ ID NO: 1931358 - RNA, 15 nt, Human
ccaauauuaaaucug

SEQ ID NO: 1931359 - RNA, 18 nt, Human
ccaauauuaaaucugcug

SEQ ID NO: 1931360 - RNA, 12 nt, Human
ccaauauuauaa

SEQ ID NO: 1931361 - RNA, 20 nt, Human
ccacacagacuugggcaggg

SEQ ID NO: 1931362 - RNA, 13 nt, Human
ccaauauuauaau

SEQ ID NO: 1931363 - RNA, 16 nt, Human
ccaauauucauagcag

SEQ ID NO: 1931364 - RNA, 21 nt, Human
ccacccaggagccccgaggcc

SEQ ID NO: 1931365 - RNA, 23 nt, Human
ccacccaggagccccgaggccuu

SEQ ID NO: 1931366 - RNA, 17 nt, Human
ccacccccacccaaggg

SEQ ID NO: 1931367 - RNA, 18 nt, Human
ccacugcagaagacagua

SEQ ID NO: 1931368 - RNA, 13 nt, Human
ccacugcagaaga

SEQ ID NO: 1931369 - RNA, 13 nt, Human
ccacuucagcuga

SEQ ID NO: 1931370 - RNA, 14 nt, Human
ccacuucagcugac

SEQ ID NO: 1931371 - RNA, 21 nt, Human
ccacuucauucuugaaagcug

SEQ ID NO: 1931372 - RNA, 23 nt, Human
ccagaaguuugagaucagccugg

SEQ ID NO: 1931373 - RNA, 22 nt, Human
ccagaauaaacuggcagcucag

SEQ ID NO: 1931374 - RNA, 22 nt, Human
ccagaaguuugagaucagccug

SEQ ID NO: 1931375 - RNA, 15 nt, Human
ccagaagcccagaau

SEQ ID NO: 1931376 - RNA, 14 nt, Human
ccagaagcccagaa

SEQ ID NO: 1931377 - RNA, 22 nt, Human
ccagaagauagcuucaccccaa

SEQ ID NO: 1931378 - RNA, 18 nt, Human
ccagaagaugaacagacu

SEQ ID NO: 1931379 - RNA, 23 nt, Human
ccagaagaugaacagacugaccu

SEQ ID NO: 1931380 - RNA, 19 nt, Human
ccagaagaugaacagacug

SEQ ID NO: 1931381 - RNA, 20 nt, Human
ccagaagaugaacagacuga

SEQ ID NO: 1931382 - RNA, 13 nt, Human
ccagaagcccaga

SEQ ID NO: 1931383 - RNA, 12 nt, Human
ccagaagcccag

SEQ ID NO: 1931384 - RNA, 18 nt, Human
ccagaauuucccaaagca

SEQ ID NO: 1931385 - RNA, 21 nt, Human
ccagacaccuugacagggcac

SEQ ID NO: 1931386 - RNA, 21 nt, Human
ccagaauuucccaaagcagug

SEQ ID NO: 1931387 - RNA, 12 nt, Human
ccagaauuuccc

SEQ ID NO: 1931388 - RNA, 19 nt, Human
ccagaauuucccaaagcag

SEQ ID NO: 1931389 - RNA, 17 nt, Human
ccagacagacaacacug

SEQ ID NO: 1931390 - RNA, 14 nt, Human
ccagacacaggccc

SEQ ID NO: 1931391 - RNA, 18 nt, Human
ccacucaguccauagcag

SEQ ID NO: 1931392 - RNA, 16 nt, Human
ccacucaggucuguuu

SEQ ID NO: 1931393 - RNA, 11 nt, Human
ccacucagguc

SEQ ID NO: 1931394 - RNA, 16 nt, Human
ccacucaaaggccaga

SEQ ID NO: 1931395 - RNA, 14 nt, Human
ccacucaaaggcca

SEQ ID NO: 1931396 - RNA, 15 nt, Human
ccacucaaaggccag

SEQ ID NO: 1931397 - RNA, 14 nt, Human
ccacuacauucugu

SEQ ID NO: 1931398 - RNA, 15 nt, Human
ccacuacauucuguu

SEQ ID NO: 1931399 - RNA, 11 nt, Human
ccacuacauuc

SEQ ID NO: 1931400 - RNA, 17 nt, Human
ccacuacauucuguuaa

SEQ ID NO: 1931401 - RNA, 16 nt, Human
ccacuacauucuguua

SEQ ID NO: 1931402 - RNA, 16 nt, Human
ccacgcuggagugcag

SEQ ID NO: 1931403 - RNA, 15 nt, Human
ccacccccacccaag

SEQ ID NO: 1931404 - RNA, 18 nt, Human
ccacggccaggccagagg

SEQ ID NO: 1931405 - RNA, 16 nt, Human
ccacggccaggccaga

SEQ ID NO: 1931406 - RNA, 19 nt, Human
ccacgcuggagugcaguga

SEQ ID NO: 1931407 - RNA, 18 nt, Human
ccacgcuggagugcagug

SEQ ID NO: 1931408 - RNA, 23 nt, Human
ccacggccaggccagagggagug

SEQ ID NO: 1931409 - RNA, 14 nt, Human
ccacgguguucugu

SEQ ID NO: 1931410 - RNA, 15 nt, Human
ccaccccacacacgc

SEQ ID NO: 1931411 - RNA, 19 nt, Human
ccacuaagcagaggagggg

SEQ ID NO: 1931412 - RNA, 21 nt, Human
ccacuaagcagaggaggggcc

SEQ ID NO: 1931413 - RNA, 22 nt, Human
ccacuaagcagaggaggggccg

SEQ ID NO: 1931414 - RNA, 21 nt, Human
cccaaauuaucaagcuaauaa

SEQ ID NO: 1931415 - RNA, 20 nt, Human
cccaaauuaucaagcuaaua

SEQ ID NO: 1931416 - RNA, 19 nt, Human
cccaaauuaucaagcuaau

SEQ ID NO: 1931417 - RNA, 19 nt, Human
cccaaauuugauugauuug

SEQ ID NO: 1931418 - RNA, 16 nt, Human
cccaaauuugauugau

SEQ ID NO: 1931419 - RNA, 17 nt, Human
cccaagggccuggccug

SEQ ID NO: 1931420 - RNA, 18 nt, Human
cccaacacgcaggagcac

SEQ ID NO: 1931421 - RNA, 23 nt, Human
cccaagggccuggccugagcugg

SEQ ID NO: 1931422 - RNA, 18 nt, Human
cccaagggccuggccuga

SEQ ID NO: 1931423 - RNA, 19 nt, Human
cccaagggccuggccugag

SEQ ID NO: 1931424 - RNA, 23 nt, Human
cccaaugcacuuuguucuggcuc

SEQ ID NO: 1931425 - RNA, 19 nt, Human
cccaaucccagcuaccuca

SEQ ID NO: 1931426 - RNA, 12 nt, Human
cccaauauuaua

SEQ ID NO: 1931427 - RNA, 15 nt, Human
cccaauauuauaauu

SEQ ID NO: 1931428 - RNA, 17 nt, Human
cccaauauuauaauuuu

SEQ ID NO: 1931429 - RNA, 11 nt, Human
cccaauauuau

SEQ ID NO: 1931430 - RNA, 21 nt, Human
cccaauucuuacaaacaugug

SEQ ID NO: 1931431 - RNA, 15 nt, Human
cccaauuucagacuc

SEQ ID NO: 1931432 - RNA, 20 nt, Human
cccaaucccagcuaccucaa

SEQ ID NO: 1931433 - RNA, 16 nt, Human
cccaauguaggagcug

SEQ ID NO: 1931434 - RNA, 18 nt, Human
cccagcaagugagagcug

SEQ ID NO: 1931435 - RNA, 16 nt, Human
cccagcaagugagagc

SEQ ID NO: 1931436 - RNA, 22 nt, Human
cccagauugcaacaggcugggc

SEQ ID NO: 1931437 - RNA, 21 nt, Human
cccagauugcaacaggcuggg

SEQ ID NO: 1931438 - RNA, 20 nt, Human
cccagauugcaacaggcugg

SEQ ID NO: 1931439 - RNA, 20 nt, Human
cccagagggccugcaaggga

SEQ ID NO: 1931440 - RNA, 18 nt, Human
cccagagggccugcaagg

SEQ ID NO: 1931441 - RNA, 22 nt, Human
cccagccuggccacgcagccag

SEQ ID NO: 1931442 - RNA, 23 nt, Human
cccagccuggccacgcagccagg

SEQ ID NO: 1931443 - RNA, 21 nt, Human
cccagccuggccacgcagcca

SEQ ID NO: 1931444 - RNA, 20 nt, Human
cccagccuggccacgcagcc

SEQ ID NO: 1931445 - RNA, 15 nt, Human
cccagcgagcccugg

SEQ ID NO: 1931446 - RNA, 18 nt, Human
cccagcgagcccuggugg

SEQ ID NO: 1931447 - RNA, 17 nt, Human
cccagcgagcccuggug

SEQ ID NO: 1931448 - RNA, 23 nt, Human
cccagcgagcccugguggcagug

SEQ ID NO: 1931449 - RNA, 19 nt, Human
cccagcgagcccugguggc

SEQ ID NO: 1931450 - RNA, 23 nt, Human
cccagcggacaguggcaggacag

SEQ ID NO: 1931451 - RNA, 18 nt, Human
cccagcggacaguggcag

SEQ ID NO: 1931452 - RNA, 20 nt, Human
cccagcggacaguggcagga

SEQ ID NO: 1931453 - RNA, 17 nt, Human
cccagcuccggccuguc

SEQ ID NO: 1931454 - RNA, 16 nt, Human
cccagcuaagaaccug

SEQ ID NO: 1931455 - RNA, 17 nt, Human
cccagcuaagaaccugg

SEQ ID NO: 1931456 - RNA, 18 nt, Human
cccagcuaagaaccugga

SEQ ID NO: 1931457 - RNA, 19 nt, Human
cccagcuaagaaccuggaa

SEQ ID NO: 1931458 - RNA, 20 nt, Human
cccagcuaagaaccuggaac

SEQ ID NO: 1931459 - RNA, 22 nt, Human
cccagcuaagaaccuggaacuu

SEQ ID NO: 1931460 - RNA, 14 nt, Human
cccagcuaccucaa

SEQ ID NO: 1931461 - RNA, 22 nt, Human
cccagcuaccucaaccaaugcc

SEQ ID NO: 1931462 - RNA, 11 nt, Human
cccagccccuu

SEQ ID NO: 1931463 - RNA, 23 nt, Human
cccagauugcaacaggcugggcu

SEQ ID NO: 1931464 - RNA, 23 nt, Human
cccagcaagugagagcugggugu

SEQ ID NO: 1931465 - RNA, 22 nt, Human
cccagcaagugagagcugggug

SEQ ID NO: 1931466 - RNA, 21 nt, Human
cccagcaagugagagcugggu

SEQ ID NO: 1931467 - RNA, 20 nt, Human
cccagcaagugagagcuggg

SEQ ID NO: 1931468 - RNA, 19 nt, Human
cccagcaagugagagcugg

SEQ ID NO: 1931469 - RNA, 12 nt, Human
cccagccugcua

SEQ ID NO: 1931470 - RNA, 18 nt, Human
cccagccccuucugaccc

SEQ ID NO: 1931471 - RNA, 21 nt, Human
cccaggugcagccagaggcac

SEQ ID NO: 1931472 - RNA, 23 nt, Human
cccaggugcuaggaacacuccuu

SEQ ID NO: 1931473 - RNA, 15 nt, Human
cccaggugcagccag

SEQ ID NO: 1931474 - RNA, 20 nt, Human
cccaggugcagccagaggca

SEQ ID NO: 1931475 - RNA, 22 nt, Human
cccaggugcuaggaacacuccu

SEQ ID NO: 1931476 - RNA, 20 nt, Human
cccagucuggaaugcagugg

SEQ ID NO: 1931477 - RNA, 13 nt, Human
cccagugcccaca

SEQ ID NO: 1931478 - RNA, 17 nt, Human
cccaggccuccuacagc

SEQ ID NO: 1931479 - RNA, 18 nt, Human
cccaggccuccuacagcu

SEQ ID NO: 1931480 - RNA, 18 nt, Human
cccaggagccccgaggcc

SEQ ID NO: 1931481 - RNA, 21 nt, Human
cccaggagccccgaggccuuc

SEQ ID NO: 1931482 - RNA, 13 nt, Human
cccaggaggccag

SEQ ID NO: 1931483 - RNA, 22 nt, Human
cccaggaggccagccuugacca

SEQ ID NO: 1931484 - RNA, 14 nt, Human
cccaggaguucugc

SEQ ID NO: 1931485 - RNA, 15 nt, Human
cccaggaguucugcu

SEQ ID NO: 1931486 - RNA, 13 nt, Human
cccaggcaggucu

SEQ ID NO: 1931487 - RNA, 11 nt, Human
cccaggcaggu

SEQ ID NO: 1931488 - RNA, 17 nt, Human
cccaggaguucugcuca

SEQ ID NO: 1931489 - RNA, 18 nt, Human
cccaggaguucugcucau

SEQ ID NO: 1931490 - RNA, 21 nt, Human
cccaggaguucugcucauucu

SEQ ID NO: 1931491 - RNA, 23 nt, Human
cccaggaguucugcucauucuaa

SEQ ID NO: 1931492 - RNA, 22 nt, Human
cccaggccccugccacccuggg

SEQ ID NO: 1931493 - RNA, 21 nt, Human
cccaggccccugccacccugg

SEQ ID NO: 1931494 - RNA, 18 nt, Human
cccaggccccugccaccc

SEQ ID NO: 1931495 - RNA, 16 nt, Human
cccaggccccugccac

SEQ ID NO: 1931496 - RNA, 11 nt, Human
cccaggccccu

SEQ ID NO: 1931497 - RNA, 17 nt, Human
cccaggcaggucuugaa

SEQ ID NO: 1931498 - RNA, 15 nt, Human
cccaggcagggccaa

SEQ ID NO: 1931499 - RNA, 23 nt, Human
cccaggcagggccaacccuucuc

SEQ ID NO: 1931500 - RNA, 20 nt, Human
cccaggcauuccccaggagg

SEQ ID NO: 1931501 - RNA, 21 nt, Human
cccaggcauuccccaggaggc

SEQ ID NO: 1931502 - RNA, 22 nt, Human
cccaggcauuccccaggaggcc

SEQ ID NO: 1931503 - RNA, 23 nt, Human
cccaggcauuccccaggaggcca

SEQ ID NO: 1931504 - RNA, 14 nt, Human
ccccacccaagggc

SEQ ID NO: 1931505 - RNA, 20 nt, Human
ccccacccaagggccuggcc

SEQ ID NO: 1931506 - RNA, 13 nt, Human
cccauucugccug

SEQ ID NO: 1931507 - RNA, 22 nt, Human
ccccaaauggaaaugggcagag

SEQ ID NO: 1931508 - RNA, 13 nt, Human
cccauucuacuug

SEQ ID NO: 1931509 - RNA, 14 nt, Human
cccauucuacuugc

SEQ ID NO: 1931510 - RNA, 15 nt, Human
cccauucuacuugcu

SEQ ID NO: 1931511 - RNA, 17 nt, Human
cccauucuacuugcucu

SEQ ID NO: 1931512 - RNA, 18 nt, Human
cccauucuacuugcucug

SEQ ID NO: 1931513 - RNA, 19 nt, Human
cccauucuacuugcucugg

SEQ ID NO: 1931514 - RNA, 20 nt, Human
cccauucuacuugcucugga

SEQ ID NO: 1931515 - RNA, 21 nt, Human
cccauucuacuugcucuggac

SEQ ID NO: 1931516 - RNA, 22 nt, Human
cccauucuacuugcucuggacc

SEQ ID NO: 1931517 - RNA, 23 nt, Human
cccauucuacuugcucuggaccu

SEQ ID NO: 1931518 - RNA, 24 nt, Human
cccauucuacuugcucuggaccug

SEQ ID NO: 1931519 - RNA, 20 nt, Human
cccagugcccacaggaucag

SEQ ID NO: 1931520 - RNA, 15 nt, Human
cccagugcccacagg

SEQ ID NO: 1931521 - RNA, 18 nt, Human
cccagugccgagaaggaa

SEQ ID NO: 1931522 - RNA, 17 nt, Human
cccagugccgagaagga

SEQ ID NO: 1931523 - RNA, 15 nt, Human
cccaugcugcccugu

SEQ ID NO: 1931524 - RNA, 16 nt, Human
cccaugcugcccugug

SEQ ID NO: 1931525 - RNA, 17 nt, Human
cccaugcugcccuguga

SEQ ID NO: 1931526 - RNA, 18 nt, Human
cccaugcugcccugugag

SEQ ID NO: 1931527 - RNA, 13 nt, Human
cccauggagccag

SEQ ID NO: 1931528 - RNA, 19 nt, Human
cccauggagccagcucccu

SEQ ID NO: 1931529 - RNA, 21 nt, Human
cccauucgguguggugcagug

SEQ ID NO: 1931530 - RNA, 17 nt, Human
ccccaggaggccagccu

SEQ ID NO: 1931531 - RNA, 22 nt, Human
ccccucagggucccugguggca

SEQ ID NO: 1931532 - RNA, 18 nt, Human
ccaggacaccgggcaggg

SEQ ID NO: 1931533 - RNA, 14 nt, Human
ccaggacaccgggc

SEQ ID NO: 1931534 - RNA, 20 nt, Human
ccaggacuauauuugggccu

SEQ ID NO: 1931535 - RNA, 21 nt, Human
ccaggacuauauuugggccug

SEQ ID NO: 1931536 - RNA, 17 nt, Human
ccagcuggggccaggcu

SEQ ID NO: 1931537 - RNA, 18 nt, Human
ccagcuggggccaggcug

SEQ ID NO: 1931538 - RNA, 19 nt, Human
ccagcuggggccaggcugg

SEQ ID NO: 1931539 - RNA, 20 nt, Human
ccagcuggggccaggcuggg

SEQ ID NO: 1931540 - RNA, 21 nt, Human
ccagcuggggccaggcugggu

SEQ ID NO: 1931541 - RNA, 22 nt, Human
ccagcuggggccaggcuggguc

SEQ ID NO: 1931542 - RNA, 23 nt, Human
ccagcuggggccaggcugggucg

SEQ ID NO: 1931543 - RNA, 22 nt, Human
ccaggaagccagcaggcucuca

SEQ ID NO: 1931544 - RNA, 20 nt, Human
ccaggaagccagcaggcucu

SEQ ID NO: 1931545 - RNA, 14 nt, Human
ccaggaauuuccca

SEQ ID NO: 1931546 - RNA, 16 nt, Human
ccaggaauuucccagg

SEQ ID NO: 1931547 - RNA, 17 nt, Human
ccaggaauuucccagga

SEQ ID NO: 1931548 - RNA, 18 nt, Human
ccaggaauuucccaggac

SEQ ID NO: 1931549 - RNA, 19 nt, Human
ccaggaauuucccaggacc

SEQ ID NO: 1931550 - RNA, 20 nt, Human
ccaggaauuucccaggaccc

SEQ ID NO: 1931551 - RNA, 21 nt, Human
ccaggaauuucccaggacccu

SEQ ID NO: 1931552 - RNA, 23 nt, Human
ccaggaauuucccaggacccuga

SEQ ID NO: 1931553 - RNA, 22 nt, Human
ccaggaauuucccaggacccug

SEQ ID NO: 1931554 - RNA, 16 nt, Human
ccagcgagcccuggug

SEQ ID NO: 1931555 - RNA, 15 nt, Human
ccagcgagcccuggu

SEQ ID NO: 1931556 - RNA, 14 nt, Human
ccagcgagcccugg

SEQ ID NO: 1931557 - RNA, 22 nt, Human
ccagccuugaccauucuccacc

SEQ ID NO: 1931558 - RNA, 11 nt, Human
ccagcucuggu

SEQ ID NO: 1931559 - RNA, 12 nt, Human
ccagcucugguc

SEQ ID NO: 1931560 - RNA, 13 nt, Human
ccagcucuggucc

SEQ ID NO: 1931561 - RNA, 16 nt, Human
ccagagcccaccuugg

SEQ ID NO: 1931562 - RNA, 22 nt, Human
ccagagcccaccuuggcucaag

SEQ ID NO: 1931563 - RNA, 11 nt, Human
ccagagcccag

SEQ ID NO: 1931564 - RNA, 19 nt, Human
ccagccuugaccauucucc

SEQ ID NO: 1931565 - RNA, 20 nt, Human
ccagccuugaccauucucca

SEQ ID NO: 1931566 - RNA, 12 nt, Human
ccagagcccagc

SEQ ID NO: 1931567 - RNA, 13 nt, Human
ccagagcccagcu

SEQ ID NO: 1931568 - RNA, 14 nt, Human
ccagagcccagcuc

SEQ ID NO: 1931569 - RNA, 15 nt, Human
ccagagcccagcucc

SEQ ID NO: 1931570 - RNA, 20 nt, Human
ccagcugcuugggcuucauc

SEQ ID NO: 1931571 - RNA, 23 nt, Human
ccagcugcuugggcuucauccuc

SEQ ID NO: 1931572 - RNA, 24 nt, Human
ccagcuggagaaauaugguacuca

SEQ ID NO: 1931573 - RNA, 14 nt, Human
ccagcucuggucca

SEQ ID NO: 1931574 - RNA, 17 nt, Human
ccagcucugguccauag

SEQ ID NO: 1931575 - RNA, 21 nt, Human
ccagcucugguccauagagag

SEQ ID NO: 1931576 - RNA, 22 nt, Human
ccagcucugguccauagagagc

SEQ ID NO: 1931577 - RNA, 12 nt, Human
ccagcugccucc

SEQ ID NO: 1931578 - RNA, 14 nt, Human
ccagcugcacugau

SEQ ID NO: 1931579 - RNA, 18 nt, Human
ccagcugcacugaugcug

SEQ ID NO: 1931580 - RNA, 19 nt, Human
ccagcugcacugaugcugc

SEQ ID NO: 1931581 - RNA, 20 nt, Human
ccaggcauccuccacaauag

SEQ ID NO: 1931582 - RNA, 17 nt, Human
ccaggcauuccccagga

SEQ ID NO: 1931583 - RNA, 14 nt, Human
ccaggcauucccca

SEQ ID NO: 1931584 - RNA, 13 nt, Human
ccaggcauggugg

SEQ ID NO: 1931585 - RNA, 24 nt, Human
ccaggcauuccccaggaggccagc

SEQ ID NO: 1931586 - RNA, 23 nt, Human
ccaggcauuccccaggaggccag

SEQ ID NO: 1931587 - RNA, 22 nt, Human
ccaggcauuccccaggaggcca

SEQ ID NO: 1931588 - RNA, 19 nt, Human
ccaggagccuccugcccuu

SEQ ID NO: 1931589 - RNA, 18 nt, Human
ccaggagccuccugcccu

SEQ ID NO: 1931590 - RNA, 13 nt, Human
ccaggagccuccu

SEQ ID NO: 1931591 - RNA, 14 nt, Human
ccaggagccuccug

SEQ ID NO: 1931592 - RNA, 12 nt, Human
ccaggaggccag

SEQ ID NO: 1931593 - RNA, 14 nt, Human
ccaggaggccagcc

SEQ ID NO: 1931594 - RNA, 13 nt, Human
ccaggaggccagc

SEQ ID NO: 1931595 - RNA, 15 nt, Human
ccaggagccccgagg

SEQ ID NO: 1931596 - RNA, 15 nt, Human
ccaggagcagccaca

SEQ ID NO: 1931597 - RNA, 16 nt, Human
ccaggagcagccacau

SEQ ID NO: 1931598 - RNA, 12 nt, Human
ccaggcuuggaa

SEQ ID NO: 1931599 - RNA, 21 nt, Human
ccaggcugguuucgaacuccu

SEQ ID NO: 1931600 - RNA, 18 nt, Human
ccaggcuugccugcaggc

SEQ ID NO: 1931601 - RNA, 19 nt, Human
ccaggcuuuuuuaucaugu

SEQ ID NO: 1931602 - RNA, 13 nt, Human
ccaggccccugcc

SEQ ID NO: 1931603 - RNA, 19 nt, Human
ccaggcuggucucaaacuc

SEQ ID NO: 1931604 - RNA, 20 nt, Human
ccaggcuguaucccaugagc

SEQ ID NO: 1931605 - RNA, 17 nt, Human
ccaggcuugccugcagg

SEQ ID NO: 1931606 - RNA, 21 nt, Human
ccaggugaguccuagagcuac

SEQ ID NO: 1931607 - RNA, 19 nt, Human
ccaggugcuaggaacacuc

SEQ ID NO: 1931608 - RNA, 18 nt, Human
ccaggugcaaccagggag

SEQ ID NO: 1931609 - RNA, 15 nt, Human
ccagguucagcuugu

SEQ ID NO: 1931610 - RNA, 14 nt, Human
ccagguucagcuug

SEQ ID NO: 1931611 - RNA, 17 nt, Human
ccagguguuacuguaau

SEQ ID NO: 1931612 - RNA, 21 nt, Human
ccagguguuacuguaauuccu

SEQ ID NO: 1931613 - RNA, 22 nt, Human
ccaguauaaaacaccuaaauaa

SEQ ID NO: 1931614 - RNA, 22 nt, Human
ccaucugguuaggauggcagga

SEQ ID NO: 1931615 - RNA, 23 nt, Human
ccaucugguuaggauggcaggac

SEQ ID NO: 1931616 - RNA, 12 nt, Human
ccaucugggcuc

SEQ ID NO: 1931617 - RNA, 16 nt, Human
ccaucugggcuccucc

SEQ ID NO: 1931618 - RNA, 14 nt, Human
ccaugaagauguag

SEQ ID NO: 1931619 - RNA, 19 nt, Human
ccaugaagaggaugcugug

SEQ ID NO: 1931620 - RNA, 21 nt, Human
ccaugaagaggaugcugugaa

SEQ ID NO: 1931621 - RNA, 14 nt, Human
ccaugauggcaaca

SEQ ID NO: 1931622 - RNA, 15 nt, Human
ccaugauggcaacag

SEQ ID NO: 1931623 - RNA, 16 nt, Human
ccaugauggcaacaga

SEQ ID NO: 1931624 - RNA, 19 nt, Human
ccaugauggcaacagaucu

SEQ ID NO: 1931625 - RNA, 21 nt, Human
ccaugauggcaacagaucugg

SEQ ID NO: 1931626 - RNA, 19 nt, Human
ccaugauuaaccacuucag

SEQ ID NO: 1931627 - RNA, 21 nt, Human
ccaugauuaaccacuucagcu

SEQ ID NO: 1931628 - RNA, 18 nt, Human
ccaugauguuuuccauga

SEQ ID NO: 1931629 - RNA, 23 nt, Human
ccaugauucuauuuauauguaca

SEQ ID NO: 1931630 - RNA, 11 nt, Human
ccaugcacugu

SEQ ID NO: 1931631 - RNA, 13 nt, Human
ccaugcacuguga

SEQ ID NO: 1931632 - RNA, 15 nt, Human
ccaugcacugugaag

SEQ ID NO: 1931633 - RNA, 16 nt, Human
ccaugcacugugaagg

SEQ ID NO: 1931634 - RNA, 17 nt, Human
ccaugcacugugaagga

SEQ ID NO: 1931635 - RNA, 14 nt, Human
ccaugcugcccugu

SEQ ID NO: 1931636 - RNA, 11 nt, Human
ccaugcugccc

SEQ ID NO: 1931637 - RNA, 13 nt, Human
ccaugcugcccug

SEQ ID NO: 1931638 - RNA, 23 nt, Human
ccaugccucccccuagccauuuu

SEQ ID NO: 1931639 - RNA, 21 nt, Human
ccaugccucagcccugacccu

SEQ ID NO: 1931640 - RNA, 15 nt, Human
ccaugccucagcccu

SEQ ID NO: 1931641 - RNA, 16 nt, Human
ccaugccucagcccug

SEQ ID NO: 1931642 - RNA, 12 nt, Human
ccaugccucagc

SEQ ID NO: 1931643 - RNA, 14 nt, Human
ccaugccucagccc

SEQ ID NO: 1931644 - RNA, 21 nt, Human
ccaugcacugugaaggacccu

SEQ ID NO: 1931645 - RNA, 19 nt, Human
ccaugcacugugaaggacc

SEQ ID NO: 1931646 - RNA, 20 nt, Human
ccaugcacugugaaggaccc

SEQ ID NO: 1931647 - RNA, 22 nt, Human
ccaucauugaaaucuuuuugcu

SEQ ID NO: 1931648 - RNA, 12 nt, Human
ccauccucugua

SEQ ID NO: 1931649 - RNA, 19 nt, Human
ccauccucuguacagagcc

SEQ ID NO: 1931650 - RNA, 13 nt, Human
ccaucaccagaca

SEQ ID NO: 1931651 - RNA, 18 nt, Human
ccauauccuuacccuccu

SEQ ID NO: 1931652 - RNA, 20 nt, Human
ccagugaggcucugcccuug

SEQ ID NO: 1931653 - RNA, 17 nt, Human
ccagugaggcucugccc

SEQ ID NO: 1931654 - RNA, 18 nt, Human
ccagugaggcucugcccu

SEQ ID NO: 1931655 - RNA, 19 nt, Human
ccagugaggcucugcccuu

SEQ ID NO: 1931656 - RNA, 20 nt, Human
ccauccucuguacagagccc

SEQ ID NO: 1931657 - RNA, 18 nt, Human
cccaaaaggcagaagcaa

SEQ ID NO: 1931658 - RNA, 13 nt, Human
cccaaaaggcaga

SEQ ID NO: 1931659 - RNA, 20 nt, Human
ccauuuugggguacccacug

SEQ ID NO: 1931660 - RNA, 23 nt, Human
ccauuuuggauucuuauggacaa

SEQ ID NO: 1931661 - RNA, 22 nt, Human
ccauuuugggguacccacugcu

SEQ ID NO: 1931662 - RNA, 16 nt, Human
cccaaagcagugcaug

SEQ ID NO: 1931663 - RNA, 12 nt, Human
cccaaagaugca

SEQ ID NO: 1931664 - RNA, 15 nt, Human
cccaaagaugcagcc

SEQ ID NO: 1931665 - RNA, 12 nt, Human
cccaaagaagga

SEQ ID NO: 1931666 - RNA, 22 nt, Human
cccaaaccaccagaagcccaga

SEQ ID NO: 1931667 - RNA, 18 nt, Human
cccaaaccaccagaagcc

SEQ ID NO: 1931668 - RNA, 17 nt, Human
cccaaaccaccagaagc

SEQ ID NO: 1931669 - RNA, 18 nt, Human
ccauucugccugcccagg

SEQ ID NO: 1931670 - RNA, 17 nt, Human
ccauucugccugcccag

SEQ ID NO: 1931671 - RNA, 17 nt, Human
ccauucuccaccugcca

SEQ ID NO: 1931672 - RNA, 16 nt, Human
ccauucugccugccca

SEQ ID NO: 1931673 - RNA, 20 nt, Human
ccauucugccugcccaggcc

SEQ ID NO: 1931674 - RNA, 19 nt, Human
ccauucugccugcccaggc

SEQ ID NO: 1931675 - RNA, 21 nt, Human
ccauucugccugcccaggccc

SEQ ID NO: 1931676 - RNA, 13 nt, Human
ccauggacuuugu

SEQ ID NO: 1931677 - RNA, 14 nt, Human
ccauggacuuuguu

SEQ ID NO: 1931678 - RNA, 15 nt, Human
ccauucuccaccugc

SEQ ID NO: 1931679 - RNA, 16 nt, Human
ccauucuccaccugcc

SEQ ID NO: 1931680 - RNA, 16 nt, Human
ccauggacaggcuggc

SEQ ID NO: 1931681 - RNA, 18 nt, Human
ccauggacaggcuggcuc

SEQ ID NO: 1931682 - RNA, 19 nt, Human
ccauggacaggcuggcucc

SEQ ID NO: 1931683 - RNA, 21 nt, Human
cccacaaaggagagcuagcag

SEQ ID NO: 1931684 - RNA, 14 nt, Human
cgcgaccuuggccg

SEQ ID NO: 1931685 - RNA, 15 nt, Human
cgcgacuaauuucaa

SEQ ID NO: 1931686 - RNA, 22 nt, Human
cgcgacuaauuucaaaaugcuu

SEQ ID NO: 1931687 - RNA, 20 nt, Human
cgcgugcacacaccagagcc

SEQ ID NO: 1931688 - RNA, 19 nt, Human
cgcgugcacacaccagagc

SEQ ID NO: 1931689 - RNA, 16 nt, Human
cgcgugcacacaccag

SEQ ID NO: 1931690 - RNA, 21 nt, Human
cgcuaagagggagggagggcu

SEQ ID NO: 1931691 - RNA, 15 nt, Human
cgcuaagagggaggg

SEQ ID NO: 1931692 - RNA, 16 nt, Human
cgcuaagagggaggga

SEQ ID NO: 1931693 - RNA, 14 nt, Human
cgcuaagagggagg

SEQ ID NO: 1931694 - RNA, 16 nt, Human
cgcgacaaugcaaacc

SEQ ID NO: 1931695 - RNA, 17 nt, Human
cgcgacaaugcaaacca

SEQ ID NO: 1931696 - RNA, 12 nt, Human
cgcccucccagg

SEQ ID NO: 1931697 - RNA, 13 nt, Human
cgcccucccaggc

SEQ ID NO: 1931698 - RNA, 12 nt, Human
cgcccccugccc

SEQ ID NO: 1931699 - RNA, 15 nt, Human
cgcccccacugguga

SEQ ID NO: 1931700 - RNA, 19 nt, Human
cgcccccacccugagcgcc

SEQ ID NO: 1931701 - RNA, 13 nt, Human
cgcagacaggacc

SEQ ID NO: 1931702 - RNA, 14 nt, Human
cgcagacaggacca

SEQ ID NO: 1931703 - RNA, 20 nt, Human
cgaggaaacgaaacccacuc

SEQ ID NO: 1931704 - RNA, 22 nt, Human
cgaggaaacgaaacccacucua

SEQ ID NO: 1931705 - RNA, 12 nt, Human
cgaggacaggga

SEQ ID NO: 1931706 - RNA, 13 nt, Human
cgaggacagggag

SEQ ID NO: 1931707 - RNA, 14 nt, Human
cgaggacagggagg

SEQ ID NO: 1931708 - RNA, 19 nt, Human
cgaggccuucucugaagga

SEQ ID NO: 1931709 - RNA, 18 nt, Human
cgaggccuucucugaagg

SEQ ID NO: 1931710 - RNA, 17 nt, Human
cgagggcagcgggagcc

SEQ ID NO: 1931711 - RNA, 20 nt, Human
ccuuuguauucucuccugua

SEQ ID NO: 1931712 - RNA, 18 nt, Human
ccuuuguauucucuccug

SEQ ID NO: 1931713 - RNA, 15 nt, Human
ccuuuguauucucuc

SEQ ID NO: 1931714 - RNA, 11 nt, Human
cgcaaugugac

SEQ ID NO: 1931715 - RNA, 12 nt, Human
cgauuucuguuu

SEQ ID NO: 1931716 - RNA, 23 nt, Human
cgauugcaggagucccugccauc

SEQ ID NO: 1931717 - RNA, 21 nt, Human
cgauuucccugguuuuagucu

SEQ ID NO: 1931718 - RNA, 19 nt, Human
cgauucuucugcuucagcc

SEQ ID NO: 1931719 - RNA, 13 nt, Human
cgauucuucugcu

SEQ ID NO: 1931720 - RNA, 21 nt, Human
cgauucuucugcuucagccuc

SEQ ID NO: 1931721 - RNA, 21 nt, Human
cgauugcaggagucccugcca

SEQ ID NO: 1931722 - RNA, 19 nt, Human
cgaucuggguucacugcaa

SEQ ID NO: 1931723 - RNA, 19 nt, Human
cgaucgcggcggagcuggc

SEQ ID NO: 1931724 - RNA, 15 nt, Human
ccuuggccgcaccua

SEQ ID NO: 1931725 - RNA, 12 nt, Human
ccuuggcucaga

SEQ ID NO: 1931726 - RNA, 15 nt, Human
ccuuggcucagacau

SEQ ID NO: 1931727 - RNA, 13 nt, Human
ccuuggcugcagg

SEQ ID NO: 1931728 - RNA, 12 nt, Human
ccuuggcugcag

SEQ ID NO: 1931729 - RNA, 14 nt, Human
ccuuggcugcaggg

SEQ ID NO: 1931730 - RNA, 20 nt, Human
ccuuguggucccaccccaca

SEQ ID NO: 1931731 - RNA, 16 nt, Human
ccuuguggucccaccc

SEQ ID NO: 1931732 - RNA, 19 nt, Human
ccuuguggucccaccccac

SEQ ID NO: 1931733 - RNA, 14 nt, Human
ccuuucuggcucuc

SEQ ID NO: 1931734 - RNA, 14 nt, Human
ccuuuaagagaaau

SEQ ID NO: 1931735 - RNA, 14 nt, Human
ccuuucuccuuugu

SEQ ID NO: 1931736 - RNA, 15 nt, Human
ccuuucuccuuugua

SEQ ID NO: 1931737 - RNA, 13 nt, Human
ccuuuaagagaaa

SEQ ID NO: 1931738 - RNA, 16 nt, Human
ccuuugcuugaaagaa

SEQ ID NO: 1931739 - RNA, 15 nt, Human
ccuuuggcagaguuc

SEQ ID NO: 1931740 - RNA, 14 nt, Human
ccuuugauaaaugu

SEQ ID NO: 1931741 - RNA, 23 nt, Human
ccuuugacgccaucccagcccca

SEQ ID NO: 1931742 - RNA, 14 nt, Human
ccuuugacaaaggu

SEQ ID NO: 1931743 - RNA, 17 nt, Human
cgggcagggcucccaca

SEQ ID NO: 1931744 - RNA, 23 nt, Human
cgggcaggggagggucagccagg

SEQ ID NO: 1931745 - RNA, 16 nt, Human
cgggcagggcucccac

SEQ ID NO: 1931746 - RNA, 15 nt, Human
cgggcagggcuccca

SEQ ID NO: 1931747 - RNA, 12 nt, Human
cgggcaugacac

SEQ ID NO: 1931748 - RNA, 15 nt, Human
cgggcaugacacgaa

SEQ ID NO: 1931749 - RNA, 15 nt, Human
cggggagggugacag

SEQ ID NO: 1931750 - RNA, 22 nt, Human
cggggagggugacaguggccgc

SEQ ID NO: 1931751 - RNA, 23 nt, Human
cgggcagccuggcucccaggaca

SEQ ID NO: 1931752 - RNA, 22 nt, Human
cgggcagccuggcucccaggac

SEQ ID NO: 1931753 - RNA, 18 nt, Human
cgggcagccuggcuccca

SEQ ID NO: 1931754 - RNA, 16 nt, Human
cgggcagccuggcucc

SEQ ID NO: 1931755 - RNA, 14 nt, Human
cgggcagccuggcu

SEQ ID NO: 1931756 - RNA, 13 nt, Human
cgggcagccuggc

SEQ ID NO: 1931757 - RNA, 17 nt, Human
cgggaggucgaggcagg

SEQ ID NO: 1931758 - RNA, 16 nt, Human
cgggaggucgaggcag

SEQ ID NO: 1931759 - RNA, 20 nt, Human
cgggaggauguucugggaca

SEQ ID NO: 1931760 - RNA, 21 nt, Human
cgggaggauguucugggacac

SEQ ID NO: 1931761 - RNA, 20 nt, Human
cggcugggcacacgccuccc

SEQ ID NO: 1931762 - RNA, 16 nt, Human
cggcugggcacacgcc

SEQ ID NO: 1931763 - RNA, 17 nt, Human
cggcugggcacacgccu

SEQ ID NO: 1931764 - RNA, 12 nt, Human
cggcugggcaca

SEQ ID NO: 1931765 - RNA, 17 nt, Human
cggccuccauccugagg

SEQ ID NO: 1931766 - RNA, 16 nt, Human
cggccuccauccugag

SEQ ID NO: 1931767 - RNA, 20 nt, Human
cggcccauccccaggcaccu

SEQ ID NO: 1931768 - RNA, 14 nt, Human
cggccucccaaagu

SEQ ID NO: 1931769 - RNA, 15 nt, Human
cggccuuuggcuuca

SEQ ID NO: 1931770 - RNA, 21 nt, Human
cggccuguccuccaacaccaa

SEQ ID NO: 1931771 - RNA, 12 nt, Human
cggccuguccuc

SEQ ID NO: 1931772 - RNA, 15 nt, Human
cggccuguccuccaa

SEQ ID NO: 1931773 - RNA, 15 nt, Human
cggcuggccuggccc

SEQ ID NO: 1931774 - RNA, 16 nt, Human
cggcuggccuggcccc

SEQ ID NO: 1931775 - RNA, 18 nt, Human
cggcuggccuggccccuc

SEQ ID NO: 1931776 - RNA, 15 nt, Human
cggacgcuggcuccc

SEQ ID NO: 1931777 - RNA, 14 nt, Human
cggacgcuggcucc

SEQ ID NO: 1931778 - RNA, 20 nt, Human
cggacagccacggccaggcc

SEQ ID NO: 1931779 - RNA, 16 nt, Human
cggaucuuuggacaga

SEQ ID NO: 1931780 - RNA, 19 nt, Human
cggaucuuuggacagaagc

SEQ ID NO: 1931781 - RNA, 24 nt, Human
cggauuccaaagaguagaauugca

SEQ ID NO: 1931782 - RNA, 15 nt, Human
cggauuuggggugga

SEQ ID NO: 1931783 - RNA, 12 nt, Human
cggcaacaucaa

SEQ ID NO: 1931784 - RNA, 17 nt, Human
cggaaagcccugugcuc

SEQ ID NO: 1931785 - RNA, 19 nt, Human
cggaacccaagcuuagaac

SEQ ID NO: 1931786 - RNA, 17 nt, Human
cggaacccaagcuuaga

SEQ ID NO: 1931787 - RNA, 13 nt, Human
cgcuccugugucu

SEQ ID NO: 1931788 - RNA, 22 nt, Human
cgcucaccuuuguuuagaacac

SEQ ID NO: 1931789 - RNA, 18 nt, Human
cggacagccacggccagg

SEQ ID NO: 1931790 - RNA, 16 nt, Human
cggacagccacggcca

SEQ ID NO: 1931791 - RNA, 15 nt, Human
cggacagccacggcc

SEQ ID NO: 1931792 - RNA, 12 nt, Human
cggacacccccu

SEQ ID NO: 1931793 - RNA, 14 nt, Human
cggacacccccucg

SEQ ID NO: 1931794 - RNA, 20 nt, Human
cggaaugaaccacaucuugc

SEQ ID NO: 1931795 - RNA, 17 nt, Human
cggaacugcaugcugcu

SEQ ID NO: 1931796 - RNA, 18 nt, Human
cggaacugcaugcugcug

SEQ ID NO: 1931797 - RNA, 16 nt, Human
cggaacugcaugcugc

SEQ ID NO: 1931798 - RNA, 14 nt, Human
cggggcagggcagc

SEQ ID NO: 1931799 - RNA, 23 nt, Human
cggugcuaucucccccagcccca

SEQ ID NO: 1931800 - RNA, 22 nt, Human
cggugcuguccucagguggcca

SEQ ID NO: 1931801 - RNA, 16 nt, Human
cgguggacccagacac

SEQ ID NO: 1931802 - RNA, 16 nt, Human
cggugcuguccucagg

SEQ ID NO: 1931803 - RNA, 17 nt, Human
cggugcuguccucaggu

SEQ ID NO: 1931804 - RNA, 21 nt, Human
cggugcuguccucagguggcc

SEQ ID NO: 1931805 - RNA, 16 nt, Human
cguauaaaagccuguu

SEQ ID NO: 1931806 - RNA, 17 nt, Human
cguauaaaagccuguuu

SEQ ID NO: 1931807 - RNA, 21 nt, Human
cguauaaaagccuguuuaaga

SEQ ID NO: 1931808 - RNA, 22 nt, Human
cguauaaaagccuguuuaagag

SEQ ID NO: 1931809 - RNA, 16 nt, Human
cguagcugcaaaggac

SEQ ID NO: 1931810 - RNA, 20 nt, Human
cguaugaguuagaauaauaa

SEQ ID NO: 1931811 - RNA, 20 nt, Human
cgucaacucauauuuucaug

SEQ ID NO: 1931812 - RNA, 16 nt, Human
cgucaacucauauuuu

SEQ ID NO: 1931813 - RNA, 11 nt, Human
cgucaacaaau

SEQ ID NO: 1931814 - RNA, 11 nt, Human
cguccagggag

SEQ ID NO: 1931815 - RNA, 19 nt, Human
cgucauuacagggcacagg

SEQ ID NO: 1931816 - RNA, 17 nt, Human
cgucauaacuagaacug

SEQ ID NO: 1931817 - RNA, 16 nt, Human
cgucauaacuagaacu

SEQ ID NO: 1931818 - RNA, 14 nt, Human
cgucauaacuagaa

SEQ ID NO: 1931819 - RNA, 14 nt, Human
cgucugacaggcaa

SEQ ID NO: 1931820 - RNA, 13 nt, Human
cgucugacaggca

SEQ ID NO: 1931821 - RNA, 15 nt, Human
cgucuggaaguccaa

SEQ ID NO: 1931822 - RNA, 14 nt, Human
cgucuaccugaggg

SEQ ID NO: 1931823 - RNA, 11 nt, Human
cguccccuguc

SEQ ID NO: 1931824 - RNA, 14 nt, Human
cguccccugucccc

SEQ ID NO: 1931825 - RNA, 15 nt, Human
cgucgcccucccagg

SEQ ID NO: 1931826 - RNA, 16 nt, Human
cgucgcccucccaggc

SEQ ID NO: 1931827 - RNA, 22 nt, Human
cgugcacacaccagagcccacc

SEQ ID NO: 1931828 - RNA, 18 nt, Human
cgugcauaccacuuuugu

SEQ ID NO: 1931829 - RNA, 14 nt, Human
cgugcauaccacuu

SEQ ID NO: 1931830 - RNA, 19 nt, Human
cgugcauaccacuuuuguu

SEQ ID NO: 1931831 - RNA, 21 nt, Human
cgugcacacaccagagcccac

SEQ ID NO: 1931832 - RNA, 20 nt, Human
cgugcacacaccagagccca

SEQ ID NO: 1931833 - RNA, 12 nt, Human
cgugacaacacu

SEQ ID NO: 1931834 - RNA, 14 nt, Human
cgucuguucccccu

SEQ ID NO: 1931835 - RNA, 12 nt, Human
cguucucugccu

SEQ ID NO: 1931836 - RNA, 12 nt, Human
cguucucccugg

SEQ ID NO: 1931837 - RNA, 13 nt, Human
cguucucccuggg

SEQ ID NO: 1931838 - RNA, 12 nt, Human
cguucugugcac

SEQ ID NO: 1931839 - RNA, 21 nt, Human
cguuucuaaaggcuaccuuug

SEQ ID NO: 1931840 - RNA, 19 nt, Human
cguuucuaaaggcuaccuu

SEQ ID NO: 1931841 - RNA, 20 nt, Human
cguuucuaugacacaugcaa

SEQ ID NO: 1931842 - RNA, 16 nt, Human
cguuuuguuuugugcc

SEQ ID NO: 1931843 - RNA, 13 nt, Human
cguuuugaagcua

SEQ ID NO: 1931844 - RNA, 20 nt, Human
cguuuugaagcuacugugug

SEQ ID NO: 1931845 - RNA, 17 nt, Human
cguuugaccuuuuaugu

SEQ ID NO: 1931846 - RNA, 20 nt, Human
cguuugaagacauugcacca

SEQ ID NO: 1931847 - RNA, 16 nt, Human
cguuugagaagaaaac

SEQ ID NO: 1931848 - RNA, 21 nt, Human
cguuugagaagaaaacaucua

SEQ ID NO: 1931849 - RNA, 14 nt, Human
cguggcucagccag

SEQ ID NO: 1931850 - RNA, 15 nt, Human
cguggcucagccagc

SEQ ID NO: 1931851 - RNA, 18 nt, Human
cguggcucagccagcacu

SEQ ID NO: 1931852 - RNA, 12 nt, Human
cguggcugcuuc

SEQ ID NO: 1931853 - RNA, 14 nt, Human
cguggcugcuucaa

SEQ ID NO: 1931854 - RNA, 15 nt, Human
cguggcugcuucaag

SEQ ID NO: 1931855 - RNA, 17 nt, Human
cguggcugcuucaagga

SEQ ID NO: 1931856 - RNA, 16 nt, Human
ccuucaguaaccccca

SEQ ID NO: 1931857 - RNA, 22 nt, Human
ccuucaguaacccccacuggac

SEQ ID NO: 1931858 - RNA, 12 nt, Human
ccuucacaaagc

SEQ ID NO: 1931859 - RNA, 18 nt, Human
ccuucacaaagcccaagg

SEQ ID NO: 1931860 - RNA, 10 nt, Human
ccuucagugc

SEQ ID NO: 1931861 - RNA, 13 nt, Human
ccuucagugccuu

SEQ ID NO: 1931862 - RNA, 14 nt, Human
ccuucagugccuua

SEQ ID NO: 1931863 - RNA, 20 nt, Human
ccuucagugccuuauggaac

SEQ ID NO: 1931864 - RNA, 15 nt, Human
ccuucagugccuuau

SEQ ID NO: 1931865 - RNA, 14 nt, Human
ccuuccucuuucca

SEQ ID NO: 1931866 - RNA, 15 nt, Human
ccuuccagggguggg

SEQ ID NO: 1931867 - RNA, 16 nt, Human
ccuuccagggguggga

SEQ ID NO: 1931868 - RNA, 18 nt, Human
ccuuccaggggugggaca

SEQ ID NO: 1931869 - RNA, 22 nt, Human
ccuuccaggggugggacacccu

SEQ ID NO: 1931870 - RNA, 20 nt, Human
ccuguggccaaguucuuagu

SEQ ID NO: 1931871 - RNA, 14 nt, Human
ccuuaccagcagag

SEQ ID NO: 1931872 - RNA, 17 nt, Human
ccuuaccagcagagcac

SEQ ID NO: 1931873 - RNA, 17 nt, Human
ccuuacccuccuuggga

SEQ ID NO: 1931874 - RNA, 15 nt, Human
ccuuaccagcagagc

SEQ ID NO: 1931875 - RNA, 16 nt, Human
ccuuaccagcagagca

SEQ ID NO: 1931876 - RNA, 20 nt, Human
ccuuaccucggugccuuccu

SEQ ID NO: 1931877 - RNA, 14 nt, Human
ccuuaccugccagg

SEQ ID NO: 1931878 - RNA, 15 nt, Human
ccuuauuguaccucu

SEQ ID NO: 1931879 - RNA, 16 nt, Human
ccuuauuguaccucuc

SEQ ID NO: 1931880 - RNA, 21 nt, Human
ccuuagacagucccugccaau

SEQ ID NO: 1931881 - RNA, 20 nt, Human
ccuuagaacauuuuaauuca

SEQ ID NO: 1931882 - RNA, 18 nt, Human
ccuuagacagucccugcc

SEQ ID NO: 1931883 - RNA, 19 nt, Human
ccuuagacagucccugcca

SEQ ID NO: 1931884 - RNA, 16 nt, Human
ccuuagacagucccug

SEQ ID NO: 1931885 - RNA, 17 nt, Human
ccuuagacagucccugc

SEQ ID NO: 1931886 - RNA, 19 nt, Human
ccuucagugccuuauggaa

SEQ ID NO: 1931887 - RNA, 16 nt, Human
ccuugaacuggguacu

SEQ ID NO: 1931888 - RNA, 17 nt, Human
ccuugaacuuugaccuc

SEQ ID NO: 1931889 - RNA, 17 nt, Human
ccuugaaugaugccaug

SEQ ID NO: 1931890 - RNA, 19 nt, Human
ccuugaacuuugaccucug

SEQ ID NO: 1931891 - RNA, 14 nt, Human
ccuugaacugggua

SEQ ID NO: 1931892 - RNA, 22 nt, Human
ccuugaaaacacuguucucugc

SEQ ID NO: 1931893 - RNA, 19 nt, Human
ccuugaaaacacuguucuc

SEQ ID NO: 1931894 - RNA, 21 nt, Human
ccuugaaaacacuguucucug

SEQ ID NO: 1931895 - RNA, 18 nt, Human
ccuucgcuccugugucuu

SEQ ID NO: 1931896 - RNA, 15 nt, Human
ccuucgcuccugugu

SEQ ID NO: 1931897 - RNA, 14 nt, Human
ccuucgcuccugug

SEQ ID NO: 1931898 - RNA, 13 nt, Human
ccuucgcuccugu

SEQ ID NO: 1931899 - RNA, 15 nt, Human
ccuugaaaacacugu

SEQ ID NO: 1931900 - RNA, 17 nt, Human
ccuugacagggcacacc

SEQ ID NO: 1931901 - RNA, 15 nt, Human
ccuugacagggcaca

SEQ ID NO: 1931902 - RNA, 19 nt, Human
ccuugaccauucuccaccu

SEQ ID NO: 1931903 - RNA, 20 nt, Human
ccuugaccauucuccaccug

SEQ ID NO: 1931904 - RNA, 14 nt, Human
ccuugacagggcac

SEQ ID NO: 1931905 - RNA, 12 nt, Human
ccuugaaugugg

SEQ ID NO: 1931906 - RNA, 23 nt, Human
ccuugacaaagucaagccacaug

SEQ ID NO: 1931907 - RNA, 21 nt, Human
ccuugacaaagucaagccaca

SEQ ID NO: 1931908 - RNA, 21 nt, Human
ccuugaccauucuccaccugc

SEQ ID NO: 1931909 - RNA, 22 nt, Human
ccuugaguugauucagcucugc

SEQ ID NO: 1931910 - RNA, 23 nt, Human
ccuugaguugauucagcucugca

SEQ ID NO: 1931911 - RNA, 19 nt, Human
ccuuggauuguccccgacc

SEQ ID NO: 1931912 - RNA, 15 nt, Human
ccuuggcaccagaca

SEQ ID NO: 1931913 - RNA, 20 nt, Human
ccuuggcaccagacacccag

SEQ ID NO: 1931914 - RNA, 21 nt, Human
ccuuggcaccagacacccagg

SEQ ID NO: 1931915 - RNA, 22 nt, Human
ccuuggcaccagacacccagga

SEQ ID NO: 1931916 - RNA, 23 nt, Human
ccuuggcaccagacacccaggac

SEQ ID NO: 1931917 - RNA, 13 nt, Human
ccuugacagggca

SEQ ID NO: 1931918 - RNA, 11 nt, Human
ccuuuggcuuc

SEQ ID NO: 1931919 - RNA, 20 nt, Human
ccuguaguugcguggacucu

SEQ ID NO: 1931920 - RNA, 19 nt, Human
ccuguaguugcguggacuc

SEQ ID NO: 1931921 - RNA, 18 nt, Human
ccuguaguugcguggacu

SEQ ID NO: 1931922 - RNA, 18 nt, Human
ccuguaggauuuuuuucu

SEQ ID NO: 1931923 - RNA, 21 nt, Human
ccuguagagugggagcugagu

SEQ ID NO: 1931924 - RNA, 19 nt, Human
ccuguagagugggagcuga

SEQ ID NO: 1931925 - RNA, 23 nt, Human
ccuguagagugggagcugagugg

SEQ ID NO: 1931926 - RNA, 13 nt, Human
ccuggugcugcug

SEQ ID NO: 1931927 - RNA, 12 nt, Human
ccuggugcugcu

SEQ ID NO: 1931928 - RNA, 13 nt, Human
ccugguggcagcu

SEQ ID NO: 1931929 - RNA, 12 nt, Human
ccugguggcagc

SEQ ID NO: 1931930 - RNA, 14 nt, Human
ccugguggcagcuc

SEQ ID NO: 1931931 - RNA, 16 nt, Human
ccugguggcagcucac

SEQ ID NO: 1931932 - RNA, 17 nt, Human
ccugguggcagcucacc

SEQ ID NO: 1931933 - RNA, 18 nt, Human
ccugguggcagcucaccu

SEQ ID NO: 1931934 - RNA, 20 nt, Human
ccuguaauccuagcacuuug

SEQ ID NO: 1931935 - RNA, 23 nt, Human
ccuguaaucccagcacuuuggga

SEQ ID NO: 1931936 - RNA, 13 nt, Human
ccuguccucccag

SEQ ID NO: 1931937 - RNA, 22 nt, Human
ccuguccucccagcuccucacu

SEQ ID NO: 1931938 - RNA, 21 nt, Human
ccuguccuccaacaccaagca

SEQ ID NO: 1931939 - RNA, 22 nt, Human
ccuguccuccaacaccaagcac

SEQ ID NO: 1931940 - RNA, 13 nt, Human
ccuguccuccaac

SEQ ID NO: 1931941 - RNA, 22 nt, Human
ccugugagcuaggaauuguguu

SEQ ID NO: 1931942 - RNA, 15 nt, Human
ccugugagcccagcu

SEQ ID NO: 1931943 - RNA, 17 nt, Human
ccugugagcccagcugg

SEQ ID NO: 1931944 - RNA, 20 nt, Human
ccugugaguacuacaguccu

SEQ ID NO: 1931945 - RNA, 20 nt, Human
ccugugagcccagcuggguc

SEQ ID NO: 1931946 - RNA, 16 nt, Human
ccugucccccugacaa

SEQ ID NO: 1931947 - RNA, 19 nt, Human
ccuguccagcuccaaccug

SEQ ID NO: 1931948 - RNA, 17 nt, Human
ccugucccccugacaac

SEQ ID NO: 1931949 - RNA, 18 nt, Human
ccuguccccgcacugggc

SEQ ID NO: 1931950 - RNA, 13 nt, Human
ccuguccagcucc

SEQ ID NO: 1931951 - RNA, 14 nt, Human
ccuguccagcucca

SEQ ID NO: 1931952 - RNA, 15 nt, Human
ccuguccagcuccaa

SEQ ID NO: 1931953 - RNA, 20 nt, Human
ccugugcauguaugucuugg

SEQ ID NO: 1931954 - RNA, 17 nt, Human
ccugugcauguaugucu

SEQ ID NO: 1931955 - RNA, 14 nt, Human
ccugugcauguaug

SEQ ID NO: 1931956 - RNA, 16 nt, Human
ccugugccuccaucag

SEQ ID NO: 1931957 - RNA, 19 nt, Human
ccugugccucugggacugg

SEQ ID NO: 1931958 - RNA, 15 nt, Human
ccugugccucuggga

SEQ ID NO: 1931959 - RNA, 17 nt, Human
ccugugccucugggacu

SEQ ID NO: 1931960 - RNA, 22 nt, Human
ccugugauggggcccugccucc

SEQ ID NO: 1931961 - RNA, 20 nt, Human
ccugugauggggcccugccu

SEQ ID NO: 1931962 - RNA, 21 nt, Human
ccugugauggggcccugccuc

SEQ ID NO: 1931963 - RNA, 17 nt, Human
ccugugauggggcccug

SEQ ID NO: 1931964 - RNA, 18 nt, Human
ccugugauggggcccugc

SEQ ID NO: 1931965 - RNA, 19 nt, Human
ccugugauggggcccugcc

SEQ ID NO: 1931966 - RNA, 18 nt, Human
ccuggcaugggaaugaau

SEQ ID NO: 1931967 - RNA, 23 nt, Human
ccuggcaugggaaugaaugucag

SEQ ID NO: 1931968 - RNA, 15 nt, Human
ccuggccaucccaca

SEQ ID NO: 1931969 - RNA, 14 nt, Human
ccuggccaucccac

SEQ ID NO: 1931970 - RNA, 12 nt, Human
ccuggcggggug

SEQ ID NO: 1931971 - RNA, 14 nt, Human
ccuggccccucagg

SEQ ID NO: 1931972 - RNA, 16 nt, Human
ccuggccccucagggu

SEQ ID NO: 1931973 - RNA, 12 nt, Human
ccugggcagaag

SEQ ID NO: 1931974 - RNA, 14 nt, Human
ccugggcagaagga

SEQ ID NO: 1931975 - RNA, 13 nt, Human
ccugggaggcucu

SEQ ID NO: 1931976 - RNA, 21 nt, Human
ccugggaggcucuggagccca

SEQ ID NO: 1931977 - RNA, 20 nt, Human
ccugggaggucaaggcugca

SEQ ID NO: 1931978 - RNA, 23 nt, Human
ccugggaggcgggcgcacugccu

SEQ ID NO: 1931979 - RNA, 16 nt, Human
ccugggaucccucauc

SEQ ID NO: 1931980 - RNA, 20 nt, Human
ccugggaucccucauccuca

SEQ ID NO: 1931981 - RNA, 21 nt, Human
ccuggcacugcuuccagugag

SEQ ID NO: 1931982 - RNA, 16 nt, Human
ccuggcagccccuguu

SEQ ID NO: 1931983 - RNA, 14 nt, Human
ccuggcagccccug

SEQ ID NO: 1931984 - RNA, 16 nt, Human
ccuggcaugggaauga

SEQ ID NO: 1931985 - RNA, 17 nt, Human
ccuggcaugggaaugaa

SEQ ID NO: 1931986 - RNA, 20 nt, Human
ccuggcacugcuuccaguga

SEQ ID NO: 1931987 - RNA, 17 nt, Human
ccuggcacugcuuccag

SEQ ID NO: 1931988 - RNA, 17 nt, Human
ccuggagcccagaggag

SEQ ID NO: 1931989 - RNA, 14 nt, Human
ccuggagcccagag

SEQ ID NO: 1931990 - RNA, 13 nt, Human
ccuggagcccaga

SEQ ID NO: 1931991 - RNA, 15 nt, Human
ccuggacuagaggga

SEQ ID NO: 1931992 - RNA, 22 nt, Human
ccuggacuagagggaccucucc

SEQ ID NO: 1931993 - RNA, 17 nt, Human
ccuggacugugugcuca

SEQ ID NO: 1931994 - RNA, 20 nt, Human
ccuggacugugugcucagga

SEQ ID NO: 1931995 - RNA, 13 nt, Human
ccuggacccugug

SEQ ID NO: 1931996 - RNA, 14 nt, Human
ccuggacccugugg

SEQ ID NO: 1931997 - RNA, 19 nt, Human
ccugcugguucaggguugg

SEQ ID NO: 1931998 - RNA, 21 nt, Human
ccugcuguaaauuuggcuucu

SEQ ID NO: 1931999 - RNA, 15 nt, Human
ccugcuuccauggcc

SEQ ID NO: 1932000 - RNA, 13 nt, Human
ccugcugguucag

SEQ ID NO: 1932001 - RNA, 20 nt, Human
ccugcuuuuuauggccugug

SEQ ID NO: 1932002 - RNA, 17 nt, Human
ccugcuaauuccccaga

SEQ ID NO: 1932003 - RNA, 16 nt, Human
ccugcuccagaccuga

SEQ ID NO: 1932004 - RNA, 22 nt, Human
ccugcuccagaccugauccugg

SEQ ID NO: 1932005 - RNA, 12 nt, Human
ccugcuccagcu

SEQ ID NO: 1932006 - RNA, 13 nt, Human
ccugcuccagcug

SEQ ID NO: 1932007 - RNA, 14 nt, Human
ccugcuccagcugu

SEQ ID NO: 1932008 - RNA, 22 nt, Human
ccugcuccagcuguucagcugg

SEQ ID NO: 1932009 - RNA, 18 nt, Human
ccugcaacaccuuguuuc

SEQ ID NO: 1932010 - RNA, 18 nt, Human
ccugauuuaggagaagcc

SEQ ID NO: 1932011 - RNA, 19 nt, Human
ccugauuuaggagaagcca

SEQ ID NO: 1932012 - RNA, 20 nt, Human
ccugauuuaggagaagccag

SEQ ID NO: 1932013 - RNA, 21 nt, Human
ccugauuuaggagaagccagg

SEQ ID NO: 1932014 - RNA, 22 nt, Human
ccugauuuaggagaagccagga

SEQ ID NO: 1932015 - RNA, 18 nt, Human
ccugauuuagauaugcaa

SEQ ID NO: 1932016 - RNA, 19 nt, Human
ccugcaacaccuuguuucc

SEQ ID NO: 1932017 - RNA, 16 nt, Human
ccugcaaccugauugu

SEQ ID NO: 1932018 - RNA, 23 nt, Human
ccugcgucucauacucaccucac

SEQ ID NO: 1932019 - RNA, 15 nt, Human
ccuccuggcccaggu

SEQ ID NO: 1932020 - RNA, 13 nt, Human
ccuccugggcuaa

SEQ ID NO: 1932021 - RNA, 17 nt, Human
ccuccugggaaugaagc

SEQ ID NO: 1932022 - RNA, 22 nt, Human
ccuccugugugugcgccuacag

SEQ ID NO: 1932023 - RNA, 15 nt, Human
ccuccugugugugcg

SEQ ID NO: 1932024 - RNA, 13 nt, Human
ccuccugugugug

SEQ ID NO: 1932025 - RNA, 13 nt, Human
ccuccugccucga

SEQ ID NO: 1932026 - RNA, 16 nt, Human
ccuccccucucugcac

SEQ ID NO: 1932027 - RNA, 17 nt, Human
ccuccccucuccuuccu

SEQ ID NO: 1932028 - RNA, 13 nt, Human
ccucccucccucu

SEQ ID NO: 1932029 - RNA, 15 nt, Human
ccucccucccucuuu

SEQ ID NO: 1932030 - RNA, 16 nt, Human
ccucccucccucuuuc

SEQ ID NO: 1932031 - RNA, 19 nt, Human
ccucccugaagccuuugca

SEQ ID NO: 1932032 - RNA, 14 nt, Human
ccucccugcaucug

SEQ ID NO: 1932033 - RNA, 20 nt, Human
ccucccugcaucugaccagc

SEQ ID NO: 1932034 - RNA, 21 nt, Human
ccucccugcaucugaccagca

SEQ ID NO: 1932035 - RNA, 22 nt, Human
ccucccugcaucugaccagcag

SEQ ID NO: 1932036 - RNA, 13 nt, Human
ccuccucccugca

SEQ ID NO: 1932037 - RNA, 14 nt, Human
ccuccucccugcau

SEQ ID NO: 1932038 - RNA, 17 nt, Human
ccuccucccugcaucug

SEQ ID NO: 1932039 - RNA, 16 nt, Human
ccuccucccugcaucu

SEQ ID NO: 1932040 - RNA, 11 nt, Human
ccucagggcac

SEQ ID NO: 1932041 - RNA, 23 nt, Human
ccucaggccugggggcugggcag

SEQ ID NO: 1932042 - RNA, 19 nt, Human
ccucaggccucugugccgc

SEQ ID NO: 1932043 - RNA, 14 nt, Human
ccucagggucccug

SEQ ID NO: 1932044 - RNA, 11 nt, Human
ccucaggccug

SEQ ID NO: 1932045 - RNA, 11 nt, Human
ccucagccaga

SEQ ID NO: 1932046 - RNA, 15 nt, Human
ccucagccagagaag

SEQ ID NO: 1932047 - RNA, 17 nt, Human
ccucagccagagaagcu

SEQ ID NO: 1932048 - RNA, 16 nt, Human
ccucagccagagaagc

SEQ ID NO: 1932049 - RNA, 14 nt, Human
ccucaggccucugu

SEQ ID NO: 1932050 - RNA, 14 nt, Human
ccucaggccugggg

SEQ ID NO: 1932051 - RNA, 21 nt, Human
ccucaggccugggggcugggc

SEQ ID NO: 1932052 - RNA, 14 nt, Human
ccucagcauccugg

SEQ ID NO: 1932053 - RNA, 17 nt, Human
ccucagcauccuggcac

SEQ ID NO: 1932054 - RNA, 16 nt, Human
ccucagcauccuggca

SEQ ID NO: 1932055 - RNA, 19 nt, Human
ccucaggugauccacccac

SEQ ID NO: 1932056 - RNA, 17 nt, Human
ccucaggugauccaccc

SEQ ID NO: 1932057 - RNA, 22 nt, Human
ccucaggugauccacccaccuc

SEQ ID NO: 1932058 - RNA, 11 nt, Human
ccucagguggc

SEQ ID NO: 1932059 - RNA, 16 nt, Human
ccucaggugagaagca

SEQ ID NO: 1932060 - RNA, 15 nt, Human
ccucagggucccugg

SEQ ID NO: 1932061 - RNA, 15 nt, Human
ccucagucuggcccu

SEQ ID NO: 1932062 - RNA, 12 nt, Human
ccucagguggcc

SEQ ID NO: 1932063 - RNA, 15 nt, Human
ccucagguggccaug

SEQ ID NO: 1932064 - RNA, 16 nt, Human
ccucagguggccaugc

SEQ ID NO: 1932065 - RNA, 18 nt, Human
ccucagguggccaugccu

SEQ ID NO: 1932066 - RNA, 21 nt, Human
ccucagguggccaugccucag

SEQ ID NO: 1932067 - RNA, 19 nt, Human
ccucucccauugucccucu

SEQ ID NO: 1932068 - RNA, 19 nt, Human
ccucuccccauucggugug

SEQ ID NO: 1932069 - RNA, 16 nt, Human
ccucugacacacagcu

SEQ ID NO: 1932070 - RNA, 23 nt, Human
ccucugaaaaccaauguucucuc

SEQ ID NO: 1932071 - RNA, 20 nt, Human
ccucucuuauagaauauuua

SEQ ID NO: 1932072 - RNA, 12 nt, Human
ccucucccaggg

SEQ ID NO: 1932073 - RNA, 12 nt, Human
ccucucccauca

SEQ ID NO: 1932074 - RNA, 18 nt, Human
ccucuccccagcccagag

SEQ ID NO: 1932075 - RNA, 19 nt, Human
ccucuccccagcccagaga

SEQ ID NO: 1932076 - RNA, 20 nt, Human
ccucuccccagcccagagac

SEQ ID NO: 1932077 - RNA, 21 nt, Human
ccucuccccagcccagagaca

SEQ ID NO: 1932078 - RNA, 23 nt, Human
ccuccugugugugcgccuacagg

SEQ ID NO: 1932079 - RNA, 12 nt, Human
ccuccuucagac

SEQ ID NO: 1932080 - RNA, 13 nt, Human
ccuccuucagaca

SEQ ID NO: 1932081 - RNA, 12 nt, Human
ccucugggacug

SEQ ID NO: 1932082 - RNA, 14 nt, Human
ccucugcuuugaaa

SEQ ID NO: 1932083 - RNA, 16 nt, Human
ccucuggaaagcaaag

SEQ ID NO: 1932084 - RNA, 13 nt, Human
ccucuggaguggc

SEQ ID NO: 1932085 - RNA, 14 nt, Human
ccucuggaguggcc

SEQ ID NO: 1932086 - RNA, 15 nt, Human
ccucuggaguggcca

SEQ ID NO: 1932087 - RNA, 16 nt, Human
ccucuggaguggccac

SEQ ID NO: 1932088 - RNA, 21 nt, Human
ccucuggaguggccacuaagc

SEQ ID NO: 1932089 - RNA, 18 nt, Human
ccucugacacacagcucu

SEQ ID NO: 1932090 - RNA, 17 nt, Human
ccucugacacacagcuc

SEQ ID NO: 1932091 - RNA, 11 nt, Human
ccucugcacaa

SEQ ID NO: 1932092 - RNA, 15 nt, Human
ccucugcacaagcug

SEQ ID NO: 1932093 - RNA, 20 nt, Human
ccucugcacaagcugcaccc

SEQ ID NO: 1932094 - RNA, 17 nt, Human
ccucugcacaagcugca

SEQ ID NO: 1932095 - RNA, 19 nt, Human
ccucugcacaagcugcacc

SEQ ID NO: 1932096 - RNA, 22 nt, Human
ccucugcacuccccugcugggu

SEQ ID NO: 1932097 - RNA, 14 nt, Human
ccucugcacucccc

SEQ ID NO: 1932098 - RNA, 19 nt, Human
ccucugcacuccccugcug

SEQ ID NO: 1932099 - RNA, 15 nt, Human
ccucugcacuccccu

SEQ ID NO: 1932100 - RNA, 20 nt, Human
ccucugcacuccccugcugg

SEQ ID NO: 1932101 - RNA, 21 nt, Human
ccucugcacuccccugcuggg

SEQ ID NO: 1932102 - RNA, 15 nt, Human
ccucucaguacuuug

SEQ ID NO: 1932103 - RNA, 19 nt, Human
ccucugugugcuccuccuu

SEQ ID NO: 1932104 - RNA, 14 nt, Human
ccucugugccuucu

SEQ ID NO: 1932105 - RNA, 21 nt, Human
ccucugugccuucuuuugauu

SEQ ID NO: 1932106 - RNA, 14 nt, Human
ccucuuagaaaaac

SEQ ID NO: 1932107 - RNA, 15 nt, Human
ccucuuaugggcugg

SEQ ID NO: 1932108 - RNA, 16 nt, Human
ccucuuaugggcuggg

SEQ ID NO: 1932109 - RNA, 14 nt, Human
ccucuuaugggcug

SEQ ID NO: 1932110 - RNA, 15 nt, Human
ccucugucagucaca

SEQ ID NO: 1932111 - RNA, 16 nt, Human
ccucugucagucacag

SEQ ID NO: 1932112 - RNA, 18 nt, Human
ccucugucagucacagcc

SEQ ID NO: 1932113 - RNA, 19 nt, Human
ccucugucagucacagcca

SEQ ID NO: 1932114 - RNA, 21 nt, Human
ccucugucagucacagccacc

SEQ ID NO: 1932115 - RNA, 19 nt, Human
ccucuguccccuucucuca

SEQ ID NO: 1932116 - RNA, 18 nt, Human
ccucuguccccuucucuc

SEQ ID NO: 1932117 - RNA, 17 nt, Human
ccucuguccccuucucu

SEQ ID NO: 1932118 - RNA, 14 nt, Human
ccucuguccccuuc

SEQ ID NO: 1932119 - RNA, 22 nt, Human
ccucuguccccuucucucaucu

SEQ ID NO: 1932120 - RNA, 21 nt, Human
ccucuguccccuucucucauc

SEQ ID NO: 1932121 - RNA, 14 nt, Human
ccucuguacagagc

SEQ ID NO: 1932122 - RNA, 15 nt, Human
ccucuguacagagcc

SEQ ID NO: 1932123 - RNA, 16 nt, Human
ccucuguacagagccc

SEQ ID NO: 1932124 - RNA, 17 nt, Human
ccucuguacagagccca

SEQ ID NO: 1932125 - RNA, 18 nt, Human
ccucuguacagagcccac

SEQ ID NO: 1932126 - RNA, 23 nt, Human
ccucuguacagagcccacgcccc

SEQ ID NO: 1932127 - RNA, 24 nt, Human
ccucugguuugccgguggugcagg

SEQ ID NO: 1932128 - RNA, 17 nt, Human
ccugaagucacacagug

SEQ ID NO: 1932129 - RNA, 16 nt, Human
ccugaagucacacagu

SEQ ID NO: 1932130 - RNA, 15 nt, Human
ccugaagucacacag

SEQ ID NO: 1932131 - RNA, 13 nt, Human
ccugaaggccccg

SEQ ID NO: 1932132 - RNA, 21 nt, Human
ccugaagacucauucuucugu

SEQ ID NO: 1932133 - RNA, 20 nt, Human
ccugaagcuaucguaaaauu

SEQ ID NO: 1932134 - RNA, 17 nt, Human
ccugaagaaccaguccc

SEQ ID NO: 1932135 - RNA, 22 nt, Human
ccugaagcuaucguaaaauuaa

SEQ ID NO: 1932136 - RNA, 23 nt, Human
ccugaagcuaucguaaaauuaag

SEQ ID NO: 1932137 - RNA, 20 nt, Human
ccugaacaggauauucucac

SEQ ID NO: 1932138 - RNA, 17 nt, Human
ccugaacugaacaccau

SEQ ID NO: 1932139 - RNA, 13 nt, Human
ccugaagaaccag

SEQ ID NO: 1932140 - RNA, 16 nt, Human
ccugaagaaccagucc

SEQ ID NO: 1932141 - RNA, 13 nt, Human
ccugaaccuagga

SEQ ID NO: 1932142 - RNA, 18 nt, Human
ccugaaagaggaaugaag

SEQ ID NO: 1932143 - RNA, 14 nt, Human
ccucuuuucucugc

SEQ ID NO: 1932144 - RNA, 23 nt, Human
ccugaaagaggaaugaaguacuc

SEQ ID NO: 1932145 - RNA, 22 nt, Human
ccucuuuggucuacacugugcu

SEQ ID NO: 1932146 - RNA, 17 nt, Human
ccucuuaugggcugggu

SEQ ID NO: 1932147 - RNA, 22 nt, Human
ccucucccauugucccucugcc

SEQ ID NO: 1932148 - RNA, 23 nt, Human
ccugauugugucucuugguccug

SEQ ID NO: 1932149 - RNA, 17 nt, Human
ccugaugcuucuucaga

SEQ ID NO: 1932150 - RNA, 18 nt, Human
ccugaugcuucuucagag

SEQ ID NO: 1932151 - RNA, 23 nt, Human
ccugaugcugacauucaccugcc

SEQ ID NO: 1932152 - RNA, 13 nt, Human
ccugaugcugaca

SEQ ID NO: 1932153 - RNA, 21 nt, Human
ccugaugcugacauucaccug

SEQ ID NO: 1932154 - RNA, 14 nt, Human
ccugaugcuucuuc

SEQ ID NO: 1932155 - RNA, 20 nt, Human
ccugaggcuccacuuggucu

SEQ ID NO: 1932156 - RNA, 18 nt, Human
ccugaggcuccacuuggu

SEQ ID NO: 1932157 - RNA, 12 nt, Human
ccugaggcccag

SEQ ID NO: 1932158 - RNA, 18 nt, Human
ccugaggcagguccccag

SEQ ID NO: 1932159 - RNA, 13 nt, Human
ccugaggcccaga

SEQ ID NO: 1932160 - RNA, 14 nt, Human
ccugaggcccagag

SEQ ID NO: 1932161 - RNA, 12 nt, Human
ccugacaacacu

SEQ ID NO: 1932162 - RNA, 14 nt, Human
ccugacaacacuca

SEQ ID NO: 1932163 - RNA, 15 nt, Human
ccugacaacacucau

SEQ ID NO: 1932164 - RNA, 16 nt, Human
ccugacaacacucauu

SEQ ID NO: 1932165 - RNA, 23 nt, Human
ccugaggcccuucucuccagccc

SEQ ID NO: 1932166 - RNA, 19 nt, Human
ccugaggcagguccccaga

SEQ ID NO: 1932167 - RNA, 21 nt, Human
ccugaggcccuucucuccagc

SEQ ID NO: 1932168 - RNA, 22 nt, Human
ccugaggcccuucucuccagcc

SEQ ID NO: 1932169 - RNA, 16 nt, Human
ccugaggcccuucucu

SEQ ID NO: 1932170 - RNA, 17 nt, Human
ccugaggcccuucucuc

SEQ ID NO: 1932171 - RNA, 19 nt, Human
ccugaggcccuucucucca

SEQ ID NO: 1932172 - RNA, 20 nt, Human
ccugaggcccuucucuccag

SEQ ID NO: 1932173 - RNA, 12 nt, Human
ccccacuggacu

SEQ ID NO: 1932174 - RNA, 19 nt, Human
ccccacuggacugaccugg

SEQ ID NO: 1932175 - RNA, 20 nt, Human
ccccacuggacugaccuggu

SEQ ID NO: 1932176 - RNA, 15 nt, Human
ccccacugaccagaa

SEQ ID NO: 1932177 - RNA, 19 nt, Human
ccccaccccugggggcucu

SEQ ID NO: 1932178 - RNA, 12 nt, Human
ccccaccccugg

SEQ ID NO: 1932179 - RNA, 20 nt, Human
ccccaccccugggggcucuc

SEQ ID NO: 1932180 - RNA, 14 nt, Human
ccccacugaccaga

SEQ ID NO: 1932181 - RNA, 12 nt, Human
ccccacugguga

SEQ ID NO: 1932182 - RNA, 13 nt, Human
ccccacuggugac

SEQ ID NO: 1932183 - RNA, 14 nt, Human
ccccacuggugaca

SEQ ID NO: 1932184 - RNA, 13 nt, Human
ccccagccucccu

SEQ ID NO: 1932185 - RNA, 15 nt, Human
ccccagccucccuga

SEQ ID NO: 1932186 - RNA, 17 nt, Human
ccccagcuaagaaccug

SEQ ID NO: 1932187 - RNA, 19 nt, Human
ccccagcuaagaaccugga

SEQ ID NO: 1932188 - RNA, 21 nt, Human
ccccagcuaagaaccuggaac

SEQ ID NO: 1932189 - RNA, 13 nt, Human
ccccaggaggcca

SEQ ID NO: 1932190 - RNA, 13 nt, Human
ccccaggaccagc

SEQ ID NO: 1932191 - RNA, 15 nt, Human
ccccaggaccagcuc

SEQ ID NO: 1932192 - RNA, 11 nt, Human
ccccaggacca

SEQ ID NO: 1932193 - RNA, 13 nt, Human
ccccagcuccggc

SEQ ID NO: 1932194 - RNA, 11 nt, Human
ccccagcuccg

SEQ ID NO: 1932195 - RNA, 14 nt, Human
ccccaggaggccag

SEQ ID NO: 1932196 - RNA, 15 nt, Human
ccccaggaggccagc

SEQ ID NO: 1932197 - RNA, 21 nt, Human
ccccaggaggccagccuugac

SEQ ID NO: 1932198 - RNA, 22 nt, Human
ccccaggaggccagccuugacc

SEQ ID NO: 1932199 - RNA, 16 nt, Human
ccccaggaccagcuca

SEQ ID NO: 1932200 - RNA, 12 nt, Human
cccccagcccca

SEQ ID NO: 1932201 - RNA, 15 nt, Human
cccccaggacugggc

SEQ ID NO: 1932202 - RNA, 13 nt, Human
cccccaggacugg

SEQ ID NO: 1932203 - RNA, 12 nt, Human
cccccaggacug

SEQ ID NO: 1932204 - RNA, 11 nt, Human
cccccaggacu

SEQ ID NO: 1932205 - RNA, 13 nt, Human
cccccagcacuga

SEQ ID NO: 1932206 - RNA, 18 nt, Human
cccccagcacugaggaag

SEQ ID NO: 1932207 - RNA, 17 nt, Human
cccccagcacugaggaa

SEQ ID NO: 1932208 - RNA, 15 nt, Human
cccccagcacugagg

SEQ ID NO: 1932209 - RNA, 18 nt, Human
cccccaugcacugugaag

SEQ ID NO: 1932210 - RNA, 17 nt, Human
cccccaggacugggcca

SEQ ID NO: 1932211 - RNA, 14 nt, Human
ccccccagcacuga

SEQ ID NO: 1932212 - RNA, 13 nt, Human
ccccccagcacug

SEQ ID NO: 1932213 - RNA, 14 nt, Human
ccccccaugcacug

SEQ ID NO: 1932214 - RNA, 12 nt, Human
cccccccuucca

SEQ ID NO: 1932215 - RNA, 13 nt, Human
cccccccuuccac

SEQ ID NO: 1932216 - RNA, 12 nt, Human
ccccccagcacu

SEQ ID NO: 1932217 - RNA, 14 nt, Human
cccccaugcacugu

SEQ ID NO: 1932218 - RNA, 12 nt, Human
ccccccaccccu

SEQ ID NO: 1932219 - RNA, 13 nt, Human
ccccccaccccug

SEQ ID NO: 1932220 - RNA, 14 nt, Human
ccccgucucuacua

SEQ ID NO: 1932221 - RNA, 15 nt, Human
cccccuggccucugu

SEQ ID NO: 1932222 - RNA, 19 nt, Human
cccccuggccucugugccu

SEQ ID NO: 1932223 - RNA, 22 nt, Human
cccccuggccucugugccuucu

SEQ ID NO: 1932224 - RNA, 13 nt, Human
cccccugcccucc

SEQ ID NO: 1932225 - RNA, 21 nt, Human
cccccgcugucagccauuccu

SEQ ID NO: 1932226 - RNA, 11 nt, Human
ccccccuucca

SEQ ID NO: 1932227 - RNA, 12 nt, Human
ccccccuuccac

SEQ ID NO: 1932228 - RNA, 13 nt, Human
ccccccuuccacu

SEQ ID NO: 1932229 - RNA, 15 nt, Human
cccccgcauccccug

SEQ ID NO: 1932230 - RNA, 18 nt, Human
cccccgcauccccugccu

SEQ ID NO: 1932231 - RNA, 12 nt, Human
cccccgcccccu

SEQ ID NO: 1932232 - RNA, 13 nt, Human
cccccgcccccug

SEQ ID NO: 1932233 - RNA, 14 nt, Human
cccccgcccccugc

SEQ ID NO: 1932234 - RNA, 16 nt, Human
cccccgcccccugccc

SEQ ID NO: 1932235 - RNA, 16 nt, Human
cccuguuuguuucuga

SEQ ID NO: 1932236 - RNA, 15 nt, Human
cccuguuuguuucug

SEQ ID NO: 1932237 - RNA, 18 nt, Human
cccugugggcccccaaau

SEQ ID NO: 1932238 - RNA, 21 nt, Human
cccuguagagugggagcugag

SEQ ID NO: 1932239 - RNA, 16 nt, Human
cccugugggcccccaa

SEQ ID NO: 1932240 - RNA, 19 nt, Human
cccugguggcagugggagc

SEQ ID NO: 1932241 - RNA, 16 nt, Human
cccugguggcaguggg

SEQ ID NO: 1932242 - RNA, 21 nt, Human
cccugguggcagugggagcug

SEQ ID NO: 1932243 - RNA, 17 nt, Human
ccccucagggucccugg

SEQ ID NO: 1932244 - RNA, 14 nt, Human
ccccuagccauuuu

SEQ ID NO: 1932245 - RNA, 19 nt, Human
ccccuagccauuuuuacug

SEQ ID NO: 1932246 - RNA, 18 nt, Human
ccccucagggucccuggu

SEQ ID NO: 1932247 - RNA, 20 nt, Human
ccccucagggucccuggugg

SEQ ID NO: 1932248 - RNA, 16 nt, Human
ccgcccgggcccagag

SEQ ID NO: 1932249 - RNA, 15 nt, Human
ccgcccgggcccaga

SEQ ID NO: 1932250 - RNA, 14 nt, Human
ccgcccgggcccag

SEQ ID NO: 1932251 - RNA, 18 nt, Human
ccgagaucacgccacugc

SEQ ID NO: 1932252 - RNA, 16 nt, Human
ccgagccuggcuccaa

SEQ ID NO: 1932253 - RNA, 19 nt, Human
ccgagccuggcuccaaacc

SEQ ID NO: 1932254 - RNA, 17 nt, Human
ccgaggccuucucugaa

SEQ ID NO: 1932255 - RNA, 19 nt, Human
cccuuuuuuggcugcugaa

SEQ ID NO: 1932256 - RNA, 17 nt, Human
ccgagaaggaagccucc

SEQ ID NO: 1932257 - RNA, 18 nt, Human
ccgagauagccaaggcca

SEQ ID NO: 1932258 - RNA, 19 nt, Human
ccgagauagccaaggccaa

SEQ ID NO: 1932259 - RNA, 22 nt, Human
ccgagauagccaaggccaaagg

SEQ ID NO: 1932260 - RNA, 17 nt, Human
cccuuuuuuggcugcug

SEQ ID NO: 1932261 - RNA, 18 nt, Human
cccuuuuuuggcugcuga

SEQ ID NO: 1932262 - RNA, 11 nt, Human
cccuuuuccuu

SEQ ID NO: 1932263 - RNA, 13 nt, Human
cccuuuucuguuu

SEQ ID NO: 1932264 - RNA, 17 nt, Human
cccuuuugcauucuccc

SEQ ID NO: 1932265 - RNA, 14 nt, Human
cccuuucuggcucu

SEQ ID NO: 1932266 - RNA, 22 nt, Human
cccuuucuccccugcccccagg

SEQ ID NO: 1932267 - RNA, 14 nt, Human
cccuuucuccccug

SEQ ID NO: 1932268 - RNA, 20 nt, Human
cccuuugacgccaucccagc

SEQ ID NO: 1932269 - RNA, 20 nt, Human
cccuuguggucccaccccac

SEQ ID NO: 1932270 - RNA, 18 nt, Human
cccuuguggucccacccc

SEQ ID NO: 1932271 - RNA, 18 nt, Human
cccuuggggagcaggcuc

SEQ ID NO: 1932272 - RNA, 14 nt, Human
cccuugugguccca

SEQ ID NO: 1932273 - RNA, 16 nt, Human
cccuuguggucccacc

SEQ ID NO: 1932274 - RNA, 14 nt, Human
cccuuggcugggac

SEQ ID NO: 1932275 - RNA, 22 nt, Human
cccuugccgucuaccugagggg

SEQ ID NO: 1932276 - RNA, 17 nt, Human
cccuugccgucuaccug

SEQ ID NO: 1932277 - RNA, 18 nt, Human
cccuugccgucuaccuga

SEQ ID NO: 1932278 - RNA, 19 nt, Human
cccuuaccucggugccuuc

SEQ ID NO: 1932279 - RNA, 14 nt, Human
ccuaaagcagccag

SEQ ID NO: 1932280 - RNA, 15 nt, Human
ccuaaagcagccagc

SEQ ID NO: 1932281 - RNA, 14 nt, Human
ccuaaaguguauuu

SEQ ID NO: 1932282 - RNA, 23 nt, Human
ccguuuccuuucauuuacugugg

SEQ ID NO: 1932283 - RNA, 22 nt, Human
ccguuugagaagaaaacaucua

SEQ ID NO: 1932284 - RNA, 21 nt, Human
ccuaaaccaaaaacugaaagu

SEQ ID NO: 1932285 - RNA, 10 nt, Human
ccgggcccag

SEQ ID NO: 1932286 - RNA, 16 nt, Human
ccgggcccagaggagc

SEQ ID NO: 1932287 - RNA, 13 nt, Human
ccgggcccagagg

SEQ ID NO: 1932288 - RNA, 20 nt, Human
ccgggcccagaggagcuggg

SEQ ID NO: 1932289 - RNA, 20 nt, Human
ccgggcacucagaagacacu

SEQ ID NO: 1932290 - RNA, 22 nt, Human
ccggcugcauacccgggcaggg

SEQ ID NO: 1932291 - RNA, 18 nt, Human
ccggcugcauacccgggc

SEQ ID NO: 1932292 - RNA, 12 nt, Human
ccggcuggccug

SEQ ID NO: 1932293 - RNA, 15 nt, Human
ccgggcacucagaag

SEQ ID NO: 1932294 - RNA, 13 nt, Human
ccggcuggccugg

SEQ ID NO: 1932295 - RNA, 22 nt, Human
ccgggaggcagagguugcagug

SEQ ID NO: 1932296 - RNA, 15 nt, Human
ccgcuucugccugca

SEQ ID NO: 1932297 - RNA, 23 nt, Human
ccgcuuucuacccagcgagcccu

SEQ ID NO: 1932298 - RNA, 13 nt, Human
ccuagaggcccca

SEQ ID NO: 1932299 - RNA, 13 nt, Human
ccuagagggaggg

SEQ ID NO: 1932300 - RNA, 15 nt, Human
ccuagagggaggggc

SEQ ID NO: 1932301 - RNA, 16 nt, Human
ccuagagggaggggcc

SEQ ID NO: 1932302 - RNA, 16 nt, Human
ccuaucaccuauuucc

SEQ ID NO: 1932303 - RNA, 17 nt, Human
ccuaucaccuauuucca

SEQ ID NO: 1932304 - RNA, 17 nt, Human
ccucacaguccuuacca

SEQ ID NO: 1932305 - RNA, 15 nt, Human
ccucacaggccccag

SEQ ID NO: 1932306 - RNA, 22 nt, Human
ccucacacacagacucauauua

SEQ ID NO: 1932307 - RNA, 16 nt, Human
ccuauguaguccgugc

SEQ ID NO: 1932308 - RNA, 18 nt, Human
ccuauguaguccgugcug

SEQ ID NO: 1932309 - RNA, 15 nt, Human
ccucaccccacugug

SEQ ID NO: 1932310 - RNA, 15 nt, Human
ccucaccccugguuc

SEQ ID NO: 1932311 - RNA, 20 nt, Human
ccucacaguccuuaccagca

SEQ ID NO: 1932312 - RNA, 22 nt, Human
ccucacaguccuuaccagcaga

SEQ ID NO: 1932313 - RNA, 12 nt, Human
ccucaccccacu

SEQ ID NO: 1932314 - RNA, 17 nt, Human
ccucaccuuucccaucu

SEQ ID NO: 1932315 - RNA, 15 nt, Human
ccucaccuuggcacc

SEQ ID NO: 1932316 - RNA, 16 nt, Human
ccucaccuuggcacca

SEQ ID NO: 1932317 - RNA, 21 nt, Human
ccucaccuuggcaccagacac

SEQ ID NO: 1932318 - RNA, 23 nt, Human
ccucaccccugguucucaucuuu

SEQ ID NO: 1932319 - RNA, 22 nt, Human
ccucaccccugguucucaucuu

SEQ ID NO: 1932320 - RNA, 21 nt, Human
ccucaccccugguucucaucu

SEQ ID NO: 1932321 - RNA, 20 nt, Human
ccucaccccugguucucauc

SEQ ID NO: 1932322 - RNA, 17 nt, Human
ccuagagggaggggccu

SEQ ID NO: 1932323 - RNA, 18 nt, Human
cugcagggccgccaggga

SEQ ID NO: 1932324 - RNA, 19 nt, Human
cugcagggccgccagggag

SEQ ID NO: 1932325 - RNA, 16 nt, Human
cugcaggggcauggga

SEQ ID NO: 1932326 - RNA, 20 nt, Human
cugccacccuggggagaaag

SEQ ID NO: 1932327 - RNA, 16 nt, Human
cugccacccuggggag

SEQ ID NO: 1932328 - RNA, 15 nt, Human
cugccacccugggga

SEQ ID NO: 1932329 - RNA, 14 nt, Human
cugccacccaccuc

SEQ ID NO: 1932330 - RNA, 15 nt, Human
cugccacccaccucc

SEQ ID NO: 1932331 - RNA, 17 nt, Human
cugccacccaccucccu

SEQ ID NO: 1932332 - RNA, 19 nt, Human
cugccacccaccucccugc

SEQ ID NO: 1932333 - RNA, 18 nt, Human
cugccacccaccucccug

SEQ ID NO: 1932334 - RNA, 17 nt, Human
cugccaugccagcuuau

SEQ ID NO: 1932335 - RNA, 19 nt, Human
cugccaugccagcuuaucu

SEQ ID NO: 1932336 - RNA, 19 nt, Human
cugccagccgagauagcca

SEQ ID NO: 1932337 - RNA, 15 nt, Human
cugccaggaagccag

SEQ ID NO: 1932338 - RNA, 16 nt, Human
cugccaggaagccagc

SEQ ID NO: 1932339 - RNA, 18 nt, Human
cugccaggaagccagcag

SEQ ID NO: 1932340 - RNA, 19 nt, Human
cugccaggaagccagcagg

SEQ ID NO: 1932341 - RNA, 16 nt, Human
cugccauuucugagau

SEQ ID NO: 1932342 - RNA, 17 nt, Human
cugcccaacccuucccu

SEQ ID NO: 1932343 - RNA, 20 nt, Human
cugcccaacccuucccucac

SEQ ID NO: 1932344 - RNA, 13 nt, Human
cugcccaggcccc

SEQ ID NO: 1932345 - RNA, 14 nt, Human
cugccccuggcagc

SEQ ID NO: 1932346 - RNA, 15 nt, Human
cugccccuggcagcc

SEQ ID NO: 1932347 - RNA, 16 nt, Human
cugccccuggcagccc

SEQ ID NO: 1932348 - RNA, 17 nt, Human
cugccccuggcagcccc

SEQ ID NO: 1932349 - RNA, 15 nt, Human
cugcccggcugcgga

SEQ ID NO: 1932350 - RNA, 19 nt, Human
cugcccuccaagaccuucu

SEQ ID NO: 1932351 - RNA, 11 nt, Human
cugcccggcug

SEQ ID NO: 1932352 - RNA, 14 nt, Human
cugcccuccccucu

SEQ ID NO: 1932353 - RNA, 22 nt, Human
cugcccuccagcucuuuccucc

SEQ ID NO: 1932354 - RNA, 10 nt, Human
cugcccuccc

SEQ ID NO: 1932355 - RNA, 20 nt, Human
cugcccuccccucucugcac

SEQ ID NO: 1932356 - RNA, 13 nt, Human
cugcccugcccac

SEQ ID NO: 1932357 - RNA, 14 nt, Human
cugcccugcccacc

SEQ ID NO: 1932358 - RNA, 15 nt, Human
cugcccugcccaccu

SEQ ID NO: 1932359 - RNA, 16 nt, Human
cugcccugcccaccug

SEQ ID NO: 1932360 - RNA, 21 nt, Human
cugcuccccucugcacggacc

SEQ ID NO: 1932361 - RNA, 15 nt, Human
cugcuccagcuguuc

SEQ ID NO: 1932362 - RNA, 21 nt, Human
cugcuccagaccugauccugg

SEQ ID NO: 1932363 - RNA, 22 nt, Human
cugcuccagaccugauccugga

SEQ ID NO: 1932364 - RNA, 17 nt, Human
cugcuccucuccccagc

SEQ ID NO: 1932365 - RNA, 16 nt, Human
cugcuccucuccccag

SEQ ID NO: 1932366 - RNA, 14 nt, Human
cugcuccuagaggg

SEQ ID NO: 1932367 - RNA, 20 nt, Human
cugcucucuuuuucuccagg

SEQ ID NO: 1932368 - RNA, 24 nt, Human
cugcucucuuuuucuccaggguca

SEQ ID NO: 1932369 - RNA, 20 nt, Human
cugcucuccuuccuggagcc

SEQ ID NO: 1932370 - RNA, 19 nt, Human
cugcucuccuuccuggagc

SEQ ID NO: 1932371 - RNA, 17 nt, Human
cugcucuccuuccugga

SEQ ID NO: 1932372 - RNA, 16 nt, Human
cugcucuccuuccugg

SEQ ID NO: 1932373 - RNA, 18 nt, Human
cugcuccucuccccagca

SEQ ID NO: 1932374 - RNA, 14 nt, Human
cugcuccagcuguu

SEQ ID NO: 1932375 - RNA, 13 nt, Human
cugcuccagaccu

SEQ ID NO: 1932376 - RNA, 14 nt, Human
cugcuccagaccug

SEQ ID NO: 1932377 - RNA, 15 nt, Human
cugcuccagaccuga

SEQ ID NO: 1932378 - RNA, 16 nt, Human
cugcgguccacccagg

SEQ ID NO: 1932379 - RNA, 17 nt, Human
cugcgguccacccagga

SEQ ID NO: 1932380 - RNA, 21 nt, Human
cugcggaaugaaccacaucuu

SEQ ID NO: 1932381 - RNA, 15 nt, Human
cugcgguccacccag

SEQ ID NO: 1932382 - RNA, 22 nt, Human
cugcgguagaugggagggaggc

SEQ ID NO: 1932383 - RNA, 20 nt, Human
cugcggaaugaaccacaucu

SEQ ID NO: 1932384 - RNA, 13 nt, Human
cugccucagccuc

SEQ ID NO: 1932385 - RNA, 14 nt, Human
cugccucagccucc

SEQ ID NO: 1932386 - RNA, 12 nt, Human
cugccucaggac

SEQ ID NO: 1932387 - RNA, 11 nt, Human
cugccucagga

SEQ ID NO: 1932388 - RNA, 13 nt, Human
cugccucaggacu

SEQ ID NO: 1932389 - RNA, 14 nt, Human
cugccucaggacug

SEQ ID NO: 1932390 - RNA, 23 nt, Human
cugccucaggaggcaggaccuuc

SEQ ID NO: 1932391 - RNA, 22 nt, Human
cugccucaggaggcaggaccuu

SEQ ID NO: 1932392 - RNA, 15 nt, Human
cugccucaggccucu

SEQ ID NO: 1932393 - RNA, 16 nt, Human
cugccucaggccucug

SEQ ID NO: 1932394 - RNA, 17 nt, Human
cugccucaggccucugu

SEQ ID NO: 1932395 - RNA, 12 nt, Human
cugccucauuua

SEQ ID NO: 1932396 - RNA, 13 nt, Human
cugccucauuuag

SEQ ID NO: 1932397 - RNA, 13 nt, Human
cugccuauuuuaa

SEQ ID NO: 1932398 - RNA, 15 nt, Human
cugccuaagugcagc

SEQ ID NO: 1932399 - RNA, 15 nt, Human
cugccugcccaggcc

SEQ ID NO: 1932400 - RNA, 14 nt, Human
cugccugcccaggc

SEQ ID NO: 1932401 - RNA, 13 nt, Human
cugccugcccagg

SEQ ID NO: 1932402 - RNA, 12 nt, Human
cugccucucugc

SEQ ID NO: 1932403 - RNA, 13 nt, Human
cugccucucugca

SEQ ID NO: 1932404 - RNA, 14 nt, Human
cugccucucugcag

SEQ ID NO: 1932405 - RNA, 13 nt, Human
cugccucuucucu

SEQ ID NO: 1932406 - RNA, 14 nt, Human
cugccucuucucua

SEQ ID NO: 1932407 - RNA, 20 nt, Human
cugcagggacacgggcagcc

SEQ ID NO: 1932408 - RNA, 15 nt, Human
cugcagggacacggg

SEQ ID NO: 1932409 - RNA, 22 nt, Human
cugcagggaguccgaaagggac

SEQ ID NO: 1932410 - RNA, 20 nt, Human
cugcagccucaaccuccugg

SEQ ID NO: 1932411 - RNA, 19 nt, Human
cugcagccucaaccuccug

SEQ ID NO: 1932412 - RNA, 22 nt, Human
cugcagccucaaccuccugggc

SEQ ID NO: 1932413 - RNA, 11 nt, Human
cugcagccuca

SEQ ID NO: 1932414 - RNA, 23 nt, Human
cugcagccaggccacuggccccu

SEQ ID NO: 1932415 - RNA, 22 nt, Human
cugcagccaggccacuggcccc

SEQ ID NO: 1932416 - RNA, 17 nt, Human
cugcagccaggccacug

SEQ ID NO: 1932417 - RNA, 16 nt, Human
cugcagccaggccacu

SEQ ID NO: 1932418 - RNA, 15 nt, Human
cugcagccaggccac

SEQ ID NO: 1932419 - RNA, 23 nt, Human
cugcagaagacaguauggcagcu

SEQ ID NO: 1932420 - RNA, 13 nt, Human
cugcagaagacag

SEQ ID NO: 1932421 - RNA, 18 nt, Human
cugcagagcagugggccu

SEQ ID NO: 1932422 - RNA, 23 nt, Human
cugcagagcagugggccuggcca

SEQ ID NO: 1932423 - RNA, 21 nt, Human
cugcagagcagugggccuggc

SEQ ID NO: 1932424 - RNA, 23 nt, Human
cugcagagcugcgggcugggugu

SEQ ID NO: 1932425 - RNA, 21 nt, Human
cugcagagcugcgggcugggu

SEQ ID NO: 1932426 - RNA, 12 nt, Human
cugcagagcugc

SEQ ID NO: 1932427 - RNA, 17 nt, Human
cugcacuugcagacucu

SEQ ID NO: 1932428 - RNA, 16 nt, Human
cugcacuugcagacuc

SEQ ID NO: 1932429 - RNA, 14 nt, Human
cugcacuugcagac

SEQ ID NO: 1932430 - RNA, 17 nt, Human
cugcaccggcuggccug

SEQ ID NO: 1932431 - RNA, 18 nt, Human
cugcaccggcuggccugg

SEQ ID NO: 1932432 - RNA, 19 nt, Human
cugcaccggcuggccuggc

SEQ ID NO: 1932433 - RNA, 20 nt, Human
cugcaccggcuggccuggcc

SEQ ID NO: 1932434 - RNA, 22 nt, Human
cugcacaagccagggugugucu

SEQ ID NO: 1932435 - RNA, 19 nt, Human
cugcacaagccagggugug

SEQ ID NO: 1932436 - RNA, 18 nt, Human
cugcacaagccagggugu

SEQ ID NO: 1932437 - RNA, 18 nt, Human
cugcacaagcugcacccu

SEQ ID NO: 1932438 - RNA, 13 nt, Human
cugcacaagcugc

SEQ ID NO: 1932439 - RNA, 14 nt, Human
cugcacaagcugca

SEQ ID NO: 1932440 - RNA, 15 nt, Human
cugcacaagcugcac

SEQ ID NO: 1932441 - RNA, 16 nt, Human
cugcacaagcugcacc

SEQ ID NO: 1932442 - RNA, 17 nt, Human
cugcacccucaggcagg

SEQ ID NO: 1932443 - RNA, 18 nt, Human
cugcacccucaggcaggu

SEQ ID NO: 1932444 - RNA, 18 nt, Human
cugcaccauuuaaaaaca

SEQ ID NO: 1932445 - RNA, 15 nt, Human
cugcacaagccaggg

SEQ ID NO: 1932446 - RNA, 15 nt, Human
cugauucccaagcuc

SEQ ID NO: 1932447 - RNA, 18 nt, Human
cugauucccaagcucugc

SEQ ID NO: 1932448 - RNA, 17 nt, Human
cugauucccaagcucug

SEQ ID NO: 1932449 - RNA, 20 nt, Human
cugauucccaagcucugcuc

SEQ ID NO: 1932450 - RNA, 19 nt, Human
cugauucccaagcucugcu

SEQ ID NO: 1932451 - RNA, 22 nt, Human
cugauucccaagcucugcuccu

SEQ ID NO: 1932452 - RNA, 21 nt, Human
cugauuaaguugucuaaacaa

SEQ ID NO: 1932453 - RNA, 22 nt, Human
cugauguuccuuuggaagaaaa

SEQ ID NO: 1932454 - RNA, 14 nt, Human
cugaucucucguga

SEQ ID NO: 1932455 - RNA, 19 nt, Human
cugauccuggaggcccagu

SEQ ID NO: 1932456 - RNA, 21 nt, Human
cugauccuggaggcccaguuc

SEQ ID NO: 1932457 - RNA, 21 nt, Human
cugauaaagaugagugagcau

SEQ ID NO: 1932458 - RNA, 12 nt, Human
cugauaccucaa

SEQ ID NO: 1932459 - RNA, 20 nt, Human
cugauccagcccugaguucc

SEQ ID NO: 1932460 - RNA, 13 nt, Human
cugauaaagauga

SEQ ID NO: 1932461 - RNA, 22 nt, Human
cugagugggggaucacagccuc

SEQ ID NO: 1932462 - RNA, 13 nt, Human
cugaguggcuuca

SEQ ID NO: 1932463 - RNA, 15 nt, Human
cugaguggcuucacu

SEQ ID NO: 1932464 - RNA, 23 nt, Human
cugaguggcuucacuccugcugu

SEQ ID NO: 1932465 - RNA, 16 nt, Human
cugaguggcuucacuc

SEQ ID NO: 1932466 - RNA, 19 nt, Human
cugaguggcuucacuccug

SEQ ID NO: 1932467 - RNA, 21 nt, Human
cugaguggcuucacuccugcu

SEQ ID NO: 1932468 - RNA, 22 nt, Human
cugaguggcuucacuccugcug

SEQ ID NO: 1932469 - RNA, 19 nt, Human
cugagugcagccguuugag

SEQ ID NO: 1932470 - RNA, 17 nt, Human
cugagucugaaggcugg

SEQ ID NO: 1932471 - RNA, 18 nt, Human
cugagugaaccuguauaa

SEQ ID NO: 1932472 - RNA, 13 nt, Human
cugagucugaagg

SEQ ID NO: 1932473 - RNA, 14 nt, Human
cugagucugaaggc

SEQ ID NO: 1932474 - RNA, 15 nt, Human
cugagucugaaggcu

SEQ ID NO: 1932475 - RNA, 16 nt, Human
cugagucugaaggcug

SEQ ID NO: 1932476 - RNA, 10 nt, Human
cugacccagu

SEQ ID NO: 1932477 - RNA, 12 nt, Human
cugacccagugc

SEQ ID NO: 1932478 - RNA, 13 nt, Human
cugacccagugcc

SEQ ID NO: 1932479 - RNA, 18 nt, Human
cugacccagugcccccac

SEQ ID NO: 1932480 - RNA, 23 nt, Human
cugacccagugcccccacugacc

SEQ ID NO: 1932481 - RNA, 20 nt, Human
cugacccagugcccccacug

SEQ ID NO: 1932482 - RNA, 21 nt, Human
cugacccagugcccccacuga

SEQ ID NO: 1932483 - RNA, 14 nt, Human
cugaggcuuuggau

SEQ ID NO: 1932484 - RNA, 15 nt, Human
cugaggcuuuggauu

SEQ ID NO: 1932485 - RNA, 17 nt, Human
cugaggcuuuggauuug

SEQ ID NO: 1932486 - RNA, 18 nt, Human
cugaggcuuuggauuuga

SEQ ID NO: 1932487 - RNA, 21 nt, Human
cugaggcuuuggauuugacau

SEQ ID NO: 1932488 - RNA, 21 nt, Human
cugggcacccucccacccggc

SEQ ID NO: 1932489 - RNA, 17 nt, Human
cugggcacccucccacc

SEQ ID NO: 1932490 - RNA, 16 nt, Human
cugggcacccucccac

SEQ ID NO: 1932491 - RNA, 12 nt, Human
cugggccccugc

SEQ ID NO: 1932492 - RNA, 16 nt, Human
cugggccccugccucu

SEQ ID NO: 1932493 - RNA, 17 nt, Human
cugggccccugccucuc

SEQ ID NO: 1932494 - RNA, 10 nt, Human
cugggccccu

SEQ ID NO: 1932495 - RNA, 20 nt, Human
cugggcaaugugauaaaacc

SEQ ID NO: 1932496 - RNA, 16 nt, Human
cugggcacacgccucc

SEQ ID NO: 1932497 - RNA, 17 nt, Human
cugggcacacgccuccc

SEQ ID NO: 1932498 - RNA, 22 nt, Human
cugggcacacgccucccacugg

SEQ ID NO: 1932499 - RNA, 23 nt, Human
cugggcacacgccucccacuggg

SEQ ID NO: 1932500 - RNA, 12 nt, Human
cugggagugagc

SEQ ID NO: 1932501 - RNA, 13 nt, Human
cugggagugagcu

SEQ ID NO: 1932502 - RNA, 16 nt, Human
cugggagugagcuggu

SEQ ID NO: 1932503 - RNA, 14 nt, Human
cugggaggccagug

SEQ ID NO: 1932504 - RNA, 17 nt, Human
cugggaggcgggcgcac

SEQ ID NO: 1932505 - RNA, 18 nt, Human
cugggaggucaaggcugc

SEQ ID NO: 1932506 - RNA, 15 nt, Human
cugggaggcucugga

SEQ ID NO: 1932507 - RNA, 16 nt, Human
cugggaggcucuggag

SEQ ID NO: 1932508 - RNA, 16 nt, Human
cugggagcuuuuguag

SEQ ID NO: 1932509 - RNA, 17 nt, Human
cuggcucuuccaggcug

SEQ ID NO: 1932510 - RNA, 13 nt, Human
cuggccugagcug

SEQ ID NO: 1932511 - RNA, 14 nt, Human
cuggccucugugcc

SEQ ID NO: 1932512 - RNA, 15 nt, Human
cuggccucugugccu

SEQ ID NO: 1932513 - RNA, 16 nt, Human
cuggccucugugccuu

SEQ ID NO: 1932514 - RNA, 20 nt, Human
cuggccucugugccuucuuu

SEQ ID NO: 1932515 - RNA, 20 nt, Human
cuggcucuuccaggcuggga

SEQ ID NO: 1932516 - RNA, 18 nt, Human
cuggcucuuccaggcugg

SEQ ID NO: 1932517 - RNA, 19 nt, Human
cuggcucuuccaggcuggg

SEQ ID NO: 1932518 - RNA, 19 nt, Human
cuggcuguuggcugggggc

SEQ ID NO: 1932519 - RNA, 22 nt, Human
cuggcuggguggcaccagcagc

SEQ ID NO: 1932520 - RNA, 21 nt, Human
cuggcuggguggcaccagcag

SEQ ID NO: 1932521 - RNA, 20 nt, Human
cuggcuguuggcugggggcc

SEQ ID NO: 1932522 - RNA, 13 nt, Human
cuggcuucucuga

SEQ ID NO: 1932523 - RNA, 14 nt, Human
cuggugcugcugcu

SEQ ID NO: 1932524 - RNA, 18 nt, Human
cuggucucaaacuccuga

SEQ ID NO: 1932525 - RNA, 23 nt, Human
cugguggcagugggagcugccug

SEQ ID NO: 1932526 - RNA, 19 nt, Human
cugguggcagugggagcug

SEQ ID NO: 1932527 - RNA, 13 nt, Human
cugguggcccagg

SEQ ID NO: 1932528 - RNA, 14 nt, Human
cugguggcccagga

SEQ ID NO: 1932529 - RNA, 11 nt, Human
cugguggccca

SEQ ID NO: 1932530 - RNA, 12 nt, Human
cugguggcccag

SEQ ID NO: 1932531 - RNA, 13 nt, Human
cuggugggccaac

SEQ ID NO: 1932532 - RNA, 20 nt, Human
cugguucucaucuuucuuga

SEQ ID NO: 1932533 - RNA, 16 nt, Human
cugguucucaucuuuc

SEQ ID NO: 1932534 - RNA, 15 nt, Human
cugguucucaucuuu

SEQ ID NO: 1932535 - RNA, 14 nt, Human
cugguucucaucuu

SEQ ID NO: 1932536 - RNA, 12 nt, Human
cugguucucauc

SEQ ID NO: 1932537 - RNA, 18 nt, Human
cuggucccacucagucca

SEQ ID NO: 1932538 - RNA, 15 nt, Human
cuggucccacucagu

SEQ ID NO: 1932539 - RNA, 18 nt, Human
cugguccauagagagcaa

SEQ ID NO: 1932540 - RNA, 21 nt, Human
cugguccauagagagcaagac

SEQ ID NO: 1932541 - RNA, 19 nt, Human
cuggguucuacccaggugc

SEQ ID NO: 1932542 - RNA, 13 nt, Human
cuggguuggaggg

SEQ ID NO: 1932543 - RNA, 15 nt, Human
cugguccauagagag

SEQ ID NO: 1932544 - RNA, 17 nt, Human
cugguccauagagagca

SEQ ID NO: 1932545 - RNA, 19 nt, Human
cugggcucccuucccaccu

SEQ ID NO: 1932546 - RNA, 21 nt, Human
cugggcuuggggaccagagcu

SEQ ID NO: 1932547 - RNA, 17 nt, Human
cugggcuuggggaccag

SEQ ID NO: 1932548 - RNA, 20 nt, Human
cugggcuuggggaccagagc

SEQ ID NO: 1932549 - RNA, 23 nt, Human
cugggcuucaguggcagcugcuu

SEQ ID NO: 1932550 - RNA, 13 nt, Human
cugggcuugggga

SEQ ID NO: 1932551 - RNA, 22 nt, Human
cugggcuucaguggcagcugcu

SEQ ID NO: 1932552 - RNA, 21 nt, Human
cugggcuucaguggcagcugc

SEQ ID NO: 1932553 - RNA, 20 nt, Human
cugggcuucaguggcagcug

SEQ ID NO: 1932554 - RNA, 19 nt, Human
cugggcuucaguggcagcu

SEQ ID NO: 1932555 - RNA, 17 nt, Human
cugggcuucaguggcag

SEQ ID NO: 1932556 - RNA, 18 nt, Human
cugggcuucaguggcagc

SEQ ID NO: 1932557 - RNA, 23 nt, Human
cugggcguaguggcucacaccug

SEQ ID NO: 1932558 - RNA, 18 nt, Human
cugggggccucagugcca

SEQ ID NO: 1932559 - RNA, 17 nt, Human
cugggggccucagugcc

SEQ ID NO: 1932560 - RNA, 13 nt, Human
cugggggccucag

SEQ ID NO: 1932561 - RNA, 17 nt, Human
cugggguggggaccuca

SEQ ID NO: 1932562 - RNA, 18 nt, Human
cugggguggggaccucag

SEQ ID NO: 1932563 - RNA, 19 nt, Human
cugggguggggaccucagg

SEQ ID NO: 1932564 - RNA, 20 nt, Human
cuggguacuuguggacacag

SEQ ID NO: 1932565 - RNA, 23 nt, Human
cugggguggggaccucaggccug

SEQ ID NO: 1932566 - RNA, 21 nt, Human
cugggguggggaccucaggcc

SEQ ID NO: 1932567 - RNA, 22 nt, Human
cugggguggggaccucaggccu

SEQ ID NO: 1932568 - RNA, 23 nt, Human
cuggguacuuguggacacagcuc

SEQ ID NO: 1932569 - RNA, 21 nt, Human
cuggguacuuguggacacagc

SEQ ID NO: 1932570 - RNA, 20 nt, Human
cugggguggggauagggagc

SEQ ID NO: 1932571 - RNA, 20 nt, Human
cuggcacugacugggcauag

SEQ ID NO: 1932572 - RNA, 18 nt, Human
cuggcacugcuuccagug

SEQ ID NO: 1932573 - RNA, 17 nt, Human
cuggcacugcuuccagu

SEQ ID NO: 1932574 - RNA, 15 nt, Human
cuggcacugcuucca

SEQ ID NO: 1932575 - RNA, 16 nt, Human
cuggcacugcuuccag

SEQ ID NO: 1932576 - RNA, 16 nt, Human
cuggccagaugcacca

SEQ ID NO: 1932577 - RNA, 16 nt, Human
cuggccaacgggguga

SEQ ID NO: 1932578 - RNA, 20 nt, Human
cuggccagaugcaccagccc

SEQ ID NO: 1932579 - RNA, 19 nt, Human
cuggccagaugcaccagcc

SEQ ID NO: 1932580 - RNA, 18 nt, Human
cuggccagaugcaccagc

SEQ ID NO: 1932581 - RNA, 17 nt, Human
cuggccagaugcaccag

SEQ ID NO: 1932582 - RNA, 21 nt, Human
cuggccagaugcaccagcccu

SEQ ID NO: 1932583 - RNA, 22 nt, Human
cuggccagaugcaccagcccuu

SEQ ID NO: 1932584 - RNA, 17 nt, Human
cuggccaacaugguaaa

SEQ ID NO: 1932585 - RNA, 22 nt, Human
cuggccucaagugauucuccug

SEQ ID NO: 1932586 - RNA, 17 nt, Human
cuggccucccacagacu

SEQ ID NO: 1932587 - RNA, 19 nt, Human
cuggccucccacagacuca

SEQ ID NO: 1932588 - RNA, 23 nt, Human
cuggccuagcauacguacacauu

SEQ ID NO: 1932589 - RNA, 11 nt, Human
cuggccucugu

SEQ ID NO: 1932590 - RNA, 13 nt, Human
cuggccucugugc

SEQ ID NO: 1932591 - RNA, 12 nt, Human
cuggcccacugc

SEQ ID NO: 1932592 - RNA, 13 nt, Human
cuggcccacugca

SEQ ID NO: 1932593 - RNA, 17 nt, Human
cuggccuagcauacgua

SEQ ID NO: 1932594 - RNA, 13 nt, Human
cuggcccagggcc

SEQ ID NO: 1932595 - RNA, 14 nt, Human
cuggcccagggccc

SEQ ID NO: 1932596 - RNA, 15 nt, Human
cuggcccagggccca

SEQ ID NO: 1932597 - RNA, 12 nt, Human
cuggcccagggc

SEQ ID NO: 1932598 - RNA, 11 nt, Human
cuggcccaggg

SEQ ID NO: 1932599 - RNA, 12 nt, Human
cuggcacacauc

SEQ ID NO: 1932600 - RNA, 19 nt, Human
cuggcaauguuuauuucau

SEQ ID NO: 1932601 - RNA, 21 nt, Human
cuggcacacaucaggaguuca

SEQ ID NO: 1932602 - RNA, 19 nt, Human
cuggcaaagcuuuuagaaa

SEQ ID NO: 1932603 - RNA, 20 nt, Human
cuggcaaagcuuuuagaaau

SEQ ID NO: 1932604 - RNA, 19 nt, Human
cuggcaaaaggaucuuugu

SEQ ID NO: 1932605 - RNA, 20 nt, Human
cuggcaaaaggaucuuugug

SEQ ID NO: 1932606 - RNA, 23 nt, Human
cuggcaaaaggaucuuuguggcc

SEQ ID NO: 1932607 - RNA, 21 nt, Human
cuggcaaaaggaucuuugugg

SEQ ID NO: 1932608 - RNA, 13 nt, Human
cuggcacugcuuc

SEQ ID NO: 1932609 - RNA, 14 nt, Human
cuggcacugcuucc

SEQ ID NO: 1932610 - RNA, 23 nt, Human
cuggcacuauaauguaagcucua

SEQ ID NO: 1932611 - RNA, 15 nt, Human
cuggauggggcugca

SEQ ID NO: 1932612 - RNA, 16 nt, Human
cuggauggggcugcac

SEQ ID NO: 1932613 - RNA, 23 nt, Human
cuggauuaaacuuaaucuaaaug

SEQ ID NO: 1932614 - RNA, 13 nt, Human
cuggauuaaacuu

SEQ ID NO: 1932615 - RNA, 17 nt, Human
cuggauuauauuaugaa

SEQ ID NO: 1932616 - RNA, 21 nt, Human
cuggaauguaaucaauguuuc

SEQ ID NO: 1932617 - RNA, 13 nt, Human
cuggacagcccca

SEQ ID NO: 1932618 - RNA, 14 nt, Human
cuggacagccccac

SEQ ID NO: 1932619 - RNA, 15 nt, Human
cuggacagccccacc

SEQ ID NO: 1932620 - RNA, 16 nt, Human
cuggacagccccaccc

SEQ ID NO: 1932621 - RNA, 18 nt, Human
cuggacagccccacccug

SEQ ID NO: 1932622 - RNA, 19 nt, Human
cuggacagccccacccugg

SEQ ID NO: 1932623 - RNA, 20 nt, Human
cuggaauguaaucaauguuu

SEQ ID NO: 1932624 - RNA, 15 nt, Human
cuggaauguaaucaa

SEQ ID NO: 1932625 - RNA, 14 nt, Human
cuggaauguaauca

SEQ ID NO: 1932626 - RNA, 15 nt, Human
cuggaaugcaguggu

SEQ ID NO: 1932627 - RNA, 14 nt, Human
cuggaaugcagugg

SEQ ID NO: 1932628 - RNA, 23 nt, Human
cuggaauaauccuaaacauauga

SEQ ID NO: 1932629 - RNA, 21 nt, Human
cuggaagugcuaauuuugaaa

SEQ ID NO: 1932630 - RNA, 18 nt, Human
cuggaagcacagcuucau

SEQ ID NO: 1932631 - RNA, 15 nt, Human
cuggaagcacagcuu

SEQ ID NO: 1932632 - RNA, 17 nt, Human
cugcuuuccaaagccaa

SEQ ID NO: 1932633 - RNA, 15 nt, Human
cugcuuuccaaagcc

SEQ ID NO: 1932634 - RNA, 21 nt, Human
cuggagcccacuguacuugcu

SEQ ID NO: 1932635 - RNA, 17 nt, Human
cuggagcccagaggagg

SEQ ID NO: 1932636 - RNA, 16 nt, Human
cuggagcccagaggag

SEQ ID NO: 1932637 - RNA, 22 nt, Human
cuggagcuagaauuugauaugu

SEQ ID NO: 1932638 - RNA, 17 nt, Human
cuggagcuagaauuuga

SEQ ID NO: 1932639 - RNA, 16 nt, Human
cuggagcuagaauuug

SEQ ID NO: 1932640 - RNA, 13 nt, Human
cuggagcccacug

SEQ ID NO: 1932641 - RNA, 15 nt, Human
cuggagccaugggca

SEQ ID NO: 1932642 - RNA, 21 nt, Human
cuggagccaugggcacaaagg

SEQ ID NO: 1932643 - RNA, 15 nt, Human
cuggagcccacugua

SEQ ID NO: 1932644 - RNA, 16 nt, Human
cuggagcccacuguac

SEQ ID NO: 1932645 - RNA, 17 nt, Human
cuggagcccacuguacu

SEQ ID NO: 1932646 - RNA, 20 nt, Human
cuggagcccacuguacuugc

SEQ ID NO: 1932647 - RNA, 20 nt, Human
cuggacuagagggaccucuc

SEQ ID NO: 1932648 - RNA, 21 nt, Human
cuggacuagagggaccucucc

SEQ ID NO: 1932649 - RNA, 23 nt, Human
cuggacuagagggaccucuccca

SEQ ID NO: 1932650 - RNA, 19 nt, Human
cuggacaguaucacugucu

SEQ ID NO: 1932651 - RNA, 20 nt, Human
cuggacaguaucacugucuu

SEQ ID NO: 1932652 - RNA, 22 nt, Human
cuggagaggcccucuggagugg

SEQ ID NO: 1932653 - RNA, 17 nt, Human
cuccucacucaccuuca

SEQ ID NO: 1932654 - RNA, 12 nt, Human
cuccucagaucu

SEQ ID NO: 1932655 - RNA, 14 nt, Human
cuccucagaucuuc

SEQ ID NO: 1932656 - RNA, 13 nt, Human
cuccucccugcau

SEQ ID NO: 1932657 - RNA, 14 nt, Human
cuccucccugcauc

SEQ ID NO: 1932658 - RNA, 15 nt, Human
cuccucccugcaucu

SEQ ID NO: 1932659 - RNA, 16 nt, Human
cuccucccugcaucug

SEQ ID NO: 1932660 - RNA, 18 nt, Human
cuccucccugcaucugac

SEQ ID NO: 1932661 - RNA, 23 nt, Human
cuccucccugcaucugaccagca

SEQ ID NO: 1932662 - RNA, 13 nt, Human
cuccucucaguac

SEQ ID NO: 1932663 - RNA, 12 nt, Human
cuccucuuguaa

SEQ ID NO: 1932664 - RNA, 13 nt, Human
cuccucuuguaaa

SEQ ID NO: 1932665 - RNA, 14 nt, Human
cuccucuuguaaau

SEQ ID NO: 1932666 - RNA, 20 nt, Human
cuccucuuguaaauaaagcc

SEQ ID NO: 1932667 - RNA, 21 nt, Human
cuccucuuguaaauaaagccc

SEQ ID NO: 1932668 - RNA, 21 nt, Human
cuccugaguagcuggauuaca

SEQ ID NO: 1932669 - RNA, 12 nt, Human
cuccugcaggca

SEQ ID NO: 1932670 - RNA, 13 nt, Human
cuccugcaggcag

SEQ ID NO: 1932671 - RNA, 14 nt, Human
cuccugcaggcagc

SEQ ID NO: 1932672 - RNA, 17 nt, Human
cuccugaggcuuuggau

SEQ ID NO: 1932673 - RNA, 16 nt, Human
cuccugaggcuuugga

SEQ ID NO: 1932674 - RNA, 16 nt, Human
cucccuucucuucaca

SEQ ID NO: 1932675 - RNA, 13 nt, Human
cucccuucugcua

SEQ ID NO: 1932676 - RNA, 14 nt, Human
cucccuucugcuac

SEQ ID NO: 1932677 - RNA, 15 nt, Human
cucccuucugcuacu

SEQ ID NO: 1932678 - RNA, 16 nt, Human
cucccuucugcuacug

SEQ ID NO: 1932679 - RNA, 14 nt, Human
cucccuuccucuuu

SEQ ID NO: 1932680 - RNA, 13 nt, Human
cucccuuccucuu

SEQ ID NO: 1932681 - RNA, 17 nt, Human
cucccuuucuucccuac

SEQ ID NO: 1932682 - RNA, 23 nt, Human
cucccuuucuccccugcccccag

SEQ ID NO: 1932683 - RNA, 15 nt, Human
cucccuuucuccccu

SEQ ID NO: 1932684 - RNA, 17 nt, Human
cucccuuggauuguccc

SEQ ID NO: 1932685 - RNA, 20 nt, Human
cucccuuggauuguccccga

SEQ ID NO: 1932686 - RNA, 13 nt, Human
cucccuuucaaca

SEQ ID NO: 1932687 - RNA, 14 nt, Human
cucccuuucucccc

SEQ ID NO: 1932688 - RNA, 12 nt, Human
cucccuuucucc

SEQ ID NO: 1932689 - RNA, 10 nt, Human
cucccuuccu

SEQ ID NO: 1932690 - RNA, 23 nt, Human
cucccuucccaccucucucacuc

SEQ ID NO: 1932691 - RNA, 19 nt, Human
cucccuggugagagggccg

SEQ ID NO: 1932692 - RNA, 14 nt, Human
cucccaucacccgc

SEQ ID NO: 1932693 - RNA, 14 nt, Human
cucccaucucacac

SEQ ID NO: 1932694 - RNA, 23 nt, Human
cucccaggugcagccagaggcac

SEQ ID NO: 1932695 - RNA, 21 nt, Human
cucccaucucacacaugagca

SEQ ID NO: 1932696 - RNA, 15 nt, Human
cucccaucucacaca

SEQ ID NO: 1932697 - RNA, 18 nt, Human
cucccaucucacacauga

SEQ ID NO: 1932698 - RNA, 20 nt, Human
cucgaguuacagacaaagcg

SEQ ID NO: 1932699 - RNA, 16 nt, Human
cucgaguuacagacaa

SEQ ID NO: 1932700 - RNA, 17 nt, Human
cucgagguuucucaaag

SEQ ID NO: 1932701 - RNA, 12 nt, Human
cucgaauuuugu

SEQ ID NO: 1932702 - RNA, 23 nt, Human
cucgacguuuacaagcccccccu

SEQ ID NO: 1932703 - RNA, 13 nt, Human
cucgcgacaaugc

SEQ ID NO: 1932704 - RNA, 15 nt, Human
cucgcgacaaugcaa

SEQ ID NO: 1932705 - RNA, 14 nt, Human
cucgcauugacaca

SEQ ID NO: 1932706 - RNA, 14 nt, Human
cucgccccagcagg

SEQ ID NO: 1932707 - RNA, 18 nt, Human
cucggccucccaaagugc

SEQ ID NO: 1932708 - RNA, 20 nt, Human
cucggccucccaaagugcug

SEQ ID NO: 1932709 - RNA, 15 nt, Human
cucggccucccaaag

SEQ ID NO: 1932710 - RNA, 17 nt, Human
cucuaaauucuuucauu

SEQ ID NO: 1932711 - RNA, 13 nt, Human
cucuaaauucuuu

SEQ ID NO: 1932712 - RNA, 18 nt, Human
cucuaacagcucaggauc

SEQ ID NO: 1932713 - RNA, 22 nt, Human
cucuaacagcucaggaucucuu

SEQ ID NO: 1932714 - RNA, 18 nt, Human
cucuaaaugggaaaguau

SEQ ID NO: 1932715 - RNA, 21 nt, Human
cucuaacaauguauuuucuuc

SEQ ID NO: 1932716 - RNA, 14 nt, Human
cucuaacagcucag

SEQ ID NO: 1932717 - RNA, 16 nt, Human
cucuaacagcucagga

SEQ ID NO: 1932718 - RNA, 22 nt, Human
cucgcuuggacggcugggcaca

SEQ ID NO: 1932719 - RNA, 22 nt, Human
cucggaacugcaugcugcugga

SEQ ID NO: 1932720 - RNA, 19 nt, Human
cucggaacugcaugcugcu

SEQ ID NO: 1932721 - RNA, 21 nt, Human
cucggaacugcaugcugcugg

SEQ ID NO: 1932722 - RNA, 20 nt, Human
cuccuucuguccuacucugu

SEQ ID NO: 1932723 - RNA, 15 nt, Human
cuccuucuguccuac

SEQ ID NO: 1932724 - RNA, 14 nt, Human
cuccuucuguccua

SEQ ID NO: 1932725 - RNA, 20 nt, Human
cuccuucagcccucaccccu

SEQ ID NO: 1932726 - RNA, 17 nt, Human
cuccuucagcccucacc

SEQ ID NO: 1932727 - RNA, 15 nt, Human
cuccuucagcccuca

SEQ ID NO: 1932728 - RNA, 14 nt, Human
cuccuucagcccuc

SEQ ID NO: 1932729 - RNA, 14 nt, Human
cuccuuccaguguc

SEQ ID NO: 1932730 - RNA, 13 nt, Human
cuccuucagcccu

SEQ ID NO: 1932731 - RNA, 19 nt, Human
cuccuucagacacccucaa

SEQ ID NO: 1932732 - RNA, 13 nt, Human
cuccuucagacac

SEQ ID NO: 1932733 - RNA, 14 nt, Human
cuccuucagacacc

SEQ ID NO: 1932734 - RNA, 12 nt, Human
cuccuucagaca

SEQ ID NO: 1932735 - RNA, 16 nt, Human
cucgaacuggcugcaa

SEQ ID NO: 1932736 - RNA, 11 nt, Human
cuccuucuucc

SEQ ID NO: 1932737 - RNA, 21 nt, Human
cuccuugaaaacacuguucuc

SEQ ID NO: 1932738 - RNA, 11 nt, Human
cuccugugugu

SEQ ID NO: 1932739 - RNA, 23 nt, Human
cuccugugucuugcaauggcagc

SEQ ID NO: 1932740 - RNA, 15 nt, Human
cuccugugucuugca

SEQ ID NO: 1932741 - RNA, 22 nt, Human
cuccugcaggcagccaggccac

SEQ ID NO: 1932742 - RNA, 15 nt, Human
cuccugcaggcagcc

SEQ ID NO: 1932743 - RNA, 21 nt, Human
cuccugcaggcagccaggcca

SEQ ID NO: 1932744 - RNA, 14 nt, Human
cuccugugugugcg

SEQ ID NO: 1932745 - RNA, 14 nt, Human
cuccuucaccuuug

SEQ ID NO: 1932746 - RNA, 16 nt, Human
cuccuucaccuuuguc

SEQ ID NO: 1932747 - RNA, 19 nt, Human
cuccuucaccuuugucccc

SEQ ID NO: 1932748 - RNA, 21 nt, Human
cuccuucaccuuuguccccac

SEQ ID NO: 1932749 - RNA, 20 nt, Human
cucauugcuuggaauucagc

SEQ ID NO: 1932750 - RNA, 18 nt, Human
cucaucucuaacagcuca

SEQ ID NO: 1932751 - RNA, 16 nt, Human
cucauugaccugaggc

SEQ ID NO: 1932752 - RNA, 20 nt, Human
cucauugcugagccucugcu

SEQ ID NO: 1932753 - RNA, 19 nt, Human
cucauugcugagccucugc

SEQ ID NO: 1932754 - RNA, 23 nt, Human
cucauucuucuguacgucugaca

SEQ ID NO: 1932755 - RNA, 17 nt, Human
cucauugaauuauaaaa

SEQ ID NO: 1932756 - RNA, 13 nt, Human
cucauugaccuga

SEQ ID NO: 1932757 - RNA, 15 nt, Human
cucauugaccugagg

SEQ ID NO: 1932758 - RNA, 14 nt, Human
cucauucuucugua

SEQ ID NO: 1932759 - RNA, 13 nt, Human
cucauucuucugu

SEQ ID NO: 1932760 - RNA, 15 nt, Human
cucauuccagaggaa

SEQ ID NO: 1932761 - RNA, 17 nt, Human
cucauuccagaggaagg

SEQ ID NO: 1932762 - RNA, 21 nt, Human
cucaucuagguaaauuacagu

SEQ ID NO: 1932763 - RNA, 14 nt, Human
cucauccugcaggc

SEQ ID NO: 1932764 - RNA, 17 nt, Human
cucaucgccagacaacu

SEQ ID NO: 1932765 - RNA, 17 nt, Human
cucaucuccccaucauu

SEQ ID NO: 1932766 - RNA, 21 nt, Human
cucauuagcauuuugcuaaau

SEQ ID NO: 1932767 - RNA, 18 nt, Human
cucauuaggauggcuagu

SEQ ID NO: 1932768 - RNA, 17 nt, Human
cucauuaggauggcuag

SEQ ID NO: 1932769 - RNA, 13 nt, Human
cucauccugcagg

SEQ ID NO: 1932770 - RNA, 14 nt, Human
cucauauuuucaug

SEQ ID NO: 1932771 - RNA, 19 nt, Human
cucauaguaugguggcugg

SEQ ID NO: 1932772 - RNA, 18 nt, Human
cucauaguaugguggcug

SEQ ID NO: 1932773 - RNA, 20 nt, Human
cucauaguaugguggcuggg

SEQ ID NO: 1932774 - RNA, 19 nt, Human
cucaggugucccugcacuu

SEQ ID NO: 1932775 - RNA, 14 nt, Human
cucaggugagaagc

SEQ ID NO: 1932776 - RNA, 20 nt, Human
cucagugucuggcugcagag

SEQ ID NO: 1932777 - RNA, 18 nt, Human
cucaggugucccugcacu

SEQ ID NO: 1932778 - RNA, 17 nt, Human
cucaggugucccugcac

SEQ ID NO: 1932779 - RNA, 22 nt, Human
cucagugucuggcugcagagca

SEQ ID NO: 1932780 - RNA, 21 nt, Human
cucagugucuggcugcagagc

SEQ ID NO: 1932781 - RNA, 16 nt, Human
cucaggugucccugca

SEQ ID NO: 1932782 - RNA, 15 nt, Human
cucaggugucccugc

SEQ ID NO: 1932783 - RNA, 22 nt, Human
cucagguggggucacucuggca

SEQ ID NO: 1932784 - RNA, 23 nt, Human
cucagguggggucacucuggcag

SEQ ID NO: 1932785 - RNA, 15 nt, Human
cucaggucuguuuuc

SEQ ID NO: 1932786 - RNA, 20 nt, Human
cucaggucccuggggcuagg

SEQ ID NO: 1932787 - RNA, 14 nt, Human
cucagggucccugg

SEQ ID NO: 1932788 - RNA, 23 nt, Human
cuaaaagguaugcaaucaaaucu

SEQ ID NO: 1932789 - RNA, 12 nt, Human
cuaaaagcacac

SEQ ID NO: 1932790 - RNA, 12 nt, Human
cucagggucccu

SEQ ID NO: 1932791 - RNA, 19 nt, Human
cuaaaagugggcuugauuc

SEQ ID NO: 1932792 - RNA, 11 nt, Human
cuccaggcucc

SEQ ID NO: 1932793 - RNA, 20 nt, Human
cuccauccugaggcuccacu

SEQ ID NO: 1932794 - RNA, 21 nt, Human
cuccauccugaggcuccacuu

SEQ ID NO: 1932795 - RNA, 23 nt, Human
cuccauccugaggcuccacuugg

SEQ ID NO: 1932796 - RNA, 18 nt, Human
cuccagcuguucagcugg

SEQ ID NO: 1932797 - RNA, 19 nt, Human
cuccagcuguucagcuggu

SEQ ID NO: 1932798 - RNA, 13 nt, Human
cuccagcuguuca

SEQ ID NO: 1932799 - RNA, 15 nt, Human
cucccaggcauuccc

SEQ ID NO: 1932800 - RNA, 22 nt, Human
cucccaaguagcugggauuaca

SEQ ID NO: 1932801 - RNA, 21 nt, Human
cucccaaggggcccaaauucu

SEQ ID NO: 1932802 - RNA, 22 nt, Human
cucccaaggggcccaaauucuu

SEQ ID NO: 1932803 - RNA, 14 nt, Human
cuccaugugggcua

SEQ ID NO: 1932804 - RNA, 24 nt, Human
cuccauucccguggaacguuuuuc

SEQ ID NO: 1932805 - RNA, 17 nt, Human
cuccauugguguugaca

SEQ ID NO: 1932806 - RNA, 17 nt, Human
cucccaggcauucccca

SEQ ID NO: 1932807 - RNA, 19 nt, Human
cucccaggcauuccccagg

SEQ ID NO: 1932808 - RNA, 20 nt, Human
cucccaggcauuccccagga

SEQ ID NO: 1932809 - RNA, 21 nt, Human
cucccaggcauuccccaggag

SEQ ID NO: 1932810 - RNA, 22 nt, Human
cucccaggcauuccccaggagg

SEQ ID NO: 1932811 - RNA, 12 nt, Human
cuccacccugcu

SEQ ID NO: 1932812 - RNA, 18 nt, Human
cuccaccugccagggaca

SEQ ID NO: 1932813 - RNA, 21 nt, Human
cuccaccugccagggacagag

SEQ ID NO: 1932814 - RNA, 17 nt, Human
cuccaccugccagggac

SEQ ID NO: 1932815 - RNA, 15 nt, Human
cuccaccugccaggg

SEQ ID NO: 1932816 - RNA, 11 nt, Human
cuccacccugc

SEQ ID NO: 1932817 - RNA, 14 nt, Human
cucauuuaaaguau

SEQ ID NO: 1932818 - RNA, 19 nt, Human
cucauuuaaaguauuuuau

SEQ ID NO: 1932819 - RNA, 20 nt, Human
cucauuuaaaguauuuuauu

SEQ ID NO: 1932820 - RNA, 11 nt, Human
cucauuuacug

SEQ ID NO: 1932821 - RNA, 16 nt, Human
cuccacagcaacccca

SEQ ID NO: 1932822 - RNA, 19 nt, Human
cuccacagcaaccccaggc

SEQ ID NO: 1932823 - RNA, 20 nt, Human
cuccagcucaccagccccag

SEQ ID NO: 1932824 - RNA, 19 nt, Human
cuccagcucaccagcccca

SEQ ID NO: 1932825 - RNA, 21 nt, Human
cuccacucuccucuuccaggc

SEQ ID NO: 1932826 - RNA, 19 nt, Human
cucugccacugacugcagg

SEQ ID NO: 1932827 - RNA, 12 nt, Human
cucugcccuugg

SEQ ID NO: 1932828 - RNA, 14 nt, Human
cucugcccuccaag

SEQ ID NO: 1932829 - RNA, 15 nt, Human
cucugcccuccaaga

SEQ ID NO: 1932830 - RNA, 16 nt, Human
cucugcccuccaagac

SEQ ID NO: 1932831 - RNA, 23 nt, Human
cucugcccuccaagaccuucucc

SEQ ID NO: 1932832 - RNA, 16 nt, Human
cucugccucugacaca

SEQ ID NO: 1932833 - RNA, 14 nt, Human
cucugccucugaca

SEQ ID NO: 1932834 - RNA, 13 nt, Human
cucuggaaagcaa

SEQ ID NO: 1932835 - RNA, 14 nt, Human
cucuggaauuugaa

SEQ ID NO: 1932836 - RNA, 14 nt, Human
cucuggacaggcau

SEQ ID NO: 1932837 - RNA, 18 nt, Human
cucuggacagccccaccc

SEQ ID NO: 1932838 - RNA, 15 nt, Human
cucuggacagcccca

SEQ ID NO: 1932839 - RNA, 12 nt, Human
cucuggaccugc

SEQ ID NO: 1932840 - RNA, 13 nt, Human
cucuggaccugcc

SEQ ID NO: 1932841 - RNA, 21 nt, Human
cucuggaccugcccccgcauc

SEQ ID NO: 1932842 - RNA, 14 nt, Human
cucuggaccugccc

SEQ ID NO: 1932843 - RNA, 12 nt, Human
cucuggagccca

SEQ ID NO: 1932844 - RNA, 12 nt, Human
cucuggacugug

SEQ ID NO: 1932845 - RNA, 23 nt, Human
cucugcauacucauuaggauggc

SEQ ID NO: 1932846 - RNA, 23 nt, Human
cucugcaggucccuaauaaagcu

SEQ ID NO: 1932847 - RNA, 10 nt, Human
cucugcacaa

SEQ ID NO: 1932848 - RNA, 22 nt, Human
cucugcaagaauugaagcagga

SEQ ID NO: 1932849 - RNA, 20 nt, Human
cucugagacucgcgacaaug

SEQ ID NO: 1932850 - RNA, 14 nt, Human
cucucccauuuccu

SEQ ID NO: 1932851 - RNA, 16 nt, Human
cucucccauugucccu

SEQ ID NO: 1932852 - RNA, 18 nt, Human
cucucccauugucccucu

SEQ ID NO: 1932853 - RNA, 19 nt, Human
cucucccauugucccucug

SEQ ID NO: 1932854 - RNA, 13 nt, Human
cucuccccagcaa

SEQ ID NO: 1932855 - RNA, 21 nt, Human
cucucccauugucccucugcc

SEQ ID NO: 1932856 - RNA, 15 nt, Human
cucuccuguaccucu

SEQ ID NO: 1932857 - RNA, 14 nt, Human
cucuccuguaccuc

SEQ ID NO: 1932858 - RNA, 13 nt, Human
cucuccuguaccu

SEQ ID NO: 1932859 - RNA, 18 nt, Human
cucuccuguaccucuuga

SEQ ID NO: 1932860 - RNA, 17 nt, Human
cucuccuguaccucuug

SEQ ID NO: 1932861 - RNA, 22 nt, Human
cucuccuguaccucuugagccu

SEQ ID NO: 1932862 - RNA, 11 nt, Human
cucuccccagc

SEQ ID NO: 1932863 - RNA, 12 nt, Human
cucucggaacug

SEQ ID NO: 1932864 - RNA, 16 nt, Human
cucucggaacugcaug

SEQ ID NO: 1932865 - RNA, 19 nt, Human
cucucggaacugcaugcug

SEQ ID NO: 1932866 - RNA, 20 nt, Human
cucucggaacugcaugcugc

SEQ ID NO: 1932867 - RNA, 21 nt, Human
cucucggaacugcaugcugcu

SEQ ID NO: 1932868 - RNA, 23 nt, Human
cucucggaacugcaugcugcugg

SEQ ID NO: 1932869 - RNA, 12 nt, Human
cucucugcaggu

SEQ ID NO: 1932870 - RNA, 18 nt, Human
cucucugcaccguacugu

SEQ ID NO: 1932871 - RNA, 13 nt, Human
cucucugcagguc

SEQ ID NO: 1932872 - RNA, 14 nt, Human
cucucugcaggucc

SEQ ID NO: 1932873 - RNA, 16 nt, Human
cucucugcaggucccu

SEQ ID NO: 1932874 - RNA, 17 nt, Human
cucucugcaggucccua

SEQ ID NO: 1932875 - RNA, 19 nt, Human
cucucugcaggucccuaau

SEQ ID NO: 1932876 - RNA, 22 nt, Human
cucucugcaggucccuaauaaa

SEQ ID NO: 1932877 - RNA, 14 nt, Human
cucucucacuccuu

SEQ ID NO: 1932878 - RNA, 15 nt, Human
cucucucacuccuug

SEQ ID NO: 1932879 - RNA, 16 nt, Human
cucucucacuccuuga

SEQ ID NO: 1932880 - RNA, 12 nt, Human
cucucucaggcc

SEQ ID NO: 1932881 - RNA, 15 nt, Human
cucuaauaucagcaa

SEQ ID NO: 1932882 - RNA, 22 nt, Human
cucucaggccagcugcuugggc

SEQ ID NO: 1932883 - RNA, 23 nt, Human
cucucaggccagcugcuugggcu

SEQ ID NO: 1932884 - RNA, 18 nt, Human
cucucaguacuuuggagg

SEQ ID NO: 1932885 - RNA, 19 nt, Human
cucucaguacuuuggaggc

SEQ ID NO: 1932886 - RNA, 17 nt, Human
cucucaucucuuagcuc

SEQ ID NO: 1932887 - RNA, 18 nt, Human
cucucaucgccagacaac

SEQ ID NO: 1932888 - RNA, 21 nt, Human
cucuccauucccguggaacgu

SEQ ID NO: 1932889 - RNA, 12 nt, Human
cucuccagcccc

SEQ ID NO: 1932890 - RNA, 13 nt, Human
cucuccagccccu

SEQ ID NO: 1932891 - RNA, 20 nt, Human
cucuccagauguuuccagac

SEQ ID NO: 1932892 - RNA, 13 nt, Human
cucucccaucacu

SEQ ID NO: 1932893 - RNA, 11 nt, Human
cucucccaggg

SEQ ID NO: 1932894 - RNA, 20 nt, Human
cucucccaucacuucccuac

SEQ ID NO: 1932895 - RNA, 14 nt, Human
cucucccaucacuu

SEQ ID NO: 1932896 - RNA, 18 nt, Human
cucucccaucacuucccu

SEQ ID NO: 1932897 - RNA, 21 nt, Human
cugacauuguuggccaaagcc

SEQ ID NO: 1932898 - RNA, 12 nt, Human
cugaccacagca

SEQ ID NO: 1932899 - RNA, 14 nt, Human
cugaccacagcaca

SEQ ID NO: 1932900 - RNA, 15 nt, Human
cugaccacagcacag

SEQ ID NO: 1932901 - RNA, 18 nt, Human
cugaccacagcacagcca

SEQ ID NO: 1932902 - RNA, 22 nt, Human
cugaccacgcuuucuagcuguu

SEQ ID NO: 1932903 - RNA, 11 nt, Human
cugacccacug

SEQ ID NO: 1932904 - RNA, 13 nt, Human
cugaccagaacua

SEQ ID NO: 1932905 - RNA, 13 nt, Human
cugaccagcagcg

SEQ ID NO: 1932906 - RNA, 14 nt, Human
cugaccagcagcgc

SEQ ID NO: 1932907 - RNA, 15 nt, Human
cugaccagcagcgcc

SEQ ID NO: 1932908 - RNA, 16 nt, Human
cugaccagcagcgccu

SEQ ID NO: 1932909 - RNA, 19 nt, Human
cugacaggcaaugcuggcu

SEQ ID NO: 1932910 - RNA, 18 nt, Human
cugacaggcaaugcuggc

SEQ ID NO: 1932911 - RNA, 17 nt, Human
cugacaggcaaugcugg

SEQ ID NO: 1932912 - RNA, 16 nt, Human
cugacaggcaaugcug

SEQ ID NO: 1932913 - RNA, 20 nt, Human
cugacaggcaaugcuggcug

SEQ ID NO: 1932914 - RNA, 16 nt, Human
cugacauucaccugcc

SEQ ID NO: 1932915 - RNA, 22 nt, Human
cugacagcugcuccuagaggga

SEQ ID NO: 1932916 - RNA, 17 nt, Human
cugacauuguuggccaa

SEQ ID NO: 1932917 - RNA, 17 nt, Human
cugacauucaccugccc

SEQ ID NO: 1932918 - RNA, 23 nt, Human
cugacauucaccugccccaacuc

SEQ ID NO: 1932919 - RNA, 21 nt, Human
cugacagacacaggcccggcu

SEQ ID NO: 1932920 - RNA, 11 nt, Human
cugacaggcaa

SEQ ID NO: 1932921 - RNA, 19 nt, Human
cugacagcugcuccuagag

SEQ ID NO: 1932922 - RNA, 23 nt, Human
cugacagcugcuccuagagggag

SEQ ID NO: 1932923 - RNA, 19 nt, Human
cugacagacacaggcccgg

SEQ ID NO: 1932924 - RNA, 23 nt, Human
cugaauuuaaauagcuuuuuucu

SEQ ID NO: 1932925 - RNA, 18 nt, Human
cugaauuuaaauagcuuu

SEQ ID NO: 1932926 - RNA, 14 nt, Human
cugaauuuaaauag

SEQ ID NO: 1932927 - RNA, 22 nt, Human
cugaaugaaccuucuggccucc

SEQ ID NO: 1932928 - RNA, 16 nt, Human
cugaagucacacagug

SEQ ID NO: 1932929 - RNA, 15 nt, Human
cugaagucacacagu

SEQ ID NO: 1932930 - RNA, 14 nt, Human
cugaagucacacag

SEQ ID NO: 1932931 - RNA, 24 nt, Human
cugaagucuuuguacagacaacaa

SEQ ID NO: 1932932 - RNA, 16 nt, Human
cugaauacagaggcaa

SEQ ID NO: 1932933 - RNA, 21 nt, Human
cugaagacucauucuucugua

SEQ ID NO: 1932934 - RNA, 21 nt, Human
cugaagagaagggcagggcug

SEQ ID NO: 1932935 - RNA, 15 nt, Human
cugaacuuggcgcug

SEQ ID NO: 1932936 - RNA, 16 nt, Human
cugaacuuggcgcugc

SEQ ID NO: 1932937 - RNA, 21 nt, Human
cugaacuuggcgcugccccug

SEQ ID NO: 1932938 - RNA, 21 nt, Human
cugaaccuggguaacuaggga

SEQ ID NO: 1932939 - RNA, 18 nt, Human
cucuuugggccuggcucc

SEQ ID NO: 1932940 - RNA, 20 nt, Human
cucuuugcuuugcuuucugc

SEQ ID NO: 1932941 - RNA, 22 nt, Human
cucuuugcuuugcuuucugcuc

SEQ ID NO: 1932942 - RNA, 19 nt, Human
cucuuuggucuacacugug

SEQ ID NO: 1932943 - RNA, 21 nt, Human
cucuuuggucuacacugugcu

SEQ ID NO: 1932944 - RNA, 12 nt, Human
cucuucuccagg

SEQ ID NO: 1932945 - RNA, 23 nt, Human
cucuuccaggcugggagagccuu

SEQ ID NO: 1932946 - RNA, 22 nt, Human
cucuuccaggcugggagagccu

SEQ ID NO: 1932947 - RNA, 21 nt, Human
cucuuccaggcugggagagcc

SEQ ID NO: 1932948 - RNA, 11 nt, Human
cucuucuggcu

SEQ ID NO: 1932949 - RNA, 14 nt, Human
cucuucuggcucaa

SEQ ID NO: 1932950 - RNA, 15 nt, Human
cucuggagcccacug

SEQ ID NO: 1932951 - RNA, 17 nt, Human
cucuggcagcucagaga

SEQ ID NO: 1932952 - RNA, 18 nt, Human
cucuggcagcucagagag

SEQ ID NO: 1932953 - RNA, 20 nt, Human
cucuggcagcucagagaggg

SEQ ID NO: 1932954 - RNA, 19 nt, Human
cucuggcagcucagagagg

SEQ ID NO: 1932955 - RNA, 13 nt, Human
cucuuaaaaccca

SEQ ID NO: 1932956 - RNA, 24 nt, Human
cucuuaaaacccaagugccuuagc

SEQ ID NO: 1932957 - RNA, 20 nt, Human
cucuguugcaagugcaauaa

SEQ ID NO: 1932958 - RNA, 19 nt, Human
cucuucagguuguaaaaaa

SEQ ID NO: 1932959 - RNA, 15 nt, Human
cucuuuggacacuca

SEQ ID NO: 1932960 - RNA, 18 nt, Human
cucuuuggacacucacac

SEQ ID NO: 1932961 - RNA, 11 nt, Human
cucuuucugua

SEQ ID NO: 1932962 - RNA, 13 nt, Human
cucuuucuguaua

SEQ ID NO: 1932963 - RNA, 14 nt, Human
cucuuucuguauau

SEQ ID NO: 1932964 - RNA, 12 nt, Human
cucuuugcuuug

SEQ ID NO: 1932965 - RNA, 13 nt, Human
cucuuugcuuugc

SEQ ID NO: 1932966 - RNA, 14 nt, Human
cucuuugcuuugcu

SEQ ID NO: 1932967 - RNA, 15 nt, Human
cucuuugcuuugcuu

SEQ ID NO: 1932968 - RNA, 16 nt, Human
cucuuugcuuugcuuu

SEQ ID NO: 1932969 - RNA, 18 nt, Human
cucuuugcuuugcuuucu

SEQ ID NO: 1932970 - RNA, 17 nt, Human
cucuuuccaucuacccu

SEQ ID NO: 1932971 - RNA, 15 nt, Human
cucuuguauuaaacu

SEQ ID NO: 1932972 - RNA, 17 nt, Human
cucuuguaaauaaagcc

SEQ ID NO: 1932973 - RNA, 18 nt, Human
cucuuguaaauaaagccc

SEQ ID NO: 1932974 - RNA, 19 nt, Human
cucuuguaaauaaagcccu

SEQ ID NO: 1932975 - RNA, 20 nt, Human
cucuuguaaauaaagcccug

SEQ ID NO: 1932976 - RNA, 23 nt, Human
cucuuguaaauaaagcccuggga

SEQ ID NO: 1932977 - RNA, 24 nt, Human
cucuuguaaauaaagcccugggau

SEQ ID NO: 1932978 - RNA, 15 nt, Human
cucuugaccucaggu

SEQ ID NO: 1932979 - RNA, 13 nt, Human
cucuugaccucag

SEQ ID NO: 1932980 - RNA, 16 nt, Human
cucuugaccucaggug

SEQ ID NO: 1932981 - RNA, 17 nt, Human
cucuugaacugagcuug

SEQ ID NO: 1932982 - RNA, 16 nt, Human
cucuugaacugagcuu

SEQ ID NO: 1932983 - RNA, 19 nt, Human
cucuugaacugagcuugga

SEQ ID NO: 1932984 - RNA, 20 nt, Human
cucuugaagacacugaaaua

SEQ ID NO: 1932985 - RNA, 21 nt, Human
cucuugaagacacugaaauau

SEQ ID NO: 1932986 - RNA, 18 nt, Human
cucuugguccugcugcag

SEQ ID NO: 1932987 - RNA, 19 nt, Human
cucuugguccugcugcagu

SEQ ID NO: 1932988 - RNA, 12 nt, Human
cucuuguaaaua

SEQ ID NO: 1932989 - RNA, 14 nt, Human
cucuuguaaauaaa

SEQ ID NO: 1932990 - RNA, 22 nt, Human
cucuuggagccugcagagcugc

SEQ ID NO: 1932991 - RNA, 19 nt, Human
cucuuggaggugucuguau

SEQ ID NO: 1932992 - RNA, 16 nt, Human
cucuuggccugaucag

SEQ ID NO: 1932993 - RNA, 14 nt, Human
cucuuggcuccacu

SEQ ID NO: 1932994 - RNA, 21 nt, Human
cucuugggaacugaacucacu

SEQ ID NO: 1932995 - RNA, 14 nt, Human
cuuauaauuuaaaa

SEQ ID NO: 1932996 - RNA, 15 nt, Human
cuuauacauuugaua

SEQ ID NO: 1932997 - RNA, 19 nt, Human
cuuauaggaauugacccac

SEQ ID NO: 1932998 - RNA, 13 nt, Human
cuuauaauuuaaa

SEQ ID NO: 1932999 - RNA, 17 nt, Human
cuuagguuggcaaaaag

SEQ ID NO: 1933000 - RNA, 22 nt, Human
cuuaggugugauuauaaaauca

SEQ ID NO: 1933001 - RNA, 19 nt, Human
cuuaucaagaguugugaca

SEQ ID NO: 1933002 - RNA, 16 nt, Human
cuuaucuccaagacca

SEQ ID NO: 1933003 - RNA, 13 nt, Human
cuuaucuccaaga

SEQ ID NO: 1933004 - RNA, 14 nt, Human
cuuaucuccaagac

SEQ ID NO: 1933005 - RNA, 15 nt, Human
cuuauuuaaugaaag

SEQ ID NO: 1933006 - RNA, 20 nt, Human
cuuauuuaaguaacuuuaaa

SEQ ID NO: 1933007 - RNA, 15 nt, Human
cuuacgugaguccug

SEQ ID NO: 1933008 - RNA, 19 nt, Human
cuuacuaguuucccuugca

SEQ ID NO: 1933009 - RNA, 15 nt, Human
cuuacggcccuggcc

SEQ ID NO: 1933010 - RNA, 16 nt, Human
cuuacggcccuggccu

SEQ ID NO: 1933011 - RNA, 17 nt, Human
cuuacggcccuggccuu

SEQ ID NO: 1933012 - RNA, 16 nt, Human
cuuacuguacaugaaa

SEQ ID NO: 1933013 - RNA, 14 nt, Human
cuuacuccaggaga

SEQ ID NO: 1933014 - RNA, 14 nt, Human
cuuacuuaguguua

SEQ ID NO: 1933015 - RNA, 15 nt, Human
cuuagaagucacaca

SEQ ID NO: 1933016 - RNA, 14 nt, Human
cuuagacagucccu

SEQ ID NO: 1933017 - RNA, 15 nt, Human
cuuagacagucccug

SEQ ID NO: 1933018 - RNA, 16 nt, Human
cuuagacagucccugc

SEQ ID NO: 1933019 - RNA, 12 nt, Human
cuuagaacauuu

SEQ ID NO: 1933020 - RNA, 15 nt, Human
cuuagaacauuuuaa

SEQ ID NO: 1933021 - RNA, 16 nt, Human
cuuagaacauuuuaau

SEQ ID NO: 1933022 - RNA, 19 nt, Human
cuuagaacauuuuaauuca

SEQ ID NO: 1933023 - RNA, 11 nt, Human
cuuagacaguc

SEQ ID NO: 1933024 - RNA, 19 nt, Human
cuuagacagucccugccaa

SEQ ID NO: 1933025 - RNA, 17 nt, Human
cuuagacagucccugcc

SEQ ID NO: 1933026 - RNA, 18 nt, Human
cuuagacagucccugcca

SEQ ID NO: 1933027 - RNA, 12 nt, Human
cuguuuagauaa

SEQ ID NO: 1933028 - RNA, 15 nt, Human
cuguuuacaguguuc

SEQ ID NO: 1933029 - RNA, 13 nt, Human
cuguuuacagugu

SEQ ID NO: 1933030 - RNA, 18 nt, Human
cuguuuguuucugaaagg

SEQ ID NO: 1933031 - RNA, 15 nt, Human
cuguuuaugcuuuug

SEQ ID NO: 1933032 - RNA, 17 nt, Human
cuguuuucucuugagag

SEQ ID NO: 1933033 - RNA, 23 nt, Human
cuguuuuaauuuauacuggcaug

SEQ ID NO: 1933034 - RNA, 17 nt, Human
cuguuuugaaggcaaaa

SEQ ID NO: 1933035 - RNA, 21 nt, Human
cuguuuuguaaaguccccaga

SEQ ID NO: 1933036 - RNA, 20 nt, Human
cuguuuuguggucagcugua

SEQ ID NO: 1933037 - RNA, 14 nt, Human
cuguuuuguaaagu

SEQ ID NO: 1933038 - RNA, 16 nt, Human
cuguuuuguaaagucc

SEQ ID NO: 1933039 - RNA, 17 nt, Human
cuguuuuguaaaguccc

SEQ ID NO: 1933040 - RNA, 13 nt, Human
cuguuuucucuug

SEQ ID NO: 1933041 - RNA, 14 nt, Human
cuguuuucucuuga

SEQ ID NO: 1933042 - RNA, 21 nt, Human
cuguuuuauuuuaauucaguu

SEQ ID NO: 1933043 - RNA, 21 nt, Human
cuguuuguuucugaaagggac

SEQ ID NO: 1933044 - RNA, 23 nt, Human
cuguuuguuucugaaagggacgc

SEQ ID NO: 1933045 - RNA, 19 nt, Human
cuuaauauucuggagucau

SEQ ID NO: 1933046 - RNA, 14 nt, Human
cuuaauauucugga

SEQ ID NO: 1933047 - RNA, 16 nt, Human
cuuaaucuaaauggaa

SEQ ID NO: 1933048 - RNA, 14 nt, Human
cuuaaucuaaaugg

SEQ ID NO: 1933049 - RNA, 18 nt, Human
cuuaaugccacuaaauug

SEQ ID NO: 1933050 - RNA, 18 nt, Human
cuuaauccagcugaugag

SEQ ID NO: 1933051 - RNA, 22 nt, Human
cuuaacuucacauauugauuuc

SEQ ID NO: 1933052 - RNA, 17 nt, Human
cuuaacuucacauauug

SEQ ID NO: 1933053 - RNA, 16 nt, Human
cuuaacuucacauauu

SEQ ID NO: 1933054 - RNA, 15 nt, Human
cuuaacuucacauau

SEQ ID NO: 1933055 - RNA, 14 nt, Human
cuuaacuucacaua

SEQ ID NO: 1933056 - RNA, 12 nt, Human
cuuaacuucaca

SEQ ID NO: 1933057 - RNA, 17 nt, Human
cuuaacuccuuccagug

SEQ ID NO: 1933058 - RNA, 13 nt, Human
cuuccagcccaga

SEQ ID NO: 1933059 - RNA, 22 nt, Human
cuuccaggggugggacacccug

SEQ ID NO: 1933060 - RNA, 24 nt, Human
cuuccaggggugggacacccugug

SEQ ID NO: 1933061 - RNA, 14 nt, Human
cuuccagugaggcu

SEQ ID NO: 1933062 - RNA, 16 nt, Human
cuuccagguguuacug

SEQ ID NO: 1933063 - RNA, 19 nt, Human
cuuccagguguuacuguaa

SEQ ID NO: 1933064 - RNA, 20 nt, Human
cuuccagguguuacuguaau

SEQ ID NO: 1933065 - RNA, 22 nt, Human
cuuccagguguuacuguaauuc

SEQ ID NO: 1933066 - RNA, 15 nt, Human
cuuccagugaggcuc

SEQ ID NO: 1933067 - RNA, 17 nt, Human
cuucccucaccuuggca

SEQ ID NO: 1933068 - RNA, 18 nt, Human
cuucauuuccugugucuu

SEQ ID NO: 1933069 - RNA, 13 nt, Human
cuucagugccuua

SEQ ID NO: 1933070 - RNA, 14 nt, Human
cuucagugccuuau

SEQ ID NO: 1933071 - RNA, 11 nt, Human
cuucagugccu

SEQ ID NO: 1933072 - RNA, 12 nt, Human
cuucagugccuu

SEQ ID NO: 1933073 - RNA, 18 nt, Human
cuucaggucaggaguucg

SEQ ID NO: 1933074 - RNA, 14 nt, Human
cuuccaagagccug

SEQ ID NO: 1933075 - RNA, 23 nt, Human
cuuccacaagagcccaggccucc

SEQ ID NO: 1933076 - RNA, 22 nt, Human
cuuccacaagagcccaggccuc

SEQ ID NO: 1933077 - RNA, 15 nt, Human
cuuccaagagccuga

SEQ ID NO: 1933078 - RNA, 11 nt, Human
cuucagcugac

SEQ ID NO: 1933079 - RNA, 19 nt, Human
cuucagcccucaccccugg

SEQ ID NO: 1933080 - RNA, 17 nt, Human
cuucagcccucaccccu

SEQ ID NO: 1933081 - RNA, 16 nt, Human
cuucagcccucacccc

SEQ ID NO: 1933082 - RNA, 15 nt, Human
cuucagcccucaccc

SEQ ID NO: 1933083 - RNA, 19 nt, Human
cuucgggcuggccaucugg

SEQ ID NO: 1933084 - RNA, 19 nt, Human
cuucuaaacccaauccaaa

SEQ ID NO: 1933085 - RNA, 18 nt, Human
cuucuaaacuuccccauc

SEQ ID NO: 1933086 - RNA, 19 nt, Human
cuucuaaacuuccccaucu

SEQ ID NO: 1933087 - RNA, 22 nt, Human
cuucuaaacuuccccaucuucu

SEQ ID NO: 1933088 - RNA, 15 nt, Human
cuucuaaagguguug

SEQ ID NO: 1933089 - RNA, 21 nt, Human
cuucuaaagguguugucccuu

SEQ ID NO: 1933090 - RNA, 22 nt, Human
cuucuaaagguguugucccuuc

SEQ ID NO: 1933091 - RNA, 21 nt, Human
cuucucauuucaccccucccu

SEQ ID NO: 1933092 - RNA, 12 nt, Human
cuucucagccac

SEQ ID NO: 1933093 - RNA, 16 nt, Human
cuucgcuccugugucu

SEQ ID NO: 1933094 - RNA, 17 nt, Human
cuucggccuccauccug

SEQ ID NO: 1933095 - RNA, 19 nt, Human
cuucggccuccauccugag

SEQ ID NO: 1933096 - RNA, 18 nt, Human
cuucggccuccauccuga

SEQ ID NO: 1933097 - RNA, 20 nt, Human
cuucgggaggucgaggcagg

SEQ ID NO: 1933098 - RNA, 21 nt, Human
cuucgggaggucgaggcagga

SEQ ID NO: 1933099 - RNA, 15 nt, Human
cuucgggcugugccc

SEQ ID NO: 1933100 - RNA, 14 nt, Human
cuucgggcugugcc

SEQ ID NO: 1933101 - RNA, 13 nt, Human
cuucgcuccugug

SEQ ID NO: 1933102 - RNA, 21 nt, Human
cuucgacagcauuuuccucug

SEQ ID NO: 1933103 - RNA, 15 nt, Human
cuucgcuccuguguc

SEQ ID NO: 1933104 - RNA, 14 nt, Human
cuucgcuccugugu

SEQ ID NO: 1933105 - RNA, 15 nt, Human
cuucgaaaccuggga

SEQ ID NO: 1933106 - RNA, 15 nt, Human
cuuccuuuugaggga

SEQ ID NO: 1933107 - RNA, 14 nt, Human
cuucgacagcauuu

SEQ ID NO: 1933108 - RNA, 15 nt, Human
cuucgacagcauuuu

SEQ ID NO: 1933109 - RNA, 17 nt, Human
cuucgacagcauuuucc

SEQ ID NO: 1933110 - RNA, 17 nt, Human
cuuccuugcuuaaggua

SEQ ID NO: 1933111 - RNA, 18 nt, Human
cuuccuugagacacggag

SEQ ID NO: 1933112 - RNA, 20 nt, Human
cuuccuugagacacggagcc

SEQ ID NO: 1933113 - RNA, 23 nt, Human
cuuccuugagacacggagcccag

SEQ ID NO: 1933114 - RNA, 17 nt, Human
cuucugccauauucugu

SEQ ID NO: 1933115 - RNA, 15 nt, Human
cuucugccauauucu

SEQ ID NO: 1933116 - RNA, 21 nt, Human
cuucugccauauucuguuggc

SEQ ID NO: 1933117 - RNA, 20 nt, Human
cuucugccauuucugagauc

SEQ ID NO: 1933118 - RNA, 16 nt, Human
cuucucucaucucuua

SEQ ID NO: 1933119 - RNA, 14 nt, Human
cuucucucaucucu

SEQ ID NO: 1933120 - RNA, 11 nt, Human
cuucugcuacu

SEQ ID NO: 1933121 - RNA, 13 nt, Human
cuucugcuacugg

SEQ ID NO: 1933122 - RNA, 19 nt, Human
cuucugcuacuggcaaaag

SEQ ID NO: 1933123 - RNA, 17 nt, Human
cuucugcuucagccucc

SEQ ID NO: 1933124 - RNA, 16 nt, Human
cuucugcuucagccuc

SEQ ID NO: 1933125 - RNA, 14 nt, Human
cuucugcucagcuc

SEQ ID NO: 1933126 - RNA, 15 nt, Human
cuucugcucagcucu

SEQ ID NO: 1933127 - RNA, 16 nt, Human
cuucugcucagcucug

SEQ ID NO: 1933128 - RNA, 18 nt, Human
cuucugcucagcucuggg

SEQ ID NO: 1933129 - RNA, 18 nt, Human
cuucugcuucagccuccc

SEQ ID NO: 1933130 - RNA, 20 nt, Human
cuucugcuacuggcaaaagg

SEQ ID NO: 1933131 - RNA, 22 nt, Human
cuucuccuucaccuuugucccc

SEQ ID NO: 1933132 - RNA, 15 nt, Human
cuucuccacccugcu

SEQ ID NO: 1933133 - RNA, 14 nt, Human
cuucuccacccugc

SEQ ID NO: 1933134 - RNA, 14 nt, Human
cuucuccaggcugu

SEQ ID NO: 1933135 - RNA, 16 nt, Human
cuucuccacccugcuc

SEQ ID NO: 1933136 - RNA, 17 nt, Human
cuucuccaggcuguauc

SEQ ID NO: 1933137 - RNA, 22 nt, Human
cuucucauuucaccccucccuu

SEQ ID NO: 1933138 - RNA, 20 nt, Human
cuuucugaagccucacuuau

SEQ ID NO: 1933139 - RNA, 21 nt, Human
cuuucugauaacuagauggug

SEQ ID NO: 1933140 - RNA, 23 nt, Human
cuuucugauaacuagauggugcu

SEQ ID NO: 1933141 - RNA, 13 nt, Human
cuuucugaaauaa

SEQ ID NO: 1933142 - RNA, 16 nt, Human
cuuuccucuuuggucu

SEQ ID NO: 1933143 - RNA, 16 nt, Human
cuuuccuccuuccaug

SEQ ID NO: 1933144 - RNA, 13 nt, Human
cuuuccuccuucc

SEQ ID NO: 1933145 - RNA, 14 nt, Human
cuuuccuccuucca

SEQ ID NO: 1933146 - RNA, 19 nt, Human
cuuuccucaaaacuucaga

SEQ ID NO: 1933147 - RNA, 21 nt, Human
cuuuaggagggaguuaucuaa

SEQ ID NO: 1933148 - RNA, 15 nt, Human
cuuucugcagaaaca

SEQ ID NO: 1933149 - RNA, 19 nt, Human
cuuucuguauauacuuuuu

SEQ ID NO: 1933150 - RNA, 20 nt, Human
cuuucuguauauacuuuuuu

SEQ ID NO: 1933151 - RNA, 13 nt, Human
cuuucugcucagc

SEQ ID NO: 1933152 - RNA, 14 nt, Human
cuuucugcucagcu

SEQ ID NO: 1933153 - RNA, 16 nt, Human
cuuucugcucagcuuc

SEQ ID NO: 1933154 - RNA, 17 nt, Human
cuuucugcucagcuucu

SEQ ID NO: 1933155 - RNA, 18 nt, Human
cuuucuguauauacuuuu

SEQ ID NO: 1933156 - RNA, 14 nt, Human
cuuucugucucucu

SEQ ID NO: 1933157 - RNA, 17 nt, Human
cuuugacaaagguaaau

SEQ ID NO: 1933158 - RNA, 19 nt, Human
cuuugaaagccccagaaau

SEQ ID NO: 1933159 - RNA, 20 nt, Human
cuuugaaagccccagaaauc

SEQ ID NO: 1933160 - RNA, 22 nt, Human
cuuucuugaucaacaucuuuuc

SEQ ID NO: 1933161 - RNA, 21 nt, Human
cuuucuugaucaacaucuuuu

SEQ ID NO: 1933162 - RNA, 12 nt, Human
cuuuggaaagac

SEQ ID NO: 1933163 - RNA, 17 nt, Human
cuuugcuuugcuuucug

SEQ ID NO: 1933164 - RNA, 17 nt, Human
cuuugcuuucugcucag

SEQ ID NO: 1933165 - RNA, 19 nt, Human
cuuugcuuucugcucagcu

SEQ ID NO: 1933166 - RNA, 21 nt, Human
cuuugcuuucugcucagcuuc

SEQ ID NO: 1933167 - RNA, 11 nt, Human
cuuugcuuugc

SEQ ID NO: 1933168 - RNA, 23 nt, Human
cuuuggaaagacuuuuccaaccc

SEQ ID NO: 1933169 - RNA, 14 nt, Human
cuuugcuugaaaga

SEQ ID NO: 1933170 - RNA, 12 nt, Human
cuuugcuuucug

SEQ ID NO: 1933171 - RNA, 13 nt, Human
cuuugcuuucugc

SEQ ID NO: 1933172 - RNA, 14 nt, Human
cuuugcuuucugcu

SEQ ID NO: 1933173 - RNA, 15 nt, Human
cuuugcuuucugcuc

SEQ ID NO: 1933174 - RNA, 16 nt, Human
cuuugcuuucugcuca

SEQ ID NO: 1933175 - RNA, 19 nt, Human
cuuugacaaagguaaauca

SEQ ID NO: 1933176 - RNA, 14 nt, Human
cuuugcauuuugga

SEQ ID NO: 1933177 - RNA, 16 nt, Human
cuuugccaagaccuuu

SEQ ID NO: 1933178 - RNA, 17 nt, Human
cuuugccaagaccuuuc

SEQ ID NO: 1933179 - RNA, 20 nt, Human
cuuugccaagaccuuucaaa

SEQ ID NO: 1933180 - RNA, 13 nt, Human
cuuuguggcuucc

SEQ ID NO: 1933181 - RNA, 11 nt, Human
cuuuguggcca

SEQ ID NO: 1933182 - RNA, 12 nt, Human
cuuuguggccaa

SEQ ID NO: 1933183 - RNA, 13 nt, Human
cuuuguggccaag

SEQ ID NO: 1933184 - RNA, 12 nt, Human
cuuugugauuuu

SEQ ID NO: 1933185 - RNA, 19 nt, Human
cuuugugaggaagccgcug

SEQ ID NO: 1933186 - RNA, 16 nt, Human
cuuuguucuggcucuu

SEQ ID NO: 1933187 - RNA, 21 nt, Human
cuuuguucuggcucuuccagg

SEQ ID NO: 1933188 - RNA, 22 nt, Human
cuuuguggccaaggagcugcua

SEQ ID NO: 1933189 - RNA, 14 nt, Human
cuuuguggccaagg

SEQ ID NO: 1933190 - RNA, 15 nt, Human
cuuuguggccaagga

SEQ ID NO: 1933191 - RNA, 16 nt, Human
cuuuguggccaaggag

SEQ ID NO: 1933192 - RNA, 18 nt, Human
cuuuguggccaaggagcu

SEQ ID NO: 1933193 - RNA, 20 nt, Human
cuuuguggccaaggagcugc

SEQ ID NO: 1933194 - RNA, 21 nt, Human
cuuuguggccaaggagcugcu

SEQ ID NO: 1933195 - RNA, 23 nt, Human
cuuugggaggccaaggugggagg

SEQ ID NO: 1933196 - RNA, 14 nt, Human
cuuuggcagaguuc

SEQ ID NO: 1933197 - RNA, 13 nt, Human
cuuuggauuugac

SEQ ID NO: 1933198 - RNA, 15 nt, Human
cuuuggauuugacau

SEQ ID NO: 1933199 - RNA, 16 nt, Human
cuuuggauuugacauu

SEQ ID NO: 1933200 - RNA, 17 nt, Human
cuuuggauuugacauug

SEQ ID NO: 1933201 - RNA, 17 nt, Human
cuuugggccuggcuccc

SEQ ID NO: 1933202 - RNA, 23 nt, Human
cuuugugaggaagccgcuggggc

SEQ ID NO: 1933203 - RNA, 12 nt, Human
cuuugggccaga

SEQ ID NO: 1933204 - RNA, 13 nt, Human
cuuugggccagac

SEQ ID NO: 1933205 - RNA, 21 nt, Human
cuuugggccagacaugccaca

SEQ ID NO: 1933206 - RNA, 19 nt, Human
gaaaauaacaauaaaagac

SEQ ID NO: 1933207 - RNA, 19 nt, Human
gaaaacaugcuacacacug

SEQ ID NO: 1933208 - RNA, 14 nt, Human
gaaaacguggcugc

SEQ ID NO: 1933209 - RNA, 13 nt, Human
gaaaacggagcug

SEQ ID NO: 1933210 - RNA, 14 nt, Human
gaaaacggagcuga

SEQ ID NO: 1933211 - RNA, 22 nt, Human
gaaaacgcucucuacucugcuu

SEQ ID NO: 1933212 - RNA, 13 nt, Human
gaaaaccucuccu

SEQ ID NO: 1933213 - RNA, 18 nt, Human
gaaaagggaacugaacau

SEQ ID NO: 1933214 - RNA, 19 nt, Human
gaaaacacuguucucugcc

SEQ ID NO: 1933215 - RNA, 18 nt, Human
gaaaacaugcuacacacu

SEQ ID NO: 1933216 - RNA, 16 nt, Human
gaaaacaugcuacaca

SEQ ID NO: 1933217 - RNA, 20 nt, Human
gaaaacacuguucucugccc

SEQ ID NO: 1933218 - RNA, 21 nt, Human
gaaaacacuguucucugcccu

SEQ ID NO: 1933219 - RNA, 16 nt, Human
cuuuuuuagaguugau

SEQ ID NO: 1933220 - RNA, 21 nt, Human
cuuuguuuguugucagcugaa

SEQ ID NO: 1933221 - RNA, 15 nt, Human
cuuuucuguuugcua

SEQ ID NO: 1933222 - RNA, 13 nt, Human
cuuuugaacccag

SEQ ID NO: 1933223 - RNA, 14 nt, Human
cuuuugaacccagg

SEQ ID NO: 1933224 - RNA, 22 nt, Human
cuuuuguucuugguuuguaaau

SEQ ID NO: 1933225 - RNA, 18 nt, Human
cuuuugaacccaggaguu

SEQ ID NO: 1933226 - RNA, 20 nt, Human
cuuuugaacccaggaguuca

SEQ ID NO: 1933227 - RNA, 21 nt, Human
cuuuugaacgcccccccccac

SEQ ID NO: 1933228 - RNA, 21 nt, Human
cuuuugaauaaaaacuuugcu

SEQ ID NO: 1933229 - RNA, 19 nt, Human
cuuuuuaaaaauagacacu

SEQ ID NO: 1933230 - RNA, 13 nt, Human
cuuuuuaaaaaua

SEQ ID NO: 1933231 - RNA, 13 nt, Human
cuuuuuauuucug

SEQ ID NO: 1933232 - RNA, 16 nt, Human
cuuuuuauuucugcau

SEQ ID NO: 1933233 - RNA, 22 nt, Human
cuuuuugauuacaguguagcuu

SEQ ID NO: 1933234 - RNA, 13 nt, Human
cuuggacacugua

SEQ ID NO: 1933235 - RNA, 15 nt, Human
cuuggaagcuucugg

SEQ ID NO: 1933236 - RNA, 18 nt, Human
cuugggccacugugaaga

SEQ ID NO: 1933237 - RNA, 20 nt, Human
cuugggccacugugaagaga

SEQ ID NO: 1933238 - RNA, 15 nt, Human
cuugggcccucuggu

SEQ ID NO: 1933239 - RNA, 23 nt, Human
cuuguaauucuaaaugaauguuu

SEQ ID NO: 1933240 - RNA, 16 nt, Human
cuuguaauucuaaaug

SEQ ID NO: 1933241 - RNA, 17 nt, Human
cuuguacuuuauuuucu

SEQ ID NO: 1933242 - RNA, 15 nt, Human
cuuguaauucuaaau

SEQ ID NO: 1933243 - RNA, 13 nt, Human
cuuguaauucuaa

SEQ ID NO: 1933244 - RNA, 20 nt, Human
cuugguuuguaaauuaacuu

SEQ ID NO: 1933245 - RNA, 15 nt, Human
cuugguuuguaaauu

SEQ ID NO: 1933246 - RNA, 14 nt, Human
cuugguuuguaaau

SEQ ID NO: 1933247 - RNA, 14 nt, Human
cuuggggcuuccua

SEQ ID NO: 1933248 - RNA, 14 nt, Human
cuugggcccucugg

SEQ ID NO: 1933249 - RNA, 12 nt, Human
cuuguuucaauu

SEQ ID NO: 1933250 - RNA, 22 nt, Human
cuuguuucaauuccaccugcaa

SEQ ID NO: 1933251 - RNA, 17 nt, Human
cuuuaccuuuuuuauac

SEQ ID NO: 1933252 - RNA, 20 nt, Human
cuuuaccuuuuuuauacaua

SEQ ID NO: 1933253 - RNA, 19 nt, Human
cuuuaccuuuuuuauacau

SEQ ID NO: 1933254 - RNA, 16 nt, Human
cuuguuaagauaguua

SEQ ID NO: 1933255 - RNA, 16 nt, Human
cuuguggucccacccc

SEQ ID NO: 1933256 - RNA, 19 nt, Human
cuuguggucccaccccaca

SEQ ID NO: 1933257 - RNA, 22 nt, Human
cuuguguuuuuaacucaauauu

SEQ ID NO: 1933258 - RNA, 17 nt, Human
cuuguuaaugcuuucug

SEQ ID NO: 1933259 - RNA, 18 nt, Human
cuuguuaaugcuuucuga

SEQ ID NO: 1933260 - RNA, 15 nt, Human
cuuguggucccaccc

SEQ ID NO: 1933261 - RNA, 17 nt, Human
cuuguagccuuuugacu

SEQ ID NO: 1933262 - RNA, 14 nt, Human
cuuguagccuuuug

SEQ ID NO: 1933263 - RNA, 16 nt, Human
cuuguagccuuuugac

SEQ ID NO: 1933264 - RNA, 12 nt, Human
cuuguagccuuu

SEQ ID NO: 1933265 - RNA, 20 nt, Human
cuugcuugauuguauggugg

SEQ ID NO: 1933266 - RNA, 14 nt, Human
cuuggaagcuccgc

SEQ ID NO: 1933267 - RNA, 20 nt, Human
cuuggaagcuccgcuuucua

SEQ ID NO: 1933268 - RNA, 20 nt, Human
cuugcugcccugugcuccuc

SEQ ID NO: 1933269 - RNA, 22 nt, Human
cuugcucugcugacagacacag

SEQ ID NO: 1933270 - RNA, 23 nt, Human
cuugcucugcuugacaacaucug

SEQ ID NO: 1933271 - RNA, 13 nt, Human
cuugcucuggacc

SEQ ID NO: 1933272 - RNA, 14 nt, Human
cuugcucuggaccu

SEQ ID NO: 1933273 - RNA, 15 nt, Human
cuugcucuggaccug

SEQ ID NO: 1933274 - RNA, 16 nt, Human
cuugcucuggaccugc

SEQ ID NO: 1933275 - RNA, 17 nt, Human
cuugcucuggaccugcc

SEQ ID NO: 1933276 - RNA, 19 nt, Human
cuugcucuugaugccuggc

SEQ ID NO: 1933277 - RNA, 18 nt, Human
cuugcucuggaccugccc

SEQ ID NO: 1933278 - RNA, 17 nt, Human
cuugcucuugaugccug

SEQ ID NO: 1933279 - RNA, 18 nt, Human
cuugcucuugaugccugg

SEQ ID NO: 1933280 - RNA, 17 nt, Human
cuugcaugaggcuagug

SEQ ID NO: 1933281 - RNA, 13 nt, Human
cuugcaugaggcu

SEQ ID NO: 1933282 - RNA, 14 nt, Human
cuugcaugaggcua

SEQ ID NO: 1933283 - RNA, 18 nt, Human
cuugcccuggugccucac

SEQ ID NO: 1933284 - RNA, 17 nt, Human
cuugaggguugggcugg

SEQ ID NO: 1933285 - RNA, 15 nt, Human
cuugaggguugggcu

SEQ ID NO: 1933286 - RNA, 12 nt, Human
cuugagccuggg

SEQ ID NO: 1933287 - RNA, 15 nt, Human
cuugagccugggagg

SEQ ID NO: 1933288 - RNA, 12 nt, Human
cuucuggcucaa

SEQ ID NO: 1933289 - RNA, 16 nt, Human
cuucuggccucccaca

SEQ ID NO: 1933290 - RNA, 19 nt, Human
cuucuggccucccacagac

SEQ ID NO: 1933291 - RNA, 15 nt, Human
cuucuggccucccac

SEQ ID NO: 1933292 - RNA, 14 nt, Human
cuucuggccuccca

SEQ ID NO: 1933293 - RNA, 15 nt, Human
cuugagaaaaaaaga

SEQ ID NO: 1933294 - RNA, 12 nt, Human
cuugagaaaccu

SEQ ID NO: 1933295 - RNA, 13 nt, Human
cuugagaaaccuu

SEQ ID NO: 1933296 - RNA, 16 nt, Human
cuugagaaaaaaagaa

SEQ ID NO: 1933297 - RNA, 22 nt, Human
cuugagaaaaaaagaauaguug

SEQ ID NO: 1933298 - RNA, 11 nt, Human
cuugagaaacc

SEQ ID NO: 1933299 - RNA, 22 nt, Human
cuugagaaauauggacacuuaa

SEQ ID NO: 1933300 - RNA, 19 nt, Human
cuugagaacuuuauuucca

SEQ ID NO: 1933301 - RNA, 23 nt, Human
cuugagaagaccucaccuagaaa

SEQ ID NO: 1933302 - RNA, 17 nt, Human
cuugagaagauucuucc

SEQ ID NO: 1933303 - RNA, 21 nt, Human
cuugagaagauucuucccauu

SEQ ID NO: 1933304 - RNA, 17 nt, Human
cuugagacacggagccc

SEQ ID NO: 1933305 - RNA, 22 nt, Human
cuugagacacggagcccagccc

SEQ ID NO: 1933306 - RNA, 20 nt, Human
cuugcagacucuacagaggc

SEQ ID NO: 1933307 - RNA, 21 nt, Human
cuugcagacucuacagaggcc

SEQ ID NO: 1933308 - RNA, 18 nt, Human
cuugcaauggcagccuug

SEQ ID NO: 1933309 - RNA, 17 nt, Human
cuugcaauggcagccuu

SEQ ID NO: 1933310 - RNA, 16 nt, Human
cuugcaauggcagccu

SEQ ID NO: 1933311 - RNA, 15 nt, Human
cuugcaauggcagcc

SEQ ID NO: 1933312 - RNA, 21 nt, Human
cuugaguugauucagcucugc

SEQ ID NO: 1933313 - RNA, 20 nt, Human
cuugaguugauucagcucug

SEQ ID NO: 1933314 - RNA, 18 nt, Human
cuugaguugauucagcuc

SEQ ID NO: 1933315 - RNA, 19 nt, Human
cuugaguugauucagcucu

SEQ ID NO: 1933316 - RNA, 17 nt, Human
gacacgggcagccuggc

SEQ ID NO: 1933317 - RNA, 20 nt, Human
gacacgggcagccuggcucc

SEQ ID NO: 1933318 - RNA, 15 nt, Human
gacacggagcccagc

SEQ ID NO: 1933319 - RNA, 22 nt, Human
gacagacacaggcccggcucca

SEQ ID NO: 1933320 - RNA, 20 nt, Human
gacagacacaggcccggcuc

SEQ ID NO: 1933321 - RNA, 17 nt, Human
gacagacacaggcccgg

SEQ ID NO: 1933322 - RNA, 16 nt, Human
gacacuagaagauuuu

SEQ ID NO: 1933323 - RNA, 22 nt, Human
gacacgaauauugcugauggug

SEQ ID NO: 1933324 - RNA, 14 nt, Human
gaauuucccaggac

SEQ ID NO: 1933325 - RNA, 15 nt, Human
gaauuucccaggacc

SEQ ID NO: 1933326 - RNA, 16 nt, Human
gaauuucccaggaccc

SEQ ID NO: 1933327 - RNA, 17 nt, Human
gaauuucccaggacccu

SEQ ID NO: 1933328 - RNA, 22 nt, Human
gaauuucccaggacccugaagg

SEQ ID NO: 1933329 - RNA, 22 nt, Human
gaauuucccaaagcagugcaug

SEQ ID NO: 1933330 - RNA, 16 nt, Human
gaauuucccaaagcag

SEQ ID NO: 1933331 - RNA, 18 nt, Human
gaauuucccaaagcagug

SEQ ID NO: 1933332 - RNA, 16 nt, Human
gacagagugagacucu

SEQ ID NO: 1933333 - RNA, 21 nt, Human
gacagagucucacuguugccc

SEQ ID NO: 1933334 - RNA, 19 nt, Human
gacagagugagacucuguc

SEQ ID NO: 1933335 - RNA, 23 nt, Human
gacagaggcagccccauucugcc

SEQ ID NO: 1933336 - RNA, 13 nt, Human
gacagaggcccca

SEQ ID NO: 1933337 - RNA, 18 nt, Human
gacagaggccccagccuc

SEQ ID NO: 1933338 - RNA, 19 nt, Human
gacagaggccccagccucc

SEQ ID NO: 1933339 - RNA, 13 nt, Human
gacagagggggug

SEQ ID NO: 1933340 - RNA, 12 nt, Human
gacagaggcagc

SEQ ID NO: 1933341 - RNA, 20 nt, Human
gacagagcuacacaggggaa

SEQ ID NO: 1933342 - RNA, 23 nt, Human
gacagacucacaaccugaaccua

SEQ ID NO: 1933343 - RNA, 17 nt, Human
gacaguucauauguacc

SEQ ID NO: 1933344 - RNA, 15 nt, Human
gacaguucauaugua

SEQ ID NO: 1933345 - RNA, 19 nt, Human
gacaguugggugagaacaa

SEQ ID NO: 1933346 - RNA, 18 nt, Human
gacaguugggugagaaca

SEQ ID NO: 1933347 - RNA, 22 nt, Human
gacaggcauguucucugaggac

SEQ ID NO: 1933348 - RNA, 16 nt, Human
gacaggcaaauaaaag

SEQ ID NO: 1933349 - RNA, 23 nt, Human
gacaucaacugcaucaagaugug

SEQ ID NO: 1933350 - RNA, 16 nt, Human
gacaucaacugcauca

SEQ ID NO: 1933351 - RNA, 18 nt, Human
gacaggcaagcaccuccu

SEQ ID NO: 1933352 - RNA, 17 nt, Human
gacaggcaagcaccucc

SEQ ID NO: 1933353 - RNA, 13 nt, Human
gacaggcaagcac

SEQ ID NO: 1933354 - RNA, 19 nt, Human
gacaggcaaugcuggcugu

SEQ ID NO: 1933355 - RNA, 18 nt, Human
gacaggcaaugcuggcug

SEQ ID NO: 1933356 - RNA, 21 nt, Human
gacaggcaagcaccuccugcc

SEQ ID NO: 1933357 - RNA, 20 nt, Human
gacaggcaagcaccuccugc

SEQ ID NO: 1933358 - RNA, 21 nt, Human
gacaggcauguucucugagga

SEQ ID NO: 1933359 - RNA, 20 nt, Human
gacaggcauguucucugagg

SEQ ID NO: 1933360 - RNA, 23 nt, Human
gacaggcaaugcuggcuguuggc

SEQ ID NO: 1933361 - RNA, 24 nt, Human
gacaggcaaugcuggcuguuggcu

SEQ ID NO: 1933362 - RNA, 16 nt, Human
gaccacaccugccucu

SEQ ID NO: 1933363 - RNA, 12 nt, Human
gaccacaccugc

SEQ ID NO: 1933364 - RNA, 12 nt, Human
gaccacagcaca

SEQ ID NO: 1933365 - RNA, 14 nt, Human
gaccacagcacagc

SEQ ID NO: 1933366 - RNA, 15 nt, Human
gaccacagcacagcc

SEQ ID NO: 1933367 - RNA, 16 nt, Human
gaccacagcacagcca

SEQ ID NO: 1933368 - RNA, 21 nt, Human
gaccaauauuguacaguuuuu

SEQ ID NO: 1933369 - RNA, 19 nt, Human
gaccaauauuguacaguuu

SEQ ID NO: 1933370 - RNA, 18 nt, Human
gaccaauauuguacaguu

SEQ ID NO: 1933371 - RNA, 17 nt, Human
gaccaauauuguacagu

SEQ ID NO: 1933372 - RNA, 18 nt, Human
gaccacaaaacuuuucua

SEQ ID NO: 1933373 - RNA, 13 nt, Human
gacaucagcuggu

SEQ ID NO: 1933374 - RNA, 16 nt, Human
gaccaaggagaugaag

SEQ ID NO: 1933375 - RNA, 16 nt, Human
gaccacguuucuaaag

SEQ ID NO: 1933376 - RNA, 21 nt, Human
gaccagacaccuugacagggc

SEQ ID NO: 1933377 - RNA, 22 nt, Human
gaccagacaccuugacagggca

SEQ ID NO: 1933378 - RNA, 18 nt, Human
gaccacugcagaagacag

SEQ ID NO: 1933379 - RNA, 16 nt, Human
gaccacugcagaagac

SEQ ID NO: 1933380 - RNA, 24 nt, Human
gaccagacaccuugacagggcaca

SEQ ID NO: 1933381 - RNA, 23 nt, Human
gaccagacaccuugacagggcac

SEQ ID NO: 1933382 - RNA, 21 nt, Human
gaccagagcugccaccugccu

SEQ ID NO: 1933383 - RNA, 20 nt, Human
gaccagcaccaucucuccuc

SEQ ID NO: 1933384 - RNA, 21 nt, Human
gaccagcaccaucucuccucc

SEQ ID NO: 1933385 - RNA, 13 nt, Human
gaccagcaaauac

SEQ ID NO: 1933386 - RNA, 21 nt, Human
gaccccgacgccacagcccag

SEQ ID NO: 1933387 - RNA, 10 nt, Human
gacccugagg

SEQ ID NO: 1933388 - RNA, 18 nt, Human
gaccccgacgccacagcc

SEQ ID NO: 1933389 - RNA, 17 nt, Human
gaccccgacgccacagc

SEQ ID NO: 1933390 - RNA, 19 nt, Human
gacccccgcccccugcccu

SEQ ID NO: 1933391 - RNA, 12 nt, Human
gacccccuggag

SEQ ID NO: 1933392 - RNA, 11 nt, Human
gacccugaggc

SEQ ID NO: 1933393 - RNA, 12 nt, Human
gacccugaggcc

SEQ ID NO: 1933394 - RNA, 16 nt, Human
gacccugaggcccaga

SEQ ID NO: 1933395 - RNA, 17 nt, Human
gacccugcccugugggc

SEQ ID NO: 1933396 - RNA, 20 nt, Human
gacccugcccugugggcccc

SEQ ID NO: 1933397 - RNA, 22 nt, Human
gacccugcccugugggccccca

SEQ ID NO: 1933398 - RNA, 13 nt, Human
gacccccagcucc

SEQ ID NO: 1933399 - RNA, 17 nt, Human
gacccccagcuccggcc

SEQ ID NO: 1933400 - RNA, 23 nt, Human
gacccccagcuccggccuguccu

SEQ ID NO: 1933401 - RNA, 11 nt, Human
gacccccgccc

SEQ ID NO: 1933402 - RNA, 15 nt, Human
gacccccgcccccug

SEQ ID NO: 1933403 - RNA, 16 nt, Human
gacccccgcccccugc

SEQ ID NO: 1933404 - RNA, 18 nt, Human
gacccccgcccccugccc

SEQ ID NO: 1933405 - RNA, 19 nt, Human
gacccaaaaggcagaagca

SEQ ID NO: 1933406 - RNA, 18 nt, Human
gacccaaaaggcagaagc

SEQ ID NO: 1933407 - RNA, 23 nt, Human
gaccagcagcgccuuucccaacu

SEQ ID NO: 1933408 - RNA, 16 nt, Human
gaccagcagcgccuuu

SEQ ID NO: 1933409 - RNA, 20 nt, Human
gaccagcagcgccuuuccca

SEQ ID NO: 1933410 - RNA, 13 nt, Human
gaccagcagcgcc

SEQ ID NO: 1933411 - RNA, 14 nt, Human
gaccagcagcgccu

SEQ ID NO: 1933412 - RNA, 20 nt, Human
gacccaaaaggcagaagcaa

SEQ ID NO: 1933413 - RNA, 17 nt, Human
gacccagacacaucgca

SEQ ID NO: 1933414 - RNA, 13 nt, Human
gacccaugcugcc

SEQ ID NO: 1933415 - RNA, 23 nt, Human
gacccaugaguuggggucuggca

SEQ ID NO: 1933416 - RNA, 18 nt, Human
gacccaugcugcccugug

SEQ ID NO: 1933417 - RNA, 19 nt, Human
gacccaugcugcccuguga

SEQ ID NO: 1933418 - RNA, 20 nt, Human
gacccaugcugcccugugag

SEQ ID NO: 1933419 - RNA, 15 nt, Human
gacccagugccccca

SEQ ID NO: 1933420 - RNA, 23 nt, Human
gacccagccccuugagaaaccuu

SEQ ID NO: 1933421 - RNA, 22 nt, Human
gacccagccccuugagaaaccu

SEQ ID NO: 1933422 - RNA, 16 nt, Human
gacccagugcccccac

SEQ ID NO: 1933423 - RNA, 17 nt, Human
gacccagugcccccacu

SEQ ID NO: 1933424 - RNA, 20 nt, Human
gacccagugcccccacugac

SEQ ID NO: 1933425 - RNA, 15 nt, Human
gacugaccuggucca

SEQ ID NO: 1933426 - RNA, 22 nt, Human
gacugaccaauauuguacaguu

SEQ ID NO: 1933427 - RNA, 21 nt, Human
gacugaccaauauuguacagu

SEQ ID NO: 1933428 - RNA, 19 nt, Human
gacugaccugguccacagg

SEQ ID NO: 1933429 - RNA, 20 nt, Human
gacugaccugguccacaggg

SEQ ID NO: 1933430 - RNA, 22 nt, Human
gacugaccugguccacagggca

SEQ ID NO: 1933431 - RNA, 23 nt, Human
gacugaccugguccacagggcac

SEQ ID NO: 1933432 - RNA, 11 nt, Human
gacugagaaau

SEQ ID NO: 1933433 - RNA, 15 nt, Human
gacucuacagaggcc

SEQ ID NO: 1933434 - RNA, 16 nt, Human
gacugaauuucuuuug

SEQ ID NO: 1933435 - RNA, 21 nt, Human
gacucuacagaggccaugggc

SEQ ID NO: 1933436 - RNA, 15 nt, Human
gacuacaggcaccca

SEQ ID NO: 1933437 - RNA, 13 nt, Human
gacuacaggcacc

SEQ ID NO: 1933438 - RNA, 18 nt, Human
gacuacaggcacccacca

SEQ ID NO: 1933439 - RNA, 18 nt, Human
gacuccugcaggcagcca

SEQ ID NO: 1933440 - RNA, 19 nt, Human
gacuccugcaggcagccag

SEQ ID NO: 1933441 - RNA, 20 nt, Human
gacuccugcaggcagccagg

SEQ ID NO: 1933442 - RNA, 21 nt, Human
gacuccugcaggcagccaggc

SEQ ID NO: 1933443 - RNA, 15 nt, Human
gacugaucaggaccu

SEQ ID NO: 1933444 - RNA, 13 nt, Human
gacugagaaauuu

SEQ ID NO: 1933445 - RNA, 19 nt, Human
gacugaccuugaugagcug

SEQ ID NO: 1933446 - RNA, 14 nt, Human
gacugaggccugag

SEQ ID NO: 1933447 - RNA, 13 nt, Human
gacugaggccuga

SEQ ID NO: 1933448 - RNA, 18 nt, Human
gacugaguacguugugca

SEQ ID NO: 1933449 - RNA, 16 nt, Human
gacugaggggagggga

SEQ ID NO: 1933450 - RNA, 23 nt, Human
gacugaggccugagcgcuccugc

SEQ ID NO: 1933451 - RNA, 21 nt, Human
gacugaggccugagcgcuccu

SEQ ID NO: 1933452 - RNA, 23 nt, Human
gacuggccaagguuuggggaaga

SEQ ID NO: 1933453 - RNA, 12 nt, Human
gacuucaucccu

SEQ ID NO: 1933454 - RNA, 20 nt, Human
gacuucaucccucuggggcu

SEQ ID NO: 1933455 - RNA, 16 nt, Human
gacuuauuuauauaaa

SEQ ID NO: 1933456 - RNA, 23 nt, Human
gacuuacuguacaugaaaacaca

SEQ ID NO: 1933457 - RNA, 18 nt, Human
gacuuacuguacaugaaa

SEQ ID NO: 1933458 - RNA, 12 nt, Human
gacuuacuguac

SEQ ID NO: 1933459 - RNA, 16 nt, Human
gacuuacuguacauga

SEQ ID NO: 1933460 - RNA, 15 nt, Human
gacuuacuguacaug

SEQ ID NO: 1933461 - RNA, 22 nt, Human
gaccuggcacuggaugcagaaa

SEQ ID NO: 1933462 - RNA, 18 nt, Human
gaccuggcacuggaugca

SEQ ID NO: 1933463 - RNA, 10 nt, Human
gaccuggcag

SEQ ID NO: 1933464 - RNA, 15 nt, Human
gaccuggcagcucug

SEQ ID NO: 1933465 - RNA, 15 nt, Human
gacccuugugguccc

SEQ ID NO: 1933466 - RNA, 16 nt, Human
gaccuggcagcucugg

SEQ ID NO: 1933467 - RNA, 19 nt, Human
gacccuugccgucuaccug

SEQ ID NO: 1933468 - RNA, 20 nt, Human
gacccuugccgucuaccuga

SEQ ID NO: 1933469 - RNA, 23 nt, Human
gacccuugccgucuaccugaggg

SEQ ID NO: 1933470 - RNA, 12 nt, Human
gaccuguaauca

SEQ ID NO: 1933471 - RNA, 15 nt, Human
gaccugucuccuggc

SEQ ID NO: 1933472 - RNA, 16 nt, Human
gaccugucuccuggcg

SEQ ID NO: 1933473 - RNA, 17 nt, Human
gaccugguccacagggc

SEQ ID NO: 1933474 - RNA, 18 nt, Human
gaccugguccacagggca

SEQ ID NO: 1933475 - RNA, 19 nt, Human
gaccugguccacagggcac

SEQ ID NO: 1933476 - RNA, 19 nt, Human
gaccuguggccaaguucuu

SEQ ID NO: 1933477 - RNA, 23 nt, Human
gaccugugagcccagcuggguca

SEQ ID NO: 1933478 - RNA, 15 nt, Human
gaccugugagcccag

SEQ ID NO: 1933479 - RNA, 16 nt, Human
gaccugugagcccagc

SEQ ID NO: 1933480 - RNA, 19 nt, Human
gaccugugagcccagcugg

SEQ ID NO: 1933481 - RNA, 18 nt, Human
gaccuguuagcagacagg

SEQ ID NO: 1933482 - RNA, 19 nt, Human
gaccuguuagcagacaggc

SEQ ID NO: 1933483 - RNA, 17 nt, Human
gaccuguuagcagacag

SEQ ID NO: 1933484 - RNA, 14 nt, Human
gaccuugaacuggg

SEQ ID NO: 1933485 - RNA, 15 nt, Human
gaccuucuaggaagc

SEQ ID NO: 1933486 - RNA, 20 nt, Human
gaccuucuccuucaccuuug

SEQ ID NO: 1933487 - RNA, 21 nt, Human
gaccuucuccuucaccuuugu

SEQ ID NO: 1933488 - RNA, 14 nt, Human
gaccuucuccuuca

SEQ ID NO: 1933489 - RNA, 19 nt, Human
gaccuucgggcugugcccg

SEQ ID NO: 1933490 - RNA, 18 nt, Human
gaccuucgggcugugccc

SEQ ID NO: 1933491 - RNA, 15 nt, Human
gaccuucuccuucac

SEQ ID NO: 1933492 - RNA, 16 nt, Human
gaccuucuccuucacc

SEQ ID NO: 1933493 - RNA, 16 nt, Human
gaccuucgggcugugc

SEQ ID NO: 1933494 - RNA, 18 nt, Human
gaccuuccaagagccuga

SEQ ID NO: 1933495 - RNA, 17 nt, Human
gaccuuccaagagccug

SEQ ID NO: 1933496 - RNA, 16 nt, Human
gaccuuccaagagccu

SEQ ID NO: 1933497 - RNA, 13 nt, Human
gaccuuaggccuu

SEQ ID NO: 1933498 - RNA, 15 nt, Human
gaccuuaggccuucc

SEQ ID NO: 1933499 - RNA, 16 nt, Human
gaccuuaggccuuccu

SEQ ID NO: 1933500 - RNA, 18 nt, Human
gaccuuaggccuuccucu

SEQ ID NO: 1933501 - RNA, 21 nt, Human
gaccuuaggccuuccucucuc

SEQ ID NO: 1933502 - RNA, 12 nt, Human
gacggcuccacu

SEQ ID NO: 1933503 - RNA, 18 nt, Human
gacggcuccacuaggacu

SEQ ID NO: 1933504 - RNA, 12 nt, Human
gacggcugggca

SEQ ID NO: 1933505 - RNA, 13 nt, Human
gacggcugggcac

SEQ ID NO: 1933506 - RNA, 18 nt, Human
gacggcugggcacacgcc

SEQ ID NO: 1933507 - RNA, 17 nt, Human
gacgugauuuugcugua

SEQ ID NO: 1933508 - RNA, 12 nt, Human
gacguggcucag

SEQ ID NO: 1933509 - RNA, 14 nt, Human
gacguggcucagcc

SEQ ID NO: 1933510 - RNA, 16 nt, Human
gacgugauuuugcugu

SEQ ID NO: 1933511 - RNA, 13 nt, Human
gacggagucccac

SEQ ID NO: 1933512 - RNA, 21 nt, Human
gacgcugugcugcccugccca

SEQ ID NO: 1933513 - RNA, 22 nt, Human
gacgcugugcugcccugcccac

SEQ ID NO: 1933514 - RNA, 22 nt, Human
gaccuuuaagagaaaugagcug

SEQ ID NO: 1933515 - RNA, 11 nt, Human
gaccuuucaau

SEQ ID NO: 1933516 - RNA, 19 nt, Human
gaccuuucaauaggaaaaa

SEQ ID NO: 1933517 - RNA, 20 nt, Human
gaccuuucaauaggaaaaac

SEQ ID NO: 1933518 - RNA, 13 nt, Human
gacgugggcuggg

SEQ ID NO: 1933519 - RNA, 20 nt, Human
gacgugggcugggcccacaa

SEQ ID NO: 1933520 - RNA, 15 nt, Human
gacguggcucagcca

SEQ ID NO: 1933521 - RNA, 16 nt, Human
gacguggcucagccag

SEQ ID NO: 1933522 - RNA, 11 nt, Human
gacguguuaug

SEQ ID NO: 1933523 - RNA, 14 nt, Human
gacguguuaugacu

SEQ ID NO: 1933524 - RNA, 15 nt, Human
gacguguuaugacuc

SEQ ID NO: 1933525 - RNA, 18 nt, Human
gacguuuacaagcccccc

SEQ ID NO: 1933526 - RNA, 16 nt, Human
gacuaacuugucuuug

SEQ ID NO: 1933527 - RNA, 23 nt, Human
gacuaacuugucuuuggacccug

SEQ ID NO: 1933528 - RNA, 12 nt, Human
gacuaaaugaaa

SEQ ID NO: 1933529 - RNA, 18 nt, Human
gacuaacuaucaaauaga

SEQ ID NO: 1933530 - RNA, 18 nt, Human
gacuaaccccaccacacc

SEQ ID NO: 1933531 - RNA, 18 nt, Human
gaaauuguauuacaaauc

SEQ ID NO: 1933532 - RNA, 16 nt, Human
gaaauuuauaaacuuu

SEQ ID NO: 1933533 - RNA, 17 nt, Human
gaaauuuauaaacuuuu

SEQ ID NO: 1933534 - RNA, 13 nt, Human
gaacacucugaga

SEQ ID NO: 1933535 - RNA, 14 nt, Human
gaacacucugagac

SEQ ID NO: 1933536 - RNA, 16 nt, Human
gaaauuguauuacaaa

SEQ ID NO: 1933537 - RNA, 15 nt, Human
gaacacucugagacu

SEQ ID NO: 1933538 - RNA, 16 nt, Human
gaacacucuuuugcuu

SEQ ID NO: 1933539 - RNA, 18 nt, Human
gaacacucuuuugcuuua

SEQ ID NO: 1933540 - RNA, 20 nt, Human
gaacagugauuaccagggac

SEQ ID NO: 1933541 - RNA, 16 nt, Human
gaacagugauuaccag

SEQ ID NO: 1933542 - RNA, 21 nt, Human
gaacagcggcuggacuuggag

SEQ ID NO: 1933543 - RNA, 15 nt, Human
gaacauaaagcaaau

SEQ ID NO: 1933544 - RNA, 17 nt, Human
gaacauccaaccuuccc

SEQ ID NO: 1933545 - RNA, 18 nt, Human
gaacauccaaccuuccca

SEQ ID NO: 1933546 - RNA, 22 nt, Human
gaacauaaagcaaauagacaca

SEQ ID NO: 1933547 - RNA, 16 nt, Human
gaacucaacuuugaca

SEQ ID NO: 1933548 - RNA, 13 nt, Human
gaacucagaucca

SEQ ID NO: 1933549 - RNA, 14 nt, Human
gaacucagauccag

SEQ ID NO: 1933550 - RNA, 14 nt, Human
gaacucacuggggc

SEQ ID NO: 1933551 - RNA, 16 nt, Human
gaacucacuggggccu

SEQ ID NO: 1933552 - RNA, 15 nt, Human
gaacucagauccagg

SEQ ID NO: 1933553 - RNA, 16 nt, Human
gaacucagauccaggg

SEQ ID NO: 1933554 - RNA, 18 nt, Human
gaacucagauccagggac

SEQ ID NO: 1933555 - RNA, 19 nt, Human
gaacucagauccagggaca

SEQ ID NO: 1933556 - RNA, 21 nt, Human
gaacucagauccagggacaga

SEQ ID NO: 1933557 - RNA, 14 nt, Human
gaacuacugaggau

SEQ ID NO: 1933558 - RNA, 23 nt, Human
gaacuacaaacaaaauuucuauu

SEQ ID NO: 1933559 - RNA, 22 nt, Human
gaacuacaaacaaaauuucuau

SEQ ID NO: 1933560 - RNA, 22 nt, Human
gaaccuuuugagugccuuacac

SEQ ID NO: 1933561 - RNA, 18 nt, Human
gaacgauauguagcagaa

SEQ ID NO: 1933562 - RNA, 21 nt, Human
gaacgauauguagcagaaagg

SEQ ID NO: 1933563 - RNA, 18 nt, Human
gaacgauuuagaaagaag

SEQ ID NO: 1933564 - RNA, 15 nt, Human
gaacguuuuuccugu

SEQ ID NO: 1933565 - RNA, 17 nt, Human
gaacuaaacucauuuau

SEQ ID NO: 1933566 - RNA, 12 nt, Human
gaacguuuuucc

SEQ ID NO: 1933567 - RNA, 18 nt, Human
gaacgcccccccccaccc

SEQ ID NO: 1933568 - RNA, 19 nt, Human
gaacgcccccccccacccc

SEQ ID NO: 1933569 - RNA, 20 nt, Human
gaacgcccccccccaccccu

SEQ ID NO: 1933570 - RNA, 18 nt, Human
gaaccuuuugagugccuu

SEQ ID NO: 1933571 - RNA, 19 nt, Human
gaaccuuuugagugccuua

SEQ ID NO: 1933572 - RNA, 21 nt, Human
gaaccuuuugagugccuuaca

SEQ ID NO: 1933573 - RNA, 14 nt, Human
gaaccucagccugg

SEQ ID NO: 1933574 - RNA, 15 nt, Human
gaaccucagccuggc

SEQ ID NO: 1933575 - RNA, 17 nt, Human
gaaccucagccuggcca

SEQ ID NO: 1933576 - RNA, 18 nt, Human
gaaccucagccuggccag

SEQ ID NO: 1933577 - RNA, 19 nt, Human
gaaccucagccuggccaga

SEQ ID NO: 1933578 - RNA, 21 nt, Human
gaaccucagccuggccagaca

SEQ ID NO: 1933579 - RNA, 17 nt, Human
gaacauugcaauagaaa

SEQ ID NO: 1933580 - RNA, 15 nt, Human
gaacauugcaauaga

SEQ ID NO: 1933581 - RNA, 13 nt, Human
gaacauugcaaua

SEQ ID NO: 1933582 - RNA, 14 nt, Human
gaacaucccuccug

SEQ ID NO: 1933583 - RNA, 12 nt, Human
gaaccucagccu

SEQ ID NO: 1933584 - RNA, 13 nt, Human
gaaccucagccug

SEQ ID NO: 1933585 - RNA, 11 nt, Human
gaaccaaagcg

SEQ ID NO: 1933586 - RNA, 16 nt, Human
gaaccuauuucucuuu

SEQ ID NO: 1933587 - RNA, 17 nt, Human
gaaccuauuucucuuuc

SEQ ID NO: 1933588 - RNA, 21 nt, Human
gaaccuauuucucuuucuuua

SEQ ID NO: 1933589 - RNA, 18 nt, Human
gaaccuauuucucuuucu

SEQ ID NO: 1933590 - RNA, 18 nt, Human
gaagauguagaggagaaa

SEQ ID NO: 1933591 - RNA, 15 nt, Human
gaagauacugaaaua

SEQ ID NO: 1933592 - RNA, 20 nt, Human
gaagauaauauuaaggaaga

SEQ ID NO: 1933593 - RNA, 21 nt, Human
gaagauaaguguauuuuucaa

SEQ ID NO: 1933594 - RNA, 20 nt, Human
gaagagguuuuaaagcuucc

SEQ ID NO: 1933595 - RNA, 12 nt, Human
gaagagggcugc

SEQ ID NO: 1933596 - RNA, 18 nt, Human
gaagcauuuacuuugugu

SEQ ID NO: 1933597 - RNA, 16 nt, Human
gaagccacaggccuga

SEQ ID NO: 1933598 - RNA, 15 nt, Human
gaagccacaggccug

SEQ ID NO: 1933599 - RNA, 20 nt, Human
gaagccaauucagacaggca

SEQ ID NO: 1933600 - RNA, 18 nt, Human
gaagccaauucagacagg

SEQ ID NO: 1933601 - RNA, 17 nt, Human
gaagcauuuacuuugug

SEQ ID NO: 1933602 - RNA, 20 nt, Human
gaagccagcaggcucucagg

SEQ ID NO: 1933603 - RNA, 18 nt, Human
gaagccacaggccugaga

SEQ ID NO: 1933604 - RNA, 17 nt, Human
gaagccacaggccugag

SEQ ID NO: 1933605 - RNA, 19 nt, Human
gaagccagcaggcucucag

SEQ ID NO: 1933606 - RNA, 21 nt, Human
gaagccagcaggcucucaggc

SEQ ID NO: 1933607 - RNA, 22 nt, Human
gaagccagcaggcucucaggcc

SEQ ID NO: 1933608 - RNA, 13 nt, Human
gaagcccaggaaa

SEQ ID NO: 1933609 - RNA, 15 nt, Human
gaagcccaggaaagg

SEQ ID NO: 1933610 - RNA, 16 nt, Human
gaagcccaggaaaggc

SEQ ID NO: 1933611 - RNA, 19 nt, Human
gaagcccaggaaaggcucc

SEQ ID NO: 1933612 - RNA, 23 nt, Human
gaagcccuucuaccuuccugcaa

SEQ ID NO: 1933613 - RNA, 22 nt, Human
gaagcccccagcuaagaaccug

SEQ ID NO: 1933614 - RNA, 20 nt, Human
gaagcccccaccgugggcag

SEQ ID NO: 1933615 - RNA, 14 nt, Human
gaagcccccagcua

SEQ ID NO: 1933616 - RNA, 17 nt, Human
gaagcccccagcuaaga

SEQ ID NO: 1933617 - RNA, 21 nt, Human
gaagcccccagcuaagaaccu

SEQ ID NO: 1933618 - RNA, 14 nt, Human
gaagacuuuggaaa

SEQ ID NO: 1933619 - RNA, 17 nt, Human
gaagacuuuggaaagag

SEQ ID NO: 1933620 - RNA, 20 nt, Human
gaagacuuuucuuucagcca

SEQ ID NO: 1933621 - RNA, 12 nt, Human
gaagagaaacca

SEQ ID NO: 1933622 - RNA, 19 nt, Human
gaagagaaugcacaaacag

SEQ ID NO: 1933623 - RNA, 17 nt, Human
gaagagaagggcagggc

SEQ ID NO: 1933624 - RNA, 12 nt, Human
gaagagccacag

SEQ ID NO: 1933625 - RNA, 13 nt, Human
gaagagccacagu

SEQ ID NO: 1933626 - RNA, 21 nt, Human
gaagagaguccauauuucaau

SEQ ID NO: 1933627 - RNA, 22 nt, Human
gaacucaucuagguaaauuaca

SEQ ID NO: 1933628 - RNA, 19 nt, Human
gaagaaccaguccccccac

SEQ ID NO: 1933629 - RNA, 22 nt, Human
gaagaaccaguccccccacccu

SEQ ID NO: 1933630 - RNA, 19 nt, Human
gaagaaaaaaggccuugaa

SEQ ID NO: 1933631 - RNA, 20 nt, Human
gaacucaucuagguaaauua

SEQ ID NO: 1933632 - RNA, 21 nt, Human
gaacucaucuagguaaauuac

SEQ ID NO: 1933633 - RNA, 23 nt, Human
gaacuuugaccucugcagcaaua

SEQ ID NO: 1933634 - RNA, 11 nt, Human
gaagacuuugg

SEQ ID NO: 1933635 - RNA, 13 nt, Human
gaagacuuuggaa

SEQ ID NO: 1933636 - RNA, 15 nt, Human
gaagacuggaagcua

SEQ ID NO: 1933637 - RNA, 16 nt, Human
gaagacuggaagcuaa

SEQ ID NO: 1933638 - RNA, 17 nt, Human
gaagacuggaagcuaau

SEQ ID NO: 1933639 - RNA, 23 nt, Human
gaagaacggggcucuucucauuu

SEQ ID NO: 1933640 - RNA, 22 nt, Human
gaagaacggggcucuucucauu

SEQ ID NO: 1933641 - RNA, 20 nt, Human
gaagaacggggcucuucuca

SEQ ID NO: 1933642 - RNA, 13 nt, Human
gaagaacggggcu

SEQ ID NO: 1933643 - RNA, 23 nt, Human
gaagucucuuuuuuuggcccagg

SEQ ID NO: 1933644 - RNA, 21 nt, Human
gaaguuucugccgcagcccug

SEQ ID NO: 1933645 - RNA, 15 nt, Human
gaagucuuagaugua

SEQ ID NO: 1933646 - RNA, 20 nt, Human
gaaguuucugccgcagcccu

SEQ ID NO: 1933647 - RNA, 23 nt, Human
gaaguaguggagccccugcucug

SEQ ID NO: 1933648 - RNA, 14 nt, Human
gaaguauccuucag

SEQ ID NO: 1933649 - RNA, 16 nt, Human
gaaguauccuucagcc

SEQ ID NO: 1933650 - RNA, 12 nt, Human
gaaguaugggaa

SEQ ID NO: 1933651 - RNA, 15 nt, Human
gaaguacuggagaaa

SEQ ID NO: 1933652 - RNA, 18 nt, Human
gaaguacuauaauuuacc

SEQ ID NO: 1933653 - RNA, 22 nt, Human
gaaguaauaugcacacauuuuu

SEQ ID NO: 1933654 - RNA, 18 nt, Human
gaaggugcugacggccag

SEQ ID NO: 1933655 - RNA, 19 nt, Human
gaaggugcugacggccagg

SEQ ID NO: 1933656 - RNA, 21 nt, Human
gaaggugcugacggccaggga

SEQ ID NO: 1933657 - RNA, 16 nt, Human
gaagggggcugggaca

SEQ ID NO: 1933658 - RNA, 19 nt, Human
gaagggggcugggacaugg

SEQ ID NO: 1933659 - RNA, 22 nt, Human
gaagggguaggauuacuaggug

SEQ ID NO: 1933660 - RNA, 19 nt, Human
gaaggggguggugucucca

SEQ ID NO: 1933661 - RNA, 12 nt, Human
gaaggggguggu

SEQ ID NO: 1933662 - RNA, 14 nt, Human
gaagcuaagcugca

SEQ ID NO: 1933663 - RNA, 14 nt, Human
gaagcggcuggcag

SEQ ID NO: 1933664 - RNA, 22 nt, Human
gaauagcugggacuacaggugu

SEQ ID NO: 1933665 - RNA, 20 nt, Human
gaauacucuuauaucuauau

SEQ ID NO: 1933666 - RNA, 23 nt, Human
gaauagcugggacuacaggugug

SEQ ID NO: 1933667 - RNA, 13 nt, Human
gaauaccuguccc

SEQ ID NO: 1933668 - RNA, 15 nt, Human
gaauaccuguccccc

SEQ ID NO: 1933669 - RNA, 13 nt, Human
gaauaccuguggu

SEQ ID NO: 1933670 - RNA, 17 nt, Human
gaauauuugaauguaug

SEQ ID NO: 1933671 - RNA, 19 nt, Human
gaauauuugguuuuccugu

SEQ ID NO: 1933672 - RNA, 20 nt, Human
gaauauuuucauuaaaagcu

SEQ ID NO: 1933673 - RNA, 21 nt, Human
gaauauuuucauuaaaagcua

SEQ ID NO: 1933674 - RNA, 21 nt, Human
gaauacagaggcaacugcauu

SEQ ID NO: 1933675 - RNA, 17 nt, Human
gaauaauacaguaucuc

SEQ ID NO: 1933676 - RNA, 16 nt, Human
gaauaauaaauauuua

SEQ ID NO: 1933677 - RNA, 20 nt, Human
gaaguuugagaucagccugg

SEQ ID NO: 1933678 - RNA, 13 nt, Human
gaaguuuuacauu

SEQ ID NO: 1933679 - RNA, 18 nt, Human
gaauaacauguaauuaag

SEQ ID NO: 1933680 - RNA, 19 nt, Human
gaauaacauguaauuaagu

SEQ ID NO: 1933681 - RNA, 16 nt, Human
gaauaaaaacuuugcu

SEQ ID NO: 1933682 - RNA, 23 nt, Human
gaaugaaccacaucuugcucugc

SEQ ID NO: 1933683 - RNA, 15 nt, Human
gaaugaaccuucugg

SEQ ID NO: 1933684 - RNA, 17 nt, Human
gaaugaaccuucuggcc

SEQ ID NO: 1933685 - RNA, 18 nt, Human
gaaugaaccacaucuugc

SEQ ID NO: 1933686 - RNA, 22 nt, Human
gaaugaaccacaucuugcucug

SEQ ID NO: 1933687 - RNA, 11 nt, Human
gaaugcagugg

SEQ ID NO: 1933688 - RNA, 19 nt, Human
gaaugaagauacugaaaua

SEQ ID NO: 1933689 - RNA, 21 nt, Human
gaaugaagauacugaaauaaa

SEQ ID NO: 1933690 - RNA, 18 nt, Human
gaaugaagauacugaaau

SEQ ID NO: 1933691 - RNA, 17 nt, Human
gaaugaagauacugaaa

SEQ ID NO: 1933692 - RNA, 14 nt, Human
gaaugucaguguga

SEQ ID NO: 1933693 - RNA, 13 nt, Human
gaauguauuuauu

SEQ ID NO: 1933694 - RNA, 16 nt, Human
gaauguauuuauuugg

SEQ ID NO: 1933695 - RNA, 23 nt, Human
gaauguauuuauuugggagaccg

SEQ ID NO: 1933696 - RNA, 21 nt, Human
gaauguaugcuucauacaggg

SEQ ID NO: 1933697 - RNA, 22 nt, Human
gaaugguuuucaaaauaaaaau

SEQ ID NO: 1933698 - RNA, 18 nt, Human
gaauguaagaacuacaaa

SEQ ID NO: 1933699 - RNA, 18 nt, Human
gaauguaugcuucauaca

SEQ ID NO: 1933700 - RNA, 16 nt, Human
gaauguaugcuucaua

SEQ ID NO: 1933701 - RNA, 17 nt, Human
gaauggcacagcccaaa

SEQ ID NO: 1933702 - RNA, 23 nt, Human
gaaugggagguugaucagaucug

SEQ ID NO: 1933703 - RNA, 17 nt, Human
gaauucucuaguuugau

SEQ ID NO: 1933704 - RNA, 17 nt, Human
gaauucucagaaucuca

SEQ ID NO: 1933705 - RNA, 20 nt, Human
gaaugucagugugacugauc

SEQ ID NO: 1933706 - RNA, 21 nt, Human
gaaugucagugugacugaucu

SEQ ID NO: 1933707 - RNA, 19 nt, Human
gaauucucuaguuugauua

SEQ ID NO: 1933708 - RNA, 14 nt, Human
gaauugaaaaacca

SEQ ID NO: 1933709 - RNA, 14 nt, Human
gaauugaagcagga

SEQ ID NO: 1933710 - RNA, 22 nt, Human
gaauugaggggauuaauaugaa

SEQ ID NO: 1933711 - RNA, 14 nt, Human
gaauugagcugcag

SEQ ID NO: 1933712 - RNA, 16 nt, Human
gaauugagcugcagaa

SEQ ID NO: 1933713 - RNA, 18 nt, Human
gaauugaggggauuaaua

SEQ ID NO: 1933714 - RNA, 15 nt, Human
gaauuucccaaagca

SEQ ID NO: 1933715 - RNA, 23 nt, Human
gaauuuauucaauuccucuggga

SEQ ID NO: 1933716 - RNA, 19 nt, Human
gaauuuagguuuuuauuag

SEQ ID NO: 1933717 - RNA, 16 nt, Human
gaauuuagguuuuuau

SEQ ID NO: 1933718 - RNA, 13 nt, Human
gaauuuauucaau

SEQ ID NO: 1933719 - RNA, 17 nt, Human
gaauuuauucaauuccu

SEQ ID NO: 1933720 - RNA, 22 nt, Human
gaauuguaaggaaugauuaauu

SEQ ID NO: 1933721 - RNA, 12 nt, Human
gaauugauuugc

SEQ ID NO: 1933722 - RNA, 13 nt, Human
gaauugauuugca

SEQ ID NO: 1933723 - RNA, 14 nt, Human
gaauugauuugcau

SEQ ID NO: 1933724 - RNA, 15 nt, Human
gaauugauuugcauu

SEQ ID NO: 1933725 - RNA, 17 nt, Human
gaauugauuugcauuga

SEQ ID NO: 1933726 - RNA, 15 nt, Human
gaauuguguuuauaa

SEQ ID NO: 1933727 - RNA, 23 nt, Human
gaauuguguuuauaauuuuaaau

SEQ ID NO: 1933728 - RNA, 22 nt, Human
gaauuuaaauagcuuuuuucuc

SEQ ID NO: 1933729 - RNA, 22 nt, Human
gaguucaauaaaugucuguuga

SEQ ID NO: 1933730 - RNA, 18 nt, Human
gaguucgagaccagccug

SEQ ID NO: 1933731 - RNA, 18 nt, Human
gacuuccuguccagcucc

SEQ ID NO: 1933732 - RNA, 19 nt, Human
gacuuccuguccagcucca

SEQ ID NO: 1933733 - RNA, 20 nt, Human
gacuuccuguccagcuccaa

SEQ ID NO: 1933734 - RNA, 21 nt, Human
gacuuccuguccagcuccaac

SEQ ID NO: 1933735 - RNA, 22 nt, Human
gacuuccuguccagcuccaacc

SEQ ID NO: 1933736 - RNA, 22 nt, Human
gaguguguaauuuaaaauugug

SEQ ID NO: 1933737 - RNA, 21 nt, Human
gaguguguaauuuaaaauugu

SEQ ID NO: 1933738 - RNA, 14 nt, Human
gacuuccuugagac

SEQ ID NO: 1933739 - RNA, 24 nt, Human
gacuucaucucccaccuagcagca

SEQ ID NO: 1933740 - RNA, 13 nt, Human
gauaaacaguagu

SEQ ID NO: 1933741 - RNA, 13 nt, Human
gaguucugguucc

SEQ ID NO: 1933742 - RNA, 20 nt, Human
gaguucugcucauucuaaug

SEQ ID NO: 1933743 - RNA, 21 nt, Human
gaguucugcucauucuaauga

SEQ ID NO: 1933744 - RNA, 16 nt, Human
gaguucugcucauucu

SEQ ID NO: 1933745 - RNA, 12 nt, Human
gauaaauuauaa

SEQ ID NO: 1933746 - RNA, 13 nt, Human
gauaaauuauaag

SEQ ID NO: 1933747 - RNA, 24 nt, Human
gauaauacaccacuacauucuguu

SEQ ID NO: 1933748 - RNA, 23 nt, Human
gauaauacaccacuacauucugu

SEQ ID NO: 1933749 - RNA, 12 nt, Human
gauaauacacca

SEQ ID NO: 1933750 - RNA, 17 nt, Human
gauaacuagauggugcu

SEQ ID NO: 1933751 - RNA, 13 nt, Human
gauaacuagaugg

SEQ ID NO: 1933752 - RNA, 14 nt, Human
gauaauuauaauau

SEQ ID NO: 1933753 - RNA, 17 nt, Human
gauaggucagugcaaau

SEQ ID NO: 1933754 - RNA, 16 nt, Human
gauacaaaagcaugug

SEQ ID NO: 1933755 - RNA, 17 nt, Human
gauacaaaagcauguga

SEQ ID NO: 1933756 - RNA, 18 nt, Human
gauauaugcucugcaugu

SEQ ID NO: 1933757 - RNA, 14 nt, Human
gauauauacauagc

SEQ ID NO: 1933758 - RNA, 15 nt, Human
gauauaaauaaaaca

SEQ ID NO: 1933759 - RNA, 18 nt, Human
gauauaaaagacugacca

SEQ ID NO: 1933760 - RNA, 13 nt, Human
gauauaaauaaaa

SEQ ID NO: 1933761 - RNA, 20 nt, Human
gauagugucccacggugccu

SEQ ID NO: 1933762 - RNA, 23 nt, Human
gauaguggggagacuucuuggcu

SEQ ID NO: 1933763 - RNA, 20 nt, Human
gaucacggcucacugcagcc

SEQ ID NO: 1933764 - RNA, 23 nt, Human
gaucacggcucacugcagccuca

SEQ ID NO: 1933765 - RNA, 14 nt, Human
gaucacagccucug

SEQ ID NO: 1933766 - RNA, 15 nt, Human
gauauccauucuuuc

SEQ ID NO: 1933767 - RNA, 16 nt, Human
gauauccauucuuucu

SEQ ID NO: 1933768 - RNA, 19 nt, Human
gauauccauucuuucugau

SEQ ID NO: 1933769 - RNA, 13 nt, Human
gaugaacagacug

SEQ ID NO: 1933770 - RNA, 22 nt, Human
gaugaaguuuuacauuguugag

SEQ ID NO: 1933771 - RNA, 23 nt, Human
gaugaaguuuuacauuguugagc

SEQ ID NO: 1933772 - RNA, 13 nt, Human
gaugaaugagaau

SEQ ID NO: 1933773 - RNA, 14 nt, Human
gaugaauguauuua

SEQ ID NO: 1933774 - RNA, 18 nt, Human
gaugacaacuacagaaaa

SEQ ID NO: 1933775 - RNA, 21 nt, Human
gaugaaaugaggucagagccu

SEQ ID NO: 1933776 - RNA, 15 nt, Human
gaugaaaugagguca

SEQ ID NO: 1933777 - RNA, 19 nt, Human
gaucuucuuuauaauucua

SEQ ID NO: 1933778 - RNA, 22 nt, Human
gaucuucuguggguuucuaaag

SEQ ID NO: 1933779 - RNA, 15 nt, Human
gaucuguccucagcc

SEQ ID NO: 1933780 - RNA, 16 nt, Human
gaucuguccucagccu

SEQ ID NO: 1933781 - RNA, 17 nt, Human
gaucuguccucagccuu

SEQ ID NO: 1933782 - RNA, 18 nt, Human
gaucuguccucagccuug

SEQ ID NO: 1933783 - RNA, 14 nt, Human
gaucuguccucagc

SEQ ID NO: 1933784 - RNA, 23 nt, Human
gaugcaccagcccuuagcaggga

SEQ ID NO: 1933785 - RNA, 15 nt, Human
gaugcaccagcccuu

SEQ ID NO: 1933786 - RNA, 14 nt, Human
gaugcaccagcccu

SEQ ID NO: 1933787 - RNA, 14 nt, Human
gaugagaggaaauc

SEQ ID NO: 1933788 - RNA, 18 nt, Human
gaugaccuugaaugaugc

SEQ ID NO: 1933789 - RNA, 23 nt, Human
gaugagaaauaaaguuucuguug

SEQ ID NO: 1933790 - RNA, 20 nt, Human
gaugaccuugaaugaugcca

SEQ ID NO: 1933791 - RNA, 16 nt, Human
gaugccugguggcagc

SEQ ID NO: 1933792 - RNA, 15 nt, Human
gaugccugguggcag

SEQ ID NO: 1933793 - RNA, 14 nt, Human
gaugccugguggca

SEQ ID NO: 1933794 - RNA, 14 nt, Human
gaugcagugcuucc

SEQ ID NO: 1933795 - RNA, 16 nt, Human
gaugagaggaaaucac

SEQ ID NO: 1933796 - RNA, 14 nt, Human
gaugcagggcaguc

SEQ ID NO: 1933797 - RNA, 15 nt, Human
gaugcagggcaguca

SEQ ID NO: 1933798 - RNA, 12 nt, Human
gauccugagcca

SEQ ID NO: 1933799 - RNA, 12 nt, Human
gauccuggaggc

SEQ ID NO: 1933800 - RNA, 15 nt, Human
gauccuggaggccca

SEQ ID NO: 1933801 - RNA, 16 nt, Human
gauccuggaggcccag

SEQ ID NO: 1933802 - RNA, 17 nt, Human
gauccuggaggcccagu

SEQ ID NO: 1933803 - RNA, 13 nt, Human
gaucuaggaagac

SEQ ID NO: 1933804 - RNA, 14 nt, Human
gaucuaggaagacu

SEQ ID NO: 1933805 - RNA, 18 nt, Human
gaucuaggaagacuuugg

SEQ ID NO: 1933806 - RNA, 20 nt, Human
gaucuaggaagacuuuggaa

SEQ ID NO: 1933807 - RNA, 15 nt, Human
gaucugguccuaccc

SEQ ID NO: 1933808 - RNA, 16 nt, Human
gaucugguccuaccca

SEQ ID NO: 1933809 - RNA, 13 nt, Human
gaucauccacugu

SEQ ID NO: 1933810 - RNA, 21 nt, Human
gaucccucccccccaugcacu

SEQ ID NO: 1933811 - RNA, 23 nt, Human
gaucccucccccccaugcacugu

SEQ ID NO: 1933812 - RNA, 13 nt, Human
gaucccucccccc

SEQ ID NO: 1933813 - RNA, 19 nt, Human
gaucccucccccccaugca

SEQ ID NO: 1933814 - RNA, 18 nt, Human
gauccucccaccucagcc

SEQ ID NO: 1933815 - RNA, 17 nt, Human
gauccucccaccucagc

SEQ ID NO: 1933816 - RNA, 16 nt, Human
gauccucccaccucag

SEQ ID NO: 1933817 - RNA, 14 nt, Human
gauccuccaggugc

SEQ ID NO: 1933818 - RNA, 18 nt, Human
gauccuaggcauuugcug

SEQ ID NO: 1933819 - RNA, 15 nt, Human
gcaaacccagacggc

SEQ ID NO: 1933820 - RNA, 18 nt, Human
gcaaacuuuauuuugugu

SEQ ID NO: 1933821 - RNA, 16 nt, Human
gcaaaccaucauugaa

SEQ ID NO: 1933822 - RNA, 17 nt, Human
gcaaaccaucauugaaa

SEQ ID NO: 1933823 - RNA, 19 nt, Human
gcaaaccaucauugaaauc

SEQ ID NO: 1933824 - RNA, 20 nt, Human
gcaaaccaucauugaaaucu

SEQ ID NO: 1933825 - RNA, 21 nt, Human
gcaaaccaucauugaaaucuu

SEQ ID NO: 1933826 - RNA, 12 nt, Human
gcaaauaaaagu

SEQ ID NO: 1933827 - RNA, 22 nt, Human
gcaaagugaaguugcuucuucu

SEQ ID NO: 1933828 - RNA, 20 nt, Human
gcaaacuuuauuuuguguuu

SEQ ID NO: 1933829 - RNA, 22 nt, Human
gcaaagacuauucccuucuaac

SEQ ID NO: 1933830 - RNA, 21 nt, Human
gcaaagacuauucccuucuaa

SEQ ID NO: 1933831 - RNA, 18 nt, Human
gcaacugcauuggcuuug

SEQ ID NO: 1933832 - RNA, 15 nt, Human
gcaacucuugauuau

SEQ ID NO: 1933833 - RNA, 12 nt, Human
gcaaaugugaau

SEQ ID NO: 1933834 - RNA, 23 nt, Human
gcaaaugcuaaugucaaacuuga

SEQ ID NO: 1933835 - RNA, 12 nt, Human
gcaaaucuugaa

SEQ ID NO: 1933836 - RNA, 17 nt, Human
gcaauccugcaagaaca

SEQ ID NO: 1933837 - RNA, 18 nt, Human
gcaagguccggcccaucc

SEQ ID NO: 1933838 - RNA, 20 nt, Human
gcaagguuuaggcugguggc

SEQ ID NO: 1933839 - RNA, 21 nt, Human
gcaagguuuaggcugguggcc

SEQ ID NO: 1933840 - RNA, 22 nt, Human
gcaagguuuaggcugguggccc

SEQ ID NO: 1933841 - RNA, 24 nt, Human
gcaagguuuaggcugguggcccag

SEQ ID NO: 1933842 - RNA, 23 nt, Human
gcaagguuuaggcugguggccca

SEQ ID NO: 1933843 - RNA, 12 nt, Human
gcaagggacugu

SEQ ID NO: 1933844 - RNA, 14 nt, Human
gcaaggcugucaau

SEQ ID NO: 1933845 - RNA, 18 nt, Human
gcaaggcugucaauuaca

SEQ ID NO: 1933846 - RNA, 16 nt, Human
gcaaggaaaaacaggu

SEQ ID NO: 1933847 - RNA, 20 nt, Human
gcaagcaccuccugccucga

SEQ ID NO: 1933848 - RNA, 18 nt, Human
gcaagcaccuccugccuc

SEQ ID NO: 1933849 - RNA, 16 nt, Human
gcaagcaccuccugcc

SEQ ID NO: 1933850 - RNA, 15 nt, Human
gcaagcaccuccugc

SEQ ID NO: 1933851 - RNA, 22 nt, Human
gcaacuuuguauaaaagggacu

SEQ ID NO: 1933852 - RNA, 21 nt, Human
gauuucauuucaacuguuugc

SEQ ID NO: 1933853 - RNA, 18 nt, Human
gauuugaagaacauguga

SEQ ID NO: 1933854 - RNA, 13 nt, Human
gauuucaugauuu

SEQ ID NO: 1933855 - RNA, 20 nt, Human
gauuucauuucaacuguuug

SEQ ID NO: 1933856 - RNA, 21 nt, Human
gauuucuguuuagauaauaca

SEQ ID NO: 1933857 - RNA, 22 nt, Human
gauuucuguuuagauaauacac

SEQ ID NO: 1933858 - RNA, 16 nt, Human
gauugggaauccgccc

SEQ ID NO: 1933859 - RNA, 18 nt, Human
gauuguucgggugugcaa

SEQ ID NO: 1933860 - RNA, 15 nt, Human
gauugggccccugcc

SEQ ID NO: 1933861 - RNA, 17 nt, Human
gauuucaucugcucucc

SEQ ID NO: 1933862 - RNA, 16 nt, Human
gauuuaaacaaacaaa

SEQ ID NO: 1933863 - RNA, 22 nt, Human
gauuucaucugcucuccuuccu

SEQ ID NO: 1933864 - RNA, 21 nt, Human
gauuucaucugcucuccuucc

SEQ ID NO: 1933865 - RNA, 20 nt, Human
gauuucaucugcucuccuuc

SEQ ID NO: 1933866 - RNA, 16 nt, Human
gauugcaacaggcugg

SEQ ID NO: 1933867 - RNA, 20 nt, Human
gauucuuuccugaggcuggg

SEQ ID NO: 1933868 - RNA, 22 nt, Human
gauucuuuccugaggcugggcu

SEQ ID NO: 1933869 - RNA, 18 nt, Human
gauucccaagcucugcuc

SEQ ID NO: 1933870 - RNA, 19 nt, Human
gauucuuuccugaggcugg

SEQ ID NO: 1933871 - RNA, 17 nt, Human
gauucccaagcucugcu

SEQ ID NO: 1933872 - RNA, 16 nt, Human
gauucccaagcucugc

SEQ ID NO: 1933873 - RNA, 18 nt, Human
gauugcuugagcucagga

SEQ ID NO: 1933874 - RNA, 20 nt, Human
gauuggcucacacugagaau

SEQ ID NO: 1933875 - RNA, 18 nt, Human
gauuggcucacacugaga

SEQ ID NO: 1933876 - RNA, 17 nt, Human
gauuggcucacacugag

SEQ ID NO: 1933877 - RNA, 18 nt, Human
gauugcaacaggcugggc

SEQ ID NO: 1933878 - RNA, 17 nt, Human
gauugcaacaggcuggg

SEQ ID NO: 1933879 - RNA, 17 nt, Human
gaugccugguggcagcu

SEQ ID NO: 1933880 - RNA, 20 nt, Human
gaugcgggccagugcuccag

SEQ ID NO: 1933881 - RNA, 16 nt, Human
gaugcuagaacucccu

SEQ ID NO: 1933882 - RNA, 22 nt, Human
gaugcgggccagugcuccagcc

SEQ ID NO: 1933883 - RNA, 21 nt, Human
gauguucuacuuuguucugcu

SEQ ID NO: 1933884 - RNA, 18 nt, Human
gauguucuagcauggcug

SEQ ID NO: 1933885 - RNA, 23 nt, Human
gauguucuacuuuguucugcugu

SEQ ID NO: 1933886 - RNA, 12 nt, Human
gauguuuccaga

SEQ ID NO: 1933887 - RNA, 13 nt, Human
gauguuuccagac

SEQ ID NO: 1933888 - RNA, 19 nt, Human
gauguuuccagacuuccuu

SEQ ID NO: 1933889 - RNA, 21 nt, Human
gauguuuuaaggaugcuugua

SEQ ID NO: 1933890 - RNA, 18 nt, Human
gauuaauauggggaugca

SEQ ID NO: 1933891 - RNA, 14 nt, Human
gauuaauaugaaaa

SEQ ID NO: 1933892 - RNA, 18 nt, Human
gauuaauaugaaaacuua

SEQ ID NO: 1933893 - RNA, 21 nt, Human
gauuacaagcgugagccacug

SEQ ID NO: 1933894 - RNA, 13 nt, Human
gauuacaagcgug

SEQ ID NO: 1933895 - RNA, 15 nt, Human
gauuaauuccuuucc

SEQ ID NO: 1933896 - RNA, 13 nt, Human
gauucagacagcu

SEQ ID NO: 1933897 - RNA, 14 nt, Human
gauucagacagcug

SEQ ID NO: 1933898 - RNA, 17 nt, Human
gauucagacagcugccu

SEQ ID NO: 1933899 - RNA, 18 nt, Human
gauucagacagcugccug

SEQ ID NO: 1933900 - RNA, 15 nt, Human
gauucccaagcucug

SEQ ID NO: 1933901 - RNA, 18 nt, Human
gauuccaaagaguagaau

SEQ ID NO: 1933902 - RNA, 19 nt, Human
gauuccaaagaguagaauu

SEQ ID NO: 1933903 - RNA, 23 nt, Human
gauuccaaagaguagaauugcau

SEQ ID NO: 1933904 - RNA, 15 nt, Human
gauucaguuuucauu

SEQ ID NO: 1933905 - RNA, 22 nt, Human
gauucaguuuucauuugguuca

SEQ ID NO: 1933906 - RNA, 16 nt, Human
gauucauaguaacuuc

SEQ ID NO: 1933907 - RNA, 13 nt, Human
gauucaggaaugu

SEQ ID NO: 1933908 - RNA, 20 nt, Human
gcagccuggcucccaggaca

SEQ ID NO: 1933909 - RNA, 19 nt, Human
gcagccuggcucccaggac

SEQ ID NO: 1933910 - RNA, 13 nt, Human
gcagccuggcucc

SEQ ID NO: 1933911 - RNA, 14 nt, Human
gcagccuggacccu

SEQ ID NO: 1933912 - RNA, 23 nt, Human
gcagccugcgccaccgcccagag

SEQ ID NO: 1933913 - RNA, 22 nt, Human
gcagccucaaccuccugggcua

SEQ ID NO: 1933914 - RNA, 21 nt, Human
gcagccucaaccuccugggcu

SEQ ID NO: 1933915 - RNA, 18 nt, Human
gcagccguuugagaagaa

SEQ ID NO: 1933916 - RNA, 22 nt, Human
gcagccguuugagaagaaaaca

SEQ ID NO: 1933917 - RNA, 20 nt, Human
gcagccucaaccuccugggc

SEQ ID NO: 1933918 - RNA, 19 nt, Human
gcagccucaaccuccuggg

SEQ ID NO: 1933919 - RNA, 20 nt, Human
gcagcagguggcagaauggg

SEQ ID NO: 1933920 - RNA, 15 nt, Human
gcagcagggaugccc

SEQ ID NO: 1933921 - RNA, 17 nt, Human
gcagcagggaugcccug

SEQ ID NO: 1933922 - RNA, 19 nt, Human
gcagcagggaugcccugga

SEQ ID NO: 1933923 - RNA, 20 nt, Human
gcagcagggaugcccuggag

SEQ ID NO: 1933924 - RNA, 13 nt, Human
gcagcagaagggg

SEQ ID NO: 1933925 - RNA, 12 nt, Human
gcagcagaaggg

SEQ ID NO: 1933926 - RNA, 16 nt, Human
gcaggagcacacccag

SEQ ID NO: 1933927 - RNA, 17 nt, Human
gcaggagcacacccagc

SEQ ID NO: 1933928 - RNA, 20 nt, Human
gcaggagcacacccagcccc

SEQ ID NO: 1933929 - RNA, 11 nt, Human
gcaggaggaag

SEQ ID NO: 1933930 - RNA, 20 nt, Human
gcaggaguuucguuuucaaa

SEQ ID NO: 1933931 - RNA, 21 nt, Human
gcaggaguuucguuuucaaaa

SEQ ID NO: 1933932 - RNA, 20 nt, Human
gcaggaccuucgggcugugc

SEQ ID NO: 1933933 - RNA, 13 nt, Human
gcagcgccaggcu

SEQ ID NO: 1933934 - RNA, 14 nt, Human
gcagcgccaggcug

SEQ ID NO: 1933935 - RNA, 13 nt, Human
gcagcgccuuucc

SEQ ID NO: 1933936 - RNA, 12 nt, Human
gcagcaauaaag

SEQ ID NO: 1933937 - RNA, 17 nt, Human
gcagauggaaaggagcc

SEQ ID NO: 1933938 - RNA, 17 nt, Human
gcagcaccguucugugc

SEQ ID NO: 1933939 - RNA, 18 nt, Human
gcagcaccguucugugca

SEQ ID NO: 1933940 - RNA, 19 nt, Human
gcagcaccguucugugcac

SEQ ID NO: 1933941 - RNA, 19 nt, Human
gcagaguugaagacagagc

SEQ ID NO: 1933942 - RNA, 16 nt, Human
gcagaguugaagacag

SEQ ID NO: 1933943 - RNA, 17 nt, Human
gcagaguugaagacaga

SEQ ID NO: 1933944 - RNA, 19 nt, Human
gcagauuuugcccuugaca

SEQ ID NO: 1933945 - RNA, 20 nt, Human
gcagaugcuagcacaugccc

SEQ ID NO: 1933946 - RNA, 13 nt, Human
gcagaugcaauga

SEQ ID NO: 1933947 - RNA, 19 nt, Human
gcagaugcaaugacucagg

SEQ ID NO: 1933948 - RNA, 15 nt, Human
gcagaguugaagaca

SEQ ID NO: 1933949 - RNA, 14 nt, Human
gcagagaccauccc

SEQ ID NO: 1933950 - RNA, 15 nt, Human
gcagagaccaucccu

SEQ ID NO: 1933951 - RNA, 17 nt, Human
gcagagaccaucccuga

SEQ ID NO: 1933952 - RNA, 19 nt, Human
gcagagaccaucccugaag

SEQ ID NO: 1933953 - RNA, 23 nt, Human
gcagagaaugaaagggcccagag

SEQ ID NO: 1933954 - RNA, 22 nt, Human
gcagagaaugaaagggcccaga

SEQ ID NO: 1933955 - RNA, 21 nt, Human
gcagagaauucucuuauccaa

SEQ ID NO: 1933956 - RNA, 21 nt, Human
gcagagaaugaaagggcccag

SEQ ID NO: 1933957 - RNA, 20 nt, Human
gcagagaaugaaagggccca

SEQ ID NO: 1933958 - RNA, 19 nt, Human
gcagagaaugaaagggccc

SEQ ID NO: 1933959 - RNA, 18 nt, Human
gcagaaggaagacuucau

SEQ ID NO: 1933960 - RNA, 20 nt, Human
gcacaugucuuguacaugug

SEQ ID NO: 1933961 - RNA, 13 nt, Human
gcacaugucuugu

SEQ ID NO: 1933962 - RNA, 21 nt, Human
gcacaugucuuguacaugugu

SEQ ID NO: 1933963 - RNA, 19 nt, Human
gcaccacugcacuccagcc

SEQ ID NO: 1933964 - RNA, 13 nt, Human
gcacccacccugg

SEQ ID NO: 1933965 - RNA, 14 nt, Human
gcacccacccuggg

SEQ ID NO: 1933966 - RNA, 17 nt, Human
gcacccacccugggacc

SEQ ID NO: 1933967 - RNA, 15 nt, Human
gcaccuccugccucg

SEQ ID NO: 1933968 - RNA, 14 nt, Human
gcaccuccugccuc

SEQ ID NO: 1933969 - RNA, 17 nt, Human
gcacccggccccugcug

SEQ ID NO: 1933970 - RNA, 15 nt, Human
gcacccggccccugc

SEQ ID NO: 1933971 - RNA, 14 nt, Human
gcacccggccccug

SEQ ID NO: 1933972 - RNA, 16 nt, Human
gcacagcuucauuucc

SEQ ID NO: 1933973 - RNA, 21 nt, Human
gcacaggacaugcgguagcca

SEQ ID NO: 1933974 - RNA, 22 nt, Human
gcacaggacaugcgguagccag

SEQ ID NO: 1933975 - RNA, 19 nt, Human
gcacagcuaacauggaagu

SEQ ID NO: 1933976 - RNA, 13 nt, Human
gcaaugaccuuuc

SEQ ID NO: 1933977 - RNA, 14 nt, Human
gcaaugaccuuuca

SEQ ID NO: 1933978 - RNA, 18 nt, Human
gcacccggccccugcugg

SEQ ID NO: 1933979 - RNA, 17 nt, Human
gcacuaaggugugcucu

SEQ ID NO: 1933980 - RNA, 12 nt, Human
gcaccugccuca

SEQ ID NO: 1933981 - RNA, 13 nt, Human
gcaccugccucag

SEQ ID NO: 1933982 - RNA, 14 nt, Human
gcaccugccucagg

SEQ ID NO: 1933983 - RNA, 15 nt, Human
gcaccugccucagga

SEQ ID NO: 1933984 - RNA, 16 nt, Human
gcaccugccucaggac

SEQ ID NO: 1933985 - RNA, 18 nt, Human
gcacuaaggugugcucug

SEQ ID NO: 1933986 - RNA, 19 nt, Human
gcacuaaggugugcucuga

SEQ ID NO: 1933987 - RNA, 15 nt, Human
gcacuaagauauuuc

SEQ ID NO: 1933988 - RNA, 14 nt, Human
gcacuaaggggccc

SEQ ID NO: 1933989 - RNA, 23 nt, Human
gcacuaaggggcccggccagcca

SEQ ID NO: 1933990 - RNA, 13 nt, Human
gcacugaugcugc

SEQ ID NO: 1933991 - RNA, 22 nt, Human
gcacugggcuuggggaccagag

SEQ ID NO: 1933992 - RNA, 23 nt, Human
gcacugggcuuggggaccagagc

SEQ ID NO: 1933993 - RNA, 22 nt, Human
gcacugaugcugccccucaucu

SEQ ID NO: 1933994 - RNA, 18 nt, Human
gcacugaugcugccccuc

SEQ ID NO: 1933995 - RNA, 19 nt, Human
gcacugaugcugccccuca

SEQ ID NO: 1933996 - RNA, 12 nt, Human
gcagaaggaaga

SEQ ID NO: 1933997 - RNA, 13 nt, Human
gcagaaggaagac

SEQ ID NO: 1933998 - RNA, 14 nt, Human
gcagaaggaagacu

SEQ ID NO: 1933999 - RNA, 14 nt, Human
gcagaagacaguau

SEQ ID NO: 1934000 - RNA, 13 nt, Human
gcauucuaguacu

SEQ ID NO: 1934001 - RNA, 12 nt, Human
gcauuccccagg

SEQ ID NO: 1934002 - RNA, 12 nt, Human
gcauuccccacu

SEQ ID NO: 1934003 - RNA, 23 nt, Human
gcauuugcugaauacagaggcaa

SEQ ID NO: 1934004 - RNA, 21 nt, Human
gcauuuggugguuucagaaau

SEQ ID NO: 1934005 - RNA, 16 nt, Human
gcauuuggauuggggu

SEQ ID NO: 1934006 - RNA, 22 nt, Human
gcauuuggauuggggucccucu

SEQ ID NO: 1934007 - RNA, 16 nt, Human
gcauuuuacuguacag

SEQ ID NO: 1934008 - RNA, 23 nt, Human
gcauuuggauuggggucccucua

SEQ ID NO: 1934009 - RNA, 17 nt, Human
gcauuuuacuguacaga

SEQ ID NO: 1934010 - RNA, 22 nt, Human
gcauuuugcuaaaugugaauga

SEQ ID NO: 1934011 - RNA, 22 nt, Human
gcauuuuggagaguuuccugaa

SEQ ID NO: 1934012 - RNA, 23 nt, Human
gcauuuuggagaguuuccugaaa

SEQ ID NO: 1934013 - RNA, 16 nt, Human
gcauuuucuaaacaga

SEQ ID NO: 1934014 - RNA, 18 nt, Human
gcauuuuccucugcuuug

SEQ ID NO: 1934015 - RNA, 21 nt, Human
gcauuuuccucugcuuugaaa

SEQ ID NO: 1934016 - RNA, 20 nt, Human
gcauuuuccuccaucgcagu

SEQ ID NO: 1934017 - RNA, 13 nt, Human
gcauuuuccucug

SEQ ID NO: 1934018 - RNA, 15 nt, Human
gcauuuuccucugcu

SEQ ID NO: 1934019 - RNA, 14 nt, Human
gcauuuuguauuug

SEQ ID NO: 1934020 - RNA, 23 nt, Human
gcauuuuguauuugucuaacugg

SEQ ID NO: 1934021 - RNA, 14 nt, Human
gccaaaagcugcuc

SEQ ID NO: 1934022 - RNA, 15 nt, Human
gccaaaagcugcuca

SEQ ID NO: 1934023 - RNA, 21 nt, Human
gccaaacucaccugccccuca

SEQ ID NO: 1934024 - RNA, 19 nt, Human
gccaaacucaccugccccu

SEQ ID NO: 1934025 - RNA, 14 nt, Human
gccaaaggaagcac

SEQ ID NO: 1934026 - RNA, 16 nt, Human
gccaaaggaagcacau

SEQ ID NO: 1934027 - RNA, 20 nt, Human
gccaaaggaagcacaugccu

SEQ ID NO: 1934028 - RNA, 13 nt, Human
gcaucaggccagg

SEQ ID NO: 1934029 - RNA, 15 nt, Human
gcaucaggccaggcc

SEQ ID NO: 1934030 - RNA, 16 nt, Human
gcaucaggccaggccc

SEQ ID NO: 1934031 - RNA, 17 nt, Human
gcaucaggccaggcccu

SEQ ID NO: 1934032 - RNA, 15 nt, Human
gcaugaauuugugaa

SEQ ID NO: 1934033 - RNA, 23 nt, Human
gcaugaaguaauaugcacacauu

SEQ ID NO: 1934034 - RNA, 20 nt, Human
gcaugacacgaauauugcug

SEQ ID NO: 1934035 - RNA, 17 nt, Human
gcaugaauuugugaagg

SEQ ID NO: 1934036 - RNA, 17 nt, Human
gcaugccuggauggggc

SEQ ID NO: 1934037 - RNA, 22 nt, Human
gcaugccuggauggggcugcac

SEQ ID NO: 1934038 - RNA, 17 nt, Human
gcauguuugugauugac

SEQ ID NO: 1934039 - RNA, 18 nt, Human
gcauggagauagccccac

SEQ ID NO: 1934040 - RNA, 15 nt, Human
gcaugcugucccuua

SEQ ID NO: 1934041 - RNA, 18 nt, Human
gcagugggagcugccugu

SEQ ID NO: 1934042 - RNA, 17 nt, Human
gcagugggagcugccug

SEQ ID NO: 1934043 - RNA, 15 nt, Human
gcagugggccuggcc

SEQ ID NO: 1934044 - RNA, 20 nt, Human
gcagugugcacuaaggggcc

SEQ ID NO: 1934045 - RNA, 21 nt, Human
gcagugugcacuaaggggccc

SEQ ID NO: 1934046 - RNA, 19 nt, Human
gcauauuuauaaaaauaaa

SEQ ID NO: 1934047 - RNA, 21 nt, Human
gcaucaagaugugacauguuu

SEQ ID NO: 1934048 - RNA, 17 nt, Human
gcauauucaggaagcuc

SEQ ID NO: 1934049 - RNA, 18 nt, Human
gcauauucaggaagcuca

SEQ ID NO: 1934050 - RNA, 20 nt, Human
gcauauucaggaagcucagg

SEQ ID NO: 1934051 - RNA, 18 nt, Human
gcauauuauuuuauguug

SEQ ID NO: 1934052 - RNA, 18 nt, Human
gcauauguugaauacuuu

SEQ ID NO: 1934053 - RNA, 19 nt, Human
gcauauguugaauacuuuu

SEQ ID NO: 1934054 - RNA, 20 nt, Human
gcauauguugaauacuuuuu

SEQ ID NO: 1934055 - RNA, 21 nt, Human
gcauauguugaauacuuuuua

SEQ ID NO: 1934056 - RNA, 23 nt, Human
gcauauuauuuuauguugcauag

SEQ ID NO: 1934057 - RNA, 15 nt, Human
gcauauucaggaagc

SEQ ID NO: 1934058 - RNA, 12 nt, Human
gcauauguugaa

SEQ ID NO: 1934059 - RNA, 23 nt, Human
gcauauauuggguuccauucuca

SEQ ID NO: 1934060 - RNA, 14 nt, Human
gcauauguugaaua

SEQ ID NO: 1934061 - RNA, 17 nt, Human
gcauauguugaauacuu

SEQ ID NO: 1934062 - RNA, 12 nt, Human
gcagggcucagc

SEQ ID NO: 1934063 - RNA, 14 nt, Human
gcagggcucagcgg

SEQ ID NO: 1934064 - RNA, 16 nt, Human
gcagggagggcuucug

SEQ ID NO: 1934065 - RNA, 20 nt, Human
gcaggauucuuccucccucc

SEQ ID NO: 1934066 - RNA, 16 nt, Human
gcagugggagcugccu

SEQ ID NO: 1934067 - RNA, 23 nt, Human
gcagugcuuccaaggauggacca

SEQ ID NO: 1934068 - RNA, 12 nt, Human
gcaggucccuaa

SEQ ID NO: 1934069 - RNA, 13 nt, Human
gcaggucccuaau

SEQ ID NO: 1934070 - RNA, 23 nt, Human
gcagguccccagacuccaccaag

SEQ ID NO: 1934071 - RNA, 10 nt, Human
gcaggucccu

SEQ ID NO: 1934072 - RNA, 11 nt, Human
gcaggucccua

SEQ ID NO: 1934073 - RNA, 18 nt, Human
gcagggguggcugccuca

SEQ ID NO: 1934074 - RNA, 22 nt, Human
gcagggguggcugccucauuua

SEQ ID NO: 1934075 - RNA, 16 nt, Human
gccagcguggcgcagu

SEQ ID NO: 1934076 - RNA, 14 nt, Human
gccagcguggcgca

SEQ ID NO: 1934077 - RNA, 19 nt, Human
gccagcgggaauggcagcu

SEQ ID NO: 1934078 - RNA, 14 nt, Human
gccagccuugacca

SEQ ID NO: 1934079 - RNA, 20 nt, Human
gccagccuugaccauucucc

SEQ ID NO: 1934080 - RNA, 21 nt, Human
gccagccuugaccauucucca

SEQ ID NO: 1934081 - RNA, 22 nt, Human
gccagccuugaccauucuccac

SEQ ID NO: 1934082 - RNA, 14 nt, Human
gccagcugcuuggg

SEQ ID NO: 1934083 - RNA, 13 nt, Human
gccagcucccucu

SEQ ID NO: 1934084 - RNA, 16 nt, Human
gccagcugcuugggcu

SEQ ID NO: 1934085 - RNA, 15 nt, Human
gccagcugcuugggc

SEQ ID NO: 1934086 - RNA, 18 nt, Human
gccagcuuguuauuuaua

SEQ ID NO: 1934087 - RNA, 20 nt, Human
gccagagggagugacagagg

SEQ ID NO: 1934088 - RNA, 19 nt, Human
gccagagggagugacagag

SEQ ID NO: 1934089 - RNA, 16 nt, Human
gccagauucuuuccug

SEQ ID NO: 1934090 - RNA, 17 nt, Human
gccagauucuuuccuga

SEQ ID NO: 1934091 - RNA, 21 nt, Human
gccagccgagauagccaaggc

SEQ ID NO: 1934092 - RNA, 20 nt, Human
gccagccgagauagccaagg

SEQ ID NO: 1934093 - RNA, 12 nt, Human
gccagccuugac

SEQ ID NO: 1934094 - RNA, 14 nt, Human
gccagccccuggcc

SEQ ID NO: 1934095 - RNA, 19 nt, Human
gccagccccuggccccagg

SEQ ID NO: 1934096 - RNA, 20 nt, Human
gccagccccuggccccagga

SEQ ID NO: 1934097 - RNA, 18 nt, Human
gccacugacugcagggac

SEQ ID NO: 1934098 - RNA, 22 nt, Human
gccacucaggcccaaagccucg

SEQ ID NO: 1934099 - RNA, 14 nt, Human
gccacucaggccca

SEQ ID NO: 1934100 - RNA, 19 nt, Human
gccacugacugcagggaca

SEQ ID NO: 1934101 - RNA, 19 nt, Human
gccacugcaccgggccaca

SEQ ID NO: 1934102 - RNA, 13 nt, Human
gccagagaagcua

SEQ ID NO: 1934103 - RNA, 18 nt, Human
gccacugcaccgggccac

SEQ ID NO: 1934104 - RNA, 17 nt, Human
gccacugcaccgggcca

SEQ ID NO: 1934105 - RNA, 18 nt, Human
gccagagggagugacaga

SEQ ID NO: 1934106 - RNA, 22 nt, Human
gccagagcuacccgcagaguuc

SEQ ID NO: 1934107 - RNA, 12 nt, Human
gccagagacaca

SEQ ID NO: 1934108 - RNA, 15 nt, Human
gccagagacacaagc

SEQ ID NO: 1934109 - RNA, 12 nt, Human
gccagagccagg

SEQ ID NO: 1934110 - RNA, 14 nt, Human
gccagagccagggg

SEQ ID NO: 1934111 - RNA, 23 nt, Human
gccagagauccaaaagaagcccc

SEQ ID NO: 1934112 - RNA, 21 nt, Human
gccacgugggcaaacaggcag

SEQ ID NO: 1934113 - RNA, 16 nt, Human
gccacggccaggccag

SEQ ID NO: 1934114 - RNA, 22 nt, Human
gccacguucuuacuaguuuccc

SEQ ID NO: 1934115 - RNA, 21 nt, Human
gccacuauuguuagucucuug

SEQ ID NO: 1934116 - RNA, 20 nt, Human
gccacuauuguuagucucuu

SEQ ID NO: 1934117 - RNA, 15 nt, Human
gccacggccaggcca

SEQ ID NO: 1934118 - RNA, 14 nt, Human
gccacggccaggcc

SEQ ID NO: 1934119 - RNA, 22 nt, Human
gccaaaugguuuaacuucugcc

SEQ ID NO: 1934120 - RNA, 16 nt, Human
gccaaauaaugucucu

SEQ ID NO: 1934121 - RNA, 22 nt, Human
gccaaauaaugucucugugaga

SEQ ID NO: 1934122 - RNA, 18 nt, Human
gccaaauaaugucucugu

SEQ ID NO: 1934123 - RNA, 15 nt, Human
gcccaccccucaaca

SEQ ID NO: 1934124 - RNA, 18 nt, Human
gcccacaggaucagucug

SEQ ID NO: 1934125 - RNA, 13 nt, Human
gcccacaggauca

SEQ ID NO: 1934126 - RNA, 19 nt, Human
gcccacaggaucagucuga

SEQ ID NO: 1934127 - RNA, 20 nt, Human
gcccaaauuaucaagcuaau

SEQ ID NO: 1934128 - RNA, 19 nt, Human
gcccaaauuaucaagcuaa

SEQ ID NO: 1934129 - RNA, 17 nt, Human
gcccaaauuaucaagcu

SEQ ID NO: 1934130 - RNA, 23 nt, Human
gcccacaaaggcaaaggguccag

SEQ ID NO: 1934131 - RNA, 19 nt, Human
gcccaaagugguauagaaa

SEQ ID NO: 1934132 - RNA, 16 nt, Human
gccauuuguguuuaua

SEQ ID NO: 1934133 - RNA, 15 nt, Human
gcccaaagaugcagc

SEQ ID NO: 1934134 - RNA, 16 nt, Human
gcccaaagaugcagcc

SEQ ID NO: 1934135 - RNA, 17 nt, Human
gccauuucuuccacaag

SEQ ID NO: 1934136 - RNA, 20 nt, Human
gccauuucuuccacaagagc

SEQ ID NO: 1934137 - RNA, 22 nt, Human
gccauuucuuccacaagagccc

SEQ ID NO: 1934138 - RNA, 19 nt, Human
gccaugggacagggaggac

SEQ ID NO: 1934139 - RNA, 14 nt, Human
gccaugggacaggg

SEQ ID NO: 1934140 - RNA, 23 nt, Human
gccauggauggaaaacgcucucu

SEQ ID NO: 1934141 - RNA, 20 nt, Human
gccauccagguucagcuugu

SEQ ID NO: 1934142 - RNA, 19 nt, Human
gccauccagguucagcuug

SEQ ID NO: 1934143 - RNA, 20 nt, Human
gccagucuugacgaguguga

SEQ ID NO: 1934144 - RNA, 18 nt, Human
gccaggugcaaccaggga

SEQ ID NO: 1934145 - RNA, 13 nt, Human
gccaucccagccc

SEQ ID NO: 1934146 - RNA, 14 nt, Human
gccaucccagcccc

SEQ ID NO: 1934147 - RNA, 15 nt, Human
gccaucccagcccca

SEQ ID NO: 1934148 - RNA, 16 nt, Human
gccaucccagccccaa

SEQ ID NO: 1934149 - RNA, 17 nt, Human
gccaucccagccccaau

SEQ ID NO: 1934150 - RNA, 17 nt, Human
gccaggggaaaaucagc

SEQ ID NO: 1934151 - RNA, 16 nt, Human
gccagggccugcgagg

SEQ ID NO: 1934152 - RNA, 14 nt, Human
gccagggccugcga

SEQ ID NO: 1934153 - RNA, 21 nt, Human
gccaggggaaaaucagccugc

SEQ ID NO: 1934154 - RNA, 22 nt, Human
gccaggggaaaaucagccugcu

SEQ ID NO: 1934155 - RNA, 23 nt, Human
gccaggggaaaaucagccugcuc

SEQ ID NO: 1934156 - RNA, 20 nt, Human
gccaggaagccagcaggcuc

SEQ ID NO: 1934157 - RNA, 19 nt, Human
gccaggaagccagcaggcu

SEQ ID NO: 1934158 - RNA, 13 nt, Human
gccagggccugcg

SEQ ID NO: 1934159 - RNA, 11 nt, Human
gccaggaagcc

SEQ ID NO: 1934160 - RNA, 17 nt, Human
gccaggaagccagcagg

SEQ ID NO: 1934161 - RNA, 18 nt, Human
gccaggaagccagcaggc

SEQ ID NO: 1934162 - RNA, 21 nt, Human
gcccaggugaguccuagagcu

SEQ ID NO: 1934163 - RNA, 22 nt, Human
gcccagucuggaaugcaguggu

SEQ ID NO: 1934164 - RNA, 18 nt, Human
gcccauccccaggcaccu

SEQ ID NO: 1934165 - RNA, 19 nt, Human
gcccaguucacccugauuu

SEQ ID NO: 1934166 - RNA, 15 nt, Human
gcccaggcuggcgug

SEQ ID NO: 1934167 - RNA, 14 nt, Human
gcccaggcuggcgu

SEQ ID NO: 1934168 - RNA, 16 nt, Human
gcccaggcuggcgugc

SEQ ID NO: 1934169 - RNA, 14 nt, Human
gcccagggcccaga

SEQ ID NO: 1934170 - RNA, 15 nt, Human
gcccagggcccagag

SEQ ID NO: 1934171 - RNA, 16 nt, Human
gcccagggcccagagc

SEQ ID NO: 1934172 - RNA, 17 nt, Human
gcccagggcccagagcc

SEQ ID NO: 1934173 - RNA, 18 nt, Human
gcccagggcccagagccc

SEQ ID NO: 1934174 - RNA, 19 nt, Human
gcccagggcccagagccca

SEQ ID NO: 1934175 - RNA, 20 nt, Human
gcccagggcccagagcccag

SEQ ID NO: 1934176 - RNA, 21 nt, Human
gcccagggcccagagcccagc

SEQ ID NO: 1934177 - RNA, 23 nt, Human
gcccagggcccagagcccagcuc

SEQ ID NO: 1934178 - RNA, 11 nt, Human
gcccaggcugg

SEQ ID NO: 1934179 - RNA, 12 nt, Human
gcccaggaaagg

SEQ ID NO: 1934180 - RNA, 15 nt, Human
gcccaggaaaggcuc

SEQ ID NO: 1934181 - RNA, 16 nt, Human
gcccaggaaaggcucc

SEQ ID NO: 1934182 - RNA, 18 nt, Human
gcccaggccuccuacagc

SEQ ID NO: 1934183 - RNA, 12 nt, Human
gcccagcuccaa

SEQ ID NO: 1934184 - RNA, 15 nt, Human
gcccagcuccaaggg

SEQ ID NO: 1934185 - RNA, 21 nt, Human
gccccauucugccugcccagg

SEQ ID NO: 1934186 - RNA, 20 nt, Human
gccccauucugccugcccag

SEQ ID NO: 1934187 - RNA, 18 nt, Human
gccccauucugccugccc

SEQ ID NO: 1934188 - RNA, 17 nt, Human
gccccauucugccugcc

SEQ ID NO: 1934189 - RNA, 23 nt, Human
gccccauccucuguacagagccc

SEQ ID NO: 1934190 - RNA, 21 nt, Human
gccccagugcccacaggauca

SEQ ID NO: 1934191 - RNA, 17 nt, Human
gccccagugcccacagg

SEQ ID NO: 1934192 - RNA, 16 nt, Human
gccccagugcccacag

SEQ ID NO: 1934193 - RNA, 22 nt, Human
gccccaggcagggccaacccuu

SEQ ID NO: 1934194 - RNA, 15 nt, Human
gccccagugcccaca

SEQ ID NO: 1934195 - RNA, 12 nt, Human
gccccaggacca

SEQ ID NO: 1934196 - RNA, 14 nt, Human
gccccaggaccagc

SEQ ID NO: 1934197 - RNA, 15 nt, Human
gccccaggaccagcu

SEQ ID NO: 1934198 - RNA, 16 nt, Human
gccccaggaccagcuc

SEQ ID NO: 1934199 - RNA, 17 nt, Human
gccccaggaccagcuca

SEQ ID NO: 1934200 - RNA, 18 nt, Human
gccccaggaccagcucag

SEQ ID NO: 1934201 - RNA, 19 nt, Human
gccccaggaccagcucagg

SEQ ID NO: 1934202 - RNA, 22 nt, Human
gccccaggaccagcucaggaca

SEQ ID NO: 1934203 - RNA, 23 nt, Human
gccccaggaccagcucaggacag

SEQ ID NO: 1934204 - RNA, 24 nt, Human
gccccaggaccagcucaggacaga

SEQ ID NO: 1934205 - RNA, 20 nt, Human
gccccaggaccuggcugcca

SEQ ID NO: 1934206 - RNA, 21 nt, Human
gccccaggaccuggcugccau

SEQ ID NO: 1934207 - RNA, 22 nt, Human
gccccaggaccuggcugccaua

SEQ ID NO: 1934208 - RNA, 21 nt, Human
gccccaggcagggccaacccu

SEQ ID NO: 1934209 - RNA, 22 nt, Human
gcccaucugggggccucuucug

SEQ ID NO: 1934210 - RNA, 19 nt, Human
gcccauggacaggcuggcu

SEQ ID NO: 1934211 - RNA, 20 nt, Human
gcccauggacaggcuggcuc

SEQ ID NO: 1934212 - RNA, 21 nt, Human
gcccauggacaggcuggcucc

SEQ ID NO: 1934213 - RNA, 23 nt, Human
gcccauggacaggcuggcuccag

SEQ ID NO: 1934214 - RNA, 22 nt, Human
gccccaggaaaggcccagccac

SEQ ID NO: 1934215 - RNA, 11 nt, Human
gccccaggacc

SEQ ID NO: 1934216 - RNA, 15 nt, Human
gccccaggaaaggcc

SEQ ID NO: 1934217 - RNA, 21 nt, Human
gccccagccucccugaagccu

SEQ ID NO: 1934218 - RNA, 16 nt, Human
gccccagccucccuga

SEQ ID NO: 1934219 - RNA, 18 nt, Human
gccccagccucccugaag

SEQ ID NO: 1934220 - RNA, 17 nt, Human
gccccgugggguuccuc

SEQ ID NO: 1934221 - RNA, 13 nt, Human
gccccgugaggca

SEQ ID NO: 1934222 - RNA, 23 nt, Human
gccccgaggccuucucugaagga

SEQ ID NO: 1934223 - RNA, 20 nt, Human
gccccauucuuuuguaauuu

SEQ ID NO: 1934224 - RNA, 23 nt, Human
gccccauucugccugcccaggcc

SEQ ID NO: 1934225 - RNA, 22 nt, Human
gccccauucugccugcccaggc

SEQ ID NO: 1934226 - RNA, 14 nt, Human
gccccgcccaggcu

SEQ ID NO: 1934227 - RNA, 22 nt, Human
gccccauucuuuuguaauuuaa

SEQ ID NO: 1934228 - RNA, 13 nt, Human
gccccgccgccug

SEQ ID NO: 1934229 - RNA, 19 nt, Human
gccccucagggucccuggu

SEQ ID NO: 1934230 - RNA, 21 nt, Human
gccccucagggucccuggugg

SEQ ID NO: 1934231 - RNA, 21 nt, Human
gccccucaucucucugcccaa

SEQ ID NO: 1934232 - RNA, 20 nt, Human
gccccuauguaguccgugcu

SEQ ID NO: 1934233 - RNA, 23 nt, Human
gccccucaacucuccuccagagu

SEQ ID NO: 1934234 - RNA, 16 nt, Human
gccccuggcugggacg

SEQ ID NO: 1934235 - RNA, 23 nt, Human
gccccuggcugggacguggcuca

SEQ ID NO: 1934236 - RNA, 14 nt, Human
gccccuggccccag

SEQ ID NO: 1934237 - RNA, 12 nt, Human
gccccuggcugg

SEQ ID NO: 1934238 - RNA, 14 nt, Human
gccccuggcuggga

SEQ ID NO: 1934239 - RNA, 13 nt, Human
gccccuggcccca

SEQ ID NO: 1934240 - RNA, 18 nt, Human
gccccucccacagcgcug

SEQ ID NO: 1934241 - RNA, 23 nt, Human
gccccuggcagccccuguucugg

SEQ ID NO: 1934242 - RNA, 19 nt, Human
gccccugcacuccagccug

SEQ ID NO: 1934243 - RNA, 19 nt, Human
gcccuccuacccugcgccc

SEQ ID NO: 1934244 - RNA, 24 nt, Human
gcccuccuacccugcgcccagucc

SEQ ID NO: 1934245 - RNA, 15 nt, Human
gcccuccccucucug

SEQ ID NO: 1934246 - RNA, 18 nt, Human
gcccuccccucucugcac

SEQ ID NO: 1934247 - RNA, 19 nt, Human
gcccuccccucucugcacc

SEQ ID NO: 1934248 - RNA, 21 nt, Human
gcccgggcucugccucccauc

SEQ ID NO: 1934249 - RNA, 19 nt, Human
gcccuccccauggagccag

SEQ ID NO: 1934250 - RNA, 19 nt, Human
gcccgggcucugccuccca

SEQ ID NO: 1934251 - RNA, 20 nt, Human
gcccgggcucugccucccau

SEQ ID NO: 1934252 - RNA, 22 nt, Human
gcccucugcccacucccugcaa

SEQ ID NO: 1934253 - RNA, 14 nt, Human
gcccucuggagugg

SEQ ID NO: 1934254 - RNA, 16 nt, Human
gcccucuggaguggcc

SEQ ID NO: 1934255 - RNA, 17 nt, Human
gcccucuggaguggcca

SEQ ID NO: 1934256 - RNA, 18 nt, Human
gcccucuggaguggccac

SEQ ID NO: 1934257 - RNA, 19 nt, Human
gcccucuggaguggccacu

SEQ ID NO: 1934258 - RNA, 20 nt, Human
gcccucuggaguggccacua

SEQ ID NO: 1934259 - RNA, 22 nt, Human
gcccucuggaguggccacuaag

SEQ ID NO: 1934260 - RNA, 12 nt, Human
gcccuccucucc

SEQ ID NO: 1934261 - RNA, 14 nt, Human
gcccuccucuccca

SEQ ID NO: 1934262 - RNA, 17 nt, Human
gcccuccucucccauug

SEQ ID NO: 1934263 - RNA, 20 nt, Human
gcccuccucucccauugucc

SEQ ID NO: 1934264 - RNA, 15 nt, Human
gcccggcuccaggcu

SEQ ID NO: 1934265 - RNA, 12 nt, Human
gcccgggcucug

SEQ ID NO: 1934266 - RNA, 14 nt, Human
gcccggcuccaggc

SEQ ID NO: 1934267 - RNA, 13 nt, Human
gcccggcuccagg

SEQ ID NO: 1934268 - RNA, 13 nt, Human
gcccgggcucugc

SEQ ID NO: 1934269 - RNA, 14 nt, Human
gcccgggcucugcc

SEQ ID NO: 1934270 - RNA, 15 nt, Human
gcccgggcucugccu

SEQ ID NO: 1934271 - RNA, 18 nt, Human
gcccgggcucugccuccc

SEQ ID NO: 1934272 - RNA, 20 nt, Human
gccccuucugacccaugcug

SEQ ID NO: 1934273 - RNA, 19 nt, Human
gccccuucugacccaugcu

SEQ ID NO: 1934274 - RNA, 12 nt, Human
gcccggcuccag

SEQ ID NO: 1934275 - RNA, 18 nt, Human
gcccgcggggacauuggg

SEQ ID NO: 1934276 - RNA, 12 nt, Human
gccgggguggau

SEQ ID NO: 1934277 - RNA, 19 nt, Human
gccgcagcccugcagaggg

SEQ ID NO: 1934278 - RNA, 22 nt, Human
gccgcaaaccacacuggacucc

SEQ ID NO: 1934279 - RNA, 13 nt, Human
gccgggcagaggg

SEQ ID NO: 1934280 - RNA, 15 nt, Human
gccgcagcccugcag

SEQ ID NO: 1934281 - RNA, 16 nt, Human
gccgcaaaccacacug

SEQ ID NO: 1934282 - RNA, 17 nt, Human
gccgcaaaccacacugg

SEQ ID NO: 1934283 - RNA, 19 nt, Human
gccgcaaaccacacuggac

SEQ ID NO: 1934284 - RNA, 21 nt, Human
gccgcaaaccacacuggacuc

SEQ ID NO: 1934285 - RNA, 16 nt, Human
gccgcagcccugcaga

SEQ ID NO: 1934286 - RNA, 17 nt, Human
gccgcagcccugcagag

SEQ ID NO: 1934287 - RNA, 17 nt, Human
gccgagauagccaaggc

SEQ ID NO: 1934288 - RNA, 19 nt, Human
gccgagauagccaaggcca

SEQ ID NO: 1934289 - RNA, 17 nt, Human
gccgauauacucuagau

SEQ ID NO: 1934290 - RNA, 22 nt, Human
gccgauauacucuagaugaagu

SEQ ID NO: 1934291 - RNA, 14 nt, Human
gccgaguccaagcu

SEQ ID NO: 1934292 - RNA, 15 nt, Human
gccgaguccaagcug

SEQ ID NO: 1934293 - RNA, 18 nt, Human
gccgaguccaagcuggga

SEQ ID NO: 1934294 - RNA, 16 nt, Human
gccgagauagccaagg

SEQ ID NO: 1934295 - RNA, 13 nt, Human
gcccuucucucca

SEQ ID NO: 1934296 - RNA, 23 nt, Human
gccuaaaagugggcuugauucug

SEQ ID NO: 1934297 - RNA, 19 nt, Human
gccguugauucacuucacg

SEQ ID NO: 1934298 - RNA, 23 nt, Human
gccguuugagaagaaaacaucua

SEQ ID NO: 1934299 - RNA, 18 nt, Human
gccgucuaccugaggggc

SEQ ID NO: 1934300 - RNA, 20 nt, Human
gccgucuaccugaggggccu

SEQ ID NO: 1934301 - RNA, 22 nt, Human
gccgucuaccugaggggccucu

SEQ ID NO: 1934302 - RNA, 23 nt, Human
gccgucuaccugaggggccucuu

SEQ ID NO: 1934303 - RNA, 17 nt, Human
gccuauuuuaauaaaca

SEQ ID NO: 1934304 - RNA, 22 nt, Human
gccuaaaagugggcuugauucu

SEQ ID NO: 1934305 - RNA, 21 nt, Human
gccucagcauccuggcacccg

SEQ ID NO: 1934306 - RNA, 13 nt, Human
gccucagccagag

SEQ ID NO: 1934307 - RNA, 14 nt, Human
gccucagccagaga

SEQ ID NO: 1934308 - RNA, 15 nt, Human
gccucagccagagaa

SEQ ID NO: 1934309 - RNA, 16 nt, Human
gccucagccagagaag

SEQ ID NO: 1934310 - RNA, 17 nt, Human
gccucagcauccuggca

SEQ ID NO: 1934311 - RNA, 18 nt, Human
gccucagcauccuggcac

SEQ ID NO: 1934312 - RNA, 24 nt, Human
gccucaagugauucuccugccuca

SEQ ID NO: 1934313 - RNA, 22 nt, Human
gccucaagugauucuccugccu

SEQ ID NO: 1934314 - RNA, 15 nt, Human
gccucugacacacag

SEQ ID NO: 1934315 - RNA, 16 nt, Human
gccucugacacacagc

SEQ ID NO: 1934316 - RNA, 16 nt, Human
gccucugcacuccccu

SEQ ID NO: 1934317 - RNA, 17 nt, Human
gccucugcacuccccug

SEQ ID NO: 1934318 - RNA, 18 nt, Human
gccucugcacuccccugc

SEQ ID NO: 1934319 - RNA, 19 nt, Human
gccucugcacuccccugcu

SEQ ID NO: 1934320 - RNA, 20 nt, Human
gccucugcacuccccugcug

SEQ ID NO: 1934321 - RNA, 15 nt, Human
gccugaagucacaca

SEQ ID NO: 1934322 - RNA, 20 nt, Human
gccugaagaguccucugaau

SEQ ID NO: 1934323 - RNA, 18 nt, Human
gccugaagaguccucuga

SEQ ID NO: 1934324 - RNA, 17 nt, Human
gccugaaggggcgucug

SEQ ID NO: 1934325 - RNA, 18 nt, Human
gccugaaggggcgucugu

SEQ ID NO: 1934326 - RNA, 22 nt, Human
gccugaaggggcgucuguuccc

SEQ ID NO: 1934327 - RNA, 22 nt, Human
gccugagauuucaucugcucuc

SEQ ID NO: 1934328 - RNA, 18 nt, Human
gccugagauuucaucugc

SEQ ID NO: 1934329 - RNA, 16 nt, Human
gccugagauuucaucu

SEQ ID NO: 1934330 - RNA, 21 nt, Human
gccucugcacuccccugcugg

SEQ ID NO: 1934331 - RNA, 12 nt, Human
gccugcccaggc

SEQ ID NO: 1934332 - RNA, 11 nt, Human
gccugcccagg

SEQ ID NO: 1934333 - RNA, 14 nt, Human
gccuggacccugug

SEQ ID NO: 1934334 - RNA, 20 nt, Human
gccugcagagcugcgggcug

SEQ ID NO: 1934335 - RNA, 23 nt, Human
gccugagauuucaucugcucucc

SEQ ID NO: 1934336 - RNA, 18 nt, Human
gccugagcaacucuugau

SEQ ID NO: 1934337 - RNA, 20 nt, Human
gccucccgaauagcugggac

SEQ ID NO: 1934338 - RNA, 23 nt, Human
gccucccgaguagcugggacuac

SEQ ID NO: 1934339 - RNA, 21 nt, Human
gccucccgaguagcugggacu

SEQ ID NO: 1934340 - RNA, 19 nt, Human
gccucccgaauagcuggga

SEQ ID NO: 1934341 - RNA, 18 nt, Human
gccucccgaauagcuggg

SEQ ID NO: 1934342 - RNA, 22 nt, Human
gccucagccucccaaagugcug

SEQ ID NO: 1934343 - RNA, 17 nt, Human
gccucagcccugacccu

SEQ ID NO: 1934344 - RNA, 22 nt, Human
gccucagcccugacccugugga

SEQ ID NO: 1934345 - RNA, 14 nt, Human
gccucagccuccca

SEQ ID NO: 1934346 - RNA, 12 nt, Human
gccucagccucc

SEQ ID NO: 1934347 - RNA, 15 nt, Human
gccucccauccaggg

SEQ ID NO: 1934348 - RNA, 22 nt, Human
gccucccauccagggcccccau

SEQ ID NO: 1934349 - RNA, 18 nt, Human
gccucccccuagccauuu

SEQ ID NO: 1934350 - RNA, 21 nt, Human
gccucccccuagccauuuuua

SEQ ID NO: 1934351 - RNA, 10 nt, Human
gccucucugc

SEQ ID NO: 1934352 - RNA, 14 nt, Human
gccucucugcaggu

SEQ ID NO: 1934353 - RNA, 16 nt, Human
gccucucugcaggucc

SEQ ID NO: 1934354 - RNA, 17 nt, Human
gccucucugcagguccc

SEQ ID NO: 1934355 - RNA, 15 nt, Human
gccucucccaucacu

SEQ ID NO: 1934356 - RNA, 17 nt, Human
gccucccugccucaggc

SEQ ID NO: 1934357 - RNA, 13 nt, Human
gccucccugaagc

SEQ ID NO: 1934358 - RNA, 18 nt, Human
gccucccugaagccuuug

SEQ ID NO: 1934359 - RNA, 14 nt, Human
gccucccugccuca

SEQ ID NO: 1934360 - RNA, 16 nt, Human
gccucccugccucagg

SEQ ID NO: 1934361 - RNA, 15 nt, Human
gcgaccuuggccgca

SEQ ID NO: 1934362 - RNA, 13 nt, Human
gcgacuaauuuca

SEQ ID NO: 1934363 - RNA, 21 nt, Human
gcgacuaauuucaaaaugcuu

SEQ ID NO: 1934364 - RNA, 23 nt, Human
gcgacuaauuucaaaaugcuuuu

SEQ ID NO: 1934365 - RNA, 21 nt, Human
gcgacucuauagacucuagga

SEQ ID NO: 1934366 - RNA, 18 nt, Human
gcgccuacaggagugagc

SEQ ID NO: 1934367 - RNA, 17 nt, Human
gcgcccaguccuuccac

SEQ ID NO: 1934368 - RNA, 22 nt, Human
gcgccaggcugaccacagcaca

SEQ ID NO: 1934369 - RNA, 21 nt, Human
gcgccaggauggaacacggcc

SEQ ID NO: 1934370 - RNA, 22 nt, Human
gcgccaggauggaacacggcca

SEQ ID NO: 1934371 - RNA, 15 nt, Human
gcgccaggcugacca

SEQ ID NO: 1934372 - RNA, 20 nt, Human
gcgccaggcugaccacagca

SEQ ID NO: 1934373 - RNA, 17 nt, Human
gcgcugccccuggcagc

SEQ ID NO: 1934374 - RNA, 19 nt, Human
gcgcuggccgggaccccga

SEQ ID NO: 1934375 - RNA, 14 nt, Human
gcgcugccccuggc

SEQ ID NO: 1934376 - RNA, 21 nt, Human
gcgccuacaggagugagcacu

SEQ ID NO: 1934377 - RNA, 20 nt, Human
gcgccuacaggagugagcac

SEQ ID NO: 1934378 - RNA, 21 nt, Human
gcgcuccugccgcagagcugg

SEQ ID NO: 1934379 - RNA, 20 nt, Human
gcgcuccugccgcagagcug

SEQ ID NO: 1934380 - RNA, 19 nt, Human
gcgcuccugccgcagagcu

SEQ ID NO: 1934381 - RNA, 19 nt, Human
gcgcccaguccuuccaccu

SEQ ID NO: 1934382 - RNA, 23 nt, Human
gcgguccacccaggagccccgag

SEQ ID NO: 1934383 - RNA, 20 nt, Human
gcgguccacccaggagcccc

SEQ ID NO: 1934384 - RNA, 23 nt, Human
gcggggacagcuccuucuguccu

SEQ ID NO: 1934385 - RNA, 19 nt, Human
gcggggacagcuccuucug

SEQ ID NO: 1934386 - RNA, 16 nt, Human
gcggacaguggcagga

SEQ ID NO: 1934387 - RNA, 19 nt, Human
gcggacaguggcaggacag

SEQ ID NO: 1934388 - RNA, 16 nt, Human
gcggacaucagcuggu

SEQ ID NO: 1934389 - RNA, 18 nt, Human
gcggggacagcuccuucu

SEQ ID NO: 1934390 - RNA, 23 nt, Human
gcggacagccacggccaggccag

SEQ ID NO: 1934391 - RNA, 14 nt, Human
gcggacaguggcag

SEQ ID NO: 1934392 - RNA, 15 nt, Human
gcggacaguggcagg

SEQ ID NO: 1934393 - RNA, 19 nt, Human
gcggacagccacggccagg

SEQ ID NO: 1934394 - RNA, 16 nt, Human
gcggacagccacggcc

SEQ ID NO: 1934395 - RNA, 19 nt, Human
gcggaaugaaccacaucuu

SEQ ID NO: 1934396 - RNA, 21 nt, Human
gcuagacgagcaggcuucuuc

SEQ ID NO: 1934397 - RNA, 22 nt, Human
gcuagacgagcaggcuucuucc

SEQ ID NO: 1934398 - RNA, 15 nt, Human
gcgugagccacugca

SEQ ID NO: 1934399 - RNA, 16 nt, Human
gcgugagccacugcac

SEQ ID NO: 1934400 - RNA, 14 nt, Human
gcgugagccacugc

SEQ ID NO: 1934401 - RNA, 16 nt, Human
gcgucgcccucccagg

SEQ ID NO: 1934402 - RNA, 17 nt, Human
gcgucgcccucccaggc

SEQ ID NO: 1934403 - RNA, 17 nt, Human
gcuaacauggaaguacu

SEQ ID NO: 1934404 - RNA, 18 nt, Human
gcuaacauggaaguacua

SEQ ID NO: 1934405 - RNA, 14 nt, Human
gcuaacauggaagu

SEQ ID NO: 1934406 - RNA, 22 nt, Human
gcuacacaggggaaaagaggag

SEQ ID NO: 1934407 - RNA, 13 nt, Human
gcuacaccuuucu

SEQ ID NO: 1934408 - RNA, 15 nt, Human
gcuacaccuuucucc

SEQ ID NO: 1934409 - RNA, 20 nt, Human
gcuacaccuuucuccuuugu

SEQ ID NO: 1934410 - RNA, 21 nt, Human
gcuaacuagcuuggaaacugg

SEQ ID NO: 1934411 - RNA, 23 nt, Human
gcuaagaaccuggaacuugggga

SEQ ID NO: 1934412 - RNA, 16 nt, Human
gcuaagaauauuugaa

SEQ ID NO: 1934413 - RNA, 14 nt, Human
gcuaagaauauuug

SEQ ID NO: 1934414 - RNA, 16 nt, Human
gcuaagaaccuggaac

SEQ ID NO: 1934415 - RNA, 17 nt, Human
gcuaagaaccuggaacu

SEQ ID NO: 1934416 - RNA, 14 nt, Human
gcuaagaaaagauu

SEQ ID NO: 1934417 - RNA, 19 nt, Human
gccuucggccuccauccug

SEQ ID NO: 1934418 - RNA, 17 nt, Human
gccuugggcccucuggu

SEQ ID NO: 1934419 - RNA, 18 nt, Human
gccuucggccuccauccu

SEQ ID NO: 1934420 - RNA, 16 nt, Human
gccuuuuauuucuuaa

SEQ ID NO: 1934421 - RNA, 12 nt, Human
gccuuuucuauu

SEQ ID NO: 1934422 - RNA, 16 nt, Human
gccuuuugacuuucau

SEQ ID NO: 1934423 - RNA, 17 nt, Human
gccugguggcagcugcg

SEQ ID NO: 1934424 - RNA, 16 nt, Human
gccugguggcagcugc

SEQ ID NO: 1934425 - RNA, 18 nt, Human
gccuguaaucacagcuac

SEQ ID NO: 1934426 - RNA, 14 nt, Human
gccugguuuagccu

SEQ ID NO: 1934427 - RNA, 14 nt, Human
gccuguaaucccag

SEQ ID NO: 1934428 - RNA, 18 nt, Human
gccuguaaucccagcacu

SEQ ID NO: 1934429 - RNA, 15 nt, Human
gccugguggcagcug

SEQ ID NO: 1934430 - RNA, 21 nt, Human
gccuuauggaacacucugaga

SEQ ID NO: 1934431 - RNA, 22 nt, Human
gccuuauggaacacucugagac

SEQ ID NO: 1934432 - RNA, 23 nt, Human
gccuuauggaacacucugagacu

SEQ ID NO: 1934433 - RNA, 20 nt, Human
gccuuagaagucacacagua

SEQ ID NO: 1934434 - RNA, 19 nt, Human
gccuuacccucauguucuu

SEQ ID NO: 1934435 - RNA, 22 nt, Human
gccuguccuccaacaccaagca

SEQ ID NO: 1934436 - RNA, 18 nt, Human
ggucagaaacaggaccgg

SEQ ID NO: 1934437 - RNA, 13 nt, Human
ggucaggcagggu

SEQ ID NO: 1934438 - RNA, 21 nt, Human
ggucaggaguuccuaaccagc

SEQ ID NO: 1934439 - RNA, 15 nt, Human
ggucagaaacaggac

SEQ ID NO: 1934440 - RNA, 16 nt, Human
ggucagaaacaggacc

SEQ ID NO: 1934441 - RNA, 17 nt, Human
ggucagaaacaggaccg

SEQ ID NO: 1934442 - RNA, 11 nt, Human
ggucagagccu

SEQ ID NO: 1934443 - RNA, 15 nt, Human
ggucccaccccacac

SEQ ID NO: 1934444 - RNA, 16 nt, Human
ggucccaccccacaca

SEQ ID NO: 1934445 - RNA, 19 nt, Human
ggucaacauggugaaaccc

SEQ ID NO: 1934446 - RNA, 12 nt, Human
ggucacucuggc

SEQ ID NO: 1934447 - RNA, 17 nt, Human
gguacuuguggacacag

SEQ ID NO: 1934448 - RNA, 16 nt, Human
gguacuuguggacaca

SEQ ID NO: 1934449 - RNA, 20 nt, Human
gguacuuguggacacagcuc

SEQ ID NO: 1934450 - RNA, 19 nt, Human
gguacuucuugaaggugcu

SEQ ID NO: 1934451 - RNA, 22 nt, Human
gguagaaauaucugaaaaugua

SEQ ID NO: 1934452 - RNA, 13 nt, Human
gguacccacugcu

SEQ ID NO: 1934453 - RNA, 16 nt, Human
gguacccacugcucug

SEQ ID NO: 1934454 - RNA, 15 nt, Human
gguacuucuugaagg

SEQ ID NO: 1934455 - RNA, 16 nt, Human
gguacuucuugaaggu

SEQ ID NO: 1934456 - RNA, 11 nt, Human
gguacccacug

SEQ ID NO: 1934457 - RNA, 20 nt, Human
gguaccaguugaaauuuuug

SEQ ID NO: 1934458 - RNA, 23 nt, Human
gguagaaauaucugaaaauguau

SEQ ID NO: 1934459 - RNA, 22 nt, Human
gguagaagcccuucuaccuucc

SEQ ID NO: 1934460 - RNA, 11 nt, Human
gguagaacaca

SEQ ID NO: 1934461 - RNA, 21 nt, Human
gguagccagcacacagggcag

SEQ ID NO: 1934462 - RNA, 18 nt, Human
gguagcauuuguguugaa

SEQ ID NO: 1934463 - RNA, 13 nt, Human
gguagccagcaca

SEQ ID NO: 1934464 - RNA, 16 nt, Human
gguagccagcacacag

SEQ ID NO: 1934465 - RNA, 12 nt, Human
gggugaaggcug

SEQ ID NO: 1934466 - RNA, 13 nt, Human
gggugaaggcugg

SEQ ID NO: 1934467 - RNA, 14 nt, Human
gggugaaggcuggc

SEQ ID NO: 1934468 - RNA, 15 nt, Human
gggugaaggcuggca

SEQ ID NO: 1934469 - RNA, 17 nt, Human
gggugaagugaagacaa

SEQ ID NO: 1934470 - RNA, 19 nt, Human
gggugacagagcaagugag

SEQ ID NO: 1934471 - RNA, 20 nt, Human
gggucuugguuccagccugc

SEQ ID NO: 1934472 - RNA, 20 nt, Human
gggugaacaaagcagccacg

SEQ ID NO: 1934473 - RNA, 17 nt, Human
gggugagaacaaccaaa

SEQ ID NO: 1934474 - RNA, 14 nt, Human
gggugaggagcugg

SEQ ID NO: 1934475 - RNA, 15 nt, Human
gggugaggagcuggg

SEQ ID NO: 1934476 - RNA, 23 nt, Human
gggugcaguaucaugcccugugc

SEQ ID NO: 1934477 - RNA, 21 nt, Human
ggguuggagcaguagcuggag

SEQ ID NO: 1934478 - RNA, 12 nt, Human
ggguucuaccca

SEQ ID NO: 1934479 - RNA, 23 nt, Human
ggguucaagcgauucuucugcuu

SEQ ID NO: 1934480 - RNA, 20 nt, Human
ggguucaccugggcugaggc

SEQ ID NO: 1934481 - RNA, 22 nt, Human
ggguucaagcgauucuucugcu

SEQ ID NO: 1934482 - RNA, 17 nt, Human
gggugcugggccccugc

SEQ ID NO: 1934483 - RNA, 14 nt, Human
gggucucacucugu

SEQ ID NO: 1934484 - RNA, 17 nt, Human
ggguaagugagagaggg

SEQ ID NO: 1934485 - RNA, 16 nt, Human
gggguggggucaugcc

SEQ ID NO: 1934486 - RNA, 21 nt, Human
gggucugaggaauccagaccc

SEQ ID NO: 1934487 - RNA, 12 nt, Human
gggucugaggaa

SEQ ID NO: 1934488 - RNA, 22 nt, Human
gggucuggaguugaucuggaac

SEQ ID NO: 1934489 - RNA, 22 nt, Human
gggucuggcagccucccaucca

SEQ ID NO: 1934490 - RNA, 20 nt, Human
gggucuggaguugaucugga

SEQ ID NO: 1934491 - RNA, 12 nt, Human
gggguggccucc

SEQ ID NO: 1934492 - RNA, 18 nt, Human
ggggugcugggccccugc

SEQ ID NO: 1934493 - RNA, 22 nt, Human
gggggagccccuucugcucagc

SEQ ID NO: 1934494 - RNA, 20 nt, Human
gggguggggggggugcuggg

SEQ ID NO: 1934495 - RNA, 14 nt, Human
ggggugggccaggc

SEQ ID NO: 1934496 - RNA, 17 nt, Human
ggggugggccaggcuga

SEQ ID NO: 1934497 - RNA, 17 nt, Human
gggguggggaccucagg

SEQ ID NO: 1934498 - RNA, 13 nt, Human
ggggugggccagg

SEQ ID NO: 1934499 - RNA, 22 nt, Human
gggggaggugggauccuccagg

SEQ ID NO: 1934500 - RNA, 23 nt, Human
ggggcugcaccggcuggccuggc

SEQ ID NO: 1934501 - RNA, 19 nt, Human
ggggcugaggugggaggau

SEQ ID NO: 1934502 - RNA, 12 nt, Human
ggggcugcaccg

SEQ ID NO: 1934503 - RNA, 21 nt, Human
ggggcugcaccggcuggccug

SEQ ID NO: 1934504 - RNA, 22 nt, Human
ggggcugcaccggcuggccugg

SEQ ID NO: 1934505 - RNA, 14 nt, Human
ggggagggugacag

SEQ ID NO: 1934506 - RNA, 21 nt, Human
ggggaaaaucagccugcucca

SEQ ID NO: 1934507 - RNA, 15 nt, Human
ggggaaaagagauga

SEQ ID NO: 1934508 - RNA, 22 nt, Human
gggcuuggggaccagagcugcc

SEQ ID NO: 1934509 - RNA, 16 nt, Human
ggggaaaaucagccug

SEQ ID NO: 1934510 - RNA, 17 nt, Human
ggggaaaaucagccugc

SEQ ID NO: 1934511 - RNA, 19 nt, Human
ggggaaaaucagccugcuc

SEQ ID NO: 1934512 - RNA, 17 nt, Human
ggggcugaggugggagg

SEQ ID NO: 1934513 - RNA, 14 nt, Human
ggggcucuucucau

SEQ ID NO: 1934514 - RNA, 12 nt, Human
ggggcucuggga

SEQ ID NO: 1934515 - RNA, 24 nt, Human
ggggcucucauguuuucaacugcc

SEQ ID NO: 1934516 - RNA, 20 nt, Human
ggggcgucuguucccccuuc

SEQ ID NO: 1934517 - RNA, 18 nt, Human
ggggcgucuguucccccu

SEQ ID NO: 1934518 - RNA, 16 nt, Human
ggggcaacccugguga

SEQ ID NO: 1934519 - RNA, 13 nt, Human
gguugagguuuca

SEQ ID NO: 1934520 - RNA, 23 nt, Human
gguucacucuuggagccugcaga

SEQ ID NO: 1934521 - RNA, 21 nt, Human
gguucacucuuggagccugca

SEQ ID NO: 1934522 - RNA, 21 nt, Human
gguucaaagauauuuugcuuu

SEQ ID NO: 1934523 - RNA, 20 nt, Human
gguucacucuuggagccugc

SEQ ID NO: 1934524 - RNA, 19 nt, Human
gguucacucuuggagccug

SEQ ID NO: 1934525 - RNA, 13 nt, Human
gguucaaagauau

SEQ ID NO: 1934526 - RNA, 21 nt, Human
gguuacccaguuagcucucaa

SEQ ID NO: 1934527 - RNA, 17 nt, Human
gguuaggcauuguggga

SEQ ID NO: 1934528 - RNA, 13 nt, Human
gguuauggagagg

SEQ ID NO: 1934529 - RNA, 17 nt, Human
ggugucaagagggucug

SEQ ID NO: 1934530 - RNA, 19 nt, Human
ggugucaagagggucugag

SEQ ID NO: 1934531 - RNA, 19 nt, Human
ggugucaccugaagacuca

SEQ ID NO: 1934532 - RNA, 18 nt, Human
ggugguuucagaaaugug

SEQ ID NO: 1934533 - RNA, 17 nt, Human
ggugguuucagaaaugu

SEQ ID NO: 1934534 - RNA, 21 nt, Human
ggugguuauggagaggguguc

SEQ ID NO: 1934535 - RNA, 23 nt, Human
ggugguucacucuuggagccugc

SEQ ID NO: 1934536 - RNA, 22 nt, Human
ggugguucacucuuggagccug

SEQ ID NO: 1934537 - RNA, 18 nt, Human
ggugguuuucuguucuuu

SEQ ID NO: 1934538 - RNA, 15 nt, Human
ggugguuuucuguuc

SEQ ID NO: 1934539 - RNA, 21 nt, Human
gguggugucuccaacccccca

SEQ ID NO: 1934540 - RNA, 21 nt, Human
ggugguugcuguuuuccuccc

SEQ ID NO: 1934541 - RNA, 23 nt, Human
ggugguugcuguuuuccucccuu

SEQ ID NO: 1934542 - RNA, 15 nt, Human
gguggugaccucugc

SEQ ID NO: 1934543 - RNA, 14 nt, Human
gguggugaccucug

SEQ ID NO: 1934544 - RNA, 16 nt, Human
gguggugaccucugcc

SEQ ID NO: 1934545 - RNA, 21 nt, Human
gguggugcagguagaccuguc

SEQ ID NO: 1934546 - RNA, 14 nt, Human
ggugguaacccugg

SEQ ID NO: 1934547 - RNA, 23 nt, Human
gguggggucaugcccuccucucc

SEQ ID NO: 1934548 - RNA, 21 nt, Human
gguggcuagucaagcuccucc

SEQ ID NO: 1934549 - RNA, 22 nt, Human
gguggcuagucaagcuccuccu

SEQ ID NO: 1934550 - RNA, 23 nt, Human
gguggcuagucaagcuccuccuc

SEQ ID NO: 1934551 - RNA, 16 nt, Human
ggugagaggggaacag

SEQ ID NO: 1934552 - RNA, 20 nt, Human
ggugagagggccgggcagag

SEQ ID NO: 1934553 - RNA, 21 nt, Human
ggugagagggccgggcagagg

SEQ ID NO: 1934554 - RNA, 15 nt, Human
ggugagaagcagagg

SEQ ID NO: 1934555 - RNA, 16 nt, Human
ggugcuaucuccccca

SEQ ID NO: 1934556 - RNA, 17 nt, Human
ggugcuaucucccccag

SEQ ID NO: 1934557 - RNA, 19 nt, Human
ggugcuaucucccccagcc

SEQ ID NO: 1934558 - RNA, 20 nt, Human
ggugcuaucucccccagccc

SEQ ID NO: 1934559 - RNA, 22 nt, Human
gguggcagugggagcugccugu

SEQ ID NO: 1934560 - RNA, 19 nt, Human
gguggcagugggagcugcc

SEQ ID NO: 1934561 - RNA, 21 nt, Human
ggugcugccauccagguucag

SEQ ID NO: 1934562 - RNA, 15 nt, Human
ggugcugccauccag

SEQ ID NO: 1934563 - RNA, 21 nt, Human
ggugcugacuucaucucccac

SEQ ID NO: 1934564 - RNA, 13 nt, Human
ggugcugagaagc

SEQ ID NO: 1934565 - RNA, 21 nt, Human
ggugcuaucucccccagcccc

SEQ ID NO: 1934566 - RNA, 15 nt, Human
ggugcugacggccag

SEQ ID NO: 1934567 - RNA, 16 nt, Human
ggugcugacggccagg

SEQ ID NO: 1934568 - RNA, 17 nt, Human
ggugcugacggccaggg

SEQ ID NO: 1934569 - RNA, 20 nt, Human
ggugcugacggccagggaga

SEQ ID NO: 1934570 - RNA, 23 nt, Human
gguggccucccaacucaccccag

SEQ ID NO: 1934571 - RNA, 17 nt, Human
gguggccaugccucagc

SEQ ID NO: 1934572 - RNA, 20 nt, Human
gguggccaugccucagcccu

SEQ ID NO: 1934573 - RNA, 20 nt, Human
gguggcuagucaagcuccuc

SEQ ID NO: 1934574 - RNA, 21 nt, Human
gguggcgacucuauagacucu

SEQ ID NO: 1934575 - RNA, 10 nt, Human
gguggccaug

SEQ ID NO: 1934576 - RNA, 22 nt, Human
gguggccucccaacucacccca

SEQ ID NO: 1934577 - RNA, 22 nt, Human
ggugaccagcaccaucucuccu

SEQ ID NO: 1934578 - RNA, 19 nt, Human
ggugaccuuccaagagccu

SEQ ID NO: 1934579 - RNA, 21 nt, Human
ggugaccuuccaagagccuga

SEQ ID NO: 1934580 - RNA, 20 nt, Human
ggugaccuuccaagagccug

SEQ ID NO: 1934581 - RNA, 14 nt, Human
ggucugacccacug

SEQ ID NO: 1934582 - RNA, 21 nt, Human
ggugacagagugagacucugu

SEQ ID NO: 1934583 - RNA, 12 nt, Human
ggugacaguggc

SEQ ID NO: 1934584 - RNA, 23 nt, Human
ggucucacucugucgcccagucu

SEQ ID NO: 1934585 - RNA, 22 nt, Human
ggucucacucugucgcccaguc

SEQ ID NO: 1934586 - RNA, 17 nt, Human
ggucucaaacuccugac

SEQ ID NO: 1934587 - RNA, 17 nt, Human
ggucccaccccacacac

SEQ ID NO: 1934588 - RNA, 14 nt, Human
ggucccaccccaca

SEQ ID NO: 1934589 - RNA, 14 nt, Human
gggcccagaggagc

SEQ ID NO: 1934590 - RNA, 12 nt, Human
gggcccagagga

SEQ ID NO: 1934591 - RNA, 20 nt, Human
gggcccagagcccagcucca

SEQ ID NO: 1934592 - RNA, 17 nt, Human
gggcccagagcccagcu

SEQ ID NO: 1934593 - RNA, 19 nt, Human
gggcccagagcccagcucc

SEQ ID NO: 1934594 - RNA, 11 nt, Human
gggcccagagc

SEQ ID NO: 1934595 - RNA, 12 nt, Human
gggcccagagcc

SEQ ID NO: 1934596 - RNA, 13 nt, Human
gggcccagagccc

SEQ ID NO: 1934597 - RNA, 15 nt, Human
gggcccagagcccag

SEQ ID NO: 1934598 - RNA, 16 nt, Human
gggcccagagcccagc

SEQ ID NO: 1934599 - RNA, 17 nt, Human
gggcccagagagggugg

SEQ ID NO: 1934600 - RNA, 16 nt, Human
gggccacagagaaagu

SEQ ID NO: 1934601 - RNA, 23 nt, Human
gggccacagagaaaguacuucuc

SEQ ID NO: 1934602 - RNA, 12 nt, Human
gggcaugacacg

SEQ ID NO: 1934603 - RNA, 18 nt, Human
gggcagugggucccagau

SEQ ID NO: 1934604 - RNA, 20 nt, Human
gggcagugguguggagaagc

SEQ ID NO: 1934605 - RNA, 19 nt, Human
gggccuggccugagcuggg

SEQ ID NO: 1934606 - RNA, 14 nt, Human
gggccuggccugag

SEQ ID NO: 1934607 - RNA, 18 nt, Human
gggccuggccugagcugg

SEQ ID NO: 1934608 - RNA, 17 nt, Human
gggccuggcucaggugg

SEQ ID NO: 1934609 - RNA, 13 nt, Human
gggccuggcuccc

SEQ ID NO: 1934610 - RNA, 22 nt, Human
gggccccugccucucugcaggu

SEQ ID NO: 1934611 - RNA, 13 nt, Human
gggcccugccucc

SEQ ID NO: 1934612 - RNA, 13 nt, Human
gggccuggccuga

SEQ ID NO: 1934613 - RNA, 14 nt, Human
gggcccccaucuca

SEQ ID NO: 1934614 - RNA, 13 nt, Human
gggccccugccuc

SEQ ID NO: 1934615 - RNA, 15 nt, Human
gggccccugccucuc

SEQ ID NO: 1934616 - RNA, 13 nt, Human
gggccccugccag

SEQ ID NO: 1934617 - RNA, 17 nt, Human
gggccccugccucucug

SEQ ID NO: 1934618 - RNA, 18 nt, Human
gggccccugccucucugc

SEQ ID NO: 1934619 - RNA, 19 nt, Human
gggccccugccucucugca

SEQ ID NO: 1934620 - RNA, 21 nt, Human
gggccccugccucucugcagg

SEQ ID NO: 1934621 - RNA, 22 nt, Human
gggcagggccgcccgggcccag

SEQ ID NO: 1934622 - RNA, 14 nt, Human
gggcagggccgccc

SEQ ID NO: 1934623 - RNA, 13 nt, Human
gggcagggcagcc

SEQ ID NO: 1934624 - RNA, 18 nt, Human
gggcagggcucccacaga

SEQ ID NO: 1934625 - RNA, 23 nt, Human
gggcaggggagggucagccaggg

SEQ ID NO: 1934626 - RNA, 15 nt, Human
gggcagggcucccac

SEQ ID NO: 1934627 - RNA, 23 nt, Human
gggcagggccgcccgggcccaga

SEQ ID NO: 1934628 - RNA, 11 nt, Human
gggcagagcag

SEQ ID NO: 1934629 - RNA, 12 nt, Human
gggcagagcaga

SEQ ID NO: 1934630 - RNA, 17 nt, Human
gggcagguugguggggg

SEQ ID NO: 1934631 - RNA, 20 nt, Human
gggcacucagaagacacuga

SEQ ID NO: 1934632 - RNA, 14 nt, Human
gggcagaaggaaga

SEQ ID NO: 1934633 - RNA, 18 nt, Human
gggcagaaggaagacuuc

SEQ ID NO: 1934634 - RNA, 23 nt, Human
gggcacaggugucugcccccucu

SEQ ID NO: 1934635 - RNA, 13 nt, Human
gggcacagggucu

SEQ ID NO: 1934636 - RNA, 16 nt, Human
gggcacagggucucua

SEQ ID NO: 1934637 - RNA, 14 nt, Human
gggcacccucccac

SEQ ID NO: 1934638 - RNA, 12 nt, Human
gggcacccaccc

SEQ ID NO: 1934639 - RNA, 12 nt, Human
gggcaccugcca

SEQ ID NO: 1934640 - RNA, 19 nt, Human
gggcacucagaagacacug

SEQ ID NO: 1934641 - RNA, 16 nt, Human
gggcacucagaagaca

SEQ ID NO: 1934642 - RNA, 23 nt, Human
gggcacaccgggcacucagaaga

SEQ ID NO: 1934643 - RNA, 15 nt, Human
gggcacacgccuccc

SEQ ID NO: 1934644 - RNA, 18 nt, Human
gggcacagaaaauggaag

SEQ ID NO: 1934645 - RNA, 19 nt, Human
gggcacacgccucccacug

SEQ ID NO: 1934646 - RNA, 20 nt, Human
gggcacagaaaauggaagac

SEQ ID NO: 1934647 - RNA, 21 nt, Human
gggcacagaaaauggaagaca

SEQ ID NO: 1934648 - RNA, 14 nt, Human
gggcacaggccaug

SEQ ID NO: 1934649 - RNA, 16 nt, Human
gggcacaggccaugga

SEQ ID NO: 1934650 - RNA, 14 nt, Human
gggagugagcuggu

SEQ ID NO: 1934651 - RNA, 11 nt, Human
gggagugagcu

SEQ ID NO: 1934652 - RNA, 18 nt, Human
gggagugacagaggcagc

SEQ ID NO: 1934653 - RNA, 17 nt, Human
gggaguuaagaccuggc

SEQ ID NO: 1934654 - RNA, 20 nt, Human
gggaguuaagaccuggcagc

SEQ ID NO: 1934655 - RNA, 23 nt, Human
gggaguuaagaccuggcagcucu

SEQ ID NO: 1934656 - RNA, 19 nt, Human
gggaguggggaagugaucu

SEQ ID NO: 1934657 - RNA, 11 nt, Human
gggagugugua

SEQ ID NO: 1934658 - RNA, 17 nt, Human
gggaguguacucccagg

SEQ ID NO: 1934659 - RNA, 18 nt, Human
gggaguguacucccaggg

SEQ ID NO: 1934660 - RNA, 15 nt, Human
gggaguuaagaccug

SEQ ID NO: 1934661 - RNA, 16 nt, Human
gggaguuaagaccugg

SEQ ID NO: 1934662 - RNA, 16 nt, Human
gggaggugaccccagg

SEQ ID NO: 1934663 - RNA, 15 nt, Human
gggacugaagccaaa

SEQ ID NO: 1934664 - RNA, 18 nt, Human
gggacugaagccaaaguu

SEQ ID NO: 1934665 - RNA, 18 nt, Human
gggacugaaaaccucucc

SEQ ID NO: 1934666 - RNA, 19 nt, Human
gggacugaaaaccucuccu

SEQ ID NO: 1934667 - RNA, 17 nt, Human
gggaggugggauccucc

SEQ ID NO: 1934668 - RNA, 13 nt, Human
gggacugagaaau

SEQ ID NO: 1934669 - RNA, 13 nt, Human
gggauagagagag

SEQ ID NO: 1934670 - RNA, 13 nt, Human
gggauagaugugu

SEQ ID NO: 1934671 - RNA, 21 nt, Human
gggauaugauuuaaaucagcc

SEQ ID NO: 1934672 - RNA, 14 nt, Human
gggauagaugugug

SEQ ID NO: 1934673 - RNA, 15 nt, Human
gggauccuccaggug

SEQ ID NO: 1934674 - RNA, 16 nt, Human
gggauccuccaggugc

SEQ ID NO: 1934675 - RNA, 22 nt, Human
gggaucaaccagcuaagaaaag

SEQ ID NO: 1934676 - RNA, 23 nt, Human
gggauccuggaguucugguuccu

SEQ ID NO: 1934677 - RNA, 20 nt, Human
gggaucccucccccccaugc

SEQ ID NO: 1934678 - RNA, 18 nt, Human
gggcaacccuggugacca

SEQ ID NO: 1934679 - RNA, 20 nt, Human
gggcaacccccagccugcua

SEQ ID NO: 1934680 - RNA, 20 nt, Human
gggaugacaugcacucagcu

SEQ ID NO: 1934681 - RNA, 19 nt, Human
gggaucugguccuacccau

SEQ ID NO: 1934682 - RNA, 23 nt, Human
gggaucugguccuacccaucccc

SEQ ID NO: 1934683 - RNA, 15 nt, Human
gggcacaaagggccc

SEQ ID NO: 1934684 - RNA, 16 nt, Human
gggcacaaagggccca

SEQ ID NO: 1934685 - RNA, 17 nt, Human
gggcacaaagggcccag

SEQ ID NO: 1934686 - RNA, 22 nt, Human
ggcuugaguuuaaauuguaaua

SEQ ID NO: 1934687 - RNA, 21 nt, Human
ggcuuggggaccagagcugcc

SEQ ID NO: 1934688 - RNA, 19 nt, Human
ggcuuggggaccagagcug

SEQ ID NO: 1934689 - RNA, 15 nt, Human
ggcuuggggcuuccu

SEQ ID NO: 1934690 - RNA, 10 nt, Human
ggcuuuugug

SEQ ID NO: 1934691 - RNA, 12 nt, Human
ggcugggcuuca

SEQ ID NO: 1934692 - RNA, 18 nt, Human
ggcugggcucccuuccca

SEQ ID NO: 1934693 - RNA, 17 nt, Human
ggcugggcucccuuccc

SEQ ID NO: 1934694 - RNA, 17 nt, Human
ggcugggcuucaguggc

SEQ ID NO: 1934695 - RNA, 13 nt, Human
ggcugggcuucag

SEQ ID NO: 1934696 - RNA, 18 nt, Human
ggcugggcuucaguggca

SEQ ID NO: 1934697 - RNA, 23 nt, Human
ggcuuaaacccauauuguaaaac

SEQ ID NO: 1934698 - RNA, 21 nt, Human
ggcuuagucacugagacagcc

SEQ ID NO: 1934699 - RNA, 13 nt, Human
ggcuuacacccac

SEQ ID NO: 1934700 - RNA, 16 nt, Human
ggcuuacggcccuggc

SEQ ID NO: 1934701 - RNA, 17 nt, Human
ggcuuacggcccuggcc

SEQ ID NO: 1934702 - RNA, 21 nt, Human
ggcuugagaaauauggacacu

SEQ ID NO: 1934703 - RNA, 20 nt, Human
ggcuugagcccccgcgccca

SEQ ID NO: 1934704 - RNA, 16 nt, Human
gggacucaaugcacug

SEQ ID NO: 1934705 - RNA, 17 nt, Human
gggacuacaggcaccca

SEQ ID NO: 1934706 - RNA, 22 nt, Human
gggacguggcucagccagcacu

SEQ ID NO: 1934707 - RNA, 20 nt, Human
gggacguggcucagccagca

SEQ ID NO: 1934708 - RNA, 19 nt, Human
gggacguggcucagccagc

SEQ ID NO: 1934709 - RNA, 19 nt, Human
gggaccuauaacugcccag

SEQ ID NO: 1934710 - RNA, 12 nt, Human
gggaccucuccc

SEQ ID NO: 1934711 - RNA, 16 nt, Human
gggaccucucccaggg

SEQ ID NO: 1934712 - RNA, 23 nt, Human
gggaccucucccagggucccugg

SEQ ID NO: 1934713 - RNA, 12 nt, Human
gggaccucaggc

SEQ ID NO: 1934714 - RNA, 17 nt, Human
gggaccuauaacugccc

SEQ ID NO: 1934715 - RNA, 13 nt, Human
gggaccucaggcc

SEQ ID NO: 1934716 - RNA, 15 nt, Human
gggaccucaggccug

SEQ ID NO: 1934717 - RNA, 22 nt, Human
gggacaaagaggccuuuaacca

SEQ ID NO: 1934718 - RNA, 15 nt, Human
gggacaaagaggccu

SEQ ID NO: 1934719 - RNA, 16 nt, Human
gggacaaagaggccuu

SEQ ID NO: 1934720 - RNA, 15 nt, Human
gggaauggcagcugc

SEQ ID NO: 1934721 - RNA, 18 nt, Human
gggaccccgagccuggcu

SEQ ID NO: 1934722 - RNA, 20 nt, Human
gggaccccgagccuggcucc

SEQ ID NO: 1934723 - RNA, 18 nt, Human
gggacaaguggacucagg

SEQ ID NO: 1934724 - RNA, 20 nt, Human
gggaccccuggugguucacu

SEQ ID NO: 1934725 - RNA, 23 nt, Human
gggaaggauacaaaagcauguga

SEQ ID NO: 1934726 - RNA, 21 nt, Human
gggaaggauacaaaagcaugu

SEQ ID NO: 1934727 - RNA, 14 nt, Human
ggcuuuugugcauu

SEQ ID NO: 1934728 - RNA, 17 nt, Human
gggaagggggcugggac

SEQ ID NO: 1934729 - RNA, 18 nt, Human
gggaaggggacccccgcc

SEQ ID NO: 1934730 - RNA, 14 nt, Human
gggaagggggcugg

SEQ ID NO: 1934731 - RNA, 16 nt, Human
gggaagggggcuggga

SEQ ID NO: 1934732 - RNA, 13 nt, Human
gggaaugaagaua

SEQ ID NO: 1934733 - RNA, 22 nt, Human
gggaauggcacagcccaaagaa

SEQ ID NO: 1934734 - RNA, 16 nt, Human
gggaauggcacagccc

SEQ ID NO: 1934735 - RNA, 18 nt, Human
ggcugcaaaggguaucag

SEQ ID NO: 1934736 - RNA, 23 nt, Human
ggcugcaaaggguaucaggugcu

SEQ ID NO: 1934737 - RNA, 22 nt, Human
ggcugcaaaggguaucaggugc

SEQ ID NO: 1934738 - RNA, 15 nt, Human
ggcugauggaguaaa

SEQ ID NO: 1934739 - RNA, 24 nt, Human
ggcugcaaaggguaucaggugcug

SEQ ID NO: 1934740 - RNA, 17 nt, Human
ggcugcaccggcuggcc

SEQ ID NO: 1934741 - RNA, 18 nt, Human
ggcugcaccggcuggccu

SEQ ID NO: 1934742 - RNA, 19 nt, Human
ggcugcaccggcuggccug

SEQ ID NO: 1934743 - RNA, 22 nt, Human
ggcugcaagguuuaggcuggug

SEQ ID NO: 1934744 - RNA, 22 nt, Human
ggcugcagccaggccacuggcc

SEQ ID NO: 1934745 - RNA, 16 nt, Human
ggcugcagccaggcca

SEQ ID NO: 1934746 - RNA, 13 nt, Human
ggcugagguggga

SEQ ID NO: 1934747 - RNA, 15 nt, Human
ggcugaggugggagg

SEQ ID NO: 1934748 - RNA, 17 nt, Human
ggccccugcccggcugc

SEQ ID NO: 1934749 - RNA, 16 nt, Human
ggccccugcccggcug

SEQ ID NO: 1934750 - RNA, 20 nt, Human
ggccccugcccggcugcgga

SEQ ID NO: 1934751 - RNA, 17 nt, Human
ggcucugccucccauca

SEQ ID NO: 1934752 - RNA, 13 nt, Human
ggcucuggagccc

SEQ ID NO: 1934753 - RNA, 14 nt, Human
ggcucuggagccca

SEQ ID NO: 1934754 - RNA, 20 nt, Human
ggccccugccagacccccug

SEQ ID NO: 1934755 - RNA, 13 nt, Human
ggcugcagggagu

SEQ ID NO: 1934756 - RNA, 14 nt, Human
ggcugcugaaggcu

SEQ ID NO: 1934757 - RNA, 12 nt, Human
ggcugcagggag

SEQ ID NO: 1934758 - RNA, 18 nt, Human
ggcugcugaaggcucgag

SEQ ID NO: 1934759 - RNA, 15 nt, Human
ggcugcugaaggcuc

SEQ ID NO: 1934760 - RNA, 17 nt, Human
ggcugcugaaggcucga

SEQ ID NO: 1934761 - RNA, 11 nt, Human
ggcugcuucaa

SEQ ID NO: 1934762 - RNA, 12 nt, Human
ggcugcuucaag

SEQ ID NO: 1934763 - RNA, 14 nt, Human
ggcugcuucaagga

SEQ ID NO: 1934764 - RNA, 22 nt, Human
ggcugcuucaaggauccugagc

SEQ ID NO: 1934765 - RNA, 18 nt, Human
ggcugggagagccuucca

SEQ ID NO: 1934766 - RNA, 15 nt, Human
ggcugggcagaggaa

SEQ ID NO: 1934767 - RNA, 19 nt, Human
ggcugggcagaggaaagca

SEQ ID NO: 1934768 - RNA, 13 nt, Human
ggcugggcagagg

SEQ ID NO: 1934769 - RNA, 14 nt, Human
ggcugggcagagga

SEQ ID NO: 1934770 - RNA, 20 nt, Human
ggcugggagagccuuccagg

SEQ ID NO: 1934771 - RNA, 23 nt, Human
ggcugggagagccuuccaggggu

SEQ ID NO: 1934772 - RNA, 19 nt, Human
ggcugggagagccuuccag

SEQ ID NO: 1934773 - RNA, 23 nt, Human
ggcugcuucaaggauccugagcc

SEQ ID NO: 1934774 - RNA, 14 nt, Human
ggcugcuuagaauc

SEQ ID NO: 1934775 - RNA, 15 nt, Human
ggcugcuuuccaaag

SEQ ID NO: 1934776 - RNA, 20 nt, Human
ggaaaaaauaacaaugaaag

SEQ ID NO: 1934777 - RNA, 14 nt, Human
gcuuuuacuuaaac

SEQ ID NO: 1934778 - RNA, 21 nt, Human
gcuuuuacugaagccuuucuu

SEQ ID NO: 1934779 - RNA, 15 nt, Human
ggaaaaauagccugc

SEQ ID NO: 1934780 - RNA, 14 nt, Human
ggaaaacgcucucu

SEQ ID NO: 1934781 - RNA, 13 nt, Human
ggaaaaauagccu

SEQ ID NO: 1934782 - RNA, 19 nt, Human
ggaaaaaccacccccaaau

SEQ ID NO: 1934783 - RNA, 14 nt, Human
ggaaaaacugauuu

SEQ ID NO: 1934784 - RNA, 13 nt, Human
gcuuuggcuucuu

SEQ ID NO: 1934785 - RNA, 15 nt, Human
gcuuugggagaaugu

SEQ ID NO: 1934786 - RNA, 17 nt, Human
gcuuuggauuugacauu

SEQ ID NO: 1934787 - RNA, 15 nt, Human
gcuuuggagaagagu

SEQ ID NO: 1934788 - RNA, 17 nt, Human
gcuuuauuccagaaugc

SEQ ID NO: 1934789 - RNA, 13 nt, Human
gcuuuaugcugaa

SEQ ID NO: 1934790 - RNA, 14 nt, Human
gcuuuaugcugaaa

SEQ ID NO: 1934791 - RNA, 13 nt, Human
gcuuuaauaaugu

SEQ ID NO: 1934792 - RNA, 14 nt, Human
gcuugauucugcag

SEQ ID NO: 1934793 - RNA, 22 nt, Human
gcuugaggguugggcugguguc

SEQ ID NO: 1934794 - RNA, 19 nt, Human
gcuucuggugaccuuccaa

SEQ ID NO: 1934795 - RNA, 14 nt, Human
gcuuggaggaagga

SEQ ID NO: 1934796 - RNA, 15 nt, Human
gcuuggaggaaggaa

SEQ ID NO: 1934797 - RNA, 13 nt, Human
gcuuggaggaagg

SEQ ID NO: 1934798 - RNA, 19 nt, Human
gcuugcccuggugccucac

SEQ ID NO: 1934799 - RNA, 17 nt, Human
gcuugcccuggugccuc

SEQ ID NO: 1934800 - RNA, 17 nt, Human
gcuucucacugccaugc

SEQ ID NO: 1934801 - RNA, 15 nt, Human
gcuucuccuguguga

SEQ ID NO: 1934802 - RNA, 19 nt, Human
gcuucucugugaacgauuu

SEQ ID NO: 1934803 - RNA, 21 nt, Human
gcuuccagugaggcucugccc

SEQ ID NO: 1934804 - RNA, 19 nt, Human
gcuuccagugaggcucugc

SEQ ID NO: 1934805 - RNA, 20 nt, Human
gcuuccagugaggcucugcc

SEQ ID NO: 1934806 - RNA, 13 nt, Human
gcuguucagcugg

SEQ ID NO: 1934807 - RNA, 19 nt, Human
ggaagaucucugcagggcc

SEQ ID NO: 1934808 - RNA, 20 nt, Human
ggaagaucucugcagggccg

SEQ ID NO: 1934809 - RNA, 17 nt, Human
ggaagcacagcuucauu

SEQ ID NO: 1934810 - RNA, 13 nt, Human
ggaagcacaugcc

SEQ ID NO: 1934811 - RNA, 14 nt, Human
ggaagcacaugccu

SEQ ID NO: 1934812 - RNA, 15 nt, Human
ggaagcacaugccuc

SEQ ID NO: 1934813 - RNA, 17 nt, Human
ggaagcacaugccucuc

SEQ ID NO: 1934814 - RNA, 13 nt, Human
ggaagagccuugc

SEQ ID NO: 1934815 - RNA, 23 nt, Human
ggaagcacaugccucucucaggc

SEQ ID NO: 1934816 - RNA, 21 nt, Human
ggaagcacaugccucucucag

SEQ ID NO: 1934817 - RNA, 22 nt, Human
ggaagcacaugccucucucagg

SEQ ID NO: 1934818 - RNA, 15 nt, Human
ggaagccagcaggcu

SEQ ID NO: 1934819 - RNA, 16 nt, Human
ggaagccagcaggcuc

SEQ ID NO: 1934820 - RNA, 17 nt, Human
ggaagccagcaggcucu

SEQ ID NO: 1934821 - RNA, 18 nt, Human
ggaagccagcaggcucuc

SEQ ID NO: 1934822 - RNA, 13 nt, Human
ggaagccagcagg

SEQ ID NO: 1934823 - RNA, 14 nt, Human
ggaagccagcaggc

SEQ ID NO: 1934824 - RNA, 14 nt, Human
ggaagccaaagagu

SEQ ID NO: 1934825 - RNA, 16 nt, Human
ggaaccguaggaccca

SEQ ID NO: 1934826 - RNA, 21 nt, Human
ggaaccguaggacccaagcag

SEQ ID NO: 1934827 - RNA, 12 nt, Human
ggaaccucagcc

SEQ ID NO: 1934828 - RNA, 13 nt, Human
ggaaccucagccu

SEQ ID NO: 1934829 - RNA, 20 nt, Human
ggaacagacuggaagcacag

SEQ ID NO: 1934830 - RNA, 19 nt, Human
ggaacagacuggaagcaca

SEQ ID NO: 1934831 - RNA, 21 nt, Human
ggaaccccggggugcccacag

SEQ ID NO: 1934832 - RNA, 13 nt, Human
ggaacucagaucc

SEQ ID NO: 1934833 - RNA, 15 nt, Human
ggaacucagauccag

SEQ ID NO: 1934834 - RNA, 16 nt, Human
ggaacucagauccagg

SEQ ID NO: 1934835 - RNA, 17 nt, Human
ggaacucagauccaggg

SEQ ID NO: 1934836 - RNA, 19 nt, Human
ggaacucagauccagggac

SEQ ID NO: 1934837 - RNA, 20 nt, Human
ggaacucagauccagggaca

SEQ ID NO: 1934838 - RNA, 22 nt, Human
ggaaccucagccuggccagaca

SEQ ID NO: 1934839 - RNA, 14 nt, Human
ggaaccucagccug

SEQ ID NO: 1934840 - RNA, 15 nt, Human
ggaaccucagccugg

SEQ ID NO: 1934841 - RNA, 16 nt, Human
ggaaccucagccuggc

SEQ ID NO: 1934842 - RNA, 19 nt, Human
ggaaccucagccuggccag

SEQ ID NO: 1934843 - RNA, 20 nt, Human
ggaaccucagccuggccaga

SEQ ID NO: 1934844 - RNA, 21 nt, Human
ggaaccucagccuggccagac

SEQ ID NO: 1934845 - RNA, 23 nt, Human
ggaaccucagccuggccagacac

SEQ ID NO: 1934846 - RNA, 15 nt, Human
ggaaaaucagccugc

SEQ ID NO: 1934847 - RNA, 12 nt, Human
ggaaaauauuuu

SEQ ID NO: 1934848 - RNA, 14 nt, Human
ggaaaauauuuuga

SEQ ID NO: 1934849 - RNA, 14 nt, Human
ggaaaauaaauuau

SEQ ID NO: 1934850 - RNA, 17 nt, Human
ggaacagacuggaagca

SEQ ID NO: 1934851 - RNA, 20 nt, Human
gcuggucccacucaguccau

SEQ ID NO: 1934852 - RNA, 12 nt, Human
gcugguggccca

SEQ ID NO: 1934853 - RNA, 13 nt, Human
gcugguggcccag

SEQ ID NO: 1934854 - RNA, 18 nt, Human
gcuggugucaccugaaga

SEQ ID NO: 1934855 - RNA, 16 nt, Human
gcuggugucaccugaa

SEQ ID NO: 1934856 - RNA, 14 nt, Human
gcugguggcccagg

SEQ ID NO: 1934857 - RNA, 15 nt, Human
gcugguggcccagga

SEQ ID NO: 1934858 - RNA, 22 nt, Human
gcugguucaggguuggccccug

SEQ ID NO: 1934859 - RNA, 16 nt, Human
gcugucaauuacagga

SEQ ID NO: 1934860 - RNA, 13 nt, Human
gcuguauuuugaa

SEQ ID NO: 1934861 - RNA, 15 nt, Human
gcugguucaggguug

SEQ ID NO: 1934862 - RNA, 21 nt, Human
gcugguuagagguucccuuug

SEQ ID NO: 1934863 - RNA, 17 nt, Human
gcugucuccauguuuga

SEQ ID NO: 1934864 - RNA, 19 nt, Human
gcugucccuuacgugaguc

SEQ ID NO: 1934865 - RNA, 22 nt, Human
gcugucccuuacgugaguccug

SEQ ID NO: 1934866 - RNA, 21 nt, Human
gcugucccuuacgugaguccu

SEQ ID NO: 1934867 - RNA, 17 nt, Human
gcugucaauuacaggaa

SEQ ID NO: 1934868 - RNA, 19 nt, Human
gcugucaauuacaggaagu

SEQ ID NO: 1934869 - RNA, 22 nt, Human
gcugucaauuacaggaaguacu

SEQ ID NO: 1934870 - RNA, 23 nt, Human
gcugucaauuacaggaaguacug

SEQ ID NO: 1934871 - RNA, 17 nt, Human
gcugggcuucaguggca

SEQ ID NO: 1934872 - RNA, 21 nt, Human
gcugggaugauuggagggggg

SEQ ID NO: 1934873 - RNA, 19 nt, Human
gcugggagagccuuccagg

SEQ ID NO: 1934874 - RNA, 22 nt, Human
gcugggagagccuuccaggggu

SEQ ID NO: 1934875 - RNA, 12 nt, Human
gcugggagagcc

SEQ ID NO: 1934876 - RNA, 13 nt, Human
gcugggagagccu

SEQ ID NO: 1934877 - RNA, 17 nt, Human
gcugggagagccuucca

SEQ ID NO: 1934878 - RNA, 18 nt, Human
gcugggagagccuuccag

SEQ ID NO: 1934879 - RNA, 20 nt, Human
gcugggggccucagugccac

SEQ ID NO: 1934880 - RNA, 19 nt, Human
gcugggggccucagugcca

SEQ ID NO: 1934881 - RNA, 19 nt, Human
gcuggucccacucagucca

SEQ ID NO: 1934882 - RNA, 15 nt, Human
gcuggucccacucag

SEQ ID NO: 1934883 - RNA, 13 nt, Human
gcugggggccuca

SEQ ID NO: 1934884 - RNA, 19 nt, Human
gcugggggugggccaggcu

SEQ ID NO: 1934885 - RNA, 15 nt, Human
gcugggggugggcca

SEQ ID NO: 1934886 - RNA, 18 nt, Human
gcugggggugggccaggc

SEQ ID NO: 1934887 - RNA, 19 nt, Human
gcugggcuucaguggcagc

SEQ ID NO: 1934888 - RNA, 18 nt, Human
gcugggcuucaguggcag

SEQ ID NO: 1934889 - RNA, 16 nt, Human
gcuggggccaggcugg

SEQ ID NO: 1934890 - RNA, 19 nt, Human
gcuggggccaggcuggguc

SEQ ID NO: 1934891 - RNA, 12 nt, Human
gcuggggccagu

SEQ ID NO: 1934892 - RNA, 23 nt, Human
gcugggggaagaagcucucuccu

SEQ ID NO: 1934893 - RNA, 16 nt, Human
gcuagcacaugcccua

SEQ ID NO: 1934894 - RNA, 12 nt, Human
gcugcccuguga

SEQ ID NO: 1934895 - RNA, 14 nt, Human
gcugcccugugagu

SEQ ID NO: 1934896 - RNA, 16 nt, Human
gcugcgguccacccag

SEQ ID NO: 1934897 - RNA, 21 nt, Human
gcugccuuggcucagacaugu

SEQ ID NO: 1934898 - RNA, 23 nt, Human
gcugccuuggcucagacauguuu

SEQ ID NO: 1934899 - RNA, 16 nt, Human
gcugccuuggcucaga

SEQ ID NO: 1934900 - RNA, 17 nt, Human
gcugccuuggcucagac

SEQ ID NO: 1934901 - RNA, 19 nt, Human
gcugccuuggcucagacau

SEQ ID NO: 1934902 - RNA, 11 nt, Human
gcugcccugug

SEQ ID NO: 1934903 - RNA, 22 nt, Human
gcuagcagcagggagggcuucu

SEQ ID NO: 1934904 - RNA, 18 nt, Human
gcugcgguccacccagga

SEQ ID NO: 1934905 - RNA, 17 nt, Human
gcugcgguccacccagg

SEQ ID NO: 1934906 - RNA, 19 nt, Human
gcugcgguccacccaggag

SEQ ID NO: 1934907 - RNA, 13 nt, Human
gcugcuucaagga

SEQ ID NO: 1934908 - RNA, 21 nt, Human
gcugcucagggaaaagcagcu

SEQ ID NO: 1934909 - RNA, 15 nt, Human
gcugcuauagccugg

SEQ ID NO: 1934910 - RNA, 16 nt, Human
gcugcuauagccuggg

SEQ ID NO: 1934911 - RNA, 20 nt, Human
gcugcucagggaaaagcagc

SEQ ID NO: 1934912 - RNA, 17 nt, Human
gcugcuauagccugggg

SEQ ID NO: 1934913 - RNA, 23 nt, Human
gcugcuucaaggauccugagcca

SEQ ID NO: 1934914 - RNA, 20 nt, Human
gcugcuuagaauccaaacuu

SEQ ID NO: 1934915 - RNA, 21 nt, Human
gcugcuucaaggauccugagc

SEQ ID NO: 1934916 - RNA, 22 nt, Human
gcugcuucaaggauccugagcc

SEQ ID NO: 1934917 - RNA, 16 nt, Human
gcugcuugggcuucau

SEQ ID NO: 1934918 - RNA, 22 nt, Human
gcuggaccuugaacuggguacu

SEQ ID NO: 1934919 - RNA, 21 nt, Human
gcuggaccuugaacuggguac

SEQ ID NO: 1934920 - RNA, 18 nt, Human
gcuggaccuugaacuggg

SEQ ID NO: 1934921 - RNA, 17 nt, Human
gcugcuugggcuucauc

SEQ ID NO: 1934922 - RNA, 22 nt, Human
gcugcuugggcuucauccuccu

SEQ ID NO: 1934923 - RNA, 16 nt, Human
gcuggauuacaggcau

SEQ ID NO: 1934924 - RNA, 13 nt, Human
gcuggcccagggc

SEQ ID NO: 1934925 - RNA, 15 nt, Human
gcuggcccagggccc

SEQ ID NO: 1934926 - RNA, 16 nt, Human
gcuggcccagggccca

SEQ ID NO: 1934927 - RNA, 17 nt, Human
gcuggcccagggcccag

SEQ ID NO: 1934928 - RNA, 21 nt, Human
gcuggcccagggcccagagcc

SEQ ID NO: 1934929 - RNA, 18 nt, Human
gcuggcccagggcccaga

SEQ ID NO: 1934930 - RNA, 19 nt, Human
gcuggcccagggcccagag

SEQ ID NO: 1934931 - RNA, 20 nt, Human
gcuggcccagggcccagagc

SEQ ID NO: 1934932 - RNA, 13 nt, Human
gcuggccccgccg

SEQ ID NO: 1934933 - RNA, 22 nt, Human
gcuggccccgccgccugguacu

SEQ ID NO: 1934934 - RNA, 23 nt, Human
gcuggccccgccgccugguacuc

SEQ ID NO: 1934935 - RNA, 24 nt, Human
gcuggccccgccgccugguacuca

SEQ ID NO: 1934936 - RNA, 20 nt, Human
gcugggacuacaggcaccca

SEQ ID NO: 1934937 - RNA, 19 nt, Human
gcugggacuacaggcaccc

SEQ ID NO: 1934938 - RNA, 18 nt, Human
gcugggacuacaggcacc

SEQ ID NO: 1934939 - RNA, 13 nt, Human
gcugggacuacag

SEQ ID NO: 1934940 - RNA, 19 nt, Human
gcugggacuacagguguga

SEQ ID NO: 1934941 - RNA, 21 nt, Human
gcugggacguggcucagccag

SEQ ID NO: 1934942 - RNA, 22 nt, Human
gcugggacguggcucagccagc

SEQ ID NO: 1934943 - RNA, 13 nt, Human
gcuggccgggacc

SEQ ID NO: 1934944 - RNA, 21 nt, Human
gcuggccucccaaaugagcca

SEQ ID NO: 1934945 - RNA, 22 nt, Human
gcuggccucccaaaugagccau

SEQ ID NO: 1934946 - RNA, 20 nt, Human
gcugggacaugggaaagggg

SEQ ID NO: 1934947 - RNA, 17 nt, Human
gcugggacguggcucag

SEQ ID NO: 1934948 - RNA, 19 nt, Human
gcugggacguggcucagcc

SEQ ID NO: 1934949 - RNA, 20 nt, Human
gcugggacguggcucagcca

SEQ ID NO: 1934950 - RNA, 13 nt, Human
ggagauggaguuc

SEQ ID NO: 1934951 - RNA, 20 nt, Human
ggagauggaaguugcaguga

SEQ ID NO: 1934952 - RNA, 15 nt, Human
ggagaggggcacagg

SEQ ID NO: 1934953 - RNA, 20 nt, Human
ggagauuuacaacuggggga

SEQ ID NO: 1934954 - RNA, 13 nt, Human
ggagcccugggag

SEQ ID NO: 1934955 - RNA, 12 nt, Human
ggagcccuggga

SEQ ID NO: 1934956 - RNA, 20 nt, Human
ggagcaaaaucgaugcagug

SEQ ID NO: 1934957 - RNA, 18 nt, Human
ggagccccuucugcucag

SEQ ID NO: 1934958 - RNA, 19 nt, Human
ggagccccuucugcucagc

SEQ ID NO: 1934959 - RNA, 21 nt, Human
ggagccccuucugcucagcuc

SEQ ID NO: 1934960 - RNA, 21 nt, Human
ggagaccuggacacaggccug

SEQ ID NO: 1934961 - RNA, 20 nt, Human
ggagaccgggguauccuggg

SEQ ID NO: 1934962 - RNA, 17 nt, Human
ggagagcuagcagcagg

SEQ ID NO: 1934963 - RNA, 21 nt, Human
ggagagcuagcagcagggagg

SEQ ID NO: 1934964 - RNA, 21 nt, Human
ggagaccccuuggggagcagg

SEQ ID NO: 1934965 - RNA, 23 nt, Human
ggacugggccacuucuggguggg

SEQ ID NO: 1934966 - RNA, 13 nt, Human
ggacucugcacau

SEQ ID NO: 1934967 - RNA, 20 nt, Human
ggacucugcacaugucuugu

SEQ ID NO: 1934968 - RNA, 15 nt, Human
ggacucugcacauga

SEQ ID NO: 1934969 - RNA, 21 nt, Human
ggacucugcacaugucuugua

SEQ ID NO: 1934970 - RNA, 18 nt, Human
ggaccuuaggccuuccuc

SEQ ID NO: 1934971 - RNA, 21 nt, Human
ggaccuuaggccuuccucucu

SEQ ID NO: 1934972 - RNA, 14 nt, Human
ggaccuggcugcca

SEQ ID NO: 1934973 - RNA, 22 nt, Human
ggaccugcccccgcauccccug

SEQ ID NO: 1934974 - RNA, 10 nt, Human
ggaccugccc

SEQ ID NO: 1934975 - RNA, 11 nt, Human
ggaccugcccc

SEQ ID NO: 1934976 - RNA, 23 nt, Human
ggaccugcccccgcauccccugc

SEQ ID NO: 1934977 - RNA, 20 nt, Human
ggaagccagcaggcucucag

SEQ ID NO: 1934978 - RNA, 19 nt, Human
ggaccagcucaggacagau

SEQ ID NO: 1934979 - RNA, 22 nt, Human
ggaccagcucaggacagaugcc

SEQ ID NO: 1934980 - RNA, 16 nt, Human
ggaccagcucaggaca

SEQ ID NO: 1934981 - RNA, 18 nt, Human
ggaccagcucaggacaga

SEQ ID NO: 1934982 - RNA, 12 nt, Human
ggaccucuccca

SEQ ID NO: 1934983 - RNA, 14 nt, Human
ggaccucucccagg

SEQ ID NO: 1934984 - RNA, 15 nt, Human
ggaccucucccaggg

SEQ ID NO: 1934985 - RNA, 22 nt, Human
ggacccaugaguuggggucugg

SEQ ID NO: 1934986 - RNA, 21 nt, Human
ggaggacgcucucuggccuuc

SEQ ID NO: 1934987 - RNA, 20 nt, Human
ggaggacgcucucuggccuu

SEQ ID NO: 1934988 - RNA, 19 nt, Human
ggaggacgcucucuggccu

SEQ ID NO: 1934989 - RNA, 15 nt, Human
ggaggauguucuggg

SEQ ID NO: 1934990 - RNA, 22 nt, Human
ggagggacaaguggacucaggg

SEQ ID NO: 1934991 - RNA, 23 nt, Human
ggaggaucacuugaguccagaag

SEQ ID NO: 1934992 - RNA, 17 nt, Human
ggaggaucucuugagcc

SEQ ID NO: 1934993 - RNA, 21 nt, Human
ggaggaucucuugagccuggg

SEQ ID NO: 1934994 - RNA, 20 nt, Human
ggaggaucuuuugaacccag

SEQ ID NO: 1934995 - RNA, 12 nt, Human
ggagggcuccag

SEQ ID NO: 1934996 - RNA, 13 nt, Human
ggagggcuccaga

SEQ ID NO: 1934997 - RNA, 12 nt, Human
ggagggagggcu

SEQ ID NO: 1934998 - RNA, 15 nt, Human
ggagggaggcucagg

SEQ ID NO: 1934999 - RNA, 16 nt, Human
ggagggaggcucaggu

SEQ ID NO: 1935000 - RNA, 16 nt, Human
ggagggcagcagaagg

SEQ ID NO: 1935001 - RNA, 12 nt, Human
ggagggauuugg

SEQ ID NO: 1935002 - RNA, 14 nt, Human
ggagugagcugguu

SEQ ID NO: 1935003 - RNA, 21 nt, Human
ggagugaguugauagcacaga

SEQ ID NO: 1935004 - RNA, 12 nt, Human
ggagugagcugg

SEQ ID NO: 1935005 - RNA, 19 nt, Human
ggagugagaggucucucuu

SEQ ID NO: 1935006 - RNA, 21 nt, Human
ggagugacagaggcagcccca

SEQ ID NO: 1935007 - RNA, 19 nt, Human
ggagugacagaggcagccc

SEQ ID NO: 1935008 - RNA, 18 nt, Human
ggagugacagaggcagcc

SEQ ID NO: 1935009 - RNA, 17 nt, Human
ggagugacagaggcagc

SEQ ID NO: 1935010 - RNA, 16 nt, Human
ggaucacagccucuga

SEQ ID NO: 1935011 - RNA, 23 nt, Human
ggagugaguugauagcacagacc

SEQ ID NO: 1935012 - RNA, 18 nt, Human
ggauagaugcuggcccag

SEQ ID NO: 1935013 - RNA, 19 nt, Human
ggauagaugcuggcccagg

SEQ ID NO: 1935014 - RNA, 20 nt, Human
ggauagaugcuggcccaggg

SEQ ID NO: 1935015 - RNA, 13 nt, Human
ggauagaugugug

SEQ ID NO: 1935016 - RNA, 21 nt, Human
ggauagaugcuggcccagggc

SEQ ID NO: 1935017 - RNA, 15 nt, Human
ggauagaugugugga

SEQ ID NO: 1935018 - RNA, 14 nt, Human
ggauagaugugugg

SEQ ID NO: 1935019 - RNA, 17 nt, Human
ggagggcuccagacaca

SEQ ID NO: 1935020 - RNA, 14 nt, Human
ggagggcuccagac

SEQ ID NO: 1935021 - RNA, 15 nt, Human
ggagggcuccagaca

SEQ ID NO: 1935022 - RNA, 22 nt, Human
ggagggcugucaucugugcacu

SEQ ID NO: 1935023 - RNA, 21 nt, Human
ggagucccaccuuggcugcag

SEQ ID NO: 1935024 - RNA, 20 nt, Human
ggagucccaccuuggcugca

SEQ ID NO: 1935025 - RNA, 16 nt, Human
ggagugacagaggcag

SEQ ID NO: 1935026 - RNA, 11 nt, Human
ggagugacaga

SEQ ID NO: 1935027 - RNA, 19 nt, Human
ggccacgcagccaggacac

SEQ ID NO: 1935028 - RNA, 18 nt, Human
ggccacgcagccaggaca

SEQ ID NO: 1935029 - RNA, 16 nt, Human
ggccacgcagccagga

SEQ ID NO: 1935030 - RNA, 15 nt, Human
ggccacgcagccagg

SEQ ID NO: 1935031 - RNA, 14 nt, Human
ggccacgcagccag

SEQ ID NO: 1935032 - RNA, 13 nt, Human
ggccacgcagcca

SEQ ID NO: 1935033 - RNA, 11 nt, Human
ggccacuguga

SEQ ID NO: 1935034 - RNA, 16 nt, Human
ggccaggagccuccug

SEQ ID NO: 1935035 - RNA, 16 nt, Human
ggccacugugaagaga

SEQ ID NO: 1935036 - RNA, 14 nt, Human
ggccaggagccucc

SEQ ID NO: 1935037 - RNA, 11 nt, Human
ggccaggcugg

SEQ ID NO: 1935038 - RNA, 15 nt, Human
ggccaggccagcugc

SEQ ID NO: 1935039 - RNA, 17 nt, Human
ggccaggccagcugccu

SEQ ID NO: 1935040 - RNA, 18 nt, Human
ggccaggcugggucgccc

SEQ ID NO: 1935041 - RNA, 22 nt, Human
ggccaggcugggucgcccugga

SEQ ID NO: 1935042 - RNA, 16 nt, Human
ggccaggccagaggga

SEQ ID NO: 1935043 - RNA, 14 nt, Human
ggccaggccagagg

SEQ ID NO: 1935044 - RNA, 23 nt, Human
ggcauguucucugaggacacuaa

SEQ ID NO: 1935045 - RNA, 16 nt, Human
ggcagugagggagggc

SEQ ID NO: 1935046 - RNA, 21 nt, Human
ggcagugagggagggcuguca

SEQ ID NO: 1935047 - RNA, 15 nt, Human
ggcagguuggugggg

SEQ ID NO: 1935048 - RNA, 16 nt, Human
ggccaccugcggugcu

SEQ ID NO: 1935049 - RNA, 22 nt, Human
ggccaccugcggugcuaucucc

SEQ ID NO: 1935050 - RNA, 12 nt, Human
ggccaaguucuu

SEQ ID NO: 1935051 - RNA, 15 nt, Human
ggcauuccccaggag

SEQ ID NO: 1935052 - RNA, 16 nt, Human
ggccacaagacccuug

SEQ ID NO: 1935053 - RNA, 17 nt, Human
ggccacaagacccuugu

SEQ ID NO: 1935054 - RNA, 13 nt, Human
ggccaugggccuc

SEQ ID NO: 1935055 - RNA, 22 nt, Human
ggccaugggacagggaggacgc

SEQ ID NO: 1935056 - RNA, 12 nt, Human
ggccaggcuggu

SEQ ID NO: 1935057 - RNA, 15 nt, Human
ggcccccaucucaug

SEQ ID NO: 1935058 - RNA, 21 nt, Human
ggcccccaucucaugccccug

SEQ ID NO: 1935059 - RNA, 14 nt, Human
ggcccccaucucau

SEQ ID NO: 1935060 - RNA, 14 nt, Human
ggccccgccgccug

SEQ ID NO: 1935061 - RNA, 15 nt, Human
ggccccgccgccugg

SEQ ID NO: 1935062 - RNA, 18 nt, Human
ggccccgccgccugguac

SEQ ID NO: 1935063 - RNA, 12 nt, Human
ggccccugccac

SEQ ID NO: 1935064 - RNA, 21 nt, Human
ggccccugagaucucugcagg

SEQ ID NO: 1935065 - RNA, 17 nt, Human
ggccccugagaucucug

SEQ ID NO: 1935066 - RNA, 16 nt, Human
ggccccugccacccug

SEQ ID NO: 1935067 - RNA, 13 nt, Human
ggccccugccacc

SEQ ID NO: 1935068 - RNA, 13 nt, Human
ggccccugcccgg

SEQ ID NO: 1935069 - RNA, 19 nt, Human
ggccccugccagacccccu

SEQ ID NO: 1935070 - RNA, 17 nt, Human
ggccccugccagacccc

SEQ ID NO: 1935071 - RNA, 18 nt, Human
ggccccugccacccuggg

SEQ ID NO: 1935072 - RNA, 17 nt, Human
ggccccugccacccugg

SEQ ID NO: 1935073 - RNA, 16 nt, Human
ggccccucaggguccc

SEQ ID NO: 1935074 - RNA, 19 nt, Human
ggccccucagggucccugg

SEQ ID NO: 1935075 - RNA, 20 nt, Human
ggccccucagggucccuggu

SEQ ID NO: 1935076 - RNA, 21 nt, Human
ggccccucagggucccuggug

SEQ ID NO: 1935077 - RNA, 22 nt, Human
ggccccuauguaguccgugcug

SEQ ID NO: 1935078 - RNA, 22 nt, Human
ggcaccugccacccugggccug

SEQ ID NO: 1935079 - RNA, 12 nt, Human
ggcagagcagag

SEQ ID NO: 1935080 - RNA, 19 nt, Human
ggcaccucacaggccccag

SEQ ID NO: 1935081 - RNA, 16 nt, Human
ggcaccucacaggccc

SEQ ID NO: 1935082 - RNA, 22 nt, Human
ggcaccuaauccaggcagaucc

SEQ ID NO: 1935083 - RNA, 20 nt, Human
ggcagagcagagaccauccc

SEQ ID NO: 1935084 - RNA, 15 nt, Human
ggcagagcagagacc

SEQ ID NO: 1935085 - RNA, 16 nt, Human
ggcagagcagagacca

SEQ ID NO: 1935086 - RNA, 16 nt, Human
ggcacccggccccugc

SEQ ID NO: 1935087 - RNA, 15 nt, Human
ggcacccggccccug

SEQ ID NO: 1935088 - RNA, 17 nt, Human
ggcacccggccccugcu

SEQ ID NO: 1935089 - RNA, 17 nt, Human
ggcaccuaauccaggca

SEQ ID NO: 1935090 - RNA, 18 nt, Human
ggcaccuaauccaggcag

SEQ ID NO: 1935091 - RNA, 19 nt, Human
ggcaccuaauccaggcaga

SEQ ID NO: 1935092 - RNA, 16 nt, Human
ggcaaggcugucaauu

SEQ ID NO: 1935093 - RNA, 19 nt, Human
ggcaacccccagccugcua

SEQ ID NO: 1935094 - RNA, 19 nt, Human
ggaucaucugccgugccug

SEQ ID NO: 1935095 - RNA, 21 nt, Human
ggaucagucugauucccaagc

SEQ ID NO: 1935096 - RNA, 12 nt, Human
ggaucagaauag

SEQ ID NO: 1935097 - RNA, 18 nt, Human
ggcaacugcauuggcuuu

SEQ ID NO: 1935098 - RNA, 15 nt, Human
ggcaaggcugucaau

SEQ ID NO: 1935099 - RNA, 19 nt, Human
ggcaacugcauuggcuuug

SEQ ID NO: 1935100 - RNA, 23 nt, Human
ggcagauacaggaaaagcugcug

SEQ ID NO: 1935101 - RNA, 23 nt, Human
ggcagaguugaagacagagcuac

SEQ ID NO: 1935102 - RNA, 17 nt, Human
ggcagaggaaagcaaag

SEQ ID NO: 1935103 - RNA, 18 nt, Human
ggcagcagaagggggugg

SEQ ID NO: 1935104 - RNA, 14 nt, Human
ggcagauccaggac

SEQ ID NO: 1935105 - RNA, 16 nt, Human
ggcagauccaggacua

SEQ ID NO: 1935106 - RNA, 13 nt, Human
ggcagguccaggg

SEQ ID NO: 1935107 - RNA, 11 nt, Human
ggcaggaaaag

SEQ ID NO: 1935108 - RNA, 23 nt, Human
ggcaggucuugaacuccuggccu

SEQ ID NO: 1935109 - RNA, 19 nt, Human
ggcagguccccagacucca

SEQ ID NO: 1935110 - RNA, 14 nt, Human
ggcagguccccaga

SEQ ID NO: 1935111 - RNA, 19 nt, Human
ggcagcugcgguccaccca

SEQ ID NO: 1935112 - RNA, 21 nt, Human
ggcagcuugaggguugggcug

SEQ ID NO: 1935113 - RNA, 22 nt, Human
ggcagcucaccucucccuugga

SEQ ID NO: 1935114 - RNA, 18 nt, Human
ggcagcucaccucucccu

SEQ ID NO: 1935115 - RNA, 21 nt, Human
ggcagcucaccucucccuugg

SEQ ID NO: 1935116 - RNA, 15 nt, Human
uauaaauauauuuaa

SEQ ID NO: 1935117 - RNA, 20 nt, Human
uauaaugaaugaaacauuuu

SEQ ID NO: 1935118 - RNA, 18 nt, Human
uauaaugaaugaaacauu

SEQ ID NO: 1935119 - RNA, 21 nt, Human
uauaaauuuuuuuuguuucau

SEQ ID NO: 1935120 - RNA, 17 nt, Human
uauaaauuuuuuuuguu

SEQ ID NO: 1935121 - RNA, 21 nt, Human
uauaaauuccucuuugcuuug

SEQ ID NO: 1935122 - RNA, 16 nt, Human
uauacuauauuuaugg

SEQ ID NO: 1935123 - RNA, 18 nt, Human
uauacucuagaugaaguu

SEQ ID NO: 1935124 - RNA, 16 nt, Human
uauacucuuucuguau

SEQ ID NO: 1935125 - RNA, 17 nt, Human
uauacucuuucuguaua

SEQ ID NO: 1935126 - RNA, 19 nt, Human
uauacucuuucuguauaua

SEQ ID NO: 1935127 - RNA, 22 nt, Human
uauacucuuucuguauauacuu

SEQ ID NO: 1935128 - RNA, 14 nt, Human
uauaauguaagcuc

SEQ ID NO: 1935129 - RNA, 19 nt, Human
uauaauguaagcucuacug

SEQ ID NO: 1935130 - RNA, 20 nt, Human
uauaauguaagcucuacuga

SEQ ID NO: 1935131 - RNA, 20 nt, Human
uauaauucacauuguauuca

SEQ ID NO: 1935132 - RNA, 17 nt, Human
uauaauucuacuuugag

SEQ ID NO: 1935133 - RNA, 19 nt, Human
uagugcugaagcuuauuaa

SEQ ID NO: 1935134 - RNA, 22 nt, Human
uagugcugaagcuuauuaaugc

SEQ ID NO: 1935135 - RNA, 18 nt, Human
uagugcugaagcuuauua

SEQ ID NO: 1935136 - RNA, 17 nt, Human
uagugcugaagcuuauu

SEQ ID NO: 1935137 - RNA, 15 nt, Human
uagugcugaagcuua

SEQ ID NO: 1935138 - RNA, 14 nt, Human
uagugcugaagcuu

SEQ ID NO: 1935139 - RNA, 12 nt, Human
uagugcugaagc

SEQ ID NO: 1935140 - RNA, 21 nt, Human
uagucacauggccuaugcaca

SEQ ID NO: 1935141 - RNA, 13 nt, Human
uagucaagcuccu

SEQ ID NO: 1935142 - RNA, 14 nt, Human
uagucaagcuccuc

SEQ ID NO: 1935143 - RNA, 15 nt, Human
uagucaagcuccucc

SEQ ID NO: 1935144 - RNA, 15 nt, Human
uaguggauguucuga

SEQ ID NO: 1935145 - RNA, 13 nt, Human
uaguuucuccaag

SEQ ID NO: 1935146 - RNA, 23 nt, Human
uaguuugauuaaauucuugcaaa

SEQ ID NO: 1935147 - RNA, 12 nt, Human
uaguuugcaguu

SEQ ID NO: 1935148 - RNA, 21 nt, Human
uaguuguaccgcaaugugacu

SEQ ID NO: 1935149 - RNA, 17 nt, Human
uauauggccucaagauc

SEQ ID NO: 1935150 - RNA, 12 nt, Human
uauauguacaug

SEQ ID NO: 1935151 - RNA, 21 nt, Human
uauauuucccugaaggaacca

SEQ ID NO: 1935152 - RNA, 13 nt, Human
uauauuuuaagac

SEQ ID NO: 1935153 - RNA, 16 nt, Human
uauauuuguguauuua

SEQ ID NO: 1935154 - RNA, 20 nt, Human
uauauuuguguauuuaacag

SEQ ID NO: 1935155 - RNA, 14 nt, Human
uauauuuuaagacg

SEQ ID NO: 1935156 - RNA, 14 nt, Human
uauauuuuaauuug

SEQ ID NO: 1935157 - RNA, 23 nt, Human
uauauuugugauagcacuuucua

SEQ ID NO: 1935158 - RNA, 20 nt, Human
uauaugcucugcauguuaca

SEQ ID NO: 1935159 - RNA, 17 nt, Human
uauaugauuuuuaucca

SEQ ID NO: 1935160 - RNA, 15 nt, Human
uauauacauauauau

SEQ ID NO: 1935161 - RNA, 23 nt, Human
uauauaauacugacugagaauau

SEQ ID NO: 1935162 - RNA, 23 nt, Human
uauacuugcuuuguguucuuugu

SEQ ID NO: 1935163 - RNA, 19 nt, Human
uaucgucacugcuuaacuu

SEQ ID NO: 1935164 - RNA, 15 nt, Human
uaucuaaauguugaa

SEQ ID NO: 1935165 - RNA, 14 nt, Human
uaucuaaaagaaau

SEQ ID NO: 1935166 - RNA, 17 nt, Human
uaucaugugaaaucauu

SEQ ID NO: 1935167 - RNA, 22 nt, Human
uaucaugugaaaucauucauuu

SEQ ID NO: 1935168 - RNA, 22 nt, Human
uauccugcuucugauaugcagu

SEQ ID NO: 1935169 - RNA, 22 nt, Human
uauccugggggacccaauguag

SEQ ID NO: 1935170 - RNA, 16 nt, Human
uaucaugacaaagacu

SEQ ID NO: 1935171 - RNA, 17 nt, Human
uaucaggugcugccauc

SEQ ID NO: 1935172 - RNA, 19 nt, Human
uauauuuuuuguuaaauga

SEQ ID NO: 1935173 - RNA, 21 nt, Human
uauauuuuauacauuaacuuc

SEQ ID NO: 1935174 - RNA, 15 nt, Human
uagcagacaguguuu

SEQ ID NO: 1935175 - RNA, 13 nt, Human
uagcagacaggcc

SEQ ID NO: 1935176 - RNA, 19 nt, Human
uagcagacaggccccguga

SEQ ID NO: 1935177 - RNA, 14 nt, Human
uagcagauuuuaau

SEQ ID NO: 1935178 - RNA, 20 nt, Human
uagcagauuuuaauuuugaa

SEQ ID NO: 1935179 - RNA, 23 nt, Human
uagcagagaaugaaagggcccag

SEQ ID NO: 1935180 - RNA, 19 nt, Human
uagcagagaaugaaagggc

SEQ ID NO: 1935181 - RNA, 19 nt, Human
uagcagcaccguucugugc

SEQ ID NO: 1935182 - RNA, 18 nt, Human
uagcagauuuuaauuuug

SEQ ID NO: 1935183 - RNA, 20 nt, Human
uagcagcaccguucugugca

SEQ ID NO: 1935184 - RNA, 20 nt, Human
uagcagcagccuuuaaugca

SEQ ID NO: 1935185 - RNA, 16 nt, Human
uagcacuuugggaggc

SEQ ID NO: 1935186 - RNA, 11 nt, Human
uagcagacagg

SEQ ID NO: 1935187 - RNA, 12 nt, Human
uagauguuuccu

SEQ ID NO: 1935188 - RNA, 15 nt, Human
uagauguucuacuuu

SEQ ID NO: 1935189 - RNA, 18 nt, Human
uagauaauacaccacuac

SEQ ID NO: 1935190 - RNA, 12 nt, Human
uagauguauaua

SEQ ID NO: 1935191 - RNA, 16 nt, Human
uagauggugcugagaa

SEQ ID NO: 1935192 - RNA, 19 nt, Human
uagauggugcugagaagcu

SEQ ID NO: 1935193 - RNA, 21 nt, Human
uagaugggagggaggcucagg

SEQ ID NO: 1935194 - RNA, 14 nt, Human
uagauggugcugag

SEQ ID NO: 1935195 - RNA, 15 nt, Human
uagauggugcugaga

SEQ ID NO: 1935196 - RNA, 18 nt, Human
uagauguuccaguaaucu

SEQ ID NO: 1935197 - RNA, 11 nt, Human
uagaugugugg

SEQ ID NO: 1935198 - RNA, 21 nt, Human
uagaaccucgagguuucucaa

SEQ ID NO: 1935199 - RNA, 16 nt, Human
uagagagagaccacuu

SEQ ID NO: 1935200 - RNA, 13 nt, Human
uagagaggaaaag

SEQ ID NO: 1935201 - RNA, 21 nt, Human
uagagguucaaagauauuuug

SEQ ID NO: 1935202 - RNA, 16 nt, Human
uagagguucaaagaua

SEQ ID NO: 1935203 - RNA, 19 nt, Human
uagagguucaaagauauuu

SEQ ID NO: 1935204 - RNA, 22 nt, Human
uagaguuucaaccaugaagucu

SEQ ID NO: 1935205 - RNA, 21 nt, Human
uagcuccccgcuucugccugc

SEQ ID NO: 1935206 - RNA, 14 nt, Human
uagcuccccuccaa

SEQ ID NO: 1935207 - RNA, 22 nt, Human
uagcucauucuccuuguguuac

SEQ ID NO: 1935208 - RNA, 17 nt, Human
uagccugccucuucucu

SEQ ID NO: 1935209 - RNA, 21 nt, Human
uagcucuaggagggcuggcaa

SEQ ID NO: 1935210 - RNA, 17 nt, Human
uagcucuauguuuacaa

SEQ ID NO: 1935211 - RNA, 20 nt, Human
uagcugggacuacaggcacc

SEQ ID NO: 1935212 - RNA, 12 nt, Human
uagcugggacua

SEQ ID NO: 1935213 - RNA, 18 nt, Human
uagcugggacuacaggug

SEQ ID NO: 1935214 - RNA, 11 nt, Human
uagcugggacu

SEQ ID NO: 1935215 - RNA, 14 nt, Human
uagcccaaaaccaa

SEQ ID NO: 1935216 - RNA, 16 nt, Human
uagccauuuuuacugu

SEQ ID NO: 1935217 - RNA, 13 nt, Human
uagcaguaaaaua

SEQ ID NO: 1935218 - RNA, 17 nt, Human
uagccauuuuuacuguu

SEQ ID NO: 1935219 - RNA, 16 nt, Human
uagccccacaggaggu

SEQ ID NO: 1935220 - RNA, 20 nt, Human
uagccuauguggauuuuuuc

SEQ ID NO: 1935221 - RNA, 15 nt, Human
uaggaagguuaaugu

SEQ ID NO: 1935222 - RNA, 14 nt, Human
uaggaauuguguuu

SEQ ID NO: 1935223 - RNA, 20 nt, Human
uaggaauugacccacaagaa

SEQ ID NO: 1935224 - RNA, 23 nt, Human
uaggaauugacccacaagaaaug

SEQ ID NO: 1935225 - RNA, 13 nt, Human
uaggccuggccag

SEQ ID NO: 1935226 - RNA, 14 nt, Human
uaggccucagccag

SEQ ID NO: 1935227 - RNA, 22 nt, Human
uaggccaggugcaaccagggag

SEQ ID NO: 1935228 - RNA, 14 nt, Human
uaggccuggccaga

SEQ ID NO: 1935229 - RNA, 16 nt, Human
uaggccucagccagag

SEQ ID NO: 1935230 - RNA, 18 nt, Human
uaggccucagccagagaa

SEQ ID NO: 1935231 - RNA, 22 nt, Human
uaggccucagccagagaagcua

SEQ ID NO: 1935232 - RNA, 13 nt, Human
uaggccaugggac

SEQ ID NO: 1935233 - RNA, 17 nt, Human
uaggaacacuccuucac

SEQ ID NO: 1935234 - RNA, 21 nt, Human
uaggaacuuaaauaaugugaa

SEQ ID NO: 1935235 - RNA, 18 nt, Human
uaggaacugcugggcuug

SEQ ID NO: 1935236 - RNA, 15 nt, Human
uaggaacugcugggc

SEQ ID NO: 1935237 - RNA, 13 nt, Human
uaggaacacuccu

SEQ ID NO: 1935238 - RNA, 14 nt, Human
uaggaacacuccuu

SEQ ID NO: 1935239 - RNA, 18 nt, Human
uagcugggggugggccag

SEQ ID NO: 1935240 - RNA, 15 nt, Human
uagcugggauuacag

SEQ ID NO: 1935241 - RNA, 13 nt, Human
uaggaagacuuug

SEQ ID NO: 1935242 - RNA, 16 nt, Human
uaggaacuugagaacu

SEQ ID NO: 1935243 - RNA, 14 nt, Human
uaggaagacuuugg

SEQ ID NO: 1935244 - RNA, 15 nt, Human
uaggaagacuuugga

SEQ ID NO: 1935245 - RNA, 16 nt, Human
uaggaagacuuuggaa

SEQ ID NO: 1935246 - RNA, 17 nt, Human
uaggaagacuuuggaaa

SEQ ID NO: 1935247 - RNA, 14 nt, Human
uaggaagagaaacc

SEQ ID NO: 1935248 - RNA, 15 nt, Human
uaggaagagaaacca

SEQ ID NO: 1935249 - RNA, 19 nt, Human
uaggaagagaaaccaggga

SEQ ID NO: 1935250 - RNA, 15 nt, Human
uacacacauccacgc

SEQ ID NO: 1935251 - RNA, 17 nt, Human
uacacacugcauguuug

SEQ ID NO: 1935252 - RNA, 18 nt, Human
uacacaccuuauauuuac

SEQ ID NO: 1935253 - RNA, 15 nt, Human
uacacacacauacac

SEQ ID NO: 1935254 - RNA, 21 nt, Human
uacacacacacgcgugcacac

SEQ ID NO: 1935255 - RNA, 17 nt, Human
uacacaaugguuuucuu

SEQ ID NO: 1935256 - RNA, 21 nt, Human
uacacaaugguuuucuugugu

SEQ ID NO: 1935257 - RNA, 23 nt, Human
uacacaaugguuuucuugugugu

SEQ ID NO: 1935258 - RNA, 22 nt, Human
uacacacugcauguuugugauu

SEQ ID NO: 1935259 - RNA, 14 nt, Human
uacacuguuucaaa

SEQ ID NO: 1935260 - RNA, 16 nt, Human
uacacugugcugaguc

SEQ ID NO: 1935261 - RNA, 24 nt, Human
uacaagaugaaggagaggcaacau

SEQ ID NO: 1935262 - RNA, 13 nt, Human
uaauuuugaaaaa

SEQ ID NO: 1935263 - RNA, 17 nt, Human
uaauuuugaaaaacugc

SEQ ID NO: 1935264 - RNA, 15 nt, Human
uaauuuugaauaaau

SEQ ID NO: 1935265 - RNA, 14 nt, Human
uacaggauuugaaa

SEQ ID NO: 1935266 - RNA, 16 nt, Human
uacaggcacccaccau

SEQ ID NO: 1935267 - RNA, 19 nt, Human
uacaggaaaagcugcugac

SEQ ID NO: 1935268 - RNA, 19 nt, Human
uacagcuuugaucccugac

SEQ ID NO: 1935269 - RNA, 16 nt, Human
uacaguguacagucuu

SEQ ID NO: 1935270 - RNA, 15 nt, Human
uacaguguacagucu

SEQ ID NO: 1935271 - RNA, 22 nt, Human
uacaguguacagucuuguauua

SEQ ID NO: 1935272 - RNA, 13 nt, Human
uacaguguacagu

SEQ ID NO: 1935273 - RNA, 18 nt, Human
uacaggaaaagcugcuga

SEQ ID NO: 1935274 - RNA, 17 nt, Human
uacaggaaaagcugcug

SEQ ID NO: 1935275 - RNA, 23 nt, Human
uacagcuugaccgugaggccaga

SEQ ID NO: 1935276 - RNA, 22 nt, Human
uacagcuugaccgugaggccag

SEQ ID NO: 1935277 - RNA, 17 nt, Human
uacagcccaccuggcuu

SEQ ID NO: 1935278 - RNA, 21 nt, Human
uacagcuugaccgugaggcca

SEQ ID NO: 1935279 - RNA, 22 nt, Human
uacacugugacuuaagaagccu

SEQ ID NO: 1935280 - RNA, 13 nt, Human
uacacuuuaugca

SEQ ID NO: 1935281 - RNA, 22 nt, Human
uacagaaaaguugaauuuuaca

SEQ ID NO: 1935282 - RNA, 18 nt, Human
uacagaaaaguugaauuu

SEQ ID NO: 1935283 - RNA, 19 nt, Human
uacacuguuucaaacuuua

SEQ ID NO: 1935284 - RNA, 18 nt, Human
uacacuguuucaaacuuu

SEQ ID NO: 1935285 - RNA, 17 nt, Human
uacacuguuucaaacuu

SEQ ID NO: 1935286 - RNA, 13 nt, Human
uacagaauuuuau

SEQ ID NO: 1935287 - RNA, 24 nt, Human
uacagcaaggagauuuacaacugg

SEQ ID NO: 1935288 - RNA, 20 nt, Human
uaccaaucauuuuaauuauu

SEQ ID NO: 1935289 - RNA, 19 nt, Human
uaccaaucauuuuaauuau

SEQ ID NO: 1935290 - RNA, 15 nt, Human
uaccaaucauuuuaa

SEQ ID NO: 1935291 - RNA, 13 nt, Human
uaccaaucauauu

SEQ ID NO: 1935292 - RNA, 22 nt, Human
uaccaaucauauuaauacaaug

SEQ ID NO: 1935293 - RNA, 22 nt, Human
uaccaaucauuuuaauuauuau

SEQ ID NO: 1935294 - RNA, 13 nt, Human
uaccacagacaua

SEQ ID NO: 1935295 - RNA, 23 nt, Human
uaccauuuugggguacccacugc

SEQ ID NO: 1935296 - RNA, 21 nt, Human
uaccauuuauacaaauuagaa

SEQ ID NO: 1935297 - RNA, 15 nt, Human
uaccauuugccuccc

SEQ ID NO: 1935298 - RNA, 14 nt, Human
uaccauuuauacaa

SEQ ID NO: 1935299 - RNA, 15 nt, Human
uaccauuuauacaaa

SEQ ID NO: 1935300 - RNA, 17 nt, Human
uaccauuuauacaaauu

SEQ ID NO: 1935301 - RNA, 18 nt, Human
uaccauuuauacaaauua

SEQ ID NO: 1935302 - RNA, 18 nt, Human
uacccagcgagcccuggu

SEQ ID NO: 1935303 - RNA, 22 nt, Human
uacccaggugcuaggaacacuc

SEQ ID NO: 1935304 - RNA, 16 nt, Human
uacccagcgagcccug

SEQ ID NO: 1935305 - RNA, 14 nt, Human
uacccacugcucug

SEQ ID NO: 1935306 - RNA, 13 nt, Human
uacccacugcucu

SEQ ID NO: 1935307 - RNA, 12 nt, Human
uacccacugcuc

SEQ ID NO: 1935308 - RNA, 11 nt, Human
uacccacugcu

SEQ ID NO: 1935309 - RNA, 12 nt, Human
uacccaccccca

SEQ ID NO: 1935310 - RNA, 15 nt, Human
uacccacccccaccc

SEQ ID NO: 1935311 - RNA, 15 nt, Human
uacccaaauuaagag

SEQ ID NO: 1935312 - RNA, 23 nt, Human
uacccacccccacccaagggccu

SEQ ID NO: 1935313 - RNA, 17 nt, Human
uacccacccccacccaa

SEQ ID NO: 1935314 - RNA, 19 nt, Human
uacccacccccacccaagg

SEQ ID NO: 1935315 - RNA, 21 nt, Human
uacauuuuguauauuuguauu

SEQ ID NO: 1935316 - RNA, 18 nt, Human
uaccaaauagcuucuguu

SEQ ID NO: 1935317 - RNA, 22 nt, Human
uacaugagguacugagagugaa

SEQ ID NO: 1935318 - RNA, 21 nt, Human
uacaugagguacugagaguga

SEQ ID NO: 1935319 - RNA, 22 nt, Human
uacauaagauaaaugugcugaa

SEQ ID NO: 1935320 - RNA, 18 nt, Human
uacaucuauuuuggauug

SEQ ID NO: 1935321 - RNA, 19 nt, Human
uacaucuauuuuggauugu

SEQ ID NO: 1935322 - RNA, 20 nt, Human
uacaucuauuuuggauugua

SEQ ID NO: 1935323 - RNA, 22 nt, Human
uacaucuauuuuggauuguaua

SEQ ID NO: 1935324 - RNA, 23 nt, Human
uacaucuauuuuggauuguauau

SEQ ID NO: 1935325 - RNA, 17 nt, Human
uacaugagaacaaacag

SEQ ID NO: 1935326 - RNA, 18 nt, Human
uacaugagaacaaacaga

SEQ ID NO: 1935327 - RNA, 16 nt, Human
uacaugagaaggaacu

SEQ ID NO: 1935328 - RNA, 23 nt, Human
uacaguuacucagaauucucuag

SEQ ID NO: 1935329 - RNA, 19 nt, Human
uacaguuacucagaauucu

SEQ ID NO: 1935330 - RNA, 18 nt, Human
uacaguuccuagguauaa

SEQ ID NO: 1935331 - RNA, 18 nt, Human
uacauaagauaaaugugc

SEQ ID NO: 1935332 - RNA, 19 nt, Human
uacauaagauaaaugugcu

SEQ ID NO: 1935333 - RNA, 18 nt, Human
uacugagccuuguaauuc

SEQ ID NO: 1935334 - RNA, 15 nt, Human
uacugagccuuguaa

SEQ ID NO: 1935335 - RNA, 23 nt, Human
uacugagccuuguaauucuaaau

SEQ ID NO: 1935336 - RNA, 19 nt, Human
uacugagccuuguaauucu

SEQ ID NO: 1935337 - RNA, 14 nt, Human
uacugagcuucucu

SEQ ID NO: 1935338 - RNA, 17 nt, Human
uacugagcuucucugug

SEQ ID NO: 1935339 - RNA, 15 nt, Human
uacugaggugcuaug

SEQ ID NO: 1935340 - RNA, 17 nt, Human
uacugauguuccuuugg

SEQ ID NO: 1935341 - RNA, 18 nt, Human
uacugauguuccuuugga

SEQ ID NO: 1935342 - RNA, 18 nt, Human
uacugagcuucucuguga

SEQ ID NO: 1935343 - RNA, 12 nt, Human
uacucccaucug

SEQ ID NO: 1935344 - RNA, 14 nt, Human
uacucccaucugug

SEQ ID NO: 1935345 - RNA, 16 nt, Human
uacucccaucugugaa

SEQ ID NO: 1935346 - RNA, 17 nt, Human
uacucccaucugugaaa

SEQ ID NO: 1935347 - RNA, 22 nt, Human
uacucagaauucucuaguuuga

SEQ ID NO: 1935348 - RNA, 16 nt, Human
uacucagaauucucua

SEQ ID NO: 1935349 - RNA, 13 nt, Human
uacucaggaagaa

SEQ ID NO: 1935350 - RNA, 14 nt, Human
uacucaggaagaac

SEQ ID NO: 1935351 - RNA, 14 nt, Human
uacucaccucaccc

SEQ ID NO: 1935352 - RNA, 12 nt, Human
uacucaccucac

SEQ ID NO: 1935353 - RNA, 16 nt, Human
uacuaccuugaaaaua

SEQ ID NO: 1935354 - RNA, 20 nt, Human
uacuaccuugaaaauaagaa

SEQ ID NO: 1935355 - RNA, 20 nt, Human
uacuacaguccucccaucuc

SEQ ID NO: 1935356 - RNA, 20 nt, Human
uacuacaguuuguuaguaug

SEQ ID NO: 1935357 - RNA, 13 nt, Human
uacuaccuugaaa

SEQ ID NO: 1935358 - RNA, 14 nt, Human
uacuaccuugaaaa

SEQ ID NO: 1935359 - RNA, 22 nt, Human
uacccaucccauaugccugggc

SEQ ID NO: 1935360 - RNA, 17 nt, Human
uacccauccccgcagug

SEQ ID NO: 1935361 - RNA, 22 nt, Human
uaccuugaaaauaagaauagaa

SEQ ID NO: 1935362 - RNA, 22 nt, Human
uacccauccccgcagugugcac

SEQ ID NO: 1935363 - RNA, 19 nt, Human
uaccuuugacaaagguaaa

SEQ ID NO: 1935364 - RNA, 20 nt, Human
uaccuuuguauucucuccug

SEQ ID NO: 1935365 - RNA, 20 nt, Human
uaccuuuuuuauacauaaac

SEQ ID NO: 1935366 - RNA, 19 nt, Human
uaccuuuuuuauacauaaa

SEQ ID NO: 1935367 - RNA, 18 nt, Human
uaccuuuuuuauacauaa

SEQ ID NO: 1935368 - RNA, 15 nt, Human
uacgacaacuugcac

SEQ ID NO: 1935369 - RNA, 14 nt, Human
uacgacaacuugca

SEQ ID NO: 1935370 - RNA, 22 nt, Human
uaccuuuuuuauacauaaacaa

SEQ ID NO: 1935371 - RNA, 18 nt, Human
uacuaaccagcagaaaug

SEQ ID NO: 1935372 - RNA, 17 nt, Human
uacuaaccagcagaaau

SEQ ID NO: 1935373 - RNA, 19 nt, Human
uacuaaccagcagaaaugc

SEQ ID NO: 1935374 - RNA, 17 nt, Human
uacuaauagacaauuua

SEQ ID NO: 1935375 - RNA, 15 nt, Human
uacuaauagacaauu

SEQ ID NO: 1935376 - RNA, 22 nt, Human
uacuaauaaaauuuaaaagucu

SEQ ID NO: 1935377 - RNA, 13 nt, Human
uacuaacuuuccu

SEQ ID NO: 1935378 - RNA, 12 nt, Human
uacuacaguccu

SEQ ID NO: 1935379 - RNA, 17 nt, Human
uacuacaguccucccau

SEQ ID NO: 1935380 - RNA, 23 nt, Human
uacuugggagaccuguaaucaua

SEQ ID NO: 1935381 - RNA, 12 nt, Human
uacuugggaggc

SEQ ID NO: 1935382 - RNA, 21 nt, Human
uacuugggagaccuguaauca

SEQ ID NO: 1935383 - RNA, 22 nt, Human
uacuugcucuggaccugccccc

SEQ ID NO: 1935384 - RNA, 14 nt, Human
uacuugcuuugugu

SEQ ID NO: 1935385 - RNA, 16 nt, Human
uacuugcucuggaccu

SEQ ID NO: 1935386 - RNA, 17 nt, Human
uacuugcucuggaccug

SEQ ID NO: 1935387 - RNA, 18 nt, Human
uacuugcucuggaccugc

SEQ ID NO: 1935388 - RNA, 20 nt, Human
uacuugcucuggaccugccc

SEQ ID NO: 1935389 - RNA, 18 nt, Human
uacuuguggacacagcuc

SEQ ID NO: 1935390 - RNA, 15 nt, Human
uacuuguggacacag

SEQ ID NO: 1935391 - RNA, 19 nt, Human
uacuuguggacacagcucu

SEQ ID NO: 1935392 - RNA, 13 nt, Human
uacuuuaauaaau

SEQ ID NO: 1935393 - RNA, 21 nt, Human
uacuugcucuugaugccuggc

SEQ ID NO: 1935394 - RNA, 12 nt, Human
uacuugcucugg

SEQ ID NO: 1935395 - RNA, 14 nt, Human
uacuugcucuggac

SEQ ID NO: 1935396 - RNA, 15 nt, Human
uacuugcucuggacc

SEQ ID NO: 1935397 - RNA, 21 nt, Human
uacuugaagggccagagccag

SEQ ID NO: 1935398 - RNA, 22 nt, Human
uacuugaagggccagagccagg

SEQ ID NO: 1935399 - RNA, 15 nt, Human
uacuguggcuucuua

SEQ ID NO: 1935400 - RNA, 16 nt, Human
uacugugguguuuugu

SEQ ID NO: 1935401 - RNA, 14 nt, Human
uacuguguguguga

SEQ ID NO: 1935402 - RNA, 23 nt, Human
uacugugucuuugguuugugcua

SEQ ID NO: 1935403 - RNA, 17 nt, Human
uacugugugugugaaug

SEQ ID NO: 1935404 - RNA, 18 nt, Human
uacugugugugugaauga

SEQ ID NO: 1935405 - RNA, 19 nt, Human
uacugugugugugaaugaa

SEQ ID NO: 1935406 - RNA, 21 nt, Human
uacugugugugugaaugaaca

SEQ ID NO: 1935407 - RNA, 13 nt, Human
uacugugucuuug

SEQ ID NO: 1935408 - RNA, 21 nt, Human
uacuguaucaugacaaagacu

SEQ ID NO: 1935409 - RNA, 12 nt, Human
uacuguauuuga

SEQ ID NO: 1935410 - RNA, 17 nt, Human
uacugcauaugaaagga

SEQ ID NO: 1935411 - RNA, 15 nt, Human
uagaaauauaauuga

SEQ ID NO: 1935412 - RNA, 20 nt, Human
uagaaauaucugaaaaugua

SEQ ID NO: 1935413 - RNA, 21 nt, Human
uagaaauaucugaaaauguau

SEQ ID NO: 1935414 - RNA, 23 nt, Human
uagaaauaucugaaaauguaugu

SEQ ID NO: 1935415 - RNA, 16 nt, Human
uagaacauaaagcaaa

SEQ ID NO: 1935416 - RNA, 17 nt, Human
uagaacauaaagcaaau

SEQ ID NO: 1935417 - RNA, 18 nt, Human
uagaacauaaagcaaaua

SEQ ID NO: 1935418 - RNA, 22 nt, Human
uagaacauaaagcaaauagaca

SEQ ID NO: 1935419 - RNA, 15 nt, Human
uagaaagaagaugaa

SEQ ID NO: 1935420 - RNA, 14 nt, Human
uagaaagaagccca

SEQ ID NO: 1935421 - RNA, 17 nt, Human
uagaaagacagagcugg

SEQ ID NO: 1935422 - RNA, 23 nt, Human
uagaaagaauauuugguuuuccu

SEQ ID NO: 1935423 - RNA, 21 nt, Human
uagaaagaagcccaauauuau

SEQ ID NO: 1935424 - RNA, 23 nt, Human
uagaaagaagcccaauauuauaa

SEQ ID NO: 1935425 - RNA, 20 nt, Human
uagaaauaaaggaugugauu

SEQ ID NO: 1935426 - RNA, 19 nt, Human
uagaaauaaaggaugugau

SEQ ID NO: 1935427 - RNA, 22 nt, Human
uagaaaggggcaguuuaaagca

SEQ ID NO: 1935428 - RNA, 17 nt, Human
uagaaagugccagaaag

SEQ ID NO: 1935429 - RNA, 18 nt, Human
uagaaagugccagaaagu

SEQ ID NO: 1935430 - RNA, 18 nt, Human
uaauugguccgaucuuug

SEQ ID NO: 1935431 - RNA, 12 nt, Human
uaauugcuuuga

SEQ ID NO: 1935432 - RNA, 18 nt, Human
uaauuugugauacaaugc

SEQ ID NO: 1935433 - RNA, 15 nt, Human
uaauuugugauacaa

SEQ ID NO: 1935434 - RNA, 14 nt, Human
uaauuugugauaca

SEQ ID NO: 1935435 - RNA, 12 nt, Human
uaauuuggcagg

SEQ ID NO: 1935436 - RNA, 18 nt, Human
uaauuugguuuucacauu

SEQ ID NO: 1935437 - RNA, 17 nt, Human
uaauuugguuuucacau

SEQ ID NO: 1935438 - RNA, 15 nt, Human
uaauuugguuuucac

SEQ ID NO: 1935439 - RNA, 22 nt, Human
uaauuugugauacaaugcugug

SEQ ID NO: 1935440 - RNA, 19 nt, Human
uaauuugugauacaaugcu

SEQ ID NO: 1935441 - RNA, 18 nt, Human
uaauucuuagcucauucu

SEQ ID NO: 1935442 - RNA, 12 nt, Human
uaauucugggaa

SEQ ID NO: 1935443 - RNA, 22 nt, Human
uaauugacaggauuauuggaaa

SEQ ID NO: 1935444 - RNA, 20 nt, Human
uaauugacaggauuauugga

SEQ ID NO: 1935445 - RNA, 20 nt, Human
uaauucuucaccuuaggaau

SEQ ID NO: 1935446 - RNA, 14 nt, Human
uaauucuuauucuu

SEQ ID NO: 1935447 - RNA, 15 nt, Human
uaauucuugcauauu

SEQ ID NO: 1935448 - RNA, 19 nt, Human
uaauucuugcauauuuugu

SEQ ID NO: 1935449 - RNA, 19 nt, Human
uaauucuuugaccuguugg

SEQ ID NO: 1935450 - RNA, 14 nt, Human
uaaugcgugcauac

SEQ ID NO: 1935451 - RNA, 17 nt, Human
uaauuaaaacacaacau

SEQ ID NO: 1935452 - RNA, 15 nt, Human
uaauuaaauagcuuu

SEQ ID NO: 1935453 - RNA, 21 nt, Human
uaauuaaauaaaaaucugugg

SEQ ID NO: 1935454 - RNA, 19 nt, Human
uaauaaauguacauuaauu

SEQ ID NO: 1935455 - RNA, 17 nt, Human
uaauaaauguacauuaa

SEQ ID NO: 1935456 - RNA, 11 nt, Human
uaauaaagcug

SEQ ID NO: 1935457 - RNA, 20 nt, Human
uaagugguacuaacuuuccu

SEQ ID NO: 1935458 - RNA, 15 nt, Human
uaaguggaggcacuu

SEQ ID NO: 1935459 - RNA, 16 nt, Human
uaaguggaggcacuuu

SEQ ID NO: 1935460 - RNA, 17 nt, Human
uaaguggaggcacuuua

SEQ ID NO: 1935461 - RNA, 19 nt, Human
uaaguggaggcacuuuagg

SEQ ID NO: 1935462 - RNA, 13 nt, Human
uaauaaagacagg

SEQ ID NO: 1935463 - RNA, 21 nt, Human
uaauaguucagguaacaggca

SEQ ID NO: 1935464 - RNA, 14 nt, Human
uaauacaccacuac

SEQ ID NO: 1935465 - RNA, 20 nt, Human
uaauacaaugaugcuauuug

SEQ ID NO: 1935466 - RNA, 19 nt, Human
uaauauaaaguuggaugcg

SEQ ID NO: 1935467 - RNA, 14 nt, Human
uaauauaaaguugg

SEQ ID NO: 1935468 - RNA, 21 nt, Human
uaauauaaaaagcuuccauga

SEQ ID NO: 1935469 - RNA, 16 nt, Human
uaauauacuauauuua

SEQ ID NO: 1935470 - RNA, 20 nt, Human
uaauauauuuguguauuuaa

SEQ ID NO: 1935471 - RNA, 19 nt, Human
uaauauauuuguguauuua

SEQ ID NO: 1935472 - RNA, 16 nt, Human
uaauauggggaugcag

SEQ ID NO: 1935473 - RNA, 19 nt, Human
uaaugccacuaaauugaca

SEQ ID NO: 1935474 - RNA, 22 nt, Human
uaaugcaucuagauuauggagc

SEQ ID NO: 1935475 - RNA, 14 nt, Human
uaaugauggcccau

SEQ ID NO: 1935476 - RNA, 18 nt, Human
uaaugauggcccauucua

SEQ ID NO: 1935477 - RNA, 22 nt, Human
uaaugauggcccauucuacuug

SEQ ID NO: 1935478 - RNA, 18 nt, Human
uaaucuuaucaagaguug

SEQ ID NO: 1935479 - RNA, 13 nt, Human
uaaucuuauuagg

SEQ ID NO: 1935480 - RNA, 21 nt, Human
uaaucuuauuagggagaaaau

SEQ ID NO: 1935481 - RNA, 11 nt, Human
uaaucuaaaug

SEQ ID NO: 1935482 - RNA, 14 nt, Human
uaaucugagaaaca

SEQ ID NO: 1935483 - RNA, 13 nt, Human
uaagauaauuaua

SEQ ID NO: 1935484 - RNA, 12 nt, Human
uaagauaauuau

SEQ ID NO: 1935485 - RNA, 16 nt, Human
uaagauaaaugugcug

SEQ ID NO: 1935486 - RNA, 17 nt, Human
uaagauaaaugugcuga

SEQ ID NO: 1935487 - RNA, 18 nt, Human
uaagaucguucucugccu

SEQ ID NO: 1935488 - RNA, 14 nt, Human
uaagauaaaugugc

SEQ ID NO: 1935489 - RNA, 12 nt, Human
uaagagggaggg

SEQ ID NO: 1935490 - RNA, 22 nt, Human
uaagagggagggagggcuccag

SEQ ID NO: 1935491 - RNA, 23 nt, Human
uaagagggagggagggcuccaga

SEQ ID NO: 1935492 - RNA, 22 nt, Human
uaagaggcagggucucacucug

SEQ ID NO: 1935493 - RNA, 17 nt, Human
uaagagagucuauuuac

SEQ ID NO: 1935494 - RNA, 21 nt, Human
uaagaacuacaaacaaaauuu

SEQ ID NO: 1935495 - RNA, 22 nt, Human
uaagaaccuuuugagugccuua

SEQ ID NO: 1935496 - RNA, 22 nt, Human
uaacuuuuauaaacuuuaccuu

SEQ ID NO: 1935497 - RNA, 21 nt, Human
uaacuuuuauaaacuuuaccu

SEQ ID NO: 1935498 - RNA, 19 nt, Human
uaacuuuuauaaacuuuac

SEQ ID NO: 1935499 - RNA, 15 nt, Human
uaagcaugcacaaau

SEQ ID NO: 1935500 - RNA, 13 nt, Human
uaagaucucagug

SEQ ID NO: 1935501 - RNA, 19 nt, Human
uaagaucucagugguuaag

SEQ ID NO: 1935502 - RNA, 13 nt, Human
uaagccagacauc

SEQ ID NO: 1935503 - RNA, 21 nt, Human
uaagccagacaucaacagaua

SEQ ID NO: 1935504 - RNA, 20 nt, Human
uaagccagacaucaacagau

SEQ ID NO: 1935505 - RNA, 19 nt, Human
uaaggaugcuuguacauaa

SEQ ID NO: 1935506 - RNA, 15 nt, Human
uaaggcaaucauggu

SEQ ID NO: 1935507 - RNA, 18 nt, Human
uaaggaugcuuguacaua

SEQ ID NO: 1935508 - RNA, 23 nt, Human
uaaggaugcuuguacauaaugcg

SEQ ID NO: 1935509 - RNA, 22 nt, Human
uaaggaugcuuguacauaaugc

SEQ ID NO: 1935510 - RNA, 21 nt, Human
uaaggaugcuuguacauaaug

SEQ ID NO: 1935511 - RNA, 20 nt, Human
uaaggaugcuuguacauaau

SEQ ID NO: 1935512 - RNA, 14 nt, Human
uaacaauguauuuu

SEQ ID NO: 1935513 - RNA, 16 nt, Human
uaacaauguauuuucu

SEQ ID NO: 1935514 - RNA, 14 nt, Human
uaaauuuaguauuu

SEQ ID NO: 1935515 - RNA, 13 nt, Human
uaacagaaaugua

SEQ ID NO: 1935516 - RNA, 15 nt, Human
uaacagaaauguaca

SEQ ID NO: 1935517 - RNA, 14 nt, Human
uaacagaaauguac

SEQ ID NO: 1935518 - RNA, 13 nt, Human
uaacagcucagga

SEQ ID NO: 1935519 - RNA, 14 nt, Human
uaacagcucaggau

SEQ ID NO: 1935520 - RNA, 12 nt, Human
uaacagcugaau

SEQ ID NO: 1935521 - RNA, 15 nt, Human
uaacagcugaauuau

SEQ ID NO: 1935522 - RNA, 19 nt, Human
uaacagcugaauuaucuau

SEQ ID NO: 1935523 - RNA, 19 nt, Human
uaacaggcagauacaggaa

SEQ ID NO: 1935524 - RNA, 19 nt, Human
uaaccagcagaaaugccuu

SEQ ID NO: 1935525 - RNA, 16 nt, Human
uaaccagcagaaaugc

SEQ ID NO: 1935526 - RNA, 14 nt, Human
uaaccagcagaaau

SEQ ID NO: 1935527 - RNA, 14 nt, Human
uaaccaaucuacaa

SEQ ID NO: 1935528 - RNA, 15 nt, Human
uaaccaaucuacaau

SEQ ID NO: 1935529 - RNA, 22 nt, Human
uaaccaaucuacaaucucccuu

SEQ ID NO: 1935530 - RNA, 19 nt, Human
uaacugcaaagugaaguug

SEQ ID NO: 1935531 - RNA, 17 nt, Human
uaacugcccagcggaca

SEQ ID NO: 1935532 - RNA, 23 nt, Human
uaacugcccagcggacaguggca

SEQ ID NO: 1935533 - RNA, 20 nt, Human
uaacuuuuauaaacuuuacc

SEQ ID NO: 1935534 - RNA, 22 nt, Human
uaaauauauuuaagauaauuau

SEQ ID NO: 1935535 - RNA, 17 nt, Human
uaaauauauuuaagaua

SEQ ID NO: 1935536 - RNA, 18 nt, Human
uaaauauaugcuaagucu

SEQ ID NO: 1935537 - RNA, 16 nt, Human
uaaauauauuuuaaga

SEQ ID NO: 1935538 - RNA, 22 nt, Human
uaaauauauuuuaagacgaaac

SEQ ID NO: 1935539 - RNA, 20 nt, Human
uaaaucagacuaugaaguuu

SEQ ID NO: 1935540 - RNA, 19 nt, Human
uaaaucagccguguaacca

SEQ ID NO: 1935541 - RNA, 13 nt, Human
uaaauauugucuu

SEQ ID NO: 1935542 - RNA, 15 nt, Human
uaaauauugucuuuu

SEQ ID NO: 1935543 - RNA, 16 nt, Human
uaaauauugucuuuuu

SEQ ID NO: 1935544 - RNA, 17 nt, Human
uaaauauugucuuuuug

SEQ ID NO: 1935545 - RNA, 20 nt, Human
uaaauauugucuuuuuguau

SEQ ID NO: 1935546 - RNA, 23 nt, Human
uaaauauugucuuuuuguauguc

SEQ ID NO: 1935547 - RNA, 10 nt, Human
uaaauauuua

SEQ ID NO: 1935548 - RNA, 17 nt, Human
uaaauaaaaauaauccu

SEQ ID NO: 1935549 - RNA, 21 nt, Human
uaaauaaaacauuuucacaca

SEQ ID NO: 1935550 - RNA, 22 nt, Human
uaaauaaaacauuuucacacaa

SEQ ID NO: 1935551 - RNA, 14 nt, Human
uaaaguuuguugaa

SEQ ID NO: 1935552 - RNA, 14 nt, Human
uaaaguuugcuuag

SEQ ID NO: 1935553 - RNA, 17 nt, Human
uaaaguuugcuuagaaa

SEQ ID NO: 1935554 - RNA, 13 nt, Human
uaaaguuucuguu

SEQ ID NO: 1935555 - RNA, 21 nt, Human
uaaaguguauuuuuuuacuaa

SEQ ID NO: 1935556 - RNA, 16 nt, Human
uaaaggaugugauugu

SEQ ID NO: 1935557 - RNA, 22 nt, Human
uaaaggaugugauuguggaaug

SEQ ID NO: 1935558 - RNA, 23 nt, Human
uaaaguguauuuuuuuacuaaua

SEQ ID NO: 1935559 - RNA, 22 nt, Human
uaaaguguauuuuuuuacuaau

SEQ ID NO: 1935560 - RNA, 14 nt, Human
uaaaggaauuuaaa

SEQ ID NO: 1935561 - RNA, 14 nt, Human
uaaagcuagaaaug

SEQ ID NO: 1935562 - RNA, 15 nt, Human
uaaagcuagaaauga

SEQ ID NO: 1935563 - RNA, 15 nt, Human
uaaagcuaaaauaac

SEQ ID NO: 1935564 - RNA, 13 nt, Human
uaaagcauuuaua

SEQ ID NO: 1935565 - RNA, 12 nt, Human
uaaagcauuuau

SEQ ID NO: 1935566 - RNA, 20 nt, Human
uaaacuuuuuucuuacuguc

SEQ ID NO: 1935567 - RNA, 13 nt, Human
uaaaaugagaaau

SEQ ID NO: 1935568 - RNA, 22 nt, Human
uaaaaucugauauguauuguuu

SEQ ID NO: 1935569 - RNA, 23 nt, Human
uaaaaucugauauguauuguuug

SEQ ID NO: 1935570 - RNA, 15 nt, Human
uaaaaugagaaaucu

SEQ ID NO: 1935571 - RNA, 16 nt, Human
uaaaaugagaaaucua

SEQ ID NO: 1935572 - RNA, 20 nt, Human
uaaaaucugauauguauugu

SEQ ID NO: 1935573 - RNA, 21 nt, Human
uaaaaucugauauguauuguu

SEQ ID NO: 1935574 - RNA, 15 nt, Human
uaaaaaugguuuaaa

SEQ ID NO: 1935575 - RNA, 16 nt, Human
uaaaagaugcaaugua

SEQ ID NO: 1935576 - RNA, 17 nt, Human
uaaaagggacugagaaa

SEQ ID NO: 1935577 - RNA, 19 nt, Human
uaaaagggacugagaaauu

SEQ ID NO: 1935578 - RNA, 20 nt, Human
uaaaagggacugagaaauuu

SEQ ID NO: 1935579 - RNA, 21 nt, Human
uaaaagggacugagaaauuua

SEQ ID NO: 1935580 - RNA, 19 nt, Human
uaaacuuaaucuaaaugga

SEQ ID NO: 1935581 - RNA, 18 nt, Human
uaaacuuaaucuaaaugg

SEQ ID NO: 1935582 - RNA, 13 nt, Human
uaaacuuaaucua

SEQ ID NO: 1935583 - RNA, 14 nt, Human
uaaacuuaaucuaa

SEQ ID NO: 1935584 - RNA, 16 nt, Human
uaaacuuuaccuuuuu

SEQ ID NO: 1935585 - RNA, 22 nt, Human
uaaacuuuaccuuuuuuauaca

SEQ ID NO: 1935586 - RNA, 20 nt, Human
uaaacugguauuuuaucuuu

SEQ ID NO: 1935587 - RNA, 18 nt, Human
uaaacaagaccacguuuc

SEQ ID NO: 1935588 - RNA, 19 nt, Human
uaaacaaauguaugauuac

SEQ ID NO: 1935589 - RNA, 12 nt, Human
uaaacaaaugua

SEQ ID NO: 1935590 - RNA, 16 nt, Human
uaaaaugcaugauuuu

SEQ ID NO: 1935591 - RNA, 19 nt, Human
uaaaaugcaugauuuugua

SEQ ID NO: 1935592 - RNA, 19 nt, Human
uaaacaagaccacguuucu

SEQ ID NO: 1935593 - RNA, 23 nt, Human
uaaacaagaccacguuucuaaag

SEQ ID NO: 1935594 - RNA, 18 nt, Human
uaaacaauaucagacuuu

SEQ ID NO: 1935595 - RNA, 21 nt, Human
uaaacaaugcugauuugguga

SEQ ID NO: 1935596 - RNA, 21 nt, Human
uaaacacucuugaaaaaugca

SEQ ID NO: 1935597 - RNA, 17 nt, Human
guuuccuuccagcccag

SEQ ID NO: 1935598 - RNA, 20 nt, Human
guuuccuuucauuuacugug

SEQ ID NO: 1935599 - RNA, 17 nt, Human
guuuccuuucauuuacu

SEQ ID NO: 1935600 - RNA, 23 nt, Human
guuuccuuucauuuacuguggcu

SEQ ID NO: 1935601 - RNA, 20 nt, Human
guuucuaaagcugccagccg

SEQ ID NO: 1935602 - RNA, 16 nt, Human
guuucuaaagcugcca

SEQ ID NO: 1935603 - RNA, 14 nt, Human
guuucuaaagcugc

SEQ ID NO: 1935604 - RNA, 15 nt, Human
guuucuaaagcugcc

SEQ ID NO: 1935605 - RNA, 16 nt, Human
guuugaaccaagaacu

SEQ ID NO: 1935606 - RNA, 17 nt, Human
guuugaauauaaacacu

SEQ ID NO: 1935607 - RNA, 19 nt, Human
guuugaauauaaacacuau

SEQ ID NO: 1935608 - RNA, 13 nt, Human
guuugaauauaaa

SEQ ID NO: 1935609 - RNA, 17 nt, Human
guuucuuuguaaugaaa

SEQ ID NO: 1935610 - RNA, 14 nt, Human
guuucuuuguaaug

SEQ ID NO: 1935611 - RNA, 22 nt, Human
guuugauuaaauucuugcaaag

SEQ ID NO: 1935612 - RNA, 19 nt, Human
guuugauuaaauucuugca

SEQ ID NO: 1935613 - RNA, 17 nt, Human
guuugauuaaauucuug

SEQ ID NO: 1935614 - RNA, 21 nt, Human
guuugaaucuauuuaucuuca

SEQ ID NO: 1935615 - RNA, 19 nt, Human
guuuguaaauuaacuuuua

SEQ ID NO: 1935616 - RNA, 17 nt, Human
guuuguaaauuaacuuu

SEQ ID NO: 1935617 - RNA, 18 nt, Human
guuugucugucuucauag

SEQ ID NO: 1935618 - RNA, 15 nt, Human
guuugucugucuuca

SEQ ID NO: 1935619 - RNA, 21 nt, Human
gguuggccccugcccggcugc

SEQ ID NO: 1935620 - RNA, 17 nt, Human
guuuagaaagcuugccc

SEQ ID NO: 1935621 - RNA, 13 nt, Human
guuuagaaagcuu

SEQ ID NO: 1935622 - RNA, 19 nt, Human
gguugggagaaugucagua

SEQ ID NO: 1935623 - RNA, 20 nt, Human
guuuaggauguugaaaaagu

SEQ ID NO: 1935624 - RNA, 23 nt, Human
guuuagcagcagccuuuaaugca

SEQ ID NO: 1935625 - RNA, 12 nt, Human
guuuagccugga

SEQ ID NO: 1935626 - RNA, 17 nt, Human
guuuagcagcagccuuu

SEQ ID NO: 1935627 - RNA, 16 nt, Human
guuuaguaaucauauu

SEQ ID NO: 1935628 - RNA, 18 nt, Human
guuuaggcugguggccca

SEQ ID NO: 1935629 - RNA, 21 nt, Human
guuuaggcugguggcccagga

SEQ ID NO: 1935630 - RNA, 18 nt, Human
guuucagaaauguguuau

SEQ ID NO: 1935631 - RNA, 14 nt, Human
guuucagaaaugug

SEQ ID NO: 1935632 - RNA, 19 nt, Human
guuuccagacuuccuugag

SEQ ID NO: 1935633 - RNA, 20 nt, Human
guuuccagacuuccuugaga

SEQ ID NO: 1935634 - RNA, 23 nt, Human
guuuccaguacaccuuucagcca

SEQ ID NO: 1935635 - RNA, 16 nt, Human
guuuccugcaggccag

SEQ ID NO: 1935636 - RNA, 16 nt, Human
guuuccuuauauuaug

SEQ ID NO: 1935637 - RNA, 21 nt, Human
guuuccuggcacugcuuccag

SEQ ID NO: 1935638 - RNA, 22 nt, Human
guuuccuggcacugcuuccagu

SEQ ID NO: 1935639 - RNA, 22 nt, Human
guuuccugaaacaacuuggaaa

SEQ ID NO: 1935640 - RNA, 14 nt, Human
guuuccugcaggcc

SEQ ID NO: 1935641 - RNA, 16 nt, Human
guuuccuggcacugcu

SEQ ID NO: 1935642 - RNA, 20 nt, Human
guuuccuggcacugcuucca

SEQ ID NO: 1935643 - RNA, 12 nt, Human
uaaaaaacacug

SEQ ID NO: 1935644 - RNA, 11 nt, Human
uaaaaaacaac

SEQ ID NO: 1935645 - RNA, 23 nt, Human
uaaaaaacaugugguuacacagu

SEQ ID NO: 1935646 - RNA, 20 nt, Human
uaaaaaacugcugacuguuu

SEQ ID NO: 1935647 - RNA, 23 nt, Human
uaaaaaacugcugacuguuuucu

SEQ ID NO: 1935648 - RNA, 15 nt, Human
uaaaaaagcugugug

SEQ ID NO: 1935649 - RNA, 14 nt, Human
uaaaaacuuugcua

SEQ ID NO: 1935650 - RNA, 15 nt, Human
uaaaaacaggcagcu

SEQ ID NO: 1935651 - RNA, 11 nt, Human
uaaaaaacacu

SEQ ID NO: 1935652 - RNA, 13 nt, Human
uaaaaaaauuggu

SEQ ID NO: 1935653 - RNA, 17 nt, Human
uaaaaaaagaagagaaa

SEQ ID NO: 1935654 - RNA, 16 nt, Human
uaaaaaaaagaaauga

SEQ ID NO: 1935655 - RNA, 12 nt, Human
uaaaaaaaagaa

SEQ ID NO: 1935656 - RNA, 12 nt, Human
guuuuucaguuu

SEQ ID NO: 1935657 - RNA, 19 nt, Human
uaaaaaaaaagaucuguuu

SEQ ID NO: 1935658 - RNA, 14 nt, Human
guuuuuauuaguac

SEQ ID NO: 1935659 - RNA, 12 nt, Human
guuuucucuuga

SEQ ID NO: 1935660 - RNA, 19 nt, Human
guuuucucuugagagggug

SEQ ID NO: 1935661 - RNA, 19 nt, Human
guuuuguggaggagcucag

SEQ ID NO: 1935662 - RNA, 23 nt, Human
guuuuuauggcuuuugugcauua

SEQ ID NO: 1935663 - RNA, 22 nt, Human
guuuuuauggcuuuugugcauu

SEQ ID NO: 1935664 - RNA, 19 nt, Human
guuuuuauggcuuuugugc

SEQ ID NO: 1935665 - RNA, 19 nt, Human
guuuuuaacucaauauuuu

SEQ ID NO: 1935666 - RNA, 15 nt, Human
guuuuuaacucaaua

SEQ ID NO: 1935667 - RNA, 17 nt, Human
guuuucaguguacaugg

SEQ ID NO: 1935668 - RNA, 16 nt, Human
guuuucaguguacaug

SEQ ID NO: 1935669 - RNA, 20 nt, Human
guuuuccuuuuauuucuuca

SEQ ID NO: 1935670 - RNA, 18 nt, Human
guuuuccuguauaggaau

SEQ ID NO: 1935671 - RNA, 17 nt, Human
guuuucauuugguucau

SEQ ID NO: 1935672 - RNA, 16 nt, Human
guuuucauuugguuca

SEQ ID NO: 1935673 - RNA, 23 nt, Human
ucaagcuaauaaaauaucauuca

SEQ ID NO: 1935674 - RNA, 22 nt, Human
ucaagcuaauaaaauaucauuc

SEQ ID NO: 1935675 - RNA, 20 nt, Human
ucaagcuaauaaaauaucau

SEQ ID NO: 1935676 - RNA, 19 nt, Human
ucaagcuaauaaaauauca

SEQ ID NO: 1935677 - RNA, 13 nt, Human
ucaagcuaauaaa

SEQ ID NO: 1935678 - RNA, 17 nt, Human
ucaagcgauucuucugc

SEQ ID NO: 1935679 - RNA, 16 nt, Human
ucaagcgauucuucug

SEQ ID NO: 1935680 - RNA, 15 nt, Human
ucaagcgauucuccu

SEQ ID NO: 1935681 - RNA, 16 nt, Human
ucaagcccgcggggac

SEQ ID NO: 1935682 - RNA, 22 nt, Human
ucaagugauucuccugccucag

SEQ ID NO: 1935683 - RNA, 23 nt, Human
ucaaggauccugagccagauuuc

SEQ ID NO: 1935684 - RNA, 20 nt, Human
ucaaggauccugagccagau

SEQ ID NO: 1935685 - RNA, 18 nt, Human
ucaaggauccugagccag

SEQ ID NO: 1935686 - RNA, 19 nt, Human
ucaaggauccugagccaga

SEQ ID NO: 1935687 - RNA, 13 nt, Human
ucaagcuccuccu

SEQ ID NO: 1935688 - RNA, 14 nt, Human
ucaagcuccuccuc

SEQ ID NO: 1935689 - RNA, 15 nt, Human
ucaagcuccuccucc

SEQ ID NO: 1935690 - RNA, 16 nt, Human
ucaagcuccuccuccc

SEQ ID NO: 1935691 - RNA, 18 nt, Human
ucaagcuccuccucccug

SEQ ID NO: 1935692 - RNA, 20 nt, Human
ucaagcuccuccucccugca

SEQ ID NO: 1935693 - RNA, 14 nt, Human
ucaaccuccugggc

SEQ ID NO: 1935694 - RNA, 13 nt, Human
ucaaccuccuggg

SEQ ID NO: 1935695 - RNA, 15 nt, Human
ucaacguauuguuuc

SEQ ID NO: 1935696 - RNA, 15 nt, Human
ucaacguuaauaauu

SEQ ID NO: 1935697 - RNA, 22 nt, Human
ucaaacucuugaccucagguga

SEQ ID NO: 1935698 - RNA, 13 nt, Human
ucaaacuuuacua

SEQ ID NO: 1935699 - RNA, 15 nt, Human
ucaaacuuuacuaug

SEQ ID NO: 1935700 - RNA, 16 nt, Human
ucaaacuuuacuaugg

SEQ ID NO: 1935701 - RNA, 14 nt, Human
ucaaagaaauaucu

SEQ ID NO: 1935702 - RNA, 11 nt, Human
ucacaggcagg

SEQ ID NO: 1935703 - RNA, 19 nt, Human
ucacaggaaguagaggagg

SEQ ID NO: 1935704 - RNA, 14 nt, Human
ucacaggaaguaga

SEQ ID NO: 1935705 - RNA, 23 nt, Human
ucacacagugagucgaggacagg

SEQ ID NO: 1935706 - RNA, 22 nt, Human
ucacacagugagucgaggacag

SEQ ID NO: 1935707 - RNA, 21 nt, Human
ucacacaugagcaucaggcca

SEQ ID NO: 1935708 - RNA, 23 nt, Human
ucacacacagacucauauuacug

SEQ ID NO: 1935709 - RNA, 14 nt, Human
ucacacacagacug

SEQ ID NO: 1935710 - RNA, 13 nt, Human
ucacacagugagu

SEQ ID NO: 1935711 - RNA, 22 nt, Human
ucacacaguauuacuucugcua

SEQ ID NO: 1935712 - RNA, 21 nt, Human
ucacacaguauuacuucugcu

SEQ ID NO: 1935713 - RNA, 19 nt, Human
ucacacaauacaauaaguu

SEQ ID NO: 1935714 - RNA, 19 nt, Human
ucaauuacaggaaguacug

SEQ ID NO: 1935715 - RNA, 20 nt, Human
ucaauuacaggaaguacugg

SEQ ID NO: 1935716 - RNA, 17 nt, Human
ucacaaguuuuuuuacu

SEQ ID NO: 1935717 - RNA, 13 nt, Human
ucacaauacuguu

SEQ ID NO: 1935718 - RNA, 18 nt, Human
ucaaugcacugacauugu

SEQ ID NO: 1935719 - RNA, 13 nt, Human
ucaauuacaggaa

SEQ ID NO: 1935720 - RNA, 18 nt, Human
ucaauuacaggaaguacu

SEQ ID NO: 1935721 - RNA, 17 nt, Human
ucaaugguuugcaagga

SEQ ID NO: 1935722 - RNA, 13 nt, Human
ucaauuaacaaua

SEQ ID NO: 1935723 - RNA, 14 nt, Human
ucaaugcacugaca

SEQ ID NO: 1935724 - RNA, 14 nt, Human
ucaauaggaaaaac

SEQ ID NO: 1935725 - RNA, 13 nt, Human
ucaauaggaaaaa

SEQ ID NO: 1935726 - RNA, 15 nt, Human
uauuuuuuaauuauu

SEQ ID NO: 1935727 - RNA, 12 nt, Human
uauuuuuuaauu

SEQ ID NO: 1935728 - RNA, 12 nt, Human
uauuuuuuaaag

SEQ ID NO: 1935729 - RNA, 14 nt, Human
uauuuucuuuaaug

SEQ ID NO: 1935730 - RNA, 15 nt, Human
uauuuuauguugcau

SEQ ID NO: 1935731 - RNA, 16 nt, Human
uauuuuauguugcaua

SEQ ID NO: 1935732 - RNA, 23 nt, Human
uauuuuaucuuugauucuccuuc

SEQ ID NO: 1935733 - RNA, 16 nt, Human
uauuuuauacauuaac

SEQ ID NO: 1935734 - RNA, 22 nt, Human
ucaaaacgguuuuacugcagcu

SEQ ID NO: 1935735 - RNA, 16 nt, Human
ucaaaacuacaaauca

SEQ ID NO: 1935736 - RNA, 14 nt, Human
ucaaacucuuaaaa

SEQ ID NO: 1935737 - RNA, 21 nt, Human
ucaaacuaggggacaaagcaa

SEQ ID NO: 1935738 - RNA, 15 nt, Human
ucaaaaacauucuua

SEQ ID NO: 1935739 - RNA, 22 nt, Human
uauuuuuuucugaauuauuuuc

SEQ ID NO: 1935740 - RNA, 17 nt, Human
uauuuuuuucugaaauu

SEQ ID NO: 1935741 - RNA, 16 nt, Human
uauuuuuuucugaaau

SEQ ID NO: 1935742 - RNA, 15 nt, Human
uauuuuuuuacuaau

SEQ ID NO: 1935743 - RNA, 14 nt, Human
uaucugaaaaugua

SEQ ID NO: 1935744 - RNA, 15 nt, Human
uaucugaaaauguau

SEQ ID NO: 1935745 - RNA, 20 nt, Human
uaucugaaaauguaugugua

SEQ ID NO: 1935746 - RNA, 23 nt, Human
uauuuauuaaaugcccagccccu

SEQ ID NO: 1935747 - RNA, 19 nt, Human
uaucugagcucuuugcacu

SEQ ID NO: 1935748 - RNA, 20 nt, Human
uaucugagcucuuugcacua

SEQ ID NO: 1935749 - RNA, 15 nt, Human
uauuuauuaccucug

SEQ ID NO: 1935750 - RNA, 16 nt, Human
uauuuauuaccucuga

SEQ ID NO: 1935751 - RNA, 13 nt, Human
uauuuauuaccuc

SEQ ID NO: 1935752 - RNA, 23 nt, Human
uauuugggccugcuccagaccug

SEQ ID NO: 1935753 - RNA, 14 nt, Human
uauuugggaaguga

SEQ ID NO: 1935754 - RNA, 15 nt, Human
uauuugggaagugaa

SEQ ID NO: 1935755 - RNA, 13 nt, Human
uauuucucuuucu

SEQ ID NO: 1935756 - RNA, 16 nt, Human
uauuucucuuucuuua

SEQ ID NO: 1935757 - RNA, 15 nt, Human
uauuucucuuucuuu

SEQ ID NO: 1935758 - RNA, 20 nt, Human
uauuucuuaaacaaauguau

SEQ ID NO: 1935759 - RNA, 17 nt, Human
uauuucugcauauguug

SEQ ID NO: 1935760 - RNA, 14 nt, Human
uauuugagaauaua

SEQ ID NO: 1935761 - RNA, 17 nt, Human
ucacuugugcaguguug

SEQ ID NO: 1935762 - RNA, 23 nt, Human
ucagaaagugugcuuuaugcuga

SEQ ID NO: 1935763 - RNA, 16 nt, Human
ucacucugucgcccag

SEQ ID NO: 1935764 - RNA, 12 nt, Human
ucacucugucgc

SEQ ID NO: 1935765 - RNA, 19 nt, Human
ucacucugucgcccagucu

SEQ ID NO: 1935766 - RNA, 22 nt, Human
ucacucugucgcccagucugga

SEQ ID NO: 1935767 - RNA, 20 nt, Human
ucacugcuuaacuucacaua

SEQ ID NO: 1935768 - RNA, 18 nt, Human
ucacugcuuaacuucaca

SEQ ID NO: 1935769 - RNA, 17 nt, Human
ucacugcuuaacuucac

SEQ ID NO: 1935770 - RNA, 15 nt, Human
ucacugcuuaacuuc

SEQ ID NO: 1935771 - RNA, 16 nt, Human
ucagaggcgcacugug

SEQ ID NO: 1935772 - RNA, 22 nt, Human
ucagaguugaugguuguacaua

SEQ ID NO: 1935773 - RNA, 23 nt, Human
ucagagugcaagccccugcucca

SEQ ID NO: 1935774 - RNA, 19 nt, Human
ucagcacgauuucuguuua

SEQ ID NO: 1935775 - RNA, 13 nt, Human
ucagcacaaggcc

SEQ ID NO: 1935776 - RNA, 18 nt, Human
ucagcacgauuucuguuu

SEQ ID NO: 1935777 - RNA, 15 nt, Human
ucagacagcugccug

SEQ ID NO: 1935778 - RNA, 16 nt, Human
ucagacagcugccugg

SEQ ID NO: 1935779 - RNA, 17 nt, Human
ucagacagcugccuggg

SEQ ID NO: 1935780 - RNA, 18 nt, Human
ucagacagcugccuggga

SEQ ID NO: 1935781 - RNA, 19 nt, Human
ucagacagcugccugggau

SEQ ID NO: 1935782 - RNA, 20 nt, Human
ucagacagcugccugggauc

SEQ ID NO: 1935783 - RNA, 19 nt, Human
ucagacauagaauuaacac

SEQ ID NO: 1935784 - RNA, 22 nt, Human
ucagacauagaauuaacacaug

SEQ ID NO: 1935785 - RNA, 14 nt, Human
ucagacauguuuuc

SEQ ID NO: 1935786 - RNA, 15 nt, Human
ucagacauguuuucc

SEQ ID NO: 1935787 - RNA, 20 nt, Human
ucagacauguuuuccgugaa

SEQ ID NO: 1935788 - RNA, 14 nt, Human
ucagaccacggcuc

SEQ ID NO: 1935789 - RNA, 14 nt, Human
ucagaccagcucuu

SEQ ID NO: 1935790 - RNA, 19 nt, Human
ucagacucccauuccugaa

SEQ ID NO: 1935791 - RNA, 21 nt, Human
ucagacucccauuccugaaga

SEQ ID NO: 1935792 - RNA, 22 nt, Human
ucagacucccauuccugaagaa

SEQ ID NO: 1935793 - RNA, 12 nt, Human
ucacuccugcug

SEQ ID NO: 1935794 - RNA, 13 nt, Human
ucacuccugcugu

SEQ ID NO: 1935795 - RNA, 14 nt, Human
ucacuccugcugua

SEQ ID NO: 1935796 - RNA, 15 nt, Human
ucacuccugcuguaa

SEQ ID NO: 1935797 - RNA, 16 nt, Human
ucacuccugcuguaaa

SEQ ID NO: 1935798 - RNA, 19 nt, Human
ucacuccugcuguaaauuu

SEQ ID NO: 1935799 - RNA, 13 nt, Human
ucacuccuugaaa

SEQ ID NO: 1935800 - RNA, 20 nt, Human
ucacggcucacugcagccuc

SEQ ID NO: 1935801 - RNA, 15 nt, Human
ucacggcucacugca

SEQ ID NO: 1935802 - RNA, 13 nt, Human
ucacggcucacug

SEQ ID NO: 1935803 - RNA, 14 nt, Human
ucacggaagagccu

SEQ ID NO: 1935804 - RNA, 16 nt, Human
ucacggaagagccuug

SEQ ID NO: 1935805 - RNA, 17 nt, Human
ucacggaagagccuugc

SEQ ID NO: 1935806 - RNA, 14 nt, Human
ucacucuggcagcu

SEQ ID NO: 1935807 - RNA, 15 nt, Human
ucacucuggcagcuc

SEQ ID NO: 1935808 - RNA, 16 nt, Human
ucacucuggcagcuca

SEQ ID NO: 1935809 - RNA, 17 nt, Human
ucacucuggcagcucag

SEQ ID NO: 1935810 - RNA, 18 nt, Human
ucacucuggcagcucaga

SEQ ID NO: 1935811 - RNA, 19 nt, Human
ucacucuggcagcucagag

SEQ ID NO: 1935812 - RNA, 20 nt, Human
ucacucuggcagcucagaga

SEQ ID NO: 1935813 - RNA, 22 nt, Human
ucacucuggcagcucagagagg

SEQ ID NO: 1935814 - RNA, 23 nt, Human
ucacucuccuuggugucgggcau

SEQ ID NO: 1935815 - RNA, 12 nt, Human
ucacucuggcag

SEQ ID NO: 1935816 - RNA, 13 nt, Human
ucacucuggcagc

SEQ ID NO: 1935817 - RNA, 12 nt, Human
ucacucuccuug

SEQ ID NO: 1935818 - RNA, 14 nt, Human
ucacucuccuuggu

SEQ ID NO: 1935819 - RNA, 23 nt, Human
ucaccuuggcaccagacacccag

SEQ ID NO: 1935820 - RNA, 18 nt, Human
ucaccuuggcaccagaca

SEQ ID NO: 1935821 - RNA, 19 nt, Human
ucaccuuggcaccagacac

SEQ ID NO: 1935822 - RNA, 14 nt, Human
ucaccuuucccauc

SEQ ID NO: 1935823 - RNA, 12 nt, Human
ucaccuuugucc

SEQ ID NO: 1935824 - RNA, 20 nt, Human
ucaccuauuuccauucaaca

SEQ ID NO: 1935825 - RNA, 15 nt, Human
ucacaggcaggucca

SEQ ID NO: 1935826 - RNA, 12 nt, Human
ucacaggcaggu

SEQ ID NO: 1935827 - RNA, 19 nt, Human
ucacaggccccaggaaagg

SEQ ID NO: 1935828 - RNA, 23 nt, Human
ucacagggacugaaaaccucucc

SEQ ID NO: 1935829 - RNA, 15 nt, Human
ucaccuagaaauuga

SEQ ID NO: 1935830 - RNA, 22 nt, Human
ucaccuuuguccccaccgcaga

SEQ ID NO: 1935831 - RNA, 14 nt, Human
ucaccuuugucccc

SEQ ID NO: 1935832 - RNA, 15 nt, Human
ucaccuuugucccca

SEQ ID NO: 1935833 - RNA, 17 nt, Human
ucaccuuuguccccacc

SEQ ID NO: 1935834 - RNA, 18 nt, Human
ucaccuuuguccccaccg

SEQ ID NO: 1935835 - RNA, 14 nt, Human
ucacgccacugcac

SEQ ID NO: 1935836 - RNA, 13 nt, Human
ucacgccacugca

SEQ ID NO: 1935837 - RNA, 16 nt, Human
ucacgccacugcacua

SEQ ID NO: 1935838 - RNA, 19 nt, Human
ucacgccuguaauccuagc

SEQ ID NO: 1935839 - RNA, 20 nt, Human
ucacgccuguaauccuagca

SEQ ID NO: 1935840 - RNA, 13 nt, Human
ucagcagacugau

SEQ ID NO: 1935841 - RNA, 24 nt, Human
ucagucugauucccaagcucugcu

SEQ ID NO: 1935842 - RNA, 22 nt, Human
ucagucuuuaaucugagaggcc

SEQ ID NO: 1935843 - RNA, 20 nt, Human
ucagucuucucucacuuuga

SEQ ID NO: 1935844 - RNA, 15 nt, Human
ucagucuggcccuuc

SEQ ID NO: 1935845 - RNA, 23 nt, Human
ucagugguuggcaauuguuucaa

SEQ ID NO: 1935846 - RNA, 11 nt, Human
ucaguguacau

SEQ ID NO: 1935847 - RNA, 13 nt, Human
ucagugugacuga

SEQ ID NO: 1935848 - RNA, 17 nt, Human
ucagugugacugaucuc

SEQ ID NO: 1935849 - RNA, 13 nt, Human
ucauacccacccc

SEQ ID NO: 1935850 - RNA, 15 nt, Human
ucauaauuauuauuu

SEQ ID NO: 1935851 - RNA, 17 nt, Human
ucaguuguuaguguguc

SEQ ID NO: 1935852 - RNA, 13 nt, Human
ucauaaugacuua

SEQ ID NO: 1935853 - RNA, 20 nt, Human
ucaguucuugccacuuuuuu

SEQ ID NO: 1935854 - RNA, 22 nt, Human
ucauuaggugugacugaauuuc

SEQ ID NO: 1935855 - RNA, 21 nt, Human
ucauuaggugugacugaauuu

SEQ ID NO: 1935856 - RNA, 18 nt, Human
ucauuaggugugacugaa

SEQ ID NO: 1935857 - RNA, 15 nt, Human
ucauguaauccucaa

SEQ ID NO: 1935858 - RNA, 16 nt, Human
ucauuaggugugacug

SEQ ID NO: 1935859 - RNA, 16 nt, Human
ucaugccccuggcugg

SEQ ID NO: 1935860 - RNA, 13 nt, Human
ucaugcccuccuc

SEQ ID NO: 1935861 - RNA, 14 nt, Human
ucaugcccuccucu

SEQ ID NO: 1935862 - RNA, 15 nt, Human
ucaugcccugugcaa

SEQ ID NO: 1935863 - RNA, 15 nt, Human
ucaugcccuccucuc

SEQ ID NO: 1935864 - RNA, 21 nt, Human
ucauacccacccccacccaag

SEQ ID NO: 1935865 - RNA, 20 nt, Human
ucauacccacccccacccaa

SEQ ID NO: 1935866 - RNA, 14 nt, Human
ucauacccaccccc

SEQ ID NO: 1935867 - RNA, 15 nt, Human
ucauacccaccccca

SEQ ID NO: 1935868 - RNA, 21 nt, Human
ucauaguaacuucuuauggaa

SEQ ID NO: 1935869 - RNA, 14 nt, Human
ucauaguaacuucu

SEQ ID NO: 1935870 - RNA, 15 nt, Human
ucauaguaacuucuu

SEQ ID NO: 1935871 - RNA, 16 nt, Human
ucauaguaacuucuua

SEQ ID NO: 1935872 - RNA, 18 nt, Human
ucauaguaacuucuuaug

SEQ ID NO: 1935873 - RNA, 12 nt, Human
ucaucugugcac

SEQ ID NO: 1935874 - RNA, 13 nt, Human
ucaucucuuagcu

SEQ ID NO: 1935875 - RNA, 16 nt, Human
ucaucucucuuuaaua

SEQ ID NO: 1935876 - RNA, 14 nt, Human
ucaucucucugccc

SEQ ID NO: 1935877 - RNA, 16 nt, Human
ucaucucucugcccaa

SEQ ID NO: 1935878 - RNA, 21 nt, Human
ucaucucuuagcuccccucca

SEQ ID NO: 1935879 - RNA, 20 nt, Human
ucaucucuuagcuccccucc

SEQ ID NO: 1935880 - RNA, 19 nt, Human
ucaucucuuagcuccccuc

SEQ ID NO: 1935881 - RNA, 14 nt, Human
ucaucucuuagcuc

SEQ ID NO: 1935882 - RNA, 20 nt, Human
uccacuucuuucagcagacu

SEQ ID NO: 1935883 - RNA, 14 nt, Human
uccacuuggucugu

SEQ ID NO: 1935884 - RNA, 22 nt, Human
uccagaacucacuggggccuac

SEQ ID NO: 1935885 - RNA, 13 nt, Human
uccaccugccagg

SEQ ID NO: 1935886 - RNA, 13 nt, Human
uccacuuggucug

SEQ ID NO: 1935887 - RNA, 12 nt, Human
uccacuuggucu

SEQ ID NO: 1935888 - RNA, 14 nt, Human
uccagaaggagaca

SEQ ID NO: 1935889 - RNA, 19 nt, Human
uccagaaggagacaggcag

SEQ ID NO: 1935890 - RNA, 23 nt, Human
uccagccaaagccuccuccagcc

SEQ ID NO: 1935891 - RNA, 14 nt, Human
uccagcaguuuuca

SEQ ID NO: 1935892 - RNA, 12 nt, Human
uccagcagggaa

SEQ ID NO: 1935893 - RNA, 15 nt, Human
uccacaagagcccag

SEQ ID NO: 1935894 - RNA, 14 nt, Human
uccacaagagccca

SEQ ID NO: 1935895 - RNA, 12 nt, Human
uccaccugccag

SEQ ID NO: 1935896 - RNA, 18 nt, Human
uccaccucgacguuuaca

SEQ ID NO: 1935897 - RNA, 14 nt, Human
uccaccuacaugag

SEQ ID NO: 1935898 - RNA, 10 nt, Human
ucauucagca

SEQ ID NO: 1935899 - RNA, 22 nt, Human
ucauucagauaugauucaaaug

SEQ ID NO: 1935900 - RNA, 17 nt, Human
uccaaaauaaaacuuuu

SEQ ID NO: 1935901 - RNA, 16 nt, Human
uccaaaauaaaacuuu

SEQ ID NO: 1935902 - RNA, 23 nt, Human
uccaaagaguagaauugcauuga

SEQ ID NO: 1935903 - RNA, 22 nt, Human
uccaaagaguagaauugcauug

SEQ ID NO: 1935904 - RNA, 22 nt, Human
uccaaacuuggauuuuugacuc

SEQ ID NO: 1935905 - RNA, 19 nt, Human
uccaagaccuucuccuuca

SEQ ID NO: 1935906 - RNA, 13 nt, Human
uccaagcaaaugu

SEQ ID NO: 1935907 - RNA, 22 nt, Human
uccaagaagcccaggaaaggcu

SEQ ID NO: 1935908 - RNA, 14 nt, Human
uccaagaauuucua

SEQ ID NO: 1935909 - RNA, 20 nt, Human
uccaagaagcccaggaaagg

SEQ ID NO: 1935910 - RNA, 17 nt, Human
uccaaagccaaugugaa

SEQ ID NO: 1935911 - RNA, 14 nt, Human
uccaaagcagacag

SEQ ID NO: 1935912 - RNA, 15 nt, Human
uccaaagcagacagc

SEQ ID NO: 1935913 - RNA, 18 nt, Human
uccaaacuuggauuuuug

SEQ ID NO: 1935914 - RNA, 11 nt, Human
ucccuaauaaa

SEQ ID NO: 1935915 - RNA, 12 nt, Human
ucccuaauaaag

SEQ ID NO: 1935916 - RNA, 13 nt, Human
ucccuaauaaagc

SEQ ID NO: 1935917 - RNA, 15 nt, Human
ucccuacuguaauuu

SEQ ID NO: 1935918 - RNA, 17 nt, Human
ucccucccucuuucccu

SEQ ID NO: 1935919 - RNA, 15 nt, Human
ucccucccucuuucc

SEQ ID NO: 1935920 - RNA, 24 nt, Human
uccccugcuggguguggcgcagca

SEQ ID NO: 1935921 - RNA, 19 nt, Human
uccccuguagagugggagc

SEQ ID NO: 1935922 - RNA, 22 nt, Human
uccccuguagagugggagcuga

SEQ ID NO: 1935923 - RNA, 23 nt, Human
uccccuguccccgcacugggcuu

SEQ ID NO: 1935924 - RNA, 14 nt, Human
uccccugcugggug

SEQ ID NO: 1935925 - RNA, 15 nt, Human
uccccugcugggugu

SEQ ID NO: 1935926 - RNA, 20 nt, Human
uccccugcuggguguggcgc

SEQ ID NO: 1935927 - RNA, 21 nt, Human
uccccugcuggguguggcgca

SEQ ID NO: 1935928 - RNA, 22 nt, Human
uccccugccccuuuacggacac

SEQ ID NO: 1935929 - RNA, 12 nt, Human
uccccugccucc

SEQ ID NO: 1935930 - RNA, 13 nt, Human
uccccugccucca

SEQ ID NO: 1935931 - RNA, 15 nt, Human
uccccugccuccauc

SEQ ID NO: 1935932 - RNA, 17 nt, Human
uccccugccuccauccu

SEQ ID NO: 1935933 - RNA, 20 nt, Human
uccccgcacugggcuugggg

SEQ ID NO: 1935934 - RNA, 15 nt, Human
uccccgcccuuuuuu

SEQ ID NO: 1935935 - RNA, 13 nt, Human
uccccgcccuuuu

SEQ ID NO: 1935936 - RNA, 21 nt, Human
uccccgcagugugcacuaagg

SEQ ID NO: 1935937 - RNA, 22 nt, Human
uccccgcagugugcacuaaggg

SEQ ID NO: 1935938 - RNA, 19 nt, Human
uccccgcagugugcacuaa

SEQ ID NO: 1935939 - RNA, 20 nt, Human
uccccgcagugugcacuaag

SEQ ID NO: 1935940 - RNA, 21 nt, Human
ucccccuuccauggacuuugu

SEQ ID NO: 1935941 - RNA, 15 nt, Human
uccccugcccccagg

SEQ ID NO: 1935942 - RNA, 14 nt, Human
uccccugcccccag

SEQ ID NO: 1935943 - RNA, 13 nt, Human
uccccugccccca

SEQ ID NO: 1935944 - RNA, 19 nt, Human
uccccugcccccaggacug

SEQ ID NO: 1935945 - RNA, 18 nt, Human
uccccugcccccaggacu

SEQ ID NO: 1935946 - RNA, 17 nt, Human
uccccugcccccaggac

SEQ ID NO: 1935947 - RNA, 16 nt, Human
uccccugcccccagga

SEQ ID NO: 1935948 - RNA, 22 nt, Human
uccccugcccccaggacugggc

SEQ ID NO: 1935949 - RNA, 20 nt, Human
uccccugcccccaggacugg

SEQ ID NO: 1935950 - RNA, 14 nt, Human
uccccagcuguuua

SEQ ID NO: 1935951 - RNA, 10 nt, Human
uccccagaga

SEQ ID NO: 1935952 - RNA, 11 nt, Human
uccccagagaa

SEQ ID NO: 1935953 - RNA, 17 nt, Human
uccccagagaaagcgca

SEQ ID NO: 1935954 - RNA, 23 nt, Human
uccccagagaaagcgcagaugcu

SEQ ID NO: 1935955 - RNA, 15 nt, Human
uccccagcuguuuau

SEQ ID NO: 1935956 - RNA, 13 nt, Human
uccccaggaggcc

SEQ ID NO: 1935957 - RNA, 15 nt, Human
ucccccuagccauuu

SEQ ID NO: 1935958 - RNA, 14 nt, Human
ucccccuagccauu

SEQ ID NO: 1935959 - RNA, 16 nt, Human
ucccccuccaccugcu

SEQ ID NO: 1935960 - RNA, 16 nt, Human
ucccccuagccauuuu

SEQ ID NO: 1935961 - RNA, 22 nt, Human
uccccacuugagaauuacccuu

SEQ ID NO: 1935962 - RNA, 22 nt, Human
ucccauguagcccccuggccuc

SEQ ID NO: 1935963 - RNA, 17 nt, Human
ucccauugucccucugc

SEQ ID NO: 1935964 - RNA, 13 nt, Human
ucccauugucccu

SEQ ID NO: 1935965 - RNA, 16 nt, Human
ucccauugucccucug

SEQ ID NO: 1935966 - RNA, 22 nt, Human
uccccagacuccaccaagccug

SEQ ID NO: 1935967 - RNA, 13 nt, Human
ucccauguagccc

SEQ ID NO: 1935968 - RNA, 15 nt, Human
ucccauguagccccc

SEQ ID NO: 1935969 - RNA, 21 nt, Human
ucccauguagcccccuggccu

SEQ ID NO: 1935970 - RNA, 16 nt, Human
ucccauucuccauuug

SEQ ID NO: 1935971 - RNA, 15 nt, Human
ucccauuccugaaga

SEQ ID NO: 1935972 - RNA, 19 nt, Human
ucccauucuccauuuguua

SEQ ID NO: 1935973 - RNA, 13 nt, Human
ucccauuccugaa

SEQ ID NO: 1935974 - RNA, 14 nt, Human
ucccauuccugaag

SEQ ID NO: 1935975 - RNA, 17 nt, Human
ucccauuccugaagaac

SEQ ID NO: 1935976 - RNA, 23 nt, Human
ucccaucucacacaugagcauca

SEQ ID NO: 1935977 - RNA, 21 nt, Human
ucccaggcucucaacagggga

SEQ ID NO: 1935978 - RNA, 20 nt, Human
ucccaucucacacaugagca

SEQ ID NO: 1935979 - RNA, 15 nt, Human
ucccaccucagccuc

SEQ ID NO: 1935980 - RNA, 14 nt, Human
ucccaccucagccu

SEQ ID NO: 1935981 - RNA, 13 nt, Human
ucccaggacccug

SEQ ID NO: 1935982 - RNA, 17 nt, Human
ucccaccuagcagcacc

SEQ ID NO: 1935983 - RNA, 19 nt, Human
ucccaggacccugaagggg

SEQ ID NO: 1935984 - RNA, 14 nt, Human
ucccaggacccuga

SEQ ID NO: 1935985 - RNA, 16 nt, Human
ucccaggacccugaag

SEQ ID NO: 1935986 - RNA, 13 nt, Human
ucccaccucagcc

SEQ ID NO: 1935987 - RNA, 20 nt, Human
ucccaggcauuccccaggag

SEQ ID NO: 1935988 - RNA, 21 nt, Human
ucccaggcauuccccaggagg

SEQ ID NO: 1935989 - RNA, 15 nt, Human
ucccaggaguucugc

SEQ ID NO: 1935990 - RNA, 18 nt, Human
ucccaggaguucugcuca

SEQ ID NO: 1935991 - RNA, 19 nt, Human
ucccaggaguucugcucau

SEQ ID NO: 1935992 - RNA, 22 nt, Human
ucccaggcauuccccaggaggc

SEQ ID NO: 1935993 - RNA, 15 nt, Human
ucccaagcucugcuc

SEQ ID NO: 1935994 - RNA, 14 nt, Human
ucccaagcucugcu

SEQ ID NO: 1935995 - RNA, 13 nt, Human
ucccaagcucugc

SEQ ID NO: 1935996 - RNA, 12 nt, Human
ucccaagcucug

SEQ ID NO: 1935997 - RNA, 17 nt, Human
ucccaagcucugcuccu

SEQ ID NO: 1935998 - RNA, 16 nt, Human
ucccaacucaccccag

SEQ ID NO: 1935999 - RNA, 20 nt, Human
ucccaaauuugauugauuug

SEQ ID NO: 1936000 - RNA, 22 nt, Human
ucccaaauuugauugauuugaa

SEQ ID NO: 1936001 - RNA, 16 nt, Human
ucccaagcucagaggc

SEQ ID NO: 1936002 - RNA, 19 nt, Human
ucccaacaaacauugaugc

SEQ ID NO: 1936003 - RNA, 14 nt, Human
ucccaacucacccc

SEQ ID NO: 1936004 - RNA, 15 nt, Human
ucccaacucacccca

SEQ ID NO: 1936005 - RNA, 13 nt, Human
ucccaacucaccc

SEQ ID NO: 1936006 - RNA, 14 nt, Human
ucccaaaugagcca

SEQ ID NO: 1936007 - RNA, 17 nt, Human
ucccaaauuugauugau

SEQ ID NO: 1936008 - RNA, 19 nt, Human
ucccaaauuugauugauuu

SEQ ID NO: 1936009 - RNA, 23 nt, Human
uccagcucaccagccccagugcc

SEQ ID NO: 1936010 - RNA, 12 nt, Human
uccagcuccaac

SEQ ID NO: 1936011 - RNA, 16 nt, Human
uccagcuccaaccugc

SEQ ID NO: 1936012 - RNA, 18 nt, Human
uccagcuccaaccugcaa

SEQ ID NO: 1936013 - RNA, 19 nt, Human
uccagcuccaaccugcaaa

SEQ ID NO: 1936014 - RNA, 13 nt, Human
uccauggacuuug

SEQ ID NO: 1936015 - RNA, 22 nt, Human
uccauggccguguagaagcaug

SEQ ID NO: 1936016 - RNA, 14 nt, Human
uccauggacuuugu

SEQ ID NO: 1936017 - RNA, 15 nt, Human
uccauggacuuuguu

SEQ ID NO: 1936018 - RNA, 20 nt, Human
ucugcacaugucuuguacau

SEQ ID NO: 1936019 - RNA, 19 nt, Human
ucugcacaagcugcacccu

SEQ ID NO: 1936020 - RNA, 14 nt, Human
ucugcacaagcugc

SEQ ID NO: 1936021 - RNA, 23 nt, Human
ucugauucccaagcucugcuccu

SEQ ID NO: 1936022 - RNA, 23 nt, Human
ucugaggacacuaaccacgcugg

SEQ ID NO: 1936023 - RNA, 20 nt, Human
ucugaggacacuaaccacgc

SEQ ID NO: 1936024 - RNA, 17 nt, Human
ucugaggaauccagacc

SEQ ID NO: 1936025 - RNA, 16 nt, Human
ucugaggaauccagac

SEQ ID NO: 1936026 - RNA, 18 nt, Human
ucugagcucuuugcacua

SEQ ID NO: 1936027 - RNA, 19 nt, Human
ucugacccagugcccccac

SEQ ID NO: 1936028 - RNA, 22 nt, Human
ucugacccagugcccccacuga

SEQ ID NO: 1936029 - RNA, 23 nt, Human
ucugacccagugcccccacugac

SEQ ID NO: 1936030 - RNA, 15 nt, Human
ucugacccaugcugc

SEQ ID NO: 1936031 - RNA, 16 nt, Human
ucugacccaugcugcc

SEQ ID NO: 1936032 - RNA, 17 nt, Human
ucugacccaugcugccc

SEQ ID NO: 1936033 - RNA, 18 nt, Human
ucugacccaugcugcccu

SEQ ID NO: 1936034 - RNA, 14 nt, Human
ucugacccaugcug

SEQ ID NO: 1936035 - RNA, 13 nt, Human
ucugacccagugc

SEQ ID NO: 1936036 - RNA, 14 nt, Human
ucugacccagugcc

SEQ ID NO: 1936037 - RNA, 15 nt, Human
ucugacccagugccc

SEQ ID NO: 1936038 - RNA, 11 nt, Human
ucugacccagu

SEQ ID NO: 1936039 - RNA, 13 nt, Human
ucugaccagcagc

SEQ ID NO: 1936040 - RNA, 16 nt, Human
ucugaccagcagcgcc

SEQ ID NO: 1936041 - RNA, 21 nt, Human
ucugaacuuggcgcugccccu

SEQ ID NO: 1936042 - RNA, 20 nt, Human
ucugaacuggagccaugggc

SEQ ID NO: 1936043 - RNA, 20 nt, Human
ucugaacuuggcgcugcccc

SEQ ID NO: 1936044 - RNA, 18 nt, Human
ucugacaugauuccuucc

SEQ ID NO: 1936045 - RNA, 19 nt, Human
ucugacaugauuccuuccu

SEQ ID NO: 1936046 - RNA, 22 nt, Human
ucugacaugauuccuuccuguu

SEQ ID NO: 1936047 - RNA, 13 nt, Human
ucucuuucuuuac

SEQ ID NO: 1936048 - RNA, 18 nt, Human
ucucuuucuuuacaagau

SEQ ID NO: 1936049 - RNA, 18 nt, Human
ucucuucacagucacauu

SEQ ID NO: 1936050 - RNA, 11 nt, Human
ucucugcaggu

SEQ ID NO: 1936051 - RNA, 18 nt, Human
ucucugcaccguacugug

SEQ ID NO: 1936052 - RNA, 16 nt, Human
ucugaaaauguaugug

SEQ ID NO: 1936053 - RNA, 16 nt, Human
ucucuuuucaaaacau

SEQ ID NO: 1936054 - RNA, 15 nt, Human
ucucuuuucaaaaca

SEQ ID NO: 1936055 - RNA, 17 nt, Human
ucucuuuguucuaaaga

SEQ ID NO: 1936056 - RNA, 23 nt, Human
ucugaaaauguauguguaaguau

SEQ ID NO: 1936057 - RNA, 17 nt, Human
ucugaaaauuaacacug

SEQ ID NO: 1936058 - RNA, 13 nt, Human
ucugaaagggacg

SEQ ID NO: 1936059 - RNA, 19 nt, Human
ucugaaaauuaacacugcu

SEQ ID NO: 1936060 - RNA, 18 nt, Human
ucugaaaauuaacacugc

SEQ ID NO: 1936061 - RNA, 14 nt, Human
ucugaaauuuccug

SEQ ID NO: 1936062 - RNA, 14 nt, Human
ucugaacuggagcc

SEQ ID NO: 1936063 - RNA, 15 nt, Human
ucugaacuggagcca

SEQ ID NO: 1936064 - RNA, 22 nt, Human
ucuccugccucagccucccaaa

SEQ ID NO: 1936065 - RNA, 15 nt, Human
ucucccugacccugu

SEQ ID NO: 1936066 - RNA, 13 nt, Human
ucuccucuuguaa

SEQ ID NO: 1936067 - RNA, 14 nt, Human
ucuccucuuguaaa

SEQ ID NO: 1936068 - RNA, 15 nt, Human
ucuccucuuguaaau

SEQ ID NO: 1936069 - RNA, 23 nt, Human
ucuccucuuguaaauaaagcccu

SEQ ID NO: 1936070 - RNA, 21 nt, Human
ucuccucuuguaaauaaagcc

SEQ ID NO: 1936071 - RNA, 17 nt, Human
ucuccugaaguucagcc

SEQ ID NO: 1936072 - RNA, 22 nt, Human
ucucccccagccccauccucug

SEQ ID NO: 1936073 - RNA, 18 nt, Human
ucucccccagccccaucc

SEQ ID NO: 1936074 - RNA, 20 nt, Human
ucucccccagccccauccuc

SEQ ID NO: 1936075 - RNA, 23 nt, Human
ucuccccugcccccaggacuggg

SEQ ID NO: 1936076 - RNA, 22 nt, Human
ucuccccugcccccaggacugg

SEQ ID NO: 1936077 - RNA, 21 nt, Human
ucuccccugcccccaggacug

SEQ ID NO: 1936078 - RNA, 20 nt, Human
ucuccccugcccccaggacu

SEQ ID NO: 1936079 - RNA, 14 nt, Human
ucucccccagcccc

SEQ ID NO: 1936080 - RNA, 15 nt, Human
ucucccccagcccca

SEQ ID NO: 1936081 - RNA, 17 nt, Human
ucucccccagccccauc

SEQ ID NO: 1936082 - RNA, 22 nt, Human
ucucagguuaagugugaguaau

SEQ ID NO: 1936083 - RNA, 17 nt, Human
ucucaguacuuuggagg

SEQ ID NO: 1936084 - RNA, 21 nt, Human
ucucagugucaaugcagcccc

SEQ ID NO: 1936085 - RNA, 22 nt, Human
ucucagugguuaagauuccuaa

SEQ ID NO: 1936086 - RNA, 19 nt, Human
ucucuaguuugauuaaauu

SEQ ID NO: 1936087 - RNA, 18 nt, Human
ucucuaguuugauuaaau

SEQ ID NO: 1936088 - RNA, 21 nt, Human
ucucuacugucucaguuuaca

SEQ ID NO: 1936089 - RNA, 13 nt, Human
ucucuacucugcu

SEQ ID NO: 1936090 - RNA, 18 nt, Human
ucucuacagguuugggua

SEQ ID NO: 1936091 - RNA, 13 nt, Human
ucuccuguaccuc

SEQ ID NO: 1936092 - RNA, 15 nt, Human
ucucuacaaaaagca

SEQ ID NO: 1936093 - RNA, 13 nt, Human
ucucugaggacac

SEQ ID NO: 1936094 - RNA, 18 nt, Human
ucucugaggaagcugggg

SEQ ID NO: 1936095 - RNA, 11 nt, Human
ucucugaaccc

SEQ ID NO: 1936096 - RNA, 15 nt, Human
ucucucgugaguaua

SEQ ID NO: 1936097 - RNA, 22 nt, Human
ucuaguacuugggagaccugua

SEQ ID NO: 1936098 - RNA, 18 nt, Human
ucuaggguuauugcauuu

SEQ ID NO: 1936099 - RNA, 14 nt, Human
ucucaaacuccuga

SEQ ID NO: 1936100 - RNA, 21 nt, Human
ucucaaacucuugaccucagg

SEQ ID NO: 1936101 - RNA, 13 nt, Human
ucucaaacucuug

SEQ ID NO: 1936102 - RNA, 22 nt, Human
ucucaaacucuugaccucaggu

SEQ ID NO: 1936103 - RNA, 17 nt, Human
ucucaaagaaauuucca

SEQ ID NO: 1936104 - RNA, 17 nt, Human
ucucacucugucgccca

SEQ ID NO: 1936105 - RNA, 22 nt, Human
ucucacucugucgcccagucug

SEQ ID NO: 1936106 - RNA, 18 nt, Human
ucucacucugucgcccag

SEQ ID NO: 1936107 - RNA, 21 nt, Human
ucucacuguugcccaggcugg

SEQ ID NO: 1936108 - RNA, 20 nt, Human
ucucacuguugcccaggcug

SEQ ID NO: 1936109 - RNA, 19 nt, Human
ucucacuguugcccaggcu

SEQ ID NO: 1936110 - RNA, 18 nt, Human
ucucacuguugcccaggc

SEQ ID NO: 1936111 - RNA, 17 nt, Human
ucucagaaucucaaaua

SEQ ID NO: 1936112 - RNA, 21 nt, Human
ucucagaaucucaaauaacua

SEQ ID NO: 1936113 - RNA, 22 nt, Human
ucuaaaucuccaaaauaaaacu

SEQ ID NO: 1936114 - RNA, 16 nt, Human
ucuaaauucuuucauu

SEQ ID NO: 1936115 - RNA, 23 nt, Human
ucuaaaugggaaaguauucugua

SEQ ID NO: 1936116 - RNA, 16 nt, Human
ucuaacuucaccauau

SEQ ID NO: 1936117 - RNA, 15 nt, Human
ucuaacuucaccaua

SEQ ID NO: 1936118 - RNA, 22 nt, Human
ucuaacuucaccauauuaccac

SEQ ID NO: 1936119 - RNA, 22 nt, Human
ucuacugaggugcuauguucuu

SEQ ID NO: 1936120 - RNA, 22 nt, Human
ucuagggaaaaaccagcgugug

SEQ ID NO: 1936121 - RNA, 21 nt, Human
ucuacacugugcugagucuga

SEQ ID NO: 1936122 - RNA, 15 nt, Human
ucuacacugugcuga

SEQ ID NO: 1936123 - RNA, 18 nt, Human
ucuacugaggugcuaugu

SEQ ID NO: 1936124 - RNA, 19 nt, Human
ucuacugaggugcuauguu

SEQ ID NO: 1936125 - RNA, 12 nt, Human
ucuacacugugc

SEQ ID NO: 1936126 - RNA, 14 nt, Human
ucuacacugugcug

SEQ ID NO: 1936127 - RNA, 17 nt, Human
ucuacacuccagugaga

SEQ ID NO: 1936128 - RNA, 23 nt, Human
uccuguaguugcguggacucugc

SEQ ID NO: 1936129 - RNA, 22 nt, Human
uccuguaguugcguggacucug

SEQ ID NO: 1936130 - RNA, 21 nt, Human
uccuguaguugcguggacucu

SEQ ID NO: 1936131 - RNA, 15 nt, Human
uccugguguggaaga

SEQ ID NO: 1936132 - RNA, 10 nt, Human
ucccucccuu

SEQ ID NO: 1936133 - RNA, 22 nt, Human
uccuggcaugggaaugaauguc

SEQ ID NO: 1936134 - RNA, 17 nt, Human
uccuggcccacugcauc

SEQ ID NO: 1936135 - RNA, 17 nt, Human
uccuggcaguuuaaaaa

SEQ ID NO: 1936136 - RNA, 20 nt, Human
uccuggcaguuuaaaaaaau

SEQ ID NO: 1936137 - RNA, 11 nt, Human
uccuggccauc

SEQ ID NO: 1936138 - RNA, 14 nt, Human
uccuggccauccca

SEQ ID NO: 1936139 - RNA, 20 nt, Human
uccuggccaucccacaagug

SEQ ID NO: 1936140 - RNA, 15 nt, Human
uccuggccaucccac

SEQ ID NO: 1936141 - RNA, 16 nt, Human
uccuggccaucccaca

SEQ ID NO: 1936142 - RNA, 19 nt, Human
uccuucuguccuacucugu

SEQ ID NO: 1936143 - RNA, 12 nt, Human
uccuucuguccu

SEQ ID NO: 1936144 - RNA, 14 nt, Human
uccuuaccagcaga

SEQ ID NO: 1936145 - RNA, 17 nt, Human
uccuuaauccagcugau

SEQ ID NO: 1936146 - RNA, 15 nt, Human
ucgaguuacagacaa

SEQ ID NO: 1936147 - RNA, 17 nt, Human
ucgaguuacagacaaag

SEQ ID NO: 1936148 - RNA, 22 nt, Human
uccuuuuuuguuccuuuuuccu

SEQ ID NO: 1936149 - RNA, 14 nt, Human
uccuuuuuuaaaag

SEQ ID NO: 1936150 - RNA, 21 nt, Human
uccuuuuuuuccaucuuuaca

SEQ ID NO: 1936151 - RNA, 15 nt, Human
ucgauuucuccagga

SEQ ID NO: 1936152 - RNA, 19 nt, Human
ucgcccaggcuggagugca

SEQ ID NO: 1936153 - RNA, 18 nt, Human
ucggaacugcaugcugcu

SEQ ID NO: 1936154 - RNA, 22 nt, Human
ucggaacugcaugcugcuggac

SEQ ID NO: 1936155 - RNA, 19 nt, Human
ucggaacccaagcuuagaa

SEQ ID NO: 1936156 - RNA, 20 nt, Human
ucggaacccaagcuuagaac

SEQ ID NO: 1936157 - RNA, 21 nt, Human
ugaacucuuaaucaaauagca

SEQ ID NO: 1936158 - RNA, 18 nt, Human
ugaacucuucaaucucuu

SEQ ID NO: 1936159 - RNA, 14 nt, Human
ugaacugaacacca

SEQ ID NO: 1936160 - RNA, 13 nt, Human
ugaacugaacacc

SEQ ID NO: 1936161 - RNA, 12 nt, Human
ugaacugaacac

SEQ ID NO: 1936162 - RNA, 22 nt, Human
ugaaccacaucuugcucugcug

SEQ ID NO: 1936163 - RNA, 15 nt, Human
ugaacucuucaaucu

SEQ ID NO: 1936164 - RNA, 21 nt, Human
ugaaccacaucuugcucugcu

SEQ ID NO: 1936165 - RNA, 20 nt, Human
ugaaccacaucuugcucugc

SEQ ID NO: 1936166 - RNA, 15 nt, Human
ugaacugauaaagau

SEQ ID NO: 1936167 - RNA, 16 nt, Human
ugaacugagcuuggaa

SEQ ID NO: 1936168 - RNA, 22 nt, Human
ugaacugaacaccauugaaggc

SEQ ID NO: 1936169 - RNA, 13 nt, Human
ugaacugauaaag

SEQ ID NO: 1936170 - RNA, 15 nt, Human
ugaacugagcuugga

SEQ ID NO: 1936171 - RNA, 12 nt, Human
ugaacugagcuu

SEQ ID NO: 1936172 - RNA, 19 nt, Human
ugaaauggacuuuuguaca

SEQ ID NO: 1936173 - RNA, 19 nt, Human
ugaacacaaacuguaaaua

SEQ ID NO: 1936174 - RNA, 20 nt, Human
ugaacaccauugaaggcuua

SEQ ID NO: 1936175 - RNA, 17 nt, Human
ugaacaccauugaaggc

SEQ ID NO: 1936176 - RNA, 17 nt, Human
ugaacauugcaauagaa

SEQ ID NO: 1936177 - RNA, 15 nt, Human
ugaacauugcaauag

SEQ ID NO: 1936178 - RNA, 14 nt, Human
ugaacauuccagag

SEQ ID NO: 1936179 - RNA, 13 nt, Human
ugaacauuccaga

SEQ ID NO: 1936180 - RNA, 17 nt, Human
ugaacagacugaccuug

SEQ ID NO: 1936181 - RNA, 18 nt, Human
ugaacagacugaccuuga

SEQ ID NO: 1936182 - RNA, 11 nt, Human
ugaaggcuggc

SEQ ID NO: 1936183 - RNA, 12 nt, Human
ugaaggcuggca

SEQ ID NO: 1936184 - RNA, 13 nt, Human
ugaaggcuggcau

SEQ ID NO: 1936185 - RNA, 16 nt, Human
ugaaggcuggcaugau

SEQ ID NO: 1936186 - RNA, 21 nt, Human
ugaaggcucgagcaugccugg

SEQ ID NO: 1936187 - RNA, 20 nt, Human
ugaaggcucgagcaugccug

SEQ ID NO: 1936188 - RNA, 16 nt, Human
ugaaggcaaaauugca

SEQ ID NO: 1936189 - RNA, 17 nt, Human
ugaaggcaaaauugcaa

SEQ ID NO: 1936190 - RNA, 14 nt, Human
ugaaggcaaaauug

SEQ ID NO: 1936191 - RNA, 22 nt, Human
ugaaggagaggcaacauccaaa

SEQ ID NO: 1936192 - RNA, 22 nt, Human
ugaacuuguaaaggaauuuaaa

SEQ ID NO: 1936193 - RNA, 14 nt, Human
ugaagacagagcua

SEQ ID NO: 1936194 - RNA, 16 nt, Human
ugaagacagagcuaca

SEQ ID NO: 1936195 - RNA, 19 nt, Human
ugaacuggguacuugugga

SEQ ID NO: 1936196 - RNA, 14 nt, Human
ugaacuuggcgcug

SEQ ID NO: 1936197 - RNA, 12 nt, Human
ugaacuugguuc

SEQ ID NO: 1936198 - RNA, 23 nt, Human
ugaacuggguacuuguggacaca

SEQ ID NO: 1936199 - RNA, 14 nt, Human
ugaagacuuuucuu

SEQ ID NO: 1936200 - RNA, 18 nt, Human
ugaagacuggaagcuaau

SEQ ID NO: 1936201 - RNA, 17 nt, Human
ugaagacuuuucuuuca

SEQ ID NO: 1936202 - RNA, 22 nt, Human
ugaagacuuuucuuucagccaa

SEQ ID NO: 1936203 - RNA, 16 nt, Human
ugaagaggaugcugug

SEQ ID NO: 1936204 - RNA, 21 nt, Human
ucuuucaauaaacuaaagaaa

SEQ ID NO: 1936205 - RNA, 20 nt, Human
ucuuucaauaaacuaaagaa

SEQ ID NO: 1936206 - RNA, 19 nt, Human
ucuuucaauaaacuaaaga

SEQ ID NO: 1936207 - RNA, 15 nt, Human
ucuuucacaaaaaag

SEQ ID NO: 1936208 - RNA, 19 nt, Human
ucuuuucuggaauguaauc

SEQ ID NO: 1936209 - RNA, 21 nt, Human
ucuuuucucccuuuuaauccu

SEQ ID NO: 1936210 - RNA, 20 nt, Human
ucuuuucuugccucuguccc

SEQ ID NO: 1936211 - RNA, 16 nt, Human
ucuuuucuugccucug

SEQ ID NO: 1936212 - RNA, 19 nt, Human
ucuuuugccguuauuaaaa

SEQ ID NO: 1936213 - RNA, 17 nt, Human
ucuuuugccguuauuaa

SEQ ID NO: 1936214 - RNA, 16 nt, Human
ucuuuuuauacuauua

SEQ ID NO: 1936215 - RNA, 16 nt, Human
ucuuuugauuauguuu

SEQ ID NO: 1936216 - RNA, 16 nt, Human
ucuuuuugcuuugcuu

SEQ ID NO: 1936217 - RNA, 15 nt, Human
ucuuuuuauugaauc

SEQ ID NO: 1936218 - RNA, 15 nt, Human
ucuuuuguaauuuaa

SEQ ID NO: 1936219 - RNA, 13 nt, Human
ucuuuuuauugaa

SEQ ID NO: 1936220 - RNA, 14 nt, Human
ucuuuuuauugaau

SEQ ID NO: 1936221 - RNA, 15 nt, Human
ugaaaagaaaaauga

SEQ ID NO: 1936222 - RNA, 19 nt, Human
ugaaaacuuuaugcuaagu

SEQ ID NO: 1936223 - RNA, 12 nt, Human
ugaaaggaaaga

SEQ ID NO: 1936224 - RNA, 11 nt, Human
ugaaagcugug

SEQ ID NO: 1936225 - RNA, 13 nt, Human
ugaaagauucaau

SEQ ID NO: 1936226 - RNA, 17 nt, Human
ugaaaggaaagaggcuc

SEQ ID NO: 1936227 - RNA, 23 nt, Human
ugaaagcagggacuugaacccau

SEQ ID NO: 1936228 - RNA, 19 nt, Human
ugaaagcagggacuugaac

SEQ ID NO: 1936229 - RNA, 18 nt, Human
ugaaagcagggacuugaa

SEQ ID NO: 1936230 - RNA, 18 nt, Human
ugaaacccugucucuacu

SEQ ID NO: 1936231 - RNA, 22 nt, Human
ugaaaagaggugugcaagagag

SEQ ID NO: 1936232 - RNA, 13 nt, Human
ugaaaagaggugu

SEQ ID NO: 1936233 - RNA, 18 nt, Human
ugaaagggcccagagagg

SEQ ID NO: 1936234 - RNA, 17 nt, Human
ugaaagggcccagagag

SEQ ID NO: 1936235 - RNA, 16 nt, Human
ugaaagggcccagaga

SEQ ID NO: 1936236 - RNA, 15 nt, Human
ugaaagggcccagag

SEQ ID NO: 1936237 - RNA, 15 nt, Human
ugaaaucauucauuu

SEQ ID NO: 1936238 - RNA, 17 nt, Human
ugaaaucuuuuugcuuu

SEQ ID NO: 1936239 - RNA, 20 nt, Human
ugaaaugaggucagagccug

SEQ ID NO: 1936240 - RNA, 19 nt, Human
ugaaaugaggucagagccu

SEQ ID NO: 1936241 - RNA, 22 nt, Human
ugaaaugaggucagagccugca

SEQ ID NO: 1936242 - RNA, 21 nt, Human
ugaaaugaggucagagccugc

SEQ ID NO: 1936243 - RNA, 23 nt, Human
ugaaaugaggucagagccugcag

SEQ ID NO: 1936244 - RNA, 19 nt, Human
ugaaaugcagagucaauga

SEQ ID NO: 1936245 - RNA, 22 nt, Human
ucugcacaugucuuguacaugu

SEQ ID NO: 1936246 - RNA, 21 nt, Human
ucugcacaugucuuguacaug

SEQ ID NO: 1936247 - RNA, 23 nt, Human
ucuggagcccacuguacuugcuc

SEQ ID NO: 1936248 - RNA, 21 nt, Human
ucuggagaccagggagccuuu

SEQ ID NO: 1936249 - RNA, 15 nt, Human
ucuggagaccaggga

SEQ ID NO: 1936250 - RNA, 19 nt, Human
ucuggagaccagggagccu

SEQ ID NO: 1936251 - RNA, 20 nt, Human
ucuggagaccagggagccuu

SEQ ID NO: 1936252 - RNA, 17 nt, Human
ucuggcuaugcauuuga

SEQ ID NO: 1936253 - RNA, 14 nt, Human
ucuggcuaugcauu

SEQ ID NO: 1936254 - RNA, 23 nt, Human
ucuguacagagcccacgccccca

SEQ ID NO: 1936255 - RNA, 12 nt, Human
ucugggacacag

SEQ ID NO: 1936256 - RNA, 13 nt, Human
ucugggacacagu

SEQ ID NO: 1936257 - RNA, 17 nt, Human
ucuggcucuuccaggcu

SEQ ID NO: 1936258 - RNA, 15 nt, Human
ucuggcucuuccagg

SEQ ID NO: 1936259 - RNA, 16 nt, Human
ucuggcucuuccaggc

SEQ ID NO: 1936260 - RNA, 22 nt, Human
ucuguggguuucuaaagcugcc

SEQ ID NO: 1936261 - RNA, 19 nt, Human
ucuguccgagcuuugaaaa

SEQ ID NO: 1936262 - RNA, 17 nt, Human
ucuguacgucugacagg

SEQ ID NO: 1936263 - RNA, 23 nt, Human
ucuguggguuucuaaagcugcca

SEQ ID NO: 1936264 - RNA, 22 nt, Human
ucugugucagguggggcagcuu

SEQ ID NO: 1936265 - RNA, 13 nt, Human
ucugugucugugu

SEQ ID NO: 1936266 - RNA, 15 nt, Human
ucugugucuguguuu

SEQ ID NO: 1936267 - RNA, 16 nt, Human
ucugugucugaguggc

SEQ ID NO: 1936268 - RNA, 12 nt, Human
ucugugucugug

SEQ ID NO: 1936269 - RNA, 21 nt, Human
ucuguguguguguaugugggg

SEQ ID NO: 1936270 - RNA, 19 nt, Human
ucuguguguguguaugugg

SEQ ID NO: 1936271 - RNA, 18 nt, Human
ucuguguguguguaugug

SEQ ID NO: 1936272 - RNA, 15 nt, Human
ucuguguguguguau

SEQ ID NO: 1936273 - RNA, 18 nt, Human
ucuuaaaaaguggaaaaa

SEQ ID NO: 1936274 - RNA, 13 nt, Human
ucuguguuuuaau

SEQ ID NO: 1936275 - RNA, 20 nt, Human
ucuguguguuuaugugugug

SEQ ID NO: 1936276 - RNA, 19 nt, Human
ucuguguguuuaugugugu

SEQ ID NO: 1936277 - RNA, 22 nt, Human
ucuguguguguguauguggggg

SEQ ID NO: 1936278 - RNA, 16 nt, Human
ucuguguguuuaugug

SEQ ID NO: 1936279 - RNA, 15 nt, Human
ucuguguguuuaugu

SEQ ID NO: 1936280 - RNA, 14 nt, Human
ucuugugacuagug

SEQ ID NO: 1936281 - RNA, 11 nt, Human
ucuugugacua

SEQ ID NO: 1936282 - RNA, 14 nt, Human
ucuugucucugggc

SEQ ID NO: 1936283 - RNA, 15 nt, Human
ucuugucucugggcu

SEQ ID NO: 1936284 - RNA, 12 nt, Human
ucuugucucugg

SEQ ID NO: 1936285 - RNA, 13 nt, Human
ucuugucucuggg

SEQ ID NO: 1936286 - RNA, 22 nt, Human
ucuugugacuagugcugaagcu

SEQ ID NO: 1936287 - RNA, 21 nt, Human
ucuugugacuagugcugaagc

SEQ ID NO: 1936288 - RNA, 19 nt, Human
ucuugugacuagugcugaa

SEQ ID NO: 1936289 - RNA, 18 nt, Human
ucuugugacuagugcuga

SEQ ID NO: 1936290 - RNA, 16 nt, Human
ucuugugacuagugcu

SEQ ID NO: 1936291 - RNA, 11 nt, Human
ucuugcucugc

SEQ ID NO: 1936292 - RNA, 13 nt, Human
ucuugcucugcug

SEQ ID NO: 1936293 - RNA, 12 nt, Human
ucuugcucugcu

SEQ ID NO: 1936294 - RNA, 22 nt, Human
ucuuguauuaaguuguuaauaa

SEQ ID NO: 1936295 - RNA, 18 nt, Human
ucuuguauuaaguuguua

SEQ ID NO: 1936296 - RNA, 16 nt, Human
ucuuguauuaaguugu

SEQ ID NO: 1936297 - RNA, 12 nt, Human
ucuucuccaggc

SEQ ID NO: 1936298 - RNA, 14 nt, Human
ucuucuccaggcug

SEQ ID NO: 1936299 - RNA, 13 nt, Human
ucuucuccaggcu

SEQ ID NO: 1936300 - RNA, 18 nt, Human
ucuugaacuccuggccuc

SEQ ID NO: 1936301 - RNA, 17 nt, Human
ucuugaacuccuggccu

SEQ ID NO: 1936302 - RNA, 16 nt, Human
ucuugaacuccuggcc

SEQ ID NO: 1936303 - RNA, 15 nt, Human
ucuucuccaggcugu

SEQ ID NO: 1936304 - RNA, 21 nt, Human
ucuugaauuguaaggaaugau

SEQ ID NO: 1936305 - RNA, 15 nt, Human
ucuugaacugagcuu

SEQ ID NO: 1936306 - RNA, 21 nt, Human
ucuugccucuguccccuucuc

SEQ ID NO: 1936307 - RNA, 16 nt, Human
ucuugccucugucccc

SEQ ID NO: 1936308 - RNA, 22 nt, Human
ucuugccucuguccccuucucu

SEQ ID NO: 1936309 - RNA, 20 nt, Human
ucuugacgagugugaagcuu

SEQ ID NO: 1936310 - RNA, 14 nt, Human
ucuucucagccacu

SEQ ID NO: 1936311 - RNA, 17 nt, Human
ucuucuagguucuaaaa

SEQ ID NO: 1936312 - RNA, 19 nt, Human
ucuucuccacuuucuagcc

SEQ ID NO: 1936313 - RNA, 21 nt, Human
ucuucuccacuuucuagccag

SEQ ID NO: 1936314 - RNA, 21 nt, Human
ucuuccacaagagcccaggcc

SEQ ID NO: 1936315 - RNA, 16 nt, Human
ucuucaguaagccgug

SEQ ID NO: 1936316 - RNA, 14 nt, Human
ucuuccaggcuggg

SEQ ID NO: 1936317 - RNA, 13 nt, Human
ucuucuaaacuuc

SEQ ID NO: 1936318 - RNA, 22 nt, Human
ucuucuaaacuuccccaucuuc

SEQ ID NO: 1936319 - RNA, 14 nt, Human
ucuuagugugugca

SEQ ID NO: 1936320 - RNA, 16 nt, Human
ucuuaguggauguucu

SEQ ID NO: 1936321 - RNA, 15 nt, Human
ucuuauacauuugau

SEQ ID NO: 1936322 - RNA, 14 nt, Human
ucuuauacauuuga

SEQ ID NO: 1936323 - RNA, 13 nt, Human
ucuuaugggcugg

SEQ ID NO: 1936324 - RNA, 15 nt, Human
ucuucaguaagccgu

SEQ ID NO: 1936325 - RNA, 14 nt, Human
ucuuauggaauuga

SEQ ID NO: 1936326 - RNA, 15 nt, Human
ucuuauggaauugau

SEQ ID NO: 1936327 - RNA, 17 nt, Human
ucuuauggaauugauuu

SEQ ID NO: 1936328 - RNA, 18 nt, Human
ucuuauggaauugauuug

SEQ ID NO: 1936329 - RNA, 21 nt, Human
ucuuauggaauugauuugcau

SEQ ID NO: 1936330 - RNA, 22 nt, Human
ucuuauggaauugauuugcauu

SEQ ID NO: 1936331 - RNA, 19 nt, Human
ucuuauagaauauuuauua

SEQ ID NO: 1936332 - RNA, 20 nt, Human
ucuuauagaauauuuauuac

SEQ ID NO: 1936333 - RNA, 22 nt, Human
ugcguggacucugcacaugucu

SEQ ID NO: 1936334 - RNA, 18 nt, Human
ugcguggacucugcacau

SEQ ID NO: 1936335 - RNA, 23 nt, Human
ugcgugguguggagugugugucu

SEQ ID NO: 1936336 - RNA, 18 nt, Human
ugcuagaacucccuuuca

SEQ ID NO: 1936337 - RNA, 19 nt, Human
ugcuagaacucccuuucaa

SEQ ID NO: 1936338 - RNA, 17 nt, Human
ugcguggacucugcaca

SEQ ID NO: 1936339 - RNA, 16 nt, Human
ugcguggacucugcac

SEQ ID NO: 1936340 - RNA, 15 nt, Human
ugcgugcauaccacu

SEQ ID NO: 1936341 - RNA, 20 nt, Human
ugcgucauuacagggcacag

SEQ ID NO: 1936342 - RNA, 16 nt, Human
ugcuaggaacacuccu

SEQ ID NO: 1936343 - RNA, 20 nt, Human
ugcuagccggccacuuugga

SEQ ID NO: 1936344 - RNA, 17 nt, Human
ugcuaggaacacuccuu

SEQ ID NO: 1936345 - RNA, 19 nt, Human
ugcuaggaacacuccuuca

SEQ ID NO: 1936346 - RNA, 21 nt, Human
ugcuagaacucccuuucaaca

SEQ ID NO: 1936347 - RNA, 20 nt, Human
ugcuagaacucccuuucaac

SEQ ID NO: 1936348 - RNA, 12 nt, Human
ugcuagcacaug

SEQ ID NO: 1936349 - RNA, 16 nt, Human
ugcuagcacaugcccu

SEQ ID NO: 1936350 - RNA, 19 nt, Human
ugcuccucuccccagcaag

SEQ ID NO: 1936351 - RNA, 14 nt, Human
ugcucaggagcccu

SEQ ID NO: 1936352 - RNA, 21 nt, Human
ugcucagcuucuccuguguga

SEQ ID NO: 1936353 - RNA, 20 nt, Human
ugcucaggagaccuggagga

SEQ ID NO: 1936354 - RNA, 18 nt, Human
ugcucagcucugggccau

SEQ ID NO: 1936355 - RNA, 20 nt, Human
ugcucagcucugggccauuc

SEQ ID NO: 1936356 - RNA, 15 nt, Human
ugcucagcuucuccu

SEQ ID NO: 1936357 - RNA, 20 nt, Human
ugcucagcuucuccugugug

SEQ ID NO: 1936358 - RNA, 12 nt, Human
ugcucagcuucu

SEQ ID NO: 1936359 - RNA, 21 nt, Human
ugcugaugaacucuuaaucaa

SEQ ID NO: 1936360 - RNA, 15 nt, Human
ugcugaguugguguu

SEQ ID NO: 1936361 - RNA, 19 nt, Human
ugcugacagacacaggccc

SEQ ID NO: 1936362 - RNA, 16 nt, Human
ugcugacagacacagg

SEQ ID NO: 1936363 - RNA, 15 nt, Human
ugcugacagacacag

SEQ ID NO: 1936364 - RNA, 15 nt, Human
ugcugcaguugccag

SEQ ID NO: 1936365 - RNA, 16 nt, Human
ugcugcaguugccagu

SEQ ID NO: 1936366 - RNA, 21 nt, Human
ugcugcaggacuugagaagac

SEQ ID NO: 1936367 - RNA, 20 nt, Human
ugcugauggugcaaugaccu

SEQ ID NO: 1936368 - RNA, 23 nt, Human
ugcugauggugcaaugaccuuuc

SEQ ID NO: 1936369 - RNA, 17 nt, Human
ugcugaaugguuuucaa

SEQ ID NO: 1936370 - RNA, 18 nt, Human
ugcugaaugguuuucaaa

SEQ ID NO: 1936371 - RNA, 22 nt, Human
ugcugaaugguuuucaaaauaa

SEQ ID NO: 1936372 - RNA, 18 nt, Human
ugcugaauacagaggcaa

SEQ ID NO: 1936373 - RNA, 23 nt, Human
ugcugaauacagaggcaacugca

SEQ ID NO: 1936374 - RNA, 19 nt, Human
ugcuccuggcccacugcau

SEQ ID NO: 1936375 - RNA, 14 nt, Human
ugcuccuuguuccu

SEQ ID NO: 1936376 - RNA, 15 nt, Human
ugcuccuuguuccua

SEQ ID NO: 1936377 - RNA, 16 nt, Human
ugcuccuuguuccuag

SEQ ID NO: 1936378 - RNA, 16 nt, Human
ugccuggccuggcaca

SEQ ID NO: 1936379 - RNA, 20 nt, Human
ugccuggccuggcacacauc

SEQ ID NO: 1936380 - RNA, 17 nt, Human
ugccuggccuggcacac

SEQ ID NO: 1936381 - RNA, 18 nt, Human
ugccuuauggaacacucu

SEQ ID NO: 1936382 - RNA, 20 nt, Human
ugccuuauggaacacucuga

SEQ ID NO: 1936383 - RNA, 21 nt, Human
ugccuuauggaacacucugag

SEQ ID NO: 1936384 - RNA, 22 nt, Human
ugccuuauggaacacucugaga

SEQ ID NO: 1936385 - RNA, 22 nt, Human
ugccuggccuggcacacaucag

SEQ ID NO: 1936386 - RNA, 13 nt, Human
ugcgccuacagga

SEQ ID NO: 1936387 - RNA, 23 nt, Human
ugcggugcuaucucccccagccc

SEQ ID NO: 1936388 - RNA, 17 nt, Human
ugcgcccaguccuucca

SEQ ID NO: 1936389 - RNA, 18 nt, Human
ugcgcccaguccuuccac

SEQ ID NO: 1936390 - RNA, 15 nt, Human
ugccuagaggcccca

SEQ ID NO: 1936391 - RNA, 17 nt, Human
ugccuccccucuccuuc

SEQ ID NO: 1936392 - RNA, 23 nt, Human
ugcccaggcuggcgugcaguggu

SEQ ID NO: 1936393 - RNA, 11 nt, Human
ugcccagcccc

SEQ ID NO: 1936394 - RNA, 16 nt, Human
ugccuccuuugugagg

SEQ ID NO: 1936395 - RNA, 18 nt, Human
ugccuccccucuccuucc

SEQ ID NO: 1936396 - RNA, 17 nt, Human
ugccuccuuugugagga

SEQ ID NO: 1936397 - RNA, 18 nt, Human
ugccuccuuugugaggaa

SEQ ID NO: 1936398 - RNA, 14 nt, Human
ugccucugggacug

SEQ ID NO: 1936399 - RNA, 15 nt, Human
ugccucuguccccuu

SEQ ID NO: 1936400 - RNA, 14 nt, Human
ugccucuguccccu

SEQ ID NO: 1936401 - RNA, 13 nt, Human
ugccucugucccc

SEQ ID NO: 1936402 - RNA, 21 nt, Human
ugccucuguccccuucucuca

SEQ ID NO: 1936403 - RNA, 20 nt, Human
ugccucuguccccuucucuc

SEQ ID NO: 1936404 - RNA, 17 nt, Human
ugccucuguccccuucu

SEQ ID NO: 1936405 - RNA, 16 nt, Human
ugccucuguccccuuc

SEQ ID NO: 1936406 - RNA, 17 nt, Human
ugccugaagucacacag

SEQ ID NO: 1936407 - RNA, 18 nt, Human
ugccugaagucacacagu

SEQ ID NO: 1936408 - RNA, 22 nt, Human
ugccugaagucacacagugagu

SEQ ID NO: 1936409 - RNA, 19 nt, Human
ugcauuuuuuaaaacaaga

SEQ ID NO: 1936410 - RNA, 17 nt, Human
ugcauuuuuuaaaacaa

SEQ ID NO: 1936411 - RNA, 15 nt, Human
ugcauuuuuuaaaac

SEQ ID NO: 1936412 - RNA, 20 nt, Human
ugccaaaaaaagacagggcu

SEQ ID NO: 1936413 - RNA, 17 nt, Human
ugccaaccuauuuugaa

SEQ ID NO: 1936414 - RNA, 19 nt, Human
ugcauguuacauaagauaa

SEQ ID NO: 1936415 - RNA, 13 nt, Human
ugcauuaaauuca

SEQ ID NO: 1936416 - RNA, 14 nt, Human
ugcauuaaauucac

SEQ ID NO: 1936417 - RNA, 15 nt, Human
ugcauuaaauucaca

SEQ ID NO: 1936418 - RNA, 16 nt, Human
ugcauuaaauucacaa

SEQ ID NO: 1936419 - RNA, 17 nt, Human
ugcauuaaauucacaaa

SEQ ID NO: 1936420 - RNA, 19 nt, Human
ugcauuaaauucacaaacu

SEQ ID NO: 1936421 - RNA, 20 nt, Human
ugcauuaaauucacaaacuu

SEQ ID NO: 1936422 - RNA, 21 nt, Human
ugcauuaaauucacaaacuuu

SEQ ID NO: 1936423 - RNA, 16 nt, Human
ugcaggcagccaggcc

SEQ ID NO: 1936424 - RNA, 13 nt, Human
ugcaggacuugag

SEQ ID NO: 1936425 - RNA, 15 nt, Human
ugcaggacuugagaa

SEQ ID NO: 1936426 - RNA, 18 nt, Human
ugcaggacuugagaagac

SEQ ID NO: 1936427 - RNA, 17 nt, Human
ugcaggcagccaggcca

SEQ ID NO: 1936428 - RNA, 18 nt, Human
ugcaggcagccaggccac

SEQ ID NO: 1936429 - RNA, 19 nt, Human
ugcaggcagccaggccaca

SEQ ID NO: 1936430 - RNA, 17 nt, Human
ugcaucguuucaucuuc

SEQ ID NO: 1936431 - RNA, 15 nt, Human
ugcaucguuucaucu

SEQ ID NO: 1936432 - RNA, 24 nt, Human
ugccagguuuuuggucugacccac

SEQ ID NO: 1936433 - RNA, 14 nt, Human
ugccaguaaaaaaa

SEQ ID NO: 1936434 - RNA, 22 nt, Human
ugccaguaaaaaaaaaaaaugg

SEQ ID NO: 1936435 - RNA, 14 nt, Human
ugccagucaccccg

SEQ ID NO: 1936436 - RNA, 11 nt, Human
ugccagggaca

SEQ ID NO: 1936437 - RNA, 22 nt, Human
ugccagggacagaggggguggc

SEQ ID NO: 1936438 - RNA, 17 nt, Human
ugccagggcaaugauga

SEQ ID NO: 1936439 - RNA, 22 nt, Human
ugccagggcaaugaugaaugag

SEQ ID NO: 1936440 - RNA, 17 nt, Human
ugccacccaccucccug

SEQ ID NO: 1936441 - RNA, 18 nt, Human
ugccacccaccucccugc

SEQ ID NO: 1936442 - RNA, 19 nt, Human
ugccacccaccucccugcc

SEQ ID NO: 1936443 - RNA, 22 nt, Human
ugccacccaccucccugccucc

SEQ ID NO: 1936444 - RNA, 20 nt, Human
ugccacccaccucccugccu

SEQ ID NO: 1936445 - RNA, 21 nt, Human
ugccacccaccucccugccuc

SEQ ID NO: 1936446 - RNA, 20 nt, Human
ugccaucucaccuccugcug

SEQ ID NO: 1936447 - RNA, 21 nt, Human
ugccaucucaccuccugcugg

SEQ ID NO: 1936448 - RNA, 22 nt, Human
ugccaucucaccuccugcuggg

SEQ ID NO: 1936449 - RNA, 23 nt, Human
ugccaucucaccuccugcugggc

SEQ ID NO: 1936450 - RNA, 20 nt, Human
ugccauggacagaagaaggc

SEQ ID NO: 1936451 - RNA, 18 nt, Human
ugccauggacagaagaag

SEQ ID NO: 1936452 - RNA, 23 nt, Human
ugccauggacagaagaaggcagc

SEQ ID NO: 1936453 - RNA, 15 nt, Human
ugcccaccuggccuc

SEQ ID NO: 1936454 - RNA, 17 nt, Human
ugcccaccuggccucug

SEQ ID NO: 1936455 - RNA, 18 nt, Human
ugcccaccuggccucugc

SEQ ID NO: 1936456 - RNA, 10 nt, Human
ugcccagccc

SEQ ID NO: 1936457 - RNA, 11 nt, Human
ugcagccagag

SEQ ID NO: 1936458 - RNA, 13 nt, Human
ugcagccagaggc

SEQ ID NO: 1936459 - RNA, 14 nt, Human
ugcagccagaggca

SEQ ID NO: 1936460 - RNA, 16 nt, Human
ugcagcaauaaagcag

SEQ ID NO: 1936461 - RNA, 15 nt, Human
ugcagcaauaaagca

SEQ ID NO: 1936462 - RNA, 14 nt, Human
ugcagcaauaaagc

SEQ ID NO: 1936463 - RNA, 18 nt, Human
ugcaggaccucaggugag

SEQ ID NO: 1936464 - RNA, 15 nt, Human
ugcaggaccucaggu

SEQ ID NO: 1936465 - RNA, 16 nt, Human
ugcaggaccucaggug

SEQ ID NO: 1936466 - RNA, 17 nt, Human
ugcaggaaauggcugug

SEQ ID NO: 1936467 - RNA, 14 nt, Human
ugcaggaccucagg

SEQ ID NO: 1936468 - RNA, 16 nt, Human
ugcacguacacacaca

SEQ ID NO: 1936469 - RNA, 19 nt, Human
ugcacguacacacacauac

SEQ ID NO: 1936470 - RNA, 16 nt, Human
ugcacuugcagacucu

SEQ ID NO: 1936471 - RNA, 21 nt, Human
ugcacuugcagacucuacaga

SEQ ID NO: 1936472 - RNA, 17 nt, Human
ugcacuugugauuauuu

SEQ ID NO: 1936473 - RNA, 20 nt, Human
ugcacuugugauuauuuauu

SEQ ID NO: 1936474 - RNA, 21 nt, Human
ugcacuugugauuauuuauua

SEQ ID NO: 1936475 - RNA, 15 nt, Human
ugcacuuuguucugg

SEQ ID NO: 1936476 - RNA, 18 nt, Human
ugcacuuuguucuggcuc

SEQ ID NO: 1936477 - RNA, 19 nt, Human
ugcacuuuguucuggcucu

SEQ ID NO: 1936478 - RNA, 20 nt, Human
ugcacuuuguucuggcucuu

SEQ ID NO: 1936479 - RNA, 17 nt, Human
ugcagauaaacaguagu

SEQ ID NO: 1936480 - RNA, 16 nt, Human
ugcagauaaacaguag

SEQ ID NO: 1936481 - RNA, 20 nt, Human
ugaaggcuggcaugauccaa

SEQ ID NO: 1936482 - RNA, 16 nt, Human
ugaaggcuggguucug

SEQ ID NO: 1936483 - RNA, 17 nt, Human
ugaagucuuuguacaga

SEQ ID NO: 1936484 - RNA, 20 nt, Human
ugaagucuuuguacagacaa

SEQ ID NO: 1936485 - RNA, 22 nt, Human
ugaagucuuuguacagacaaca

SEQ ID NO: 1936486 - RNA, 22 nt, Human
ugcacagaguuguuacauuuuu

SEQ ID NO: 1936487 - RNA, 21 nt, Human
ugcacagaguuguuacauuuu

SEQ ID NO: 1936488 - RNA, 23 nt, Human
ugcacagaguuguuacauuuuua

SEQ ID NO: 1936489 - RNA, 17 nt, Human
ugcacagcuaacaugga

SEQ ID NO: 1936490 - RNA, 18 nt, Human
ugcacauauggacucugc

SEQ ID NO: 1936491 - RNA, 17 nt, Human
ugcacauauggacucug

SEQ ID NO: 1936492 - RNA, 15 nt, Human
ugcacauauggacuc

SEQ ID NO: 1936493 - RNA, 14 nt, Human
ugcacauauggacu

SEQ ID NO: 1936494 - RNA, 19 nt, Human
ugcacauauggacucugca

SEQ ID NO: 1936495 - RNA, 15 nt, Human
ugcacaucucugcuu

SEQ ID NO: 1936496 - RNA, 14 nt, Human
ugcacaucucugcu

SEQ ID NO: 1936497 - RNA, 18 nt, Human
ugcacagcuaacauggaa

SEQ ID NO: 1936498 - RNA, 20 nt, Human
ugcacagcuaacauggaagu

SEQ ID NO: 1936499 - RNA, 23 nt, Human
ugcacagcuaacauggaaguacu

SEQ ID NO: 1936500 - RNA, 14 nt, Human
uggaauguaaucaa

SEQ ID NO: 1936501 - RNA, 17 nt, Human
uggaaucuggagaccag

SEQ ID NO: 1936502 - RNA, 18 nt, Human
uggaaucuggagaccagg

SEQ ID NO: 1936503 - RNA, 15 nt, Human
uggaauuauuuuaaa

SEQ ID NO: 1936504 - RNA, 16 nt, Human
uggaauaucuccguca

SEQ ID NO: 1936505 - RNA, 23 nt, Human
uggaagugugggucugugugugu

SEQ ID NO: 1936506 - RNA, 14 nt, Human
uggaagacagcucu

SEQ ID NO: 1936507 - RNA, 15 nt, Human
uggaagacagcucuu

SEQ ID NO: 1936508 - RNA, 21 nt, Human
uggaagugugggucugugugu

SEQ ID NO: 1936509 - RNA, 16 nt, Human
uggaauacucuuauau

SEQ ID NO: 1936510 - RNA, 12 nt, Human
uggaauacuuuu

SEQ ID NO: 1936511 - RNA, 13 nt, Human
uggaauacuuuuu

SEQ ID NO: 1936512 - RNA, 18 nt, Human
uggaauacuuuuuguuau

SEQ ID NO: 1936513 - RNA, 15 nt, Human
uggaaccaggcuugg

SEQ ID NO: 1936514 - RNA, 12 nt, Human
uggaacccagac

SEQ ID NO: 1936515 - RNA, 14 nt, Human
uggaacccagacuc

SEQ ID NO: 1936516 - RNA, 15 nt, Human
uggaacccagacuca

SEQ ID NO: 1936517 - RNA, 22 nt, Human
uggaacccagacucagacauug

SEQ ID NO: 1936518 - RNA, 16 nt, Human
uggaacccagacucag

SEQ ID NO: 1936519 - RNA, 17 nt, Human
uggaacccagacucaga

SEQ ID NO: 1936520 - RNA, 15 nt, Human
uggaaaauaaauuau

SEQ ID NO: 1936521 - RNA, 16 nt, Human
uggaaaauaaauuauu

SEQ ID NO: 1936522 - RNA, 20 nt, Human
uggaaaaaccacccccaaau

SEQ ID NO: 1936523 - RNA, 17 nt, Human
uggaaaaaaaaaagaca

SEQ ID NO: 1936524 - RNA, 16 nt, Human
uggaaaaaaaaaagac

SEQ ID NO: 1936525 - RNA, 14 nt, Human
uggaacucucgagc

SEQ ID NO: 1936526 - RNA, 15 nt, Human
uggaaccucagccug

SEQ ID NO: 1936527 - RNA, 16 nt, Human
uggaaccucagccugg

SEQ ID NO: 1936528 - RNA, 11 nt, Human
uggaagacagc

SEQ ID NO: 1936529 - RNA, 12 nt, Human
uggaagacagcu

SEQ ID NO: 1936530 - RNA, 16 nt, Human
uggaacuuacauuguu

SEQ ID NO: 1936531 - RNA, 17 nt, Human
ugcuugaacccaggaga

SEQ ID NO: 1936532 - RNA, 20 nt, Human
ugcuuguuaaugcuuucuga

SEQ ID NO: 1936533 - RNA, 14 nt, Human
ugcuuguuggauuu

SEQ ID NO: 1936534 - RNA, 13 nt, Human
ugcuuuaugcuga

SEQ ID NO: 1936535 - RNA, 14 nt, Human
ugcuuuccaaagcc

SEQ ID NO: 1936536 - RNA, 15 nt, Human
ugcuuuauuccagaa

SEQ ID NO: 1936537 - RNA, 17 nt, Human
ugcuuuauuccagaaug

SEQ ID NO: 1936538 - RNA, 14 nt, Human
ugcuuuauuccaga

SEQ ID NO: 1936539 - RNA, 14 nt, Human
ugcuuuaugcugaa

SEQ ID NO: 1936540 - RNA, 15 nt, Human
ugcuuuaugcugaaa

SEQ ID NO: 1936541 - RNA, 17 nt, Human
ugcuuuaugcugaaaca

SEQ ID NO: 1936542 - RNA, 16 nt, Human
ugcuucuucagagacu

SEQ ID NO: 1936543 - RNA, 12 nt, Human
ugcuucucacug

SEQ ID NO: 1936544 - RNA, 21 nt, Human
ugcuuccagugaggcucugcc

SEQ ID NO: 1936545 - RNA, 19 nt, Human
ugcuuccagugaggcucug

SEQ ID NO: 1936546 - RNA, 20 nt, Human
ugcuuccagugaggcucugc

SEQ ID NO: 1936547 - RNA, 18 nt, Human
ugcuuccagugaggcucu

SEQ ID NO: 1936548 - RNA, 23 nt, Human
uggccagagagccuggugcugcu

SEQ ID NO: 1936549 - RNA, 13 nt, Human
uggccagagagcc

SEQ ID NO: 1936550 - RNA, 12 nt, Human
uggccagacaca

SEQ ID NO: 1936551 - RNA, 13 nt, Human
uggccagacacag

SEQ ID NO: 1936552 - RNA, 18 nt, Human
uggccagacacaggcccu

SEQ ID NO: 1936553 - RNA, 20 nt, Human
uggcagugggagcugccugu

SEQ ID NO: 1936554 - RNA, 19 nt, Human
uggcagugggagcugccug

SEQ ID NO: 1936555 - RNA, 16 nt, Human
uggcagugggagcugc

SEQ ID NO: 1936556 - RNA, 15 nt, Human
uggcagugggagcug

SEQ ID NO: 1936557 - RNA, 14 nt, Human
uggcagugggagcu

SEQ ID NO: 1936558 - RNA, 14 nt, Human
uggaugccuggugg

SEQ ID NO: 1936559 - RNA, 20 nt, Human
uggaugccaauauuaaaucu

SEQ ID NO: 1936560 - RNA, 21 nt, Human
uggaugccaauauuaaaucug

SEQ ID NO: 1936561 - RNA, 14 nt, Human
uggcacugcuucca

SEQ ID NO: 1936562 - RNA, 16 nt, Human
uggcacugcuuccagu

SEQ ID NO: 1936563 - RNA, 18 nt, Human
uggcacugcuuccaguga

SEQ ID NO: 1936564 - RNA, 22 nt, Human
uggcagcugcgguccacccagg

SEQ ID NO: 1936565 - RNA, 21 nt, Human
uggcagcugcgguccacccag

SEQ ID NO: 1936566 - RNA, 23 nt, Human
uggcagcugcgguccacccagga

SEQ ID NO: 1936567 - RNA, 22 nt, Human
uggaggcaugugaugagaggaa

SEQ ID NO: 1936568 - RNA, 13 nt, Human
uggaggcacuuua

SEQ ID NO: 1936569 - RNA, 14 nt, Human
uggaggcacuuuag

SEQ ID NO: 1936570 - RNA, 12 nt, Human
uggaggcccagu

SEQ ID NO: 1936571 - RNA, 15 nt, Human
uggaggcccaguuca

SEQ ID NO: 1936572 - RNA, 19 nt, Human
uggauacgacaacuugcac

SEQ ID NO: 1936573 - RNA, 18 nt, Human
uggauacauacaccagca

SEQ ID NO: 1936574 - RNA, 12 nt, Human
uggagagaaaac

SEQ ID NO: 1936575 - RNA, 16 nt, Human
uggacaggcauguucu

SEQ ID NO: 1936576 - RNA, 12 nt, Human
uggacaggcaug

SEQ ID NO: 1936577 - RNA, 19 nt, Human
uggaauuauuuuaaaagau

SEQ ID NO: 1936578 - RNA, 17 nt, Human
uggaauuauuuuaaaag

SEQ ID NO: 1936579 - RNA, 16 nt, Human
uggagaggcccucugg

SEQ ID NO: 1936580 - RNA, 18 nt, Human
uggagaggcccucuggag

SEQ ID NO: 1936581 - RNA, 13 nt, Human
uggagauguuuag

SEQ ID NO: 1936582 - RNA, 17 nt, Human
uggcgccuccgagggac

SEQ ID NO: 1936583 - RNA, 15 nt, Human
uggcgcugccccugg

SEQ ID NO: 1936584 - RNA, 14 nt, Human
uggcgcugccccug

SEQ ID NO: 1936585 - RNA, 22 nt, Human
uggcgugcaguggugcgaucug

SEQ ID NO: 1936586 - RNA, 15 nt, Human
uggccagaugcacca

SEQ ID NO: 1936587 - RNA, 18 nt, Human
uggccuucggccuccauc

SEQ ID NO: 1936588 - RNA, 17 nt, Human
uggccuucggccuccau

SEQ ID NO: 1936589 - RNA, 20 nt, Human
uggccuucggccuccauccu

SEQ ID NO: 1936590 - RNA, 18 nt, Human
uggccuugggcccucugg

SEQ ID NO: 1936591 - RNA, 12 nt, Human
uggcugggggcc

SEQ ID NO: 1936592 - RNA, 16 nt, Human
uggcucuuccaggcug

SEQ ID NO: 1936593 - RNA, 13 nt, Human
uggcucuuccagg

SEQ ID NO: 1936594 - RNA, 15 nt, Human
uggcucuuccaggcu

SEQ ID NO: 1936595 - RNA, 16 nt, Human
uggcuccaaacccucg

SEQ ID NO: 1936596 - RNA, 18 nt, Human
uggcuccaaacccucgag

SEQ ID NO: 1936597 - RNA, 20 nt, Human
uggcuccaaacccucgaggc

SEQ ID NO: 1936598 - RNA, 22 nt, Human
uggcucagguggggucacucug

SEQ ID NO: 1936599 - RNA, 20 nt, Human
uggcucagguggggucacuc

SEQ ID NO: 1936600 - RNA, 15 nt, Human
uggcugggggccuca

SEQ ID NO: 1936601 - RNA, 14 nt, Human
uggcugggggccuc

SEQ ID NO: 1936602 - RNA, 22 nt, Human
uggcugguuagagguucccuuu

SEQ ID NO: 1936603 - RNA, 22 nt, Human
ugggaaugaaugucagugugac

SEQ ID NO: 1936604 - RNA, 16 nt, Human
ugggacaugggaaagg

SEQ ID NO: 1936605 - RNA, 23 nt, Human
ugggagcugccuguucagcucca

SEQ ID NO: 1936606 - RNA, 16 nt, Human
ugggagcugaggccac

SEQ ID NO: 1936607 - RNA, 21 nt, Human
ugggguggggggggugcuggg

SEQ ID NO: 1936608 - RNA, 22 nt, Human
ugggguggggggggugcugggc

SEQ ID NO: 1936609 - RNA, 13 nt, Human
ugggucaggcagg

SEQ ID NO: 1936610 - RNA, 20 nt, Human
uggguccaggauuccucuuu

SEQ ID NO: 1936611 - RNA, 19 nt, Human
ugggguggggggggugcug

SEQ ID NO: 1936612 - RNA, 17 nt, Human
ugggguggggaccucag

SEQ ID NO: 1936613 - RNA, 21 nt, Human
uggguucauccuauucuuucg

SEQ ID NO: 1936614 - RNA, 15 nt, Human
uggguuccauucuca

SEQ ID NO: 1936615 - RNA, 21 nt, Human
uggguucugccugccagcugc

SEQ ID NO: 1936616 - RNA, 22 nt, Human
uggguucugccugccagcugca

SEQ ID NO: 1936617 - RNA, 16 nt, Human
uggguucacugcaacc

SEQ ID NO: 1936618 - RNA, 23 nt, Human
uggguucaagcgauucuucugcu

SEQ ID NO: 1936619 - RNA, 14 nt, Human
uggguguggcgcag

SEQ ID NO: 1936620 - RNA, 23 nt, Human
ugggugucaagagggucugagga

SEQ ID NO: 1936621 - RNA, 21 nt, Human
ugggugucaagagggucugag

SEQ ID NO: 1936622 - RNA, 16 nt, Human
uggggcagcuugaggg

SEQ ID NO: 1936623 - RNA, 21 nt, Human
ugggcuuggggaccagagcug

SEQ ID NO: 1936624 - RNA, 20 nt, Human
ugggcuucaguggcagcugc

SEQ ID NO: 1936625 - RNA, 19 nt, Human
ugggcuuggggaccagagc

SEQ ID NO: 1936626 - RNA, 19 nt, Human
ugggcuucaguggcagcug

SEQ ID NO: 1936627 - RNA, 18 nt, Human
ugggcuucaguggcagcu

SEQ ID NO: 1936628 - RNA, 17 nt, Human
ugggcgggcaggggagg

SEQ ID NO: 1936629 - RNA, 22 nt, Human
ugggcgggcaggggagggucag

SEQ ID NO: 1936630 - RNA, 24 nt, Human
ugggagcugccuguucagcuccag

SEQ ID NO: 1936631 - RNA, 16 nt, Human
ugggagcuuuuguaga

SEQ ID NO: 1936632 - RNA, 22 nt, Human
ugggccuccugugugugcgccu

SEQ ID NO: 1936633 - RNA, 16 nt, Human
ugggccuccugugugu

SEQ ID NO: 1936634 - RNA, 14 nt, Human
ugggccuccugugu

SEQ ID NO: 1936635 - RNA, 20 nt, Human
uuaaaacaagaaaguuuccc

SEQ ID NO: 1936636 - RNA, 19 nt, Human
uuaaaacaagaaaguuucc

SEQ ID NO: 1936637 - RNA, 11 nt, Human
uuaaaacaaga

SEQ ID NO: 1936638 - RNA, 13 nt, Human
uguuuuugucuua

SEQ ID NO: 1936639 - RNA, 23 nt, Human
uguuuuaaaaugagaaaucuaaa

SEQ ID NO: 1936640 - RNA, 12 nt, Human
uguuuuguaaag

SEQ ID NO: 1936641 - RNA, 20 nt, Human
uguuuccuggcacugcuucc

SEQ ID NO: 1936642 - RNA, 21 nt, Human
uguuuccuggcacugcuucca

SEQ ID NO: 1936643 - RNA, 22 nt, Human
uguuuccuggcacugcuuccag

SEQ ID NO: 1936644 - RNA, 17 nt, Human
uguuuguugucagcuga

SEQ ID NO: 1936645 - RNA, 16 nt, Human
uguuuguugucagcug

SEQ ID NO: 1936646 - RNA, 18 nt, Human
uguuuuaaaaugagaaau

SEQ ID NO: 1936647 - RNA, 12 nt, Human
uuaaaugcugcu

SEQ ID NO: 1936648 - RNA, 19 nt, Human
uuaaauggaaacugaaacu

SEQ ID NO: 1936649 - RNA, 17 nt, Human
uuaaaugcccagccccu

SEQ ID NO: 1936650 - RNA, 13 nt, Human
uuaaaugcccagc

SEQ ID NO: 1936651 - RNA, 18 nt, Human
uuaaaugcccagccccuu

SEQ ID NO: 1936652 - RNA, 19 nt, Human
uuaaauagcuuuuuucucu

SEQ ID NO: 1936653 - RNA, 15 nt, Human
uuaaauagcuuuugu

SEQ ID NO: 1936654 - RNA, 20 nt, Human
uuaaagcuuccauuguuguc

SEQ ID NO: 1936655 - RNA, 15 nt, Human
uuaaagcuuccauug

SEQ ID NO: 1936656 - RNA, 18 nt, Human
uuaaaugcaccuggaaua

SEQ ID NO: 1936657 - RNA, 17 nt, Human
uuaaaugcaccuggaau

SEQ ID NO: 1936658 - RNA, 16 nt, Human
uuaaaugcaccuggaa

SEQ ID NO: 1936659 - RNA, 14 nt, Human
uuaaagacuuuuau

SEQ ID NO: 1936660 - RNA, 22 nt, Human
uuaaacuuaaucuaaauggaac

SEQ ID NO: 1936661 - RNA, 20 nt, Human
uuaaacuuaaucuaaaugga

SEQ ID NO: 1936662 - RNA, 14 nt, Human
uuaaagcaaaggag

SEQ ID NO: 1936663 - RNA, 18 nt, Human
uuaaacuuaaucuaaaug

SEQ ID NO: 1936664 - RNA, 16 nt, Human
uuaaacuuaaucuaaa

SEQ ID NO: 1936665 - RNA, 18 nt, Human
uuaaaagauaaauauuau

SEQ ID NO: 1936666 - RNA, 21 nt, Human
uuaaugcuaagggcaggccca

SEQ ID NO: 1936667 - RNA, 13 nt, Human
uuaaugcuaaggg

SEQ ID NO: 1936668 - RNA, 22 nt, Human
uuaauauggggaugcagcauua

SEQ ID NO: 1936669 - RNA, 16 nt, Human
uuaauauggggaugca

SEQ ID NO: 1936670 - RNA, 12 nt, Human
uuaauaugaaaa

SEQ ID NO: 1936671 - RNA, 14 nt, Human
uuaauaugaaaacu

SEQ ID NO: 1936672 - RNA, 15 nt, Human
uuaauaugaaaacuu

SEQ ID NO: 1936673 - RNA, 16 nt, Human
uuaauaugaaaacuua

SEQ ID NO: 1936674 - RNA, 17 nt, Human
uuaauaugaaaacuuau

SEQ ID NO: 1936675 - RNA, 21 nt, Human
uuaauagguuuggacaaaaug

SEQ ID NO: 1936676 - RNA, 14 nt, Human
uuaauuauuauuua

SEQ ID NO: 1936677 - RNA, 17 nt, Human
uuaauuauuauucuuca

SEQ ID NO: 1936678 - RNA, 14 nt, Human
uuaauuauuauucu

SEQ ID NO: 1936679 - RNA, 18 nt, Human
uuaaugucacaggcaggu

SEQ ID NO: 1936680 - RNA, 22 nt, Human
uuaaugucaauucuugccaaau

SEQ ID NO: 1936681 - RNA, 17 nt, Human
uuaaugucacaggcagg

SEQ ID NO: 1936682 - RNA, 18 nt, Human
uuaaugcuuuuauauuuu

SEQ ID NO: 1936683 - RNA, 22 nt, Human
uuaaggaugcuuguacauaaug

SEQ ID NO: 1936684 - RNA, 16 nt, Human
uuaauagguuuggaca

SEQ ID NO: 1936685 - RNA, 21 nt, Human
uuaaggaagacaaugugaaaa

SEQ ID NO: 1936686 - RNA, 20 nt, Human
uuaaggaugcuuguacauaa

SEQ ID NO: 1936687 - RNA, 19 nt, Human
uuaaggaugcuuguacaua

SEQ ID NO: 1936688 - RNA, 18 nt, Human
uuaaggaugcuuguacau

SEQ ID NO: 1936689 - RNA, 17 nt, Human
uuaaggaugcuuguaca

SEQ ID NO: 1936690 - RNA, 12 nt, Human
uuacauggcucu

SEQ ID NO: 1936691 - RNA, 22 nt, Human
uuacauggcuggagcuagaauu

SEQ ID NO: 1936692 - RNA, 20 nt, Human
uuacagaugaauguauuuau

SEQ ID NO: 1936693 - RNA, 23 nt, Human
uuacauggcuggagcuagaauuu

SEQ ID NO: 1936694 - RNA, 14 nt, Human
uuacauuuccuaaa

SEQ ID NO: 1936695 - RNA, 20 nt, Human
uuacagagacagaaagcaga

SEQ ID NO: 1936696 - RNA, 15 nt, Human
uuacagaggacagua

SEQ ID NO: 1936697 - RNA, 20 nt, Human
uuacgguuuuccagguuuaa

SEQ ID NO: 1936698 - RNA, 16 nt, Human
uuacggacacccccuc

SEQ ID NO: 1936699 - RNA, 18 nt, Human
uuacggcccuggccuugg

SEQ ID NO: 1936700 - RNA, 16 nt, Human
uuacggaacucaaaua

SEQ ID NO: 1936701 - RNA, 15 nt, Human
uuacgcuuugauuca

SEQ ID NO: 1936702 - RNA, 16 nt, Human
uuacgcuuugauucau

SEQ ID NO: 1936703 - RNA, 13 nt, Human
uuacgcuuugauu

SEQ ID NO: 1936704 - RNA, 22 nt, Human
uuaccuuuuuuauacauaaaca

SEQ ID NO: 1936705 - RNA, 23 nt, Human
uuaccuuuuugaaaaagaaaaca

SEQ ID NO: 1936706 - RNA, 20 nt, Human
uuaccuuuuuuauacauaaa

SEQ ID NO: 1936707 - RNA, 19 nt, Human
uuaccuuuuuuauacauaa

SEQ ID NO: 1936708 - RNA, 23 nt, Human
uuacauuuuuaagugcugcauuu

SEQ ID NO: 1936709 - RNA, 22 nt, Human
uuacauuuuuaagugcugcauu

SEQ ID NO: 1936710 - RNA, 21 nt, Human
uuacauuuuuaagugcugcau

SEQ ID NO: 1936711 - RNA, 20 nt, Human
uuacauuuuuaagugcugca

SEQ ID NO: 1936712 - RNA, 14 nt, Human
uuaccagcagagca

SEQ ID NO: 1936713 - RNA, 18 nt, Human
uguuuacacucuuuguaa

SEQ ID NO: 1936714 - RNA, 16 nt, Human
uguuuacacucuuugu

SEQ ID NO: 1936715 - RNA, 19 nt, Human
uguuuacacucuuuguaag

SEQ ID NO: 1936716 - RNA, 14 nt, Human
uguuuacagaggac

SEQ ID NO: 1936717 - RNA, 21 nt, Human
uguuuacagaggacaguauuu

SEQ ID NO: 1936718 - RNA, 14 nt, Human
uguuggccaggcug

SEQ ID NO: 1936719 - RNA, 11 nt, Human
uguuggccagg

SEQ ID NO: 1936720 - RNA, 20 nt, Human
uguuggauuuuugucuugug

SEQ ID NO: 1936721 - RNA, 17 nt, Human
uguuggauuuuugucuu

SEQ ID NO: 1936722 - RNA, 13 nt, Human
uguugagcuguuu

SEQ ID NO: 1936723 - RNA, 19 nt, Human
uguugaagagguuuuaaag

SEQ ID NO: 1936724 - RNA, 19 nt, Human
uguucucugcccuccaaga

SEQ ID NO: 1936725 - RNA, 23 nt, Human
uguucucuugggaacugaacuca

SEQ ID NO: 1936726 - RNA, 15 nt, Human
uguucugacccugcu

SEQ ID NO: 1936727 - RNA, 13 nt, Human
uguucugaacugu

SEQ ID NO: 1936728 - RNA, 15 nt, Human
uguucugaacugugg

SEQ ID NO: 1936729 - RNA, 18 nt, Human
uguucugacccugcuuca

SEQ ID NO: 1936730 - RNA, 23 nt, Human
uguucugcaaaaauauuuauaaa

SEQ ID NO: 1936731 - RNA, 14 nt, Human
uguucuuucuggcu

SEQ ID NO: 1936732 - RNA, 22 nt, Human
uguucuuucuggcuaugcauuu

SEQ ID NO: 1936733 - RNA, 20 nt, Human
uguucuuucuggcuaugcau

SEQ ID NO: 1936734 - RNA, 23 nt, Human
uguucugcccaaugccuuuuuga

SEQ ID NO: 1936735 - RNA, 11 nt, Human
uguugaaagau

SEQ ID NO: 1936736 - RNA, 18 nt, Human
uguucucugaggacacua

SEQ ID NO: 1936737 - RNA, 12 nt, Human
uguucucugccc

SEQ ID NO: 1936738 - RNA, 16 nt, Human
uguucucugaggacac

SEQ ID NO: 1936739 - RNA, 13 nt, Human
uguucucugagga

SEQ ID NO: 1936740 - RNA, 12 nt, Human
uguucuauagcu

SEQ ID NO: 1936741 - RNA, 13 nt, Human
uguucauaaauaa

SEQ ID NO: 1936742 - RNA, 20 nt, Human
uguucaugaaagauucaaug

SEQ ID NO: 1936743 - RNA, 15 nt, Human
uguuacauuauuauc

SEQ ID NO: 1936744 - RNA, 13 nt, Human
uguuacauuuuua

SEQ ID NO: 1936745 - RNA, 22 nt, Human
uguuacauuuuuaagugcugca

SEQ ID NO: 1936746 - RNA, 15 nt, Human
uguuacugucuucag

SEQ ID NO: 1936747 - RNA, 16 nt, Human
uguuacugucuucagu

SEQ ID NO: 1936748 - RNA, 15 nt, Human
uguuacuguaauucc

SEQ ID NO: 1936749 - RNA, 15 nt, Human
uguguuuguguauuu

SEQ ID NO: 1936750 - RNA, 10 nt, Human
uguguuuguu

SEQ ID NO: 1936751 - RNA, 20 nt, Human
uguguuuguucuuuuuauug

SEQ ID NO: 1936752 - RNA, 14 nt, Human
uguucagcuccagc

SEQ ID NO: 1936753 - RNA, 18 nt, Human
uguucagcuccagcucac

SEQ ID NO: 1936754 - RNA, 11 nt, Human
uguucagcugg

SEQ ID NO: 1936755 - RNA, 16 nt, Human
uguucagcuccagcuc

SEQ ID NO: 1936756 - RNA, 15 nt, Human
uguucagcuccagcu

SEQ ID NO: 1936757 - RNA, 14 nt, Human
uguguagccugugc

SEQ ID NO: 1936758 - RNA, 23 nt, Human
uguguaugugggggucugugugu

SEQ ID NO: 1936759 - RNA, 14 nt, Human
uguguauguggggg

SEQ ID NO: 1936760 - RNA, 12 nt, Human
ugugugaaugaa

SEQ ID NO: 1936761 - RNA, 16 nt, Human
ugugugaaugaacacu

SEQ ID NO: 1936762 - RNA, 17 nt, Human
ugugugaaugaacacuc

SEQ ID NO: 1936763 - RNA, 18 nt, Human
ugugugaaugaacacucu

SEQ ID NO: 1936764 - RNA, 22 nt, Human
ugugugaaugaacacucuuuug

SEQ ID NO: 1936765 - RNA, 15 nt, Human
uguguauuuacgcuu

SEQ ID NO: 1936766 - RNA, 13 nt, Human
uguguauuuaaca

SEQ ID NO: 1936767 - RNA, 18 nt, Human
uguguauuuaacagggag

SEQ ID NO: 1936768 - RNA, 20 nt, Human
uguguauuuaacagggaggg

SEQ ID NO: 1936769 - RNA, 22 nt, Human
uguguauuuaacagggagggga

SEQ ID NO: 1936770 - RNA, 22 nt, Human
uguguuuaggaacuacugagga

SEQ ID NO: 1936771 - RNA, 13 nt, Human
uguguuuaugugu

SEQ ID NO: 1936772 - RNA, 17 nt, Human
uguguuuaugugagcug

SEQ ID NO: 1936773 - RNA, 13 nt, Human
uguguuuauuguc

SEQ ID NO: 1936774 - RNA, 15 nt, Human
uguguuuaugugugu

SEQ ID NO: 1936775 - RNA, 23 nt, Human
uguguugugugugggagugugua

SEQ ID NO: 1936776 - RNA, 14 nt, Human
uguguugugugugg

SEQ ID NO: 1936777 - RNA, 19 nt, Human
uguguguccaaaacugccu

SEQ ID NO: 1936778 - RNA, 16 nt, Human
uguguguccaaaacug

SEQ ID NO: 1936779 - RNA, 11 nt, Human
uguguguaugu

SEQ ID NO: 1936780 - RNA, 21 nt, Human
uguauuuauaaauauauuuaa

SEQ ID NO: 1936781 - RNA, 14 nt, Human
uguauuuauaaaua

SEQ ID NO: 1936782 - RNA, 21 nt, Human
uguauuuacgcuuugauucau

SEQ ID NO: 1936783 - RNA, 23 nt, Human
uguauuuacgcuuugauucauag

SEQ ID NO: 1936784 - RNA, 20 nt, Human
uguauuuacgcuuugauuca

SEQ ID NO: 1936785 - RNA, 18 nt, Human
uguauuuaacagggaggg

SEQ ID NO: 1936786 - RNA, 19 nt, Human
uguauugcauauauacaua

SEQ ID NO: 1936787 - RNA, 15 nt, Human
uguauuuaaaugaaa

SEQ ID NO: 1936788 - RNA, 23 nt, Human
uguaucccaugagccucagcauc

SEQ ID NO: 1936789 - RNA, 19 nt, Human
uguaucccaugagccucag

SEQ ID NO: 1936790 - RNA, 16 nt, Human
uguauaaguggaggca

SEQ ID NO: 1936791 - RNA, 19 nt, Human
uguauaaguggaggcacuu

SEQ ID NO: 1936792 - RNA, 20 nt, Human
uguauaaguggaggcacuuu

SEQ ID NO: 1936793 - RNA, 13 nt, Human
uguagcagaaagg

SEQ ID NO: 1936794 - RNA, 15 nt, Human
uguauaauauuuuua

SEQ ID NO: 1936795 - RNA, 21 nt, Human
uguauaaguggaggcacuuua

SEQ ID NO: 1936796 - RNA, 23 nt, Human
uguauaaguggaggcacuuuagg

SEQ ID NO: 1936797 - RNA, 12 nt, Human
uguagcagaaag

SEQ ID NO: 1936798 - RNA, 12 nt, Human
ugucagugugac

SEQ ID NO: 1936799 - RNA, 20 nt, Human
ugucagugugacugaucucu

SEQ ID NO: 1936800 - RNA, 16 nt, Human
ugucagucacagccac

SEQ ID NO: 1936801 - RNA, 17 nt, Human
ugucagucacagccacc

SEQ ID NO: 1936802 - RNA, 18 nt, Human
ugucagucacagccaccc

SEQ ID NO: 1936803 - RNA, 22 nt, Human
ugucagucacagccaccccuga

SEQ ID NO: 1936804 - RNA, 17 nt, Human
ugucauagaaagugcca

SEQ ID NO: 1936805 - RNA, 22 nt, Human
ugucauagaaagugccagaaag

SEQ ID NO: 1936806 - RNA, 20 nt, Human
ugucacguuuuguuuugugc

SEQ ID NO: 1936807 - RNA, 15 nt, Human
ugucacucauugcug

SEQ ID NO: 1936808 - RNA, 16 nt, Human
ugucacucauugcuga

SEQ ID NO: 1936809 - RNA, 14 nt, Human
ugucagucacagcc

SEQ ID NO: 1936810 - RNA, 15 nt, Human
ugucagucacagcca

SEQ ID NO: 1936811 - RNA, 21 nt, Human
ugucacucauugcugagccuc

SEQ ID NO: 1936812 - RNA, 22 nt, Human
ugucacucauugcugagccucu

SEQ ID NO: 1936813 - RNA, 23 nt, Human
ugucacucauugcugagccucug

SEQ ID NO: 1936814 - RNA, 20 nt, Human
uguauuuguuaaugguuuga

SEQ ID NO: 1936815 - RNA, 18 nt, Human
uguauuuguuaaugguuu

SEQ ID NO: 1936816 - RNA, 23 nt, Human
ugucccaaaaagaaaggagggga

SEQ ID NO: 1936817 - RNA, 18 nt, Human
ugucauauagcugguuau

SEQ ID NO: 1936818 - RNA, 20 nt, Human
uguacugagccuuguaauuc

SEQ ID NO: 1936819 - RNA, 19 nt, Human
uguacugagccuuguaauu

SEQ ID NO: 1936820 - RNA, 22 nt, Human
uguacugagccuuguaauucua

SEQ ID NO: 1936821 - RNA, 17 nt, Human
uguacugagccuuguaa

SEQ ID NO: 1936822 - RNA, 12 nt, Human
uguacucccagg

SEQ ID NO: 1936823 - RNA, 17 nt, Human
uguagauaauacaguuc

SEQ ID NO: 1936824 - RNA, 16 nt, Human
uguacgucugacaggc

SEQ ID NO: 1936825 - RNA, 17 nt, Human
uguacgucugacaggca

SEQ ID NO: 1936826 - RNA, 12 nt, Human
uguacuacaauu

SEQ ID NO: 1936827 - RNA, 18 nt, Human
uguacuaggauacugcug

SEQ ID NO: 1936828 - RNA, 17 nt, Human
uguacagucuuguauua

SEQ ID NO: 1936829 - RNA, 15 nt, Human
uguacagucuuguau

SEQ ID NO: 1936830 - RNA, 14 nt, Human
uguacagucuugua

SEQ ID NO: 1936831 - RNA, 12 nt, Human
uguacagucuug

SEQ ID NO: 1936832 - RNA, 19 nt, Human
uguacaggaugcuuugguu

SEQ ID NO: 1936833 - RNA, 23 nt, Human
uguaccucuugagccuugaacuu

SEQ ID NO: 1936834 - RNA, 14 nt, Human
uguaccucuugagc

SEQ ID NO: 1936835 - RNA, 22 nt, Human
uguaccucuugagccuugaacu

SEQ ID NO: 1936836 - RNA, 15 nt, Human
uguaccgcaauguga

SEQ ID NO: 1936837 - RNA, 14 nt, Human
uguaccauuugccu

SEQ ID NO: 1936838 - RNA, 17 nt, Human
uguaaaauuucacuuaa

SEQ ID NO: 1936839 - RNA, 18 nt, Human
ugguaggacuguagaaaa

SEQ ID NO: 1936840 - RNA, 17 nt, Human
ugguaggacuguagaaa

SEQ ID NO: 1936841 - RNA, 16 nt, Human
ugguaggcauuuccua

SEQ ID NO: 1936842 - RNA, 17 nt, Human
uguaaauuaacuuuuau

SEQ ID NO: 1936843 - RNA, 16 nt, Human
uguaaauuaacuuuua

SEQ ID NO: 1936844 - RNA, 15 nt, Human
uguaaauuaacuuuu

SEQ ID NO: 1936845 - RNA, 14 nt, Human
uguaaauuaacuuu

SEQ ID NO: 1936846 - RNA, 13 nt, Human
uguaaauuaacuu

SEQ ID NO: 1936847 - RNA, 13 nt, Human
uguaaaucugcuc

SEQ ID NO: 1936848 - RNA, 16 nt, Human
uguaaaucugcucagg

SEQ ID NO: 1936849 - RNA, 17 nt, Human
uguaaucauauaauaaa

SEQ ID NO: 1936850 - RNA, 15 nt, Human
uguaaucccagcacu

SEQ ID NO: 1936851 - RNA, 22 nt, Human
uguaaucccagcacuuugggag

SEQ ID NO: 1936852 - RNA, 16 nt, Human
uguaaucccagcuacu

SEQ ID NO: 1936853 - RNA, 15 nt, Human
uguaaucacagcuac

SEQ ID NO: 1936854 - RNA, 16 nt, Human
uguaaauuuaugugau

SEQ ID NO: 1936855 - RNA, 17 nt, Human
uguaaauugaaucagua

SEQ ID NO: 1936856 - RNA, 22 nt, Human
uguaaauugaaucaguauaaac

SEQ ID NO: 1936857 - RNA, 15 nt, Human
uguaaauuuauguga

SEQ ID NO: 1936858 - RNA, 13 nt, Human
ugucugcccccuc

SEQ ID NO: 1936859 - RNA, 13 nt, Human
ugucugccagggc

SEQ ID NO: 1936860 - RNA, 17 nt, Human
ugucuggcugcagagca

SEQ ID NO: 1936861 - RNA, 16 nt, Human
ugucuggcugcagagc

SEQ ID NO: 1936862 - RNA, 14 nt, Human
ugucuggcugcaga

SEQ ID NO: 1936863 - RNA, 22 nt, Human
ugucucaguccaugaagaugua

SEQ ID NO: 1936864 - RNA, 21 nt, Human
ugucucaguccaugaagaugu

SEQ ID NO: 1936865 - RNA, 13 nt, Human
ugucugcauuucg

SEQ ID NO: 1936866 - RNA, 21 nt, Human
ugucugcauuucgguggcuag

SEQ ID NO: 1936867 - RNA, 14 nt, Human
ugucucacauggga

SEQ ID NO: 1936868 - RNA, 13 nt, Human
uguccccaccgca

SEQ ID NO: 1936869 - RNA, 16 nt, Human
ugucuuuuuucacuac

SEQ ID NO: 1936870 - RNA, 14 nt, Human
ugucuuuuuucuaa

SEQ ID NO: 1936871 - RNA, 19 nt, Human
ugucuuuggacccugaggc

SEQ ID NO: 1936872 - RNA, 22 nt, Human
ugucuuuggacccugaggccca

SEQ ID NO: 1936873 - RNA, 17 nt, Human
ugucuuuggacccugag

SEQ ID NO: 1936874 - RNA, 18 nt, Human
ugucuuuggacccugagg

SEQ ID NO: 1936875 - RNA, 13 nt, Human
ugugaaacauguu

SEQ ID NO: 1936876 - RNA, 13 nt, Human
ugugaaaggaaag

SEQ ID NO: 1936877 - RNA, 14 nt, Human
ugugaaaggaaaga

SEQ ID NO: 1936878 - RNA, 22 nt, Human
ugugacacauaugcaccuugug

SEQ ID NO: 1936879 - RNA, 17 nt, Human
ugugacacauaugcacc

SEQ ID NO: 1936880 - RNA, 15 nt, Human
ugugacauguuuuau

SEQ ID NO: 1936881 - RNA, 22 nt, Human
ugugaccacugcagaagacagu

SEQ ID NO: 1936882 - RNA, 21 nt, Human
ugugacaaggauugcuacugu

SEQ ID NO: 1936883 - RNA, 14 nt, Human
ugugaaugaacacu

SEQ ID NO: 1936884 - RNA, 23 nt, Human
ugugaaugaacacucuuuugcuu

SEQ ID NO: 1936885 - RNA, 17 nt, Human
ugugaaugaacacucuu

SEQ ID NO: 1936886 - RNA, 16 nt, Human
ugugaaucauuuuacc

SEQ ID NO: 1936887 - RNA, 21 nt, Human
ugugauacaaugcugugcccu

SEQ ID NO: 1936888 - RNA, 14 nt, Human
ugugauagcacuuu

SEQ ID NO: 1936889 - RNA, 15 nt, Human
ugugauagcacuuuc

SEQ ID NO: 1936890 - RNA, 17 nt, Human
ugugauagcacuuucua

SEQ ID NO: 1936891 - RNA, 13 nt, Human
ugugauauaagug

SEQ ID NO: 1936892 - RNA, 14 nt, Human
ugugcaagagaggg

SEQ ID NO: 1936893 - RNA, 17 nt, Human
ugugcaauaauuuacau

SEQ ID NO: 1936894 - RNA, 18 nt, Human
ugugaguacuacaguccu

SEQ ID NO: 1936895 - RNA, 18 nt, Human
ugugaggggcucucucau

SEQ ID NO: 1936896 - RNA, 15 nt, Human
ugugacccccagcuc

SEQ ID NO: 1936897 - RNA, 16 nt, Human
ugugacccccagcucc

SEQ ID NO: 1936898 - RNA, 20 nt, Human
ugugacccccagcuccggcc

SEQ ID NO: 1936899 - RNA, 17 nt, Human
ugugacccccagcuccg

SEQ ID NO: 1936900 - RNA, 19 nt, Human
ugugaguacuacaguccuc

SEQ ID NO: 1936901 - RNA, 20 nt, Human
ugugaguacuacaguccucc

SEQ ID NO: 1936902 - RNA, 23 nt, Human
ugugaguacuacaguccucccau

SEQ ID NO: 1936903 - RNA, 16 nt, Human
ugugaguaaucugaga

SEQ ID NO: 1936904 - RNA, 19 nt, Human
ugugaguaaucugagaaac

SEQ ID NO: 1936905 - RNA, 22 nt, Human
uguggcuucuuaaucuuuucac

SEQ ID NO: 1936906 - RNA, 12 nt, Human
ugugggaagggg

SEQ ID NO: 1936907 - RNA, 23 nt, Human
uguggggaaccaauugcuuuguc

SEQ ID NO: 1936908 - RNA, 22 nt, Human
uguggggugugcacaucucugc

SEQ ID NO: 1936909 - RNA, 15 nt, Human
ugugggucaaggaau

SEQ ID NO: 1936910 - RNA, 16 nt, Human
ugugggggucugugug

SEQ ID NO: 1936911 - RNA, 20 nt, Human
ugugggucugugugugugua

SEQ ID NO: 1936912 - RNA, 15 nt, Human
uguggguaccuguau

SEQ ID NO: 1936913 - RNA, 16 nt, Human
ugugggucugugugug

SEQ ID NO: 1936914 - RNA, 14 nt, Human
ugugggucugugug

SEQ ID NO: 1936915 - RNA, 15 nt, Human
uguguacccaaacgu

SEQ ID NO: 1936916 - RNA, 13 nt, Human
uguggacacagcu

SEQ ID NO: 1936917 - RNA, 14 nt, Human
uguggacacagcuc

SEQ ID NO: 1936918 - RNA, 23 nt, Human
uguggaaaagccaagaggcugca

SEQ ID NO: 1936919 - RNA, 21 nt, Human
uguggaaaagccaagaggcug

SEQ ID NO: 1936920 - RNA, 19 nt, Human
uguggaaaagccaagaggc

SEQ ID NO: 1936921 - RNA, 15 nt, Human
uguggaaaagaaaca

SEQ ID NO: 1936922 - RNA, 20 nt, Human
uguggaaaagaaacacgcac

SEQ ID NO: 1936923 - RNA, 16 nt, Human
uguggacacagcucuu

SEQ ID NO: 1936924 - RNA, 15 nt, Human
uguggacacagcucu

SEQ ID NO: 1936925 - RNA, 19 nt, Human
uguggagaagccacaggcc

SEQ ID NO: 1936926 - RNA, 12 nt, Human
uguggagaagcg

SEQ ID NO: 1936927 - RNA, 21 nt, Human
uguggagaagcggcuggcagc

SEQ ID NO: 1936928 - RNA, 23 nt, Human
ugugcauguaugucuuggacacu

SEQ ID NO: 1936929 - RNA, 20 nt, Human
ugugcauguaugucuuggac

SEQ ID NO: 1936930 - RNA, 12 nt, Human
ugugcaguguug

SEQ ID NO: 1936931 - RNA, 19 nt, Human
ugugcauagagccacguau

SEQ ID NO: 1936932 - RNA, 13 nt, Human
ugugccucuggga

SEQ ID NO: 1936933 - RNA, 15 nt, Human
ugugccucugggacu

SEQ ID NO: 1936934 - RNA, 16 nt, Human
ugugccucugggacug

SEQ ID NO: 1936935 - RNA, 22 nt, Human
ugugcacaugcacgugugugca

SEQ ID NO: 1936936 - RNA, 16 nt, Human
ugugcacaugcacgug

SEQ ID NO: 1936937 - RNA, 14 nt, Human
ugugcacaaagugg

SEQ ID NO: 1936938 - RNA, 17 nt, Human
ugugcacaaaguggcau

SEQ ID NO: 1936939 - RNA, 13 nt, Human
ugugcagacuuca

SEQ ID NO: 1936940 - RNA, 15 nt, Human
ugugcuacaggggcc

SEQ ID NO: 1936941 - RNA, 17 nt, Human
ugugcuacaggggccag

SEQ ID NO: 1936942 - RNA, 18 nt, Human
ugugcuacaggggccaga

SEQ ID NO: 1936943 - RNA, 20 nt, Human
ugugcuacaggggccagaag

SEQ ID NO: 1936944 - RNA, 17 nt, Human
ugugccucugggacugg

SEQ ID NO: 1936945 - RNA, 20 nt, Human
ugugcgugcauguguguuca

SEQ ID NO: 1936946 - RNA, 14 nt, Human
uucugagcauuuaa

SEQ ID NO: 1936947 - RNA, 17 nt, Human
uucuguccgagcuuuga

SEQ ID NO: 1936948 - RNA, 21 nt, Human
uucuguccgagcuuugaaaau

SEQ ID NO: 1936949 - RNA, 17 nt, Human
uucuguccuacucugug

SEQ ID NO: 1936950 - RNA, 19 nt, Human
uucuguccuacucuguguc

SEQ ID NO: 1936951 - RNA, 23 nt, Human
uucuguggguuucuaaagcugcc

SEQ ID NO: 1936952 - RNA, 16 nt, Human
uucuugguuuguaaau

SEQ ID NO: 1936953 - RNA, 13 nt, Human
uucuugguuugua

SEQ ID NO: 1936954 - RNA, 22 nt, Human
uucuucacuguccuccaagcca

SEQ ID NO: 1936955 - RNA, 23 nt, Human
uucuugguuuguaaauuaacuuu

SEQ ID NO: 1936956 - RNA, 18 nt, Human
uucuugguuuguaaauua

SEQ ID NO: 1936957 - RNA, 17 nt, Human
uucuugguuuguaaauu

SEQ ID NO: 1936958 - RNA, 11 nt, Human
uucuguucuuu

SEQ ID NO: 1936959 - RNA, 19 nt, Human
uucuuauuuaaugaaagac

SEQ ID NO: 1936960 - RNA, 23 nt, Human
uucuuauuuaaugaaagacugua

SEQ ID NO: 1936961 - RNA, 19 nt, Human
uugaagacuuuucuuucag

SEQ ID NO: 1936962 - RNA, 22 nt, Human
uugaagacacugaaauauacac

SEQ ID NO: 1936963 - RNA, 17 nt, Human
uugaagacagagcuaca

SEQ ID NO: 1936964 - RNA, 13 nt, Human
uugaagacacuga

SEQ ID NO: 1936965 - RNA, 15 nt, Human
uugaagacacugaaa

SEQ ID NO: 1936966 - RNA, 17 nt, Human
uugaaucuauuuaucuu

SEQ ID NO: 1936967 - RNA, 20 nt, Human
uugaaucuauuuaucuucau

SEQ ID NO: 1936968 - RNA, 19 nt, Human
uugaacucuucaaucucuu

SEQ ID NO: 1936969 - RNA, 16 nt, Human
uugaacugauaaagau

SEQ ID NO: 1936970 - RNA, 16 nt, Human
uugaacugagcuugga

SEQ ID NO: 1936971 - RNA, 15 nt, Human
uugaacugagcuugg

SEQ ID NO: 1936972 - RNA, 22 nt, Human
uugaacuuugaccucugcagca

SEQ ID NO: 1936973 - RNA, 15 nt, Human
uugaaaaaugcaugu

SEQ ID NO: 1936974 - RNA, 19 nt, Human
uugaaaacacuguucucug

SEQ ID NO: 1936975 - RNA, 21 nt, Human
uugaaaacacuguucucugcc

SEQ ID NO: 1936976 - RNA, 18 nt, Human
uucuuuauaauucuacuu

SEQ ID NO: 1936977 - RNA, 22 nt, Human
uugaaaacacuguucucugccc

SEQ ID NO: 1936978 - RNA, 22 nt, Human
uugcauaguaccaaucauuuua

SEQ ID NO: 1936979 - RNA, 14 nt, Human
uugcauagaauaaa

SEQ ID NO: 1936980 - RNA, 22 nt, Human
uugcagacaggcaagcaccucc

SEQ ID NO: 1936981 - RNA, 16 nt, Human
uugcagacaggcaagc

SEQ ID NO: 1936982 - RNA, 19 nt, Human
uugcagaacuaaacucauu

SEQ ID NO: 1936983 - RNA, 21 nt, Human
uugcagaacuaaacucauuua

SEQ ID NO: 1936984 - RNA, 17 nt, Human
uugcaacaggcugggcu

SEQ ID NO: 1936985 - RNA, 14 nt, Human
uugcaacaggcugg

SEQ ID NO: 1936986 - RNA, 18 nt, Human
uugauuuccguuaaaaua

SEQ ID NO: 1936987 - RNA, 20 nt, Human
uugauuuuuacguuugaaga

SEQ ID NO: 1936988 - RNA, 21 nt, Human
uugauagcacagacccugccc

SEQ ID NO: 1936989 - RNA, 23 nt, Human
uugauagcacagacccugcccug

SEQ ID NO: 1936990 - RNA, 11 nt, Human
uugaucuucaa

SEQ ID NO: 1936991 - RNA, 13 nt, Human
uugaucuucaaca

SEQ ID NO: 1936992 - RNA, 15 nt, Human
uugaucuucaacaaa

SEQ ID NO: 1936993 - RNA, 16 nt, Human
uugaucuucaacaaau

SEQ ID NO: 1936994 - RNA, 17 nt, Human
uugaucuucaacaaauu

SEQ ID NO: 1936995 - RNA, 15 nt, Human
uugaucuggaaccca

SEQ ID NO: 1936996 - RNA, 16 nt, Human
uugaucuggaacccag

SEQ ID NO: 1936997 - RNA, 17 nt, Human
uugaucuggaacccaga

SEQ ID NO: 1936998 - RNA, 19 nt, Human
uugaucuggaacccagacu

SEQ ID NO: 1936999 - RNA, 20 nt, Human
uugauuguucgggugugcaa

SEQ ID NO: 1937000 - RNA, 15 nt, Human
uugacgccaucccag

SEQ ID NO: 1937001 - RNA, 21 nt, Human
uugaccuuuuauguaguaauu

SEQ ID NO: 1937002 - RNA, 22 nt, Human
uugacgccaucccagccccaau

SEQ ID NO: 1937003 - RNA, 14 nt, Human
uugacgccauccca

SEQ ID NO: 1937004 - RNA, 12 nt, Human
uugaccugaggc

SEQ ID NO: 1937005 - RNA, 19 nt, Human
uugaccugaggcccuucuc

SEQ ID NO: 1937006 - RNA, 22 nt, Human
uugaccugaggcccuucucucc

SEQ ID NO: 1937007 - RNA, 15 nt, Human
uugaccucaggugau

SEQ ID NO: 1937008 - RNA, 20 nt, Human
uugaccgugaggccagagac

SEQ ID NO: 1937009 - RNA, 21 nt, Human
uugaccgugaggccagagaca

SEQ ID NO: 1937010 - RNA, 18 nt, Human
uugaauguaugcuucaua

SEQ ID NO: 1937011 - RNA, 19 nt, Human
uugauagcacagacccugc

SEQ ID NO: 1937012 - RNA, 20 nt, Human
uugauagcacagacccugcc

SEQ ID NO: 1937013 - RNA, 19 nt, Human
uugaggggagagggaacgg

SEQ ID NO: 1937014 - RNA, 15 nt, Human
uugaggggauuaaua

SEQ ID NO: 1937015 - RNA, 16 nt, Human
uugaggggauuaauau

SEQ ID NO: 1937016 - RNA, 20 nt, Human
uugaggggauuaauaugaaa

SEQ ID NO: 1937017 - RNA, 22 nt, Human
uugaggggauuaauaugaaaac

SEQ ID NO: 1937018 - RNA, 18 nt, Human
uugaggaaacaacagcuu

SEQ ID NO: 1937019 - RNA, 18 nt, Human
uugagcuguuuucccuga

SEQ ID NO: 1937020 - RNA, 12 nt, Human
uugagcuguuuu

SEQ ID NO: 1937021 - RNA, 23 nt, Human
uugacuagaugauggaugccaau

SEQ ID NO: 1937022 - RNA, 23 nt, Human
uugacgagugugaagcuuccuug

SEQ ID NO: 1937023 - RNA, 16 nt, Human
uuguaaaggaauuuaa

SEQ ID NO: 1937024 - RNA, 18 nt, Human
uuguaaauaaaggaacca

SEQ ID NO: 1937025 - RNA, 16 nt, Human
uuguaaaguccccaga

SEQ ID NO: 1937026 - RNA, 22 nt, Human
uuguaaaguccccagagaaagc

SEQ ID NO: 1937027 - RNA, 22 nt, Human
uuggucccccuuccauggacuu

SEQ ID NO: 1937028 - RNA, 16 nt, Human
uuggucccccuuccau

SEQ ID NO: 1937029 - RNA, 12 nt, Human
uugguccugcug

SEQ ID NO: 1937030 - RNA, 13 nt, Human
uugguccugcugc

SEQ ID NO: 1937031 - RNA, 12 nt, Human
uuguacagacaa

SEQ ID NO: 1937032 - RNA, 13 nt, Human
uuguacagacaac

SEQ ID NO: 1937033 - RNA, 19 nt, Human
uuguacacaccuuauauuu

SEQ ID NO: 1937034 - RNA, 14 nt, Human
uuguauuacaaauc

SEQ ID NO: 1937035 - RNA, 14 nt, Human
uuguauucagaguu

SEQ ID NO: 1937036 - RNA, 21 nt, Human
uuguauucucuccuguaccuc

SEQ ID NO: 1937037 - RNA, 15 nt, Human
uuguagagccagggu

SEQ ID NO: 1937038 - RNA, 14 nt, Human
uuguagagccaggg

SEQ ID NO: 1937039 - RNA, 13 nt, Human
uuguacaguuuuu

SEQ ID NO: 1937040 - RNA, 12 nt, Human
uuguacaguuuu

SEQ ID NO: 1937041 - RNA, 16 nt, Human
uuguacaguuuuuauu

SEQ ID NO: 1937042 - RNA, 14 nt, Human
uuguacauaaugcg

SEQ ID NO: 1937043 - RNA, 16 nt, Human
uuggguggaugccugg

SEQ ID NO: 1937044 - RNA, 19 nt, Human
uuggguggggggcuucaua

SEQ ID NO: 1937045 - RNA, 17 nt, Human
uuggguggggggcuuca

SEQ ID NO: 1937046 - RNA, 22 nt, Human
uuggguggggggcuucauacac

SEQ ID NO: 1937047 - RNA, 17 nt, Human
uugggugggcaggaaaa

SEQ ID NO: 1937048 - RNA, 21 nt, Human
uuggguggggggcuucauaca

SEQ ID NO: 1937049 - RNA, 20 nt, Human
uuggguggggggcuucauac

SEQ ID NO: 1937050 - RNA, 12 nt, Human
uugguaaaccuu

SEQ ID NO: 1937051 - RNA, 16 nt, Human
uuggguuccauucuca

SEQ ID NO: 1937052 - RNA, 14 nt, Human
uugguaaaccuuuu

SEQ ID NO: 1937053 - RNA, 16 nt, Human
uugggaggccauuugu

SEQ ID NO: 1937054 - RNA, 18 nt, Human
uugggaacugaacucacu

SEQ ID NO: 1937055 - RNA, 12 nt, Human
uugggaggcuga

SEQ ID NO: 1937056 - RNA, 22 nt, Human
uuggcuuuggguugcaggaccu

SEQ ID NO: 1937057 - RNA, 22 nt, Human
uuggcugggggccucagugcca

SEQ ID NO: 1937058 - RNA, 21 nt, Human
uuggcugggggccucagugcc

SEQ ID NO: 1937059 - RNA, 16 nt, Human
uuggcugcugaaggcu

SEQ ID NO: 1937060 - RNA, 18 nt, Human
uuggcugggggccucagu

SEQ ID NO: 1937061 - RNA, 24 nt, Human
uuggccaaagccaaagcuaggccu

SEQ ID NO: 1937062 - RNA, 15 nt, Human
uuggccaaacaagug

SEQ ID NO: 1937063 - RNA, 14 nt, Human
uuggccaggcuggu

SEQ ID NO: 1937064 - RNA, 13 nt, Human
uuggcauucccca

SEQ ID NO: 1937065 - RNA, 23 nt, Human
uuggcaaacucuccaccacacgu

SEQ ID NO: 1937066 - RNA, 16 nt, Human
uuggauuuuugacucu

SEQ ID NO: 1937067 - RNA, 18 nt, Human
uugcguggacucugcaca

SEQ ID NO: 1937068 - RNA, 15 nt, Human
uugcguggacucugc

SEQ ID NO: 1937069 - RNA, 21 nt, Human
uugcguggaauugugcugagu

SEQ ID NO: 1937070 - RNA, 12 nt, Human
uugccugcaggc

SEQ ID NO: 1937071 - RNA, 20 nt, Human
uugcugauggugcaaugacc

SEQ ID NO: 1937072 - RNA, 22 nt, Human
uugcugauggugcaaugaccuu

SEQ ID NO: 1937073 - RNA, 11 nt, Human
uugcccaggca

SEQ ID NO: 1937074 - RNA, 23 nt, Human
uugcccacgcuggagugcaguga

SEQ ID NO: 1937075 - RNA, 13 nt, Human
uugccagucaccc

SEQ ID NO: 1937076 - RNA, 18 nt, Human
uugccagucaccccggcc

SEQ ID NO: 1937077 - RNA, 14 nt, Human
uugccucugccucu

SEQ ID NO: 1937078 - RNA, 11 nt, Human
uugccucugcc

SEQ ID NO: 1937079 - RNA, 18 nt, Human
uugccucugccucugaca

SEQ ID NO: 1937080 - RNA, 16 nt, Human
uugccucugccucuga

SEQ ID NO: 1937081 - RNA, 20 nt, Human
uugccucuguccccuucucu

SEQ ID NO: 1937082 - RNA, 19 nt, Human
uugccucuguccccuucuc

SEQ ID NO: 1937083 - RNA, 18 nt, Human
uugccucuguccccuucu

SEQ ID NO: 1937084 - RNA, 17 nt, Human
uugccucuguccccuuc

SEQ ID NO: 1937085 - RNA, 11 nt, Human
uuggaaggaac

SEQ ID NO: 1937086 - RNA, 19 nt, Human
uuggaaggaacguccccug

SEQ ID NO: 1937087 - RNA, 16 nt, Human
uuggaagaaaaaaucu

SEQ ID NO: 1937088 - RNA, 18 nt, Human
uuggauuuuugucuugug

SEQ ID NO: 1937089 - RNA, 14 nt, Human
uuggauuguauauu

SEQ ID NO: 1937090 - RNA, 18 nt, Human
uuggauuguauauugugu

SEQ ID NO: 1937091 - RNA, 14 nt, Human
uuggauuguccccg

SEQ ID NO: 1937092 - RNA, 17 nt, Human
uuggcaaaaaggcagga

SEQ ID NO: 1937093 - RNA, 20 nt, Human
uuggcaaacucuccaccaca

SEQ ID NO: 1937094 - RNA, 16 nt, Human
uuggcaaacucuccac

SEQ ID NO: 1937095 - RNA, 14 nt, Human
uuggauuggggucc

SEQ ID NO: 1937096 - RNA, 17 nt, Human
uuggauucugagagcug

SEQ ID NO: 1937097 - RNA, 15 nt, Human
uuggauucugagagc

SEQ ID NO: 1937098 - RNA, 20 nt, Human
uugcuguagaagauggcacu

SEQ ID NO: 1937099 - RNA, 20 nt, Human
uugcuggggccgaaagaaca

SEQ ID NO: 1937100 - RNA, 11 nt, Human
uugcuguauau

SEQ ID NO: 1937101 - RNA, 14 nt, Human
uugcuguuuuccuc

SEQ ID NO: 1937102 - RNA, 16 nt, Human
uugcuguuuuccuccc

SEQ ID NO: 1937103 - RNA, 18 nt, Human
uugcuguuuuccucccuu

SEQ ID NO: 1937104 - RNA, 19 nt, Human
uugcuguuuuccucccuuc

SEQ ID NO: 1937105 - RNA, 20 nt, Human
uugcuguuuuccucccuucu

SEQ ID NO: 1937106 - RNA, 22 nt, Human
uugcuguuuuccucccuucugc

SEQ ID NO: 1937107 - RNA, 14 nt, Human
uucuccagggucag

SEQ ID NO: 1937108 - RNA, 13 nt, Human
uucuccacccugc

SEQ ID NO: 1937109 - RNA, 16 nt, Human
uucuccaagcaggaca

SEQ ID NO: 1937110 - RNA, 11 nt, Human
uucuccaggcu

SEQ ID NO: 1937111 - RNA, 22 nt, Human
uucuccacagcaaccccaggcu

SEQ ID NO: 1937112 - RNA, 15 nt, Human
uucuccacagcaacc

SEQ ID NO: 1937113 - RNA, 18 nt, Human
uucucuccagccccugga

SEQ ID NO: 1937114 - RNA, 16 nt, Human
uucugacccaugcugc

SEQ ID NO: 1937115 - RNA, 18 nt, Human
uucugacccaugcugccc

SEQ ID NO: 1937116 - RNA, 20 nt, Human
uucugacccaugcugcccug

SEQ ID NO: 1937117 - RNA, 21 nt, Human
uucugacccaugcugcccugu

SEQ ID NO: 1937118 - RNA, 17 nt, Human
uucucugauacagaaaa

SEQ ID NO: 1937119 - RNA, 16 nt, Human
uucucugauacagaaa

SEQ ID NO: 1937120 - RNA, 15 nt, Human
uucucugauacagaa

SEQ ID NO: 1937121 - RNA, 14 nt, Human
uucucugauacaga

SEQ ID NO: 1937122 - RNA, 17 nt, Human
uucuaugacacaugcaa

SEQ ID NO: 1937123 - RNA, 16 nt, Human
uucuaugacacaugca

SEQ ID NO: 1937124 - RNA, 16 nt, Human
uucuaaugauggccca

SEQ ID NO: 1937125 - RNA, 23 nt, Human
uucuaaugauggcccauucuacu

SEQ ID NO: 1937126 - RNA, 18 nt, Human
uucuaauagaacucaguu

SEQ ID NO: 1937127 - RNA, 12 nt, Human
uucuaauagaac

SEQ ID NO: 1937128 - RNA, 14 nt, Human
uucuaauagaacuc

SEQ ID NO: 1937129 - RNA, 14 nt, Human
uucuauuguuucuu

SEQ ID NO: 1937130 - RNA, 18 nt, Human
uucuauuuauauguacau

SEQ ID NO: 1937131 - RNA, 19 nt, Human
uucuauuuauauguacaug

SEQ ID NO: 1937132 - RNA, 15 nt, Human
uucuauuuauuuacu

SEQ ID NO: 1937133 - RNA, 17 nt, Human
uucucaugauuuacaga

SEQ ID NO: 1937134 - RNA, 20 nt, Human
uucucaugauuuacagagaa

SEQ ID NO: 1937135 - RNA, 15 nt, Human
uucucaucuuucuug

SEQ ID NO: 1937136 - RNA, 18 nt, Human
uucucaucuuucuugauc

SEQ ID NO: 1937137 - RNA, 20 nt, Human
uucucaaagaaauuuccacu

SEQ ID NO: 1937138 - RNA, 19 nt, Human
uucucaaagaaauuuccac

SEQ ID NO: 1937139 - RNA, 15 nt, Human
uucucaaagaaauuu

SEQ ID NO: 1937140 - RNA, 13 nt, Human
uucucaaagaaau

SEQ ID NO: 1937141 - RNA, 15 nt, Human
uucucauccugcagg

SEQ ID NO: 1937142 - RNA, 18 nt, Human
uuccugccgcaacaguuu

SEQ ID NO: 1937143 - RNA, 14 nt, Human
uuccuuccagccca

SEQ ID NO: 1937144 - RNA, 21 nt, Human
uuccuuucauuuacuguggcu

SEQ ID NO: 1937145 - RNA, 15 nt, Human
uuccuuccuguucug

SEQ ID NO: 1937146 - RNA, 16 nt, Human
uuccuucagugccuua

SEQ ID NO: 1937147 - RNA, 19 nt, Human
uuccuucagugccuuaugg

SEQ ID NO: 1937148 - RNA, 23 nt, Human
uuccuucagugccuuauggaaca

SEQ ID NO: 1937149 - RNA, 19 nt, Human
uuccuucauucaacccacc

SEQ ID NO: 1937150 - RNA, 13 nt, Human
uucuaaagaugga

SEQ ID NO: 1937151 - RNA, 16 nt, Human
uucuaaaggcuaccuu

SEQ ID NO: 1937152 - RNA, 18 nt, Human
uucuaaacccaauccaaa

SEQ ID NO: 1937153 - RNA, 19 nt, Human
uucuaaacccaauccaaau

SEQ ID NO: 1937154 - RNA, 23 nt, Human
uucuaaacccaauccaaauggcg

SEQ ID NO: 1937155 - RNA, 14 nt, Human
uucuaaacagagau

SEQ ID NO: 1937156 - RNA, 18 nt, Human
uucuaaaggcuaccuuug

SEQ ID NO: 1937157 - RNA, 17 nt, Human
uucuaaaggcuaccuuu

SEQ ID NO: 1937158 - RNA, 19 nt, Human
uucggccuccauccugagg

SEQ ID NO: 1937159 - RNA, 18 nt, Human
uucggccuccauccugag

SEQ ID NO: 1937160 - RNA, 22 nt, Human
uucggccuccauccugaggcuc

SEQ ID NO: 1937161 - RNA, 16 nt, Human
uuccuuuggaagaaaa

SEQ ID NO: 1937162 - RNA, 18 nt, Human
uuccuuuccagguauuuu

SEQ ID NO: 1937163 - RNA, 20 nt, Human
uuccuuucauuuacuguggc

SEQ ID NO: 1937164 - RNA, 21 nt, Human
uuccccaccagugaaugaaag

SEQ ID NO: 1937165 - RNA, 22 nt, Human
uuccccacuugagaauuacccu

SEQ ID NO: 1937166 - RNA, 11 nt, Human
uuccccagaga

SEQ ID NO: 1937167 - RNA, 12 nt, Human
uuccccagagaa

SEQ ID NO: 1937168 - RNA, 19 nt, Human
uucccuuugacgccauccc

SEQ ID NO: 1937169 - RNA, 19 nt, Human
uuccuagauggcagucacu

SEQ ID NO: 1937170 - RNA, 22 nt, Human
uuccuagauggcagucacugaa

SEQ ID NO: 1937171 - RNA, 14 nt, Human
uuccuagccaccgc

SEQ ID NO: 1937172 - RNA, 21 nt, Human
uuccuagccaccgccuccuac

SEQ ID NO: 1937173 - RNA, 15 nt, Human
uuccuagccaccgcc

SEQ ID NO: 1937174 - RNA, 23 nt, Human
uuccucauaguaugguggcuggg

SEQ ID NO: 1937175 - RNA, 20 nt, Human
uuccuagguauaauucacau

SEQ ID NO: 1937176 - RNA, 22 nt, Human
uuccuagccaccgccuccuaca

SEQ ID NO: 1937177 - RNA, 22 nt, Human
uuccucccucccucuuucccuc

SEQ ID NO: 1937178 - RNA, 11 nt, Human
uuccucccuuc

SEQ ID NO: 1937179 - RNA, 12 nt, Human
uuccucccuucu

SEQ ID NO: 1937180 - RNA, 14 nt, Human
uuccucccuucugc

SEQ ID NO: 1937181 - RNA, 15 nt, Human
uuccucccuucugcu

SEQ ID NO: 1937182 - RNA, 16 nt, Human
uuccucccuucugcua

SEQ ID NO: 1937183 - RNA, 18 nt, Human
uuccucccuucugcuacu

SEQ ID NO: 1937184 - RNA, 12 nt, Human
uuccucccuccc

SEQ ID NO: 1937185 - RNA, 19 nt, Human
uuccucccucccucuuucc

SEQ ID NO: 1937186 - RNA, 21 nt, Human
uuccucccucccucuuucccu

SEQ ID NO: 1937187 - RNA, 15 nt, Human
uucauuucaacuguu

SEQ ID NO: 1937188 - RNA, 22 nt, Human
uucauuugguucauuaauucua

SEQ ID NO: 1937189 - RNA, 17 nt, Human
uucaugauuucauuuca

SEQ ID NO: 1937190 - RNA, 16 nt, Human
uucaugaguuuuuccc

SEQ ID NO: 1937191 - RNA, 23 nt, Human
uucaugauuucauuucaacuguu

SEQ ID NO: 1937192 - RNA, 19 nt, Human
uucauuuaggugaggaagc

SEQ ID NO: 1937193 - RNA, 17 nt, Human
uucaucuugaauuguaa

SEQ ID NO: 1937194 - RNA, 12 nt, Human
uucaucuugaau

SEQ ID NO: 1937195 - RNA, 18 nt, Human
uucaugaaagauucaaug

SEQ ID NO: 1937196 - RNA, 20 nt, Human
uucaucuuccaacucaaacu

SEQ ID NO: 1937197 - RNA, 11 nt, Human
uucaucuugaa

SEQ ID NO: 1937198 - RNA, 22 nt, Human
uucaucucccaccuagcagcac

SEQ ID NO: 1937199 - RNA, 13 nt, Human
uucaguggcagcu

SEQ ID NO: 1937200 - RNA, 19 nt, Human
uucagugccuuauggaaca

SEQ ID NO: 1937201 - RNA, 21 nt, Human
uucagugccuuauggaacacu

SEQ ID NO: 1937202 - RNA, 12 nt, Human
uucaguuuucag

SEQ ID NO: 1937203 - RNA, 14 nt, Human
uucauaaucuuugc

SEQ ID NO: 1937204 - RNA, 21 nt, Human
uucaguuuucauuugguucau

SEQ ID NO: 1937205 - RNA, 15 nt, Human
uucaucuaggauuuu

SEQ ID NO: 1937206 - RNA, 13 nt, Human
uucauaaugacuu

SEQ ID NO: 1937207 - RNA, 23 nt, Human
uucauaaugacuuaagcacacuu

SEQ ID NO: 1937208 - RNA, 19 nt, Human
uuccacuuauaggaauuga

SEQ ID NO: 1937209 - RNA, 15 nt, Human
uucauuuuaugaaga

SEQ ID NO: 1937210 - RNA, 16 nt, Human
uuccagccugccacuc

SEQ ID NO: 1937211 - RNA, 14 nt, Human
uuccagccugccac

SEQ ID NO: 1937212 - RNA, 12 nt, Human
uuccagccugcc

SEQ ID NO: 1937213 - RNA, 20 nt, Human
uuccacuuuuuuuuguaugu

SEQ ID NO: 1937214 - RNA, 23 nt, Human
uuccaugugaggguuuucagcau

SEQ ID NO: 1937215 - RNA, 18 nt, Human
uuccccaaccacuucauu

SEQ ID NO: 1937216 - RNA, 16 nt, Human
uucccaaacgccuccc

SEQ ID NO: 1937217 - RNA, 17 nt, Human
uuccaugaguccccugu

SEQ ID NO: 1937218 - RNA, 17 nt, Human
uuccaugauucuauuua

SEQ ID NO: 1937219 - RNA, 18 nt, Human
uuccaugauucuauuuau

SEQ ID NO: 1937220 - RNA, 24 nt, Human
uuccaugaaaaugcaacaacaugu

SEQ ID NO: 1937221 - RNA, 15 nt, Human
uuccaugaaaaugca

SEQ ID NO: 1937222 - RNA, 13 nt, Human
uuccaucuuuaca

SEQ ID NO: 1937223 - RNA, 18 nt, Human
uuccaucuuuacaaaacu

SEQ ID NO: 1937224 - RNA, 18 nt, Human
uucaauucucauuuguca

SEQ ID NO: 1937225 - RNA, 12 nt, Human
uucaauuccucu

SEQ ID NO: 1937226 - RNA, 16 nt, Human
uucaauuccucuggga

SEQ ID NO: 1937227 - RNA, 20 nt, Human
uucaauguuuuuaaaaaucu

SEQ ID NO: 1937228 - RNA, 19 nt, Human
uucaaugccccugaauuua

SEQ ID NO: 1937229 - RNA, 23 nt, Human
uucaaugguuugcaaggaagcca

SEQ ID NO: 1937230 - RNA, 22 nt, Human
uucaaugguuugcaaggaagcc

SEQ ID NO: 1937231 - RNA, 20 nt, Human
uucaaugguuugcaaggaag

SEQ ID NO: 1937232 - RNA, 21 nt, Human
uucaacagguuuuccugaaga

SEQ ID NO: 1937233 - RNA, 23 nt, Human
uucaaauuguaagcaugcacaaa

SEQ ID NO: 1937234 - RNA, 21 nt, Human
uucaaauugugugugcucugc

SEQ ID NO: 1937235 - RNA, 14 nt, Human
uucaaauugugugu

SEQ ID NO: 1937236 - RNA, 13 nt, Human
uucaaagauauuu

SEQ ID NO: 1937237 - RNA, 13 nt, Human
uuacgugaguccu

SEQ ID NO: 1937238 - RNA, 14 nt, Human
uuacgugaguccug

SEQ ID NO: 1937239 - RNA, 15 nt, Human
uucagagacuccugc

SEQ ID NO: 1937240 - RNA, 20 nt, Human
uucagacucccauuccugaa

SEQ ID NO: 1937241 - RNA, 21 nt, Human
uucagacucccauuccugaag

SEQ ID NO: 1937242 - RNA, 14 nt, Human
uucacucuccuugg

SEQ ID NO: 1937243 - RNA, 12 nt, Human
uucaccccuccc

SEQ ID NO: 1937244 - RNA, 14 nt, Human
uucacucuuggagc

SEQ ID NO: 1937245 - RNA, 19 nt, Human
uucacucuuggagccugca

SEQ ID NO: 1937246 - RNA, 18 nt, Human
uucacucuuggagccugc

SEQ ID NO: 1937247 - RNA, 17 nt, Human
uucaccccaaucccagc

SEQ ID NO: 1937248 - RNA, 23 nt, Human
uucagcuccagcucaccagcccc

SEQ ID NO: 1937249 - RNA, 17 nt, Human
uucagcucugcaagaau

SEQ ID NO: 1937250 - RNA, 24 nt, Human
uucagcucugcaagaauugaagca

SEQ ID NO: 1937251 - RNA, 21 nt, Human
uucagcugguugagguuucaa

SEQ ID NO: 1937252 - RNA, 16 nt, Human
uucaggaagcucaggg

SEQ ID NO: 1937253 - RNA, 18 nt, Human
uucagcugcauacaguuu

SEQ ID NO: 1937254 - RNA, 17 nt, Human
uucagcugacuuuucug

SEQ ID NO: 1937255 - RNA, 19 nt, Human
uucaggaauguguggccug

SEQ ID NO: 1937256 - RNA, 20 nt, Human
uucaggaagcucagggccug

SEQ ID NO: 1937257 - RNA, 15 nt, Human
uucaggaagcucagg

SEQ ID NO: 1937258 - RNA, 17 nt, Human
uucaggaagcucagggc

SEQ ID NO: 1937259 - RNA, 19 nt, Human
uucaggaagcucagggccu

SEQ ID NO: 1937260 - RNA, 20 nt, Human
uuuaucuaauaccucugugu

SEQ ID NO: 1937261 - RNA, 21 nt, Human
uuuaucgucacugcuuaacuu

SEQ ID NO: 1937262 - RNA, 16 nt, Human
uuuauaaacuuuaccu

SEQ ID NO: 1937263 - RNA, 16 nt, Human
uuuaucgucacugcuu

SEQ ID NO: 1937264 - RNA, 14 nt, Human
uuuauaaacuuuac

SEQ ID NO: 1937265 - RNA, 14 nt, Human
uuuauaaaacuucu

SEQ ID NO: 1937266 - RNA, 19 nt, Human
uuuaucuuugauucuccuu

SEQ ID NO: 1937267 - RNA, 18 nt, Human
uuuaucuuugauucuccu

SEQ ID NO: 1937268 - RNA, 13 nt, Human
uuuauugcuuguu

SEQ ID NO: 1937269 - RNA, 18 nt, Human
uuuauuccagaaugcugu

SEQ ID NO: 1937270 - RNA, 19 nt, Human
uuuauuccagaaugcugua

SEQ ID NO: 1937271 - RNA, 22 nt, Human
uuuauuccagaaugcuguacau

SEQ ID NO: 1937272 - RNA, 23 nt, Human
uuuauuccagaaugcuguacauc

SEQ ID NO: 1937273 - RNA, 14 nt, Human
uuuaugcauauuau

SEQ ID NO: 1937274 - RNA, 17 nt, Human
uuuauucaauuccucug

SEQ ID NO: 1937275 - RNA, 17 nt, Human
uuuauuauuuucaccug

SEQ ID NO: 1937276 - RNA, 14 nt, Human
uuuauugucaaagu

SEQ ID NO: 1937277 - RNA, 16 nt, Human
uuuauugucaaagugg

SEQ ID NO: 1937278 - RNA, 20 nt, Human
uuguauuuuacuaauaaaau

SEQ ID NO: 1937279 - RNA, 23 nt, Human
uuguauuuaaaugaaagugagac

SEQ ID NO: 1937280 - RNA, 21 nt, Human
uuuaaucuccaccagucauuu

SEQ ID NO: 1937281 - RNA, 17 nt, Human
uuuacauggcuggagcu

SEQ ID NO: 1937282 - RNA, 15 nt, Human
uuuacaagccccccc

SEQ ID NO: 1937283 - RNA, 21 nt, Human
uuuacaagcccccccuuccac

SEQ ID NO: 1937284 - RNA, 15 nt, Human
uuuacuuuguguuca

SEQ ID NO: 1937285 - RNA, 22 nt, Human
uuuacauggcuggagcuagaau

SEQ ID NO: 1937286 - RNA, 15 nt, Human
uuuagagaggaaaag

SEQ ID NO: 1937287 - RNA, 17 nt, Human
uuuagaagaaguguguc

SEQ ID NO: 1937288 - RNA, 19 nt, Human
uuuagaagaagugugucac

SEQ ID NO: 1937289 - RNA, 15 nt, Human
uuucagcagcugcag

SEQ ID NO: 1937290 - RNA, 21 nt, Human
uuucaaugguuugcaaggaag

SEQ ID NO: 1937291 - RNA, 16 nt, Human
uuucagagaccauugc

SEQ ID NO: 1937292 - RNA, 17 nt, Human
uuucagagaccauugca

SEQ ID NO: 1937293 - RNA, 20 nt, Human
uuucaauaggaaaaacugau

SEQ ID NO: 1937294 - RNA, 22 nt, Human
uuucaauaggaaaaacugauuu

SEQ ID NO: 1937295 - RNA, 13 nt, Human
uuuauuucuuaaa

SEQ ID NO: 1937296 - RNA, 20 nt, Human
uuuauuuguuugugcauuug

SEQ ID NO: 1937297 - RNA, 16 nt, Human
uuuauuucugcauaug

SEQ ID NO: 1937298 - RNA, 14 nt, Human
uuuauuuauuuaca

SEQ ID NO: 1937299 - RNA, 15 nt, Human
uuuccaaaguacacu

SEQ ID NO: 1937300 - RNA, 12 nt, Human
uuuccaaaguac

SEQ ID NO: 1937301 - RNA, 22 nt, Human
uuucauuggaaauuaggaugua

SEQ ID NO: 1937302 - RNA, 13 nt, Human
uuuccaggaaggc

SEQ ID NO: 1937303 - RNA, 18 nt, Human
uuuccagacuuccuugag

SEQ ID NO: 1937304 - RNA, 19 nt, Human
uuuccagacuuccuugaga

SEQ ID NO: 1937305 - RNA, 15 nt, Human
uuucagccaagaauu

SEQ ID NO: 1937306 - RNA, 16 nt, Human
uuucagccaagaauuc

SEQ ID NO: 1937307 - RNA, 14 nt, Human
uuucagcauugaua

SEQ ID NO: 1937308 - RNA, 15 nt, Human
uuucagcauugauau

SEQ ID NO: 1937309 - RNA, 20 nt, Human
uuucagcauugauauuugug

SEQ ID NO: 1937310 - RNA, 22 nt, Human
uuucauugcugggcuugucugu

SEQ ID NO: 1937311 - RNA, 20 nt, Human
uuuccugagaccacagagag

SEQ ID NO: 1937312 - RNA, 14 nt, Human
uuucuaaaggcuac

SEQ ID NO: 1937313 - RNA, 14 nt, Human
uuucuaaagcugcc

SEQ ID NO: 1937314 - RNA, 17 nt, Human
uuucuaaagcugccagc

SEQ ID NO: 1937315 - RNA, 18 nt, Human
uuucuaaaggcuaccuuu

SEQ ID NO: 1937316 - RNA, 17 nt, Human
uuuccucuuccugccua

SEQ ID NO: 1937317 - RNA, 22 nt, Human
uuuccucaaaacuucagacaua

SEQ ID NO: 1937318 - RNA, 21 nt, Human
uuuccugaaacaacuuggaaa

SEQ ID NO: 1937319 - RNA, 21 nt, Human
uuuccucuuuggucuacacug

SEQ ID NO: 1937320 - RNA, 15 nt, Human
uuuccaggcugguuc

SEQ ID NO: 1937321 - RNA, 22 nt, Human
uuuccaggcugguucggauuug

SEQ ID NO: 1937322 - RNA, 23 nt, Human
uuuccuagauggcagucacugaa

SEQ ID NO: 1937323 - RNA, 15 nt, Human
uuucuagccagagga

SEQ ID NO: 1937324 - RNA, 19 nt, Human
uuucuagcuguugagcugu

SEQ ID NO: 1937325 - RNA, 21 nt, Human
uuucuagcuguugagcuguuu

SEQ ID NO: 1937326 - RNA, 16 nt, Human
uuucuaggacugaauu

SEQ ID NO: 1937327 - RNA, 24 nt, Human
uuucuccccugcccccaggacugg

SEQ ID NO: 1937328 - RNA, 23 nt, Human
uuucuccccugcccccaggacug

SEQ ID NO: 1937329 - RNA, 22 nt, Human
uuucuccccugcccccaggacu

SEQ ID NO: 1937330 - RNA, 12 nt, Human
uuucucuuucuu

SEQ ID NO: 1937331 - RNA, 14 nt, Human
uuucucuuucuuua

SEQ ID NO: 1937332 - RNA, 14 nt, Human
uuuucacaaauaaa

SEQ ID NO: 1937333 - RNA, 23 nt, Human
uuuucacacaauacaauaaguua

SEQ ID NO: 1937334 - RNA, 13 nt, Human
uuuucacaaauaa

SEQ ID NO: 1937335 - RNA, 15 nt, Human
uuuucacaguucucu

SEQ ID NO: 1937336 - RNA, 14 nt, Human
uuuucaauauuuau

SEQ ID NO: 1937337 - RNA, 16 nt, Human
uuuucaauauuuauua

SEQ ID NO: 1937338 - RNA, 13 nt, Human
uuuuaugcauguu

SEQ ID NO: 1937339 - RNA, 13 nt, Human
uuuucaacugcca

SEQ ID NO: 1937340 - RNA, 23 nt, Human
uuuucaacugccaaaaugcucua

SEQ ID NO: 1937341 - RNA, 14 nt, Human
uuuucuucucccuc

SEQ ID NO: 1937342 - RNA, 17 nt, Human
uuuucuugcaugaggcu

SEQ ID NO: 1937343 - RNA, 15 nt, Human
uuuuccuucagugcc

SEQ ID NO: 1937344 - RNA, 18 nt, Human
uuuuccaugaguccccug

SEQ ID NO: 1937345 - RNA, 19 nt, Human
uuuuccaugaguccccugu

SEQ ID NO: 1937346 - RNA, 14 nt, Human
uuuuccucccuucu

SEQ ID NO: 1937347 - RNA, 17 nt, Human
uuuuccucccuucugcu

SEQ ID NO: 1937348 - RNA, 20 nt, Human
uuuuccucccuucugcuacu

SEQ ID NO: 1937349 - RNA, 21 nt, Human
uuuuccucccuucugcuacug

SEQ ID NO: 1937350 - RNA, 19 nt, Human
uuuuaucauuuucaaaaug

SEQ ID NO: 1937351 - RNA, 18 nt, Human
uuuuaucgucacugcuua

SEQ ID NO: 1937352 - RNA, 16 nt, Human
uuuuaugauacuugaa

SEQ ID NO: 1937353 - RNA, 20 nt, Human
uuuuaugauacuugaaaauu

SEQ ID NO: 1937354 - RNA, 14 nt, Human
uuuuacuguacaga

SEQ ID NO: 1937355 - RNA, 15 nt, Human
uuuuacugaagccuu

SEQ ID NO: 1937356 - RNA, 19 nt, Human
uuuuacugaagccuuucuu

SEQ ID NO: 1937357 - RNA, 20 nt, Human
uuuuauaucaauuuaaaaaa

SEQ ID NO: 1937358 - RNA, 22 nt, Human
uuuuauaugaagauaaguguau

SEQ ID NO: 1937359 - RNA, 15 nt, Human
uuuuaaaaugagaaa

SEQ ID NO: 1937360 - RNA, 22 nt, Human
uuuuaaaaugagaaaucuaaaa

SEQ ID NO: 1937361 - RNA, 22 nt, Human
uuuuacauaaauuuaguauuuu

SEQ ID NO: 1937362 - RNA, 21 nt, Human
uuuuaauuugguuuucacauu

SEQ ID NO: 1937363 - RNA, 17 nt, Human
uuuuaauuugguuuuca

SEQ ID NO: 1937364 - RNA, 13 nt, Human
uuuuaauuugaua

SEQ ID NO: 1937365 - RNA, 23 nt, Human
uuugcauaguaccaaucauuuua

SEQ ID NO: 1937366 - RNA, 19 nt, Human
uuugcauaauaaaugcuuc

SEQ ID NO: 1937367 - RNA, 18 nt, Human
uuugccauguuggccagg

SEQ ID NO: 1937368 - RNA, 14 nt, Human
uuugcagacaggca

SEQ ID NO: 1937369 - RNA, 21 nt, Human
uuugcacuugugauuauuuau

SEQ ID NO: 1937370 - RNA, 18 nt, Human
uuugauaguauugugcau

SEQ ID NO: 1937371 - RNA, 19 nt, Human
uuugcauaacguauaaaag

SEQ ID NO: 1937372 - RNA, 23 nt, Human
uuugcauaacguauaaaagccug

SEQ ID NO: 1937373 - RNA, 15 nt, Human
uuugagcagggcuca

SEQ ID NO: 1937374 - RNA, 16 nt, Human
uuugagcauggguuca

SEQ ID NO: 1937375 - RNA, 22 nt, Human
uuucuuacugucuuuuuucuaa

SEQ ID NO: 1937376 - RNA, 22 nt, Human
uuugaggucuguucuuuccaaa

SEQ ID NO: 1937377 - RNA, 17 nt, Human
uuugaggucuguucuuu

SEQ ID NO: 1937378 - RNA, 13 nt, Human
uuugagugccuua

SEQ ID NO: 1937379 - RNA, 16 nt, Human
uuugagguggaagagg

SEQ ID NO: 1937380 - RNA, 16 nt, Human
uuuguugucagcugaa

SEQ ID NO: 1937381 - RNA, 15 nt, Human
uuuguuccccuccuc

SEQ ID NO: 1937382 - RNA, 13 nt, Human
uuuguuccccucc

SEQ ID NO: 1937383 - RNA, 12 nt, Human
uuuguuccccuc

SEQ ID NO: 1937384 - RNA, 23 nt, Human
uuuguucccauccucuucuuuua

SEQ ID NO: 1937385 - RNA, 18 nt, Human
uuuguuccccuccuccac

SEQ ID NO: 1937386 - RNA, 16 nt, Human
uuuguuccccuccucc

SEQ ID NO: 1937387 - RNA, 14 nt, Human
uuuguucccauccu

SEQ ID NO: 1937388 - RNA, 13 nt, Human
uuuguccccaccg

SEQ ID NO: 1937389 - RNA, 21 nt, Human
uuuguccccaccgcagacagg

SEQ ID NO: 1937390 - RNA, 13 nt, Human
uuuguguucuuug

SEQ ID NO: 1937391 - RNA, 17 nt, Human
uuuguccuaaaacaccu

SEQ ID NO: 1937392 - RNA, 22 nt, Human
uuuguaaauuaacuuuuauaaa

SEQ ID NO: 1937393 - RNA, 19 nt, Human
uuuggugguuucagaaaug

SEQ ID NO: 1937394 - RNA, 15 nt, Human
uuuggaauacuuuuu

SEQ ID NO: 1937395 - RNA, 17 nt, Human
uuuggaauacuuuuugu

SEQ ID NO: 1937396 - RNA, 13 nt, Human
uuuggaauacuuu

SEQ ID NO: 1937397 - RNA, 16 nt, Human
uuugguuaagcuuuga

SEQ ID NO: 1937398 - RNA, 17 nt, Human
uuuguaaauuaacuuuu

SEQ ID NO: 1937399 - RNA, 16 nt, Human
uuuguaaauuaacuuu

SEQ ID NO: 1937400 - RNA, 15 nt, Human
uuuguaaauuaacuu

SEQ ID NO: 1937401 - RNA, 16 nt, Human
uuuuuuaugcuaauca

SEQ ID NO: 1937402 - RNA, 12 nt, Human
uuuuuucugaaa

SEQ ID NO: 1937403 - RNA, 13 nt, Human
uuuuuuaugcuaa

SEQ ID NO: 1937404 - RNA, 17 nt, Human
uuuuuuccuucagugcc

SEQ ID NO: 1937405 - RNA, 20 nt, Human
uuuuuuauacaggaugauga

SEQ ID NO: 1937406 - RNA, 12 nt, Human
uuuuuuacuaau

SEQ ID NO: 1937407 - RNA, 13 nt, Human
uuuugaaaaacug

SEQ ID NO: 1937408 - RNA, 21 nt, Human
uuuucuugccucuguccccuu

SEQ ID NO: 1937409 - RNA, 19 nt, Human
uuuucuugccucugucccc

SEQ ID NO: 1937410 - RNA, 18 nt, Human
uuuucuugccucuguccc

SEQ ID NO: 1937411 - RNA, 13 nt, Human
uuuuuucuuacug

SEQ ID NO: 1937412 - RNA, 14 nt, Human
cuggcagcucagcu

SEQ ID NO: 1937413 - RNA, 18 nt, Human
gugccauagucacauggc

SEQ ID NO: 1937414 - RNA, 20 nt, Human
gugcugcugcugcuguggcg

SEQ ID NO: 1937415 - RNA, 19 nt, Human
ggcuccaacacugcugcuc

SEQ ID NO: 1937416 - RNA, 13 nt, Human
ggacgugggcugg

SEQ ID NO: 1937417 - RNA, 21 nt, Human
ggagggcacaggugucugccc

SEQ ID NO: 1937418 - RNA, 20 nt, Human
cccaggugaguccuagagcu

SEQ ID NO: 1937419 - RNA, 19 nt, Human
ccuuucauuuacuguggcu

SEQ ID NO: 1937420 - RNA, 17 nt, Human
gcugcuccagugcagga

SEQ ID NO: 1937421 - RNA, 23 nt, Human
ugcaguuugagacaggagaccug

SEQ ID NO: 1937422 - RNA, 14 nt, Human
aaauuaaggcauaa

SEQ ID NO: 1937423 - RNA, 12 nt, Human
aaaaauugugau

SEQ ID NO: 1937424 - RNA, 17 nt, Human
acccaggaguguggcca

SEQ ID NO: 1937425 - RNA, 23 nt, Human
agacaggagaccuggcacuggau

SEQ ID NO: 1937426 - RNA, 15 nt, Human
agccuggugcugcug

SEQ ID NO: 1937427 - RNA, 16 nt, Human
acuuugacaaccauga

SEQ ID NO: 1937428 - RNA, 13 nt, Human
gguccacagggca

SEQ ID NO: 1937429 - RNA, 18 nt, Human
gggucgacuucgggcugg

SEQ ID NO: 1937430 - RNA, 16 nt, Human
gcugcuguggcgugag

SEQ ID NO: 1937431 - RNA, 18 nt, Human
gcccagccacggacgcug

SEQ ID NO: 1937432 - RNA, 21 nt, Human
ggcacccaagaccucagggca

SEQ ID NO: 1937433 - RNA, 22 nt, Human
gcuuccccaacacgcaggagca

SEQ ID NO: 1937434 - RNA, 14 nt, Human
uacccauauuacag

SEQ ID NO: 1937435 - RNA, 17 nt, Human
ucaccuugaagaaccuc

SEQ ID NO: 1937436 - RNA, 17 nt, Human
cuuucauuuacuguggc

SEQ ID NO: 1937437 - RNA, 16 nt, Human
uccugagggagcucca

SEQ ID NO: 1937438 - RNA, 17 nt, Human
gugucuguacacguguc

SEQ ID NO: 1937439 - RNA, 12 nt, Human
uaaguugcugau

SEQ ID NO: 1937440 - RNA, 14 nt, Human
gcccagaggagcug

SEQ ID NO: 1937441 - RNA, 15 nt, Human
gccagagagccuggu

SEQ ID NO: 1937442 - RNA, 19 nt, Human
ugcauacccgggcagggcu

SEQ ID NO: 1937443 - RNA, 20 nt, Human
aaauugugaucagaccauaa

SEQ ID NO: 1937444 - RNA, 16 nt, Human
aaguugcugaugaacu

SEQ ID NO: 1937445 - RNA, 22 nt, Human
acaagcuaaaauuagaugaacu

SEQ ID NO: 1937446 - RNA, 14 nt, Human
cugcugcuguggcg

SEQ ID NO: 1937447 - RNA, 11 nt, Human
cgggcagggcc

SEQ ID NO: 1937448 - RNA, 12 nt, Human
cggggcagggca

SEQ ID NO: 1937449 - RNA, 17 nt, Human
cugccacccugggccug

SEQ ID NO: 1937450 - RNA, 17 nt, Human
cccccacauccugugcc

SEQ ID NO: 1937451 - RNA, 22 nt, Human
cagcccccacauccugugccuc

SEQ ID NO: 1937452 - RNA, 23 nt, Human
ccaagcagagaagcucucgggcu

SEQ ID NO: 1937453 - RNA, 18 nt, Human
ccacccaggaguguggcc

SEQ ID NO: 1937454 - RNA, 16 nt, Human
cagugaggcugcaccc

SEQ ID NO: 1937455 - RNA, 18 nt, Human
caguuggccagagagccu

SEQ ID NO: 1937456 - RNA, 17 nt, Human
auuuuaggaggaccaga

SEQ ID NO: 1937457 - RNA, 14 nt, Human
agucauuugcugag

SEQ ID NO: 1937458 - RNA, 22 nt, Human
uaaucauauaauaaauguacau

SEQ ID NO: 1937459 - RNA, 12 nt, Human
uaccauguacau

SEQ ID NO: 1937460 - RNA, 17 nt, Human
auugugaucagaccaua

SEQ ID NO: 1937461 - RNA, 18 nt, Human
acucaauguuacuaucug

SEQ ID NO: 1937462 - RNA, 21 nt, Human
gagucgcaucucagugcagga

SEQ ID NO: 1937463 - RNA, 16 nt, Human
gcagacuugaccccga

SEQ ID NO: 1937464 - RNA, 15 nt, Human
cuucugccugcaccc

SEQ ID NO: 1937465 - RNA, 19 nt, Human
acucuucaaggacuuucug

SEQ ID NO: 1937466 - RNA, 17 nt, Human
accugccacccugggcc

SEQ ID NO: 1937467 - RNA, 22 nt, Human
aacucuuaaucaaauagcauaa

SEQ ID NO: 1937468 - RNA, 21 nt, Human herpesvirus 4 [Epstein-Barr virus]
acaggccuggcggguggagau

SEQ ID NO: 1937469 - RNA, 13 nt, Human herpesvirus 4 [Epstein-Barr virus]
ugccgucccaggg

SEQ ID NO: 1937470 - RNA, 23 nt, Human herpesvirus 4 [Epstein-Barr virus]
ggcuucuuagaugaggagcaggc

SEQ ID NO: 1937471 - RNA, 14 nt, Human herpesvirus 4 [Epstein-Barr virus]
acucugaaaaugau

SEQ ID NO: 1937472 - RNA, 12 nt, Human herpesvirus 4 [Epstein-Barr virus]
ugaaucaggguc

SEQ ID NO: 1937473 - RNA, 19 nt, Human herpesvirus 4 [Epstein-Barr virus]
cugccaacuuugagcuggg

SEQ ID NO: 1937474 - RNA, 14 nt, Human herpesvirus 4 [Epstein-Barr virus]
augaacccuggggc

SEQ ID NO: 1937475 - RNA, 16 nt, Human herpesvirus 4 [Epstein-Barr virus]
cccgagaccggcuccg

SEQ ID NO: 1937476 - RNA, 15 nt, Human herpesvirus 4 [Epstein-Barr virus]
ugugaccgucuacau

SEQ ID NO: 1937477 - RNA, 22 nt, Human herpesvirus 4 [Epstein-Barr virus]
agcuacacucuggggucucagg

SEQ ID NO: 1937478 - RNA, 16 nt, Human herpesvirus 4 [Epstein-Barr virus]
cucucuggcugugcug

SEQ ID NO: 1937479 - RNA, 12 nt, Human herpesvirus 4 [Epstein-Barr virus]
gucccccuccau

SEQ ID NO: 1937480 - RNA, 13 nt, Human herpesvirus 4 [Epstein-Barr virus]
ccacacagcgcca

SEQ ID NO: 1937481 - RNA, 21 nt, Human herpesvirus 4 [Epstein-Barr virus]
cugggcauaaauucuccugcc

SEQ ID NO: 1937482 - RNA, 15 nt, Human herpesvirus 4 [Epstein-Barr virus]
aucccaggccucagc

SEQ ID NO: 1937483 - RNA, 14 nt, Human herpesvirus 4 [Epstein-Barr virus]
gcagagagccacau

SEQ ID NO: 1937484 - RNA, 20 nt, Human herpesvirus 4 [Epstein-Barr virus]
gggccagguacaggaccugg

SEQ ID NO: 1937485 - RNA, 15 nt, Human herpesvirus 4 [Epstein-Barr virus]
ucugacauuucucau

SEQ ID NO: 1937486 - RNA, 23 nt, Human herpesvirus 4 [Epstein-Barr virus]
cgcuucagcuccuugugcagcuu

SEQ ID NO: 1937487 - RNA, 23 nt, Human herpesvirus 4 [Epstein-Barr virus]
uguuucucagagagcauuucagg

SEQ ID NO: 1937488 - RNA, 18 nt, Human herpesvirus 4 [Epstein-Barr virus]
uccaugacgcugcugcua

SEQ ID NO: 1937489 - RNA, 15 nt, Human herpesvirus 4 [Epstein-Barr virus]
gcugguggccuggga

SEQ ID NO: 1937490 - RNA, 18 nt, Human herpesvirus 4 [Epstein-Barr virus]
gggcugguggccugggag

SEQ ID NO: 1937491 - RNA, 15 nt, Human herpesvirus 4 [Epstein-Barr virus]
cugcuacuacugccu

SEQ ID NO: 1937492 - RNA, 23 nt, Human herpesvirus 4 [Epstein-Barr virus]
gaaaggguuggcaguguggcccg

SEQ ID NO: 1937493 - RNA, 17 nt, Human herpesvirus 4 [Epstein-Barr virus]
cacauacaucccugucu

SEQ ID NO: 1937494 - RNA, 17 nt, Human herpesvirus 4 [Epstein-Barr virus]
agggagacacaucugga

SEQ ID NO: 1937495 - RNA, 13 nt, Human herpesvirus 4 [Epstein-Barr virus]
cgcugggccaggu

SEQ ID NO: 1937496 - RNA, 17 nt, Human herpesvirus 4 [Epstein-Barr virus]
cgccaugcucagggcca

SEQ ID NO: 1937497 - RNA, 17 nt, Human herpesvirus 4 [Epstein-Barr virus]
cgugcaaccaggcccac

SEQ ID NO: 1937498 - RNA, 14 nt, Human herpesvirus 4 [Epstein-Barr virus]
cucccguacccacc

SEQ ID NO: 1937499 - RNA, 23 nt, Human herpesvirus 4 [Epstein-Barr virus]
cugcccuagagguuuugcuaggg

SEQ ID NO: 1937500 - RNA, 14 nt, Human herpesvirus 4 [Epstein-Barr virus]
agccauuggcaugg

SEQ ID NO: 1937501 - RNA, 21 nt, Human herpesvirus 4 [Epstein-Barr virus]
ccugucucuuucuggccaacc

SEQ ID NO: 1937502 - RNA, 13 nt, Human herpesvirus 4 [Epstein-Barr virus]
agacuccugccug

SEQ ID NO: 1937503 - RNA, 23 nt, Human herpesvirus 4 [Epstein-Barr virus]
uggcuguacgccgccgccagcag

SEQ ID NO: 1937504 - RNA, 13 nt, Human herpesvirus 4 [Epstein-Barr virus]
acgacuguuccua

SEQ ID NO: 1937505 - RNA, 23 nt, Human herpesvirus 4 [Epstein-Barr virus]
gacacaggacuaaccaugccauc

SEQ ID NO: 1937506 - RNA, 22 nt, Human herpesvirus 4 [Epstein-Barr virus]
ugguguauuucuggccaucugu

SEQ ID NO: 1937507 - RNA, 10 nt, Human herpesvirus 4 [Epstein-Barr virus]
ucggcgccgc

SEQ ID NO: 1937508 - RNA, 18 nt, Human herpesvirus 4 [Epstein-Barr virus]
acaugcugaugugcugcc

SEQ ID NO: 1937509 - RNA, 22 nt, Human herpesvirus 4 [Epstein-Barr virus]
ccagccgggugcacacgcucag

SEQ ID NO: 1937510 - RNA, 13 nt, Human herpesvirus 4 [Epstein-Barr virus]
cagagccucugcc

SEQ ID NO: 1937511 - RNA, 18 nt, Human herpesvirus 4 [Epstein-Barr virus]
cccucugccuccggccgc

SEQ ID NO: 1937512 - RNA, 16 nt, Human herpesvirus 4 [Epstein-Barr virus]
cuccgcauccuaggca

SEQ ID NO: 1937513 - RNA, 22 nt, Human herpesvirus 4 [Epstein-Barr virus]
ugucuaacacgcuuuugucugc

SEQ ID NO: 1937514 - RNA, 16 nt, Human herpesvirus 4 [Epstein-Barr virus]
gucaaguaccagcugg

SEQ ID NO: 1937515 - RNA, 20 nt, Human herpesvirus 4 [Epstein-Barr virus]
ccgcauccuaggcacggccu

SEQ ID NO: 1937516 - RNA, 14 nt, Human herpesvirus 4 [Epstein-Barr virus]
ggugggguggugua

SEQ ID NO: 1937517 - RNA, 16 nt, Human herpesvirus 4 [Epstein-Barr virus]
gagaccaaggcggcug

SEQ ID NO: 1937518 - RNA, 14 nt, Human herpesvirus 4 [Epstein-Barr virus]
auggugcuggucuc

SEQ ID NO: 1937519 - RNA, 21 nt, Human herpesvirus 4 [Epstein-Barr virus]
gauggggcgcgcuucagcucc

SEQ ID NO: 1937520 - RNA, 16 nt, Human herpesvirus 4 [Epstein-Barr virus]
ggccucaaaguccugc

SEQ ID NO: 1937521 - RNA, 16 nt, Human herpesvirus 4 [Epstein-Barr virus]
cuggcagaaaggcugg

SEQ ID NO: 1937522 - RNA, 13 nt, Human herpesvirus 4 [Epstein-Barr virus]
auccaguggggcu

SEQ ID NO: 1937523 - RNA, 13 nt, Human herpesvirus 4 [Epstein-Barr virus]
caggcagaggaag

SEQ ID NO: 1937524 - RNA, 22 nt, Human herpesvirus 4 [Epstein-Barr virus]
ccaacgagggcagacaccaccu

SEQ ID NO: 1937525 - RNA, 14 nt, Human herpesvirus 4 [Epstein-Barr virus]
aggggcgagcagcg

SEQ ID NO: 1937526 - RNA, 19 nt, Human herpesvirus 4 [Epstein-Barr virus]
cucagcgucaggagagggc

SEQ ID NO: 1937527 - RNA, 13 nt, Human herpesvirus 4 [Epstein-Barr virus]
aaaaauucagacc

SEQ ID NO: 1937528 - RNA, 22 nt, Human herpesvirus 4 [Epstein-Barr virus]
aucuggcuggggcauuaacuaa

SEQ ID NO: 1937529 - RNA, 23 nt, Human herpesvirus 4 [Epstein-Barr virus]
acagcaauggcacggaugccugg

SEQ ID NO: 1937530 - RNA, 20 nt, Human herpesvirus 4 [Epstein-Barr virus]
accgcgcccuccucugggcc

SEQ ID NO: 1937531 - RNA, 16 nt, Human herpesvirus 4 [Epstein-Barr virus]
cugcugccgucccagg

SEQ ID NO: 1937532 - RNA, 11 nt, Human herpesvirus 4 [Epstein-Barr virus]
cuccauuccac

SEQ ID NO: 1937533 - RNA, 19 nt, Human herpesvirus 4 [Epstein-Barr virus]
guaggcuugauagcaguga

SEQ ID NO: 1937534 - RNA, 21 nt, Human herpesvirus 4 [Epstein-Barr virus]
caaguuuaagcaacugcugca

SEQ ID NO: 1937535 - RNA, 15 nt, Human herpesvirus 4 [Epstein-Barr virus]
aaauaaauguuacuu

SEQ ID NO: 1937536 - RNA, 17 nt, Human herpesvirus 4 [Epstein-Barr virus]
ugacuacaauguuccuu

SEQ ID NO: 1937537 - RNA, 21 nt, Human herpesvirus 4 [Epstein-Barr virus]
cccacugucacugugcacucu

SEQ ID NO: 1937538 - RNA, 19 nt, Human herpesvirus 4 [Epstein-Barr virus]
agcagauagccggccaggc

SEQ ID NO: 1937539 - RNA, 13 nt, Human herpesvirus 4 [Epstein-Barr virus]
aggcccaggaccu

SEQ ID NO: 1937540 - RNA, 23 nt, Human herpesvirus 4 [Epstein-Barr virus]
aguccugucucuuuguguucuug

SEQ ID NO: 1937541 - RNA, 14 nt, Human herpesvirus 4 [Epstein-Barr virus]
agacaccaggcgcc

SEQ ID NO: 1937542 - RNA, 22 nt, Human herpesvirus 4 [Epstein-Barr virus]
aggucugcgaugaggcgguggg

SEQ ID NO: 1937543 - RNA, 20 nt, Human herpesvirus 4 [Epstein-Barr virus]
cgugaauugugcccaccaga

SEQ ID NO: 1937544 - RNA, 14 nt, Human herpesvirus 4 [Epstein-Barr virus]
gccccggcuggcca

SEQ ID NO: 1937545 - RNA, 23 nt, Human herpesvirus 4 [Epstein-Barr virus]
accugucugauugcacccuggcc

SEQ ID NO: 1937546 - RNA, 21 nt, Human herpesvirus 4 [Epstein-Barr virus]
acagggguauguggugccaug

SEQ ID NO: 1937547 - RNA, 19 nt, Human herpesvirus 4 [Epstein-Barr virus]
ucuugauagggauccgcua

SEQ ID NO: 1937548 - RNA, 20 nt, Human herpesvirus 4 [Epstein-Barr virus]
gauuugcucuucgugcucuu

SEQ ID NO: 1937549 - RNA, 13 nt, Human herpesvirus 4 [Epstein-Barr virus]
uguuuuuggcaug

SEQ ID NO: 1937550 - RNA, 16 nt, Human herpesvirus 4 [Epstein-Barr virus]
cagcccggccgaggcc

SEQ ID NO: 1937551 - RNA, 23 nt, Human herpesvirus 4 [Epstein-Barr virus]
cauccugaagcgaagcagcuccg

SEQ ID NO: 1937552 - RNA, 21 nt, Human herpesvirus 4 [Epstein-Barr virus]
cggcccacgccauaccugcac

SEQ ID NO: 1937553 - RNA, 16 nt, Human herpesvirus 4 [Epstein-Barr virus]
cgacgcggugcugacc

SEQ ID NO: 1937554 - RNA, 17 nt, Human herpesvirus 4 [Epstein-Barr virus]
gacuacaauguuccuuc

SEQ ID NO: 1937555 - RNA, 19 nt, Human herpesvirus 4 [Epstein-Barr virus]
cacagaaacuacacggccu

SEQ ID NO: 1937556 - RNA, 17 nt, Human herpesvirus 4 [Epstein-Barr virus]
cagaccugaucagggaa

SEQ ID NO: 1937557 - RNA, 12 nt, Human herpesvirus 4 [Epstein-Barr virus]
cagggcaacacc

SEQ ID NO: 1937558 - RNA, 18 nt, Human herpesvirus 4 [Epstein-Barr virus]
accgaauggggcagugga

SEQ ID NO: 1937559 - RNA, 19 nt, Human herpesvirus 4 [Epstein-Barr virus]
cgggcaaacagggcagaga

SEQ ID NO: 1937560 - RNA, 13 nt, Human herpesvirus 4 [Epstein-Barr virus]
cuccuugugcagc

SEQ ID NO: 1937561 - RNA, 21 nt, Human herpesvirus 4 [Epstein-Barr virus]
gucucuuucuggccaaccugc

SEQ ID NO: 1937562 - RNA, 14 nt, Human herpesvirus 4 [Epstein-Barr virus]
gccacacuggggac

SEQ ID NO: 1937563 - RNA, 20 nt, Human herpesvirus 4 [Epstein-Barr virus]
gaccacauacaucccugucu

SEQ ID NO: 1937564 - RNA, 13 nt, Human herpesvirus 4 [Epstein-Barr virus]
ucgugcucuucau

SEQ ID NO: 1937565 - RNA, 21 nt, Human herpesvirus 4 [Epstein-Barr virus]
aucaaccugauucccccugcu

SEQ ID NO: 1937566 - RNA, 21 nt, Human herpesvirus 4 [Epstein-Barr virus]
ggcgccgcccgggggccaguc

SEQ ID NO: 1937567 - RNA, 13 nt, Human herpesvirus 4 [Epstein-Barr virus]
gccgcggcccagg

SEQ ID NO: 1937568 - RNA, 13 nt, Human herpesvirus 4 [Epstein-Barr virus]
gccggggcccacg

SEQ ID NO: 1937569 - RNA, 14 nt, Human herpesvirus 4 [Epstein-Barr virus]
ccucauuggcuuug

SEQ ID NO: 1937570 - RNA, 13 nt, Human herpesvirus 4 [Epstein-Barr virus]
ggcucauggaggg

SEQ ID NO: 1937571 - RNA, 15 nt, Human herpesvirus 4 [Epstein-Barr virus]
gauugaggcaauggc

SEQ ID NO: 1937572 - RNA, 19 nt, Human herpesvirus 4 [Epstein-Barr virus]
agaagugugucccccucca

SEQ ID NO: 1937573 - RNA, 16 nt, Human herpesvirus 4 [Epstein-Barr virus]
cauuuucguccuccca

SEQ ID NO: 1937574 - RNA, 18 nt, Human herpesvirus 4 [Epstein-Barr virus]
ggugaacacuugggcacg

SEQ ID NO: 1937575 - RNA, 23 nt, Human herpesvirus 4 [Epstein-Barr virus]
guagcccuuggaacugacgggca

SEQ ID NO: 1937576 - RNA, 16 nt, Human herpesvirus 4 [Epstein-Barr virus]
augaaaauguguauuc

SEQ ID NO: 1937577 - RNA, 22 nt, Human herpesvirus 4 [Epstein-Barr virus]
guggcagaaucaccagagccca

SEQ ID NO: 1937578 - RNA, 23 nt, Human herpesvirus 4 [Epstein-Barr virus]
cuuuccuagaaacugugccaugg

SEQ ID NO: 1937579 - RNA, 11 nt, Human herpesvirus 4 [Epstein-Barr virus]
cugacagagcc

SEQ ID NO: 1937580 - RNA, 20 nt, Human herpesvirus 4 [Epstein-Barr virus]
ucccguggagaguagggagg

SEQ ID NO: 1937581 - RNA, 19 nt, Human herpesvirus 4 [Epstein-Barr virus]
gcauuuuuggugcugccug

SEQ ID NO: 1937582 - RNA, 14 nt, Human herpesvirus 4 [Epstein-Barr virus]
gccagccaccccag

SEQ ID NO: 1937583 - RNA, 14 nt, Human herpesvirus 4 [Epstein-Barr virus]
ugagcuauguggaa

SEQ ID NO: 1937584 - RNA, 19 nt, Human herpesvirus 4 [Epstein-Barr virus]
ucacuaaaguuggucaggc

SEQ ID NO: 1937585 - RNA, 22 nt, Human herpesvirus 4 [Epstein-Barr virus]
agccacggcgucaaacagguga

SEQ ID NO: 1937586 - RNA, 14 nt, Human herpesvirus 4 [Epstein-Barr virus]
cgauaccgggucag

SEQ ID NO: 1937587 - RNA, 22 nt, Human herpesvirus 4 [Epstein-Barr virus]
caauaaaguugaugauauugaa

SEQ ID NO: 1937588 - RNA, 15 nt, Human herpesvirus 4 [Epstein-Barr virus]
uggcuguagccaccc

SEQ ID NO: 1937589 - RNA, 21 nt, Human herpesvirus 4 [Epstein-Barr virus]
gucgcuggcauacucuucauu

SEQ ID NO: 1937590 - RNA, 15 nt, Human herpesvirus 4 [Epstein-Barr virus]
cucuaucaaggaaac

SEQ ID NO: 1937591 - RNA, 18 nt, Human herpesvirus 4 [Epstein-Barr virus]
aggccccuuacuuccaca

SEQ ID NO: 1937592 - RNA, 15 nt, Human herpesvirus 4 [Epstein-Barr virus]
gaggaggaccuggug

SEQ ID NO: 1937593 - RNA, 19 nt, Human herpesvirus 4 [Epstein-Barr virus]
aguuacaccgucaacagau

SEQ ID NO: 1937594 - RNA, 15 nt, Human herpesvirus 4 [Epstein-Barr virus]
gacaccugcacgaga

SEQ ID NO: 1937595 - RNA, 13 nt, Human herpesvirus 4 [Epstein-Barr virus]
gaggagacgugug

SEQ ID NO: 1937596 - RNA, 22 nt, Human herpesvirus 4 [Epstein-Barr virus]
acaugggccacugcaggcugga

SEQ ID NO: 1937597 - RNA, 16 nt, Human herpesvirus 4 [Epstein-Barr virus]
cggcaccgccaggugg

SEQ ID NO: 1937598 - RNA, 15 nt, Human herpesvirus 4 [Epstein-Barr virus]
uggugggcuccuuag

SEQ ID NO: 1937599 - RNA, 20 nt, Human herpesvirus 4 [Epstein-Barr virus]
gggccacugcaggcuggacg

SEQ ID NO: 1937600 - RNA, 19 nt, Human herpesvirus 4 [Epstein-Barr virus]
caccauagcaugucacaca

SEQ ID NO: 1937601 - RNA, 18 nt, Human herpesvirus 4 [Epstein-Barr virus]
gaggauaaucugggcagc

SEQ ID NO: 1937602 - RNA, 19 nt, Human herpesvirus 4 [Epstein-Barr virus]
agaggccucugggguccag

SEQ ID NO: 1937603 - RNA, 18 nt, Human herpesvirus 4 [Epstein-Barr virus]
auagccggccaggcagag

SEQ ID NO: 1937604 - RNA, 20 nt, Human herpesvirus 4 [Epstein-Barr virus]
aggcuccuggaucuggggcu

SEQ ID NO: 1937605 - RNA, 21 nt, Human herpesvirus 4 [Epstein-Barr virus]
ggguggacagcagcguccugg

SEQ ID NO: 1937606 - RNA, 19 nt, Human herpesvirus 4 [Epstein-Barr virus]
cccggggguggaggcugcg

SEQ ID NO: 1937607 - RNA, 19 nt, Human herpesvirus 4 [Epstein-Barr virus]
gacuucauauguaugccuu

SEQ ID NO: 1937608 - RNA, 19 nt, Human herpesvirus 4 [Epstein-Barr virus]
aaugaacacucauggugug

SEQ ID NO: 1937609 - RNA, 15 nt, Human herpesvirus 4 [Epstein-Barr virus]
gaccaauacccagga

SEQ ID NO: 1937610 - RNA, 18 nt, Human herpesvirus 4 [Epstein-Barr virus]
cuccauuccacccacuga

SEQ ID NO: 1937611 - RNA, 18 nt, Human herpesvirus 4 [Epstein-Barr virus]
uggccuccagcucggcca

SEQ ID NO: 1937612 - RNA, 20 nt, Human herpesvirus 4 [Epstein-Barr virus]
cggagaucaucccacuggga

SEQ ID NO: 1937613 - RNA, 15 nt, Human herpesvirus 4 [Epstein-Barr virus]
gaaggacagggggac

SEQ ID NO: 1937614 - RNA, 13 nt, Human herpesvirus 4 [Epstein-Barr virus]
gucccugcugccc

SEQ ID NO: 1937615 - RNA, 22 nt, Human herpesvirus 4 [Epstein-Barr virus]
gcgacauguuucuggugagcca

SEQ ID NO: 1937616 - RNA, 14 nt, Human herpesvirus 4 [Epstein-Barr virus]
ccuggaagcaggag

SEQ ID NO: 1937617 - RNA, 20 nt, Human herpesvirus 4 [Epstein-Barr virus]
uccacgggaugacucaucuc

SEQ ID NO: 1937618 - RNA, 21 nt, Human herpesvirus 4 [Epstein-Barr virus]
cagugacgaagacccaucuga

SEQ ID NO: 1937619 - RNA, 16 nt, Human herpesvirus 4 [Epstein-Barr virus]
gggugaccuggcucag

SEQ ID NO: 1937620 - RNA, 13 nt, Human herpesvirus 4 [Epstein-Barr virus]
cuuuccaguuccc

SEQ ID NO: 1937621 - RNA, 18 nt, Human herpesvirus 4 [Epstein-Barr virus]
cguccccgggagcgggag

SEQ ID NO: 1937622 - RNA, 23 nt, Human herpesvirus 4 [Epstein-Barr virus]
gaagaagcccaccuaugugaccg

SEQ ID NO: 1937623 - RNA, 11 nt, Human herpesvirus 4 [Epstein-Barr virus]
gaaaaaccaga

SEQ ID NO: 1937624 - RNA, 16 nt, Human herpesvirus 4 [Epstein-Barr virus]
augccuuggcaugacg

SEQ ID NO: 1937625 - RNA, 11 nt, Human herpesvirus 4 [Epstein-Barr virus]
agagagccaca

SEQ ID NO: 1937626 - RNA, 18 nt, Human herpesvirus 4 [Epstein-Barr virus]
ugaccacucaggaagcug

SEQ ID NO: 1937627 - RNA, 15 nt, Human herpesvirus 4 [Epstein-Barr virus]
ccaccaccuccacca

SEQ ID NO: 1937628 - RNA, 17 nt, Human herpesvirus 4 [Epstein-Barr virus]
aguaccguugugaccgc

SEQ ID NO: 1937629 - RNA, 19 nt, Human herpesvirus 4 [Epstein-Barr virus]
auaauacgcccgacaauaa

SEQ ID NO: 1937630 - RNA, 21 nt, Human herpesvirus 4 [Epstein-Barr virus]
caggaggggcaggaggggcag

SEQ ID NO: 1937631 - RNA, 15 nt, Human herpesvirus 4 [Epstein-Barr virus]
agaucgugaggccug

SEQ ID NO: 1937632 - RNA, 23 nt, Human herpesvirus 4 [Epstein-Barr virus]
cagauuuccgucagccaggguga

SEQ ID NO: 1937633 - RNA, 16 nt, Human herpesvirus 4 [Epstein-Barr virus]
gcuccagggccagcaa

SEQ ID NO: 1937634 - RNA, 23 nt, Human herpesvirus 4 [Epstein-Barr virus]
gcccggggaaaagagagcugaug

SEQ ID NO: 1937635 - RNA, 13 nt, Human herpesvirus 4 [Epstein-Barr virus]
cuuguuucucaga

SEQ ID NO: 1937636 - RNA, 14 nt, Human herpesvirus 4 [Epstein-Barr virus]
cgccguccacucua

SEQ ID NO: 1937637 - RNA, 20 nt, Human herpesvirus 4 [Epstein-Barr virus]
ccaggcacaucuggcaccug

SEQ ID NO: 1937638 - RNA, 11 nt, Human herpesvirus 4 [Epstein-Barr virus]
aagcccaccua

SEQ ID NO: 1937639 - RNA, 17 nt, Human herpesvirus 4 [Epstein-Barr virus]
caucuacaauggcuggu

SEQ ID NO: 1937640 - RNA, 22 nt, Human herpesvirus 4 [Epstein-Barr virus]
uggucuccuucuuuaucuccau

SEQ ID NO: 1937641 - RNA, 21 nt, Human herpesvirus 4 [Epstein-Barr virus]
auccagugcgucagcaacugc

SEQ ID NO: 1937642 - RNA, 20 nt, Human herpesvirus 4 [Epstein-Barr virus]
gucgggagaacgaaggcgug

SEQ ID NO: 1937643 - RNA, 17 nt, Human herpesvirus 4 [Epstein-Barr virus]
cgagggugaggcccagc

SEQ ID NO: 1937644 - RNA, 18 nt, Human herpesvirus 4 [Epstein-Barr virus]
gcagugggccucucuggc

SEQ ID NO: 1937645 - RNA, 16 nt, Human herpesvirus 4 [Epstein-Barr virus]
cucauaccuccacuua

SEQ ID NO: 1937646 - RNA, 23 nt, Human herpesvirus 4 [Epstein-Barr virus]
gguuucaauuuugggagcuccag

SEQ ID NO: 1937647 - RNA, 22 nt, Human herpesvirus 4 [Epstein-Barr virus]
cauacgucuagccacauagcag

SEQ ID NO: 1937648 - RNA, 23 nt, Human herpesvirus 4 [Epstein-Barr virus]
acuuggaggcugcuaagccagga

SEQ ID NO: 1937649 - RNA, 18 nt, Human herpesvirus 4 [Epstein-Barr virus]
ccuggaagcaggagaugg

SEQ ID NO: 1937650 - RNA, 17 nt, Human herpesvirus 4 [Epstein-Barr virus]
gguguagccggggugga

SEQ ID NO: 1937651 - RNA, 20 nt, Human herpesvirus 4 [Epstein-Barr virus]
ugaaaccacgccugcuucac

SEQ ID NO: 1937652 - RNA, 16 nt, Human herpesvirus 4 [Epstein-Barr virus]
gucccugcugcccaug

SEQ ID NO: 1937653 - RNA, 14 nt, Human herpesvirus 4 [Epstein-Barr virus]
auucaucagaagcu

SEQ ID NO: 1937654 - RNA, 17 nt, Human herpesvirus 4 [Epstein-Barr virus]
aagcaacagguccucag

SEQ ID NO: 1937655 - RNA, 12 nt, Human herpesvirus 4 [Epstein-Barr virus]
gucacagcugcu

SEQ ID NO: 1937656 - RNA, 15 nt, Human herpesvirus 4 [Epstein-Barr virus]
cacaucuggcaccug

SEQ ID NO: 1937657 - RNA, 22 nt, Human herpesvirus 4 [Epstein-Barr virus]
cagagucuacucgaccagcacg

SEQ ID NO: 1937658 - RNA, 18 nt, Human herpesvirus 4 [Epstein-Barr virus]
uaucacccauggccaggc

SEQ ID NO: 1937659 - RNA, 15 nt, Human herpesvirus 4 [Epstein-Barr virus]
ugguugucuucccag

SEQ ID NO: 1937660 - RNA, 13 nt, Human herpesvirus 4 [Epstein-Barr virus]
gacccccccaagc

SEQ ID NO: 1937661 - RNA, 14 nt, Human herpesvirus 4 [Epstein-Barr virus]
cuggcccccaaccc

SEQ ID NO: 1937662 - RNA, 17 nt, Human herpesvirus 4 [Epstein-Barr virus]
ccaggucuugccguggc

SEQ ID NO: 1937663 - RNA, 23 nt, Human herpesvirus 4 [Epstein-Barr virus]
acgcucccgggcaaacagggcag

SEQ ID NO: 1937664 - RNA, 20 nt, Human herpesvirus 4 [Epstein-Barr virus]
cgguggaacaggagcaggag

SEQ ID NO: 1937665 - RNA, 21 nt, Human herpesvirus 4 [Epstein-Barr virus]
ggggaguaaggccgcugccag

SEQ ID NO: 1937666 - RNA, 13 nt, Human herpesvirus 4 [Epstein-Barr virus]
aguaggcgguggg

SEQ ID NO: 1937667 - RNA, 15 nt, Human herpesvirus 4 [Epstein-Barr virus]
uucucaaacaguccc

SEQ ID NO: 1937668 - RNA, 13 nt, Human herpesvirus 4 [Epstein-Barr virus]
aaugucaccacua

SEQ ID NO: 1937669 - RNA, 14 nt, Human herpesvirus 4 [Epstein-Barr virus]
uggugcuguccugc

SEQ ID NO: 1937670 - RNA, 21 nt, Human herpesvirus 4 [Epstein-Barr virus]
cgcggugguggcccucggugg

SEQ ID NO: 1937671 - RNA, 19 nt, Human herpesvirus 4 [Epstein-Barr virus]
ccagcaaaaccagcccggg

SEQ ID NO: 1937672 - RNA, 14 nt, Human herpesvirus 4 [Epstein-Barr virus]
ccgcagguggcugc

SEQ ID NO: 1937673 - RNA, 14 nt, Human herpesvirus 4 [Epstein-Barr virus]
uuugcuagggagga

SEQ ID NO: 1937674 - RNA, 14 nt, Human herpesvirus 4 [Epstein-Barr virus]
uguccagcagggcc

SEQ ID NO: 1937675 - RNA, 21 nt, Human herpesvirus 4 [Epstein-Barr virus]
cuggccuccuuaaauucaccu

SEQ ID NO: 1937676 - RNA, 14 nt, Human herpesvirus 4 [Epstein-Barr virus]
agccggggguugcu

SEQ ID NO: 1937677 - RNA, 15 nt, Human herpesvirus 4 [Epstein-Barr virus]
ucagccugcuccuga

SEQ ID NO: 1937678 - RNA, 20 nt, Human herpesvirus 4 [Epstein-Barr virus]
cucccuuagccacacugucu

SEQ ID NO: 1937679 - RNA, 18 nt, Human herpesvirus 4 [Epstein-Barr virus]
aguacuagcauggagagg

SEQ ID NO: 1937680 - RNA, 14 nt, Human herpesvirus 4 [Epstein-Barr virus]
cugcagguaaaccu

SEQ ID NO: 1937681 - RNA, 17 nt, Human herpesvirus 4 [Epstein-Barr virus]
ggcacgccguggcccug

SEQ ID NO: 1937682 - RNA, 13 nt, Human herpesvirus 4 [Epstein-Barr virus]
ccccaccaccccc

SEQ ID NO: 1937683 - RNA, 15 nt, Human herpesvirus 4 [Epstein-Barr virus]
cuuaugcuaacauuu

SEQ ID NO: 1937684 - RNA, 13 nt, Human herpesvirus 4 [Epstein-Barr virus]
gagccguggccuu

SEQ ID NO: 1937685 - RNA, 13 nt, Human herpesvirus 4 [Epstein-Barr virus]
ccgagaccaaggc

SEQ ID NO: 1937686 - RNA, 11 nt, Human herpesvirus 4 [Epstein-Barr virus]
gggccaggacc

SEQ ID NO: 1937687 - RNA, 19 nt, Human herpesvirus 4 [Epstein-Barr virus]
ccacuuuuaccccaguccc

SEQ ID NO: 1937688 - RNA, 12 nt, Human herpesvirus 4 [Epstein-Barr virus]
cggcguggagcu

SEQ ID NO: 1937689 - RNA, 15 nt, Human herpesvirus 4 [Epstein-Barr virus]
ggaccuguugcuuca

SEQ ID NO: 1937690 - RNA, 16 nt, Human herpesvirus 4 [Epstein-Barr virus]
aggacgcugcugucca

SEQ ID NO: 1937691 - RNA, 14 nt, Human herpesvirus 4 [Epstein-Barr virus]
gaucgauuggaaaa

SEQ ID NO: 1937692 - RNA, 18 nt, Human herpesvirus 4 [Epstein-Barr virus]
gcagguggcugcugccaa

SEQ ID NO: 1937693 - RNA, 19 nt, Human herpesvirus 4 [Epstein-Barr virus]
ccacugagcaagauccuuc

SEQ ID NO: 1937694 - RNA, 18 nt, Human herpesvirus 4 [Epstein-Barr virus]
auggggccaggacgcugc

SEQ ID NO: 1937695 - RNA, 17 nt, Human herpesvirus 4 [Epstein-Barr virus]
auuacggugcuggagau

SEQ ID NO: 1937696 - RNA, 12 nt, Human herpesvirus 4 [Epstein-Barr virus]
uggggcaauggc

SEQ ID NO: 1937697 - RNA, 21 nt, Human herpesvirus 4 [Epstein-Barr virus]
ccuccgcauccuaggcacggc

SEQ ID NO: 1937698 - RNA, 15 nt, Human herpesvirus 4 [Epstein-Barr virus]
ugggcgguccuccac

SEQ ID NO: 1937699 - RNA, 18 nt, Human herpesvirus 4 [Epstein-Barr virus]
ugccuggcgcuuugcuau

SEQ ID NO: 1937700 - RNA, 20 nt, Human herpesvirus 4 [Epstein-Barr virus]
cgccaucuacccaacagucu

SEQ ID NO: 1937701 - RNA, 16 nt, Human herpesvirus 4 [Epstein-Barr virus]
gugccucgguggccug

SEQ ID NO: 1937702 - RNA, 18 nt, Human herpesvirus 4 [Epstein-Barr virus]
cggccgccccgggcccgg

SEQ ID NO: 1937703 - RNA, 21 nt, Human herpesvirus 4 [Epstein-Barr virus]
cuugacgugcaaggauggaag

SEQ ID NO: 1937704 - RNA, 18 nt, Human herpesvirus 4 [Epstein-Barr virus]
cuacugccuuguccacug

SEQ ID NO: 1937705 - RNA, 13 nt, Human herpesvirus 4 [Epstein-Barr virus]
ugcagugggugag

SEQ ID NO: 1937706 - RNA, 19 nt, Human herpesvirus 4 [Epstein-Barr virus]
ccauaccuacaccacccca

SEQ ID NO: 1937707 - RNA, 17 nt, Human herpesvirus 4 [Epstein-Barr virus]
cuugugaaccagaaaga

SEQ ID NO: 1937708 - RNA, 18 nt, Human herpesvirus 4 [Epstein-Barr virus]
cugauggcaaagguccca

SEQ ID NO: 1937709 - RNA, 23 nt, Human herpesvirus 4 [Epstein-Barr virus]
cagagcugagugcccagggcaga

SEQ ID NO: 1937710 - RNA, 16 nt, Human herpesvirus 4 [Epstein-Barr virus]
acccaaugugcauggg

SEQ ID NO: 1937711 - RNA, 23 nt, Human herpesvirus 4 [Epstein-Barr virus]
aggggcgagcagcgcggcagagg

SEQ ID NO: 1937712 - RNA, 11 nt, Human herpesvirus 4 [Epstein-Barr virus]
ggugggcuggu

SEQ ID NO: 1937713 - RNA, 14 nt, Human herpesvirus 4 [Epstein-Barr virus]
gucuauccaggagg

SEQ ID NO: 1937714 - RNA, 18 nt, Human herpesvirus 4 [Epstein-Barr virus]
gucauggcggacugcgcc

SEQ ID NO: 1937715 - RNA, 13 nt, Human herpesvirus 4 [Epstein-Barr virus]
agagaggccucug

SEQ ID NO: 1937716 - RNA, 21 nt, Human herpesvirus 4 [Epstein-Barr virus]
cgggaguauggggccagaggc

SEQ ID NO: 1937717 - RNA, 20 nt, Human herpesvirus 4 [Epstein-Barr virus]
caguaugcucgaagcauugg

SEQ ID NO: 1937718 - RNA, 16 nt, Human herpesvirus 4 [Epstein-Barr virus]
ccucgguggugggcug

SEQ ID NO: 1937719 - RNA, 18 nt, Human herpesvirus 4 [Epstein-Barr virus]
cuaccucuuuuggcuggc

SEQ ID NO: 1937720 - RNA, 20 nt, Human herpesvirus 4 [Epstein-Barr virus]
caagaguuuaagcagcacug

SEQ ID NO: 1937721 - RNA, 22 nt, Human herpesvirus 4 [Epstein-Barr virus]
agcaggaggaggggcaggagca

SEQ ID NO: 1937722 - RNA, 21 nt, Human herpesvirus 4 [Epstein-Barr virus]
gcuguccgccaggacggagaa

SEQ ID NO: 1937723 - RNA, 16 nt, Human herpesvirus 4 [Epstein-Barr virus]
gucuauccaggaggag

SEQ ID NO: 1937724 - RNA, 12 nt, Human herpesvirus 4 [Epstein-Barr virus]
cggcacccaggc

SEQ ID NO: 1937725 - RNA, 18 nt, Human herpesvirus 4 [Epstein-Barr virus]
guuuguacuucuucucug

SEQ ID NO: 1937726 - RNA, 21 nt, Human herpesvirus 4 [Epstein-Barr virus]
cugccuggaucugagcuaugu

SEQ ID NO: 1937727 - RNA, 14 nt, Human herpesvirus 4 [Epstein-Barr virus]
cgccgccagcaugg

SEQ ID NO: 1937728 - RNA, 15 nt, Human herpesvirus 4 [Epstein-Barr virus]
ugguggguguggagc

SEQ ID NO: 1937729 - RNA, 22 nt, Human herpesvirus 4 [Epstein-Barr virus]
acuggucaccagcuucgagagc

SEQ ID NO: 1937730 - RNA, 18 nt, Human herpesvirus 4 [Epstein-Barr virus]
cucuucauguccacugag

SEQ ID NO: 1937731 - RNA, 15 nt, Human herpesvirus 4 [Epstein-Barr virus]
gaaacuggcuucugu

SEQ ID NO: 1937732 - RNA, 20 nt, Human herpesvirus 4 [Epstein-Barr virus]
ccgcagccgcugaagccagg

SEQ ID NO: 1937733 - RNA, 14 nt, Human herpesvirus 4 [Epstein-Barr virus]
gcguugccagacuc

SEQ ID NO: 1937734 - RNA, 16 nt, Human herpesvirus 4 [Epstein-Barr virus]
gcuucuggaccgugcc

SEQ ID NO: 1937735 - RNA, 17 nt, Human herpesvirus 4 [Epstein-Barr virus]
cggccaugcgcuuuguc

SEQ ID NO: 1937736 - RNA, 22 nt, Human herpesvirus 4 [Epstein-Barr virus]
agaccccggguugguggcacug

SEQ ID NO: 1937737 - RNA, 13 nt, Human herpesvirus 4 [Epstein-Barr virus]
caaggcccuagcc

SEQ ID NO: 1937738 - RNA, 17 nt, Human herpesvirus 4 [Epstein-Barr virus]
agcgugugcacccggcu

SEQ ID NO: 1937739 - RNA, 22 nt, Human herpesvirus 4 [Epstein-Barr virus]
gaugaggcugaugauggccacg

SEQ ID NO: 1937740 - RNA, 18 nt, Human herpesvirus 4 [Epstein-Barr virus]
gccuucuccucagccucc

SEQ ID NO: 1937741 - RNA, 12 nt, Human herpesvirus 4 [Epstein-Barr virus]
ggaggaagaugg

SEQ ID NO: 1937742 - RNA, 23 nt, Human herpesvirus 4 [Epstein-Barr virus]
ugagccacuccggacgcagaggc

SEQ ID NO: 1937743 - RNA, 22 nt, Human herpesvirus 4 [Epstein-Barr virus]
gagcaggagcgggaggggcagg

SEQ ID NO: 1937744 - RNA, 21 nt, Human herpesvirus 4 [Epstein-Barr virus]
cauauucuauuucaaaacaag

SEQ ID NO: 1937745 - RNA, 23 nt, Human herpesvirus 4 [Epstein-Barr virus]
aggggccagguacaggaccugga

SEQ ID NO: 1937746 - RNA, 22 nt, Human herpesvirus 4 [Epstein-Barr virus]
agcaguagcuugggaacaccgg

SEQ ID NO: 1937747 - RNA, 13 nt, Human herpesvirus 4 [Epstein-Barr virus]
agaaccccagcaa

SEQ ID NO: 1937748 - RNA, 15 nt, Human herpesvirus 4 [Epstein-Barr virus]
uuuccgucagccagg

SEQ ID NO: 1937749 - RNA, 21 nt, Human herpesvirus 4 [Epstein-Barr virus]
cagccuacucuccacucccag

SEQ ID NO: 1937750 - RNA, 14 nt, Human herpesvirus 4 [Epstein-Barr virus]
agacucuccgcuuu

SEQ ID NO: 1937751 - RNA, 12 nt, Human herpesvirus 4 [Epstein-Barr virus]
uuucuguacaau

SEQ ID NO: 1937752 - RNA, 13 nt, Human herpesvirus 4 [Epstein-Barr virus]
gcuagcgucacug

SEQ ID NO: 1937753 - RNA, 21 nt, Human herpesvirus 4 [Epstein-Barr virus]
accgcgaccaagacucaauuu

SEQ ID NO: 1937754 - RNA, 16 nt, Human herpesvirus 4 [Epstein-Barr virus]
aacuggucaccagcuu

SEQ ID NO: 1937755 - RNA, 17 nt, Human herpesvirus 4 [Epstein-Barr virus]
ggggcaggaggggcagg

SEQ ID NO: 1937756 - RNA, 19 nt, Human herpesvirus 4 [Epstein-Barr virus]
uugaagguggaggggggcg

SEQ ID NO: 1937757 - RNA, 19 nt, Human herpesvirus 4 [Epstein-Barr virus]
aggucgacccuccugucac

SEQ ID NO: 1937758 - RNA, 17 nt, Human herpesvirus 4 [Epstein-Barr virus]
accuucaccaccacccc

SEQ ID NO: 1937759 - RNA, 11 nt, Human herpesvirus 4 [Epstein-Barr virus]
cggacacaccg

SEQ ID NO: 1937760 - RNA, 22 nt, Human herpesvirus 4 [Epstein-Barr virus]
guucaguggacacccaccacac

SEQ ID NO: 1937761 - RNA, 20 nt, Human herpesvirus 4 [Epstein-Barr virus]
ccucgugcaaccaggcccac

SEQ ID NO: 1937762 - RNA, 17 nt, Human herpesvirus 4 [Epstein-Barr virus]
ggcuggugggcucccuc

SEQ ID NO: 1937763 - RNA, 14 nt, Human herpesvirus 4 [Epstein-Barr virus]
gccuccagagcccc

SEQ ID NO: 1937764 - RNA, 22 nt, Human herpesvirus 4 [Epstein-Barr virus]
gcaccuguccuugucugcugcc

SEQ ID NO: 1937765 - RNA, 20 nt, Human herpesvirus 4 [Epstein-Barr virus]
ccacgcuccgcgcucggccu

SEQ ID NO: 1937766 - RNA, 16 nt, Human herpesvirus 4 [Epstein-Barr virus]
ggaggccccggccgcc

SEQ ID NO: 1937767 - RNA, 22 nt, Human herpesvirus 4 [Epstein-Barr virus]
gagccugccggaguuuucuccc

SEQ ID NO: 1937768 - RNA, 16 nt, Human herpesvirus 4 [Epstein-Barr virus]
augaaggugucauuga

SEQ ID NO: 1937769 - RNA, 19 nt, Human herpesvirus 4 [Epstein-Barr virus]
caaggauggaagagagggg

SEQ ID NO: 1937770 - RNA, 17 nt, Human herpesvirus 4 [Epstein-Barr virus]
cguuggcuucugcugcu

SEQ ID NO: 1937771 - RNA, 15 nt, Human herpesvirus 4 [Epstein-Barr virus]
uugugcuuguacuga

SEQ ID NO: 1937772 - RNA, 21 nt, Human herpesvirus 4 [Epstein-Barr virus]
uacacucuggggucucaggcc

SEQ ID NO: 1937773 - RNA, 15 nt, Human herpesvirus 4 [Epstein-Barr virus]
guccagauguccagg

SEQ ID NO: 1937774 - RNA, 22 nt, Human herpesvirus 4 [Epstein-Barr virus]
accgcagccacguccagacucc

SEQ ID NO: 1937775 - RNA, 20 nt, Human herpesvirus 4 [Epstein-Barr virus]
gcccgcaccccccgccacca

SEQ ID NO: 1937776 - RNA, 16 nt, Human herpesvirus 4 [Epstein-Barr virus]
ucuagcaggugcacca

SEQ ID NO: 1937777 - RNA, 19 nt, Human herpesvirus 4 [Epstein-Barr virus]
cugcgaugagggccuucca

SEQ ID NO: 1937778 - RNA, 21 nt, Human herpesvirus 4 [Epstein-Barr virus]
caccuguccuugucugcugcc

SEQ ID NO: 1937779 - RNA, 13 nt, Human herpesvirus 4 [Epstein-Barr virus]
uuccuugccaucu

SEQ ID NO: 1937780 - RNA, 15 nt, Human herpesvirus 4 [Epstein-Barr virus]
gucacugugcacucu

SEQ ID NO: 1937781 - RNA, 20 nt, Human herpesvirus 4 [Epstein-Barr virus]
gccucucuuaugccuguggc

SEQ ID NO: 1937782 - RNA, 14 nt, Human herpesvirus 4 [Epstein-Barr virus]
uacggcuuuccagu

SEQ ID NO: 1937783 - RNA, 14 nt, Human herpesvirus 4 [Epstein-Barr virus]
gggucagugaugga

SEQ ID NO: 1937784 - RNA, 20 nt, Human herpesvirus 4 [Epstein-Barr virus]
gacguguguggcuguagcca

SEQ ID NO: 1937785 - RNA, 15 nt, Human herpesvirus 4 [Epstein-Barr virus]
cccagccccuccucu

SEQ ID NO: 1937786 - RNA, 17 nt, Human herpesvirus 4 [Epstein-Barr virus]
cuccacaccaaauaaac

SEQ ID NO: 1937787 - RNA, 23 nt, Human herpesvirus 4 [Epstein-Barr virus]
gccaaaauuggugccuugcucuc

SEQ ID NO: 1937788 - RNA, 14 nt, Human herpesvirus 4 [Epstein-Barr virus]
gcaccagggccagg

SEQ ID NO: 1937789 - RNA, 16 nt, Human herpesvirus 4 [Epstein-Barr virus]
gugguuucggacacac

SEQ ID NO: 1937790 - RNA, 18 nt, Human herpesvirus 4 [Epstein-Barr virus]
gcugacccuucugcugcu

SEQ ID NO: 1937791 - RNA, 18 nt, Human herpesvirus 4 [Epstein-Barr virus]
uccgcgcuaaucgcuggu

SEQ ID NO: 1937792 - RNA, 17 nt, Human herpesvirus 4 [Epstein-Barr virus]
gcaccuugccggccacc

SEQ ID NO: 1937793 - RNA, 17 nt, Human herpesvirus 4 [Epstein-Barr virus]
uggcagaaaggcuggcc

SEQ ID NO: 1937794 - RNA, 16 nt, Human herpesvirus 4 [Epstein-Barr virus]
uguaaucgcagcucua

SEQ ID NO: 1937795 - RNA, 21 nt, Human herpesvirus 4 [Epstein-Barr virus]
gcccugagcuggacgaggucc

SEQ ID NO: 1937796 - RNA, 18 nt, Human herpesvirus 4 [Epstein-Barr virus]
aggccaaauggagacugc

SEQ ID NO: 1937797 - RNA, 23 nt, Human herpesvirus 4 [Epstein-Barr virus]
cguccaucuugagcgccguggcc

SEQ ID NO: 1937798 - RNA, 13 nt, Human herpesvirus 4 [Epstein-Barr virus]
ugggcuuggguca

SEQ ID NO: 1937799 - RNA, 18 nt, Human herpesvirus 4 [Epstein-Barr virus]
cggccugaauuccccugc

SEQ ID NO: 1937800 - RNA, 18 nt, Human herpesvirus 4 [Epstein-Barr virus]
gcgcugggacugccuggg

SEQ ID NO: 1937801 - RNA, 21 nt, Human herpesvirus 4 [Epstein-Barr virus]
uccccgagggugaggcccagc

SEQ ID NO: 1937802 - RNA, 14 nt, Human herpesvirus 4 [Epstein-Barr virus]
acagcgccagcagg

SEQ ID NO: 1937803 - RNA, 16 nt, Human herpesvirus 4 [Epstein-Barr virus]
ugaagauccaacuccg

SEQ ID NO: 1937804 - RNA, 16 nt, Human herpesvirus 4 [Epstein-Barr virus]
acccugguacaggacc

SEQ ID NO: 1937805 - RNA, 17 nt, Human herpesvirus 4 [Epstein-Barr virus]
cagcuggugguccgcau

SEQ ID NO: 1937806 - RNA, 15 nt, Human herpesvirus 4 [Epstein-Barr virus]
ccgccgccagcagcc

SEQ ID NO: 1937807 - RNA, 15 nt, Human herpesvirus 4 [Epstein-Barr virus]
agaaguguguccccc

SEQ ID NO: 1937808 - RNA, 21 nt, Human herpesvirus 4 [Epstein-Barr virus]
auuccccggggacaccugcac

SEQ ID NO: 1937809 - RNA, 16 nt, Human herpesvirus 4 [Epstein-Barr virus]
gcauccgcaccacaga

SEQ ID NO: 1937810 - RNA, 18 nt, Human herpesvirus 4 [Epstein-Barr virus]
gacacgcuccuucuuggc

SEQ ID NO: 1937811 - RNA, 15 nt, Human herpesvirus 4 [Epstein-Barr virus]
uacaaacccaacaau

SEQ ID NO: 1937812 - RNA, 17 nt, Human herpesvirus 4 [Epstein-Barr virus]
gccgcaccacgggaggc

SEQ ID NO: 1937813 - RNA, 14 nt, Human herpesvirus 4 [Epstein-Barr virus]
gagcuauguggaaa

SEQ ID NO: 1937814 - RNA, 15 nt, Human herpesvirus 4 [Epstein-Barr virus]
acagauacaaaaacu

SEQ ID NO: 1937815 - RNA, 17 nt, Human herpesvirus 4 [Epstein-Barr virus]
cacucccuuagccacac

SEQ ID NO: 1937816 - RNA, 18 nt, Human herpesvirus 4 [Epstein-Barr virus]
cccgccagcgccuccucg

SEQ ID NO: 1937817 - RNA, 16 nt, Human herpesvirus 4 [Epstein-Barr virus]
aggccagguagcccag

SEQ ID NO: 1937818 - RNA, 13 nt, Human herpesvirus 4 [Epstein-Barr virus]
cgccagcgccucc

SEQ ID NO: 1937819 - RNA, 16 nt, Human herpesvirus 4 [Epstein-Barr virus]
gccugccaaagagcca

SEQ ID NO: 1937820 - RNA, 17 nt, Human herpesvirus 4 [Epstein-Barr virus]
ccgacgagcagaggacu

SEQ ID NO: 1937821 - RNA, 20 nt, Human herpesvirus 4 [Epstein-Barr virus]
gggucaagcaaacggccugg

SEQ ID NO: 1937822 - RNA, 13 nt, Human herpesvirus 4 [Epstein-Barr virus]
cacuccaccugcc

SEQ ID NO: 1937823 - RNA, 14 nt, Human herpesvirus 4 [Epstein-Barr virus]
aauguccagugggg

SEQ ID NO: 1937824 - RNA, 21 nt, Human herpesvirus 4 [Epstein-Barr virus]
uguuucucagagagcauuuca

SEQ ID NO: 1937825 - RNA, 16 nt, Human herpesvirus 4 [Epstein-Barr virus]
ucuacucgaccagcac

SEQ ID NO: 1937826 - RNA, 17 nt, Human herpesvirus 4 [Epstein-Barr virus]
agacacggcucugucag

SEQ ID NO: 1937827 - RNA, 23 nt, Human herpesvirus 4 [Epstein-Barr virus]
cagaccccggguugguggcacug

SEQ ID NO: 1937828 - RNA, 18 nt, Human herpesvirus 4 [Epstein-Barr virus]
cccacugaaaaaccagac

SEQ ID NO: 1937829 - RNA, 14 nt, Human herpesvirus 4 [Epstein-Barr virus]
uggcauucagauuu

SEQ ID NO: 1937830 - RNA, 14 nt, Human herpesvirus 4 [Epstein-Barr virus]
cauguuuuuggcau

SEQ ID NO: 1937831 - RNA, 14 nt, Human herpesvirus 4 [Epstein-Barr virus]
ccuucuuccuagcc

SEQ ID NO: 1937832 - RNA, 19 nt, Human herpesvirus 4 [Epstein-Barr virus]
uacugcgaugagggccuuc

SEQ ID NO: 1937833 - RNA, 17 nt, Human herpesvirus 4 [Epstein-Barr virus]
gcaaacagggcagagag

SEQ ID NO: 1937834 - RNA, 21 nt, Human herpesvirus 4 [Epstein-Barr virus]
cgcccgccuggcucgccugga

SEQ ID NO: 1937835 - RNA, 17 nt, Human herpesvirus 4 [Epstein-Barr virus]
caacccuaacacucuuu

SEQ ID NO: 1937836 - RNA, 19 nt, Human herpesvirus 4 [Epstein-Barr virus]
cucgaagcggucucagaca

SEQ ID NO: 1937837 - RNA, 19 nt, Human herpesvirus 4 [Epstein-Barr virus]
gaacguggagguugucaaa

SEQ ID NO: 1937838 - RNA, 18 nt, Human herpesvirus 4 [Epstein-Barr virus]
caggcacaucuggcaccu

SEQ ID NO: 1937839 - RNA, 15 nt, Human herpesvirus 4 [Epstein-Barr virus]
cgggagccggcggcc

SEQ ID NO: 1937840 - RNA, 21 nt, Human herpesvirus 4 [Epstein-Barr virus]
cgugggaaaauaguuccaggu

SEQ ID NO: 1937841 - RNA, 13 nt, Human herpesvirus 4 [Epstein-Barr virus]
agcggcugugagc

SEQ ID NO: 1937842 - RNA, 13 nt, Human herpesvirus 4 [Epstein-Barr virus]
gcaacugcugcag

SEQ ID NO: 1937843 - RNA, 23 nt, Human herpesvirus 4 [Epstein-Barr virus]
cauucacggggccgugcaccugc

SEQ ID NO: 1937844 - RNA, 16 nt, Human herpesvirus 4 [Epstein-Barr virus]
agcucaccuaugguca

SEQ ID NO: 1937845 - RNA, 19 nt, Human herpesvirus 4 [Epstein-Barr virus]
uguaacugugguuuccaug

SEQ ID NO: 1937846 - RNA, 23 nt, Human herpesvirus 4 [Epstein-Barr virus]
ucucuaaucccucugggagaagg

SEQ ID NO: 1937847 - RNA, 16 nt, Human herpesvirus 4 [Epstein-Barr virus]
aggccaauuggcacuc

SEQ ID NO: 1937848 - RNA, 20 nt, Human herpesvirus 4 [Epstein-Barr virus]
aggugguuauuuugggccag

SEQ ID NO: 1937849 - RNA, 16 nt, Human herpesvirus 4 [Epstein-Barr virus]
uugucggagguggaga

SEQ ID NO: 1937850 - RNA, 12 nt, Human herpesvirus 4 [Epstein-Barr virus]
gcgcugggacug

SEQ ID NO: 1937851 - RNA, 14 nt, Human herpesvirus 4 [Epstein-Barr virus]
cacaucuggaccug

SEQ ID NO: 1937852 - RNA, 17 nt, Human herpesvirus 4 [Epstein-Barr virus]
cccagacucugcuuucu

SEQ ID NO: 1937853 - RNA, 18 nt, Human herpesvirus 4 [Epstein-Barr virus]
ggguauucucagaugcag

SEQ ID NO: 1937854 - RNA, 14 nt, Human herpesvirus 4 [Epstein-Barr virus]
uggacacccacccu

SEQ ID NO: 1937855 - RNA, 15 nt, Human herpesvirus 4 [Epstein-Barr virus]
auauccuagagggac

SEQ ID NO: 1937856 - RNA, 16 nt, Human herpesvirus 4 [Epstein-Barr virus]
caugcuugggcaugcu

SEQ ID NO: 1937857 - RNA, 19 nt, Human herpesvirus 4 [Epstein-Barr virus]
auccaguaugccugccugu

SEQ ID NO: 1937858 - RNA, 15 nt, Human herpesvirus 4 [Epstein-Barr virus]
acucccgaggcacuu

SEQ ID NO: 1937859 - RNA, 20 nt, Human herpesvirus 4 [Epstein-Barr virus]
agcaagauccuucuggcacg

SEQ ID NO: 1937860 - RNA, 16 nt, Human herpesvirus 4 [Epstein-Barr virus]
aaucuaaugaagagcc

SEQ ID NO: 1937861 - RNA, 19 nt, Human herpesvirus 4 [Epstein-Barr virus]
gggccauucgugaguccag

SEQ ID NO: 1937862 - RNA, 12 nt, Human herpesvirus 4 [Epstein-Barr virus]
acgcgauggcac

SEQ ID NO: 1937863 - RNA, 16 nt, Human herpesvirus 4 [Epstein-Barr virus]
acccccaccaccucca

SEQ ID NO: 1937864 - RNA, 18 nt, Human herpesvirus 4 [Epstein-Barr virus]
uccucugggccgcccggc

SEQ ID NO: 1937865 - RNA, 15 nt, Human herpesvirus 4 [Epstein-Barr virus]
agaagacuccugccu

SEQ ID NO: 1937866 - RNA, 23 nt, Human herpesvirus 4 [Epstein-Barr virus]
gucacugagaaucuccugugcuu

SEQ ID NO: 1937867 - RNA, 17 nt, Human herpesvirus 4 [Epstein-Barr virus]
gcaggagcaggagcggg

SEQ ID NO: 1937868 - RNA, 21 nt, Human herpesvirus 4 [Epstein-Barr virus]
cccugaacaucucauccccag

SEQ ID NO: 1937869 - RNA, 16 nt, Human herpesvirus 4 [Epstein-Barr virus]
caauggucgccagggu

SEQ ID NO: 1937870 - RNA, 15 nt, Human herpesvirus 4 [Epstein-Barr virus]
caggacgcugcuguc

SEQ ID NO: 1937871 - RNA, 15 nt, Human herpesvirus 4 [Epstein-Barr virus]
ugaggcugaugaugg

SEQ ID NO: 1937872 - RNA, 14 nt, Human herpesvirus 4 [Epstein-Barr virus]
gaggcccacugcag

SEQ ID NO: 1937873 - RNA, 16 nt, Human herpesvirus 4 [Epstein-Barr virus]
acugaccacucaggaa

SEQ ID NO: 1937874 - RNA, 22 nt, Human herpesvirus 4 [Epstein-Barr virus]
gucugccgcguguuugcugcuc

SEQ ID NO: 1937875 - RNA, 16 nt, Human herpesvirus 4 [Epstein-Barr virus]
gccuugggggccugga

SEQ ID NO: 1937876 - RNA, 17 nt, Human herpesvirus 4 [Epstein-Barr virus]
uggggucucaggccucc

SEQ ID NO: 1937877 - RNA, 22 nt, Human herpesvirus 4 [Epstein-Barr virus]
gaacugggaugaacccuggggc

SEQ ID NO: 1937878 - RNA, 17 nt, Human herpesvirus 4 [Epstein-Barr virus]
ccugcacggcccuccag

SEQ ID NO: 1937879 - RNA, 19 nt, Human herpesvirus 4 [Epstein-Barr virus]
gcagcggacgguggggcuc

SEQ ID NO: 1937880 - RNA, 22 nt, Human herpesvirus 4 [Epstein-Barr virus]
augaauccaguaugccugccug

SEQ ID NO: 1937881 - RNA, 14 nt, Human herpesvirus 4 [Epstein-Barr virus]
uccccggccucccg

SEQ ID NO: 1937882 - RNA, 24 nt, Human herpesvirus 4 [Epstein-Barr virus]
cccccugcaggacacgugacaugu

SEQ ID NO: 1937883 - RNA, 16 nt, Human herpesvirus 4 [Epstein-Barr virus]
aucuggaccagaaggc

SEQ ID NO: 1937884 - RNA, 19 nt, Human herpesvirus 4 [Epstein-Barr virus]
cugaacaucucauccccag

SEQ ID NO: 1937885 - RNA, 18 nt, Human herpesvirus 4 [Epstein-Barr virus]
aguagcacugguggugga

SEQ ID NO: 1937886 - RNA, 21 nt, Human herpesvirus 4 [Epstein-Barr virus]
caggugcaccagcuccaggga

SEQ ID NO: 1937887 - RNA, 19 nt, Human herpesvirus 4 [Epstein-Barr virus]
gccucugccgcgcugcucg

SEQ ID NO: 1937888 - RNA, 14 nt, Human herpesvirus 4 [Epstein-Barr virus]
gcaggccuggacag

SEQ ID NO: 1937889 - RNA, 22 nt, Human herpesvirus 4 [Epstein-Barr virus]
ugcgcgcccugucaccaggccu

SEQ ID NO: 1937890 - RNA, 13 nt, Human herpesvirus 4 [Epstein-Barr virus]
ugaggacucugaa

SEQ ID NO: 1937891 - RNA, 17 nt, Human herpesvirus 4 [Epstein-Barr virus]
cuauagugagccaggcu

SEQ ID NO: 1937892 - RNA, 20 nt, Human herpesvirus 4 [Epstein-Barr virus]
ccuggccagggcggaggaga

SEQ ID NO: 1937893 - RNA, 20 nt, Human herpesvirus 4 [Epstein-Barr virus]
acgcucucuauguugucaca

SEQ ID NO: 1937894 - RNA, 15 nt, Human herpesvirus 4 [Epstein-Barr virus]
gcggagagggauggg

SEQ ID NO: 1937895 - RNA, 18 nt, Human herpesvirus 4 [Epstein-Barr virus]
ucucccacccuguacacc

SEQ ID NO: 1937896 - RNA, 19 nt, Human herpesvirus 4 [Epstein-Barr virus]
aucucauccccagagggcg

SEQ ID NO: 1937897 - RNA, 24 nt, Human herpesvirus 4 [Epstein-Barr virus]
ggcccagugcacccagguggucuu

SEQ ID NO: 1937898 - RNA, 18 nt, Human herpesvirus 4 [Epstein-Barr virus]
gcacuuucuuugcuucac

SEQ ID NO: 1937899 - RNA, 19 nt, Human herpesvirus 4 [Epstein-Barr virus]
guccaagagaaugacagca

SEQ ID NO: 1937900 - RNA, 19 nt, Human herpesvirus 4 [Epstein-Barr virus]
uccugcucauuauugcucu

SEQ ID NO: 1937901 - RNA, 17 nt, Human herpesvirus 4 [Epstein-Barr virus]
caagcaaacggccuggc

SEQ ID NO: 1937902 - RNA, 16 nt, Human herpesvirus 4 [Epstein-Barr virus]
cagccgcugaagccag

SEQ ID NO: 1937903 - RNA, 17 nt, Human herpesvirus 4 [Epstein-Barr virus]
ccaaggacaacagcuag

SEQ ID NO: 1937904 - RNA, 17 nt, Human herpesvirus 4 [Epstein-Barr virus]
guagccccuaggccugc

SEQ ID NO: 1937905 - RNA, 18 nt, Human herpesvirus 4 [Epstein-Barr virus]
ggcgauaccuugggcauc

SEQ ID NO: 1937906 - RNA, 14 nt, Human herpesvirus 4 [Epstein-Barr virus]
uggaaacccucagu

SEQ ID NO: 1937907 - RNA, 23 nt, Human herpesvirus 4 [Epstein-Barr virus]
cgucccagggccggaaccugagc

SEQ ID NO: 1937908 - RNA, 15 nt, Human herpesvirus 4 [Epstein-Barr virus]
cuaaggcaguccagg

SEQ ID NO: 1937909 - RNA, 19 nt, Human herpesvirus 4 [Epstein-Barr virus]
gccuagccaucggggcacg

SEQ ID NO: 1937910 - RNA, 14 nt, Human herpesvirus 4 [Epstein-Barr virus]
cggccgaggccugc

SEQ ID NO: 1937911 - RNA, 17 nt, Human herpesvirus 4 [Epstein-Barr virus]
cgagccccgccuggcgg

SEQ ID NO: 1937912 - RNA, 21 nt, Human herpesvirus 4 [Epstein-Barr virus]
cgagccugucgauaucccugc

SEQ ID NO: 1937913 - RNA, 22 nt, Human herpesvirus 4 [Epstein-Barr virus]
gacauccccagacucaccccca

SEQ ID NO: 1937914 - RNA, 21 nt, Human herpesvirus 4 [Epstein-Barr virus]
ggacaugcugaugugcugccc

SEQ ID NO: 1937915 - RNA, 18 nt, Human herpesvirus 4 [Epstein-Barr virus]
gacgggguggugccuggu

SEQ ID NO: 1937916 - RNA, 20 nt, Human herpesvirus 4 [Epstein-Barr virus]
gccccgaaagcggcccagca

SEQ ID NO: 1937917 - RNA, 13 nt, Human herpesvirus 4 [Epstein-Barr virus]
uuguucuuuggag

SEQ ID NO: 1937918 - RNA, 15 nt, Human herpesvirus 4 [Epstein-Barr virus]
uagcccacuccccuc

SEQ ID NO: 1937919 - RNA, 20 nt, Human herpesvirus 4 [Epstein-Barr virus]
caccagcuaacaggacaugu

SEQ ID NO: 1937920 - RNA, 18 nt, Human herpesvirus 4 [Epstein-Barr virus]
gcaguagcuugggaacac

SEQ ID NO: 1937921 - RNA, 20 nt, Human herpesvirus 4 [Epstein-Barr virus]
cgaugccucuacgccccaga

SEQ ID NO: 1937922 - RNA, 13 nt, Human herpesvirus 4 [Epstein-Barr virus]
uuucuuugcuuca

SEQ ID NO: 1937923 - RNA, 18 nt, Human herpesvirus 4 [Epstein-Barr virus]
gcgucgggaaacacagcu

SEQ ID NO: 1937924 - RNA, 15 nt, Human herpesvirus 4 [Epstein-Barr virus]
auggcaaagguccca

SEQ ID NO: 1937925 - RNA, 13 nt, Human herpesvirus 4 [Epstein-Barr virus]
ccugagccacacc

SEQ ID NO: 1937926 - RNA, 13 nt, Human herpesvirus 4 [Epstein-Barr virus]
uuucugaccuuua

SEQ ID NO: 1937927 - RNA, 21 nt, Human herpesvirus 4 [Epstein-Barr virus]
cugauaaaguuguccugggcu

SEQ ID NO: 1937928 - RNA, 14 nt, Human herpesvirus 4 [Epstein-Barr virus]
uaccaggcauacag

SEQ ID NO: 1937929 - RNA, 16 nt, Human herpesvirus 4 [Epstein-Barr virus]
cgcggaaucaggacca

SEQ ID NO: 1937930 - RNA, 23 nt, Human herpesvirus 4 [Epstein-Barr virus]
cggggcuaaccaaggacaacagc

SEQ ID NO: 1937931 - RNA, 15 nt, Human herpesvirus 4 [Epstein-Barr virus]
aagaguucucuggug

SEQ ID NO: 1937932 - RNA, 17 nt, Human herpesvirus 4 [Epstein-Barr virus]
ggcaaacagggcagaga

SEQ ID NO: 1937933 - RNA, 14 nt, Human herpesvirus 4 [Epstein-Barr virus]
ggaaugugugacau

SEQ ID NO: 1937934 - RNA, 17 nt, Human herpesvirus 4 [Epstein-Barr virus]
gugcccaccagagggug

SEQ ID NO: 1937935 - RNA, 20 nt, Human herpesvirus 4 [Epstein-Barr virus]
aggucgugguacuugaccag

SEQ ID NO: 1937936 - RNA, 19 nt, Human herpesvirus 4 [Epstein-Barr virus]
ugguuauuuugggccagga

SEQ ID NO: 1937937 - RNA, 16 nt, Human herpesvirus 4 [Epstein-Barr virus]
cuggccaggcugguga

SEQ ID NO: 1937938 - RNA, 12 nt, Human herpesvirus 4 [Epstein-Barr virus]
ggcuugccaaaa

SEQ ID NO: 1937939 - RNA, 14 nt, Human herpesvirus 4 [Epstein-Barr virus]
aggacggagaagcg

SEQ ID NO: 1937940 - RNA, 21 nt, Human herpesvirus 4 [Epstein-Barr virus]
cgaggaggaagagacuucaca

SEQ ID NO: 1937941 - RNA, 18 nt, Human herpesvirus 4 [Epstein-Barr virus]
aucagaugagacuuuguu

SEQ ID NO: 1937942 - RNA, 17 nt, Human herpesvirus 4 [Epstein-Barr virus]
gaggagaagagaggcuu

SEQ ID NO: 1937943 - RNA, 14 nt, Human herpesvirus 4 [Epstein-Barr virus]
agacuccugccuga

SEQ ID NO: 1937944 - RNA, 21 nt, Human herpesvirus 4 [Epstein-Barr virus]
aggcacggucgccccuccgag

SEQ ID NO: 1937945 - RNA, 15 nt, Human herpesvirus 4 [Epstein-Barr virus]
cccuuuuaacauugg

SEQ ID NO: 1937946 - RNA, 15 nt, Human herpesvirus 4 [Epstein-Barr virus]
ccagagcccagagga

SEQ ID NO: 1937947 - RNA, 14 nt, Human herpesvirus 4 [Epstein-Barr virus]
aacacagcucuggc

SEQ ID NO: 1937948 - RNA, 12 nt, Human herpesvirus 4 [Epstein-Barr virus]
ugagucagccuu

SEQ ID NO: 1937949 - RNA, 20 nt, Human herpesvirus 4 [Epstein-Barr virus]
ccucguguuucacggccuca

SEQ ID NO: 1937950 - RNA, 17 nt, Human herpesvirus 4 [Epstein-Barr virus]
acuacaagcagcuagag

SEQ ID NO: 1937951 - RNA, 15 nt, Human herpesvirus 4 [Epstein-Barr virus]
cauacucuucauucu

SEQ ID NO: 1937952 - RNA, 14 nt, Human herpesvirus 4 [Epstein-Barr virus]
auggcgaccgucac

SEQ ID NO: 1937953 - RNA, 22 nt, Human herpesvirus 4 [Epstein-Barr virus]
gguagccggcgcuguguggcug

SEQ ID NO: 1937954 - RNA, 22 nt, Human herpesvirus 4 [Epstein-Barr virus]
cagaggacuaauguucucuaac

SEQ ID NO: 1937955 - RNA, 12 nt, Human herpesvirus 4 [Epstein-Barr virus]
uccacagcccca

SEQ ID NO: 1937956 - RNA, 17 nt, Human herpesvirus 4 [Epstein-Barr virus]
cauggaaaccacucaga

SEQ ID NO: 1937957 - RNA, 20 nt, Human herpesvirus 4 [Epstein-Barr virus]
gcaugagcuccucuccaaau

SEQ ID NO: 1937958 - RNA, 13 nt, Human herpesvirus 4 [Epstein-Barr virus]
uguccggucaggu

SEQ ID NO: 1937959 - RNA, 22 nt, Human herpesvirus 4 [Epstein-Barr virus]
cuuggaggcugcuaagccagga

SEQ ID NO: 1937960 - RNA, 18 nt, Human herpesvirus 4 [Epstein-Barr virus]
caggagggcagagagggg

SEQ ID NO: 1937961 - RNA, 12 nt, Human herpesvirus 4 [Epstein-Barr virus]
cacagcgccagc

SEQ ID NO: 1937962 - RNA, 14 nt, Human herpesvirus 4 [Epstein-Barr virus]
gagcaggaggggca

SEQ ID NO: 1937963 - RNA, 13 nt, Human herpesvirus 4 [Epstein-Barr virus]
ugacuaugaggag

SEQ ID NO: 1937964 - RNA, 12 nt, Human herpesvirus 4 [Epstein-Barr virus]
gacccuucugcu

SEQ ID NO: 1937965 - RNA, 13 nt, Human herpesvirus 4 [Epstein-Barr virus]
cggcccagcccga

SEQ ID NO: 1937966 - RNA, 15 nt, Human herpesvirus 4 [Epstein-Barr virus]
ccgcccgccuggcuc

SEQ ID NO: 1937967 - RNA, 15 nt, Human herpesvirus 4 [Epstein-Barr virus]
agcugagugcccagg

SEQ ID NO: 1937968 - RNA, 16 nt, Human herpesvirus 4 [Epstein-Barr virus]
gcccguccccugaccg

SEQ ID NO: 1937969 - RNA, 22 nt, Human herpesvirus 4 [Epstein-Barr virus]
uuuacuaauggaauauuaauaa

SEQ ID NO: 1937970 - RNA, 17 nt, Human herpesvirus 4 [Epstein-Barr virus]
auaaggcucugaagcaa

SEQ ID NO: 1937971 - RNA, 17 nt, Human herpesvirus 4 [Epstein-Barr virus]
cgaggaacuggcucagc

SEQ ID NO: 1937972 - RNA, 21 nt, Human herpesvirus 4 [Epstein-Barr virus]
aaucagaccacccggacccgg

SEQ ID NO: 1937973 - RNA, 19 nt, Human herpesvirus 4 [Epstein-Barr virus]
auuaagagucccuccucac

SEQ ID NO: 1937974 - RNA, 18 nt, Human herpesvirus 4 [Epstein-Barr virus]
ucgccgcuaguuggucca

SEQ ID NO: 1937975 - RNA, 22 nt, Human herpesvirus 4 [Epstein-Barr virus]
cggcgccgcccgggggccaguc

SEQ ID NO: 1937976 - RNA, 14 nt, Human herpesvirus 4 [Epstein-Barr virus]
guccgugagagccu

SEQ ID NO: 1937977 - RNA, 14 nt, Human herpesvirus 4 [Epstein-Barr virus]
gccucuaccuucca

SEQ ID NO: 1937978 - RNA, 19 nt, Human herpesvirus 4 [Epstein-Barr virus]
caggccucacgaucuucaa

SEQ ID NO: 1937979 - RNA, 20 nt, Human herpesvirus 4 [Epstein-Barr virus]
cauugcuggccgcagcuggc

SEQ ID NO: 1937980 - RNA, 13 nt, Human herpesvirus 4 [Epstein-Barr virus]
ucuacuuuaaaaa

SEQ ID NO: 1937981 - RNA, 15 nt, Human herpesvirus 4 [Epstein-Barr virus]
gugcacccggcugga

SEQ ID NO: 1937982 - RNA, 17 nt, Human herpesvirus 4 [Epstein-Barr virus]
gacacagacuuggccuu

SEQ ID NO: 1937983 - RNA, 17 nt, Human herpesvirus 4 [Epstein-Barr virus]
uuguuaaggaacacggu

SEQ ID NO: 1937984 - RNA, 19 nt, Human herpesvirus 4 [Epstein-Barr virus]
acccuccccaugggauggc

SEQ ID NO: 1937985 - RNA, 16 nt, Human herpesvirus 4 [Epstein-Barr virus]
ggaagcucagcaguug

SEQ ID NO: 1937986 - RNA, 16 nt, Human herpesvirus 4 [Epstein-Barr virus]
ccuuuccuaagaccua

SEQ ID NO: 1937987 - RNA, 19 nt, Human herpesvirus 4 [Epstein-Barr virus]
acacauuacggugcuggag

SEQ ID NO: 1937988 - RNA, 22 nt, Human herpesvirus 4 [Epstein-Barr virus]
uugccucuuguguucuugccgc

SEQ ID NO: 1937989 - RNA, 23 nt, Human herpesvirus 4 [Epstein-Barr virus]
ggccccccgcaccagggccaggc

SEQ ID NO: 1937990 - RNA, 18 nt, Human herpesvirus 4 [Epstein-Barr virus]
ggucauuagaugcugccg

SEQ ID NO: 1937991 - RNA, 20 nt, Human herpesvirus 4 [Epstein-Barr virus]
ggccugggaggugcugaggc

SEQ ID NO: 1937992 - RNA, 15 nt, Human herpesvirus 4 [Epstein-Barr virus]
ggacgaggaggaaga

SEQ ID NO: 1937993 - RNA, 21 nt, Human herpesvirus 4 [Epstein-Barr virus]
cagaucccuacuacugcagca

SEQ ID NO: 1937994 - RNA, 22 nt, Human herpesvirus 4 [Epstein-Barr virus]
ucgggauccgcaggggcgccga

SEQ ID NO: 1937995 - RNA, 15 nt, Human herpesvirus 4 [Epstein-Barr virus]
uggccaggcugguga

SEQ ID NO: 1937996 - RNA, 22 nt, Human herpesvirus 4 [Epstein-Barr virus]
caggguggcuacuugcucaggu

SEQ ID NO: 1937997 - RNA, 15 nt, Human herpesvirus 4 [Epstein-Barr virus]
cuggacguggcugcg

SEQ ID NO: 1937998 - RNA, 16 nt, Human herpesvirus 4 [Epstein-Barr virus]
auggcacgggcagagg

SEQ ID NO: 1937999 - RNA, 14 nt, Human herpesvirus 4 [Epstein-Barr virus]
guggucuccuucuu

SEQ ID NO: 1938000 - RNA, 15 nt, Human herpesvirus 4 [Epstein-Barr virus]
cacucugaccaggac

SEQ ID NO: 1938001 - RNA, 17 nt, Human herpesvirus 4 [Epstein-Barr virus]
cagagcuguguuucccg

SEQ ID NO: 1938002 - RNA, 14 nt, Human herpesvirus 4 [Epstein-Barr virus]
ggaugcuguagugg

SEQ ID NO: 1938003 - RNA, 15 nt, Human herpesvirus 4 [Epstein-Barr virus]
cugguuggggcugcu

SEQ ID NO: 1938004 - RNA, 16 nt, Human herpesvirus 4 [Epstein-Barr virus]
cuuccgugccucgggc

SEQ ID NO: 1938005 - RNA, 15 nt, Human herpesvirus 4 [Epstein-Barr virus]
ucuccaccuguguaa

SEQ ID NO: 1938006 - RNA, 19 nt, Human herpesvirus 4 [Epstein-Barr virus]
guagccgaauaucuggagg

SEQ ID NO: 1938007 - RNA, 13 nt, Human herpesvirus 4 [Epstein-Barr virus]
uagacgaggcaca

SEQ ID NO: 1938008 - RNA, 13 nt, Human herpesvirus 4 [Epstein-Barr virus]
ccgggcccagccc

SEQ ID NO: 1938009 - RNA, 16 nt, Human herpesvirus 4 [Epstein-Barr virus]
acuuuagagcucugga

SEQ ID NO: 1938010 - RNA, 19 nt, Human herpesvirus 4 [Epstein-Barr virus]
acccccuggagccagcgcu

SEQ ID NO: 1938011 - RNA, 17 nt, Human herpesvirus 4 [Epstein-Barr virus]
uguuugcugcucggggc

SEQ ID NO: 1938012 - RNA, 16 nt, Human herpesvirus 4 [Epstein-Barr virus]
ugcauggccugggccc

SEQ ID NO: 1938013 - RNA, 14 nt, Human herpesvirus 4 [Epstein-Barr virus]
accuuuugucuccc

SEQ ID NO: 1938014 - RNA, 20 nt, Human herpesvirus 4 [Epstein-Barr virus]
acguuguagguguccagcgc

SEQ ID NO: 1938015 - RNA, 12 nt, Human herpesvirus 4 [Epstein-Barr virus]
cugcccauccau

SEQ ID NO: 1938016 - RNA, 16 nt, Human herpesvirus 4 [Epstein-Barr virus]
ggccaaaagggcucug

SEQ ID NO: 1938017 - RNA, 22 nt, Human herpesvirus 4 [Epstein-Barr virus]
uccucaaauguuccagaagucg

SEQ ID NO: 1938018 - RNA, 19 nt, Human herpesvirus 4 [Epstein-Barr virus]
gggccgucacuccagccau

SEQ ID NO: 1938019 - RNA, 17 nt, Human herpesvirus 4 [Epstein-Barr virus]
agagagcggcugugagc

SEQ ID NO: 1938020 - RNA, 16 nt, Human herpesvirus 4 [Epstein-Barr virus]
cugcuagcgucacuga

SEQ ID NO: 1938021 - RNA, 14 nt, Human herpesvirus 4 [Epstein-Barr virus]
gaccacucaggaag

SEQ ID NO: 1938022 - RNA, 20 nt, Human herpesvirus 4 [Epstein-Barr virus]
cucaccgggaacgcccagua

SEQ ID NO: 1938023 - RNA, 17 nt, Human herpesvirus 4 [Epstein-Barr virus]
ccgugcauggcagcaga

SEQ ID NO: 1938024 - RNA, 12 nt, Human herpesvirus 4 [Epstein-Barr virus]
gccccagccccu

SEQ ID NO: 1938025 - RNA, 20 nt, Human herpesvirus 4 [Epstein-Barr virus]
uggagagauuucauccucag

SEQ ID NO: 1938026 - RNA, 14 nt, Human herpesvirus 4 [Epstein-Barr virus]
gcucuggcaguuau

SEQ ID NO: 1938027 - RNA, 22 nt, Human herpesvirus 4 [Epstein-Barr virus]
cugcgccugagcugccugguga

SEQ ID NO: 1938028 - RNA, 18 nt, Human herpesvirus 4 [Epstein-Barr virus]
uaugcauacacugaauuu

SEQ ID NO: 1938029 - RNA, 17 nt, Human herpesvirus 4 [Epstein-Barr virus]
ugaacaucucaucccca

SEQ ID NO: 1938030 - RNA, 22 nt, Human herpesvirus 4 [Epstein-Barr virus]
uccugauacuagcguacagaag

SEQ ID NO: 1938031 - RNA, 23 nt, Human herpesvirus 4 [Epstein-Barr virus]
gagggggccugagacuggacccu

SEQ ID NO: 1938032 - RNA, 16 nt, Human herpesvirus 4 [Epstein-Barr virus]
accauccacagcccca

SEQ ID NO: 1938033 - RNA, 15 nt, Human herpesvirus 4 [Epstein-Barr virus]
gcacggaugccuggc

SEQ ID NO: 1938034 - RNA, 14 nt, Human herpesvirus 4 [Epstein-Barr virus]
ggcuucugcugcug

SEQ ID NO: 1938035 - RNA, 11 nt, Human herpesvirus 4 [Epstein-Barr virus]
uguugggugaa

SEQ ID NO: 1938036 - RNA, 21 nt, Human herpesvirus 4 [Epstein-Barr virus]
caacagcgaccggcagauccc

SEQ ID NO: 1938037 - RNA, 18 nt, Human herpesvirus 4 [Epstein-Barr virus]
gggguguagugggugggc

SEQ ID NO: 1938038 - RNA, 17 nt, Human herpesvirus 4 [Epstein-Barr virus]
cacgcuuuugucugccu

SEQ ID NO: 1938039 - RNA, 20 nt, Human herpesvirus 4 [Epstein-Barr virus]
caccggggaggccagguagc

SEQ ID NO: 1938040 - RNA, 18 nt, Human herpesvirus 4 [Epstein-Barr virus]
ucgacuuuaugccccccg

SEQ ID NO: 1938041 - RNA, 21 nt, Human herpesvirus 4 [Epstein-Barr virus]
acggcaaggccggaggcagac

SEQ ID NO: 1938042 - RNA, 14 nt, Human herpesvirus 4 [Epstein-Barr virus]
cgacggccucggcg

SEQ ID NO: 1938043 - RNA, 17 nt, Human herpesvirus 4 [Epstein-Barr virus]
gcuuuugucugccugga

SEQ ID NO: 1938044 - RNA, 14 nt, Human herpesvirus 4 [Epstein-Barr virus]
agaccuauguauaa

SEQ ID NO: 1938045 - RNA, 17 nt, Human herpesvirus 4 [Epstein-Barr virus]
ccacggccguagcccag

SEQ ID NO: 1938046 - RNA, 11 nt, Human herpesvirus 4 [Epstein-Barr virus]
cggagaggcgg

SEQ ID NO: 1938047 - RNA, 16 nt, Human herpesvirus 4 [Epstein-Barr virus]
ccgcggugguggcccu

SEQ ID NO: 1938048 - RNA, 16 nt, Human herpesvirus 4 [Epstein-Barr virus]
cuuggucaagguguca

SEQ ID NO: 1938049 - RNA, 18 nt, Human herpesvirus 4 [Epstein-Barr virus]
gcccgacaauaaaguuga

SEQ ID NO: 1938050 - RNA, 22 nt, Human herpesvirus 4 [Epstein-Barr virus]
caugcccagacucaucucaagg

SEQ ID NO: 1938051 - RNA, 16 nt, Human herpesvirus 4 [Epstein-Barr virus]
gaacaacugucagaca

SEQ ID NO: 1938052 - RNA, 13 nt, Human herpesvirus 4 [Epstein-Barr virus]
caucgcaagcucc

SEQ ID NO: 1938053 - RNA, 23 nt, Human herpesvirus 4 [Epstein-Barr virus]
aggcuguugacaugagcauggaa

SEQ ID NO: 1938054 - RNA, 15 nt, Human herpesvirus 4 [Epstein-Barr virus]
gucagcaaaccagcu

SEQ ID NO: 1938055 - RNA, 12 nt, Human herpesvirus 4 [Epstein-Barr virus]
ugcggggaacug

SEQ ID NO: 1938056 - RNA, 14 nt, Human herpesvirus 4 [Epstein-Barr virus]
ggaacgaggggagg

SEQ ID NO: 1938057 - RNA, 14 nt, Human herpesvirus 4 [Epstein-Barr virus]
ucccauaccuacac

SEQ ID NO: 1938058 - RNA, 19 nt, Human herpesvirus 4 [Epstein-Barr virus]
acccgaggucaagucccgg

SEQ ID NO: 1938059 - RNA, 16 nt, Human herpesvirus 4 [Epstein-Barr virus]
ugcuagcuucagggaa

SEQ ID NO: 1938060 - RNA, 23 nt, Human herpesvirus 4 [Epstein-Barr virus]
ggccagggcggaggagauccgcc

SEQ ID NO: 1938061 - RNA, 15 nt, Human herpesvirus 4 [Epstein-Barr virus]
aggaaggggccucgg

SEQ ID NO: 1938062 - RNA, 19 nt, Human herpesvirus 4 [Epstein-Barr virus]
ggaaauggccuaggagaga

SEQ ID NO: 1938063 - RNA, 15 nt, Human herpesvirus 4 [Epstein-Barr virus]
ucaccuacaugucaa

SEQ ID NO: 1938064 - RNA, 23 nt, Human herpesvirus 4 [Epstein-Barr virus]
cuuccuggccggccgcccccuga

SEQ ID NO: 1938065 - RNA, 19 nt, Human herpesvirus 4 [Epstein-Barr virus]
gcaacgccggccugcuggc

SEQ ID NO: 1938066 - RNA, 19 nt, Human herpesvirus 4 [Epstein-Barr virus]
ucgauuggaaaagggccca

SEQ ID NO: 1938067 - RNA, 18 nt, Human herpesvirus 4 [Epstein-Barr virus]
gccggcgcuguguggcug

SEQ ID NO: 1938068 - RNA, 14 nt, Human herpesvirus 4 [Epstein-Barr virus]
gcucucgcacucuu

SEQ ID NO: 1938069 - RNA, 20 nt, Human herpesvirus 4 [Epstein-Barr virus]
cgucgcggagagggaugggc

SEQ ID NO: 1938070 - RNA, 13 nt, Human herpesvirus 4 [Epstein-Barr virus]
gagauuaggggua

SEQ ID NO: 1938071 - RNA, 14 nt, Human herpesvirus 4 [Epstein-Barr virus]
agcagcuacacucu

SEQ ID NO: 1938072 - RNA, 13 nt, Human herpesvirus 4 [Epstein-Barr virus]
ucggugggccaga

SEQ ID NO: 1938073 - RNA, 13 nt, Human herpesvirus 4 [Epstein-Barr virus]
ucaucccugaccc

SEQ ID NO: 1938074 - RNA, 14 nt, Human herpesvirus 4 [Epstein-Barr virus]
gccgucuggcaggg

SEQ ID NO: 1938075 - RNA, 16 nt, Human herpesvirus 4 [Epstein-Barr virus]
guggccgaguggcaga

SEQ ID NO: 1938076 - RNA, 14 nt, Human herpesvirus 4 [Epstein-Barr virus]
cggcucgaccggga

SEQ ID NO: 1938077 - RNA, 13 nt, Human herpesvirus 4 [Epstein-Barr virus]
cgcaccagggcca

SEQ ID NO: 1938078 - RNA, 15 nt, Human herpesvirus 4 [Epstein-Barr virus]
caucagcucgcccac

SEQ ID NO: 1938079 - RNA, 18 nt, Human herpesvirus 4 [Epstein-Barr virus]
cagcuggcggacuacaag

SEQ ID NO: 1938080 - RNA, 20 nt, Human herpesvirus 4 [Epstein-Barr virus]
gcuuuguugggucugauguu

SEQ ID NO: 1938081 - RNA, 15 nt, Human herpesvirus 4 [Epstein-Barr virus]
guucuggugaugcuu

SEQ ID NO: 1938082 - RNA, 22 nt, Human herpesvirus 4 [Epstein-Barr virus]
cuggacacaagagccaucaccu

SEQ ID NO: 1938083 - RNA, 18 nt, Human herpesvirus 4 [Epstein-Barr virus]
gcuaaucgcugguggcag

SEQ ID NO: 1938084 - RNA, 19 nt, Human herpesvirus 4 [Epstein-Barr virus]
gaaugccaagagccccucc

SEQ ID NO: 1938085 - RNA, 23 nt, Human herpesvirus 4 [Epstein-Barr virus]
auguccaaaaggucaaagaacaa

SEQ ID NO: 1938086 - RNA, 12 nt, Human herpesvirus 4 [Epstein-Barr virus]
aagaccaaggcc

SEQ ID NO: 1938087 - RNA, 20 nt, Human herpesvirus 4 [Epstein-Barr virus]
cagaggcgacgcuccugggu

SEQ ID NO: 1938088 - RNA, 20 nt, Human herpesvirus 4 [Epstein-Barr virus]
ggcccagcagauccagggcc

SEQ ID NO: 1938089 - RNA, 16 nt, Human herpesvirus 4 [Epstein-Barr virus]
gcaaugcccacccacu

SEQ ID NO: 1938090 - RNA, 14 nt, Human herpesvirus 4 [Epstein-Barr virus]
gcccaccagccagc

SEQ ID NO: 1938091 - RNA, 15 nt, Human herpesvirus 4 [Epstein-Barr virus]
cagggcuucacuaga

SEQ ID NO: 1938092 - RNA, 22 nt, Human herpesvirus 4 [Epstein-Barr virus]
ugccuaaacgugauggugcugg

SEQ ID NO: 1938093 - RNA, 23 nt, Human herpesvirus 4 [Epstein-Barr virus]
ccugaucugggagaugagauaga

SEQ ID NO: 1938094 - RNA, 21 nt, Human herpesvirus 4 [Epstein-Barr virus]
ugcugccagagccucugccac

SEQ ID NO: 1938095 - RNA, 18 nt, Human herpesvirus 4 [Epstein-Barr virus]
ucacucucaguaauuccc

SEQ ID NO: 1938096 - RNA, 12 nt, Human herpesvirus 4 [Epstein-Barr virus]
ucccccuagccc

SEQ ID NO: 1938097 - RNA, 16 nt, Human herpesvirus 4 [Epstein-Barr virus]
caggaaguacagccgg

SEQ ID NO: 1938098 - RNA, 15 nt, Human herpesvirus 4 [Epstein-Barr virus]
ugcccucuccagcaa

SEQ ID NO: 1938099 - RNA, 21 nt, Human herpesvirus 4 [Epstein-Barr virus]
ggaaccugagccugagccaca

SEQ ID NO: 1938100 - RNA, 14 nt, Human herpesvirus 4 [Epstein-Barr virus]
agggcccuggucag

SEQ ID NO: 1938101 - RNA, 14 nt, Human herpesvirus 4 [Epstein-Barr virus]
guggugggcuccuu

SEQ ID NO: 1938102 - RNA, 17 nt, Human herpesvirus 4 [Epstein-Barr virus]
gagacgagcugcgacag

SEQ ID NO: 1938103 - RNA, 22 nt, Human herpesvirus 4 [Epstein-Barr virus]
ccaggcagcacacgaagccugc

SEQ ID NO: 1938104 - RNA, 18 nt, Human herpesvirus 4 [Epstein-Barr virus]
gacgcuguccgccaggac

SEQ ID NO: 1938105 - RNA, 20 nt, Human herpesvirus 4 [Epstein-Barr virus]
ugagggcuuugccugccuaa

SEQ ID NO: 1938106 - RNA, 15 nt, Human herpesvirus 4 [Epstein-Barr virus]
aauugugcccaccag

SEQ ID NO: 1938107 - RNA, 13 nt, Human herpesvirus 4 [Epstein-Barr virus]
gagcggcaagggc

SEQ ID NO: 1938108 - RNA, 17 nt, Human herpesvirus 4 [Epstein-Barr virus]
gcacccggcuggacccc

SEQ ID NO: 1938109 - RNA, 14 nt, Human herpesvirus 4 [Epstein-Barr virus]
ccuugcguggugcu

SEQ ID NO: 1938110 - RNA, 16 nt, Human herpesvirus 4 [Epstein-Barr virus]
caacuucagcuccagg

SEQ ID NO: 1938111 - RNA, 20 nt, Human herpesvirus 4 [Epstein-Barr virus]
cggcucaggaucagggccaa

SEQ ID NO: 1938112 - RNA, 14 nt, Human herpesvirus 4 [Epstein-Barr virus]
gcaaggacgggggu

SEQ ID NO: 1938113 - RNA, 18 nt, Human herpesvirus 4 [Epstein-Barr virus]
agccccuuuugccccccu

SEQ ID NO: 1938114 - RNA, 22 nt, Human herpesvirus 4 [Epstein-Barr virus]
uggucgucaucuggcucuccug

SEQ ID NO: 1938115 - RNA, 15 nt, Human herpesvirus 4 [Epstein-Barr virus]
ugccugugccucguc

SEQ ID NO: 1938116 - RNA, 18 nt, Human herpesvirus 4 [Epstein-Barr virus]
ugggucagugauggaaag

SEQ ID NO: 1938117 - RNA, 13 nt, Human herpesvirus 4 [Epstein-Barr virus]
ugguuucagccuc

SEQ ID NO: 1938118 - RNA, 20 nt, Human herpesvirus 4 [Epstein-Barr virus]
ccugacugacucucccucca

SEQ ID NO: 1938119 - RNA, 17 nt, Human herpesvirus 4 [Epstein-Barr virus]
guaauuguugcgcccua

SEQ ID NO: 1938120 - RNA, 20 nt, Human herpesvirus 4 [Epstein-Barr virus]
gcucgcccacacagcgccag

SEQ ID NO: 1938121 - RNA, 18 nt, Human herpesvirus 4 [Epstein-Barr virus]
aaacauggugucuguaau

SEQ ID NO: 1938122 - RNA, 13 nt, Human herpesvirus 4 [Epstein-Barr virus]
caucuuccaggug

SEQ ID NO: 1938123 - RNA, 14 nt, Human herpesvirus 4 [Epstein-Barr virus]
ccgggggccuuguc

SEQ ID NO: 1938124 - RNA, 15 nt, Human herpesvirus 4 [Epstein-Barr virus]
cugucagacacucca

SEQ ID NO: 1938125 - RNA, 21 nt, Human herpesvirus 4 [Epstein-Barr virus]
aggcccccgggugggcugguu

SEQ ID NO: 1938126 - RNA, 13 nt, Human herpesvirus 4 [Epstein-Barr virus]
ccuuaacacacca

SEQ ID NO: 1938127 - RNA, 14 nt, Human herpesvirus 4 [Epstein-Barr virus]
aucccauaccuaca

SEQ ID NO: 1938128 - RNA, 22 nt, Human herpesvirus 4 [Epstein-Barr virus]
agcugggccucuaaguacaggu

SEQ ID NO: 1938129 - RNA, 17 nt, Human herpesvirus 4 [Epstein-Barr virus]
uugugcggucuguuuuc

SEQ ID NO: 1938130 - RNA, 14 nt, Human herpesvirus 4 [Epstein-Barr virus]
cgcggcagaggccu

SEQ ID NO: 1938131 - RNA, 23 nt, Human herpesvirus 4 [Epstein-Barr virus]
ccuagaaacugugccauggugcc

SEQ ID NO: 1938132 - RNA, 15 nt, Human herpesvirus 4 [Epstein-Barr virus]
cgaaacuauggcaga

SEQ ID NO: 1938133 - RNA, 14 nt, Human herpesvirus 4 [Epstein-Barr virus]
cagucgcuggcugg

SEQ ID NO: 1938134 - RNA, 19 nt, Human herpesvirus 4 [Epstein-Barr virus]
caggagcaggagcaggagc

SEQ ID NO: 1938135 - RNA, 16 nt, Human herpesvirus 4 [Epstein-Barr virus]
ugaaaacugccuccuc

SEQ ID NO: 1938136 - RNA, 13 nt, Human herpesvirus 4 [Epstein-Barr virus]
cuggcucagcuug

SEQ ID NO: 1938137 - RNA, 14 nt, Human herpesvirus 4 [Epstein-Barr virus]
aucugggcugggac

SEQ ID NO: 1938138 - RNA, 22 nt, Human herpesvirus 4 [Epstein-Barr virus]
cacaaccacggugacauucacu

SEQ ID NO: 1938139 - RNA, 15 nt, Human herpesvirus 4 [Epstein-Barr virus]
aguaccagcuggugg

SEQ ID NO: 1938140 - RNA, 18 nt, Human herpesvirus 4 [Epstein-Barr virus]
ggccgagcagggacuggc

SEQ ID NO: 1938141 - RNA, 22 nt, Human herpesvirus 4 [Epstein-Barr virus]
aagcuaccgaugauucuggcca

SEQ ID NO: 1938142 - RNA, 13 nt, Human herpesvirus 4 [Epstein-Barr virus]
cuugcacccaccc

SEQ ID NO: 1938143 - RNA, 14 nt, Human herpesvirus 4 [Epstein-Barr virus]
ggcagaaaggcugg

SEQ ID NO: 1938144 - RNA, 14 nt, Human herpesvirus 4 [Epstein-Barr virus]
uccaucugcuucug

SEQ ID NO: 1938145 - RNA, 18 nt, Human herpesvirus 4 [Epstein-Barr virus]
ucaacuucagcuccaggg

SEQ ID NO: 1938146 - RNA, 18 nt, Human herpesvirus 4 [Epstein-Barr virus]
cagaguucccggcugcuc

SEQ ID NO: 1938147 - RNA, 18 nt, Human herpesvirus 4 [Epstein-Barr virus]
caacguccgugagagccu

SEQ ID NO: 1938148 - RNA, 16 nt, Human herpesvirus 4 [Epstein-Barr virus]
uucuggaaugcuucua

SEQ ID NO: 1938149 - RNA, 13 nt, Human herpesvirus 4 [Epstein-Barr virus]
cuggcucuccugu

SEQ ID NO: 1938150 - RNA, 14 nt, Human herpesvirus 4 [Epstein-Barr virus]
augcuccuauggac

SEQ ID NO: 1938151 - RNA, 22 nt, Human herpesvirus 4 [Epstein-Barr virus]
cuagauuuccuacaacucagcc

SEQ ID NO: 1938152 - RNA, 20 nt, Human herpesvirus 4 [Epstein-Barr virus]
uccacccccuggagccagcg

SEQ ID NO: 1938153 - RNA, 21 nt, Human herpesvirus 4 [Epstein-Barr virus]
ugaccacucaggaagcuggcc

SEQ ID NO: 1938154 - RNA, 22 nt, Human herpesvirus 4 [Epstein-Barr virus]
ccucggcgcugggacugccugg

SEQ ID NO: 1938155 - RNA, 19 nt, Human herpesvirus 4 [Epstein-Barr virus]
uggcagccgcggccaucac

SEQ ID NO: 1938156 - RNA, 19 nt, Human herpesvirus 4 [Epstein-Barr virus]
acaagaguucucuggugaa

SEQ ID NO: 1938157 - RNA, 17 nt, Human herpesvirus 4 [Epstein-Barr virus]
ccggucgcaugguggcu

SEQ ID NO: 1938158 - RNA, 16 nt, Human herpesvirus 4 [Epstein-Barr virus]
agccuacccaugacca

SEQ ID NO: 1938159 - RNA, 20 nt, Human herpesvirus 4 [Epstein-Barr virus]
cggaggcacuggagcagaag

SEQ ID NO: 1938160 - RNA, 19 nt, Human herpesvirus 4 [Epstein-Barr virus]
cauaaguccucauggcagg

SEQ ID NO: 1938161 - RNA, 18 nt, Human herpesvirus 4 [Epstein-Barr virus]
ccaguuccccccagccug

SEQ ID NO: 1938162 - RNA, 14 nt, Human herpesvirus 4 [Epstein-Barr virus]
acaccagucccaac

SEQ ID NO: 1938163 - RNA, 21 nt, Human herpesvirus 4 [Epstein-Barr virus]
cuuggaggcugcuaagccagg

SEQ ID NO: 1938164 - RNA, 20 nt, Human herpesvirus 4 [Epstein-Barr virus]
ccgacaucgccgccccaggg

SEQ ID NO: 1938165 - RNA, 18 nt, Human herpesvirus 4 [Epstein-Barr virus]
guggauggggucauuuau

SEQ ID NO: 1938166 - RNA, 20 nt, Human herpesvirus 4 [Epstein-Barr virus]
cccgaaagcggcccagcaga

SEQ ID NO: 1938167 - RNA, 14 nt, Human herpesvirus 4 [Epstein-Barr virus]
ugcaaugcccaccc

SEQ ID NO: 1938168 - RNA, 15 nt, Human herpesvirus 4 [Epstein-Barr virus]
ccaggcgacacuugg

SEQ ID NO: 1938169 - RNA, 12 nt, Human herpesvirus 4 [Epstein-Barr virus]
agguccgcuccu

SEQ ID NO: 1938170 - RNA, 19 nt, Human herpesvirus 4 [Epstein-Barr virus]
uggggcugagaccaugcuc

SEQ ID NO: 1938171 - RNA, 15 nt, Human herpesvirus 4 [Epstein-Barr virus]
aacuccuccagcagu

SEQ ID NO: 1938172 - RNA, 16 nt, Human herpesvirus 4 [Epstein-Barr virus]
uacuaauggaauauua

SEQ ID NO: 1938173 - RNA, 18 nt, Human herpesvirus 4 [Epstein-Barr virus]
gcccagaggcgcugugga

SEQ ID NO: 1938174 - RNA, 13 nt, Human herpesvirus 4 [Epstein-Barr virus]
gaaugugguaaca

SEQ ID NO: 1938175 - RNA, 12 nt, Human herpesvirus 4 [Epstein-Barr virus]
ucucuggcugug

SEQ ID NO: 1938176 - RNA, 17 nt, Human herpesvirus 4 [Epstein-Barr virus]
ugccccucagccugcuc

SEQ ID NO: 1938177 - RNA, 14 nt, Human herpesvirus 4 [Epstein-Barr virus]
cuggcggcccagcc

SEQ ID NO: 1938178 - RNA, 23 nt, Human herpesvirus 4 [Epstein-Barr virus]
gacccaucugagggcagugauag

SEQ ID NO: 1938179 - RNA, 12 nt, Human herpesvirus 4 [Epstein-Barr virus]
cagcccuccuca

SEQ ID NO: 1938180 - RNA, 19 nt, Human herpesvirus 4 [Epstein-Barr virus]
gagacacaucuggaccaga

SEQ ID NO: 1938181 - RNA, 21 nt, Human herpesvirus 4 [Epstein-Barr virus]
gaggaggcuggugccuuggcu

SEQ ID NO: 1938182 - RNA, 14 nt, Human herpesvirus 4 [Epstein-Barr virus]
gacgggguggugcc

SEQ ID NO: 1938183 - RNA, 16 nt, Human herpesvirus 4 [Epstein-Barr virus]
cggaaaccacaacagc

SEQ ID NO: 1938184 - RNA, 10 nt, Human herpesvirus 4 [Epstein-Barr virus]
uuucugcccc

SEQ ID NO: 1938185 - RNA, 22 nt, Human herpesvirus 4 [Epstein-Barr virus]
auuugaggaggcacacaaaaug

SEQ ID NO: 1938186 - RNA, 23 nt, Human herpesvirus 4 [Epstein-Barr virus]
agcacgguagccuugggggccug

SEQ ID NO: 1938187 - RNA, 17 nt, Human herpesvirus 4 [Epstein-Barr virus]
cugcguccaccuggcca

SEQ ID NO: 1938188 - RNA, 13 nt, Human herpesvirus 4 [Epstein-Barr virus]
cccugucuccccu

SEQ ID NO: 1938189 - RNA, 16 nt, Human herpesvirus 4 [Epstein-Barr virus]
gcuaaucgcugguggc

SEQ ID NO: 1938190 - RNA, 15 nt, Human herpesvirus 4 [Epstein-Barr virus]
agcggggcugggugg

SEQ ID NO: 1938191 - RNA, 16 nt, Human herpesvirus 4 [Epstein-Barr virus]
cuuggacccugcugcg

SEQ ID NO: 1938192 - RNA, 15 nt, Human herpesvirus 4 [Epstein-Barr virus]
cuccagagagggagu

SEQ ID NO: 1938193 - RNA, 15 nt, Human herpesvirus 4 [Epstein-Barr virus]
ucugccuccggccgc

SEQ ID NO: 1938194 - RNA, 18 nt, Human herpesvirus 4 [Epstein-Barr virus]
caccacccccaccaccuc

SEQ ID NO: 1938195 - RNA, 20 nt, Human herpesvirus 4 [Epstein-Barr virus]
gucaaacauggugucuguaa

SEQ ID NO: 1938196 - RNA, 21 nt, Human herpesvirus 4 [Epstein-Barr virus]
acuugcucagguuucugggca

SEQ ID NO: 1938197 - RNA, 20 nt, Human herpesvirus 4 [Epstein-Barr virus]
uauggcugcggaguugagcc

SEQ ID NO: 1938198 - RNA, 19 nt, Human herpesvirus 4 [Epstein-Barr virus]
cucgccuucuccucagccu

SEQ ID NO: 1938199 - RNA, 16 nt, Human herpesvirus 4 [Epstein-Barr virus]
ggccgcagcuggcgga

SEQ ID NO: 1938200 - RNA, 17 nt, Human herpesvirus 4 [Epstein-Barr virus]
cagaaaaucgcagcagg

SEQ ID NO: 1938201 - RNA, 18 nt, Human herpesvirus 4 [Epstein-Barr virus]
gagcagaaggaacagagg

SEQ ID NO: 1938202 - RNA, 12 nt, Human herpesvirus 4 [Epstein-Barr virus]
gugagucagccu

SEQ ID NO: 1938203 - RNA, 15 nt, Human herpesvirus 4 [Epstein-Barr virus]
cauucuaucagcuua

SEQ ID NO: 1938204 - RNA, 16 nt, Human herpesvirus 4 [Epstein-Barr virus]
agggcagacugcacag

SEQ ID NO: 1938205 - RNA, 17 nt, Human herpesvirus 4 [Epstein-Barr virus]
gugaauugugcccacca

SEQ ID NO: 1938206 - RNA, 23 nt, Human herpesvirus 4 [Epstein-Barr virus]
cggagagugcccuggaggccuca

SEQ ID NO: 1938207 - RNA, 23 nt, Human herpesvirus 4 [Epstein-Barr virus]
gucagccuugcccccgccagcgc

SEQ ID NO: 1938208 - RNA, 18 nt, Human herpesvirus 4 [Epstein-Barr virus]
gaccaucacauggggcau

SEQ ID NO: 1938209 - RNA, 22 nt, Human herpesvirus 4 [Epstein-Barr virus]
ugccucuacgccccagaugaaa

SEQ ID NO: 1938210 - RNA, 23 nt, Human herpesvirus 4 [Epstein-Barr virus]
uccccaaagucaagggaaaggaa

SEQ ID NO: 1938211 - RNA, 15 nt, Human herpesvirus 4 [Epstein-Barr virus]
ugccuuuuugccaca

SEQ ID NO: 1938212 - RNA, 19 nt, Human herpesvirus 4 [Epstein-Barr virus]
ucuagcaggugcaccagcu

SEQ ID NO: 1938213 - RNA, 20 nt, Human herpesvirus 4 [Epstein-Barr virus]
cgggaaugacgggcucccuc

SEQ ID NO: 1938214 - RNA, 23 nt, Human herpesvirus 4 [Epstein-Barr virus]
ugagucugcuggacuccgaggac

SEQ ID NO: 1938215 - RNA, 15 nt, Human herpesvirus 4 [Epstein-Barr virus]
ucaagagcuuccugg

SEQ ID NO: 1938216 - RNA, 15 nt, Human herpesvirus 4 [Epstein-Barr virus]
cggcguggagcuggg

SEQ ID NO: 1938217 - RNA, 12 nt, Human herpesvirus 4 [Epstein-Barr virus]
cuaugacaccua

SEQ ID NO: 1938218 - RNA, 15 nt, Human herpesvirus 4 [Epstein-Barr virus]
cucuggcacugcuag

SEQ ID NO: 1938219 - RNA, 14 nt, Human herpesvirus 4 [Epstein-Barr virus]
cuaccucuuuuggc

SEQ ID NO: 1938220 - RNA, 16 nt, Human herpesvirus 4 [Epstein-Barr virus]
ccagcauggcagccgg

SEQ ID NO: 1938221 - RNA, 15 nt, Human herpesvirus 4 [Epstein-Barr virus]
cagaaaaucgcagca

SEQ ID NO: 1938222 - RNA, 22 nt, Human herpesvirus 4 [Epstein-Barr virus]
agaaaggcuggccguguucacu

SEQ ID NO: 1938223 - RNA, 16 nt, Human herpesvirus 4 [Epstein-Barr virus]
cugacccuucugcugc

SEQ ID NO: 1938224 - RNA, 17 nt, Human herpesvirus 4 [Epstein-Barr virus]
uagcauggccgccagag

SEQ ID NO: 1938225 - RNA, 15 nt, Human herpesvirus 4 [Epstein-Barr virus]
cggugucggcaccua

SEQ ID NO: 1938226 - RNA, 18 nt, Human herpesvirus 4 [Epstein-Barr virus]
cugcgguugucacuuucu

SEQ ID NO: 1938227 - RNA, 16 nt, Human herpesvirus 4 [Epstein-Barr virus]
cugacacacaggccug

SEQ ID NO: 1938228 - RNA, 13 nt, Human herpesvirus 4 [Epstein-Barr virus]
cuccagggccagc

SEQ ID NO: 1938229 - RNA, 16 nt, Human herpesvirus 4 [Epstein-Barr virus]
ccagcagauccagggc

SEQ ID NO: 1938230 - RNA, 13 nt, Human herpesvirus 4 [Epstein-Barr virus]
agggaggccuggg

SEQ ID NO: 1938231 - RNA, 16 nt, Human herpesvirus 4 [Epstein-Barr virus]
uaaaaggggcagcaau

SEQ ID NO: 1938232 - RNA, 17 nt, Human herpesvirus 4 [Epstein-Barr virus]
ccaggggcgagcagcgc

SEQ ID NO: 1938233 - RNA, 20 nt, Human herpesvirus 4 [Epstein-Barr virus]
cuccguccuuguccaggaga

SEQ ID NO: 1938234 - RNA, 14 nt, Human herpesvirus 4 [Epstein-Barr virus]
guagacgaggcaca

SEQ ID NO: 1938235 - RNA, 22 nt, Human herpesvirus 4 [Epstein-Barr virus]
gcccaggcacaucuggcaccug

SEQ ID NO: 1938236 - RNA, 12 nt, Human herpesvirus 4 [Epstein-Barr virus]
gaggaggcacac

SEQ ID NO: 1938237 - RNA, 18 nt, Human herpesvirus 4 [Epstein-Barr virus]
gcgguuauaacugccaga

SEQ ID NO: 1938238 - RNA, 17 nt, Human herpesvirus 4 [Epstein-Barr virus]
augcuugugcuccugau

SEQ ID NO: 1938239 - RNA, 15 nt, Human herpesvirus 4 [Epstein-Barr virus]
ugcuggccgagcugg

SEQ ID NO: 1938240 - RNA, 21 nt, Human herpesvirus 4 [Epstein-Barr virus]
cagcccucgagaaccccagca

SEQ ID NO: 1938241 - RNA, 13 nt, Human herpesvirus 4 [Epstein-Barr virus]
caaauaaauguua

SEQ ID NO: 1938242 - RNA, 23 nt, Human herpesvirus 4 [Epstein-Barr virus]
gacuugaggugggcugacacaga

SEQ ID NO: 1938243 - RNA, 21 nt, Human herpesvirus 4 [Epstein-Barr virus]
ccugugcagggacgaggacga

SEQ ID NO: 1938244 - RNA, 19 nt, Human herpesvirus 4 [Epstein-Barr virus]
agcuccgagagcuccgcca

SEQ ID NO: 1938245 - RNA, 22 nt, Human herpesvirus 4 [Epstein-Barr virus]
cacccucggagaucaucccacu

SEQ ID NO: 1938246 - RNA, 17 nt, Human herpesvirus 4 [Epstein-Barr virus]
caggcauuuuuggugcu

SEQ ID NO: 1938247 - RNA, 14 nt, Human herpesvirus 4 [Epstein-Barr virus]
cugcugcugcuggu

SEQ ID NO: 1938248 - RNA, 18 nt, Human herpesvirus 4 [Epstein-Barr virus]
ggcagugauaagucauga

SEQ ID NO: 1938249 - RNA, 15 nt, Human herpesvirus 4 [Epstein-Barr virus]
cuggccgcagcuggc

SEQ ID NO: 1938250 - RNA, 14 nt, Human herpesvirus 4 [Epstein-Barr virus]
gucaaggugucaau

SEQ ID NO: 1938251 - RNA, 13 nt, Human herpesvirus 4 [Epstein-Barr virus]
gcaaccuuggggg

SEQ ID NO: 1938252 - RNA, 17 nt, Human herpesvirus 4 [Epstein-Barr virus]
gagggcgcucugcgcca

SEQ ID NO: 1938253 - RNA, 12 nt, Human herpesvirus 4 [Epstein-Barr virus]
ugcucaaggcag

SEQ ID NO: 1938254 - RNA, 20 nt, Human herpesvirus 4 [Epstein-Barr virus]
cuggucuccuuguugaccuc

SEQ ID NO: 1938255 - RNA, 13 nt, Human herpesvirus 4 [Epstein-Barr virus]
cucagguuucugg

SEQ ID NO: 1938256 - RNA, 12 nt, Human herpesvirus 4 [Epstein-Barr virus]
uggacaugcuga

SEQ ID NO: 1938257 - RNA, 13 nt, Human herpesvirus 4 [Epstein-Barr virus]
gccccagccccuc

SEQ ID NO: 1938258 - RNA, 13 nt, Human herpesvirus 4 [Epstein-Barr virus]
gccucagcccccc

SEQ ID NO: 1938259 - RNA, 13 nt, Human herpesvirus 4 [Epstein-Barr virus]
aaaggaagggggc

SEQ ID NO: 1938260 - RNA, 20 nt, Human herpesvirus 4 [Epstein-Barr virus]
cuguuuguccagcagggccu

SEQ ID NO: 1938261 - RNA, 14 nt, Human herpesvirus 4 [Epstein-Barr virus]
gguugucuucccag

SEQ ID NO: 1938262 - RNA, 12 nt, Human herpesvirus 4 [Epstein-Barr virus]
caucucagggac

SEQ ID NO: 1938263 - RNA, 13 nt, Human herpesvirus 4 [Epstein-Barr virus]
gcucucucuggag

SEQ ID NO: 1938264 - RNA, 14 nt, Human herpesvirus 4 [Epstein-Barr virus]
cacugaaaaaccag

SEQ ID NO: 1938265 - RNA, 13 nt, Human herpesvirus 4 [Epstein-Barr virus]
cgacuccaggccc

SEQ ID NO: 1938266 - RNA, 15 nt, Human herpesvirus 4 [Epstein-Barr virus]
cuacucgaccagcac

SEQ ID NO: 1938267 - RNA, 15 nt, Human herpesvirus 4 [Epstein-Barr virus]
cgucaucuggcucuc

SEQ ID NO: 1938268 - RNA, 12 nt, Human herpesvirus 4 [Epstein-Barr virus]
auggagaugugc

SEQ ID NO: 1938269 - RNA, 13 nt, Human herpesvirus 4 [Epstein-Barr virus]
caauaauuucagu

SEQ ID NO: 1938270 - RNA, 23 nt, Human herpesvirus 4 [Epstein-Barr virus]
cuccgccgccugcggcccacuga

SEQ ID NO: 1938271 - RNA, 19 nt, Human herpesvirus 4 [Epstein-Barr virus]
gcagcaguggccagcucau

SEQ ID NO: 1938272 - RNA, 23 nt, Human herpesvirus 4 [Epstein-Barr virus]
caggagccccgggcggcucagga

SEQ ID NO: 1938273 - RNA, 17 nt, Human herpesvirus 4 [Epstein-Barr virus]
gugaagggcagggcucg

SEQ ID NO: 1938274 - RNA, 14 nt, Human herpesvirus 4 [Epstein-Barr virus]
cuugcucucagcac

SEQ ID NO: 1938275 - RNA, 15 nt, Human herpesvirus 4 [Epstein-Barr virus]
agaccucugugucca

SEQ ID NO: 1938276 - RNA, 19 nt, Human herpesvirus 4 [Epstein-Barr virus]
guccaggggcuuguucuug

SEQ ID NO: 1938277 - RNA, 19 nt, Human herpesvirus 4 [Epstein-Barr virus]
gggaacgaggggaggcggg

SEQ ID NO: 1938278 - RNA, 13 nt, Human herpesvirus 4 [Epstein-Barr virus]
cccaggcagccuu

SEQ ID NO: 1938279 - RNA, 22 nt, Human herpesvirus 4 [Epstein-Barr virus]
gccggcauccagugcgucagca

SEQ ID NO: 1938280 - RNA, 18 nt, Human herpesvirus 4 [Epstein-Barr virus]
gcaagaauuggggcuggg

SEQ ID NO: 1938281 - RNA, 21 nt, Human herpesvirus 4 [Epstein-Barr virus]
aggaacacggucuggucacua

SEQ ID NO: 1938282 - RNA, 14 nt, Human herpesvirus 4 [Epstein-Barr virus]
auaccugcacggcc

SEQ ID NO: 1938283 - RNA, 18 nt, Human herpesvirus 4 [Epstein-Barr virus]
auagcagaagacuccugc

SEQ ID NO: 1938284 - RNA, 16 nt, Human herpesvirus 4 [Epstein-Barr virus]
uucugcugcugcuggu

SEQ ID NO: 1938285 - RNA, 13 nt, Human herpesvirus 4 [Epstein-Barr virus]
cggaccaggguca

SEQ ID NO: 1938286 - RNA, 23 nt, Human herpesvirus 4 [Epstein-Barr virus]
gacaaaauggggucuguggcagu

SEQ ID NO: 1938287 - RNA, 17 nt, Human herpesvirus 4 [Epstein-Barr virus]
gacggaaaucugcucuu

SEQ ID NO: 1938288 - RNA, 20 nt, Human herpesvirus 4 [Epstein-Barr virus]
aacuuccaacgcauccacca

SEQ ID NO: 1938289 - RNA, 21 nt, Human herpesvirus 4 [Epstein-Barr virus]
guucuccccacgggaaaaaga

SEQ ID NO: 1938290 - RNA, 13 nt, Human herpesvirus 4 [Epstein-Barr virus]
gaacgguggccag

SEQ ID NO: 1938291 - RNA, 21 nt, Human herpesvirus 4 [Epstein-Barr virus]
agccugagccacacccaccua

SEQ ID NO: 1938292 - RNA, 13 nt, Human herpesvirus 4 [Epstein-Barr virus]
guggagaggcccg

SEQ ID NO: 1938293 - RNA, 17 nt, Human herpesvirus 4 [Epstein-Barr virus]
augauugagaaugccaa

SEQ ID NO: 1938294 - RNA, 18 nt, Human herpesvirus 4 [Epstein-Barr virus]
cuggacgagguccuggac

SEQ ID NO: 1938295 - RNA, 23 nt, Human herpesvirus 4 [Epstein-Barr virus]
ucgaugauugagaaugccaagag

SEQ ID NO: 1938296 - RNA, 23 nt, Human herpesvirus 4 [Epstein-Barr virus]
uggagauuuucccacugugccua

SEQ ID NO: 1938297 - RNA, 16 nt, Human herpesvirus 4 [Epstein-Barr virus]
cgccaugcucagggcc

SEQ ID NO: 1938298 - RNA, 19 nt, Human herpesvirus 4 [Epstein-Barr virus]
gggaaaaacuggccaugca

SEQ ID NO: 1938299 - RNA, 21 nt, Human herpesvirus 4 [Epstein-Barr virus]
cuuauguuucaagcagcucac

SEQ ID NO: 1938300 - RNA, 16 nt, Human herpesvirus 4 [Epstein-Barr virus]
ucaguggcccucagaa

SEQ ID NO: 1938301 - RNA, 15 nt, Human herpesvirus 4 [Epstein-Barr virus]
cauuugaggaggcac

SEQ ID NO: 1938302 - RNA, 15 nt, Human herpesvirus 4 [Epstein-Barr virus]
uaacuugacuacaau

SEQ ID NO: 1938303 - RNA, 16 nt, Human herpesvirus 4 [Epstein-Barr virus]
uggaucuggggcuggc

SEQ ID NO: 1938304 - RNA, 12 nt, Human herpesvirus 4 [Epstein-Barr virus]
cugcaggcugga

SEQ ID NO: 1938305 - RNA, 13 nt, Human herpesvirus 4 [Epstein-Barr virus]
ggacgugaaccuc

SEQ ID NO: 1938306 - RNA, 17 nt, Human herpesvirus 4 [Epstein-Barr virus]
agcucggccagcaggcc

SEQ ID NO: 1938307 - RNA, 16 nt, Human herpesvirus 4 [Epstein-Barr virus]
ggucauuagaugcugc

SEQ ID NO: 1938308 - RNA, 11 nt, Human herpesvirus 4 [Epstein-Barr virus]
gaccuggaaau

SEQ ID NO: 1938309 - RNA, 19 nt, Human herpesvirus 4 [Epstein-Barr virus]
ucguccgccuacugguugu

SEQ ID NO: 1938310 - RNA, 14 nt, Human herpesvirus 4 [Epstein-Barr virus]
cugaccgacgggca

SEQ ID NO: 1938311 - RNA, 13 nt, Human herpesvirus 4 [Epstein-Barr virus]
gaagaccaggagc

SEQ ID NO: 1938312 - RNA, 14 nt, Human herpesvirus 4 [Epstein-Barr virus]
cuccaucagggcca

SEQ ID NO: 1938313 - RNA, 21 nt, Human herpesvirus 4 [Epstein-Barr virus]
agcguggucgugcugcuagcc

SEQ ID NO: 1938314 - RNA, 17 nt, Human herpesvirus 4 [Epstein-Barr virus]
ccccuggcggcccagcc

SEQ ID NO: 1938315 - RNA, 17 nt, Human herpesvirus 4 [Epstein-Barr virus]
acuggccaugcaggccu

SEQ ID NO: 1938316 - RNA, 17 nt, Human herpesvirus 4 [Epstein-Barr virus]
auugaugugacuuguga

SEQ ID NO: 1938317 - RNA, 12 nt, Human herpesvirus 4 [Epstein-Barr virus]
gcuuaaaaaugu

SEQ ID NO: 1938318 - RNA, 18 nt, Human herpesvirus 4 [Epstein-Barr virus]
caaggcggcugcugagac

SEQ ID NO: 1938319 - RNA, 21 nt, Human herpesvirus 4 [Epstein-Barr virus]
cagauuucuaguuaccacagg

SEQ ID NO: 1938320 - RNA, 22 nt, Human herpesvirus 4 [Epstein-Barr virus]
uacuugcucagguuucugggca

SEQ ID NO: 1938321 - RNA, 14 nt, Human herpesvirus 4 [Epstein-Barr virus]
gaaggaaaggccug

SEQ ID NO: 1938322 - RNA, 17 nt, Human herpesvirus 4 [Epstein-Barr virus]
ucggucaaguaccagcu

SEQ ID NO: 1938323 - RNA, 13 nt, Human herpesvirus 4 [Epstein-Barr virus]
gcaucucuuuuac

SEQ ID NO: 1938324 - RNA, 14 nt, Human herpesvirus 4 [Epstein-Barr virus]
cagcccuuaacaca

SEQ ID NO: 1938325 - RNA, 15 nt, Human herpesvirus 4 [Epstein-Barr virus]
ucacagaccagcccc

SEQ ID NO: 1938326 - RNA, 15 nt, Human herpesvirus 4 [Epstein-Barr virus]
ccucacgcgaaggga

SEQ ID NO: 1938327 - RNA, 21 nt, Human herpesvirus 4 [Epstein-Barr virus]
uuccugucggcucucuuugaa

SEQ ID NO: 1938328 - RNA, 14 nt, Human herpesvirus 4 [Epstein-Barr virus]
caggccgccaugcu

SEQ ID NO: 1938329 - RNA, 20 nt, Human herpesvirus 4 [Epstein-Barr virus]
ucuguuaaggcuguugacau

SEQ ID NO: 1938330 - RNA, 15 nt, Human herpesvirus 4 [Epstein-Barr virus]
agcaggugagggugc

SEQ ID NO: 1938331 - RNA, 13 nt, Human herpesvirus 4 [Epstein-Barr virus]
gaugguggggcuu

SEQ ID NO: 1938332 - RNA, 20 nt, Human herpesvirus 4 [Epstein-Barr virus]
uagcgucccaaacauaaaug

SEQ ID NO: 1938333 - RNA, 15 nt, Human herpesvirus 4 [Epstein-Barr virus]
ugcagcgcaucaggc

SEQ ID NO: 1938334 - RNA, 15 nt, Human herpesvirus 4 [Epstein-Barr virus]
cgggggagagaaaga

SEQ ID NO: 1938335 - RNA, 23 nt, Human herpesvirus 4 [Epstein-Barr virus]
ccuccgagugaccagucaccuuc

SEQ ID NO: 1938336 - RNA, 21 nt, Human herpesvirus 4 [Epstein-Barr virus]
gguacucuuggugcagcccuu

SEQ ID NO: 1938337 - RNA, 22 nt, Human herpesvirus 4 [Epstein-Barr virus]
gaagcccaagaagaagcccacc

SEQ ID NO: 1938338 - RNA, 23 nt, Human herpesvirus 4 [Epstein-Barr virus]
gcgcaaccagcacgucgucagag

SEQ ID NO: 1938339 - RNA, 15 nt, Human herpesvirus 4 [Epstein-Barr virus]
ccaggagucugcugc

SEQ ID NO: 1938340 - RNA, 16 nt, Human herpesvirus 4 [Epstein-Barr virus]
ggauccuccaccgccg

SEQ ID NO: 1938341 - RNA, 19 nt, Human herpesvirus 4 [Epstein-Barr virus]
cuugugaacuuuaacauug

SEQ ID NO: 1938342 - RNA, 22 nt, Human herpesvirus 4 [Epstein-Barr virus]
uucacggggccgugcaccugcc

SEQ ID NO: 1938343 - RNA, 23 nt, Human herpesvirus 4 [Epstein-Barr virus]
ggauagccucgcgacucguggga

SEQ ID NO: 1938344 - RNA, 15 nt, Human herpesvirus 4 [Epstein-Barr virus]
acuuuuugccaccca

SEQ ID NO: 1938345 - RNA, 14 nt, Human herpesvirus 4 [Epstein-Barr virus]
gcugcgguggugcg

SEQ ID NO: 1938346 - RNA, 18 nt, Human herpesvirus 4 [Epstein-Barr virus]
gcaccagcuccagggaca

SEQ ID NO: 1938347 - RNA, 19 nt, Human herpesvirus 4 [Epstein-Barr virus]
uuggagaaaacgggggugg

SEQ ID NO: 1938348 - RNA, 23 nt, Human herpesvirus 4 [Epstein-Barr virus]
ggaacccuagccaccguggccag

SEQ ID NO: 1938349 - RNA, 12 nt, Human herpesvirus 4 [Epstein-Barr virus]
gccagguacagg

SEQ ID NO: 1938350 - RNA, 17 nt, Human herpesvirus 4 [Epstein-Barr virus]
gaacaggagcaggagca

SEQ ID NO: 1938351 - RNA, 19 nt, Human herpesvirus 4 [Epstein-Barr virus]
cuggccgagcuggaggcca

SEQ ID NO: 1938352 - RNA, 16 nt, Human herpesvirus 4 [Epstein-Barr virus]
auuccaggugugcuuc

SEQ ID NO: 1938353 - RNA, 18 nt, Human herpesvirus 4 [Epstein-Barr virus]
ggcccuuugccuggggcu

SEQ ID NO: 1938354 - RNA, 17 nt, Human herpesvirus 4 [Epstein-Barr virus]
acccaccgcaaccgcug

SEQ ID NO: 1938355 - RNA, 23 nt, Human herpesvirus 4 [Epstein-Barr virus]
gucuucugucucggccuccuggc

SEQ ID NO: 1938356 - RNA, 21 nt, Human herpesvirus 4 [Epstein-Barr virus]
gggguucuccaggcuccugga

SEQ ID NO: 1938357 - RNA, 22 nt, Human herpesvirus 4 [Epstein-Barr virus]
cugcuugugaucauggaaacca

SEQ ID NO: 1938358 - RNA, 23 nt, Human herpesvirus 4 [Epstein-Barr virus]
cuuguuucucagagagcauuuca

SEQ ID NO: 1938359 - RNA, 20 nt, Human herpesvirus 4 [Epstein-Barr virus]
gguauucucagaugcagugg

SEQ ID NO: 1938360 - RNA, 21 nt, Human herpesvirus 4 [Epstein-Barr virus]
gacauuucucauaauggugcc

SEQ ID NO: 1938361 - RNA, 21 nt, Human herpesvirus 4 [Epstein-Barr virus]
gcugcuuuuagccuaauugug

SEQ ID NO: 1938362 - RNA, 19 nt, Human herpesvirus 4 [Epstein-Barr virus]
aaagaucuaccccagcugc

SEQ ID NO: 1938363 - RNA, 13 nt, Human herpesvirus 4 [Epstein-Barr virus]
ccagguagcccag

SEQ ID NO: 1938364 - RNA, 14 nt, Human herpesvirus 4 [Epstein-Barr virus]
ccuccucugggccg

SEQ ID NO: 1938365 - RNA, 21 nt, Human herpesvirus 4 [Epstein-Barr virus]
ugaggcugaugauggccacga

SEQ ID NO: 1938366 - RNA, 21 nt, Human herpesvirus 4 [Epstein-Barr virus]
ggaagcguucuucacugucca

SEQ ID NO: 1938367 - RNA, 23 nt, Human herpesvirus 4 [Epstein-Barr virus]
ccagacuccggggguccagccgg

SEQ ID NO: 1938368 - RNA, 21 nt, Human herpesvirus 4 [Epstein-Barr virus]
cgaaagcacuuugaaagaugu

SEQ ID NO: 1938369 - RNA, 18 nt, Human herpesvirus 4 [Epstein-Barr virus]
gucaauaauuucagugaa

SEQ ID NO: 1938370 - RNA, 16 nt, Human herpesvirus 4 [Epstein-Barr virus]
uaggcguaacuugucu

SEQ ID NO: 1938371 - RNA, 15 nt, Human herpesvirus 4 [Epstein-Barr virus]
guggccacacugggg

SEQ ID NO: 1938372 - RNA, 18 nt, Human herpesvirus 4 [Epstein-Barr virus]
aggagacuggcaacuccu

SEQ ID NO: 1938373 - RNA, 18 nt, Human herpesvirus 4 [Epstein-Barr virus]
ggaagagaggggcaggga

SEQ ID NO: 1938374 - RNA, 15 nt, Human herpesvirus 4 [Epstein-Barr virus]
uccaagugcaacaau

SEQ ID NO: 1938375 - RNA, 18 nt, Human herpesvirus 4 [Epstein-Barr virus]
gugcgcaacgccggccug

SEQ ID NO: 1938376 - RNA, 14 nt, Human herpesvirus 4 [Epstein-Barr virus]
uugugcuccugaua

SEQ ID NO: 1938377 - RNA, 18 nt, Human herpesvirus 4 [Epstein-Barr virus]
ggcuacaacaggcugcug

SEQ ID NO: 1938378 - RNA, 13 nt, Human herpesvirus 4 [Epstein-Barr virus]
cuggcacacacuc

SEQ ID NO: 1938379 - RNA, 19 nt, Human herpesvirus 4 [Epstein-Barr virus]
uggagagauuucauccuca

SEQ ID NO: 1938380 - RNA, 16 nt, Human herpesvirus 4 [Epstein-Barr virus]
cuugcacccaccccca

SEQ ID NO: 1938381 - RNA, 13 nt, Human herpesvirus 4 [Epstein-Barr virus]
uggcggccuggca

SEQ ID NO: 1938382 - RNA, 19 nt, Human herpesvirus 4 [Epstein-Barr virus]
cgggucaggucgcggacca

SEQ ID NO: 1938383 - RNA, 22 nt, Human herpesvirus 4 [Epstein-Barr virus]
gugauaaccauggacgaggacg

SEQ ID NO: 1938384 - RNA, 23 nt, Human herpesvirus 4 [Epstein-Barr virus]
guaguaggcacaucuggaccugg

SEQ ID NO: 1938385 - RNA, 17 nt, Human herpesvirus 4 [Epstein-Barr virus]
ccacagccugcaccagu

SEQ ID NO: 1938386 - RNA, 15 nt, Human herpesvirus 4 [Epstein-Barr virus]
aggcgcgggucuggg

SEQ ID NO: 1938387 - RNA, 23 nt, Human herpesvirus 4 [Epstein-Barr virus]
aauuauccaagaaaccccacgga

SEQ ID NO: 1938388 - RNA, 21 nt, Human herpesvirus 4 [Epstein-Barr virus]
cggggccuuggcaucaucagc

SEQ ID NO: 1938389 - RNA, 13 nt, Human herpesvirus 4 [Epstein-Barr virus]
ccccucugcagag

SEQ ID NO: 1938390 - RNA, 16 nt, Human herpesvirus 4 [Epstein-Barr virus]
cagggcaaagccacaa

SEQ ID NO: 1938391 - RNA, 21 nt, Human herpesvirus 4 [Epstein-Barr virus]
ccacggcccggggguggcagc

SEQ ID NO: 1938392 - RNA, 18 nt, Human herpesvirus 4 [Epstein-Barr virus]
cccagacucaucucaagg

SEQ ID NO: 1938393 - RNA, 20 nt, Human herpesvirus 4 [Epstein-Barr virus]
caacacaacuaccaggcaga

SEQ ID NO: 1938394 - RNA, 13 nt, Human herpesvirus 4 [Epstein-Barr virus]
agcucuggcacug

SEQ ID NO: 1938395 - RNA, 21 nt, Human herpesvirus 4 [Epstein-Barr virus]
ggacguuggcgggacuggcac

SEQ ID NO: 1938396 - RNA, 14 nt, Human herpesvirus 4 [Epstein-Barr virus]
cucugaccaggaca

SEQ ID NO: 1938397 - RNA, 20 nt, Human herpesvirus 4 [Epstein-Barr virus]
ggcgugcccgaacccggguu

SEQ ID NO: 1938398 - RNA, 21 nt, Human herpesvirus 4 [Epstein-Barr virus]
caaugagagccaaaaauuuga

SEQ ID NO: 1938399 - RNA, 16 nt, Human herpesvirus 4 [Epstein-Barr virus]
ggugggggugggugca

SEQ ID NO: 1938400 - RNA, 14 nt, Human herpesvirus 4 [Epstein-Barr virus]
agucaccugcacag

SEQ ID NO: 1938401 - RNA, 14 nt, Human herpesvirus 4 [Epstein-Barr virus]
caagaguucucugg

SEQ ID NO: 1938402 - RNA, 14 nt, Human herpesvirus 4 [Epstein-Barr virus]
caauggggccagga

SEQ ID NO: 1938403 - RNA, 12 nt, Human herpesvirus 4 [Epstein-Barr virus]
cggcugcucccg

SEQ ID NO: 1938404 - RNA, 20 nt, Human herpesvirus 4 [Epstein-Barr virus]
agaggccguguuucucccac

SEQ ID NO: 1938405 - RNA, 20 nt, Human herpesvirus 4 [Epstein-Barr virus]
ggacccuugucuuuggugga

SEQ ID NO: 1938406 - RNA, 17 nt, Human herpesvirus 4 [Epstein-Barr virus]
ggcacaucuggcaccug

SEQ ID NO: 1938407 - RNA, 17 nt, Human herpesvirus 4 [Epstein-Barr virus]
uccagaaaaugccgggc

SEQ ID NO: 1938408 - RNA, 21 nt, Human herpesvirus 4 [Epstein-Barr virus]
aguggcagaaucaccagagcc

SEQ ID NO: 1938409 - RNA, 20 nt, Human herpesvirus 4 [Epstein-Barr virus]
gagcaggagcgggaggggca

SEQ ID NO: 1938410 - RNA, 16 nt, Human herpesvirus 4 [Epstein-Barr virus]
gaucccaggccucagc

SEQ ID NO: 1938411 - RNA, 17 nt, Human herpesvirus 4 [Epstein-Barr virus]
ccuugcguggugcuguc

SEQ ID NO: 1938412 - RNA, 23 nt, Human herpesvirus 4 [Epstein-Barr virus]
uaccaggggcgagcagcgcggca

SEQ ID NO: 1938413 - RNA, 16 nt, Human herpesvirus 4 [Epstein-Barr virus]
ggagaugggugcauuu

SEQ ID NO: 1938414 - RNA, 17 nt, Human herpesvirus 4 [Epstein-Barr virus]
acacacauggcacucau

SEQ ID NO: 1938415 - RNA, 16 nt, Human herpesvirus 4 [Epstein-Barr virus]
cgugaccaccuggcca

SEQ ID NO: 1938416 - RNA, 17 nt, Human herpesvirus 4 [Epstein-Barr virus]
cuggccaaccugccucu

SEQ ID NO: 1938417 - RNA, 20 nt, Human herpesvirus 4 [Epstein-Barr virus]
ucguguuggauuggcuguca

SEQ ID NO: 1938418 - RNA, 11 nt, Human herpesvirus 4 [Epstein-Barr virus]
ccucugggugc

SEQ ID NO: 1938419 - RNA, 21 nt, Human herpesvirus 4 [Epstein-Barr virus]
acuugucuacaucccauaccu

SEQ ID NO: 1938420 - RNA, 14 nt, Human herpesvirus 4 [Epstein-Barr virus]
gacgcuccaggauc

SEQ ID NO: 1938421 - RNA, 14 nt, Human herpesvirus 4 [Epstein-Barr virus]
gccuucgcccccuc

SEQ ID NO: 1938422 - RNA, 14 nt, Human herpesvirus 4 [Epstein-Barr virus]
gucagaccugaaga

SEQ ID NO: 1938423 - RNA, 13 nt, Human herpesvirus 4 [Epstein-Barr virus]
ggcccgggaccgc

SEQ ID NO: 1938424 - RNA, 17 nt, Human herpesvirus 4 [Epstein-Barr virus]
gucuccagagggcagac

SEQ ID NO: 1938425 - RNA, 15 nt, Human herpesvirus 4 [Epstein-Barr virus]
ucuggucgcccccuc

SEQ ID NO: 1938426 - RNA, 15 nt, Human herpesvirus 4 [Epstein-Barr virus]
gccuucuccucagcc

SEQ ID NO: 1938427 - RNA, 13 nt, Human herpesvirus 4 [Epstein-Barr virus]
gaggaaggggccu

SEQ ID NO: 1938428 - RNA, 23 nt, Human herpesvirus 4 [Epstein-Barr virus]
ccugcccuccuccacccagcagc

SEQ ID NO: 1938429 - RNA, 18 nt, Human herpesvirus 4 [Epstein-Barr virus]
gggccacugcaggcugga

SEQ ID NO: 1938430 - RNA, 19 nt, Human herpesvirus 4 [Epstein-Barr virus]
aggaccugggagggccauc

SEQ ID NO: 1938431 - RNA, 21 nt, Human herpesvirus 4 [Epstein-Barr virus]
cgucguucaggaacagccucc

SEQ ID NO: 1938432 - RNA, 16 nt, Human herpesvirus 4 [Epstein-Barr virus]
gaccuggcucaggucc

SEQ ID NO: 1938433 - RNA, 15 nt, Human herpesvirus 4 [Epstein-Barr virus]
ggccuccagcucggc

SEQ ID NO: 1938434 - RNA, 17 nt, Human herpesvirus 4 [Epstein-Barr virus]
cucggaggugcccgggu

SEQ ID NO: 1938435 - RNA, 22 nt, Human herpesvirus 4 [Epstein-Barr virus]
ccccuccauuccacccacugau

SEQ ID NO: 1938436 - RNA, 14 nt, Human herpesvirus 4 [Epstein-Barr virus]
gcgccagcagggca

SEQ ID NO: 1938437 - RNA, 17 nt, Human herpesvirus 4 [Epstein-Barr virus]
augcuuacucaauccau

SEQ ID NO: 1938438 - RNA, 21 nt, Human herpesvirus 4 [Epstein-Barr virus]
acgaggcccugcaagccaaga

SEQ ID NO: 1938439 - RNA, 22 nt, Human herpesvirus 4 [Epstein-Barr virus]
cucgccgcuaguugguccaggg

SEQ ID NO: 1938440 - RNA, 14 nt, Human herpesvirus 4 [Epstein-Barr virus]
gcgagaauuggcag

SEQ ID NO: 1938441 - RNA, 18 nt, Human herpesvirus 4 [Epstein-Barr virus]
caacgccggccugcuggc

SEQ ID NO: 1938442 - RNA, 17 nt, Human herpesvirus 4 [Epstein-Barr virus]
cccuacucuccacggga

SEQ ID NO: 1938443 - RNA, 13 nt, Human herpesvirus 4 [Epstein-Barr virus]
uuuggugcugccu

SEQ ID NO: 1938444 - RNA, 13 nt, Human herpesvirus 4 [Epstein-Barr virus]
ugucccacuccac

SEQ ID NO: 1938445 - RNA, 19 nt, Human herpesvirus 4 [Epstein-Barr virus]
cccacacagcgccagcagg

SEQ ID NO: 1938446 - RNA, 18 nt, Human herpesvirus 4 [Epstein-Barr virus]
agagguuuugcuagggag

SEQ ID NO: 1938447 - RNA, 20 nt, Human herpesvirus 4 [Epstein-Barr virus]
gaacacccccaccccaccga

SEQ ID NO: 1938448 - RNA, 20 nt, Human herpesvirus 4 [Epstein-Barr virus]
acucccauguaagccugccu

SEQ ID NO: 1938449 - RNA, 19 nt, Human herpesvirus 4 [Epstein-Barr virus]
cuguacaaacccaacaaug

SEQ ID NO: 1938450 - RNA, 16 nt, Human herpesvirus 4 [Epstein-Barr virus]
gccuccagcucggcca

SEQ ID NO: 1938451 - RNA, 22 nt, Human herpesvirus 4 [Epstein-Barr virus]
cagcuccagggccagcaaaacc

SEQ ID NO: 1938452 - RNA, 16 nt, Human herpesvirus 4 [Epstein-Barr virus]
augaggaaggggccuc

SEQ ID NO: 1938453 - RNA, 12 nt, Human herpesvirus 4 [Epstein-Barr virus]
gauggugcuggu

SEQ ID NO: 1938454 - RNA, 14 nt, Human herpesvirus 4 [Epstein-Barr virus]
cugcucgccccugg

SEQ ID NO: 1938455 - RNA, 16 nt, Human herpesvirus 4 [Epstein-Barr virus]
gucucggccuccuggc

SEQ ID NO: 1938456 - RNA, 15 nt, Human herpesvirus 4 [Epstein-Barr virus]
caggaucagaaucaa

SEQ ID NO: 1938457 - RNA, 16 nt, Human herpesvirus 4 [Epstein-Barr virus]
gcguccuuugggaaca

SEQ ID NO: 1938458 - RNA, 19 nt, Human herpesvirus 4 [Epstein-Barr virus]
cccgaaagcggcccagcag

SEQ ID NO: 1938459 - RNA, 17 nt, Human herpesvirus 4 [Epstein-Barr virus]
gcgccagcagggcacag

SEQ ID NO: 1938460 - RNA, 22 nt, Human herpesvirus 4 [Epstein-Barr virus]
cgggccaaguuuaagcaacugc

SEQ ID NO: 1938461 - RNA, 22 nt, Human herpesvirus 4 [Epstein-Barr virus]
cugccuauggauagauagccac

SEQ ID NO: 1938462 - RNA, 12 nt, Human herpesvirus 4 [Epstein-Barr virus]
gucaaggccucg

SEQ ID NO: 1938463 - RNA, 18 nt, Human herpesvirus 4 [Epstein-Barr virus]
cagagcaaaagcaauaaa

SEQ ID NO: 1938464 - RNA, 14 nt, Human herpesvirus 4 [Epstein-Barr virus]
gaaacccucaguca

SEQ ID NO: 1938465 - RNA, 20 nt, Human herpesvirus 4 [Epstein-Barr virus]
caggcagaugaggccccuua

SEQ ID NO: 1938466 - RNA, 17 nt, Human herpesvirus 4 [Epstein-Barr virus]
cgccugcuucacgccuc

SEQ ID NO: 1938467 - RNA, 17 nt, Human herpesvirus 4 [Epstein-Barr virus]
uccacagauggagagau

SEQ ID NO: 1938468 - RNA, 15 nt, Human herpesvirus 4 [Epstein-Barr virus]
gggcguacaccuggc

SEQ ID NO: 1938469 - RNA, 23 nt, Human herpesvirus 4 [Epstein-Barr virus]
cugauucccccugcucauaccuc

SEQ ID NO: 1938470 - RNA, 13 nt, Human herpesvirus 4 [Epstein-Barr virus]
caugguggcuucu

SEQ ID NO: 1938471 - RNA, 12 nt, Human herpesvirus 4 [Epstein-Barr virus]
uacaaccaagcc

SEQ ID NO: 1938472 - RNA, 16 nt, Human herpesvirus 4 [Epstein-Barr virus]
ugcaggccuggacagc

SEQ ID NO: 1938473 - RNA, 22 nt, Human herpesvirus 4 [Epstein-Barr virus]
agccuugcguggugcuguccug

SEQ ID NO: 1938474 - RNA, 17 nt, Human herpesvirus 4 [Epstein-Barr virus]
gcccggccucgccuucu

SEQ ID NO: 1938475 - RNA, 24 nt, Human herpesvirus 4 [Epstein-Barr virus]
cggaguugaugaaaggggccgagg

SEQ ID NO: 1938476 - RNA, 23 nt, Human herpesvirus 4 [Epstein-Barr virus]
ccuggacgagggggcgcggcugg

SEQ ID NO: 1938477 - RNA, 16 nt, Human herpesvirus 4 [Epstein-Barr virus]
cuuguccgcuauuuuu

SEQ ID NO: 1938478 - RNA, 16 nt, Human herpesvirus 4 [Epstein-Barr virus]
uggcuugcuccaccag

SEQ ID NO: 1938479 - RNA, 17 nt, Human herpesvirus 4 [Epstein-Barr virus]
augcgugaccaccuggc

SEQ ID NO: 1938480 - RNA, 20 nt, Human herpesvirus 4 [Epstein-Barr virus]
gcuggcucgccucauccugg

SEQ ID NO: 1938481 - RNA, 15 nt, Human herpesvirus 4 [Epstein-Barr virus]
gcugcgguggugcgc

SEQ ID NO: 1938482 - RNA, 18 nt, Human herpesvirus 4 [Epstein-Barr virus]
cugagugcccagggcaga

SEQ ID NO: 1938483 - RNA, 22 nt, Human herpesvirus 4 [Epstein-Barr virus]
cagaggaaggccacaaagaggg

SEQ ID NO: 1938484 - RNA, 21 nt, Human herpesvirus 4 [Epstein-Barr virus]
ccucucgccuuguuucucaga

SEQ ID NO: 1938485 - RNA, 15 nt, Human herpesvirus 4 [Epstein-Barr virus]
caggaggaggggcag

SEQ ID NO: 1938486 - RNA, 20 nt, Human herpesvirus 4 [Epstein-Barr virus]
ggcacguuuaccagugugcc

SEQ ID NO: 1938487 - RNA, 16 nt, Human herpesvirus 4 [Epstein-Barr virus]
ucccgccccuguccac

SEQ ID NO: 1938488 - RNA, 15 nt, Human herpesvirus 4 [Epstein-Barr virus]
cuacccggucgcaug

SEQ ID NO: 1938489 - RNA, 14 nt, Human herpesvirus 4 [Epstein-Barr virus]
cggcaccgccaggu

SEQ ID NO: 1938490 - RNA, 16 nt, Human herpesvirus 4 [Epstein-Barr virus]
cacugucacugugcac

SEQ ID NO: 1938491 - RNA, 19 nt, Human herpesvirus 4 [Epstein-Barr virus]
ugcauuuccugcccuccca

SEQ ID NO: 1938492 - RNA, 14 nt, Human herpesvirus 4 [Epstein-Barr virus]
cugcguagaugagc

SEQ ID NO: 1938493 - RNA, 23 nt, Human herpesvirus 4 [Epstein-Barr virus]
cgugccucagauagccggaccuc

SEQ ID NO: 1938494 - RNA, 23 nt, Human herpesvirus 4 [Epstein-Barr virus]
uccuguacaaacccaacaaugug

SEQ ID NO: 1938495 - RNA, 23 nt, Human herpesvirus 4 [Epstein-Barr virus]
cguggaguccaugaccagggggc

SEQ ID NO: 1938496 - RNA, 22 nt, Human herpesvirus 4 [Epstein-Barr virus]
gccgcuccguggccccgggagc

SEQ ID NO: 1938497 - RNA, 18 nt, Human herpesvirus 4 [Epstein-Barr virus]
uccagcucggccagcagg

SEQ ID NO: 1938498 - RNA, 23 nt, Human herpesvirus 4 [Epstein-Barr virus]
uuagccuaauuguguauugcucu

SEQ ID NO: 1938499 - RNA, 20 nt, Human herpesvirus 4 [Epstein-Barr virus]
uggcagcagcucuggcacug

SEQ ID NO: 1938500 - RNA, 20 nt, Human herpesvirus 4 [Epstein-Barr virus]
aggagaagagaggcuucccg

SEQ ID NO: 1938501 - RNA, 17 nt, Human herpesvirus 4 [Epstein-Barr virus]
aaacaaggggaaaggag

SEQ ID NO: 1938502 - RNA, 17 nt, Human herpesvirus 4 [Epstein-Barr virus]
ccaucuaaacgccugau

SEQ ID NO: 1938503 - RNA, 18 nt, Human herpesvirus 4 [Epstein-Barr virus]
guccaccuggccaccaca

SEQ ID NO: 1938504 - RNA, 22 nt, Human herpesvirus 4 [Epstein-Barr virus]
gugugucccccuccauuccacc

SEQ ID NO: 1938505 - RNA, 21 nt, Human herpesvirus 4 [Epstein-Barr virus]
agagaggcgggaauggccgcc

SEQ ID NO: 1938506 - RNA, 16 nt, Human herpesvirus 4 [Epstein-Barr virus]
uaacacgaaugcccag

SEQ ID NO: 1938507 - RNA, 23 nt, Human herpesvirus 4 [Epstein-Barr virus]
cuacgggcgcaccuguguccugg

SEQ ID NO: 1938508 - RNA, 19 nt, Human herpesvirus 4 [Epstein-Barr virus]
augccucacgcgaagggaa

SEQ ID NO: 1938509 - RNA, 22 nt, Human herpesvirus 4 [Epstein-Barr virus]
ggaaagaggucccauguacagc

SEQ ID NO: 1938510 - RNA, 12 nt, Human herpesvirus 4 [Epstein-Barr virus]
ucuuggcagcag

SEQ ID NO: 1938511 - RNA, 19 nt, Human herpesvirus 4 [Epstein-Barr virus]
ccucggacauccagugucc

SEQ ID NO: 1938512 - RNA, 19 nt, Human herpesvirus 4 [Epstein-Barr virus]
ccagcuggucaucagccgc

SEQ ID NO: 1938513 - RNA, 17 nt, Human herpesvirus 4 [Epstein-Barr virus]
gccacggcgucaaacag

SEQ ID NO: 1938514 - RNA, 16 nt, Human herpesvirus 4 [Epstein-Barr virus]
acuggaugcaggaccu

SEQ ID NO: 1938515 - RNA, 22 nt, Human herpesvirus 4 [Epstein-Barr virus]
ggaagagacuucacagagcagc

SEQ ID NO: 1938516 - RNA, 22 nt, Human herpesvirus 4 [Epstein-Barr virus]
gcgucccaaacauaaaugcccc

SEQ ID NO: 1938517 - RNA, 14 nt, Human herpesvirus 4 [Epstein-Barr virus]
gugauuaggagcag

SEQ ID NO: 1938518 - RNA, 16 nt, Human herpesvirus 4 [Epstein-Barr virus]
ggcccuuagcauggga

SEQ ID NO: 1938519 - RNA, 16 nt, Human herpesvirus 4 [Epstein-Barr virus]
cagaacaucacugcca

SEQ ID NO: 1938520 - RNA, 19 nt, Human herpesvirus 4 [Epstein-Barr virus]
ucgugcucuucauguccac

SEQ ID NO: 1938521 - RNA, 14 nt, Human herpesvirus 4 [Epstein-Barr virus]
gaaagaggcucugc

SEQ ID NO: 1938522 - RNA, 19 nt, Human herpesvirus 4 [Epstein-Barr virus]
aggaggauggccuccagcu

SEQ ID NO: 1938523 - RNA, 23 nt, Human herpesvirus 4 [Epstein-Barr virus]
uccacaccauccacagccccacu

SEQ ID NO: 1938524 - RNA, 22 nt, Human herpesvirus 4 [Epstein-Barr virus]
cuccugccugccucugcucugg

SEQ ID NO: 1938525 - RNA, 21 nt, Human herpesvirus 4 [Epstein-Barr virus]
ccggugguggguguggagccg

SEQ ID NO: 1938526 - RNA, 16 nt, Human herpesvirus 4 [Epstein-Barr virus]
ugcaccgauagcaugg

SEQ ID NO: 1938527 - RNA, 12 nt, Human herpesvirus 4 [Epstein-Barr virus]
gaggaaacagga

SEQ ID NO: 1938528 - RNA, 23 nt, Human herpesvirus 4 [Epstein-Barr virus]
gcugcaccuggacauagaggggc

SEQ ID NO: 1938529 - RNA, 13 nt, Human herpesvirus 4 [Epstein-Barr virus]
cagggggccgggc

SEQ ID NO: 1938530 - RNA, 15 nt, Human herpesvirus 4 [Epstein-Barr virus]
gugaguccagggccc

SEQ ID NO: 1938531 - RNA, 19 nt, Human herpesvirus 4 [Epstein-Barr virus]
cgccugcggacucaggcca

SEQ ID NO: 1938532 - RNA, 23 nt, Human herpesvirus 4 [Epstein-Barr virus]
ucagggguguagugggugggcau

SEQ ID NO: 1938533 - RNA, 15 nt, Human herpesvirus 4 [Epstein-Barr virus]
gaaucucugccaacu

SEQ ID NO: 1938534 - RNA, 16 nt, Human herpesvirus 4 [Epstein-Barr virus]
ggcaggaggggcagga

SEQ ID NO: 1938535 - RNA, 20 nt, Human herpesvirus 4 [Epstein-Barr virus]
gccaggcagaggaaggccac

SEQ ID NO: 1938536 - RNA, 22 nt, Human herpesvirus 4 [Epstein-Barr virus]
gugagguggugcuugugaaggu

SEQ ID NO: 1938537 - RNA, 15 nt, Human herpesvirus 4 [Epstein-Barr virus]
gucccugcugcccau

SEQ ID NO: 1938538 - RNA, 22 nt, Human herpesvirus 4 [Epstein-Barr virus]
ucccaguuguuauucccaccuc

SEQ ID NO: 1938539 - RNA, 20 nt, Human herpesvirus 4 [Epstein-Barr virus]
aacuugacuacaauguuccu

SEQ ID NO: 1938540 - RNA, 16 nt, Human herpesvirus 4 [Epstein-Barr virus]
cucugggguccaggag

SEQ ID NO: 1938541 - RNA, 20 nt, Human herpesvirus 4 [Epstein-Barr virus]
ugaggacggugucugugguu

SEQ ID NO: 1938542 - RNA, 21 nt, Human herpesvirus 4 [Epstein-Barr virus]
ucucgccuuguuucucagaga

SEQ ID NO: 1938543 - RNA, 19 nt, Human herpesvirus 4 [Epstein-Barr virus]
acuacgagggccucuggca

SEQ ID NO: 1938544 - RNA, 15 nt, Human herpesvirus 4 [Epstein-Barr virus]
ccuccuacacacauc

SEQ ID NO: 1938545 - RNA, 16 nt, Human herpesvirus 4 [Epstein-Barr virus]
cgagcagaaggccaug

SEQ ID NO: 1938546 - RNA, 19 nt, Human herpesvirus 4 [Epstein-Barr virus]
agcaugucacacauucccc

SEQ ID NO: 1938547 - RNA, 16 nt, Human herpesvirus 4 [Epstein-Barr virus]
cuuguuggaauggggc

SEQ ID NO: 1938548 - RNA, 18 nt, Human herpesvirus 4 [Epstein-Barr virus]
cggacaugucacgugucc

SEQ ID NO: 1938549 - RNA, 21 nt, Human herpesvirus 4 [Epstein-Barr virus]
caucugaaaaugacaggcugc

SEQ ID NO: 1938550 - RNA, 17 nt, Human herpesvirus 4 [Epstein-Barr virus]
aggccgcugccaggccg

SEQ ID NO: 1938551 - RNA, 13 nt, Human herpesvirus 4 [Epstein-Barr virus]
ggccucugggguc

SEQ ID NO: 1938552 - RNA, 15 nt, Human herpesvirus 4 [Epstein-Barr virus]
ccggccgaggccugc

SEQ ID NO: 1938553 - RNA, 16 nt, Human herpesvirus 4 [Epstein-Barr virus]
uggccgcggcccaggu

SEQ ID NO: 1938554 - RNA, 12 nt, Human herpesvirus 4 [Epstein-Barr virus]
ggcggcugcugc

SEQ ID NO: 1938555 - RNA, 15 nt, Human herpesvirus 4 [Epstein-Barr virus]
aggagcuccgugagc

SEQ ID NO: 1938556 - RNA, 21 nt, Human herpesvirus 4 [Epstein-Barr virus]
ggcuuccagagaggcgcagcc

SEQ ID NO: 1938557 - RNA, 19 nt, Human herpesvirus 4 [Epstein-Barr virus]
cuucccagacucugcuuuc

SEQ ID NO: 1938558 - RNA, 20 nt, Human herpesvirus 4 [Epstein-Barr virus]
agucagccuugcccccgcca

SEQ ID NO: 1938559 - RNA, 15 nt, Human herpesvirus 4 [Epstein-Barr virus]
caugccuccccagca

SEQ ID NO: 1938560 - RNA, 13 nt, Human herpesvirus 4 [Epstein-Barr virus]
ggcgaagcuggcu

SEQ ID NO: 1938561 - RNA, 15 nt, Human herpesvirus 4 [Epstein-Barr virus]
ucuccauucccagcc

SEQ ID NO: 1938562 - RNA, 13 nt, Human herpesvirus 4 [Epstein-Barr virus]
ccagagcccagag

SEQ ID NO: 1938563 - RNA, 22 nt, Human herpesvirus 4 [Epstein-Barr virus]
auaaagcuguccuucugucaca

SEQ ID NO: 1938564 - RNA, 16 nt, Human herpesvirus 4 [Epstein-Barr virus]
cuggggcuggccugcc

SEQ ID NO: 1938565 - RNA, 20 nt, Human herpesvirus 4 [Epstein-Barr virus]
ccugaguucuacaaugccag

SEQ ID NO: 1938566 - RNA, 16 nt, Human herpesvirus 4 [Epstein-Barr virus]
cgagaccggcuccgga

SEQ ID NO: 1938567 - RNA, 18 nt, Human herpesvirus 4 [Epstein-Barr virus]
ucgugcaaccaggcccac

SEQ ID NO: 1938568 - RNA, 16 nt, Human herpesvirus 4 [Epstein-Barr virus]
cgugcaagcagcaccu

SEQ ID NO: 1938569 - RNA, 15 nt, Human herpesvirus 4 [Epstein-Barr virus]
cccuucugcugcugc

SEQ ID NO: 1938570 - RNA, 18 nt, Human herpesvirus 4 [Epstein-Barr virus]
aggcaauggucgccaggg

SEQ ID NO: 1938571 - RNA, 14 nt, Human herpesvirus 4 [Epstein-Barr virus]
ucggcccuccgcau

SEQ ID NO: 1938572 - RNA, 20 nt, Human herpesvirus 4 [Epstein-Barr virus]
gacggugggcaugacacagg

SEQ ID NO: 1938573 - RNA, 12 nt, Human herpesvirus 4 [Epstein-Barr virus]
ugguggcagcag

SEQ ID NO: 1938574 - RNA, 12 nt, Human herpesvirus 4 [Epstein-Barr virus]
cacucagcuccg

SEQ ID NO: 1938575 - RNA, 16 nt, Human herpesvirus 4 [Epstein-Barr virus]
cuucugcugcugcugg

SEQ ID NO: 1938576 - RNA, 15 nt, Human herpesvirus 4 [Epstein-Barr virus]
gucacggaugcugca

SEQ ID NO: 1938577 - RNA, 16 nt, Human herpesvirus 4 [Epstein-Barr virus]
ccaggccgccaugcuc

SEQ ID NO: 1938578 - RNA, 13 nt, Human herpesvirus 4 [Epstein-Barr virus]
cgggcucccuccc

SEQ ID NO: 1938579 - RNA, 15 nt, Human herpesvirus 4 [Epstein-Barr virus]
gccuccaacaggugc

SEQ ID NO: 1938580 - RNA, 15 nt, Human herpesvirus 4 [Epstein-Barr virus]
gcacugcguccaccu

SEQ ID NO: 1938581 - RNA, 21 nt, Human herpesvirus 4 [Epstein-Barr virus]
gaugaccaugauggugcagag

SEQ ID NO: 1938582 - RNA, 19 nt, Human herpesvirus 4 [Epstein-Barr virus]
aguaccagcccuuuuucca

SEQ ID NO: 1938583 - RNA, 18 nt, Human herpesvirus 4 [Epstein-Barr virus]
cagacuuuuggcaauggg

SEQ ID NO: 1938584 - RNA, 16 nt, Human herpesvirus 4 [Epstein-Barr virus]
uccggcugcccgucuc

SEQ ID NO: 1938585 - RNA, 16 nt, Human herpesvirus 4 [Epstein-Barr virus]
gcucccucccccuccc

SEQ ID NO: 1938586 - RNA, 15 nt, Human herpesvirus 4 [Epstein-Barr virus]
uacaaacacuacaau

SEQ ID NO: 1938587 - RNA, 22 nt, Human herpesvirus 4 [Epstein-Barr virus]
ccugauuuuuguccgcaggugg

SEQ ID NO: 1938588 - RNA, 16 nt, Human herpesvirus 4 [Epstein-Barr virus]
aggacccauauugggg

SEQ ID NO: 1938589 - RNA, 18 nt, Human herpesvirus 4 [Epstein-Barr virus]
gccuugguuucagccuca

SEQ ID NO: 1938590 - RNA, 17 nt, Human herpesvirus 4 [Epstein-Barr virus]
ugccuggauucuuacag

SEQ ID NO: 1938591 - RNA, 14 nt, Human herpesvirus 4 [Epstein-Barr virus]
ucaugcgugaccac

SEQ ID NO: 1938592 - RNA, 24 nt, Human herpesvirus 4 [Epstein-Barr virus]
cacugccaagguugaagagcagau

SEQ ID NO: 1938593 - RNA, 16 nt, Human herpesvirus 4 [Epstein-Barr virus]
cuagagguuuugcuag

SEQ ID NO: 1938594 - RNA, 22 nt, Human herpesvirus 4 [Epstein-Barr virus]
ccuccgguuugaacaucagacc

SEQ ID NO: 1938595 - RNA, 19 nt, Human herpesvirus 4 [Epstein-Barr virus]
cuuucuggccaaccugccu

SEQ ID NO: 1938596 - RNA, 19 nt, Human herpesvirus 4 [Epstein-Barr virus]
ggggccagguacaggaccu

SEQ ID NO: 1938597 - RNA, 20 nt, Human herpesvirus 4 [Epstein-Barr virus]
agcgcccugucccuggagcu

SEQ ID NO: 1938598 - RNA, 19 nt, Human herpesvirus 4 [Epstein-Barr virus]
ugccugaagcuugcugggg

SEQ ID NO: 1938599 - RNA, 11 nt, Human herpesvirus 4 [Epstein-Barr virus]
caggcuccugg

SEQ ID NO: 1938600 - RNA, 13 nt, Human herpesvirus 4 [Epstein-Barr virus]
gggcaccguggga

SEQ ID NO: 1938601 - RNA, 18 nt, Human herpesvirus 4 [Epstein-Barr virus]
cgacauguuucuggugag

SEQ ID NO: 1938602 - RNA, 16 nt, Human herpesvirus 4 [Epstein-Barr virus]
guccagggguccccga

SEQ ID NO: 1938603 - RNA, 13 nt, Human herpesvirus 4 [Epstein-Barr virus]
agagcuccgccac

SEQ ID NO: 1938604 - RNA, 17 nt, Human herpesvirus 4 [Epstein-Barr virus]
ccagaucgccugccacu

SEQ ID NO: 1938605 - RNA, 15 nt, Human herpesvirus 4 [Epstein-Barr virus]
ggugccggggcccac

SEQ ID NO: 1938606 - RNA, 14 nt, Human herpesvirus 4 [Epstein-Barr virus]
gcuccagggccagc

SEQ ID NO: 1938607 - RNA, 14 nt, Human herpesvirus 4 [Epstein-Barr virus]
ccuggccggccgcc

SEQ ID NO: 1938608 - RNA, 13 nt, Human herpesvirus 4 [Epstein-Barr virus]
cagcgcuggcucc

SEQ ID NO: 1938609 - RNA, 21 nt, Human herpesvirus 4 [Epstein-Barr virus]
gguccaagaguaaaagcagaa

SEQ ID NO: 1938610 - RNA, 22 nt, Human herpesvirus 4 [Epstein-Barr virus]
uccagcucggccagcaggccgg

SEQ ID NO: 1938611 - RNA, 20 nt, Human herpesvirus 4 [Epstein-Barr virus]
caaagacgccggaugccugc

SEQ ID NO: 1938612 - RNA, 13 nt, Human herpesvirus 4 [Epstein-Barr virus]
cuguacgccgccg

SEQ ID NO: 1938613 - RNA, 19 nt, Human herpesvirus 4 [Epstein-Barr virus]
cugguggccugggaggugc

SEQ ID NO: 1938614 - RNA, 20 nt, Human herpesvirus 4 [Epstein-Barr virus]
cucaggaucagggccaagac

SEQ ID NO: 1938615 - RNA, 22 nt, Human herpesvirus 4 [Epstein-Barr virus]
aacucucucaucuccaaaaagu

SEQ ID NO: 1938616 - RNA, 19 nt, Human herpesvirus 4 [Epstein-Barr virus]
cuugggcaugcuguaccug

SEQ ID NO: 1938617 - RNA, 22 nt, Human herpesvirus 4 [Epstein-Barr virus]
caaggugucaauaauuucagug

SEQ ID NO: 1938618 - RNA, 14 nt, Human herpesvirus 4 [Epstein-Barr virus]
guggccugcucacc

SEQ ID NO: 1938619 - RNA, 13 nt, Human herpesvirus 4 [Epstein-Barr virus]
augcaaugcccac

SEQ ID NO: 1938620 - RNA, 23 nt, Human herpesvirus 4 [Epstein-Barr virus]
cugugugcgcgccgccagcaugg

SEQ ID NO: 1938621 - RNA, 18 nt, Human herpesvirus 4 [Epstein-Barr virus]
cuuggccccuguguacau

SEQ ID NO: 1938622 - RNA, 16 nt, Human herpesvirus 4 [Epstein-Barr virus]
cuggccguggccaggu

SEQ ID NO: 1938623 - RNA, 15 nt, Human herpesvirus 4 [Epstein-Barr virus]
uaauguacagacuac

SEQ ID NO: 1938624 - RNA, 22 nt, Human herpesvirus 4 [Epstein-Barr virus]
ugaccucuacacgcuuggaguc

SEQ ID NO: 1938625 - RNA, 14 nt, Human herpesvirus 4 [Epstein-Barr virus]
cacgaaugcccagg

SEQ ID NO: 1938626 - RNA, 22 nt, Human herpesvirus 4 [Epstein-Barr virus]
acuuacagcacauuuuguucua

SEQ ID NO: 1938627 - RNA, 17 nt, Human herpesvirus 4 [Epstein-Barr virus]
aagcgggugcaguaaca

SEQ ID NO: 1938628 - RNA, 15 nt, Human herpesvirus 4 [Epstein-Barr virus]
aaggagggcugguug

SEQ ID NO: 1938629 - RNA, 17 nt, Human herpesvirus 4 [Epstein-Barr virus]
gcuccagugccuccgcc

SEQ ID NO: 1938630 - RNA, 16 nt, Human herpesvirus 4 [Epstein-Barr virus]
cgugccucgggccuca

SEQ ID NO: 1938631 - RNA, 15 nt, Human herpesvirus 4 [Epstein-Barr virus]
cagggccgugcaugg

SEQ ID NO: 1938632 - RNA, 15 nt, Human herpesvirus 4 [Epstein-Barr virus]
uguguacauuccagu

SEQ ID NO: 1938633 - RNA, 19 nt, Human herpesvirus 4 [Epstein-Barr virus]
uguauugggacuugaaggu

SEQ ID NO: 1938634 - RNA, 14 nt, Human herpesvirus 4 [Epstein-Barr virus]
agaugcucuggcga

SEQ ID NO: 1938635 - RNA, 23 nt, Human herpesvirus 4 [Epstein-Barr virus]
acgaggaggcggaagaccaggag

SEQ ID NO: 1938636 - RNA, 22 nt, Human herpesvirus 4 [Epstein-Barr virus]
gauggcgacuuuguuuagggac

SEQ ID NO: 1938637 - RNA, 16 nt, Human herpesvirus 4 [Epstein-Barr virus]
caccgucagccacaca

SEQ ID NO: 1938638 - RNA, 14 nt, Human herpesvirus 4 [Epstein-Barr virus]
uggcaggagaggcg

SEQ ID NO: 1938639 - RNA, 14 nt, Human herpesvirus 4 [Epstein-Barr virus]
cgugaacucugccc

SEQ ID NO: 1938640 - RNA, 19 nt, Human herpesvirus 4 [Epstein-Barr virus]
agugccaagagcugccucc

SEQ ID NO: 1938641 - RNA, 15 nt, Human herpesvirus 4 [Epstein-Barr virus]
ugccaagagcugccu

SEQ ID NO: 1938642 - RNA, 18 nt, Human herpesvirus 4 [Epstein-Barr virus]
caccagggaggccuggga

SEQ ID NO: 1938643 - RNA, 18 nt, Human herpesvirus 4 [Epstein-Barr virus]
acacgguuauggcagagc

SEQ ID NO: 1938644 - RNA, 16 nt, Human herpesvirus 4 [Epstein-Barr virus]
acuccacagauggaga

SEQ ID NO: 1938645 - RNA, 19 nt, Human herpesvirus 4 [Epstein-Barr virus]
gcgggggaccacauacauc

SEQ ID NO: 1938646 - RNA, 17 nt, Human herpesvirus 4 [Epstein-Barr virus]
gccaaccugcucucucu

SEQ ID NO: 1938647 - RNA, 19 nt, Human herpesvirus 4 [Epstein-Barr virus]
ccgggcagguccgugagaa

SEQ ID NO: 1938648 - RNA, 11 nt, Human herpesvirus 4 [Epstein-Barr virus]
aaaggggagau

SEQ ID NO: 1938649 - RNA, 15 nt, Human herpesvirus 4 [Epstein-Barr virus]
ugccaugugugucca

SEQ ID NO: 1938650 - RNA, 14 nt, Human herpesvirus 4 [Epstein-Barr virus]
ugaaaagccacauu

SEQ ID NO: 1938651 - RNA, 20 nt, Human herpesvirus 4 [Epstein-Barr virus]
gggcagacaccaccugcucg

SEQ ID NO: 1938652 - RNA, 20 nt, Human herpesvirus 4 [Epstein-Barr virus]
augagcacguguggaagagg

SEQ ID NO: 1938653 - RNA, 13 nt, Human herpesvirus 4 [Epstein-Barr virus]
ccucuacgcccca

SEQ ID NO: 1938654 - RNA, 15 nt, Human herpesvirus 4 [Epstein-Barr virus]
gccgaagaagggagg

SEQ ID NO: 1938655 - RNA, 13 nt, Human herpesvirus 4 [Epstein-Barr virus]
cgggaggcggugc

SEQ ID NO: 1938656 - RNA, 19 nt, Human herpesvirus 4 [Epstein-Barr virus]
auggcuauacacaggagcc

SEQ ID NO: 1938657 - RNA, 15 nt, Human herpesvirus 4 [Epstein-Barr virus]
gcugccagccucagc

SEQ ID NO: 1938658 - RNA, 17 nt, Human herpesvirus 4 [Epstein-Barr virus]
ugcauacgcugagugag

SEQ ID NO: 1938659 - RNA, 13 nt, Human herpesvirus 4 [Epstein-Barr virus]
gcgcccugcgagu

SEQ ID NO: 1938660 - RNA, 20 nt, Human herpesvirus 4 [Epstein-Barr virus]
cuguaaacuauggaggcccc

SEQ ID NO: 1938661 - RNA, 19 nt, Human herpesvirus 4 [Epstein-Barr virus]
gcaggagcaggaggagggg

SEQ ID NO: 1938662 - RNA, 16 nt, Human herpesvirus 4 [Epstein-Barr virus]
ccccuggcggcccagc

SEQ ID NO: 1938663 - RNA, 14 nt, Human herpesvirus 4 [Epstein-Barr virus]
cagguacaggaccu

SEQ ID NO: 1938664 - RNA, 22 nt, Human herpesvirus 4 [Epstein-Barr virus]
ccagcccucgagaaccccagca

SEQ ID NO: 1938665 - RNA, 20 nt, Human herpesvirus 4 [Epstein-Barr virus]
gucggacgaggaggaagaga

SEQ ID NO: 1938666 - RNA, 22 nt, Human herpesvirus 4 [Epstein-Barr virus]
agcggcgugucuuggccagcgg

SEQ ID NO: 1938667 - RNA, 16 nt, Human herpesvirus 4 [Epstein-Barr virus]
cccccgggcgccccca

SEQ ID NO: 1938668 - RNA, 11 nt, Human herpesvirus 4 [Epstein-Barr virus]
agcugcugguu

SEQ ID NO: 1938669 - RNA, 23 nt, Human herpesvirus 4 [Epstein-Barr virus]
uccccccgccuuugggcacccca

SEQ ID NO: 1938670 - RNA, 18 nt, Human herpesvirus 4 [Epstein-Barr virus]
agugguuucggacacacc

SEQ ID NO: 1938671 - RNA, 14 nt, Human herpesvirus 4 [Epstein-Barr virus]
augagcggggagau

SEQ ID NO: 1938672 - RNA, 21 nt, Human herpesvirus 4 [Epstein-Barr virus]
ccgaaagcggcccagcagauc

SEQ ID NO: 1938673 - RNA, 19 nt, Human herpesvirus 4 [Epstein-Barr virus]
ccaaaacuauaccaaagcu

SEQ ID NO: 1938674 - RNA, 16 nt, Human herpesvirus 4 [Epstein-Barr virus]
uggcgucucaggcuau

SEQ ID NO: 1938675 - RNA, 20 nt, Human herpesvirus 4 [Epstein-Barr virus]
uacagccgggcuaugcucua

SEQ ID NO: 1938676 - RNA, 16 nt, Human herpesvirus 4 [Epstein-Barr virus]
cacggcgucaaacagg

SEQ ID NO: 1938677 - RNA, 18 nt, Human herpesvirus 4 [Epstein-Barr virus]
caagucccggguggugag

SEQ ID NO: 1938678 - RNA, 21 nt, Human herpesvirus 4 [Epstein-Barr virus]
gagcaggaggggcaggagcag

SEQ ID NO: 1938679 - RNA, 14 nt, Human herpesvirus 4 [Epstein-Barr virus]
gccaggcuggugac

SEQ ID NO: 1938680 - RNA, 16 nt, Human herpesvirus 4 [Epstein-Barr virus]
gccaucucugauuaua

SEQ ID NO: 1938681 - RNA, 20 nt, Human herpesvirus 4 [Epstein-Barr virus]
gcaagcagcaccugucccug

SEQ ID NO: 1938682 - RNA, 12 nt, Human herpesvirus 4 [Epstein-Barr virus]
guggccugggag

SEQ ID NO: 1938683 - RNA, 16 nt, Human herpesvirus 4 [Epstein-Barr virus]
cacuuuagagcucugg

SEQ ID NO: 1938684 - RNA, 22 nt, Human herpesvirus 4 [Epstein-Barr virus]
cgggagggcgcucugcgccagc

SEQ ID NO: 1938685 - RNA, 17 nt, Human herpesvirus 4 [Epstein-Barr virus]
ccggggguccagccggg

SEQ ID NO: 1938686 - RNA, 21 nt, Human herpesvirus 4 [Epstein-Barr virus]
ccagguagcccagcgucagga

SEQ ID NO: 1938687 - RNA, 14 nt, Human herpesvirus 4 [Epstein-Barr virus]
ccgaaagcacuuug

SEQ ID NO: 1938688 - RNA, 19 nt, Human herpesvirus 4 [Epstein-Barr virus]
uugacacccccagcgcugg

SEQ ID NO: 1938689 - RNA, 14 nt, Human herpesvirus 4 [Epstein-Barr virus]
acuauguucucuac

SEQ ID NO: 1938690 - RNA, 20 nt, Human herpesvirus 4 [Epstein-Barr virus]
gccccuguccacugccccgg

SEQ ID NO: 1938691 - RNA, 15 nt, Human herpesvirus 4 [Epstein-Barr virus]
ccugggccccccgga

SEQ ID NO: 1938692 - RNA, 13 nt, Human herpesvirus 4 [Epstein-Barr virus]
cagaggaaggcca

SEQ ID NO: 1938693 - RNA, 21 nt, Human herpesvirus 4 [Epstein-Barr virus]
acgcccgacaauaaaguugau

SEQ ID NO: 1938694 - RNA, 14 nt, Human herpesvirus 4 [Epstein-Barr virus]
ggaaggaggauggc

SEQ ID NO: 1938695 - RNA, 17 nt, Human herpesvirus 4 [Epstein-Barr virus]
ccagcccuuaacacacc

SEQ ID NO: 1938696 - RNA, 22 nt, Human herpesvirus 4 [Epstein-Barr virus]
augcucaguggccgucuggcag

SEQ ID NO: 1938697 - RNA, 21 nt, Human herpesvirus 4 [Epstein-Barr virus]
ccagggacauccccagacuca

SEQ ID NO: 1938698 - RNA, 13 nt, Human herpesvirus 4 [Epstein-Barr virus]
gcuggccaggcug

SEQ ID NO: 1938699 - RNA, 20 nt, Human herpesvirus 4 [Epstein-Barr virus]
cggcauuccuaggagaagga

SEQ ID NO: 1938700 - RNA, 19 nt, Human herpesvirus 4 [Epstein-Barr virus]
ggacccuauggagggcagc

SEQ ID NO: 1938701 - RNA, 12 nt, Human herpesvirus 4 [Epstein-Barr virus]
cgagaaggagga

SEQ ID NO: 1938702 - RNA, 17 nt, Human herpesvirus 4 [Epstein-Barr virus]
gaugaacccuggggcaa

SEQ ID NO: 1938703 - RNA, 17 nt, Human herpesvirus 4 [Epstein-Barr virus]
uggugcuguccugcuga

SEQ ID NO: 1938704 - RNA, 14 nt, Human herpesvirus 4 [Epstein-Barr virus]
caaguaccagcugg

SEQ ID NO: 1938705 - RNA, 17 nt, Human herpesvirus 4 [Epstein-Barr virus]
ggcagcgaagaacacuc

SEQ ID NO: 1938706 - RNA, 18 nt, Human herpesvirus 4 [Epstein-Barr virus]
ccuguuucggcgccgccc

SEQ ID NO: 1938707 - RNA, 18 nt, Human herpesvirus 4 [Epstein-Barr virus]
ucuugagcgccguggcca

SEQ ID NO: 1938708 - RNA, 23 nt, Human herpesvirus 4 [Epstein-Barr virus]
ccauccaucaacuucagcuccag

SEQ ID NO: 1938709 - RNA, 21 nt, Human herpesvirus 4 [Epstein-Barr virus]
gcugcaccggagccugccgga

SEQ ID NO: 1938710 - RNA, 18 nt, Human herpesvirus 4 [Epstein-Barr virus]
uaagaaugggagcaacca

SEQ ID NO: 1938711 - RNA, 20 nt, Human herpesvirus 4 [Epstein-Barr virus]
cguuugaguccaaacagcua

SEQ ID NO: 1938712 - RNA, 15 nt, Human herpesvirus 4 [Epstein-Barr virus]
cacggcccuccagcg

SEQ ID NO: 1938713 - RNA, 16 nt, Human herpesvirus 4 [Epstein-Barr virus]
uggguccccucugccg

SEQ ID NO: 1938714 - RNA, 15 nt, Human herpesvirus 4 [Epstein-Barr virus]
cugugugaccccuca

SEQ ID NO: 1938715 - RNA, 22 nt, Human herpesvirus 4 [Epstein-Barr virus]
gggcagaaccaucagcucgccc

SEQ ID NO: 1938716 - RNA, 14 nt, Human herpesvirus 4 [Epstein-Barr virus]
cuacaacucagccc

SEQ ID NO: 1938717 - RNA, 13 nt, Human herpesvirus 4 [Epstein-Barr virus]
gugcagcuucucc

SEQ ID NO: 1938718 - RNA, 16 nt, Human herpesvirus 4 [Epstein-Barr virus]
gggcaaacagggcaga

SEQ ID NO: 1938719 - RNA, 17 nt, Human herpesvirus 4 [Epstein-Barr virus]
cuucucauuagucagga

SEQ ID NO: 1938720 - RNA, 15 nt, Human herpesvirus 4 [Epstein-Barr virus]
aucugggcagccaga

SEQ ID NO: 1938721 - RNA, 16 nt, Human herpesvirus 4 [Epstein-Barr virus]
gggacaguaccacaag

SEQ ID NO: 1938722 - RNA, 14 nt, Human herpesvirus 4 [Epstein-Barr virus]
ccaacgcucagugc

SEQ ID NO: 1938723 - RNA, 21 nt, Human herpesvirus 4 [Epstein-Barr virus]
agccugcaccaguggcugccc

SEQ ID NO: 1938724 - RNA, 17 nt, Human herpesvirus 4 [Epstein-Barr virus]
aacuuggaggcugcuaa

SEQ ID NO: 1938725 - RNA, 13 nt, Human herpesvirus 4 [Epstein-Barr virus]
uggcagcaguggc

SEQ ID NO: 1938726 - RNA, 21 nt, Human herpesvirus 4 [Epstein-Barr virus]
ggggccaaaagggcucugacc

SEQ ID NO: 1938727 - RNA, 15 nt, Human herpesvirus 4 [Epstein-Barr virus]
ucacuggcaaagggc

SEQ ID NO: 1938728 - RNA, 18 nt, Human herpesvirus 4 [Epstein-Barr virus]
gcaggaggggcaggagca

SEQ ID NO: 1938729 - RNA, 19 nt, Human herpesvirus 4 [Epstein-Barr virus]
cggcgaugucggggcugcu

SEQ ID NO: 1938730 - RNA, 23 nt, Human herpesvirus 4 [Epstein-Barr virus]
gggcauuaacuaagcuuaugagc

SEQ ID NO: 1938731 - RNA, 15 nt, Human herpesvirus 4 [Epstein-Barr virus]
cuugucuacauccca

SEQ ID NO: 1938732 - RNA, 12 nt, Human herpesvirus 4 [Epstein-Barr virus]
uacaggaggaaa

SEQ ID NO: 1938733 - RNA, 21 nt, Human herpesvirus 4 [Epstein-Barr virus]
aacaguagaagaacugcaaga

SEQ ID NO: 1938734 - RNA, 18 nt, Human herpesvirus 4 [Epstein-Barr virus]
ccccuggcggcccagccc

SEQ ID NO: 1938735 - RNA, 13 nt, Human herpesvirus 4 [Epstein-Barr virus]
uggacugugguau

SEQ ID NO: 1938736 - RNA, 18 nt, Human herpesvirus 4 [Epstein-Barr virus]
uguugaagcagaugugcc

SEQ ID NO: 1938737 - RNA, 14 nt, Human herpesvirus 4 [Epstein-Barr virus]
cggggcaugcugcc

SEQ ID NO: 1938738 - RNA, 19 nt, Human herpesvirus 4 [Epstein-Barr virus]
aggagugccucugggugcu

SEQ ID NO: 1938739 - RNA, 19 nt, Human herpesvirus 4 [Epstein-Barr virus]
ugccuccucaaauguucca

SEQ ID NO: 1938740 - RNA, 19 nt, Human herpesvirus 4 [Epstein-Barr virus]
gcgcggcuggaugcccuca

SEQ ID NO: 1938741 - RNA, 22 nt, Human herpesvirus 4 [Epstein-Barr virus]
gauguacuuuccuagaaacugu

SEQ ID NO: 1938742 - RNA, 14 nt, Human herpesvirus 4 [Epstein-Barr virus]
ugcgagggggccug

SEQ ID NO: 1938743 - RNA, 15 nt, Human herpesvirus 4 [Epstein-Barr virus]
agcagauccagggcc

SEQ ID NO: 1938744 - RNA, 22 nt, Human herpesvirus 4 [Epstein-Barr virus]
gacauuucucauaauggugccu

SEQ ID NO: 1938745 - RNA, 13 nt, Human herpesvirus 4 [Epstein-Barr virus]
aggccucuggggu

SEQ ID NO: 1938746 - RNA, 23 nt, Human herpesvirus 4 [Epstein-Barr virus]
gaguccaaacagcuaauuucuac

SEQ ID NO: 1938747 - RNA, 12 nt, Human herpesvirus 4 [Epstein-Barr virus]
acauaaaugccc

SEQ ID NO: 1938748 - RNA, 14 nt, Human herpesvirus 4 [Epstein-Barr virus]
augacccacuccag

SEQ ID NO: 1938749 - RNA, 21 nt, Human herpesvirus 4 [Epstein-Barr virus]
ugcagguaaaccuucugucug

SEQ ID NO: 1938750 - RNA, 16 nt, Human herpesvirus 4 [Epstein-Barr virus]
agcuagugcagggggc

SEQ ID NO: 1938751 - RNA, 11 nt, Human herpesvirus 4 [Epstein-Barr virus]
cccccuccauu

SEQ ID NO: 1938752 - RNA, 23 nt, Human herpesvirus 4 [Epstein-Barr virus]
gcugaggggcaaccugaacuuua

SEQ ID NO: 1938753 - RNA, 22 nt, Human herpesvirus 4 [Epstein-Barr virus]
cucccagucuauccaggaggag

SEQ ID NO: 1938754 - RNA, 17 nt, Human herpesvirus 4 [Epstein-Barr virus]
ggacucucuguuucugu

SEQ ID NO: 1938755 - RNA, 22 nt, Human herpesvirus 4 [Epstein-Barr virus]
gccuagccaucggggcacguuu

SEQ ID NO: 1938756 - RNA, 22 nt, Human herpesvirus 4 [Epstein-Barr virus]
gcugcacaaaggaaacugcuga

SEQ ID NO: 1938757 - RNA, 16 nt, Human herpesvirus 4 [Epstein-Barr virus]
cguucaggaacagccu

SEQ ID NO: 1938758 - RNA, 13 nt, Human herpesvirus 4 [Epstein-Barr virus]
ucuggcugugcug

SEQ ID NO: 1938759 - RNA, 23 nt, Human herpesvirus 4 [Epstein-Barr virus]
agaagugugucccccuccauucc

SEQ ID NO: 1938760 - RNA, 12 nt, Human herpesvirus 4 [Epstein-Barr virus]
gcucccucuggg

SEQ ID NO: 1938761 - RNA, 19 nt, Human herpesvirus 4 [Epstein-Barr virus]
cuuaaaaaugugcagcuuc

SEQ ID NO: 1938762 - RNA, 14 nt, Human herpesvirus 4 [Epstein-Barr virus]
cuggggcugguggc

SEQ ID NO: 1938763 - RNA, 17 nt, Human herpesvirus 4 [Epstein-Barr virus]
aggugcaccagcuccag

SEQ ID NO: 1938764 - RNA, 16 nt, Human herpesvirus 4 [Epstein-Barr virus]
ugccauguguguccag

SEQ ID NO: 1938765 - RNA, 22 nt, Human herpesvirus 4 [Epstein-Barr virus]
acucgaccagcacguggguuuc

SEQ ID NO: 1938766 - RNA, 12 nt, Human herpesvirus 4 [Epstein-Barr virus]
cggugcugccag

SEQ ID NO: 1938767 - RNA, 14 nt, Human herpesvirus 4 [Epstein-Barr virus]
cuacucuccacggg

SEQ ID NO: 1938768 - RNA, 17 nt, Human herpesvirus 4 [Epstein-Barr virus]
cucagagggggugccug

SEQ ID NO: 1938769 - RNA, 16 nt, Human herpesvirus 4 [Epstein-Barr virus]
gccuggauucuuacag

SEQ ID NO: 1938770 - RNA, 23 nt, Human herpesvirus 4 [Epstein-Barr virus]
agggccacggcgugccagaggcc

SEQ ID NO: 1938771 - RNA, 17 nt, Human herpesvirus 4 [Epstein-Barr virus]
aguuccaauagaggagc

SEQ ID NO: 1938772 - RNA, 12 nt, Human herpesvirus 4 [Epstein-Barr virus]
gcugccagccuc

SEQ ID NO: 1938773 - RNA, 14 nt, Human herpesvirus 4 [Epstein-Barr virus]
agagacaaggcagg

SEQ ID NO: 1938774 - RNA, 13 nt, Human herpesvirus 4 [Epstein-Barr virus]
cagucuccggguc

SEQ ID NO: 1938775 - RNA, 11 nt, Human herpesvirus 4 [Epstein-Barr virus]
cucaaggaggg

SEQ ID NO: 1938776 - RNA, 22 nt, Human herpesvirus 4 [Epstein-Barr virus]
gggagcacauuccccccgccuu

SEQ ID NO: 1938777 - RNA, 16 nt, Human herpesvirus 4 [Epstein-Barr virus]
caaaaguagaggcuca

SEQ ID NO: 1938778 - RNA, 17 nt, Human herpesvirus 4 [Epstein-Barr virus]
cuggcuucugugacuuu

SEQ ID NO: 1938779 - RNA, 17 nt, Human herpesvirus 4 [Epstein-Barr virus]
cuucuccucagccucca

SEQ ID NO: 1938780 - RNA, 20 nt, Human herpesvirus 4 [Epstein-Barr virus]
ucccgugcuuuuugccaggc

SEQ ID NO: 1938781 - RNA, 14 nt, Human herpesvirus 4 [Epstein-Barr virus]
gaucccaggccuca

SEQ ID NO: 1938782 - RNA, 15 nt, Human herpesvirus 4 [Epstein-Barr virus]
ucagccgggaggaag

SEQ ID NO: 1938783 - RNA, 15 nt, Human herpesvirus 4 [Epstein-Barr virus]
ggcaugggaccggga

SEQ ID NO: 1938784 - RNA, 16 nt, Human herpesvirus 4 [Epstein-Barr virus]
gcucuccagccacggc

SEQ ID NO: 1938785 - RNA, 19 nt, Human herpesvirus 4 [Epstein-Barr virus]
uuaacccacccaaaaugca

SEQ ID NO: 1938786 - RNA, 18 nt, Human herpesvirus 4 [Epstein-Barr virus]
caagagucucgccaucua

SEQ ID NO: 1938787 - RNA, 14 nt, Human herpesvirus 4 [Epstein-Barr virus]
cggcggcugcugcc

SEQ ID NO: 1938788 - RNA, 20 nt, Human herpesvirus 4 [Epstein-Barr virus]
cccgugcuuuuugccaggcc

SEQ ID NO: 1938789 - RNA, 15 nt, Human herpesvirus 4 [Epstein-Barr virus]
cccucgguggugggc

SEQ ID NO: 1938790 - RNA, 20 nt, Human herpesvirus 4 [Epstein-Barr virus]
agauagggaccagaggacua

SEQ ID NO: 1938791 - RNA, 21 nt, Human herpesvirus 4 [Epstein-Barr virus]
cucaccagggaggccugggag

SEQ ID NO: 1938792 - RNA, 19 nt, Human herpesvirus 4 [Epstein-Barr virus]
agccugcaccaguggcugc

SEQ ID NO: 1938793 - RNA, 17 nt, Human herpesvirus 4 [Epstein-Barr virus]
cagcuuuuggccuucuu

SEQ ID NO: 1938794 - RNA, 13 nt, Human herpesvirus 4 [Epstein-Barr virus]
gugcugaggcccg

SEQ ID NO: 1938795 - RNA, 21 nt, Human herpesvirus 4 [Epstein-Barr virus]
auggacgaggacggggaagag

SEQ ID NO: 1938796 - RNA, 21 nt, Human herpesvirus 4 [Epstein-Barr virus]
ggaaaaucucgcucagagcug

SEQ ID NO: 1938797 - RNA, 22 nt, Human herpesvirus 4 [Epstein-Barr virus]
accaagaccaauacccaggauc

SEQ ID NO: 1938798 - RNA, 21 nt, Human herpesvirus 4 [Epstein-Barr virus]
ggcaccuguccuugucugcug

SEQ ID NO: 1938799 - RNA, 13 nt, Human herpesvirus 4 [Epstein-Barr virus]
gccuuacacugga

SEQ ID NO: 1938800 - RNA, 16 nt, Human herpesvirus 4 [Epstein-Barr virus]
ucaggacccugggccg

SEQ ID NO: 1938801 - RNA, 21 nt, Human herpesvirus 4 [Epstein-Barr virus]
ccagacacgucguucaugaga

SEQ ID NO: 1938802 - RNA, 22 nt, Human herpesvirus 4 [Epstein-Barr virus]
cguggccaccuucuccaucucc

SEQ ID NO: 1938803 - RNA, 22 nt, Human herpesvirus 4 [Epstein-Barr virus]
cuuccagagaggcgcagcccag

SEQ ID NO: 1938804 - RNA, 16 nt, Human herpesvirus 4 [Epstein-Barr virus]
acagcaaggacggucc

SEQ ID NO: 1938805 - RNA, 14 nt, Human herpesvirus 4 [Epstein-Barr virus]
ccauaccaggugcc

SEQ ID NO: 1938806 - RNA, 17 nt, Human herpesvirus 4 [Epstein-Barr virus]
gguauucucagaugcag

SEQ ID NO: 1938807 - RNA, 23 nt, Human herpesvirus 4 [Epstein-Barr virus]
caacucggcccgucuuacugccc

SEQ ID NO: 1938808 - RNA, 19 nt, Human herpesvirus 4 [Epstein-Barr virus]
cggcccuuugccuggggcu

SEQ ID NO: 1938809 - RNA, 18 nt, Human herpesvirus 4 [Epstein-Barr virus]
ggcugcugccgucccagg

SEQ ID NO: 1938810 - RNA, 14 nt, Human herpesvirus 4 [Epstein-Barr virus]
gcucccgccucagg

SEQ ID NO: 1938811 - RNA, 19 nt, Human herpesvirus 4 [Epstein-Barr virus]
ugccgucuucggucaagua

SEQ ID NO: 1938812 - RNA, 15 nt, Human herpesvirus 4 [Epstein-Barr virus]
gccaucgggacagau

SEQ ID NO: 1938813 - RNA, 19 nt, Human herpesvirus 4 [Epstein-Barr virus]
gcaccgggaugagcuggag

SEQ ID NO: 1938814 - RNA, 22 nt, Human herpesvirus 4 [Epstein-Barr virus]
caaagucaagggaaaggaaggg

SEQ ID NO: 1938815 - RNA, 20 nt, Human herpesvirus 4 [Epstein-Barr virus]
gccaaugggggaggagagac

SEQ ID NO: 1938816 - RNA, 20 nt, Human herpesvirus 4 [Epstein-Barr virus]
ggcagaaugaccgugcaugc

SEQ ID NO: 1938817 - RNA, 15 nt, Human herpesvirus 4 [Epstein-Barr virus]
cucgcagcuggagga

SEQ ID NO: 1938818 - RNA, 16 nt, Human herpesvirus 4 [Epstein-Barr virus]
ccgagugaccagucac

SEQ ID NO: 1938819 - RNA, 14 nt, Human herpesvirus 4 [Epstein-Barr virus]
cucaggccgccgca

SEQ ID NO: 1938820 - RNA, 20 nt, Human herpesvirus 4 [Epstein-Barr virus]
gguaacauuguacagagcug

SEQ ID NO: 1938821 - RNA, 15 nt, Human herpesvirus 4 [Epstein-Barr virus]
cuccauuccacccac

SEQ ID NO: 1938822 - RNA, 19 nt, Human herpesvirus 4 [Epstein-Barr virus]
ccagcagauccagggcccg

SEQ ID NO: 1938823 - RNA, 17 nt, Human herpesvirus 4 [Epstein-Barr virus]
acaagggaagagggaaa

SEQ ID NO: 1938824 - RNA, 15 nt, Human herpesvirus 4 [Epstein-Barr virus]
auggcggacugcgcc

SEQ ID NO: 1938825 - RNA, 22 nt, Human herpesvirus 4 [Epstein-Barr virus]
cggcaagggcucaccagggagg

SEQ ID NO: 1938826 - RNA, 14 nt, Human herpesvirus 4 [Epstein-Barr virus]
agcgccguggccac

SEQ ID NO: 1938827 - RNA, 21 nt, Human herpesvirus 4 [Epstein-Barr virus]
acccuucugcugcugcugguc

SEQ ID NO: 1938828 - RNA, 16 nt, Human herpesvirus 4 [Epstein-Barr virus]
cccucuuccgugccuc

SEQ ID NO: 1938829 - RNA, 18 nt, Human herpesvirus 4 [Epstein-Barr virus]
gccuccagcucggccagc

SEQ ID NO: 1938830 - RNA, 13 nt, Human herpesvirus 4 [Epstein-Barr virus]
gacucugcuuucu

SEQ ID NO: 1938831 - RNA, 20 nt, Human herpesvirus 4 [Epstein-Barr virus]
uggacauucuucugaaggaa

SEQ ID NO: 1938832 - RNA, 17 nt, Human herpesvirus 4 [Epstein-Barr virus]
ucagcuccagggccagc

SEQ ID NO: 1938833 - RNA, 20 nt, Human herpesvirus 4 [Epstein-Barr virus]
cucggcucaccgggaacgcc

SEQ ID NO: 1938834 - RNA, 14 nt, Human herpesvirus 4 [Epstein-Barr virus]
agaaguuaccuggu

SEQ ID NO: 1938835 - RNA, 20 nt, Human herpesvirus 4 [Epstein-Barr virus]
gcccaccagccagcgacuga

SEQ ID NO: 1938836 - RNA, 23 nt, Human herpesvirus 4 [Epstein-Barr virus]
gcuggaggcaauggucgccaggg

SEQ ID NO: 1938837 - RNA, 18 nt, Human herpesvirus 4 [Epstein-Barr virus]
cgccuacgcagaggccau

SEQ ID NO: 1938838 - RNA, 12 nt, Human herpesvirus 4 [Epstein-Barr virus]
gggccuggggcc

SEQ ID NO: 1938839 - RNA, 13 nt, Human herpesvirus 4 [Epstein-Barr virus]
cccuggccaccua

SEQ ID NO: 1938840 - RNA, 18 nt, Human herpesvirus 4 [Epstein-Barr virus]
gucucacgagggucugcc

SEQ ID NO: 1938841 - RNA, 18 nt, Human herpesvirus 4 [Epstein-Barr virus]
cuggcagaaaggcuggcc

SEQ ID NO: 1938842 - RNA, 20 nt, Human herpesvirus 4 [Epstein-Barr virus]
caggcauuuuuggugcugcc

SEQ ID NO: 1938843 - RNA, 17 nt, Human herpesvirus 4 [Epstein-Barr virus]
cgugaucaugagggcuu

SEQ ID NO: 1938844 - RNA, 16 nt, Human herpesvirus 4 [Epstein-Barr virus]
acuuuauuaauaaaca

SEQ ID NO: 1938845 - RNA, 19 nt, Human herpesvirus 4 [Epstein-Barr virus]
ggccuugguuucagccuca

SEQ ID NO: 1938846 - RNA, 24 nt, Human herpesvirus 4 [Epstein-Barr virus]
cugggagguagauagguggucgca

SEQ ID NO: 1938847 - RNA, 12 nt, Human herpesvirus 4 [Epstein-Barr virus]
ggagcaggagca

SEQ ID NO: 1938848 - RNA, 20 nt, Human herpesvirus 4 [Epstein-Barr virus]
ugcuggacuccgaggaccag

SEQ ID NO: 1938849 - RNA, 19 nt, Human herpesvirus 4 [Epstein-Barr virus]
ccggacgcagaggccugca

SEQ ID NO: 1938850 - RNA, 21 nt, Human herpesvirus 4 [Epstein-Barr virus]
cauucguacaucuccaggcga

SEQ ID NO: 1938851 - RNA, 15 nt, Human herpesvirus 4 [Epstein-Barr virus]
gcacgagauggccca

SEQ ID NO: 1938852 - RNA, 11 nt, Human herpesvirus 4 [Epstein-Barr virus]
ucagccaccuc

SEQ ID NO: 1938853 - RNA, 13 nt, Human herpesvirus 4 [Epstein-Barr virus]
ucagcuguguacg

SEQ ID NO: 1938854 - RNA, 20 nt, Human herpesvirus 4 [Epstein-Barr virus]
gccaaugacccacuccagug

SEQ ID NO: 1938855 - RNA, 15 nt, Human herpesvirus 4 [Epstein-Barr virus]
cuggcaccuguccuu

SEQ ID NO: 1938856 - RNA, 13 nt, Human herpesvirus 4 [Epstein-Barr virus]
uguucuccgagag

SEQ ID NO: 1938857 - RNA, 17 nt, Human herpesvirus 4 [Epstein-Barr virus]
agggccuuccagagcuc

SEQ ID NO: 1938858 - RNA, 20 nt, Human herpesvirus 4 [Epstein-Barr virus]
ugcaagucaggauucucuaa

SEQ ID NO: 1938859 - RNA, 14 nt, Human herpesvirus 4 [Epstein-Barr virus]
ucagagaggccucu

SEQ ID NO: 1938860 - RNA, 22 nt, Human herpesvirus 4 [Epstein-Barr virus]
ccgcaccagcuaacaggacaug

SEQ ID NO: 1938861 - RNA, 22 nt, Human herpesvirus 4 [Epstein-Barr virus]
uggccaccacaucggacgggca

SEQ ID NO: 1938862 - RNA, 13 nt, Human herpesvirus 4 [Epstein-Barr virus]
gcgacacuugggu

SEQ ID NO: 1938863 - RNA, 23 nt, Human herpesvirus 4 [Epstein-Barr virus]
gccucuacgccaggcucgcuuuu

SEQ ID NO: 1938864 - RNA, 19 nt, Human herpesvirus 4 [Epstein-Barr virus]
cgguggaacaggagcagga

SEQ ID NO: 1938865 - RNA, 20 nt, Human herpesvirus 4 [Epstein-Barr virus]
ugguggccggcagccuggcu

SEQ ID NO: 1938866 - RNA, 15 nt, Human herpesvirus 4 [Epstein-Barr virus]
caagcuaccagaguc

SEQ ID NO: 1938867 - RNA, 15 nt, Human herpesvirus 4 [Epstein-Barr virus]
ugauggcaaaggucc

SEQ ID NO: 1938868 - RNA, 15 nt, Human herpesvirus 4 [Epstein-Barr virus]
cagccgggaggaaga

SEQ ID NO: 1938869 - RNA, 21 nt, Human herpesvirus 4 [Epstein-Barr virus]
gaggggcaggaggggcaggag

SEQ ID NO: 1938870 - RNA, 23 nt, Human herpesvirus 4 [Epstein-Barr virus]
cuucaggggaaucucugccaacu

SEQ ID NO: 1938871 - RNA, 19 nt, Human herpesvirus 4 [Epstein-Barr virus]
auggucgucaucuggcucu

SEQ ID NO: 1938872 - RNA, 18 nt, Human herpesvirus 4 [Epstein-Barr virus]
gauugucacagcugcugg

SEQ ID NO: 1938873 - RNA, 16 nt, Human herpesvirus 4 [Epstein-Barr virus]
cggagaggcgggaccc

SEQ ID NO: 1938874 - RNA, 20 nt, Human herpesvirus 4 [Epstein-Barr virus]
cgccugagcugccuggugag

SEQ ID NO: 1938875 - RNA, 12 nt, Human herpesvirus 4 [Epstein-Barr virus]
gugccucagaua

SEQ ID NO: 1938876 - RNA, 11 nt, Human herpesvirus 4 [Epstein-Barr virus]
ucccuuccuuu

SEQ ID NO: 1938877 - RNA, 19 nt, Human herpesvirus 4 [Epstein-Barr virus]
cugucuacuucgccaugcu

SEQ ID NO: 1938878 - RNA, 19 nt, Human herpesvirus 4 [Epstein-Barr virus]
gcggggcuccccagccaca

SEQ ID NO: 1938879 - RNA, 15 nt, Human herpesvirus 4 [Epstein-Barr virus]
cacuacuuguuucug

SEQ ID NO: 1938880 - RNA, 20 nt, Human herpesvirus 4 [Epstein-Barr virus]
cugggcauaaauucuccugc

SEQ ID NO: 1938881 - RNA, 16 nt, Human herpesvirus 4 [Epstein-Barr virus]
gacgaggacggggaag

SEQ ID NO: 1938882 - RNA, 14 nt, Human herpesvirus 4 [Epstein-Barr virus]
cauaacccagaauc

SEQ ID NO: 1938883 - RNA, 19 nt, Human herpesvirus 4 [Epstein-Barr virus]
ccgugcauggcagcagaca

SEQ ID NO: 1938884 - RNA, 19 nt, Human herpesvirus 4 [Epstein-Barr virus]
cgaguaggugccuccagag

SEQ ID NO: 1938885 - RNA, 14 nt, Human herpesvirus 4 [Epstein-Barr virus]
agucuccgggucag

SEQ ID NO: 1938886 - RNA, 16 nt, Human herpesvirus 4 [Epstein-Barr virus]
gccuugcguggugcug

SEQ ID NO: 1938887 - RNA, 15 nt, Human herpesvirus 4 [Epstein-Barr virus]
caccuagcccacucc

SEQ ID NO: 1938888 - RNA, 13 nt, Human herpesvirus 4 [Epstein-Barr virus]
gugcacucucucc

SEQ ID NO: 1938889 - RNA, 16 nt, Human herpesvirus 4 [Epstein-Barr virus]
cagcccuuaacacacc

SEQ ID NO: 1938890 - RNA, 12 nt, Human herpesvirus 4 [Epstein-Barr virus]
cagagcugagug

SEQ ID NO: 1938891 - RNA, 20 nt, Human herpesvirus 4 [Epstein-Barr virus]
ugcgccagagcggcauccuc

SEQ ID NO: 1938892 - RNA, 18 nt, Human herpesvirus 4 [Epstein-Barr virus]
gggcugccccgggcccac

SEQ ID NO: 1938893 - RNA, 21 nt, Human herpesvirus 4 [Epstein-Barr virus]
caagaacccccugcaggacac

SEQ ID NO: 1938894 - RNA, 16 nt, Human herpesvirus 4 [Epstein-Barr virus]
caacuacaagcagcua

SEQ ID NO: 1938895 - RNA, 21 nt, Human herpesvirus 4 [Epstein-Barr virus]
ggcguaguugaaucaccgccg

SEQ ID NO: 1938896 - RNA, 23 nt, Human herpesvirus 4 [Epstein-Barr virus]
guccccguggaggaccgcccacc

SEQ ID NO: 1938897 - RNA, 22 nt, Human herpesvirus 4 [Epstein-Barr virus]
acgccggccugcuggccgagcu

SEQ ID NO: 1938898 - RNA, 19 nt, Human herpesvirus 4 [Epstein-Barr virus]
aggcggaagaccaggagcc

SEQ ID NO: 1938899 - RNA, 15 nt, Human herpesvirus 4 [Epstein-Barr virus]
cgggucccccuagcc

SEQ ID NO: 1938900 - RNA, 16 nt, Human herpesvirus 4 [Epstein-Barr virus]
caccggugacagugcu

SEQ ID NO: 1938901 - RNA, 20 nt, Human herpesvirus 4 [Epstein-Barr virus]
ccuccacccagcagcagccc

SEQ ID NO: 1938902 - RNA, 19 nt, Human herpesvirus 4 [Epstein-Barr virus]
aguaggugccuccagagcc

SEQ ID NO: 1938903 - RNA, 20 nt, Human herpesvirus 4 [Epstein-Barr virus]
cagaagcuacaaacacgggc

SEQ ID NO: 1938904 - RNA, 23 nt, Human herpesvirus 4 [Epstein-Barr virus]
uggaggagaugaccuccuacacg

SEQ ID NO: 1938905 - RNA, 13 nt, Human herpesvirus 4 [Epstein-Barr virus]
ccuaucacaggga

SEQ ID NO: 1938906 - RNA, 20 nt, Human herpesvirus 4 [Epstein-Barr virus]
cgccaggugguuacaggaga

SEQ ID NO: 1938907 - RNA, 15 nt, Human herpesvirus 4 [Epstein-Barr virus]
ccuauuugcacguug

SEQ ID NO: 1938908 - RNA, 21 nt, Human herpesvirus 4 [Epstein-Barr virus]
uuccuacaacucagccccauc

SEQ ID NO: 1938909 - RNA, 16 nt, Human herpesvirus 4 [Epstein-Barr virus]
ugcguugaacccaccc

SEQ ID NO: 1938910 - RNA, 15 nt, Human herpesvirus 4 [Epstein-Barr virus]
gccaguaggauauua

SEQ ID NO: 1938911 - RNA, 15 nt, Human herpesvirus 4 [Epstein-Barr virus]
guuccaggcucucca

SEQ ID NO: 1938912 - RNA, 14 nt, Human herpesvirus 4 [Epstein-Barr virus]
caccacggugcagc

SEQ ID NO: 1938913 - RNA, 17 nt, Human herpesvirus 4 [Epstein-Barr virus]
ccagacgcgauggcaca

SEQ ID NO: 1938914 - RNA, 19 nt, Human herpesvirus 4 [Epstein-Barr virus]
uccaacauuaaagccuccu

SEQ ID NO: 1938915 - RNA, 17 nt, Human herpesvirus 4 [Epstein-Barr virus]
ucugcugccaugcacgg

SEQ ID NO: 1938916 - RNA, 14 nt, Human herpesvirus 4 [Epstein-Barr virus]
cugguacaggacca

SEQ ID NO: 1938917 - RNA, 22 nt, Human herpesvirus 4 [Epstein-Barr virus]
gcccaccagagggugagcccac

SEQ ID NO: 1938918 - RNA, 16 nt, Human herpesvirus 4 [Epstein-Barr virus]
uaauguccaguggggu

SEQ ID NO: 1938919 - RNA, 18 nt, Human herpesvirus 4 [Epstein-Barr virus]
uccgcggugguggcccuc

SEQ ID NO: 1938920 - RNA, 14 nt, Human herpesvirus 4 [Epstein-Barr virus]
acuccccucuccau

SEQ ID NO: 1938921 - RNA, 17 nt, Human herpesvirus 4 [Epstein-Barr virus]
cgugcaaggauggaaga

SEQ ID NO: 1938922 - RNA, 22 nt, Human herpesvirus 4 [Epstein-Barr virus]
acuggugcuuguggugugggag

SEQ ID NO: 1938923 - RNA, 19 nt, Human herpesvirus 4 [Epstein-Barr virus]
ccucugccacaaggccagc

SEQ ID NO: 1938924 - RNA, 14 nt, Human herpesvirus 4 [Epstein-Barr virus]
caucccaauucaca

SEQ ID NO: 1938925 - RNA, 15 nt, Human herpesvirus 4 [Epstein-Barr virus]
cggaagacaacgagg

SEQ ID NO: 1938926 - RNA, 17 nt, Human herpesvirus 4 [Epstein-Barr virus]
cguggccagguacgggc

SEQ ID NO: 1938927 - RNA, 19 nt, Human herpesvirus 4 [Epstein-Barr virus]
cagauagccggccaggcag

SEQ ID NO: 1938928 - RNA, 14 nt, Human herpesvirus 4 [Epstein-Barr virus]
cugaccacggccca

SEQ ID NO: 1938929 - RNA, 20 nt, Human herpesvirus 4 [Epstein-Barr virus]
gcccguuccaggcucuccag

SEQ ID NO: 1938930 - RNA, 15 nt, Human herpesvirus 4 [Epstein-Barr virus]
ccggguacaaguccc

SEQ ID NO: 1938931 - RNA, 22 nt, Human herpesvirus 4 [Epstein-Barr virus]
aguggaugcaucuaagguccau

SEQ ID NO: 1938932 - RNA, 21 nt, Human herpesvirus 4 [Epstein-Barr virus]
ucucuguuucuguacaauggg

SEQ ID NO: 1938933 - RNA, 14 nt, Human herpesvirus 4 [Epstein-Barr virus]
cagguuugacuuca

SEQ ID NO: 1938934 - RNA, 20 nt, Human herpesvirus 4 [Epstein-Barr virus]
gaagauugucacagcugcug

SEQ ID NO: 1938935 - RNA, 16 nt, Human herpesvirus 4 [Epstein-Barr virus]
gaagaggacgaggacg

SEQ ID NO: 1938936 - RNA, 12 nt, Human herpesvirus 4 [Epstein-Barr virus]
caccauccacag

SEQ ID NO: 1938937 - RNA, 13 nt, Human herpesvirus 4 [Epstein-Barr virus]
ucccaaguacaga

SEQ ID NO: 1938938 - RNA, 17 nt, Human herpesvirus 4 [Epstein-Barr virus]
cugugcacucucucccc

SEQ ID NO: 1938939 - RNA, 15 nt, Human herpesvirus 4 [Epstein-Barr virus]
ggacaaggcaguaga

SEQ ID NO: 1938940 - RNA, 19 nt, Human herpesvirus 4 [Epstein-Barr virus]
cacugcguccaccuggcca

SEQ ID NO: 1938941 - RNA, 14 nt, Human herpesvirus 4 [Epstein-Barr virus]
cugcggggaaacca

SEQ ID NO: 1938942 - RNA, 21 nt, Human herpesvirus 4 [Epstein-Barr virus]
augcaauaaauaaaaguacag

SEQ ID NO: 1938943 - RNA, 15 nt, Human herpesvirus 4 [Epstein-Barr virus]
aggggcaggaggggc

SEQ ID NO: 1938944 - RNA, 15 nt, Human herpesvirus 4 [Epstein-Barr virus]
ugggaccuacaggac

SEQ ID NO: 1938945 - RNA, 19 nt, Human herpesvirus 4 [Epstein-Barr virus]
caggcuacaacaggcugcu

SEQ ID NO: 1938946 - RNA, 14 nt, Human herpesvirus 4 [Epstein-Barr virus]
ucaaggccucggag

SEQ ID NO: 1938947 - RNA, 18 nt, Human herpesvirus 4 [Epstein-Barr virus]
ggucauggcggacugcgc

SEQ ID NO: 1938948 - RNA, 14 nt, Human herpesvirus 4 [Epstein-Barr virus]
uccaggguccagga

SEQ ID NO: 1938949 - RNA, 22 nt, Human herpesvirus 4 [Epstein-Barr virus]
gacuccgugaccaaccggcacg

SEQ ID NO: 1938950 - RNA, 20 nt, Human herpesvirus 4 [Epstein-Barr virus]
uguuacccucauugugcuga

SEQ ID NO: 1938951 - RNA, 17 nt, Human herpesvirus 4 [Epstein-Barr virus]
uggcgaagauucccaac

SEQ ID NO: 1938952 - RNA, 19 nt, Human herpesvirus 4 [Epstein-Barr virus]
cugagccugagccacaccc

SEQ ID NO: 1938953 - RNA, 15 nt, Human herpesvirus 4 [Epstein-Barr virus]
cuggcagaaaggcug

SEQ ID NO: 1938954 - RNA, 20 nt, Human herpesvirus 4 [Epstein-Barr virus]
ccacugagcaagauccuucu

SEQ ID NO: 1938955 - RNA, 17 nt, Human herpesvirus 4 [Epstein-Barr virus]
ggaggagcuccgugagc

SEQ ID NO: 1938956 - RNA, 20 nt, Human herpesvirus 4 [Epstein-Barr virus]
cccugccccucggugggcca

SEQ ID NO: 1938957 - RNA, 21 nt, Human herpesvirus 4 [Epstein-Barr virus]
ccaguggccggggccguggag

SEQ ID NO: 1938958 - RNA, 20 nt, Human herpesvirus 4 [Epstein-Barr virus]
ucguagucauccgaggcuga

SEQ ID NO: 1938959 - RNA, 20 nt, Human herpesvirus 4 [Epstein-Barr virus]
agcccggggaaaagagagcu

SEQ ID NO: 1938960 - RNA, 20 nt, Human herpesvirus 4 [Epstein-Barr virus]
cuccaccagcuucucaaagg

SEQ ID NO: 1938961 - RNA, 13 nt, Human herpesvirus 4 [Epstein-Barr virus]
ggaaaaggcccua

SEQ ID NO: 1938962 - RNA, 23 nt, Human herpesvirus 4 [Epstein-Barr virus]
gaacucugcccuucagugucugg

SEQ ID NO: 1938963 - RNA, 20 nt, Human herpesvirus 4 [Epstein-Barr virus]
agaaaacucugcauggagaa

SEQ ID NO: 1938964 - RNA, 18 nt, Human herpesvirus 4 [Epstein-Barr virus]
gcccaagaagaagcccac

SEQ ID NO: 1938965 - RNA, 14 nt, Human herpesvirus 4 [Epstein-Barr virus]
caccagggccaggc

SEQ ID NO: 1938966 - RNA, 21 nt, Human herpesvirus 4 [Epstein-Barr virus]
augucaaggcucugcacagga

SEQ ID NO: 1938967 - RNA, 20 nt, Human herpesvirus 4 [Epstein-Barr virus]
ugauguucaaaccggaggau

SEQ ID NO: 1938968 - RNA, 12 nt, Human herpesvirus 4 [Epstein-Barr virus]
ggaggcagacac

SEQ ID NO: 1938969 - RNA, 23 nt, Human herpesvirus 4 [Epstein-Barr virus]
cuguuucuguacaauggggccag

SEQ ID NO: 1938970 - RNA, 19 nt, Human herpesvirus 4 [Epstein-Barr virus]
augccaagagccccuccau

SEQ ID NO: 1938971 - RNA, 20 nt, Human herpesvirus 4 [Epstein-Barr virus]
ggcucaccagggaggccugg

SEQ ID NO: 1938972 - RNA, 13 nt, Human herpesvirus 4 [Epstein-Barr virus]
ugcugcccaugga

SEQ ID NO: 1938973 - RNA, 17 nt, Human herpesvirus 4 [Epstein-Barr virus]
uacuaaagaaauaacug

SEQ ID NO: 1938974 - RNA, 16 nt, Human herpesvirus 4 [Epstein-Barr virus]
guccacggggagacuu

SEQ ID NO: 1938975 - RNA, 17 nt, Human herpesvirus 4 [Epstein-Barr virus]
gccuacgaggcccuggc

SEQ ID NO: 1938976 - RNA, 20 nt, Human herpesvirus 4 [Epstein-Barr virus]
gacuuuguuuagggacagac

SEQ ID NO: 1938977 - RNA, 16 nt, Human herpesvirus 4 [Epstein-Barr virus]
cgugcaaccaggccca

SEQ ID NO: 1938978 - RNA, 16 nt, Human herpesvirus 4 [Epstein-Barr virus]
ccaagccgggggagaa

SEQ ID NO: 1938979 - RNA, 15 nt, Human herpesvirus 4 [Epstein-Barr virus]
cggacgugcccagcu

SEQ ID NO: 1938980 - RNA, 15 nt, Human herpesvirus 4 [Epstein-Barr virus]
ggggcaggagcagga

SEQ ID NO: 1938981 - RNA, 17 nt, Human herpesvirus 4 [Epstein-Barr virus]
cagaaugaccgugcaug

SEQ ID NO: 1938982 - RNA, 20 nt, Human herpesvirus 4 [Epstein-Barr virus]
cggcaucaccguggagccgg

SEQ ID NO: 1938983 - RNA, 18 nt, Human herpesvirus 4 [Epstein-Barr virus]
ugucugugguugucuucc

SEQ ID NO: 1938984 - RNA, 19 nt, Human herpesvirus 4 [Epstein-Barr virus]
cuguggccccggcuggcca

SEQ ID NO: 1938985 - RNA, 17 nt, Human herpesvirus 4 [Epstein-Barr virus]
cguaaucuguggugggc

SEQ ID NO: 1938986 - RNA, 21 nt, Human herpesvirus 4 [Epstein-Barr virus]
cuccgcuuuaagaccaaggcc

SEQ ID NO: 1938987 - RNA, 16 nt, Human herpesvirus 4 [Epstein-Barr virus]
acgaggacgaggaggc

SEQ ID NO: 1938988 - RNA, 22 nt, Human herpesvirus 4 [Epstein-Barr virus]
cagacgcgauggcacacgccag

SEQ ID NO: 1938989 - RNA, 20 nt, Human herpesvirus 4 [Epstein-Barr virus]
auaugcucucgcacucuugu

SEQ ID NO: 1938990 - RNA, 19 nt, Human herpesvirus 4 [Epstein-Barr virus]
gagucaguuacacacacag

SEQ ID NO: 1938991 - RNA, 11 nt, Human herpesvirus 4 [Epstein-Barr virus]
aaaaugagcca

SEQ ID NO: 1938992 - RNA, 18 nt, Human herpesvirus 4 [Epstein-Barr virus]
gaggagcaccggagccac

SEQ ID NO: 1938993 - RNA, 21 nt, Human herpesvirus 4 [Epstein-Barr virus]
ugccuuucccccacccuggaa

SEQ ID NO: 1938994 - RNA, 15 nt, Human herpesvirus 4 [Epstein-Barr virus]
cucagaggaggagga

SEQ ID NO: 1938995 - RNA, 20 nt, Human herpesvirus 4 [Epstein-Barr virus]
aucucagaauugucacugag

SEQ ID NO: 1938996 - RNA, 19 nt, Human herpesvirus 4 [Epstein-Barr virus]
uccaggcucuccagcccca

SEQ ID NO: 1938997 - RNA, 15 nt, Human herpesvirus 4 [Epstein-Barr virus]
agcauaugccggugg

SEQ ID NO: 1938998 - RNA, 13 nt, Human herpesvirus 4 [Epstein-Barr virus]
cugcugcagcacu

SEQ ID NO: 1938999 - RNA, 19 nt, Human herpesvirus 4 [Epstein-Barr virus]
uacccgaaacaagagacga

SEQ ID NO: 1939000 - RNA, 16 nt, Human herpesvirus 4 [Epstein-Barr virus]
aggcaguagaggacac

SEQ ID NO: 1939001 - RNA, 13 nt, Human herpesvirus 4 [Epstein-Barr virus]
uccaucauguguu

SEQ ID NO: 1939002 - RNA, 16 nt, Human herpesvirus 4 [Epstein-Barr virus]
gcagggcaaagccaca

SEQ ID NO: 1939003 - RNA, 18 nt, Human herpesvirus 4 [Epstein-Barr virus]
ccuagauauaccccuccu

SEQ ID NO: 1939004 - RNA, 17 nt, Human herpesvirus 4 [Epstein-Barr virus]
gaaugcccaggcggcua

SEQ ID NO: 1939005 - RNA, 21 nt, Human herpesvirus 4 [Epstein-Barr virus]
cccgggcccagcccuccucag

SEQ ID NO: 1939006 - RNA, 13 nt, Human herpesvirus 4 [Epstein-Barr virus]
ggcgccuggggau

SEQ ID NO: 1939007 - RNA, 13 nt, Human herpesvirus 4 [Epstein-Barr virus]
ucaccagccaccu

SEQ ID NO: 1939008 - RNA, 22 nt, Human herpesvirus 4 [Epstein-Barr virus]
uucccagccccaauucuugcac

SEQ ID NO: 1939009 - RNA, 18 nt, Human herpesvirus 4 [Epstein-Barr virus]
gacgaagacccaucugag

SEQ ID NO: 1939010 - RNA, 14 nt, Human herpesvirus 4 [Epstein-Barr virus]
ccuauggagggcag

SEQ ID NO: 1939011 - RNA, 18 nt, Human herpesvirus 4 [Epstein-Barr virus]
aauucagccaccuccccu

SEQ ID NO: 1939012 - RNA, 22 nt, Human herpesvirus 4 [Epstein-Barr virus]
aaccuuaaaaguccccccaucu

SEQ ID NO: 1939013 - RNA, 24 nt, Human herpesvirus 4 [Epstein-Barr virus]
caagauugggugguggcagcaggc

SEQ ID NO: 1939014 - RNA, 21 nt, Human herpesvirus 4 [Epstein-Barr virus]
ccugccucucuuaugccugug

SEQ ID NO: 1939015 - RNA, 11 nt, Human herpesvirus 4 [Epstein-Barr virus]
ggccuggggcc

SEQ ID NO: 1939016 - RNA, 15 nt, Human herpesvirus 4 [Epstein-Barr virus]
ccugcauggccaggc

SEQ ID NO: 1939017 - RNA, 22 nt, Human herpesvirus 4 [Epstein-Barr virus]
cacgacuguuccuauaugcucu

SEQ ID NO: 1939018 - RNA, 19 nt, Human herpesvirus 4 [Epstein-Barr virus]
cauuccccccgccuuuggg

SEQ ID NO: 1939019 - RNA, 20 nt, Human herpesvirus 4 [Epstein-Barr virus]
cucagcuguucccagucucc

SEQ ID NO: 1939020 - RNA, 16 nt, Human herpesvirus 4 [Epstein-Barr virus]
uguguggcuguagcca

SEQ ID NO: 1939021 - RNA, 22 nt, Human herpesvirus 4 [Epstein-Barr virus]
gcacugcguccaccuggccacc

SEQ ID NO: 1939022 - RNA, 13 nt, Human herpesvirus 4 [Epstein-Barr virus]
ggaaugaacacuc

SEQ ID NO: 1939023 - RNA, 22 nt, Human herpesvirus 4 [Epstein-Barr virus]
cuggugcgguuauaacugccag

SEQ ID NO: 1939024 - RNA, 18 nt, Human herpesvirus 4 [Epstein-Barr virus]
cucgcccacacagcgcca

SEQ ID NO: 1939025 - RNA, 21 nt, Human herpesvirus 4 [Epstein-Barr virus]
gugguguucuaacgggaagug

SEQ ID NO: 1939026 - RNA, 23 nt, Human herpesvirus 4 [Epstein-Barr virus]
cugccuggauucuuacagcagga

SEQ ID NO: 1939027 - RNA, 18 nt, Human herpesvirus 4 [Epstein-Barr virus]
gggcaggaggggcaggag

SEQ ID NO: 1939028 - RNA, 21 nt, Human herpesvirus 4 [Epstein-Barr virus]
ugccacauguuuucuggacac

SEQ ID NO: 1939029 - RNA, 19 nt, Human herpesvirus 4 [Epstein-Barr virus]
agcagacaaggacaggugc

SEQ ID NO: 1939030 - RNA, 21 nt, Human herpesvirus 4 [Epstein-Barr virus]
acgcucccgggcaaacagggc

SEQ ID NO: 1939031 - RNA, 16 nt, Human herpesvirus 4 [Epstein-Barr virus]
gaaugacgggcucccu

SEQ ID NO: 1939032 - RNA, 19 nt, Human herpesvirus 4 [Epstein-Barr virus]
aggagauccgccaggaccu

SEQ ID NO: 1939033 - RNA, 20 nt, Human herpesvirus 4 [Epstein-Barr virus]
aggacacgcuggucuugaau

SEQ ID NO: 1939034 - RNA, 14 nt, Human herpesvirus 4 [Epstein-Barr virus]
cagagggugagccc

SEQ ID NO: 1939035 - RNA, 18 nt, Human herpesvirus 4 [Epstein-Barr virus]
gcagcaguggccagcuca

SEQ ID NO: 1939036 - RNA, 21 nt, Human herpesvirus 4 [Epstein-Barr virus]
ucucucccccgggcgcugccu

SEQ ID NO: 1939037 - RNA, 23 nt, Human herpesvirus 4 [Epstein-Barr virus]
guacagacuaccggcgagcauga

SEQ ID NO: 1939038 - RNA, 16 nt, Human herpesvirus 4 [Epstein-Barr virus]
uccuacgcgcuaccuc

SEQ ID NO: 1939039 - RNA, 16 nt, Human herpesvirus 4 [Epstein-Barr virus]
auguuacuucuuuugc

SEQ ID NO: 1939040 - RNA, 21 nt, Human herpesvirus 4 [Epstein-Barr virus]
augcauuuccugcccucccac

SEQ ID NO: 1939041 - RNA, 22 nt, Human herpesvirus 4 [Epstein-Barr virus]
cguggacaguuugauacucacc

SEQ ID NO: 1939042 - RNA, 20 nt, Human herpesvirus 4 [Epstein-Barr virus]
cgacgaggcccugcaagcca

SEQ ID NO: 1939043 - RNA, 15 nt, Human herpesvirus 4 [Epstein-Barr virus]
gcucggcccuccgca

SEQ ID NO: 1939044 - RNA, 21 nt, Human herpesvirus 4 [Epstein-Barr virus]
uccucauuggcuuugcccucu

SEQ ID NO: 1939045 - RNA, 17 nt, Human herpesvirus 4 [Epstein-Barr virus]
ucagccacacaaucagc

SEQ ID NO: 1939046 - RNA, 12 nt, Human herpesvirus 4 [Epstein-Barr virus]
acucugcuuucu

SEQ ID NO: 1939047 - RNA, 19 nt, Human herpesvirus 4 [Epstein-Barr virus]
accaaggcggcugcugaga

SEQ ID NO: 1939048 - RNA, 17 nt, Human herpesvirus 4 [Epstein-Barr virus]
uagccuauuugcacguu

SEQ ID NO: 1939049 - RNA, 16 nt, Human herpesvirus 4 [Epstein-Barr virus]
gccgccaugcucaggg

SEQ ID NO: 1939050 - RNA, 12 nt, Human herpesvirus 4 [Epstein-Barr virus]
acaggagcagga

SEQ ID NO: 1939051 - RNA, 13 nt, Human herpesvirus 4 [Epstein-Barr virus]
uuugacuguuugu

SEQ ID NO: 1939052 - RNA, 23 nt, Human herpesvirus 4 [Epstein-Barr virus]
ccugccacuuccacagcaauggc

SEQ ID NO: 1939053 - RNA, 21 nt, Human herpesvirus 4 [Epstein-Barr virus]
ggaggaagagacuucacagag

SEQ ID NO: 1939054 - RNA, 16 nt, Human herpesvirus 4 [Epstein-Barr virus]
cguuggcuucugcugc

SEQ ID NO: 1939055 - RNA, 22 nt, Human herpesvirus 4 [Epstein-Barr virus]
aggcucggcccuccgcauccua

SEQ ID NO: 1939056 - RNA, 23 nt, Human herpesvirus 4 [Epstein-Barr virus]
ccguaccaugagugccaugugug

SEQ ID NO: 1939057 - RNA, 22 nt, Human herpesvirus 4 [Epstein-Barr virus]
cugccucccugccccucggugg

SEQ ID NO: 1939058 - RNA, 15 nt, Human herpesvirus 4 [Epstein-Barr virus]
ugcauggccugggcc

SEQ ID NO: 1939059 - RNA, 19 nt, Human herpesvirus 4 [Epstein-Barr virus]
agcccccucccgccccugu

SEQ ID NO: 1939060 - RNA, 14 nt, Human herpesvirus 4 [Epstein-Barr virus]
cgguggaacaggag

SEQ ID NO: 1939061 - RNA, 14 nt, Human herpesvirus 4 [Epstein-Barr virus]
cuacgcagaggcca

SEQ ID NO: 1939062 - RNA, 13 nt, Human herpesvirus 4 [Epstein-Barr virus]
ccagccacagcac

SEQ ID NO: 1939063 - RNA, 17 nt, Human herpesvirus 4 [Epstein-Barr virus]
cccgccagcgccuccuc

SEQ ID NO: 1939064 - RNA, 12 nt, Human herpesvirus 4 [Epstein-Barr virus]
cuacugcugcua

SEQ ID NO: 1939065 - RNA, 17 nt, Human herpesvirus 4 [Epstein-Barr virus]
aaacauggugucuguaa

SEQ ID NO: 1939066 - RNA, 22 nt, Human herpesvirus 4 [Epstein-Barr virus]
ggaugccucacgcgaagggaaa

SEQ ID NO: 1939067 - RNA, 16 nt, Human herpesvirus 4 [Epstein-Barr virus]
gcuccgagagcuccgc

SEQ ID NO: 1939068 - RNA, 13 nt, Human herpesvirus 4 [Epstein-Barr virus]
uccuuagacugag

SEQ ID NO: 1939069 - RNA, 19 nt, Human herpesvirus 4 [Epstein-Barr virus]
acccccggcucucaggccu

SEQ ID NO: 1939070 - RNA, 18 nt, Human herpesvirus 4 [Epstein-Barr virus]
acccccguccagcaggcu

SEQ ID NO: 1939071 - RNA, 19 nt, Human herpesvirus 4 [Epstein-Barr virus]
gcucugguacguuggcuuc

SEQ ID NO: 1939072 - RNA, 17 nt, Human herpesvirus 4 [Epstein-Barr virus]
gagccagaucuaaggcc

SEQ ID NO: 1939073 - RNA, 18 nt, Human herpesvirus 4 [Epstein-Barr virus]
ggccgccuauggggccug

SEQ ID NO: 1939074 - RNA, 19 nt, Human herpesvirus 4 [Epstein-Barr virus]
cggguggaggagcuccgug

SEQ ID NO: 1939075 - RNA, 16 nt, Human herpesvirus 4 [Epstein-Barr virus]
uaguaugaaggcuggc

SEQ ID NO: 1939076 - RNA, 20 nt, Human herpesvirus 4 [Epstein-Barr virus]
caucaggcgaaggcggagaa

SEQ ID NO: 1939077 - RNA, 18 nt, Human herpesvirus 4 [Epstein-Barr virus]
ucaaguaccagcuggugg

SEQ ID NO: 1939078 - RNA, 21 nt, Human herpesvirus 4 [Epstein-Barr virus]
cugccaggccgccaugcucag

SEQ ID NO: 1939079 - RNA, 19 nt, Human herpesvirus 4 [Epstein-Barr virus]
cucagaaaacucugcaugg

SEQ ID NO: 1939080 - RNA, 17 nt, Human herpesvirus 4 [Epstein-Barr virus]
uccuuugcggcaucacc

SEQ ID NO: 1939081 - RNA, 16 nt, Human herpesvirus 4 [Epstein-Barr virus]
auuauauuguaagaca

SEQ ID NO: 1939082 - RNA, 20 nt, Human herpesvirus 4 [Epstein-Barr virus]
cccaccuuuuaauucucuuc

SEQ ID NO: 1939083 - RNA, 16 nt, Human herpesvirus 4 [Epstein-Barr virus]
caccuccaccaccuuc

SEQ ID NO: 1939084 - RNA, 12 nt, Human herpesvirus 4 [Epstein-Barr virus]
ccucugccggga

SEQ ID NO: 1939085 - RNA, 13 nt, Human herpesvirus 4 [Epstein-Barr virus]
ccccaccaccacc

SEQ ID NO: 1939086 - RNA, 15 nt, Human herpesvirus 4 [Epstein-Barr virus]
uggaacaggagcagg

SEQ ID NO: 1939087 - RNA, 23 nt, Human herpesvirus 4 [Epstein-Barr virus]
gacacaccgccaacgcucagugc

SEQ ID NO: 1939088 - RNA, 23 nt, Human herpesvirus 4 [Epstein-Barr virus]
cuuuucuccucagucuuugcaau

SEQ ID NO: 1939089 - RNA, 14 nt, Human herpesvirus 4 [Epstein-Barr virus]
cacucccaccaccc

SEQ ID NO: 1939090 - RNA, 18 nt, Human herpesvirus 4 [Epstein-Barr virus]
gcccagcccgacccccgg

SEQ ID NO: 1939091 - RNA, 21 nt, Human herpesvirus 4 [Epstein-Barr virus]
agcaccggagccaccacagca

SEQ ID NO: 1939092 - RNA, 17 nt, Human herpesvirus 4 [Epstein-Barr virus]
gccuacgcagaggccau

SEQ ID NO: 1939093 - RNA, 15 nt, Human herpesvirus 4 [Epstein-Barr virus]
acgaggaggaagaga

SEQ ID NO: 1939094 - RNA, 13 nt, Human herpesvirus 4 [Epstein-Barr virus]
ucugccacaaggc

SEQ ID NO: 1939095 - RNA, 15 nt, Human herpesvirus 4 [Epstein-Barr virus]
ucgacuucugaagau

SEQ ID NO: 1939096 - RNA, 16 nt, Human herpesvirus 4 [Epstein-Barr virus]
cagcccccuccuccag

SEQ ID NO: 1939097 - RNA, 15 nt, Human herpesvirus 4 [Epstein-Barr virus]
guguauuucuggcca

SEQ ID NO: 1939098 - RNA, 13 nt, Human herpesvirus 4 [Epstein-Barr virus]
auaugcucucgca

SEQ ID NO: 1939099 - RNA, 20 nt, Human herpesvirus 4 [Epstein-Barr virus]
uccaacauuaaagccuccuc

SEQ ID NO: 1939100 - RNA, 19 nt, Human herpesvirus 4 [Epstein-Barr virus]
cuucuucaggggaaucucu

SEQ ID NO: 1939101 - RNA, 15 nt, Human herpesvirus 4 [Epstein-Barr virus]
cgcuguccgccagga

SEQ ID NO: 1939102 - RNA, 21 nt, Human herpesvirus 4 [Epstein-Barr virus]
ggagauuuucccacugugccu

SEQ ID NO: 1939103 - RNA, 20 nt, Human herpesvirus 4 [Epstein-Barr virus]
gacccccgggcgcccccaaa

SEQ ID NO: 1939104 - RNA, 19 nt, Human herpesvirus 4 [Epstein-Barr virus]
guucccuucucccacccug

SEQ ID NO: 1939105 - RNA, 15 nt, Human herpesvirus 4 [Epstein-Barr virus]
acacagccugacucu

SEQ ID NO: 1939106 - RNA, 22 nt, Human herpesvirus 4 [Epstein-Barr virus]
cagccugcaccaguggcugccc

SEQ ID NO: 1939107 - RNA, 22 nt, Human herpesvirus 4 [Epstein-Barr virus]
caccacuaagguuacugcacag

SEQ ID NO: 1939108 - RNA, 17 nt, Human herpesvirus 4 [Epstein-Barr virus]
agacguguguggcugua

SEQ ID NO: 1939109 - RNA, 22 nt, Human herpesvirus 4 [Epstein-Barr virus]
gucggcuaaugccaugcagcgg

SEQ ID NO: 1939110 - RNA, 16 nt, Human herpesvirus 4 [Epstein-Barr virus]
cuacgcgggccacagg

SEQ ID NO: 1939111 - RNA, 15 nt, Human herpesvirus 4 [Epstein-Barr virus]
ucaggccucccaguc

SEQ ID NO: 1939112 - RNA, 22 nt, Human herpesvirus 4 [Epstein-Barr virus]
caucaugcugaauauugccagc

SEQ ID NO: 1939113 - RNA, 15 nt, Human herpesvirus 4 [Epstein-Barr virus]
gggggccuggugcca

SEQ ID NO: 1939114 - RNA, 21 nt, Human herpesvirus 4 [Epstein-Barr virus]
ggcaaagauccccaguggagc

SEQ ID NO: 1939115 - RNA, 12 nt, Human herpesvirus 4 [Epstein-Barr virus]
ccagcagcagcc

SEQ ID NO: 1939116 - RNA, 19 nt, Human herpesvirus 4 [Epstein-Barr virus]
gaauaaggcucugaagcaa

SEQ ID NO: 1939117 - RNA, 17 nt, Human herpesvirus 4 [Epstein-Barr virus]
ccugauauugucccccu

SEQ ID NO: 1939118 - RNA, 18 nt, Human herpesvirus 4 [Epstein-Barr virus]
cuucugaaaacugccucc

SEQ ID NO: 1939119 - RNA, 20 nt, Human herpesvirus 4 [Epstein-Barr virus]
caguagccgaauaucuggag

SEQ ID NO: 1939120 - RNA, 17 nt, Human herpesvirus 4 [Epstein-Barr virus]
ucacaggacauguuugg

SEQ ID NO: 1939121 - RNA, 22 nt, Human herpesvirus 4 [Epstein-Barr virus]
gugggccucucuggcugugcug

SEQ ID NO: 1939122 - RNA, 19 nt, Human herpesvirus 4 [Epstein-Barr virus]
ccacucaggaagcuggcca

SEQ ID NO: 1939123 - RNA, 21 nt, Human herpesvirus 4 [Epstein-Barr virus]
acuaauguucucuaacugugu

SEQ ID NO: 1939124 - RNA, 22 nt, Human herpesvirus 4 [Epstein-Barr virus]
cuggcuguacgccgccgccagc

SEQ ID NO: 1939125 - RNA, 20 nt, Human herpesvirus 4 [Epstein-Barr virus]
gcgcccuccucugggccgcc

SEQ ID NO: 1939126 - RNA, 21 nt, Human herpesvirus 4 [Epstein-Barr virus]
gccucugccgggaggugcugg

SEQ ID NO: 1939127 - RNA, 17 nt, Human herpesvirus 4 [Epstein-Barr virus]
gggagaacgguggccag

SEQ ID NO: 1939128 - RNA, 18 nt, Human herpesvirus 4 [Epstein-Barr virus]
cuacaccggccaguggcc

SEQ ID NO: 1939129 - RNA, 16 nt, Human herpesvirus 4 [Epstein-Barr virus]
cagccgggucgugaaa

SEQ ID NO: 1939130 - RNA, 19 nt, Human herpesvirus 4 [Epstein-Barr virus]
gaaaccacgccugcuucac

SEQ ID NO: 1939131 - RNA, 15 nt, Human herpesvirus 4 [Epstein-Barr virus]
uggcaaagggcaugc

SEQ ID NO: 1939132 - RNA, 14 nt, Human herpesvirus 4 [Epstein-Barr virus]
gaggccguguuucu

SEQ ID NO: 1939133 - RNA, 21 nt, Human herpesvirus 4 [Epstein-Barr virus]
augggggaaugagggaaaagg

SEQ ID NO: 1939134 - RNA, 19 nt, Human herpesvirus 4 [Epstein-Barr virus]
aacccccggcucucaggcc

SEQ ID NO: 1939135 - RNA, 14 nt, Human herpesvirus 4 [Epstein-Barr virus]
ugauaaaccuuaaa

SEQ ID NO: 1939136 - RNA, 16 nt, Human herpesvirus 4 [Epstein-Barr virus]
agucggccacagggga

SEQ ID NO: 1939137 - RNA, 16 nt, Human herpesvirus 4 [Epstein-Barr virus]
ccuacgaggcccuggc

SEQ ID NO: 1939138 - RNA, 21 nt, Human herpesvirus 4 [Epstein-Barr virus]
gcucagcucaaccgccagggc

SEQ ID NO: 1939139 - RNA, 16 nt, Human herpesvirus 4 [Epstein-Barr virus]
ggcccgggaccgcgcc

SEQ ID NO: 1939140 - RNA, 14 nt, Human herpesvirus 4 [Epstein-Barr virus]
cuguaaucacuggc

SEQ ID NO: 1939141 - RNA, 14 nt, Human herpesvirus 4 [Epstein-Barr virus]
ucguucaggaacag

SEQ ID NO: 1939142 - RNA, 16 nt, Human herpesvirus 4 [Epstein-Barr virus]
cagaugcaguggguga

SEQ ID NO: 1939143 - RNA, 17 nt, Human herpesvirus 4 [Epstein-Barr virus]
gugaggagcgcccaccg

SEQ ID NO: 1939144 - RNA, 23 nt, Human herpesvirus 4 [Epstein-Barr virus]
ggaggccaccgacgagcagagga

SEQ ID NO: 1939145 - RNA, 18 nt, Human herpesvirus 4 [Epstein-Barr virus]
cuucucuagagccaggcu

SEQ ID NO: 1939146 - RNA, 17 nt, Human herpesvirus 4 [Epstein-Barr virus]
cagccugcuccugagaa

SEQ ID NO: 1939147 - RNA, 15 nt, Human herpesvirus 4 [Epstein-Barr virus]
ucccggguggugagg

SEQ ID NO: 1939148 - RNA, 21 nt, Human herpesvirus 4 [Epstein-Barr virus]
ccgagugaccagucaccuucc

SEQ ID NO: 1939149 - RNA, 17 nt, Human herpesvirus 4 [Epstein-Barr virus]
gcgagcucuccagccac

SEQ ID NO: 1939150 - RNA, 21 nt, Human herpesvirus 4 [Epstein-Barr virus]
accggccaagguccugggccu

SEQ ID NO: 1939151 - RNA, 14 nt, Human herpesvirus 4 [Epstein-Barr virus]
aucaccagccaccu

SEQ ID NO: 1939152 - RNA, 13 nt, Human herpesvirus 4 [Epstein-Barr virus]
gucacugauuuug

SEQ ID NO: 1939153 - RNA, 19 nt, Human herpesvirus 4 [Epstein-Barr virus]
gucugcaccccaguggaca

SEQ ID NO: 1939154 - RNA, 15 nt, Human herpesvirus 4 [Epstein-Barr virus]
gagguugggccacgc

SEQ ID NO: 1939155 - RNA, 19 nt, Human herpesvirus 4 [Epstein-Barr virus]
guaugcagaaggggcccug

SEQ ID NO: 1939156 - RNA, 19 nt, Human herpesvirus 4 [Epstein-Barr virus]
ugcccaccagccagcgacu

SEQ ID NO: 1939157 - RNA, 21 nt, Human herpesvirus 4 [Epstein-Barr virus]
uguccacuggggugcagacga

SEQ ID NO: 1939158 - RNA, 19 nt, Human herpesvirus 4 [Epstein-Barr virus]
guuccucaacaaggagugc

SEQ ID NO: 1939159 - RNA, 20 nt, Human herpesvirus 4 [Epstein-Barr virus]
ccgccuagagcauuugcaag

SEQ ID NO: 1939160 - RNA, 16 nt, Human herpesvirus 4 [Epstein-Barr virus]
uauucaaucaaccuga

SEQ ID NO: 1939161 - RNA, 20 nt, Human herpesvirus 4 [Epstein-Barr virus]
aacugccuaucauguuucaa

SEQ ID NO: 1939162 - RNA, 13 nt, Human herpesvirus 4 [Epstein-Barr virus]
auggaggggcggc

SEQ ID NO: 1939163 - RNA, 14 nt, Human herpesvirus 4 [Epstein-Barr virus]
ugcauggccaggcc

SEQ ID NO: 1939164 - RNA, 20 nt, Human herpesvirus 4 [Epstein-Barr virus]
ccggcggcaguggaccucaa

SEQ ID NO: 1939165 - RNA, 17 nt, Human herpesvirus 4 [Epstein-Barr virus]
gagcaggaggaggggca

SEQ ID NO: 1939166 - RNA, 21 nt, Human herpesvirus 4 [Epstein-Barr virus]
gaguuggcaucuuccuccuug

SEQ ID NO: 1939167 - RNA, 15 nt, Human herpesvirus 4 [Epstein-Barr virus]
ccaugccaucucuga

SEQ ID NO: 1939168 - RNA, 13 nt, Human herpesvirus 4 [Epstein-Barr virus]
cagcccccccugu

SEQ ID NO: 1939169 - RNA, 19 nt, Human herpesvirus 4 [Epstein-Barr virus]
gccgcguguuugcugcucg

SEQ ID NO: 1939170 - RNA, 13 nt, Human herpesvirus 4 [Epstein-Barr virus]
agguuauuuugcc

SEQ ID NO: 1939171 - RNA, 15 nt, Human herpesvirus 4 [Epstein-Barr virus]
acauugguguuccac

SEQ ID NO: 1939172 - RNA, 21 nt, Human herpesvirus 4 [Epstein-Barr virus]
accagagggugagcccaccug

SEQ ID NO: 1939173 - RNA, 18 nt, Human herpesvirus 4 [Epstein-Barr virus]
cuuugccaaccugcucuc

SEQ ID NO: 1939174 - RNA, 20 nt, Human herpesvirus 4 [Epstein-Barr virus]
uccucuuacaccagaggcca

SEQ ID NO: 1939175 - RNA, 15 nt, Human herpesvirus 4 [Epstein-Barr virus]
cagcggacggugggg

SEQ ID NO: 1939176 - RNA, 21 nt, Human herpesvirus 4 [Epstein-Barr virus]
guggccuuccucugccuggcc

SEQ ID NO: 1939177 - RNA, 15 nt, Human herpesvirus 4 [Epstein-Barr virus]
cccgcaccagggcca

SEQ ID NO: 1939178 - RNA, 20 nt, Human herpesvirus 4 [Epstein-Barr virus]
gcuugccuuuuugccacaug

SEQ ID NO: 1939179 - RNA, 15 nt, Human herpesvirus 4 [Epstein-Barr virus]
aagcaacugcugcag

SEQ ID NO: 1939180 - RNA, 17 nt, Human herpesvirus 4 [Epstein-Barr virus]
agcucacuuucagugga

SEQ ID NO: 1939181 - RNA, 16 nt, Human herpesvirus 4 [Epstein-Barr virus]
augcaggccuggacag

SEQ ID NO: 1939182 - RNA, 15 nt, Human herpesvirus 4 [Epstein-Barr virus]
cguggucgugcugcu

SEQ ID NO: 1939183 - RNA, 20 nt, Human herpesvirus 4 [Epstein-Barr virus]
cucuggggucucaggccucc

SEQ ID NO: 1939184 - RNA, 18 nt, Human herpesvirus 4 [Epstein-Barr virus]
gcuauugccgccucgugu

SEQ ID NO: 1939185 - RNA, 22 nt, Human herpesvirus 4 [Epstein-Barr virus]
uuccuagaaacugugccauggu

SEQ ID NO: 1939186 - RNA, 17 nt, Human herpesvirus 4 [Epstein-Barr virus]
cuccccugacgcugugg

SEQ ID NO: 1939187 - RNA, 14 nt, Human herpesvirus 4 [Epstein-Barr virus]
cugaugugcugccc

SEQ ID NO: 1939188 - RNA, 18 nt, Human herpesvirus 4 [Epstein-Barr virus]
ucauuuuuagccccagcc

SEQ ID NO: 1939189 - RNA, 12 nt, Human herpesvirus 4 [Epstein-Barr virus]
cguuaacaugga

SEQ ID NO: 1939190 - RNA, 13 nt, Human herpesvirus 4 [Epstein-Barr virus]
cggcucaggauca

SEQ ID NO: 1939191 - RNA, 15 nt, Human herpesvirus 4 [Epstein-Barr virus]
aggauggcacggucc

SEQ ID NO: 1939192 - RNA, 15 nt, Human herpesvirus 4 [Epstein-Barr virus]
gcaggaggggcagga

SEQ ID NO: 1939193 - RNA, 21 nt, Human herpesvirus 4 [Epstein-Barr virus]
gauggcccugaucugggagau

SEQ ID NO: 1939194 - RNA, 14 nt, Human herpesvirus 4 [Epstein-Barr virus]
gccagcgccuugau

SEQ ID NO: 1939195 - RNA, 12 nt, Human herpesvirus 4 [Epstein-Barr virus]
aguggcugggau

SEQ ID NO: 1939196 - RNA, 16 nt, Human herpesvirus 4 [Epstein-Barr virus]
cucuucugggaacacc

SEQ ID NO: 1939197 - RNA, 16 nt, Human herpesvirus 4 [Epstein-Barr virus]
aucagacggggaggug

SEQ ID NO: 1939198 - RNA, 18 nt, Human herpesvirus 4 [Epstein-Barr virus]
guuuguccagcagggccu

SEQ ID NO: 1939199 - RNA, 18 nt, Human herpesvirus 4 [Epstein-Barr virus]
cgaggauaaucugggcag

SEQ ID NO: 1939200 - RNA, 17 nt, Human herpesvirus 4 [Epstein-Barr virus]
aguccaggggccacaca

SEQ ID NO: 1939201 - RNA, 14 nt, Human herpesvirus 4 [Epstein-Barr virus]
ccugcccucccacu

SEQ ID NO: 1939202 - RNA, 14 nt, Human herpesvirus 4 [Epstein-Barr virus]
gcagguggcugcug

SEQ ID NO: 1939203 - RNA, 13 nt, Human herpesvirus 4 [Epstein-Barr virus]
gugaggccugaga

SEQ ID NO: 1939204 - RNA, 19 nt, Human herpesvirus 4 [Epstein-Barr virus]
uguggccuuccucugccug

SEQ ID NO: 1939205 - RNA, 12 nt, Human herpesvirus 4 [Epstein-Barr virus]
guggcugcugcc

SEQ ID NO: 1939206 - RNA, 21 nt, Human herpesvirus 4 [Epstein-Barr virus]
gguugucuucccagacucugc

SEQ ID NO: 1939207 - RNA, 15 nt, Human herpesvirus 4 [Epstein-Barr virus]
ccagcggggagaggg

SEQ ID NO: 1939208 - RNA, 16 nt, Human herpesvirus 4 [Epstein-Barr virus]
cgcguagcucugguag

SEQ ID NO: 1939209 - RNA, 21 nt, Human herpesvirus 4 [Epstein-Barr virus]
aaaccaguagugcgcgugagu

SEQ ID NO: 1939210 - RNA, 15 nt, Human herpesvirus 4 [Epstein-Barr virus]
gccugacggugccgc

SEQ ID NO: 1939211 - RNA, 16 nt, Human herpesvirus 4 [Epstein-Barr virus]
ucagguuucugggcau

SEQ ID NO: 1939212 - RNA, 16 nt, Human herpesvirus 4 [Epstein-Barr virus]
aauuccccggggacac

SEQ ID NO: 1939213 - RNA, 19 nt, Human herpesvirus 4 [Epstein-Barr virus]
acagcugucacccaugccu

SEQ ID NO: 1939214 - RNA, 23 nt, Human herpesvirus 4 [Epstein-Barr virus]
ucuggaacauuugaggaggcaca

SEQ ID NO: 1939215 - RNA, 17 nt, Human herpesvirus 4 [Epstein-Barr virus]
caggaggggcaggagca

SEQ ID NO: 1939216 - RNA, 14 nt, Human herpesvirus 4 [Epstein-Barr virus]
cuccgggggcacug

SEQ ID NO: 1939217 - RNA, 21 nt, Human herpesvirus 4 [Epstein-Barr virus]
ugggcaauauaaauuacuggc

SEQ ID NO: 1939218 - RNA, 17 nt, Human herpesvirus 4 [Epstein-Barr virus]
cccagggacauccccag

SEQ ID NO: 1939219 - RNA, 18 nt, Human herpesvirus 4 [Epstein-Barr virus]
agacucaucucaagggag

SEQ ID NO: 1939220 - RNA, 17 nt, Human herpesvirus 4 [Epstein-Barr virus]
ucacagaccagccccuc

SEQ ID NO: 1939221 - RNA, 15 nt, Human herpesvirus 4 [Epstein-Barr virus]
uguccagauguccag

SEQ ID NO: 1939222 - RNA, 21 nt, Human herpesvirus 4 [Epstein-Barr virus]
acaggaggcccgaccccaacu

SEQ ID NO: 1939223 - RNA, 19 nt, Human herpesvirus 4 [Epstein-Barr virus]
uccaaucaccagccaccuu

SEQ ID NO: 1939224 - RNA, 22 nt, Human herpesvirus 4 [Epstein-Barr virus]
gggcaucaugcagggugcacag

SEQ ID NO: 1939225 - RNA, 18 nt, Human herpesvirus 4 [Epstein-Barr virus]
cacugauaauacgcccga

SEQ ID NO: 1939226 - RNA, 23 nt, Human herpesvirus 4 [Epstein-Barr virus]
cucagaugccggccaugcgcuuu

SEQ ID NO: 1939227 - RNA, 23 nt, Human herpesvirus 4 [Epstein-Barr virus]
ccuagagguuuugcuagggagga

SEQ ID NO: 1939228 - RNA, 23 nt, Human herpesvirus 4 [Epstein-Barr virus]
cgucgacgcuguuuugcagcuga

SEQ ID NO: 1939229 - RNA, 18 nt, Human herpesvirus 4 [Epstein-Barr virus]
acaagggaagagggaaaa

SEQ ID NO: 1939230 - RNA, 22 nt, Human herpesvirus 4 [Epstein-Barr virus]
ccaguucccuucucccacccug

SEQ ID NO: 1939231 - RNA, 16 nt, Human herpesvirus 4 [Epstein-Barr virus]
cgccagcagccccgac

SEQ ID NO: 1939232 - RNA, 17 nt, Human herpesvirus 4 [Epstein-Barr virus]
caccuagaaagagccau

SEQ ID NO: 1939233 - RNA, 17 nt, Human herpesvirus 4 [Epstein-Barr virus]
acuugggggcaggcuac

SEQ ID NO: 1939234 - RNA, 16 nt, Human herpesvirus 4 [Epstein-Barr virus]
agcucggccagcaggc

SEQ ID NO: 1939235 - RNA, 13 nt, Human herpesvirus 4 [Epstein-Barr virus]
acauuggcagcag

SEQ ID NO: 1939236 - RNA, 16 nt, Human herpesvirus 4 [Epstein-Barr virus]
ugccaggccugucauu

SEQ ID NO: 1939237 - RNA, 16 nt, Human herpesvirus 4 [Epstein-Barr virus]
cagcgucaggagaggg

SEQ ID NO: 1939238 - RNA, 12 nt, Human herpesvirus 4 [Epstein-Barr virus]
gcugugcugacc

SEQ ID NO: 1939239 - RNA, 12 nt, Human herpesvirus 4 [Epstein-Barr virus]
aggcaccccauc

SEQ ID NO: 1939240 - RNA, 18 nt, Human herpesvirus 4 [Epstein-Barr virus]
acgcugcccuagagguuu

SEQ ID NO: 1939241 - RNA, 19 nt, Human herpesvirus 4 [Epstein-Barr virus]
uaaguaauuuguugccguu

SEQ ID NO: 1939242 - RNA, 14 nt, Human herpesvirus 4 [Epstein-Barr virus]
uccucaaggauggc

SEQ ID NO: 1939243 - RNA, 16 nt, Human herpesvirus 4 [Epstein-Barr virus]
cagcucuaacuuggca

SEQ ID NO: 1939244 - RNA, 17 nt, Human herpesvirus 4 [Epstein-Barr virus]
aggccagguagcccagc

SEQ ID NO: 1939245 - RNA, 23 nt, Human herpesvirus 4 [Epstein-Barr virus]
accuacgcugcccuagagguuuu

SEQ ID NO: 1939246 - RNA, 14 nt, Human herpesvirus 4 [Epstein-Barr virus]
cugccuggauucuu

SEQ ID NO: 1939247 - RNA, 22 nt, Human herpesvirus 4 [Epstein-Barr virus]
cagcuggcccaccuaaagagag

SEQ ID NO: 1939248 - RNA, 11 nt, Human herpesvirus 4 [Epstein-Barr virus]
ucaccagagcc

SEQ ID NO: 1939249 - RNA, 16 nt, Human herpesvirus 4 [Epstein-Barr virus]
aggggguacggagagg

SEQ ID NO: 1939250 - RNA, 23 nt, Human herpesvirus 4 [Epstein-Barr virus]
gugaaugcacgccaacagcgacc

SEQ ID NO: 1939251 - RNA, 22 nt, Human herpesvirus 4 [Epstein-Barr virus]
gcccuccucugggccgcccggc

SEQ ID NO: 1939252 - RNA, 22 nt, Human herpesvirus 4 [Epstein-Barr virus]
uacggugauaacugacagagcc

SEQ ID NO: 1939253 - RNA, 23 nt, Human herpesvirus 4 [Epstein-Barr virus]
uacauguuuuucguuaacaugga

SEQ ID NO: 1939254 - RNA, 13 nt, Human herpesvirus 4 [Epstein-Barr virus]
gagguagauaggu

SEQ ID NO: 1939255 - RNA, 14 nt, Human herpesvirus 4 [Epstein-Barr virus]
gggccucggccugg

SEQ ID NO: 1939256 - RNA, 17 nt, Human herpesvirus 4 [Epstein-Barr virus]
uagaugaggagcaggca

SEQ ID NO: 1939257 - RNA, 21 nt, Human herpesvirus 4 [Epstein-Barr virus]
ccaagccacuacggccacguc

SEQ ID NO: 1939258 - RNA, 18 nt, Human herpesvirus 4 [Epstein-Barr virus]
ucccauaccuacaccacc

SEQ ID NO: 1939259 - RNA, 19 nt, Human herpesvirus 4 [Epstein-Barr virus]
cucaaggauggcacgggca

SEQ ID NO: 1939260 - RNA, 22 nt, Human herpesvirus 4 [Epstein-Barr virus]
cagaugcaccgggaugagcugg

SEQ ID NO: 1939261 - RNA, 12 nt, Human herpesvirus 4 [Epstein-Barr virus]
cgccaccugcag

SEQ ID NO: 1939262 - RNA, 20 nt, Human herpesvirus 4 [Epstein-Barr virus]
gaggauccaaacccccuccc

SEQ ID NO: 1939263 - RNA, 15 nt, Human herpesvirus 4 [Epstein-Barr virus]
gagcgcacgugacag

SEQ ID NO: 1939264 - RNA, 19 nt, Human herpesvirus 4 [Epstein-Barr virus]
gugcgguuauaacugccag

SEQ ID NO: 1939265 - RNA, 20 nt, Human herpesvirus 4 [Epstein-Barr virus]
gaggccugggagggggcgag

SEQ ID NO: 1939266 - RNA, 16 nt, Human herpesvirus 4 [Epstein-Barr virus]
gguuauggcagagcuu

SEQ ID NO: 1939267 - RNA, 21 nt, Human herpesvirus 4 [Epstein-Barr virus]
auuugcacuuucuuugcuuca

SEQ ID NO: 1939268 - RNA, 13 nt, Human herpesvirus 4 [Epstein-Barr virus]
cauggcagcagac

SEQ ID NO: 1939269 - RNA, 21 nt, Human herpesvirus 4 [Epstein-Barr virus]
cacacggaaaccacaacagcc

SEQ ID NO: 1939270 - RNA, 19 nt, Human herpesvirus 4 [Epstein-Barr virus]
gacuccggggguccagccg

SEQ ID NO: 1939271 - RNA, 20 nt, Human herpesvirus 4 [Epstein-Barr virus]
auuuugggcacacuuaacuu

SEQ ID NO: 1939272 - RNA, 15 nt, Human herpesvirus 4 [Epstein-Barr virus]
agggugaggcccagc

SEQ ID NO: 1939273 - RNA, 21 nt, Human herpesvirus 4 [Epstein-Barr virus]
ccacuccaccugccggaggga

SEQ ID NO: 1939274 - RNA, 16 nt, Human herpesvirus 4 [Epstein-Barr virus]
caaucaccagccaccu

SEQ ID NO: 1939275 - RNA, 15 nt, Human herpesvirus 4 [Epstein-Barr virus]
guuuacaucugcccg

SEQ ID NO: 1939276 - RNA, 17 nt, Human herpesvirus 4 [Epstein-Barr virus]
agcaggugcaccagcuc

SEQ ID NO: 1939277 - RNA, 16 nt, Human herpesvirus 4 [Epstein-Barr virus]
gcuccggcugccgcac

SEQ ID NO: 1939278 - RNA, 15 nt, Human herpesvirus 4 [Epstein-Barr virus]
cgcggcgacgagcgg

SEQ ID NO: 1939279 - RNA, 20 nt, Human herpesvirus 4 [Epstein-Barr virus]
uccugaagcgaagcagcucc

SEQ ID NO: 1939280 - RNA, 22 nt, Human herpesvirus 4 [Epstein-Barr virus]
gcagaggaugagaccaguggca

SEQ ID NO: 1939281 - RNA, 12 nt, Human herpesvirus 4 [Epstein-Barr virus]
aaacgugauggu

SEQ ID NO: 1939282 - RNA, 16 nt, Human herpesvirus 4 [Epstein-Barr virus]
gccccuguccacugcc

SEQ ID NO: 1939283 - RNA, 17 nt, Human herpesvirus 4 [Epstein-Barr virus]
auugcugaacuggggcu

SEQ ID NO: 1939284 - RNA, 16 nt, Human herpesvirus 4 [Epstein-Barr virus]
uuuuugccacauguuu

SEQ ID NO: 1939285 - RNA, 17 nt, Human herpesvirus 4 [Epstein-Barr virus]
gcugccccgggcccacc

SEQ ID NO: 1939286 - RNA, 13 nt, Human herpesvirus 4 [Epstein-Barr virus]
cgccugagcugcc

SEQ ID NO: 1939287 - RNA, 22 nt, Human herpesvirus 4 [Epstein-Barr virus]
cuaccugucggcccugcgcuac

SEQ ID NO: 1939288 - RNA, 19 nt, Human herpesvirus 4 [Epstein-Barr virus]
ugucuuccacaccauccac

SEQ ID NO: 1939289 - RNA, 23 nt, Human herpesvirus 4 [Epstein-Barr virus]
cagccagguguacgcccuggcgg

SEQ ID NO: 1939290 - RNA, 16 nt, Human herpesvirus 4 [Epstein-Barr virus]
ugggugcacagguggc

SEQ ID NO: 1939291 - RNA, 17 nt, Human herpesvirus 4 [Epstein-Barr virus]
gcacacgcucagcucaa

SEQ ID NO: 1939292 - RNA, 23 nt, Human herpesvirus 4 [Epstein-Barr virus]
cucuggucgcccccucugccucc

SEQ ID NO: 1939293 - RNA, 15 nt, Human herpesvirus 4 [Epstein-Barr virus]
cuguccuugucugcu

SEQ ID NO: 1939294 - RNA, 19 nt, Human herpesvirus 4 [Epstein-Barr virus]
acuuacaucgacuuuaugc

SEQ ID NO: 1939295 - RNA, 15 nt, Human herpesvirus 4 [Epstein-Barr virus]
ccccuguccacugcc

SEQ ID NO: 1939296 - RNA, 19 nt, Human herpesvirus 4 [Epstein-Barr virus]
ccgacgccguccucgaagg

SEQ ID NO: 1939297 - RNA, 13 nt, Human herpesvirus 4 [Epstein-Barr virus]
uccucagccucca

SEQ ID NO: 1939298 - RNA, 19 nt, Human herpesvirus 4 [Epstein-Barr virus]
uugugaagguaaacaagcu

SEQ ID NO: 1939299 - RNA, 18 nt, Human herpesvirus 4 [Epstein-Barr virus]
cugugcagggacgaggac

SEQ ID NO: 1939300 - RNA, 23 nt, Human herpesvirus 4 [Epstein-Barr virus]
aauguagccccuaggccugccac

SEQ ID NO: 1939301 - RNA, 22 nt, Human herpesvirus 4 [Epstein-Barr virus]
ggucacuggcuuaugcguggga

SEQ ID NO: 1939302 - RNA, 15 nt, Human herpesvirus 4 [Epstein-Barr virus]
ccgcguguuugcugc

SEQ ID NO: 1939303 - RNA, 14 nt, Human herpesvirus 4 [Epstein-Barr virus]
gccucuacccuccc

SEQ ID NO: 1939304 - RNA, 21 nt, Human herpesvirus 4 [Epstein-Barr virus]
ccaggaggaggacgugaguga

SEQ ID NO: 1939305 - RNA, 17 nt, Human herpesvirus 4 [Epstein-Barr virus]
gccugccucugcucugg

SEQ ID NO: 1939306 - RNA, 21 nt, Human herpesvirus 4 [Epstein-Barr virus]
auguuuuuggcauguguacuu

SEQ ID NO: 1939307 - RNA, 20 nt, Human herpesvirus 4 [Epstein-Barr virus]
ccgagggugaggcccagccc

SEQ ID NO: 1939308 - RNA, 14 nt, Human herpesvirus 4 [Epstein-Barr virus]
acugccagagcugu

SEQ ID NO: 1939309 - RNA, 15 nt, Human herpesvirus 4 [Epstein-Barr virus]
caucucauccccaga

SEQ ID NO: 1939310 - RNA, 20 nt, Human herpesvirus 4 [Epstein-Barr virus]
cuggaggccucaggcaacaa

SEQ ID NO: 1939311 - RNA, 12 nt, Human herpesvirus 4 [Epstein-Barr virus]
cuauacggccac

SEQ ID NO: 1939312 - RNA, 18 nt, Human herpesvirus 4 [Epstein-Barr virus]
gcaccuguguccugggca

SEQ ID NO: 1939313 - RNA, 15 nt, Human herpesvirus 4 [Epstein-Barr virus]
cacccgucccgggua

SEQ ID NO: 1939314 - RNA, 14 nt, Human herpesvirus 4 [Epstein-Barr virus]
augcacgccaacag

SEQ ID NO: 1939315 - RNA, 23 nt, Human herpesvirus 4 [Epstein-Barr virus]
caacuucagcuccagggccagca

SEQ ID NO: 1939316 - RNA, 18 nt, Human herpesvirus 4 [Epstein-Barr virus]
gaugcccaguuaugggua

SEQ ID NO: 1939317 - RNA, 18 nt, Human herpesvirus 4 [Epstein-Barr virus]
ugcaacaaucuggacucu

SEQ ID NO: 1939318 - RNA, 23 nt, Human herpesvirus 4 [Epstein-Barr virus]
ccugguaugcagaaggggcccug

SEQ ID NO: 1939319 - RNA, 12 nt, Human herpesvirus 4 [Epstein-Barr virus]
ucaaacagcagc

SEQ ID NO: 1939320 - RNA, 22 nt, Human herpesvirus 4 [Epstein-Barr virus]
gguuucauuuaagcaggugagg

SEQ ID NO: 1939321 - RNA, 13 nt, Human herpesvirus 4 [Epstein-Barr virus]
aggaugagaccag

SEQ ID NO: 1939322 - RNA, 16 nt, Human herpesvirus 4 [Epstein-Barr virus]
auggccgccacccucc

SEQ ID NO: 1939323 - RNA, 22 nt, Human herpesvirus 4 [Epstein-Barr virus]
gcucgccuggagucugagaaua

SEQ ID NO: 1939324 - RNA, 12 nt, Human herpesvirus 4 [Epstein-Barr virus]
accuacaccacc

SEQ ID NO: 1939325 - RNA, 13 nt, Human herpesvirus 4 [Epstein-Barr virus]
ccucauccugcuc

SEQ ID NO: 1939326 - RNA, 15 nt, Human herpesvirus 4 [Epstein-Barr virus]
gcuagggaggagacg

SEQ ID NO: 1939327 - RNA, 18 nt, Human herpesvirus 4 [Epstein-Barr virus]
auuccuaggagaaggagc

SEQ ID NO: 1939328 - RNA, 14 nt, Human herpesvirus 4 [Epstein-Barr virus]
gcuugugaacuuua

SEQ ID NO: 1939329 - RNA, 15 nt, Human herpesvirus 4 [Epstein-Barr virus]
cacuuucuuugcaau

SEQ ID NO: 1939330 - RNA, 18 nt, Human herpesvirus 4 [Epstein-Barr virus]
agaggacacgcuggucuu

SEQ ID NO: 1939331 - RNA, 13 nt, Human herpesvirus 4 [Epstein-Barr virus]
cagcccuccucag

SEQ ID NO: 1939332 - RNA, 15 nt, Human herpesvirus 4 [Epstein-Barr virus]
cgaaggagagcugga

SEQ ID NO: 1939333 - RNA, 19 nt, Human herpesvirus 4 [Epstein-Barr virus]
cuccggcugcccgucucgg

SEQ ID NO: 1939334 - RNA, 15 nt, Human herpesvirus 4 [Epstein-Barr virus]
gccugagcugccugg

SEQ ID NO: 1939335 - RNA, 19 nt, Human herpesvirus 4 [Epstein-Barr virus]
ccauagucacggaugcugc

SEQ ID NO: 1939336 - RNA, 13 nt, Human herpesvirus 4 [Epstein-Barr virus]
ccacuacaccccu

SEQ ID NO: 1939337 - RNA, 13 nt, Human herpesvirus 4 [Epstein-Barr virus]
agggcagagaggc

SEQ ID NO: 1939338 - RNA, 20 nt, Human herpesvirus 4 [Epstein-Barr virus]
gugauuaggagcagggccca

SEQ ID NO: 1939339 - RNA, 14 nt, Human herpesvirus 4 [Epstein-Barr virus]
cuucuggcucuucu

SEQ ID NO: 1939340 - RNA, 20 nt, Human herpesvirus 4 [Epstein-Barr virus]
aaggcuccggcggcagugga

SEQ ID NO: 1939341 - RNA, 13 nt, Human herpesvirus 4 [Epstein-Barr virus]
cucccccuggaca

SEQ ID NO: 1939342 - RNA, 14 nt, Human herpesvirus 4 [Epstein-Barr virus]
ggcgaaggcggaga

SEQ ID NO: 1939343 - RNA, 13 nt, Human herpesvirus 4 [Epstein-Barr virus]
ccuggagccagcg

SEQ ID NO: 1939344 - RNA, 17 nt, Human herpesvirus 4 [Epstein-Barr virus]
gugcccuggaggccuca

SEQ ID NO: 1939345 - RNA, 13 nt, Human herpesvirus 4 [Epstein-Barr virus]
auuccacccacug

SEQ ID NO: 1939346 - RNA, 17 nt, Human herpesvirus 4 [Epstein-Barr virus]
gggcuggccugccugga

SEQ ID NO: 1939347 - RNA, 19 nt, Human herpesvirus 4 [Epstein-Barr virus]
ggggcuaugguaguggcug

SEQ ID NO: 1939348 - RNA, 21 nt, Human herpesvirus 4 [Epstein-Barr virus]
cagcgcucuggucgcccccuc

SEQ ID NO: 1939349 - RNA, 16 nt, Human herpesvirus 4 [Epstein-Barr virus]
cauccggugccugaga

SEQ ID NO: 1939350 - RNA, 17 nt, Human herpesvirus 4 [Epstein-Barr virus]
gugggccucucuggcug

SEQ ID NO: 1939351 - RNA, 17 nt, Human herpesvirus 4 [Epstein-Barr virus]
cccugcauggccaggcc

SEQ ID NO: 1939352 - RNA, 14 nt, Human herpesvirus 4 [Epstein-Barr virus]
gagcuggagacccg

SEQ ID NO: 1939353 - RNA, 14 nt, Human herpesvirus 4 [Epstein-Barr virus]
agugcgaggaacug

SEQ ID NO: 1939354 - RNA, 13 nt, Human herpesvirus 4 [Epstein-Barr virus]
ggacacaccgcca

SEQ ID NO: 1939355 - RNA, 15 nt, Human herpesvirus 4 [Epstein-Barr virus]
uccaggggccacaca

SEQ ID NO: 1939356 - RNA, 17 nt, Human herpesvirus 4 [Epstein-Barr virus]
caggaagcuggccaggc

SEQ ID NO: 1939357 - RNA, 16 nt, Human herpesvirus 4 [Epstein-Barr virus]
gaaagaggcucugcau

SEQ ID NO: 1939358 - RNA, 19 nt, Human herpesvirus 4 [Epstein-Barr virus]
cguacccauaacugggcau

SEQ ID NO: 1939359 - RNA, 17 nt, Human herpesvirus 4 [Epstein-Barr virus]
cucuacaaccccuucca

SEQ ID NO: 1939360 - RNA, 12 nt, Human herpesvirus 4 [Epstein-Barr virus]
gcaacugcugca

SEQ ID NO: 1939361 - RNA, 22 nt, Human herpesvirus 4 [Epstein-Barr virus]
ucaagauugggugguggcagca

SEQ ID NO: 1939362 - RNA, 20 nt, Human herpesvirus 4 [Epstein-Barr virus]
gggugaaagcuacuaucucc

SEQ ID NO: 1939363 - RNA, 18 nt, Human herpesvirus 4 [Epstein-Barr virus]
aggagcaggaggaggggc

SEQ ID NO: 1939364 - RNA, 16 nt, Human herpesvirus 4 [Epstein-Barr virus]
augcgcgcccugucac

SEQ ID NO: 1939365 - RNA, 10 nt, Human herpesvirus 4 [Epstein-Barr virus]
aagcucagca

SEQ ID NO: 1939366 - RNA, 21 nt, Human herpesvirus 4 [Epstein-Barr virus]
ggcacucucgagggugccugu

SEQ ID NO: 1939367 - RNA, 18 nt, Human herpesvirus 4 [Epstein-Barr virus]
cauugguguuccacagcc

SEQ ID NO: 1939368 - RNA, 19 nt, Human herpesvirus 4 [Epstein-Barr virus]
cuagcgucacugauuuugg

SEQ ID NO: 1939369 - RNA, 19 nt, Human herpesvirus 4 [Epstein-Barr virus]
cccucugaugguggccggc

SEQ ID NO: 1939370 - RNA, 16 nt, Human herpesvirus 4 [Epstein-Barr virus]
agggguaacccuguag

SEQ ID NO: 1939371 - RNA, 13 nt, Human herpesvirus 4 [Epstein-Barr virus]
acgggacuucuuc

SEQ ID NO: 1939372 - RNA, 21 nt, Human herpesvirus 4 [Epstein-Barr virus]
cugucccugggggccuguguc

SEQ ID NO: 1939373 - RNA, 16 nt, Human herpesvirus 4 [Epstein-Barr virus]
guuaacauggacaugc

SEQ ID NO: 1939374 - RNA, 17 nt, Human herpesvirus 4 [Epstein-Barr virus]
aacgaucccaggccuca

SEQ ID NO: 1939375 - RNA, 13 nt, Human herpesvirus 4 [Epstein-Barr virus]
uacucggggucuc

SEQ ID NO: 1939376 - RNA, 15 nt, Human herpesvirus 4 [Epstein-Barr virus]
gggagguggccacac

SEQ ID NO: 1939377 - RNA, 19 nt, Human herpesvirus 4 [Epstein-Barr virus]
gcccucgguggugggcugc

SEQ ID NO: 1939378 - RNA, 22 nt, Human herpesvirus 4 [Epstein-Barr virus]
cugacccuucugcugcugcugg

SEQ ID NO: 1939379 - RNA, 12 nt, Human herpesvirus 4 [Epstein-Barr virus]
cacaggacaugu

SEQ ID NO: 1939380 - RNA, 21 nt, Human herpesvirus 4 [Epstein-Barr virus]
uguagccccuaggccugccac

SEQ ID NO: 1939381 - RNA, 11 nt, Human herpesvirus 4 [Epstein-Barr virus]
agaucuucuca

SEQ ID NO: 1939382 - RNA, 23 nt, Human herpesvirus 4 [Epstein-Barr virus]
ucaagcagcucaccuauggucac

SEQ ID NO: 1939383 - RNA, 17 nt, Human herpesvirus 4 [Epstein-Barr virus]
gagugggcagcagagag

SEQ ID NO: 1939384 - RNA, 21 nt, Human herpesvirus 4 [Epstein-Barr virus]
gacguuugaguccaaacagcu

SEQ ID NO: 1939385 - RNA, 12 nt, Human herpesvirus 4 [Epstein-Barr virus]
auccccagccca

SEQ ID NO: 1939386 - RNA, 18 nt, Human herpesvirus 4 [Epstein-Barr virus]
gccugaauuccccugccu

SEQ ID NO: 1939387 - RNA, 21 nt, Human herpesvirus 4 [Epstein-Barr virus]
gcggcaagggcucaccaggga

SEQ ID NO: 1939388 - RNA, 21 nt, Human herpesvirus 4 [Epstein-Barr virus]
cagcagugguguuugcuugcc

SEQ ID NO: 1939389 - RNA, 22 nt, Human herpesvirus 4 [Epstein-Barr virus]
agucagccuugcccccgccagc

SEQ ID NO: 1939390 - RNA, 23 nt, Human herpesvirus 4 [Epstein-Barr virus]
cagcgucaggagagggccagaga

SEQ ID NO: 1939391 - RNA, 11 nt, Human herpesvirus 4 [Epstein-Barr virus]
uugcagcugga

SEQ ID NO: 1939392 - RNA, 15 nt, Human herpesvirus 4 [Epstein-Barr virus]
uuaggcacuggacac

SEQ ID NO: 1939393 - RNA, 19 nt, Human herpesvirus 4 [Epstein-Barr virus]
ccccaccaccuccaccacc

SEQ ID NO: 1939394 - RNA, 13 nt, Human herpesvirus 4 [Epstein-Barr virus]
uucugaaggaacg

SEQ ID NO: 1939395 - RNA, 23 nt, Human herpesvirus 4 [Epstein-Barr virus]
guuaugcacucugaccaggacau

SEQ ID NO: 1939396 - RNA, 19 nt, Human herpesvirus 4 [Epstein-Barr virus]
ugcgaugagggccuuccag

SEQ ID NO: 1939397 - RNA, 12 nt, Human herpesvirus 4 [Epstein-Barr virus]
gagucugcugcg

SEQ ID NO: 1939398 - RNA, 14 nt, Human herpesvirus 4 [Epstein-Barr virus]
ccugucggcucucu

SEQ ID NO: 1939399 - RNA, 22 nt, Human herpesvirus 4 [Epstein-Barr virus]
ccgcucggguaagugcuuuuuc

SEQ ID NO: 1939400 - RNA, 14 nt, Human herpesvirus 4 [Epstein-Barr virus]
ccgccgccagcagc

SEQ ID NO: 1939401 - RNA, 11 nt, Human herpesvirus 4 [Epstein-Barr virus]
uacugcugcua

SEQ ID NO: 1939402 - RNA, 18 nt, Human herpesvirus 4 [Epstein-Barr virus]
ggcugugguaaccggugg

SEQ ID NO: 1939403 - RNA, 13 nt, Human herpesvirus 4 [Epstein-Barr virus]
ggcgaaggguggg

SEQ ID NO: 1939404 - RNA, 18 nt, Human herpesvirus 4 [Epstein-Barr virus]
ucaggaagcuggccaggc

SEQ ID NO: 1939405 - RNA, 15 nt, Human herpesvirus 4 [Epstein-Barr virus]
gcauacgcugaguga

SEQ ID NO: 1939406 - RNA, 19 nt, Human herpesvirus 4 [Epstein-Barr virus]
acacgaggaucucuuaaau

SEQ ID NO: 1939407 - RNA, 23 nt, Human herpesvirus 4 [Epstein-Barr virus]
ggggauuacccgacccagccacu

SEQ ID NO: 1939408 - RNA, 18 nt, Human herpesvirus 4 [Epstein-Barr virus]
gagaaccugaugugggac

SEQ ID NO: 1939409 - RNA, 14 nt, Human herpesvirus 4 [Epstein-Barr virus]
cgcucagagcuggg

SEQ ID NO: 1939410 - RNA, 17 nt, Human herpesvirus 4 [Epstein-Barr virus]
caccggcuuggcccucu

SEQ ID NO: 1939411 - RNA, 21 nt, Human herpesvirus 4 [Epstein-Barr virus]
ugagcgugugcacccggcugg

SEQ ID NO: 1939412 - RNA, 19 nt, Human herpesvirus 4 [Epstein-Barr virus]
cuaccuccuaucacaggga

SEQ ID NO: 1939413 - RNA, 16 nt, Human herpesvirus 4 [Epstein-Barr virus]
cacagaccagccccuc

SEQ ID NO: 1939414 - RNA, 16 nt, Human herpesvirus 4 [Epstein-Barr virus]
agcagcgcggcagagg

SEQ ID NO: 1939415 - RNA, 16 nt, Human herpesvirus 4 [Epstein-Barr virus]
ugagucugcuggacuc

SEQ ID NO: 1939416 - RNA, 13 nt, Human herpesvirus 4 [Epstein-Barr virus]
agugaccagucac

SEQ ID NO: 1939417 - RNA, 23 nt, Human herpesvirus 4 [Epstein-Barr virus]
gggccucucuggcugugcugacc

SEQ ID NO: 1939418 - RNA, 13 nt, Human herpesvirus 4 [Epstein-Barr virus]
accauccacagcc

SEQ ID NO: 1939419 - RNA, 16 nt, Human herpesvirus 4 [Epstein-Barr virus]
caugacgcugcugcua

SEQ ID NO: 1939420 - RNA, 13 nt, Human herpesvirus 4 [Epstein-Barr virus]
cgccgccagcagc

SEQ ID NO: 1939421 - RNA, 14 nt, Human herpesvirus 4 [Epstein-Barr virus]
cuggagcuggugca

SEQ ID NO: 1939422 - RNA, 16 nt, Human herpesvirus 4 [Epstein-Barr virus]
agguggcugcugccaa

SEQ ID NO: 1939423 - RNA, 18 nt, Human herpesvirus 4 [Epstein-Barr virus]
uguggccgacuucuggaa

SEQ ID NO: 1939424 - RNA, 17 nt, Human herpesvirus 4 [Epstein-Barr virus]
gauucaccggcaccgcc

SEQ ID NO: 1939425 - RNA, 16 nt, Human herpesvirus 4 [Epstein-Barr virus]
gccuugcccccgccag

SEQ ID NO: 1939426 - RNA, 22 nt, Human herpesvirus 4 [Epstein-Barr virus]
uccccgagggugaggcccagcc

SEQ ID NO: 1939427 - RNA, 22 nt, Human herpesvirus 4 [Epstein-Barr virus]
ccagggacagggcgcugcaugc

SEQ ID NO: 1939428 - RNA, 21 nt, Human herpesvirus 4 [Epstein-Barr virus]
gaugugaauauggcugcggag

SEQ ID NO: 1939429 - RNA, 14 nt, Human herpesvirus 4 [Epstein-Barr virus]
cgcccccaccaccc

SEQ ID NO: 1939430 - RNA, 20 nt, Human herpesvirus 4 [Epstein-Barr virus]
aggagugccucugggugcug

SEQ ID NO: 1939431 - RNA, 12 nt, Human herpesvirus 4 [Epstein-Barr virus]
ugggggcuacag

SEQ ID NO: 1939432 - RNA, 14 nt, Human herpesvirus 4 [Epstein-Barr virus]
gccccgggcggcuc

SEQ ID NO: 1939433 - RNA, 17 nt, Human herpesvirus 4 [Epstein-Barr virus]
ugcuagcgucacugauu

SEQ ID NO: 1939434 - RNA, 15 nt, Human herpesvirus 4 [Epstein-Barr virus]
cagcucggccagcag

SEQ ID NO: 1939435 - RNA, 21 nt, Human herpesvirus 4 [Epstein-Barr virus]
guaacccuguagucaccugca

SEQ ID NO: 1939436 - RNA, 19 nt, Human herpesvirus 4 [Epstein-Barr virus]
agggaugggcuugauggcc

SEQ ID NO: 1939437 - RNA, 14 nt, Human herpesvirus 4 [Epstein-Barr virus]
gccgagccugucga

SEQ ID NO: 1939438 - RNA, 16 nt, Human herpesvirus 4 [Epstein-Barr virus]
ugcucucguugccaaa

SEQ ID NO: 1939439 - RNA, 19 nt, Human herpesvirus 4 [Epstein-Barr virus]
uaccuucuuucuccuucaa

SEQ ID NO: 1939440 - RNA, 15 nt, Human herpesvirus 4 [Epstein-Barr virus]
caguccgccaugacc

SEQ ID NO: 1939441 - RNA, 18 nt, Human herpesvirus 4 [Epstein-Barr virus]
gaggggcaggagcaggag

SEQ ID NO: 1939442 - RNA, 23 nt, Human herpesvirus 4 [Epstein-Barr virus]
cuaaggcaguccaggggccacac

SEQ ID NO: 1939443 - RNA, 12 nt, Human herpesvirus 4 [Epstein-Barr virus]
ccgggggcggga

SEQ ID NO: 1939444 - RNA, 13 nt, Human herpesvirus 4 [Epstein-Barr virus]
uggcuugcuccac

SEQ ID NO: 1939445 - RNA, 18 nt, Human herpesvirus 4 [Epstein-Barr virus]
ugccauguguguccagug

SEQ ID NO: 1939446 - RNA, 18 nt, Human herpesvirus 4 [Epstein-Barr virus]
gcagaguaauugcagugg

SEQ ID NO: 1939447 - RNA, 21 nt, Human herpesvirus 4 [Epstein-Barr virus]
ugcuucgcauuacaccauccc

SEQ ID NO: 1939448 - RNA, 19 nt, Human herpesvirus 4 [Epstein-Barr virus]
cugcucuucaaccuuggca

SEQ ID NO: 1939449 - RNA, 16 nt, Human herpesvirus 4 [Epstein-Barr virus]
cgggggagagaaagag

SEQ ID NO: 1939450 - RNA, 17 nt, Human herpesvirus 4 [Epstein-Barr virus]
ccucuacgccaggcucg

SEQ ID NO: 1939451 - RNA, 23 nt, Human herpesvirus 4 [Epstein-Barr virus]
cugucauucuaucaauuaaacaa

SEQ ID NO: 1939452 - RNA, 20 nt, Human herpesvirus 4 [Epstein-Barr virus]
cagaagacuccugccugaau

SEQ ID NO: 1939453 - RNA, 18 nt, Human herpesvirus 4 [Epstein-Barr virus]
acaagguucggaaaucug

SEQ ID NO: 1939454 - RNA, 14 nt, Human herpesvirus 4 [Epstein-Barr virus]
gcugaacuggggcu

SEQ ID NO: 1939455 - RNA, 20 nt, Human herpesvirus 4 [Epstein-Barr virus]
cggccugcuggccgagcugg

SEQ ID NO: 1939456 - RNA, 19 nt, Human herpesvirus 4 [Epstein-Barr virus]
gcaggagcgggaggggcag

SEQ ID NO: 1939457 - RNA, 18 nt, Human herpesvirus 4 [Epstein-Barr virus]
cccgcaccagggccaggc

SEQ ID NO: 1939458 - RNA, 18 nt, Human herpesvirus 4 [Epstein-Barr virus]
cuaacaggacauguuugg

SEQ ID NO: 1939459 - RNA, 15 nt, Human herpesvirus 4 [Epstein-Barr virus]
cuccaggcuccugga

SEQ ID NO: 1939460 - RNA, 16 nt, Human herpesvirus 4 [Epstein-Barr virus]
cacucugaccaggaca

SEQ ID NO: 1939461 - RNA, 13 nt, Human herpesvirus 4 [Epstein-Barr virus]
agcuuggggccac

SEQ ID NO: 1939462 - RNA, 22 nt, Human herpesvirus 4 [Epstein-Barr virus]
gcacucuuaccuuccucugccc

SEQ ID NO: 1939463 - RNA, 14 nt, Human herpesvirus 4 [Epstein-Barr virus]
ggucgggggcacuc

SEQ ID NO: 1939464 - RNA, 22 nt, Human herpesvirus 4 [Epstein-Barr virus]
auguucccggcacaccagacau

SEQ ID NO: 1939465 - RNA, 18 nt, Human herpesvirus 4 [Epstein-Barr virus]
agcuuugaugaggcugaa

SEQ ID NO: 1939466 - RNA, 15 nt, Human herpesvirus 4 [Epstein-Barr virus]
uccuugugcagcuua

SEQ ID NO: 1939467 - RNA, 16 nt, Human herpesvirus 4 [Epstein-Barr virus]
ucacccauggccaggc

SEQ ID NO: 1939468 - RNA, 14 nt, Human herpesvirus 4 [Epstein-Barr virus]
cggcucggccacgc

SEQ ID NO: 1939469 - RNA, 23 nt, Human herpesvirus 4 [Epstein-Barr virus]
gccacauguuuucuggacacagg

SEQ ID NO: 1939470 - RNA, 16 nt, Human herpesvirus 4 [Epstein-Barr virus]
guggacucggccacac

SEQ ID NO: 1939471 - RNA, 12 nt, Human herpesvirus 4 [Epstein-Barr virus]
ccugccuggauc

SEQ ID NO: 1939472 - RNA, 15 nt, Human herpesvirus 4 [Epstein-Barr virus]
gggcaggagcaggag

SEQ ID NO: 1939473 - RNA, 20 nt, Human herpesvirus 4 [Epstein-Barr virus]
cuuuacccagcccuuaacac

SEQ ID NO: 1939474 - RNA, 22 nt, Human herpesvirus 4 [Epstein-Barr virus]
gagccgugucuccugacgccaa

SEQ ID NO: 1939475 - RNA, 14 nt, Human herpesvirus 4 [Epstein-Barr virus]
ggagccgggcuuca

SEQ ID NO: 1939476 - RNA, 16 nt, Human herpesvirus 4 [Epstein-Barr virus]
ggcagccagagccagc

SEQ ID NO: 1939477 - RNA, 19 nt, Human herpesvirus 4 [Epstein-Barr virus]
cuucucauuagucaggagg

SEQ ID NO: 1939478 - RNA, 15 nt, Human herpesvirus 4 [Epstein-Barr virus]
gaucuggggcuggcc

SEQ ID NO: 1939479 - RNA, 12 nt, Human herpesvirus 4 [Epstein-Barr virus]
ccugcaaacuga

SEQ ID NO: 1939480 - RNA, 19 nt, Human herpesvirus 4 [Epstein-Barr virus]
ggcccagggucacuggcuu

SEQ ID NO: 1939481 - RNA, 18 nt, Human herpesvirus 4 [Epstein-Barr virus]
acccaucugagggcagug

SEQ ID NO: 1939482 - RNA, 20 nt, Human herpesvirus 4 [Epstein-Barr virus]
gcccuccuccacccagcagc

SEQ ID NO: 1939483 - RNA, 16 nt, Human herpesvirus 4 [Epstein-Barr virus]
uuuccaugacaguccc

SEQ ID NO: 1939484 - RNA, 19 nt, Human herpesvirus 4 [Epstein-Barr virus]
auugcugagaaccugcugc

SEQ ID NO: 1939485 - RNA, 20 nt, Human herpesvirus 4 [Epstein-Barr virus]
gcugcaucuuaccccuggcu

SEQ ID NO: 1939486 - RNA, 21 nt, Human herpesvirus 4 [Epstein-Barr virus]
ggcccuguacacuacacucua

SEQ ID NO: 1939487 - RNA, 19 nt, Human herpesvirus 4 [Epstein-Barr virus]
cauucgacaggccauuaga

SEQ ID NO: 1939488 - RNA, 21 nt, Human herpesvirus 4 [Epstein-Barr virus]
ugcgucagcaacugcguccuc

SEQ ID NO: 1939489 - RNA, 12 nt, Human herpesvirus 4 [Epstein-Barr virus]
ucccucugggag

SEQ ID NO: 1939490 - RNA, 14 nt, Human herpesvirus 4 [Epstein-Barr virus]
ccaagacucccuga

SEQ ID NO: 1939491 - RNA, 14 nt, Human herpesvirus 4 [Epstein-Barr virus]
cuuguccaggagac

SEQ ID NO: 1939492 - RNA, 18 nt, Human herpesvirus 4 [Epstein-Barr virus]
ugggaauaacaagggaag

SEQ ID NO: 1939493 - RNA, 12 nt, Human herpesvirus 4 [Epstein-Barr virus]
agagcucuggag

SEQ ID NO: 1939494 - RNA, 13 nt, Human herpesvirus 4 [Epstein-Barr virus]
gaacugauggcaa

SEQ ID NO: 1939495 - RNA, 15 nt, Human herpesvirus 4 [Epstein-Barr virus]
gaggcuucccgccua

SEQ ID NO: 1939496 - RNA, 23 nt, Human herpesvirus 4 [Epstein-Barr virus]
ccccacggggugcucccccugga

SEQ ID NO: 1939497 - RNA, 16 nt, Human herpesvirus 4 [Epstein-Barr virus]
ccuugggggccuggac

SEQ ID NO: 1939498 - RNA, 19 nt, Human herpesvirus 4 [Epstein-Barr virus]
ucaucaguaaaucugucuc

SEQ ID NO: 1939499 - RNA, 11 nt, Human herpesvirus 4 [Epstein-Barr virus]
aucuggcucuc

SEQ ID NO: 1939500 - RNA, 22 nt, Human herpesvirus 4 [Epstein-Barr virus]
gcccccugucucuuucuggcca

SEQ ID NO: 1939501 - RNA, 16 nt, Human herpesvirus 4 [Epstein-Barr virus]
cagacucucuucagug

SEQ ID NO: 1939502 - RNA, 12 nt, Human herpesvirus 4 [Epstein-Barr virus]
agggcagacugc

SEQ ID NO: 1939503 - RNA, 17 nt, Human herpesvirus 4 [Epstein-Barr virus]
ccagcaaccaauguauc

SEQ ID NO: 1939504 - RNA, 13 nt, Human herpesvirus 4 [Epstein-Barr virus]
gccuucuuccuag

SEQ ID NO: 1939505 - RNA, 12 nt, Human herpesvirus 4 [Epstein-Barr virus]
gacggugucugu

SEQ ID NO: 1939506 - RNA, 16 nt, Human herpesvirus 4 [Epstein-Barr virus]
cucaaacagucccgag

SEQ ID NO: 1939507 - RNA, 21 nt, Human herpesvirus 4 [Epstein-Barr virus]
agacguguguggcuguagcca

SEQ ID NO: 1939508 - RNA, 19 nt, Human herpesvirus 4 [Epstein-Barr virus]
gcacacacucccuuagcca

SEQ ID NO: 1939509 - RNA, 22 nt, Human herpesvirus 4 [Epstein-Barr virus]
ucucaugggggaaugagggaaa

SEQ ID NO: 1939510 - RNA, 19 nt, Human herpesvirus 4 [Epstein-Barr virus]
cuucacuaaggcaguccag

SEQ ID NO: 1939511 - RNA, 17 nt, Human herpesvirus 4 [Epstein-Barr virus]
cugcaccaguggcugcc

SEQ ID NO: 1939512 - RNA, 18 nt, Human herpesvirus 4 [Epstein-Barr virus]
ugaggaggcacacaaaau

SEQ ID NO: 1939513 - RNA, 20 nt, Human herpesvirus 4 [Epstein-Barr virus]
gccucuacgccccagaugaa

SEQ ID NO: 1939514 - RNA, 18 nt, Human herpesvirus 4 [Epstein-Barr virus]
caaacaugggcugcuaua

SEQ ID NO: 1939515 - RNA, 18 nt, Human herpesvirus 4 [Epstein-Barr virus]
ggcagcacacgaagccug

SEQ ID NO: 1939516 - RNA, 20 nt, Human herpesvirus 4 [Epstein-Barr virus]
gccaggccgccaugcucagg

SEQ ID NO: 1939517 - RNA, 18 nt, Human herpesvirus 4 [Epstein-Barr virus]
acccggaccaaugccaaa

SEQ ID NO: 1939518 - RNA, 19 nt, Human herpesvirus 4 [Epstein-Barr virus]
uagaauccagccagugguc

SEQ ID NO: 1939519 - RNA, 19 nt, Human herpesvirus 4 [Epstein-Barr virus]
acugcagugggccucucug

SEQ ID NO: 1939520 - RNA, 16 nt, Human herpesvirus 4 [Epstein-Barr virus]
aagauguaaagaucua

SEQ ID NO: 1939521 - RNA, 15 nt, Human herpesvirus 4 [Epstein-Barr virus]
guugcaguauguaca

SEQ ID NO: 1939522 - RNA, 19 nt, Human herpesvirus 4 [Epstein-Barr virus]
gccuaaacgugauggugcu

SEQ ID NO: 1939523 - RNA, 20 nt, Human herpesvirus 4 [Epstein-Barr virus]
guauuccucaagcccuucuu

SEQ ID NO: 1939524 - RNA, 12 nt, Human herpesvirus 4 [Epstein-Barr virus]
agggccaagaca

SEQ ID NO: 1939525 - RNA, 19 nt, Human herpesvirus 4 [Epstein-Barr virus]
ugguggguguccucuacug

SEQ ID NO: 1939526 - RNA, 22 nt, Human herpesvirus 4 [Epstein-Barr virus]
ggaauuugugguuuggggcagg

SEQ ID NO: 1939527 - RNA, 13 nt, Human herpesvirus 4 [Epstein-Barr virus]
ggcgcaggggagg

SEQ ID NO: 1939528 - RNA, 13 nt, Human herpesvirus 4 [Epstein-Barr virus]
gucuacccagagg

SEQ ID NO: 1939529 - RNA, 16 nt, Human herpesvirus 4 [Epstein-Barr virus]
cccgaguccaaggccc

SEQ ID NO: 1939530 - RNA, 17 nt, Human herpesvirus 4 [Epstein-Barr virus]
accuuccagacuaugca

SEQ ID NO: 1939531 - RNA, 18 nt, Human herpesvirus 4 [Epstein-Barr virus]
gaaccugagccugagcca

SEQ ID NO: 1939532 - RNA, 19 nt, Human herpesvirus 4 [Epstein-Barr virus]
ucuuuugcucuuaaccauu

SEQ ID NO: 1939533 - RNA, 18 nt, Human herpesvirus 4 [Epstein-Barr virus]
cugauucccccugcucau

SEQ ID NO: 1939534 - RNA, 23 nt, Human herpesvirus 4 [Epstein-Barr virus]
cagacaugguguagacagauccc

SEQ ID NO: 1939535 - RNA, 17 nt, Human herpesvirus 4 [Epstein-Barr virus]
ccagacucugcuuucug

SEQ ID NO: 1939536 - RNA, 16 nt, Human herpesvirus 4 [Epstein-Barr virus]
gcgccagcagggcaca

SEQ ID NO: 1939537 - RNA, 13 nt, Human herpesvirus 4 [Epstein-Barr virus]
acgcuccuggguu

SEQ ID NO: 1939538 - RNA, 17 nt, Human herpesvirus 4 [Epstein-Barr virus]
cgcccugagcuggacga

SEQ ID NO: 1939539 - RNA, 22 nt, Human herpesvirus 4 [Epstein-Barr virus]
uguucccuaagcagcugagggg

SEQ ID NO: 1939540 - RNA, 20 nt, Human herpesvirus 4 [Epstein-Barr virus]
aggccauacgucuagccaca

SEQ ID NO: 1939541 - RNA, 19 nt, Human herpesvirus 4 [Epstein-Barr virus]
caguggaccucaaagaaga

SEQ ID NO: 1939542 - RNA, 14 nt, Human herpesvirus 4 [Epstein-Barr virus]
aucuggggccaagg

SEQ ID NO: 1939543 - RNA, 23 nt, Human herpesvirus 4 [Epstein-Barr virus]
aguggaccucaaagaagaggggg

SEQ ID NO: 1939544 - RNA, 12 nt, Human herpesvirus 4 [Epstein-Barr virus]
cuggccagcacc

SEQ ID NO: 1939545 - RNA, 11 nt, Human herpesvirus 4 [Epstein-Barr virus]
cagccauggcc

SEQ ID NO: 1939546 - RNA, 14 nt, Human herpesvirus 4 [Epstein-Barr virus]
cagccccucauccc

SEQ ID NO: 1939547 - RNA, 16 nt, Human herpesvirus 4 [Epstein-Barr virus]
aacacuccacagaugg

SEQ ID NO: 1939548 - RNA, 23 nt, Human herpesvirus 4 [Epstein-Barr virus]
cagggcucuguucacgcgauggu

SEQ ID NO: 1939549 - RNA, 17 nt, Human herpesvirus 4 [Epstein-Barr virus]
ugcacaggcuuggaaac

SEQ ID NO: 1939550 - RNA, 22 nt, Human herpesvirus 4 [Epstein-Barr virus]
cacagaggugauguagaggcgc

SEQ ID NO: 1939551 - RNA, 13 nt, Human herpesvirus 4 [Epstein-Barr virus]
cugguaguaggca

SEQ ID NO: 1939552 - RNA, 22 nt, Human herpesvirus 4 [Epstein-Barr virus]
augggaauaacaagggaagagg

SEQ ID NO: 1939553 - RNA, 18 nt, Human herpesvirus 4 [Epstein-Barr virus]
acgccguggcccugagca

SEQ ID NO: 1939554 - RNA, 16 nt, Human herpesvirus 4 [Epstein-Barr virus]
ccaugccuccccagca

SEQ ID NO: 1939555 - RNA, 13 nt, Human herpesvirus 4 [Epstein-Barr virus]
augacacaggaca

SEQ ID NO: 1939556 - RNA, 17 nt, Human herpesvirus 4 [Epstein-Barr virus]
acgaggacgagaaggag

SEQ ID NO: 1939557 - RNA, 23 nt, Human herpesvirus 4 [Epstein-Barr virus]
cuaacacgcuuuugucugccugg

SEQ ID NO: 1939558 - RNA, 17 nt, Human herpesvirus 4 [Epstein-Barr virus]
gcacggucgccccuccg

SEQ ID NO: 1939559 - RNA, 14 nt, Human herpesvirus 4 [Epstein-Barr virus]
cugcuggucauggc

SEQ ID NO: 1939560 - RNA, 19 nt, Human herpesvirus 4 [Epstein-Barr virus]
cccucgguggugggcugcu

SEQ ID NO: 1939561 - RNA, 16 nt, Human herpesvirus 4 [Epstein-Barr virus]
ugagaacuuucuucua

SEQ ID NO: 1939562 - RNA, 24 nt, Human herpesvirus 4 [Epstein-Barr virus]
gaggauggcacgguccagaagcag

SEQ ID NO: 1939563 - RNA, 22 nt, Human herpesvirus 4 [Epstein-Barr virus]
agacgagucugacuacagcgag

SEQ ID NO: 1939564 - RNA, 23 nt, Human herpesvirus 4 [Epstein-Barr virus]
gcccuuggaacugacgggcacug

SEQ ID NO: 1939565 - RNA, 15 nt, Human herpesvirus 4 [Epstein-Barr virus]
gaccuacgcugcccu

SEQ ID NO: 1939566 - RNA, 21 nt, Human herpesvirus 4 [Epstein-Barr virus]
cugcacaaaggaaacugcuga

SEQ ID NO: 1939567 - RNA, 20 nt, Human herpesvirus 4 [Epstein-Barr virus]
cagauagccggccaggcaga

SEQ ID NO: 1939568 - RNA, 18 nt, Human herpesvirus 4 [Epstein-Barr virus]
cuucagcuccagggccag

SEQ ID NO: 1939569 - RNA, 19 nt, Human herpesvirus 4 [Epstein-Barr virus]
gacaugagcauggaagaca

SEQ ID NO: 1939570 - RNA, 16 nt, Human herpesvirus 4 [Epstein-Barr virus]
auuguucuacuccugg

SEQ ID NO: 1939571 - RNA, 16 nt, Human herpesvirus 4 [Epstein-Barr virus]
cgugggauggcggggc

SEQ ID NO: 1939572 - RNA, 20 nt, Human herpesvirus 4 [Epstein-Barr virus]
cggccucgccuucuccucag

SEQ ID NO: 1939573 - RNA, 19 nt, Human herpesvirus 4 [Epstein-Barr virus]
gcgaacauuuauucauuau

SEQ ID NO: 1939574 - RNA, 18 nt, Human herpesvirus 4 [Epstein-Barr virus]
cauuggcagcagcucugg

SEQ ID NO: 1939575 - RNA, 22 nt, Human herpesvirus 4 [Epstein-Barr virus]
ucccgugcuuuuugccaggccu

SEQ ID NO: 1939576 - RNA, 18 nt, Human herpesvirus 4 [Epstein-Barr virus]
gggugaccacugagggag

SEQ ID NO: 1939577 - RNA, 19 nt, Human herpesvirus 4 [Epstein-Barr virus]
ccagaaucgguaaggaggg

SEQ ID NO: 1939578 - RNA, 19 nt, Human herpesvirus 4 [Epstein-Barr virus]
ggagggagccugcccaucc

SEQ ID NO: 1939579 - RNA, 15 nt, Human herpesvirus 4 [Epstein-Barr virus]
ggugaucgacuccag

SEQ ID NO: 1939580 - RNA, 20 nt, Human herpesvirus 4 [Epstein-Barr virus]
agcagcccggccgaggccug

SEQ ID NO: 1939581 - RNA, 21 nt, Human herpesvirus 4 [Epstein-Barr virus]
aaaaggggcagcaaucucggc

SEQ ID NO: 1939582 - RNA, 19 nt, Human herpesvirus 4 [Epstein-Barr virus]
caggccgccaugcucaggg

SEQ ID NO: 1939583 - RNA, 12 nt, Human herpesvirus 4 [Epstein-Barr virus]
cuggaggccuca

SEQ ID NO: 1939584 - RNA, 20 nt, Human herpesvirus 4 [Epstein-Barr virus]
gauuuccuacaacucagccc

SEQ ID NO: 1939585 - RNA, 18 nt, Human herpesvirus 4 [Epstein-Barr virus]
ggccaggcagaggaaggc

SEQ ID NO: 1939586 - RNA, 21 nt, Human herpesvirus 4 [Epstein-Barr virus]
gccccaauucuugcacccacc

SEQ ID NO: 1939587 - RNA, 20 nt, Human herpesvirus 4 [Epstein-Barr virus]
gagcugggcaaagauuuucu

SEQ ID NO: 1939588 - RNA, 15 nt, Human herpesvirus 4 [Epstein-Barr virus]
ugcaugagccacagg

SEQ ID NO: 1939589 - RNA, 19 nt, Human herpesvirus 4 [Epstein-Barr virus]
caacacaaccacggugaca

SEQ ID NO: 1939590 - RNA, 20 nt, Human herpesvirus 4 [Epstein-Barr virus]
gccuauggguuaccaggcau

SEQ ID NO: 1939591 - RNA, 18 nt, Human herpesvirus 4 [Epstein-Barr virus]
guacccgggucccgccuc

SEQ ID NO: 1939592 - RNA, 19 nt, Human herpesvirus 4 [Epstein-Barr virus]
gcccacacagcgccagcag

SEQ ID NO: 1939593 - RNA, 21 nt, Human herpesvirus 4 [Epstein-Barr virus]
ggaaagaggucccauguacag

SEQ ID NO: 1939594 - RNA, 17 nt, Human herpesvirus 4 [Epstein-Barr virus]
ggccaugcgcgcccugu

SEQ ID NO: 1939595 - RNA, 21 nt, Human herpesvirus 4 [Epstein-Barr virus]
caagccgggggagaagcaccu

SEQ ID NO: 1939596 - RNA, 14 nt, Human herpesvirus 4 [Epstein-Barr virus]
gcgacgcucccggg

SEQ ID NO: 1939597 - RNA, 19 nt, Human herpesvirus 4 [Epstein-Barr virus]
uggcuucuuagaugaggag

SEQ ID NO: 1939598 - RNA, 22 nt, Human herpesvirus 4 [Epstein-Barr virus]
cugugcugacccuucugcugcu

SEQ ID NO: 1939599 - RNA, 23 nt, Human herpesvirus 4 [Epstein-Barr virus]
cccaccauaugaugacgccgaga

SEQ ID NO: 1939600 - RNA, 22 nt, Human herpesvirus 4 [Epstein-Barr virus]
gccugagacagaggugcucaag

SEQ ID NO: 1939601 - RNA, 19 nt, Human herpesvirus 4 [Epstein-Barr virus]
gucggacgaggaggaagag

SEQ ID NO: 1939602 - RNA, 20 nt, Human herpesvirus 4 [Epstein-Barr virus]
aaggugguuauuuugggcca

SEQ ID NO: 1939603 - RNA, 14 nt, Human herpesvirus 4 [Epstein-Barr virus]
caggaggggcagga

SEQ ID NO: 1939604 - RNA, 14 nt, Human herpesvirus 4 [Epstein-Barr virus]
ggccaggcagagga

SEQ ID NO: 1939605 - RNA, 21 nt, Human herpesvirus 4 [Epstein-Barr virus]
gacugaggggguacggagagg

SEQ ID NO: 1939606 - RNA, 22 nt, Human herpesvirus 4 [Epstein-Barr virus]
uguucagggccgugcauggcag

SEQ ID NO: 1939607 - RNA, 15 nt, Human herpesvirus 4 [Epstein-Barr virus]
cugcaaagggaccca

SEQ ID NO: 1939608 - RNA, 23 nt, Human herpesvirus 4 [Epstein-Barr virus]
gcggcccagcagauccagggccc

SEQ ID NO: 1939609 - RNA, 17 nt, Human herpesvirus 4 [Epstein-Barr virus]
ccgccccgggcccggga

SEQ ID NO: 1939610 - RNA, 18 nt, Human herpesvirus 4 [Epstein-Barr virus]
gacacuuuagagcucugg

SEQ ID NO: 1939611 - RNA, 14 nt, Human herpesvirus 4 [Epstein-Barr virus]
ccggccaggcagag

SEQ ID NO: 1939612 - RNA, 12 nt, Human herpesvirus 4 [Epstein-Barr virus]
ugccagaggccc

SEQ ID NO: 1939613 - RNA, 15 nt, Human herpesvirus 4 [Epstein-Barr virus]
aagacuauguucucu

SEQ ID NO: 1939614 - RNA, 23 nt, Human herpesvirus 4 [Epstein-Barr virus]
auugggugguggcagcaggcgcu

SEQ ID NO: 1939615 - RNA, 19 nt, Human herpesvirus 4 [Epstein-Barr virus]
uucucuaaucccucuggga

SEQ ID NO: 1939616 - RNA, 23 nt, Human herpesvirus 4 [Epstein-Barr virus]
uccugugugaccccucacuuugu

SEQ ID NO: 1939617 - RNA, 17 nt, Human herpesvirus 4 [Epstein-Barr virus]
gugcuuuccaccggugg

SEQ ID NO: 1939618 - RNA, 22 nt, Human herpesvirus 4 [Epstein-Barr virus]
acccggucgcaugguggcuucu

SEQ ID NO: 1939619 - RNA, 17 nt, Human herpesvirus 4 [Epstein-Barr virus]
aggagggcugguugggg

SEQ ID NO: 1939620 - RNA, 19 nt, Human herpesvirus 4 [Epstein-Barr virus]
acucaccaagauuguucca

SEQ ID NO: 1939621 - RNA, 14 nt, Human herpesvirus 4 [Epstein-Barr virus]
auuuugggccagga

SEQ ID NO: 1939622 - RNA, 21 nt, Human herpesvirus 4 [Epstein-Barr virus]
gacgccugcggacucaggcca

SEQ ID NO: 1939623 - RNA, 18 nt, Human herpesvirus 4 [Epstein-Barr virus]
cccugcucauaccuccac

SEQ ID NO: 1939624 - RNA, 21 nt, Human herpesvirus 4 [Epstein-Barr virus]
gcccugucaccaggccugcca

SEQ ID NO: 1939625 - RNA, 22 nt, Human herpesvirus 4 [Epstein-Barr virus]
gcuggacgugaaccuccccccc

SEQ ID NO: 1939626 - RNA, 18 nt, Human herpesvirus 4 [Epstein-Barr virus]
cugacucucauguacuuu

SEQ ID NO: 1939627 - RNA, 16 nt, Human herpesvirus 4 [Epstein-Barr virus]
gcccagugcacccagg

SEQ ID NO: 1939628 - RNA, 22 nt, Human herpesvirus 4 [Epstein-Barr virus]
gagucugacuacucagaugaag

SEQ ID NO: 1939629 - RNA, 14 nt, Human herpesvirus 4 [Epstein-Barr virus]
gccggcagccuggc

SEQ ID NO: 1939630 - RNA, 15 nt, Human herpesvirus 4 [Epstein-Barr virus]
gcugaugugcugccc

SEQ ID NO: 1939631 - RNA, 17 nt, Human herpesvirus 4 [Epstein-Barr virus]
cuugugguucuccugau

SEQ ID NO: 1939632 - RNA, 24 nt, Human herpesvirus 4 [Epstein-Barr virus]
ccugcagaguaauugcaguggacc

SEQ ID NO: 1939633 - RNA, 20 nt, Human herpesvirus 4 [Epstein-Barr virus]
cucgccgcuaguugguccag

SEQ ID NO: 1939634 - RNA, 19 nt, Human herpesvirus 4 [Epstein-Barr virus]
ggccagcaaaaccagcccg

SEQ ID NO: 1939635 - RNA, 15 nt, Human herpesvirus 4 [Epstein-Barr virus]
ugcccgccgugaacu

SEQ ID NO: 1939636 - RNA, 22 nt, Human herpesvirus 4 [Epstein-Barr virus]
cauagagaugguguccggagac

SEQ ID NO: 1939637 - RNA, 21 nt, Human herpesvirus 4 [Epstein-Barr virus]
cccaccagaucgccugccacu

SEQ ID NO: 1939638 - RNA, 15 nt, Human herpesvirus 4 [Epstein-Barr virus]
ucuccugccugccuc

SEQ ID NO: 1939639 - RNA, 20 nt, Human herpesvirus 4 [Epstein-Barr virus]
cuuuaggcguaacuugucua

SEQ ID NO: 1939640 - RNA, 16 nt, Human herpesvirus 4 [Epstein-Barr virus]
ucaauuuugggagcuc

SEQ ID NO: 1939641 - RNA, 13 nt, Human herpesvirus 4 [Epstein-Barr virus]
gaauuauuuacca

SEQ ID NO: 1939642 - RNA, 16 nt, Human herpesvirus 4 [Epstein-Barr virus]
cuuagccacacugucu

SEQ ID NO: 1939643 - RNA, 16 nt, Human herpesvirus 4 [Epstein-Barr virus]
ucuggcugugcugacc

SEQ ID NO: 1939644 - RNA, 14 nt, Human herpesvirus 4 [Epstein-Barr virus]
cggguccuagcaca

SEQ ID NO: 1939645 - RNA, 19 nt, Human herpesvirus 4 [Epstein-Barr virus]
ccacuuccacagcaauggc

SEQ ID NO: 1939646 - RNA, 23 nt, Human herpesvirus 4 [Epstein-Barr virus]
agcuccgcgcucaacaccuucuc

SEQ ID NO: 1939647 - RNA, 23 nt, Human herpesvirus 4 [Epstein-Barr virus]
cuggcaaagauccccaguggagc

SEQ ID NO: 1939648 - RNA, 22 nt, Human herpesvirus 4 [Epstein-Barr virus]
ccacgggaaaaagaauagcuuc

SEQ ID NO: 1939649 - RNA, 20 nt, Human herpesvirus 4 [Epstein-Barr virus]
guggcacacauuacggugcu

SEQ ID NO: 1939650 - RNA, 17 nt, Human herpesvirus 4 [Epstein-Barr virus]
gccagcgccuccucgca

SEQ ID NO: 1939651 - RNA, 14 nt, Human herpesvirus 4 [Epstein-Barr virus]
ugcaccagcuccag

SEQ ID NO: 1939652 - RNA, 16 nt, Human herpesvirus 4 [Epstein-Barr virus]
aagaccaauacccagg

SEQ ID NO: 1939653 - RNA, 23 nt, Human herpesvirus 4 [Epstein-Barr virus]
gcaccuguccuugucugcugcca

SEQ ID NO: 1939654 - RNA, 21 nt, Human herpesvirus 4 [Epstein-Barr virus]
uggagaugauucaugggcugg

SEQ ID NO: 1939655 - RNA, 20 nt, Human herpesvirus 4 [Epstein-Barr virus]
ccagcagggccuugagccca

SEQ ID NO: 1939656 - RNA, 15 nt, Human herpesvirus 4 [Epstein-Barr virus]
gcgccguccacggcc

SEQ ID NO: 1939657 - RNA, 12 nt, Human herpesvirus 4 [Epstein-Barr virus]
cccuucugcugc

SEQ ID NO: 1939658 - RNA, 19 nt, Human herpesvirus 4 [Epstein-Barr virus]
gccagagaggcccacugca

SEQ ID NO: 1939659 - RNA, 15 nt, Human herpesvirus 4 [Epstein-Barr virus]
uccucaagcccuucu

SEQ ID NO: 1939660 - RNA, 15 nt, Human herpesvirus 4 [Epstein-Barr virus]
cuccgugguccugag

SEQ ID NO: 1939661 - RNA, 17 nt, Human herpesvirus 4 [Epstein-Barr virus]
gccaggcccgaccugcc

SEQ ID NO: 1939662 - RNA, 23 nt, Human herpesvirus 4 [Epstein-Barr virus]
gggaugaacccuggggcaacaga

SEQ ID NO: 1939663 - RNA, 22 nt, Human herpesvirus 4 [Epstein-Barr virus]
aaucucucccacggaccccccu

SEQ ID NO: 1939664 - RNA, 17 nt, Human herpesvirus 4 [Epstein-Barr virus]
gcccagaggcgcugugg

SEQ ID NO: 1939665 - RNA, 14 nt, Human herpesvirus 4 [Epstein-Barr virus]
augucacguguccu

SEQ ID NO: 1939666 - RNA, 22 nt, Human herpesvirus 4 [Epstein-Barr virus]
cugccuccggccgccccgggcc

SEQ ID NO: 1939667 - RNA, 22 nt, Human herpesvirus 4 [Epstein-Barr virus]
guaccagcccuuuuuccagugg

SEQ ID NO: 1939668 - RNA, 16 nt, Human herpesvirus 4 [Epstein-Barr virus]
ccuaugccuggaagaa

SEQ ID NO: 1939669 - RNA, 17 nt, Human herpesvirus 4 [Epstein-Barr virus]
gggcggcguggagcugg

SEQ ID NO: 1939670 - RNA, 23 nt, Human herpesvirus 4 [Epstein-Barr virus]
cacaccuaaauuuagcacguccc

SEQ ID NO: 1939671 - RNA, 21 nt, Human herpesvirus 4 [Epstein-Barr virus]
gaaggcgugggugucagaccu

SEQ ID NO: 1939672 - RNA, 23 nt, Human herpesvirus 4 [Epstein-Barr virus]
uccaaguugcauuggcugcaaag

SEQ ID NO: 1939673 - RNA, 16 nt, Human herpesvirus 4 [Epstein-Barr virus]
uaacugugucccacuc

SEQ ID NO: 1939674 - RNA, 12 nt, Human herpesvirus 4 [Epstein-Barr virus]
aucgcagcucua

SEQ ID NO: 1939675 - RNA, 14 nt, Human herpesvirus 4 [Epstein-Barr virus]
acucccaccacccc

SEQ ID NO: 1939676 - RNA, 15 nt, Human herpesvirus 4 [Epstein-Barr virus]
gccagguacaggacc

SEQ ID NO: 1939677 - RNA, 22 nt, Human herpesvirus 4 [Epstein-Barr virus]
acacuucugaaaacugccuccu

SEQ ID NO: 1939678 - RNA, 17 nt, Human herpesvirus 4 [Epstein-Barr virus]
agccccauggugugaga

SEQ ID NO: 1939679 - RNA, 14 nt, Human herpesvirus 4 [Epstein-Barr virus]
cuccaaaaaguugg

SEQ ID NO: 1939680 - RNA, 18 nt, Human herpesvirus 4 [Epstein-Barr virus]
acccccagcgcuggcucc

SEQ ID NO: 1939681 - RNA, 13 nt, Human herpesvirus 4 [Epstein-Barr virus]
ggcgaaggcgugc

SEQ ID NO: 1939682 - RNA, 17 nt, Human herpesvirus 4 [Epstein-Barr virus]
uccucugccuggccggc

SEQ ID NO: 1939683 - RNA, 19 nt, Human herpesvirus 4 [Epstein-Barr virus]
aacauuugaggaggcacac

SEQ ID NO: 1939684 - RNA, 13 nt, Human herpesvirus 4 [Epstein-Barr virus]
cgguugagcugag

SEQ ID NO: 1939685 - RNA, 12 nt, Human herpesvirus 4 [Epstein-Barr virus]
ggguacuggcau

SEQ ID NO: 1939686 - RNA, 21 nt, Human herpesvirus 4 [Epstein-Barr virus]
ugacuguaaucacuggcaaag

SEQ ID NO: 1939687 - RNA, 15 nt, Human herpesvirus 4 [Epstein-Barr virus]
ccaccacucccacca

SEQ ID NO: 1939688 - RNA, 11 nt, Human herpesvirus 4 [Epstein-Barr virus]
ggccaggaccc

SEQ ID NO: 1939689 - RNA, 20 nt, Human herpesvirus 4 [Epstein-Barr virus]
ccaugcaaguggaugcaucu

SEQ ID NO: 1939690 - RNA, 22 nt, Human herpesvirus 4 [Epstein-Barr virus]
ccgggcgcccccaaacuuuguc

SEQ ID NO: 1939691 - RNA, 12 nt, Human herpesvirus 4 [Epstein-Barr virus]
gcggcugugagc

SEQ ID NO: 1939692 - RNA, 13 nt, Human herpesvirus 4 [Epstein-Barr virus]
gcugcgccuccug

SEQ ID NO: 1939693 - RNA, 14 nt, Human herpesvirus 4 [Epstein-Barr virus]
cauaucgcaacacu

SEQ ID NO: 1939694 - RNA, 15 nt, Human herpesvirus 4 [Epstein-Barr virus]
ucucccacugucacu

SEQ ID NO: 1939695 - RNA, 22 nt, Human herpesvirus 4 [Epstein-Barr virus]
gcaucggggcggacgccuccuc

SEQ ID NO: 1939696 - RNA, 16 nt, Human herpesvirus 4 [Epstein-Barr virus]
ccugguacaggaccau

SEQ ID NO: 1939697 - RNA, 22 nt, Human herpesvirus 4 [Epstein-Barr virus]
ggagacguggguccccucugcc

SEQ ID NO: 1939698 - RNA, 15 nt, Human herpesvirus 4 [Epstein-Barr virus]
cuugaggugggcuga

SEQ ID NO: 1939699 - RNA, 20 nt, Human herpesvirus 4 [Epstein-Barr virus]
gcuguggccggugcugccag

SEQ ID NO: 1939700 - RNA, 20 nt, Human herpesvirus 4 [Epstein-Barr virus]
acagcagcagugugugaaga

SEQ ID NO: 1939701 - RNA, 16 nt, Human herpesvirus 4 [Epstein-Barr virus]
ggcaaacagggcagag

SEQ ID NO: 1939702 - RNA, 19 nt, Human herpesvirus 4 [Epstein-Barr virus]
uacuuauuggagaugcucu

SEQ ID NO: 1939703 - RNA, 18 nt, Human herpesvirus 4 [Epstein-Barr virus]
ggucaaguaccagcuggu

SEQ ID NO: 1939704 - RNA, 15 nt, Human herpesvirus 4 [Epstein-Barr virus]
accccugggcucuca

SEQ ID NO: 1939705 - RNA, 14 nt, Human herpesvirus 4 [Epstein-Barr virus]
gcugaagcccaaga

SEQ ID NO: 1939706 - RNA, 22 nt, Human herpesvirus 4 [Epstein-Barr virus]
cucuucauuagauucacguucc

SEQ ID NO: 1939707 - RNA, 19 nt, Human herpesvirus 4 [Epstein-Barr virus]
aggcgcuguggagagaggc

SEQ ID NO: 1939708 - RNA, 23 nt, Human herpesvirus 4 [Epstein-Barr virus]
ggccggaaccugagccugagcca

SEQ ID NO: 1939709 - RNA, 12 nt, Human herpesvirus 4 [Epstein-Barr virus]
agcaauggcacg

SEQ ID NO: 1939710 - RNA, 19 nt, Human herpesvirus 4 [Epstein-Barr virus]
ucaccccgaguccaaggcc

SEQ ID NO: 1939711 - RNA, 15 nt, Human herpesvirus 4 [Epstein-Barr virus]
cuacuucgccaugcu

SEQ ID NO: 1939712 - RNA, 23 nt, Human herpesvirus 4 [Epstein-Barr virus]
cgcgcugcucgccccugguagaa

SEQ ID NO: 1939713 - RNA, 20 nt, Human herpesvirus 4 [Epstein-Barr virus]
caugaggagguaauuagcac

SEQ ID NO: 1939714 - RNA, 17 nt, Human herpesvirus 4 [Epstein-Barr virus]
cgcaguccgccaugacc

SEQ ID NO: 1939715 - RNA, 18 nt, Human herpesvirus 4 [Epstein-Barr virus]
uacccugcauggccaggc

SEQ ID NO: 1939716 - RNA, 23 nt, Human herpesvirus 4 [Epstein-Barr virus]
gggaguaaggccgcugccaggcc

SEQ ID NO: 1939717 - RNA, 14 nt, Human herpesvirus 4 [Epstein-Barr virus]
gcgagggggccugg

SEQ ID NO: 1939718 - RNA, 17 nt, Human herpesvirus 4 [Epstein-Barr virus]
cuaucacagggacaucu

SEQ ID NO: 1939719 - RNA, 22 nt, Human herpesvirus 4 [Epstein-Barr virus]
augauaaugaugaggagcaccg

SEQ ID NO: 1939720 - RNA, 21 nt, Human herpesvirus 4 [Epstein-Barr virus]
cggcggacccgaucagagccc

SEQ ID NO: 1939721 - RNA, 18 nt, Human herpesvirus 4 [Epstein-Barr virus]
acuaugacaccuaucugu

SEQ ID NO: 1939722 - RNA, 16 nt, Human herpesvirus 4 [Epstein-Barr virus]
aaucccucugggagaa

SEQ ID NO: 1939723 - RNA, 22 nt, Human herpesvirus 4 [Epstein-Barr virus]
cucuggucgcccccucugccuc

SEQ ID NO: 1939724 - RNA, 10 nt, Human herpesvirus 4 [Epstein-Barr virus]
ggugcucccc

SEQ ID NO: 1939725 - RNA, 12 nt, Human herpesvirus 4 [Epstein-Barr virus]
uucaaccuaauu

SEQ ID NO: 1939726 - RNA, 15 nt, Human herpesvirus 4 [Epstein-Barr virus]
aguccaggggccaca

SEQ ID NO: 1939727 - RNA, 14 nt, Human herpesvirus 4 [Epstein-Barr virus]
ggguccgugcggcu

SEQ ID NO: 1939728 - RNA, 12 nt, Human herpesvirus 4 [Epstein-Barr virus]
caccaccacccc

SEQ ID NO: 1939729 - RNA, 14 nt, Human herpesvirus 4 [Epstein-Barr virus]
ugaggcccagcccc

SEQ ID NO: 1939730 - RNA, 20 nt, Human herpesvirus 4 [Epstein-Barr virus]
auuuggacgagagcaugcca

SEQ ID NO: 1939731 - RNA, 16 nt, Human herpesvirus 4 [Epstein-Barr virus]
cuccggcugcccgucu

SEQ ID NO: 1939732 - RNA, 18 nt, Human herpesvirus 4 [Epstein-Barr virus]
cucuaacuuggcaucucu

SEQ ID NO: 1939733 - RNA, 22 nt, Human herpesvirus 4 [Epstein-Barr virus]
ggucacuaaaguuggucaggcu

SEQ ID NO: 1939734 - RNA, 23 nt, Human herpesvirus 4 [Epstein-Barr virus]
caggagcgggaggggcaggagca

SEQ ID NO: 1939735 - RNA, 18 nt, Human herpesvirus 4 [Epstein-Barr virus]
gguagauagguggucgca

SEQ ID NO: 1939736 - RNA, 18 nt, Human herpesvirus 4 [Epstein-Barr virus]
ucaggaucagggccaaga

SEQ ID NO: 1939737 - RNA, 21 nt, Human herpesvirus 4 [Epstein-Barr virus]
caugacgcugcugcuacuggc

SEQ ID NO: 1939738 - RNA, 20 nt, Human herpesvirus 4 [Epstein-Barr virus]
gccccgaugcggaggacugc

SEQ ID NO: 1939739 - RNA, 12 nt, Human herpesvirus 4 [Epstein-Barr virus]
cucuccagcccc

SEQ ID NO: 1939740 - RNA, 19 nt, Human herpesvirus 4 [Epstein-Barr virus]
aguuggcaucuuccuccuu

SEQ ID NO: 1939741 - RNA, 16 nt, Human herpesvirus 4 [Epstein-Barr virus]
cauuggcgucaggaga

SEQ ID NO: 1939742 - RNA, 18 nt, Human herpesvirus 4 [Epstein-Barr virus]
gcaggaggaggggcagga

SEQ ID NO: 1939743 - RNA, 21 nt, Human herpesvirus 4 [Epstein-Barr virus]
gggcacucucgagggugccug

SEQ ID NO: 1939744 - RNA, 18 nt, Human herpesvirus 4 [Epstein-Barr virus]
gcagccuguucauagaga

SEQ ID NO: 1939745 - RNA, 16 nt, Human herpesvirus 4 [Epstein-Barr virus]
uucugccccucagccu

SEQ ID NO: 1939746 - RNA, 16 nt, Human herpesvirus 4 [Epstein-Barr virus]
acucuuggugcagccc

SEQ ID NO: 1939747 - RNA, 16 nt, Human herpesvirus 4 [Epstein-Barr virus]
aguuuaccugguacau

SEQ ID NO: 1939748 - RNA, 12 nt, Human herpesvirus 4 [Epstein-Barr virus]
uaagccugccuc

SEQ ID NO: 1939749 - RNA, 17 nt, Human herpesvirus 4 [Epstein-Barr virus]
ucaucuggcucuccugu

SEQ ID NO: 1939750 - RNA, 14 nt, Human herpesvirus 4 [Epstein-Barr virus]
gacgcagaggccug

SEQ ID NO: 1939751 - RNA, 17 nt, Human herpesvirus 4 [Epstein-Barr virus]
aauggggguuggagaaa

SEQ ID NO: 1939752 - RNA, 12 nt, Human herpesvirus 4 [Epstein-Barr virus]
aauuuaaccaaa

SEQ ID NO: 1939753 - RNA, 23 nt, Human herpesvirus 4 [Epstein-Barr virus]
guggccagcucauaugccgcugc

SEQ ID NO: 1939754 - RNA, 19 nt, Human herpesvirus 4 [Epstein-Barr virus]
acgccugcuucacgccucg

SEQ ID NO: 1939755 - RNA, 20 nt, Human herpesvirus 4 [Epstein-Barr virus]
cccggguggugaggacggug

SEQ ID NO: 1939756 - RNA, 13 nt, Human herpesvirus 4 [Epstein-Barr virus]
ggccuccuggcca

SEQ ID NO: 1939757 - RNA, 19 nt, Human herpesvirus 4 [Epstein-Barr virus]
augggggaaugagggaaaa

SEQ ID NO: 1939758 - RNA, 21 nt, Human herpesvirus 4 [Epstein-Barr virus]
ucugaggaccuguugcuucag

SEQ ID NO: 1939759 - RNA, 15 nt, Human herpesvirus 4 [Epstein-Barr virus]
aacuuggaggcugcu

SEQ ID NO: 1939760 - RNA, 19 nt, Human herpesvirus 4 [Epstein-Barr virus]
cuccggggguccagccggg

SEQ ID NO: 1939761 - RNA, 16 nt, Human herpesvirus 4 [Epstein-Barr virus]
gcccagcccccucccg

SEQ ID NO: 1939762 - RNA, 18 nt, Human herpesvirus 4 [Epstein-Barr virus]
gaagcccaagaagaagcc

SEQ ID NO: 1939763 - RNA, 23 nt, Human herpesvirus 4 [Epstein-Barr virus]
ggugccugguaugcagaaggggc

SEQ ID NO: 1939764 - RNA, 19 nt, Human herpesvirus 4 [Epstein-Barr virus]
cgagcagcgcggcagaggc

SEQ ID NO: 1939765 - RNA, 22 nt, Human herpesvirus 4 [Epstein-Barr virus]
gggacgcagaaugugcagggau

SEQ ID NO: 1939766 - RNA, 17 nt, Human herpesvirus 4 [Epstein-Barr virus]
uuuaaacgagagaagag

SEQ ID NO: 1939767 - RNA, 23 nt, Human herpesvirus 4 [Epstein-Barr virus]
cugccucgaguaggugccuccag

SEQ ID NO: 1939768 - RNA, 16 nt, Human herpesvirus 4 [Epstein-Barr virus]
ccgcgcucggccuaga

SEQ ID NO: 1939769 - RNA, 15 nt, Human herpesvirus 4 [Epstein-Barr virus]
acccaaugugcaugg

SEQ ID NO: 1939770 - RNA, 19 nt, Human herpesvirus 4 [Epstein-Barr virus]
gcucgaccgggaugugaug

SEQ ID NO: 1939771 - RNA, 12 nt, Human herpesvirus 4 [Epstein-Barr virus]
ucuucugaagga

SEQ ID NO: 1939772 - RNA, 18 nt, Human herpesvirus 4 [Epstein-Barr virus]
ggccaccggggaggccag

SEQ ID NO: 1939773 - RNA, 17 nt, Human herpesvirus 4 [Epstein-Barr virus]
agugcuaugaccaugcc

SEQ ID NO: 1939774 - RNA, 13 nt, Human herpesvirus 4 [Epstein-Barr virus]
agauccaacuccg

SEQ ID NO: 1939775 - RNA, 21 nt, Human herpesvirus 4 [Epstein-Barr virus]
guccagaguucccggcugcuc

SEQ ID NO: 1939776 - RNA, 15 nt, Human herpesvirus 4 [Epstein-Barr virus]
cccugagcuggacga

SEQ ID NO: 1939777 - RNA, 18 nt, Human herpesvirus 4 [Epstein-Barr virus]
agcgccuccucgcaggcc

SEQ ID NO: 1939778 - RNA, 15 nt, Human herpesvirus 4 [Epstein-Barr virus]
uagauauagaggcuc

SEQ ID NO: 1939779 - RNA, 21 nt, Human herpesvirus 4 [Epstein-Barr virus]
ccggagacugaggccuuuguc

SEQ ID NO: 1939780 - RNA, 14 nt, Human herpesvirus 4 [Epstein-Barr virus]
acgccggccugcug

SEQ ID NO: 1939781 - RNA, 11 nt, Human herpesvirus 4 [Epstein-Barr virus]
gccccucagcc

SEQ ID NO: 1939782 - RNA, 13 nt, Human herpesvirus 4 [Epstein-Barr virus]
ccucccccugccc

SEQ ID NO: 1939783 - RNA, 13 nt, Human herpesvirus 4 [Epstein-Barr virus]
ugauaaugaugag

SEQ ID NO: 1939784 - RNA, 16 nt, Human herpesvirus 4 [Epstein-Barr virus]
cgggggugggcaccuc

SEQ ID NO: 1939785 - RNA, 12 nt, Human herpesvirus 4 [Epstein-Barr virus]
cuguaacugugg

SEQ ID NO: 1939786 - RNA, 17 nt, Human herpesvirus 4 [Epstein-Barr virus]
gaggacacgcuggucuu

SEQ ID NO: 1939787 - RNA, 15 nt, Human herpesvirus 4 [Epstein-Barr virus]
auacccagagcaaaa

SEQ ID NO: 1939788 - RNA, 14 nt, Human herpesvirus 4 [Epstein-Barr virus]
ggcugccgaagcag

SEQ ID NO: 1939789 - RNA, 18 nt, Human herpesvirus 4 [Epstein-Barr virus]
gcccagcagauccagggc

SEQ ID NO: 1939790 - RNA, 22 nt, Human herpesvirus 4 [Epstein-Barr virus]
ucaagcuuaugcagcaccucag

SEQ ID NO: 1939791 - RNA, 13 nt, Human herpesvirus 4 [Epstein-Barr virus]
uagccccagcccc

SEQ ID NO: 1939792 - RNA, 21 nt, Human herpesvirus 4 [Epstein-Barr virus]
ggccagcucauaugccgcugc

SEQ ID NO: 1939793 - RNA, 15 nt, Human herpesvirus 4 [Epstein-Barr virus]
cucuggacuuccaug

SEQ ID NO: 1939794 - RNA, 14 nt, Human herpesvirus 4 [Epstein-Barr virus]
uggacccugcugcg

SEQ ID NO: 1939795 - RNA, 16 nt, Human herpesvirus 4 [Epstein-Barr virus]
uccgggcuccaugucc

SEQ ID NO: 1939796 - RNA, 15 nt, Human herpesvirus 4 [Epstein-Barr virus]
guuugcuugccccgg

SEQ ID NO: 1939797 - RNA, 16 nt, Human herpesvirus 4 [Epstein-Barr virus]
gcgggauagcaggacg

SEQ ID NO: 1939798 - RNA, 24 nt, Human herpesvirus 4 [Epstein-Barr virus]
uaauacgcccgacaauaaaguuga

SEQ ID NO: 1939799 - RNA, 15 nt, Human herpesvirus 4 [Epstein-Barr virus]
gcugcugcuggucau

SEQ ID NO: 1939800 - RNA, 14 nt, Human herpesvirus 4 [Epstein-Barr virus]
cggcaguggaccuc

SEQ ID NO: 1939801 - RNA, 21 nt, Human herpesvirus 4 [Epstein-Barr virus]
acaugguuuaaggaaugaaca

SEQ ID NO: 1939802 - RNA, 16 nt, Human herpesvirus 4 [Epstein-Barr virus]
ugcacaggaugacagc

SEQ ID NO: 1939803 - RNA, 16 nt, Human herpesvirus 4 [Epstein-Barr virus]
guagagaucaggccaa

SEQ ID NO: 1939804 - RNA, 23 nt, Human herpesvirus 4 [Epstein-Barr virus]
gaagcccaagaagaagcccaccu

SEQ ID NO: 1939805 - RNA, 15 nt, Human herpesvirus 4 [Epstein-Barr virus]
ugccgugaaugcacg

SEQ ID NO: 1939806 - RNA, 18 nt, Human herpesvirus 4 [Epstein-Barr virus]
gacaccggugacagugcu

SEQ ID NO: 1939807 - RNA, 23 nt, Human herpesvirus 4 [Epstein-Barr virus]
ucugggcauaaauucuccugccu

SEQ ID NO: 1939808 - RNA, 18 nt, Human herpesvirus 4 [Epstein-Barr virus]
ccuugcguggugcugucc

SEQ ID NO: 1939809 - RNA, 13 nt, Human herpesvirus 4 [Epstein-Barr virus]
gguccccucugcc

SEQ ID NO: 1939810 - RNA, 18 nt, Human herpesvirus 4 [Epstein-Barr virus]
uaacccaauucccgccuc

SEQ ID NO: 1939811 - RNA, 15 nt, Human herpesvirus 4 [Epstein-Barr virus]
cgguggaacaggagc

SEQ ID NO: 1939812 - RNA, 14 nt, Human herpesvirus 4 [Epstein-Barr virus]
ggauauagcucugc

SEQ ID NO: 1939813 - RNA, 22 nt, Human herpesvirus 4 [Epstein-Barr virus]
gcacacacucccuuagccacac

SEQ ID NO: 1939814 - RNA, 16 nt, Human herpesvirus 4 [Epstein-Barr virus]
ggaaaagagagcugau

SEQ ID NO: 1939815 - RNA, 21 nt, Human herpesvirus 4 [Epstein-Barr virus]
cuucaagauugggugguggca

SEQ ID NO: 1939816 - RNA, 15 nt, Human herpesvirus 4 [Epstein-Barr virus]
cauugcagggcucug

SEQ ID NO: 1939817 - RNA, 21 nt, Human herpesvirus 4 [Epstein-Barr virus]
gcccgccuggcucgccuggag

SEQ ID NO: 1939818 - RNA, 16 nt, Human herpesvirus 4 [Epstein-Barr virus]
gcaucaugcgugacca

SEQ ID NO: 1939819 - RNA, 13 nt, Human herpesvirus 4 [Epstein-Barr virus]
acugaccacucag

SEQ ID NO: 1939820 - RNA, 16 nt, Human herpesvirus 4 [Epstein-Barr virus]
cggcucucaggccuca

SEQ ID NO: 1939821 - RNA, 14 nt, Human herpesvirus 4 [Epstein-Barr virus]
aagcuccggcugcc

SEQ ID NO: 1939822 - RNA, 19 nt, Human herpesvirus 4 [Epstein-Barr virus]
gcccccgccagcgccuccu

SEQ ID NO: 1939823 - RNA, 19 nt, Human herpesvirus 4 [Epstein-Barr virus]
cagcagauagugaacgugg

SEQ ID NO: 1939824 - RNA, 18 nt, Human herpesvirus 4 [Epstein-Barr virus]
gcagcaacgcccagggac

SEQ ID NO: 1939825 - RNA, 18 nt, Human herpesvirus 4 [Epstein-Barr virus]
gccauggccgagaagcuu

SEQ ID NO: 1939826 - RNA, 11 nt, Human herpesvirus 4 [Epstein-Barr virus]
aaagggcccag

SEQ ID NO: 1939827 - RNA, 19 nt, Human herpesvirus 4 [Epstein-Barr virus]
ucacauauccagagcugag

SEQ ID NO: 1939828 - RNA, 21 nt, Human herpesvirus 4 [Epstein-Barr virus]
aucucugauuauagcucuggc

SEQ ID NO: 1939829 - RNA, 15 nt, Human herpesvirus 4 [Epstein-Barr virus]
cuacgcugcccuaga

SEQ ID NO: 1939830 - RNA, 18 nt, Human herpesvirus 4 [Epstein-Barr virus]
cgugaguccagggcccug

SEQ ID NO: 1939831 - RNA, 23 nt, Human herpesvirus 4 [Epstein-Barr virus]
cacuccggacgcagaggccugca

SEQ ID NO: 1939832 - RNA, 17 nt, Human herpesvirus 4 [Epstein-Barr virus]
cgccugacccucuugca

SEQ ID NO: 1939833 - RNA, 16 nt, Human herpesvirus 4 [Epstein-Barr virus]
ccccuuccacguggcc

SEQ ID NO: 1939834 - RNA, 16 nt, Human herpesvirus 4 [Epstein-Barr virus]
gucaggagggcagaga

SEQ ID NO: 1939835 - RNA, 20 nt, Human herpesvirus 4 [Epstein-Barr virus]
gaacauccugcguggcugga

SEQ ID NO: 1939836 - RNA, 13 nt, Human herpesvirus 4 [Epstein-Barr virus]
gucacuccagcca

SEQ ID NO: 1939837 - RNA, 14 nt, Human herpesvirus 4 [Epstein-Barr virus]
cucggcacccaggc

SEQ ID NO: 1939838 - RNA, 17 nt, Human herpesvirus 4 [Epstein-Barr virus]
cggccuacgaggcccug

SEQ ID NO: 1939839 - RNA, 14 nt, Human herpesvirus 4 [Epstein-Barr virus]
gaccgcgcccuccu

SEQ ID NO: 1939840 - RNA, 22 nt, Human herpesvirus 4 [Epstein-Barr virus]
cuggcuuucguccucuggcucu

SEQ ID NO: 1939841 - RNA, 20 nt, Human herpesvirus 4 [Epstein-Barr virus]
ugcccuagagguuuugcuag

SEQ ID NO: 1939842 - RNA, 18 nt, Human herpesvirus 4 [Epstein-Barr virus]
ugcacgccaacagcgacc

SEQ ID NO: 1939843 - RNA, 15 nt, Human herpesvirus 4 [Epstein-Barr virus]
aauaaaguugaugau

SEQ ID NO: 1939844 - RNA, 16 nt, Human herpesvirus 4 [Epstein-Barr virus]
ggugaccuggccaggc

SEQ ID NO: 1939845 - RNA, 17 nt, Human herpesvirus 4 [Epstein-Barr virus]
ugcuccagugccuccgc

SEQ ID NO: 1939846 - RNA, 17 nt, Human herpesvirus 4 [Epstein-Barr virus]
cggcguggagcugggcc

SEQ ID NO: 1939847 - RNA, 18 nt, Human herpesvirus 4 [Epstein-Barr virus]
gaagaucgugaggccuga

SEQ ID NO: 1939848 - RNA, 17 nt, Human herpesvirus 4 [Epstein-Barr virus]
gcuacgcgggccacagg

SEQ ID NO: 1939849 - RNA, 20 nt, Human herpesvirus 4 [Epstein-Barr virus]
cgagaauuggcagacaccuu

SEQ ID NO: 1939850 - RNA, 14 nt, Human herpesvirus 4 [Epstein-Barr virus]
aaauaaauguuacu

SEQ ID NO: 1939851 - RNA, 15 nt, Human herpesvirus 4 [Epstein-Barr virus]
caggccucccagucu

SEQ ID NO: 1939852 - RNA, 21 nt, Human herpesvirus 4 [Epstein-Barr virus]
auugaaaccacgccugcuuca

SEQ ID NO: 1939853 - RNA, 21 nt, Human herpesvirus 4 [Epstein-Barr virus]
gcaugagccacaggcauugcu

SEQ ID NO: 1939854 - RNA, 22 nt, Human herpesvirus 4 [Epstein-Barr virus]
caugcacaccuuggcgggucau

SEQ ID NO: 1939855 - RNA, 12 nt, Human herpesvirus 4 [Epstein-Barr virus]
caucuggaccug

SEQ ID NO: 1939856 - RNA, 16 nt, Human herpesvirus 4 [Epstein-Barr virus]
caucaucagcgccguc

SEQ ID NO: 1939857 - RNA, 13 nt, Human herpesvirus 4 [Epstein-Barr virus]
acuuggaggcugc

SEQ ID NO: 1939858 - RNA, 21 nt, Human herpesvirus 4 [Epstein-Barr virus]
cgaccccauaucgcaacacug

SEQ ID NO: 1939859 - RNA, 16 nt, Human herpesvirus 4 [Epstein-Barr virus]
ccggagacugaggccu

SEQ ID NO: 1939860 - RNA, 18 nt, Human herpesvirus 4 [Epstein-Barr virus]
gcggcccagcagauccag

SEQ ID NO: 1939861 - RNA, 13 nt, Human herpesvirus 4 [Epstein-Barr virus]
ccuccucaccacu

SEQ ID NO: 1939862 - RNA, 20 nt, Human herpesvirus 4 [Epstein-Barr virus]
gagcaggaggggcaggagca

SEQ ID NO: 1939863 - RNA, 19 nt, Human herpesvirus 4 [Epstein-Barr virus]
cggggagcggcaagggcuc

SEQ ID NO: 1939864 - RNA, 23 nt, Human herpesvirus 4 [Epstein-Barr virus]
cacugaugagucugacuacucag

SEQ ID NO: 1939865 - RNA, 20 nt, Human herpesvirus 4 [Epstein-Barr virus]
uugucuacaucccauaccua

SEQ ID NO: 1939866 - RNA, 14 nt, Human herpesvirus 4 [Epstein-Barr virus]
ccgugcaccugcca

SEQ ID NO: 1939867 - RNA, 20 nt, Human herpesvirus 4 [Epstein-Barr virus]
ugcaggccuggacagcacaa

SEQ ID NO: 1939868 - RNA, 23 nt, Human herpesvirus 4 [Epstein-Barr virus]
gaccaaugccaaagcugaagaac

SEQ ID NO: 1939869 - RNA, 18 nt, Human herpesvirus 4 [Epstein-Barr virus]
cccaucugagggcaguga

SEQ ID NO: 1939870 - RNA, 16 nt, Human herpesvirus 4 [Epstein-Barr virus]
cugacauauguacaau

SEQ ID NO: 1939871 - RNA, 13 nt, Human herpesvirus 4 [Epstein-Barr virus]
gugcccaagccug

SEQ ID NO: 1939872 - RNA, 21 nt, Human herpesvirus 4 [Epstein-Barr virus]
acggcccggggguggcagccc

SEQ ID NO: 1939873 - RNA, 18 nt, Human herpesvirus 4 [Epstein-Barr virus]
ggacguaucugggcacuu

SEQ ID NO: 1939874 - RNA, 17 nt, Human herpesvirus 4 [Epstein-Barr virus]
gcagugucccugcugcc

SEQ ID NO: 1939875 - RNA, 20 nt, Human herpesvirus 4 [Epstein-Barr virus]
cugcacgagaccccugggcu

SEQ ID NO: 1939876 - RNA, 11 nt, Human herpesvirus 4 [Epstein-Barr virus]
auucucagaug

SEQ ID NO: 1939877 - RNA, 13 nt, Human herpesvirus 4 [Epstein-Barr virus]
aggagcaggaggg

SEQ ID NO: 1939878 - RNA, 17 nt, Human herpesvirus 4 [Epstein-Barr virus]
uacugauugucgcuggc

SEQ ID NO: 1939879 - RNA, 16 nt, Human herpesvirus 4 [Epstein-Barr virus]
auuuugggagcuccag

SEQ ID NO: 1939880 - RNA, 19 nt, Human herpesvirus 4 [Epstein-Barr virus]
gucaagagcuuccuggccg

SEQ ID NO: 1939881 - RNA, 14 nt, Human herpesvirus 4 [Epstein-Barr virus]
uuguccgcugggcc

SEQ ID NO: 1939882 - RNA, 13 nt, Human herpesvirus 4 [Epstein-Barr virus]
acaucucagggac

SEQ ID NO: 1939883 - RNA, 17 nt, Human herpesvirus 4 [Epstein-Barr virus]
gugaccugacuggcaga

SEQ ID NO: 1939884 - RNA, 18 nt, Human herpesvirus 4 [Epstein-Barr virus]
agccccuaggccugccac

SEQ ID NO: 1939885 - RNA, 16 nt, Human herpesvirus 4 [Epstein-Barr virus]
guguguggcuguagcc

SEQ ID NO: 1939886 - RNA, 18 nt, Human herpesvirus 4 [Epstein-Barr virus]
ggcacaucuggaccugga

SEQ ID NO: 1939887 - RNA, 16 nt, Human herpesvirus 4 [Epstein-Barr virus]
cuagccguccugucca

SEQ ID NO: 1939888 - RNA, 23 nt, Human herpesvirus 4 [Epstein-Barr virus]
gcagcuuuuggccuucuuccuag

SEQ ID NO: 1939889 - RNA, 23 nt, Human herpesvirus 4 [Epstein-Barr virus]
gcuccggcggcaguggaccucaa

SEQ ID NO: 1939890 - RNA, 23 nt, Human herpesvirus 4 [Epstein-Barr virus]
agaggcgggaauggccgccaccc

SEQ ID NO: 1939891 - RNA, 17 nt, Human herpesvirus 4 [Epstein-Barr virus]
ccaggcuccuggaucug

SEQ ID NO: 1939892 - RNA, 15 nt, Human herpesvirus 4 [Epstein-Barr virus]
ccuuuacccagcccu

SEQ ID NO: 1939893 - RNA, 21 nt, Human herpesvirus 4 [Epstein-Barr virus]
cgcccugucccuggagcuggu

SEQ ID NO: 1939894 - RNA, 20 nt, Human herpesvirus 4 [Epstein-Barr virus]
ggcgggaguauggggccaga

SEQ ID NO: 1939895 - RNA, 20 nt, Human herpesvirus 4 [Epstein-Barr virus]
cccaccacccccaccaccuc

SEQ ID NO: 1939896 - RNA, 14 nt, Human herpesvirus 4 [Epstein-Barr virus]
caggaccuagaaug

SEQ ID NO: 1939897 - RNA, 15 nt, Human herpesvirus 4 [Epstein-Barr virus]
caggucgaccaccuc

SEQ ID NO: 1939898 - RNA, 20 nt, Human herpesvirus 4 [Epstein-Barr virus]
gaaggcuagacgcagcugug

SEQ ID NO: 1939899 - RNA, 21 nt, Human herpesvirus 4 [Epstein-Barr virus]
cucugcuuucgcgcagagccc

SEQ ID NO: 1939900 - RNA, 17 nt, Human herpesvirus 4 [Epstein-Barr virus]
gccacugcaggcuggac

SEQ ID NO: 1939901 - RNA, 17 nt, Human herpesvirus 4 [Epstein-Barr virus]
cucccauguaagccugc

SEQ ID NO: 1939902 - RNA, 19 nt, Human herpesvirus 4 [Epstein-Barr virus]
uggaggcccccggcuggcc

SEQ ID NO: 1939903 - RNA, 14 nt, Human herpesvirus 4 [Epstein-Barr virus]
aacccccugcagga

SEQ ID NO: 1939904 - RNA, 16 nt, Human herpesvirus 4 [Epstein-Barr virus]
cuaagcagcugagggg

SEQ ID NO: 1939905 - RNA, 22 nt, Human herpesvirus 4 [Epstein-Barr virus]
acaaccuuggacccugcugcga

SEQ ID NO: 1939906 - RNA, 16 nt, Human herpesvirus 4 [Epstein-Barr virus]
ccggcgagacuuggac

SEQ ID NO: 1939907 - RNA, 14 nt, Human herpesvirus 4 [Epstein-Barr virus]
uccugcccucccac

SEQ ID NO: 1939908 - RNA, 18 nt, Human herpesvirus 4 [Epstein-Barr virus]
caccaucuggcagcuuuu

SEQ ID NO: 1939909 - RNA, 14 nt, Human herpesvirus 4 [Epstein-Barr virus]
guaaaacugccaca

SEQ ID NO: 1939910 - RNA, 15 nt, Human herpesvirus 4 [Epstein-Barr virus]
guuauugaaaccacg

SEQ ID NO: 1939911 - RNA, 23 nt, Human herpesvirus 4 [Epstein-Barr virus]
gaaucaugucugacgaggggcca

SEQ ID NO: 1939912 - RNA, 16 nt, Human herpesvirus 4 [Epstein-Barr virus]
aaccucacugucauuc

SEQ ID NO: 1939913 - RNA, 16 nt, Human herpesvirus 4 [Epstein-Barr virus]
cugugcugacccuucu

SEQ ID NO: 1939914 - RNA, 17 nt, Human herpesvirus 4 [Epstein-Barr virus]
uagccccgggcccagcc

SEQ ID NO: 1939915 - RNA, 21 nt, Human herpesvirus 4 [Epstein-Barr virus]
uucugcauguuauuacugauu

SEQ ID NO: 1939916 - RNA, 17 nt, Human herpesvirus 4 [Epstein-Barr virus]
agaguacgugcagagga

SEQ ID NO: 1939917 - RNA, 13 nt, Human herpesvirus 4 [Epstein-Barr virus]
uuccuggccaugg

SEQ ID NO: 1939918 - RNA, 19 nt, Human herpesvirus 4 [Epstein-Barr virus]
cucaucguucgguggggug

SEQ ID NO: 1939919 - RNA, 19 nt, Human herpesvirus 4 [Epstein-Barr virus]
ugcccucaugcgccagagc

SEQ ID NO: 1939920 - RNA, 18 nt, Human herpesvirus 4 [Epstein-Barr virus]
ucuugauaaaacagguua

SEQ ID NO: 1939921 - RNA, 20 nt, Human herpesvirus 4 [Epstein-Barr virus]
auuugcugacauauguacaa

SEQ ID NO: 1939922 - RNA, 15 nt, Human herpesvirus 4 [Epstein-Barr virus]
aguuuuaacaccuga

SEQ ID NO: 1939923 - RNA, 18 nt, Human herpesvirus 4 [Epstein-Barr virus]
caugcagggugcacagac

SEQ ID NO: 1939924 - RNA, 16 nt, Human herpesvirus 4 [Epstein-Barr virus]
ucccccuagccccggc

SEQ ID NO: 1939925 - RNA, 15 nt, Human herpesvirus 4 [Epstein-Barr virus]
ugccucugggugcug

SEQ ID NO: 1939926 - RNA, 21 nt, Human herpesvirus 4 [Epstein-Barr virus]
agcagagguugggccacgcug

SEQ ID NO: 1939927 - RNA, 14 nt, Human herpesvirus 4 [Epstein-Barr virus]
acccagcagcagcc

SEQ ID NO: 1939928 - RNA, 12 nt, Human herpesvirus 4 [Epstein-Barr virus]
accagcuccagg

SEQ ID NO: 1939929 - RNA, 20 nt, Human herpesvirus 4 [Epstein-Barr virus]
agcaacccccggcucucagg

SEQ ID NO: 1939930 - RNA, 22 nt, Human herpesvirus 4 [Epstein-Barr virus]
gguacaugggccacugcaggcu

SEQ ID NO: 1939931 - RNA, 15 nt, Human herpesvirus 4 [Epstein-Barr virus]
uggcggcccagcccg

SEQ ID NO: 1939932 - RNA, 17 nt, Human herpesvirus 4 [Epstein-Barr virus]
gcaucacaagucacauc

SEQ ID NO: 1939933 - RNA, 23 nt, Human herpesvirus 4 [Epstein-Barr virus]
uagguaucuggaucuacuuauug

SEQ ID NO: 1939934 - RNA, 23 nt, Human herpesvirus 4 [Epstein-Barr virus]
aacccuguagucaccugcacaga

SEQ ID NO: 1939935 - RNA, 17 nt, Human herpesvirus 4 [Epstein-Barr virus]
cuuggcuauggucaugg

SEQ ID NO: 1939936 - RNA, 15 nt, Human herpesvirus 4 [Epstein-Barr virus]
caccgagcagaaggc

SEQ ID NO: 1939937 - RNA, 21 nt, Human herpesvirus 4 [Epstein-Barr virus]
ccaucugcuucuggcucuucu

SEQ ID NO: 1939938 - RNA, 19 nt, Human herpesvirus 4 [Epstein-Barr virus]
gaaaaccggcgagacuugg

SEQ ID NO: 1939939 - RNA, 15 nt, Human herpesvirus 4 [Epstein-Barr virus]
uguaaccuaugccug

SEQ ID NO: 1939940 - RNA, 17 nt, Human herpesvirus 4 [Epstein-Barr virus]
ucgccuuguuucucaga

SEQ ID NO: 1939941 - RNA, 13 nt, Human herpesvirus 4 [Epstein-Barr virus]
ugugguucuccug

SEQ ID NO: 1939942 - RNA, 14 nt, Human herpesvirus 4 [Epstein-Barr virus]
ugauccuguacaaa

SEQ ID NO: 1939943 - RNA, 18 nt, Human herpesvirus 4 [Epstein-Barr virus]
agagggugagcccaccug

SEQ ID NO: 1939944 - RNA, 16 nt, Human herpesvirus 4 [Epstein-Barr virus]
uuugggagcuccagag

SEQ ID NO: 1939945 - RNA, 16 nt, Human herpesvirus 4 [Epstein-Barr virus]
cugagaccaugcucag

SEQ ID NO: 1939946 - RNA, 18 nt, Human herpesvirus 4 [Epstein-Barr virus]
acgugaacauccugcgug

SEQ ID NO: 1939947 - RNA, 13 nt, Human herpesvirus 4 [Epstein-Barr virus]
aaacaugguguau

SEQ ID NO: 1939948 - RNA, 18 nt, Human herpesvirus 4 [Epstein-Barr virus]
ucaugcagggugcacaga

SEQ ID NO: 1939949 - RNA, 17 nt, Human herpesvirus 4 [Epstein-Barr virus]
ccuugcccucuccagca

SEQ ID NO: 1939950 - RNA, 16 nt, Human herpesvirus 4 [Epstein-Barr virus]
cugagcugccugguga

SEQ ID NO: 1939951 - RNA, 16 nt, Human herpesvirus 4 [Epstein-Barr virus]
agucaucccguggaga

SEQ ID NO: 1939952 - RNA, 17 nt, Human herpesvirus 4 [Epstein-Barr virus]
ugacccuucugcugcug

SEQ ID NO: 1939953 - RNA, 18 nt, Human herpesvirus 4 [Epstein-Barr virus]
ccucgggucucgccgcua

SEQ ID NO: 1939954 - RNA, 14 nt, Human herpesvirus 4 [Epstein-Barr virus]
gaccucgggaggga

SEQ ID NO: 1939955 - RNA, 17 nt, Human herpesvirus 4 [Epstein-Barr virus]
cugggaguccggcccuu

SEQ ID NO: 1939956 - RNA, 14 nt, Human herpesvirus 4 [Epstein-Barr virus]
ggcccgucccucuu

SEQ ID NO: 1939957 - RNA, 20 nt, Human herpesvirus 4 [Epstein-Barr virus]
cccccagaccugugugcugu

SEQ ID NO: 1939958 - RNA, 21 nt, Human herpesvirus 4 [Epstein-Barr virus]
ggcaggcauuuuuggugcugc

SEQ ID NO: 1939959 - RNA, 24 nt, Human herpesvirus 4 [Epstein-Barr virus]
uggaccgaacugauggcaaagguc

SEQ ID NO: 1939960 - RNA, 18 nt, Human herpesvirus 4 [Epstein-Barr virus]
uccuacaacucagcccca

SEQ ID NO: 1939961 - RNA, 18 nt, Human herpesvirus 4 [Epstein-Barr virus]
agugcaacaaucuggacu

SEQ ID NO: 1939962 - RNA, 11 nt, Human herpesvirus 4 [Epstein-Barr virus]
cggcccagccc

SEQ ID NO: 1939963 - RNA, 22 nt, Human herpesvirus 4 [Epstein-Barr virus]
gcccagcagauccagggcccgu

SEQ ID NO: 1939964 - RNA, 17 nt, Human herpesvirus 4 [Epstein-Barr virus]
ccagccuacucuccacu

SEQ ID NO: 1939965 - RNA, 21 nt, Human herpesvirus 4 [Epstein-Barr virus]
cugcccccggagcccugcccu

SEQ ID NO: 1939966 - RNA, 13 nt, Human herpesvirus 4 [Epstein-Barr virus]
ccuacgcagaggc

SEQ ID NO: 1939967 - RNA, 18 nt, Human herpesvirus 4 [Epstein-Barr virus]
ugcgcggaaucaggacca

SEQ ID NO: 1939968 - RNA, 17 nt, Human herpesvirus 4 [Epstein-Barr virus]
acgccggaugccugccu

SEQ ID NO: 1939969 - RNA, 17 nt, Human herpesvirus 4 [Epstein-Barr virus]
uaggagcagggcccagu

SEQ ID NO: 1939970 - RNA, 17 nt, Human herpesvirus 4 [Epstein-Barr virus]
gcgugaccaccuggcca

SEQ ID NO: 1939971 - RNA, 15 nt, Human herpesvirus 4 [Epstein-Barr virus]
cuccccagccacagc

SEQ ID NO: 1939972 - RNA, 14 nt, Human herpesvirus 4 [Epstein-Barr virus]
gccggcgcugugug

SEQ ID NO: 1939973 - RNA, 13 nt, Human herpesvirus 4 [Epstein-Barr virus]
cagauugccuucu

SEQ ID NO: 1939974 - RNA, 21 nt, Human herpesvirus 4 [Epstein-Barr virus]
ggcauaaauucuccugccugc

SEQ ID NO: 1939975 - RNA, 20 nt, Human herpesvirus 4 [Epstein-Barr virus]
cagggugaccuggcucaggu

SEQ ID NO: 1939976 - RNA, 23 nt, Human herpesvirus 4 [Epstein-Barr virus]
gccuggccggcuaucugcuucug

SEQ ID NO: 1939977 - RNA, 23 nt, Human herpesvirus 4 [Epstein-Barr virus]
ggccacgcugauaaaguuguccu

SEQ ID NO: 1939978 - RNA, 23 nt, Human herpesvirus 4 [Epstein-Barr virus]
gucuuacugcccagccuacucuc

SEQ ID NO: 1939979 - RNA, 23 nt, Human herpesvirus 4 [Epstein-Barr virus]
ggcugugagcgcacgugacagau

SEQ ID NO: 1939980 - RNA, 18 nt, Human herpesvirus 4 [Epstein-Barr virus]
gcuacuacugccuuacac

SEQ ID NO: 1939981 - RNA, 19 nt, Human herpesvirus 4 [Epstein-Barr virus]
cgucuuguaaaacuuggag

SEQ ID NO: 1939982 - RNA, 21 nt, Human herpesvirus 4 [Epstein-Barr virus]
ccugaccgaauggggcagugg

SEQ ID NO: 1939983 - RNA, 15 nt, Human herpesvirus 4 [Epstein-Barr virus]
ucaccaggccugcca

SEQ ID NO: 1939984 - RNA, 13 nt, Human herpesvirus 4 [Epstein-Barr virus]
gccuugcccccgc

SEQ ID NO: 1939985 - RNA, 14 nt, Human herpesvirus 4 [Epstein-Barr virus]
agaagugcugggag

SEQ ID NO: 1939986 - RNA, 14 nt, Human herpesvirus 4 [Epstein-Barr virus]
gagagcuccgccac

SEQ ID NO: 1939987 - RNA, 12 nt, Human herpesvirus 4 [Epstein-Barr virus]
guaccagcuggu

SEQ ID NO: 1939988 - RNA, 14 nt, Human herpesvirus 4 [Epstein-Barr virus]
ggccugcugucauc

SEQ ID NO: 1939989 - RNA, 22 nt, Human herpesvirus 4 [Epstein-Barr virus]
cuucggucaaguaccagcuggu

SEQ ID NO: 1939990 - RNA, 15 nt, Human herpesvirus 4 [Epstein-Barr virus]
cauaauggugccuga

SEQ ID NO: 1939991 - RNA, 12 nt, Human herpesvirus 4 [Epstein-Barr virus]
ucuguuuucccc

SEQ ID NO: 1939992 - RNA, 20 nt, Human herpesvirus 4 [Epstein-Barr virus]
gauauagcucugcacaggcu

SEQ ID NO: 1939993 - RNA, 22 nt, Human herpesvirus 4 [Epstein-Barr virus]
aauguaacacuacuuguuucug

SEQ ID NO: 1939994 - RNA, 19 nt, Human herpesvirus 4 [Epstein-Barr virus]
cuaggcaaaccuccaauca

SEQ ID NO: 1939995 - RNA, 20 nt, Human herpesvirus 4 [Epstein-Barr virus]
gggcaaaacucacaggacau

SEQ ID NO: 1939996 - RNA, 19 nt, Human herpesvirus 4 [Epstein-Barr virus]
auggcccugaucugggaga

SEQ ID NO: 1939997 - RNA, 14 nt, Human herpesvirus 4 [Epstein-Barr virus]
ucauccgccacccc

SEQ ID NO: 1939998 - RNA, 17 nt, Human herpesvirus 4 [Epstein-Barr virus]
gcacacauuacggugcu

SEQ ID NO: 1939999 - RNA, 19 nt, Human herpesvirus 4 [Epstein-Barr virus]
cugcuccgcguggagcugg

SEQ ID NO: 1940000 - RNA, 19 nt, Human herpesvirus 4 [Epstein-Barr virus]
cgcccccucugccuccggc

SEQ ID NO: 1940001 - RNA, 19 nt, Human herpesvirus 4 [Epstein-Barr virus]
cguccacucuaucccgcug

SEQ ID NO: 1940002 - RNA, 16 nt, Human herpesvirus 4 [Epstein-Barr virus]
ggcugcuaagccagga

SEQ ID NO: 1940003 - RNA, 17 nt, Human herpesvirus 4 [Epstein-Barr virus]
cugcccccggagcccug

SEQ ID NO: 1940004 - RNA, 15 nt, Human herpesvirus 4 [Epstein-Barr virus]
cuacgaaacugacca

SEQ ID NO: 1940005 - RNA, 19 nt, Human herpesvirus 4 [Epstein-Barr virus]
cuguaguggccuucucuga

SEQ ID NO: 1940006 - RNA, 14 nt, Human herpesvirus 4 [Epstein-Barr virus]
aacuggccaugcag

SEQ ID NO: 1940007 - RNA, 18 nt, Human herpesvirus 4 [Epstein-Barr virus]
caccagcuucgagagcca

SEQ ID NO: 1940008 - RNA, 18 nt, Human herpesvirus 4 [Epstein-Barr virus]
cacguguggaagaggaaa

SEQ ID NO: 1940009 - RNA, 22 nt, Human herpesvirus 4 [Epstein-Barr virus]
cgagcuccgugggcccagagug

SEQ ID NO: 1940010 - RNA, 13 nt, Human herpesvirus 4 [Epstein-Barr virus]
guauguauuggga

SEQ ID NO: 1940011 - RNA, 19 nt, Human herpesvirus 4 [Epstein-Barr virus]
agugggcuucgggggccug

SEQ ID NO: 1940012 - RNA, 12 nt, Human herpesvirus 4 [Epstein-Barr virus]
gcucugcacagg

SEQ ID NO: 1940013 - RNA, 22 nt, Human herpesvirus 4 [Epstein-Barr virus]
ggcggcagcggaugguggggcu

SEQ ID NO: 1940014 - RNA, 18 nt, Human herpesvirus 4 [Epstein-Barr virus]
ccaauucacaucucaggg

SEQ ID NO: 1940015 - RNA, 15 nt, Human herpesvirus 4 [Epstein-Barr virus]
acccccaccaccucc

SEQ ID NO: 1940016 - RNA, 23 nt, Human herpesvirus 4 [Epstein-Barr virus]
gcccgacccccgggcgcccccaa

SEQ ID NO: 1940017 - RNA, 21 nt, Human herpesvirus 4 [Epstein-Barr virus]
cauggagaacguccacgggga

SEQ ID NO: 1940018 - RNA, 17 nt, Human herpesvirus 4 [Epstein-Barr virus]
ccagggcguacaccugg

SEQ ID NO: 1940019 - RNA, 20 nt, Human herpesvirus 4 [Epstein-Barr virus]
ccgcgguuucagcaucacag

SEQ ID NO: 1940020 - RNA, 14 nt, Human herpesvirus 4 [Epstein-Barr virus]
ggacauucuucuga

SEQ ID NO: 1940021 - RNA, 18 nt, Human herpesvirus 4 [Epstein-Barr virus]
ccacgguggaacaggagc

SEQ ID NO: 1940022 - RNA, 23 nt, Human herpesvirus 4 [Epstein-Barr virus]
ccaggaccuggaugcuguagugg

SEQ ID NO: 1940023 - RNA, 19 nt, Human herpesvirus 4 [Epstein-Barr virus]
ggugccaagcucagccccu

SEQ ID NO: 1940024 - RNA, 19 nt, Human herpesvirus 4 [Epstein-Barr virus]
gcuaucuuugcugaagaug

SEQ ID NO: 1940025 - RNA, 19 nt, Human herpesvirus 4 [Epstein-Barr virus]
cuccccugacgcuguggcc

SEQ ID NO: 1940026 - RNA, 17 nt, Human herpesvirus 4 [Epstein-Barr virus]
cccauguaagccugccu

SEQ ID NO: 1940027 - RNA, 15 nt, Human herpesvirus 4 [Epstein-Barr virus]
ucugcugcugcuggu

SEQ ID NO: 1940028 - RNA, 11 nt, Human herpesvirus 4 [Epstein-Barr virus]
ccuuuugcaac

SEQ ID NO: 1940029 - RNA, 18 nt, Human herpesvirus 4 [Epstein-Barr virus]
gugccauaccacaccccc

SEQ ID NO: 1940030 - RNA, 21 nt, Human herpesvirus 4 [Epstein-Barr virus]
gagaucucuugcgcccaggca

SEQ ID NO: 1940031 - RNA, 14 nt, Human herpesvirus 4 [Epstein-Barr virus]
ggagcagggcccag

SEQ ID NO: 1940032 - RNA, 15 nt, Human herpesvirus 4 [Epstein-Barr virus]
gagcaggagcaggag

SEQ ID NO: 1940033 - RNA, 18 nt, Human herpesvirus 4 [Epstein-Barr virus]
caccccccccaccaccac

SEQ ID NO: 1940034 - RNA, 16 nt, Human herpesvirus 4 [Epstein-Barr virus]
uggccggugcugccag

SEQ ID NO: 1940035 - RNA, 12 nt, Human herpesvirus 4 [Epstein-Barr virus]
cagggcaauggg

SEQ ID NO: 1940036 - RNA, 20 nt, Human herpesvirus 4 [Epstein-Barr virus]
accuguccuugucugcugcc

SEQ ID NO: 1940037 - RNA, 18 nt, Human herpesvirus 4 [Epstein-Barr virus]
ugucccccuagccccggg

SEQ ID NO: 1940038 - RNA, 17 nt, Human herpesvirus 4 [Epstein-Barr virus]
cuucucaaaggccuugg

SEQ ID NO: 1940039 - RNA, 14 nt, Human herpesvirus 4 [Epstein-Barr virus]
cgacaucgccgccc

SEQ ID NO: 1940040 - RNA, 12 nt, Human herpesvirus 4 [Epstein-Barr virus]
ugaggcccagcc

SEQ ID NO: 1940041 - RNA, 13 nt, Human herpesvirus 4 [Epstein-Barr virus]
ccucuggcacgcc

SEQ ID NO: 1940042 - RNA, 14 nt, Human herpesvirus 4 [Epstein-Barr virus]
cgcguggagcugga

SEQ ID NO: 1940043 - RNA, 13 nt, Human herpesvirus 4 [Epstein-Barr virus]
ucaccaggccugc

SEQ ID NO: 1940044 - RNA, 21 nt, Human herpesvirus 4 [Epstein-Barr virus]
accuguccuugucugcugcca

SEQ ID NO: 1940045 - RNA, 13 nt, Human herpesvirus 4 [Epstein-Barr virus]
ccagggaggccug

SEQ ID NO: 1940046 - RNA, 23 nt, Human herpesvirus 4 [Epstein-Barr virus]
ccaucaugcugaauauugccagc

SEQ ID NO: 1940047 - RNA, 22 nt, Human herpesvirus 4 [Epstein-Barr virus]
agagcuggaugguguuggagac

SEQ ID NO: 1940048 - RNA, 21 nt, Human herpesvirus 4 [Epstein-Barr virus]
cuguacuugggauugcaacac

SEQ ID NO: 1940049 - RNA, 22 nt, Human herpesvirus 4 [Epstein-Barr virus]
ucuaacacgcuuuugucugccu

SEQ ID NO: 1940050 - RNA, 20 nt, Human herpesvirus 4 [Epstein-Barr virus]
cagaggccguguuucuccca

SEQ ID NO: 1940051 - RNA, 21 nt, Human herpesvirus 4 [Epstein-Barr virus]
ggaagcaggagaugggugcau

SEQ ID NO: 1940052 - RNA, 15 nt, Human herpesvirus 4 [Epstein-Barr virus]
aacccuguagucacc

SEQ ID NO: 1940053 - RNA, 21 nt, Human herpesvirus 4 [Epstein-Barr virus]
ccccuauauccuagagggaca

SEQ ID NO: 1940054 - RNA, 17 nt, Human herpesvirus 4 [Epstein-Barr virus]
ccggcaccgccaggugg

SEQ ID NO: 1940055 - RNA, 17 nt, Human herpesvirus 4 [Epstein-Barr virus]
gagaaugacagcaagga

SEQ ID NO: 1940056 - RNA, 13 nt, Human herpesvirus 4 [Epstein-Barr virus]
gagggccucuggc

SEQ ID NO: 1940057 - RNA, 14 nt, Human herpesvirus 4 [Epstein-Barr virus]
gaaacuacacggcc

SEQ ID NO: 1940058 - RNA, 16 nt, Human herpesvirus 4 [Epstein-Barr virus]
gcucggggcuggggag

SEQ ID NO: 1940059 - RNA, 19 nt, Human herpesvirus 4 [Epstein-Barr virus]
uacacacaucagaccucug

SEQ ID NO: 1940060 - RNA, 21 nt, Human herpesvirus 4 [Epstein-Barr virus]
gcgaugucggggcugcuggcg

SEQ ID NO: 1940061 - RNA, 24 nt, Human herpesvirus 4 [Epstein-Barr virus]
cccaaacucgacuucugaagaugu

SEQ ID NO: 1940062 - RNA, 18 nt, Human herpesvirus 4 [Epstein-Barr virus]
ugucaauaauuucaguga

SEQ ID NO: 1940063 - RNA, 14 nt, Human herpesvirus 4 [Epstein-Barr virus]
gccagguagcccag

SEQ ID NO: 1940064 - RNA, 21 nt, Human herpesvirus 4 [Epstein-Barr virus]
ugcccccgccagcgccuccuc

SEQ ID NO: 1940065 - RNA, 16 nt, Human herpesvirus 4 [Epstein-Barr virus]
caggcccccagcuucu

SEQ ID NO: 1940066 - RNA, 17 nt, Human herpesvirus 4 [Epstein-Barr virus]
gccauguguguccagug

SEQ ID NO: 1940067 - RNA, 14 nt, Human herpesvirus 4 [Epstein-Barr virus]
cuaauucagccacc

SEQ ID NO: 1940068 - RNA, 21 nt, Human herpesvirus 4 [Epstein-Barr virus]
ucucaugggggaaugagggaa

SEQ ID NO: 1940069 - RNA, 14 nt, Human herpesvirus 4 [Epstein-Barr virus]
uaugaaggcuggca

SEQ ID NO: 1940070 - RNA, 22 nt, Human herpesvirus 4 [Epstein-Barr virus]
uccagcaaccaauguaucccaa

SEQ ID NO: 1940071 - RNA, 23 nt, Human herpesvirus 4 [Epstein-Barr virus]
gaggcugagaacugacgcuccag

SEQ ID NO: 1940072 - RNA, 16 nt, Human herpesvirus 4 [Epstein-Barr virus]
gcccccaccaccccca

SEQ ID NO: 1940073 - RNA, 15 nt, Human herpesvirus 4 [Epstein-Barr virus]
cccagaggaggcccc

SEQ ID NO: 1940074 - RNA, 17 nt, Human herpesvirus 4 [Epstein-Barr virus]
uagccggccaggcagag

SEQ ID NO: 1940075 - RNA, 23 nt, Human herpesvirus 4 [Epstein-Barr virus]
cuuuguggugggacugagauuua

SEQ ID NO: 1940076 - RNA, 23 nt, Human herpesvirus 4 [Epstein-Barr virus]
cccgacuuauggcuagauuuccu

SEQ ID NO: 1940077 - RNA, 22 nt, Human herpesvirus 4 [Epstein-Barr virus]
cccgggaccgcgcccuccucug

SEQ ID NO: 1940078 - RNA, 22 nt, Human herpesvirus 4 [Epstein-Barr virus]
uccccugccugcaugcuuagug

SEQ ID NO: 1940079 - RNA, 17 nt, Human herpesvirus 4 [Epstein-Barr virus]
acccugcauggccaggc

SEQ ID NO: 1940080 - RNA, 16 nt, Human herpesvirus 4 [Epstein-Barr virus]
gauacucaucugugag

SEQ ID NO: 1940081 - RNA, 16 nt, Human herpesvirus 4 [Epstein-Barr virus]
ugagucagccuugccc

SEQ ID NO: 1940082 - RNA, 15 nt, Human herpesvirus 4 [Epstein-Barr virus]
cagcuaacaggacau

SEQ ID NO: 1940083 - RNA, 19 nt, Human herpesvirus 4 [Epstein-Barr virus]
guuugagaaucugggcugg

SEQ ID NO: 1940084 - RNA, 22 nt, Human herpesvirus 4 [Epstein-Barr virus]
cacugccaagguugaagagcag

SEQ ID NO: 1940085 - RNA, 21 nt, Human herpesvirus 4 [Epstein-Barr virus]
gcccucgguggugggcugcug

SEQ ID NO: 1940086 - RNA, 19 nt, Human herpesvirus 4 [Epstein-Barr virus]
gcugcgaggcauacagcau

SEQ ID NO: 1940087 - RNA, 17 nt, Human herpesvirus 4 [Epstein-Barr virus]
cuccauaggccucugcc

SEQ ID NO: 1940088 - RNA, 15 nt, Human herpesvirus 4 [Epstein-Barr virus]
guccuuugggaacac

SEQ ID NO: 1940089 - RNA, 21 nt, Human herpesvirus 4 [Epstein-Barr virus]
ccagcucggccagcaggccgg

SEQ ID NO: 1940090 - RNA, 13 nt, Human herpesvirus 4 [Epstein-Barr virus]
cuuggaggcugcu

SEQ ID NO: 1940091 - RNA, 15 nt, Human herpesvirus 4 [Epstein-Barr virus]
gagucgaagcucuug

SEQ ID NO: 1940092 - RNA, 22 nt, Human herpesvirus 4 [Epstein-Barr virus]
gcacaucuggaccuggacuggg

SEQ ID NO: 1940093 - RNA, 14 nt, Human herpesvirus 4 [Epstein-Barr virus]
cgcccuccucuggg

SEQ ID NO: 1940094 - RNA, 18 nt, Human herpesvirus 4 [Epstein-Barr virus]
augauucaucagaagcua

SEQ ID NO: 1940095 - RNA, 20 nt, Human herpesvirus 4 [Epstein-Barr virus]
ucuccugccugccucugcuc

SEQ ID NO: 1940096 - RNA, 21 nt, Human herpesvirus 4 [Epstein-Barr virus]
aguggccgucuggcagggggc

SEQ ID NO: 1940097 - RNA, 21 nt, Human herpesvirus 4 [Epstein-Barr virus]
gaagacuguuggguagauggc

SEQ ID NO: 1940098 - RNA, 20 nt, Human herpesvirus 4 [Epstein-Barr virus]
cuguucaaacagcagcagca

SEQ ID NO: 1940099 - RNA, 23 nt, Human herpesvirus 4 [Epstein-Barr virus]
cccagguggucuuagggcgccag

SEQ ID NO: 1940100 - RNA, 20 nt, Human herpesvirus 4 [Epstein-Barr virus]
uuuuggugaaauaaaaacag

SEQ ID NO: 1940101 - RNA, 22 nt, Human herpesvirus 4 [Epstein-Barr virus]
ccugcgacgcggugcugaccgg

SEQ ID NO: 1940102 - RNA, 20 nt, Human herpesvirus 4 [Epstein-Barr virus]
ccugagcauggcggccuggc

SEQ ID NO: 1940103 - RNA, 14 nt, Human herpesvirus 4 [Epstein-Barr virus]
ucuucucugacaaa

SEQ ID NO: 1940104 - RNA, 17 nt, Human herpesvirus 4 [Epstein-Barr virus]
uaucagagaggccucug

SEQ ID NO: 1940105 - RNA, 21 nt, Human herpesvirus 4 [Epstein-Barr virus]
gcuaauagcuuucuguugcug

SEQ ID NO: 1940106 - RNA, 20 nt, Human herpesvirus 4 [Epstein-Barr virus]
cugccacgugggucucaugg

SEQ ID NO: 1940107 - RNA, 18 nt, Human herpesvirus 4 [Epstein-Barr virus]
gcgagcuccgugggccca

SEQ ID NO: 1940108 - RNA, 13 nt, Human herpesvirus 4 [Epstein-Barr virus]
aaaagcagccacc

SEQ ID NO: 1940109 - RNA, 24 nt, Human herpesvirus 4 [Epstein-Barr virus]
gagcggcauccucaaggggcacga

SEQ ID NO: 1940110 - RNA, 21 nt, Human herpesvirus 4 [Epstein-Barr virus]
guaguaacgcauucccuugcu

SEQ ID NO: 1940111 - RNA, 23 nt, Human herpesvirus 4 [Epstein-Barr virus]
uugguggauugcugaacuggggc

SEQ ID NO: 1940112 - RNA, 19 nt, Human herpesvirus 4 [Epstein-Barr virus]
aucuacaacaaaacuggug

SEQ ID NO: 1940113 - RNA, 13 nt, Human herpesvirus 4 [Epstein-Barr virus]
cgccaccuccggg

SEQ ID NO: 1940114 - RNA, 15 nt, Human herpesvirus 4 [Epstein-Barr virus]
uacuucuuuugcucu

SEQ ID NO: 1940115 - RNA, 14 nt, Human herpesvirus 4 [Epstein-Barr virus]
aacugccagagcug

SEQ ID NO: 1940116 - RNA, 14 nt, Human herpesvirus 4 [Epstein-Barr virus]
acaugguagauaaa

SEQ ID NO: 1940117 - RNA, 15 nt, Human herpesvirus 4 [Epstein-Barr virus]
cuuugaugaggcuga

SEQ ID NO: 1940118 - RNA, 17 nt, Human herpesvirus 4 [Epstein-Barr virus]
ccugggcaaggagcugu

SEQ ID NO: 1940119 - RNA, 12 nt, Human herpesvirus 4 [Epstein-Barr virus]
ucccaacauggg

SEQ ID NO: 1940120 - RNA, 12 nt, Human herpesvirus 4 [Epstein-Barr virus]
acagcucuggca

SEQ ID NO: 1940121 - RNA, 13 nt, Human herpesvirus 4 [Epstein-Barr virus]
acuuuauuaauaa

SEQ ID NO: 1940122 - RNA, 13 nt, Human herpesvirus 4 [Epstein-Barr virus]
caagcagcuagag

SEQ ID NO: 1940123 - RNA, 22 nt, Human herpesvirus 4 [Epstein-Barr virus]
caaggauggcacgggcagagga

SEQ ID NO: 1940124 - RNA, 17 nt, Human herpesvirus 4 [Epstein-Barr virus]
aucacagaggaggcugg

SEQ ID NO: 1940125 - RNA, 22 nt, Human herpesvirus 4 [Epstein-Barr virus]
ccagcgccuccucgcaggcccc

SEQ ID NO: 1940126 - RNA, 14 nt, Human herpesvirus 4 [Epstein-Barr virus]
ggugaggcccagcc

SEQ ID NO: 1940127 - RNA, 12 nt, Human herpesvirus 4 [Epstein-Barr virus]
cauuggcagcag

SEQ ID NO: 1940128 - RNA, 19 nt, Human herpesvirus 4 [Epstein-Barr virus]
uggcaguauuuugcaaaca

SEQ ID NO: 1940129 - RNA, 13 nt, Human herpesvirus 4 [Epstein-Barr virus]
uauagcucuggca

SEQ ID NO: 1940130 - RNA, 16 nt, Human herpesvirus 4 [Epstein-Barr virus]
ccuucuccaucuccau

SEQ ID NO: 1940131 - RNA, 19 nt, Human herpesvirus 4 [Epstein-Barr virus]
ccugaagcgaagcagcucc

SEQ ID NO: 1940132 - RNA, 15 nt, Human herpesvirus 4 [Epstein-Barr virus]
gcaagaauuggggcu

SEQ ID NO: 1940133 - RNA, 15 nt, Human herpesvirus 4 [Epstein-Barr virus]
uccccggccucccgc

SEQ ID NO: 1940134 - RNA, 20 nt, Human herpesvirus 4 [Epstein-Barr virus]
cgacgcuguuuugcagcuga

SEQ ID NO: 1940135 - RNA, 15 nt, Human herpesvirus 4 [Epstein-Barr virus]
uccgcuccuacacca

SEQ ID NO: 1940136 - RNA, 18 nt, Human herpesvirus 4 [Epstein-Barr virus]
uauccaggucuugccgug

SEQ ID NO: 1940137 - RNA, 18 nt, Human herpesvirus 4 [Epstein-Barr virus]
cucucuauguugucacau

SEQ ID NO: 1940138 - RNA, 21 nt, Human herpesvirus 4 [Epstein-Barr virus]
gccucucuggcugugcugacc

SEQ ID NO: 1940139 - RNA, 22 nt, Human herpesvirus 4 [Epstein-Barr virus]
uguaucccaaauaaauguuacu

SEQ ID NO: 1940140 - RNA, 17 nt, Human herpesvirus 4 [Epstein-Barr virus]
acucgagagaggccucu

SEQ ID NO: 1940141 - RNA, 20 nt, Human herpesvirus 4 [Epstein-Barr virus]
ggaggccugggagggggcga

SEQ ID NO: 1940142 - RNA, 14 nt, Human herpesvirus 4 [Epstein-Barr virus]
gaccuggcucaggu

SEQ ID NO: 1940143 - RNA, 15 nt, Human herpesvirus 4 [Epstein-Barr virus]
auggaugugaaugcc

SEQ ID NO: 1940144 - RNA, 14 nt, Human herpesvirus 4 [Epstein-Barr virus]
uggcucgccucauc

SEQ ID NO: 1940145 - RNA, 19 nt, Human herpesvirus 4 [Epstein-Barr virus]
cggguaguagcacuggugg

SEQ ID NO: 1940146 - RNA, 22 nt, Human herpesvirus 4 [Epstein-Barr virus]
cauggugagacaccuggcccac

SEQ ID NO: 1940147 - RNA, 18 nt, Human herpesvirus 4 [Epstein-Barr virus]
ccagagccucugccacaa

SEQ ID NO: 1940148 - RNA, 14 nt, Human herpesvirus 4 [Epstein-Barr virus]
ggggcuguagaagg

SEQ ID NO: 1940149 - RNA, 10 nt, Human herpesvirus 4 [Epstein-Barr virus]
accuccacca

SEQ ID NO: 1940150 - RNA, 14 nt, Human herpesvirus 4 [Epstein-Barr virus]
cugacacuuuagag

SEQ ID NO: 1940151 - RNA, 14 nt, Human herpesvirus 4 [Epstein-Barr virus]
ccuucuccucagcc

SEQ ID NO: 1940152 - RNA, 18 nt, Human herpesvirus 4 [Epstein-Barr virus]
cccaagaucaaagucugu

SEQ ID NO: 1940153 - RNA, 16 nt, Human herpesvirus 4 [Epstein-Barr virus]
cucaucgcacgggggu

SEQ ID NO: 1940154 - RNA, 17 nt, Human herpesvirus 4 [Epstein-Barr virus]
cacccggacccggacca

SEQ ID NO: 1940155 - RNA, 20 nt, Human herpesvirus 4 [Epstein-Barr virus]
ggccgggagaggcagcccca

SEQ ID NO: 1940156 - RNA, 13 nt, Human herpesvirus 4 [Epstein-Barr virus]
ccgggagccacgg

SEQ ID NO: 1940157 - RNA, 18 nt, Human herpesvirus 4 [Epstein-Barr virus]
augcucagaccccggguu

SEQ ID NO: 1940158 - RNA, 21 nt, Human herpesvirus 4 [Epstein-Barr virus]
gagugcccuggaggccucagg

SEQ ID NO: 1940159 - RNA, 23 nt, Human herpesvirus 4 [Epstein-Barr virus]
gacuacaaggcauuuacguucug

SEQ ID NO: 1940160 - RNA, 16 nt, Human herpesvirus 4 [Epstein-Barr virus]
gcugguggccugggag

SEQ ID NO: 1940161 - RNA, 17 nt, Human herpesvirus 4 [Epstein-Barr virus]
ccaaagcgggugcagua

SEQ ID NO: 1940162 - RNA, 17 nt, Human herpesvirus 4 [Epstein-Barr virus]
uuugcuaucuuugcuga

SEQ ID NO: 1940163 - RNA, 13 nt, Human herpesvirus 4 [Epstein-Barr virus]
cccucuugucccu

SEQ ID NO: 1940164 - RNA, 21 nt, Human herpesvirus 4 [Epstein-Barr virus]
agggcagacugcacaggauga

SEQ ID NO: 1940165 - RNA, 16 nt, Human herpesvirus 4 [Epstein-Barr virus]
ccucuccagcaaccaa

SEQ ID NO: 1940166 - RNA, 19 nt, Human herpesvirus 4 [Epstein-Barr virus]
guaugaggaaggggccucg

SEQ ID NO: 1940167 - RNA, 14 nt, Human herpesvirus 4 [Epstein-Barr virus]
cgguguccaggugu

SEQ ID NO: 1940168 - RNA, 15 nt, Human herpesvirus 4 [Epstein-Barr virus]
gugccucagauagcc

SEQ ID NO: 1940169 - RNA, 17 nt, Human herpesvirus 4 [Epstein-Barr virus]
agcgaagaacacuccac

SEQ ID NO: 1940170 - RNA, 20 nt, Human herpesvirus 4 [Epstein-Barr virus]
gcuccccagccacagcaccc

SEQ ID NO: 1940171 - RNA, 16 nt, Human herpesvirus 4 [Epstein-Barr virus]
cuuggcagcaguggcc

SEQ ID NO: 1940172 - RNA, 20 nt, Human herpesvirus 4 [Epstein-Barr virus]
accacucaggaagcuggcca

SEQ ID NO: 1940173 - RNA, 20 nt, Human herpesvirus 4 [Epstein-Barr virus]
ggugccauuguuuaccgcca

SEQ ID NO: 1940174 - RNA, 15 nt, Human herpesvirus 4 [Epstein-Barr virus]
ccaguguggcugggg

SEQ ID NO: 1940175 - RNA, 23 nt, Human herpesvirus 4 [Epstein-Barr virus]
guacccuuucuaccaggggcgag

SEQ ID NO: 1940176 - RNA, 16 nt, Human herpesvirus 4 [Epstein-Barr virus]
augcagggugcacaga

SEQ ID NO: 1940177 - RNA, 19 nt, Human herpesvirus 4 [Epstein-Barr virus]
cauggugucuguaaucucu

SEQ ID NO: 1940178 - RNA, 17 nt, Human herpesvirus 4 [Epstein-Barr virus]
cauugcuaauguaccuc

SEQ ID NO: 1940179 - RNA, 22 nt, Human herpesvirus 4 [Epstein-Barr virus]
auagcaggacggggggcuggcg

SEQ ID NO: 1940180 - RNA, 23 nt, Human herpesvirus 4 [Epstein-Barr virus]
cucggcggggaacgugacaggca

SEQ ID NO: 1940181 - RNA, 13 nt, Human herpesvirus 4 [Epstein-Barr virus]
gauggccuggaga

SEQ ID NO: 1940182 - RNA, 19 nt, Human herpesvirus 4 [Epstein-Barr virus]
gaaggggccucggccuggg

SEQ ID NO: 1940183 - RNA, 12 nt, Human herpesvirus 4 [Epstein-Barr virus]
aaacggccuggc

SEQ ID NO: 1940184 - RNA, 17 nt, Human herpesvirus 4 [Epstein-Barr virus]
acucucucccccgggcg

SEQ ID NO: 1940185 - RNA, 16 nt, Human herpesvirus 4 [Epstein-Barr virus]
caggcccgaccugcca

SEQ ID NO: 1940186 - RNA, 16 nt, Human herpesvirus 4 [Epstein-Barr virus]
cagccccucaucccug

SEQ ID NO: 1940187 - RNA, 13 nt, Human herpesvirus 4 [Epstein-Barr virus]
cagaaccaucagc

SEQ ID NO: 1940188 - RNA, 22 nt, Human herpesvirus 4 [Epstein-Barr virus]
acaugagaaaauacuucucuag

SEQ ID NO: 1940189 - RNA, 18 nt, Human herpesvirus 4 [Epstein-Barr virus]
aagguguagaaguguguc

SEQ ID NO: 1940190 - RNA, 21 nt, Human herpesvirus 4 [Epstein-Barr virus]
aggagcaggagcgggaggggc

SEQ ID NO: 1940191 - RNA, 16 nt, Human herpesvirus 4 [Epstein-Barr virus]
cuggugagccacguag

SEQ ID NO: 1940192 - RNA, 18 nt, Human herpesvirus 4 [Epstein-Barr virus]
gcacuggugguggaggag

SEQ ID NO: 1940193 - RNA, 13 nt, Human herpesvirus 4 [Epstein-Barr virus]
uggcagcagcucu

SEQ ID NO: 1940194 - RNA, 14 nt, Human herpesvirus 4 [Epstein-Barr virus]
uggcauccuucaga

SEQ ID NO: 1940195 - RNA, 16 nt, Human herpesvirus 4 [Epstein-Barr virus]
gcaggugcaccagcuc

SEQ ID NO: 1940196 - RNA, 17 nt, Human herpesvirus 4 [Epstein-Barr virus]
ugccaaagagccagauc

SEQ ID NO: 1940197 - RNA, 17 nt, Human herpesvirus 4 [Epstein-Barr virus]
acuccggcccacgccau

SEQ ID NO: 1940198 - RNA, 17 nt, Human herpesvirus 4 [Epstein-Barr virus]
cccucugggagaagggu

SEQ ID NO: 1940199 - RNA, 16 nt, Human herpesvirus 4 [Epstein-Barr virus]
gacagaaauuggguga

SEQ ID NO: 1940200 - RNA, 14 nt, Human herpesvirus 4 [Epstein-Barr virus]
agaggaugaggcug

SEQ ID NO: 1940201 - RNA, 13 nt, Human herpesvirus 4 [Epstein-Barr virus]
guuccacagccug

SEQ ID NO: 1940202 - RNA, 14 nt, Human herpesvirus 4 [Epstein-Barr virus]
ucuggcugugcuga

SEQ ID NO: 1940203 - RNA, 21 nt, Human herpesvirus 4 [Epstein-Barr virus]
gcgcccugucccuggagcugg

SEQ ID NO: 1940204 - RNA, 14 nt, Human herpesvirus 4 [Epstein-Barr virus]
cugucuugucacca

SEQ ID NO: 1940205 - RNA, 17 nt, Human herpesvirus 4 [Epstein-Barr virus]
caccaagauagugacca

SEQ ID NO: 1940206 - RNA, 23 nt, Human herpesvirus 4 [Epstein-Barr virus]
cugagcuggacgagguccuggac

SEQ ID NO: 1940207 - RNA, 19 nt, Human herpesvirus 4 [Epstein-Barr virus]
cgcaacgccggccugcugg

SEQ ID NO: 1940208 - RNA, 19 nt, Human herpesvirus 4 [Epstein-Barr virus]
cgacuuuguuuagggacag

SEQ ID NO: 1940209 - RNA, 19 nt, Human herpesvirus 4 [Epstein-Barr virus]
cgaugauugagaaugccaa

SEQ ID NO: 1940210 - RNA, 18 nt, Human herpesvirus 4 [Epstein-Barr virus]
agcaccggagccaccaca

SEQ ID NO: 1940211 - RNA, 13 nt, Human herpesvirus 4 [Epstein-Barr virus]
cagcgccuccucg

SEQ ID NO: 1940212 - RNA, 14 nt, Human herpesvirus 4 [Epstein-Barr virus]
gaggacgugaguga

SEQ ID NO: 1940213 - RNA, 19 nt, Human herpesvirus 4 [Epstein-Barr virus]
ggcuccuuagacugagcca

SEQ ID NO: 1940214 - RNA, 17 nt, Human herpesvirus 4 [Epstein-Barr virus]
gucuggcagggggccgg

SEQ ID NO: 1940215 - RNA, 14 nt, Human herpesvirus 4 [Epstein-Barr virus]
cgcccgggggccag

SEQ ID NO: 1940216 - RNA, 21 nt, Human herpesvirus 4 [Epstein-Barr virus]
cauggguaaugauucaucaga

SEQ ID NO: 1940217 - RNA, 17 nt, Human herpesvirus 4 [Epstein-Barr virus]
gcugggaauggagaggg

SEQ ID NO: 1940218 - RNA, 23 nt, Human herpesvirus 4 [Epstein-Barr virus]
auagcucugcacaggcuuggaaa

SEQ ID NO: 1940219 - RNA, 24 nt, Human herpesvirus 4 [Epstein-Barr virus]
uaaacgccugauuuuuguccgcag

SEQ ID NO: 1940220 - RNA, 16 nt, Human herpesvirus 4 [Epstein-Barr virus]
gacaagacagucacau

SEQ ID NO: 1940221 - RNA, 17 nt, Human herpesvirus 4 [Epstein-Barr virus]
accuguguccugggcaa

SEQ ID NO: 1940222 - RNA, 20 nt, Human herpesvirus 4 [Epstein-Barr virus]
cgcgagcuccgugggcccag

SEQ ID NO: 1940223 - RNA, 14 nt, Human herpesvirus 4 [Epstein-Barr virus]
gguggugggugugg

SEQ ID NO: 1940224 - RNA, 18 nt, Human herpesvirus 4 [Epstein-Barr virus]
gccgcuccguggccccgg

SEQ ID NO: 1940225 - RNA, 18 nt, Human herpesvirus 4 [Epstein-Barr virus]
ucuuuugcucuuaaccau

SEQ ID NO: 1940226 - RNA, 21 nt, Human herpesvirus 4 [Epstein-Barr virus]
gaagcggggcugggugggaga

SEQ ID NO: 1940227 - RNA, 14 nt, Human herpesvirus 4 [Epstein-Barr virus]
gccgccccgggccc

SEQ ID NO: 1940228 - RNA, 12 nt, Human herpesvirus 4 [Epstein-Barr virus]
gagcaaccagcu

SEQ ID NO: 1940229 - RNA, 22 nt, Human herpesvirus 4 [Epstein-Barr virus]
gucugacgaggggccagguaca

SEQ ID NO: 1940230 - RNA, 17 nt, Human herpesvirus 4 [Epstein-Barr virus]
aagagccauggugagac

SEQ ID NO: 1940231 - RNA, 12 nt, Human herpesvirus 4 [Epstein-Barr virus]
cuaccgccacgc

SEQ ID NO: 1940232 - RNA, 21 nt, Human herpesvirus 4 [Epstein-Barr virus]
ggcagccgcggccaucaccug

SEQ ID NO: 1940233 - RNA, 18 nt, Human herpesvirus 4 [Epstein-Barr virus]
cuaacacgaaugcccagg

SEQ ID NO: 1940234 - RNA, 23 nt, Human herpesvirus 4 [Epstein-Barr virus]
cucaggcacggucgccccuccga

SEQ ID NO: 1940235 - RNA, 21 nt, Human herpesvirus 4 [Epstein-Barr virus]
aaaguacaggauuauugccaa

SEQ ID NO: 1940236 - RNA, 21 nt, Human herpesvirus 4 [Epstein-Barr virus]
ugcagaggaugagaccagugg

SEQ ID NO: 1940237 - RNA, 12 nt, Human herpesvirus 4 [Epstein-Barr virus]
uggccucaaagu

SEQ ID NO: 1940238 - RNA, 18 nt, Human herpesvirus 4 [Epstein-Barr virus]
cugcucccgccucaggga

SEQ ID NO: 1940239 - RNA, 18 nt, Human herpesvirus 4 [Epstein-Barr virus]
caggagcgggaggggcag

SEQ ID NO: 1940240 - RNA, 15 nt, Human herpesvirus 4 [Epstein-Barr virus]
aggaaacugcugaca

SEQ ID NO: 1940241 - RNA, 17 nt, Human herpesvirus 4 [Epstein-Barr virus]
gucaaguaccagcuggu

SEQ ID NO: 1940242 - RNA, 19 nt, Human herpesvirus 4 [Epstein-Barr virus]
cagccggguccgugcggcu

SEQ ID NO: 1940243 - RNA, 14 nt, Human herpesvirus 4 [Epstein-Barr virus]
cucagaugcagugg

SEQ ID NO: 1940244 - RNA, 18 nt, Human herpesvirus 4 [Epstein-Barr virus]
ggaggccgagcagggacu

SEQ ID NO: 1940245 - RNA, 12 nt, Human herpesvirus 4 [Epstein-Barr virus]
cgcccccucugc

SEQ ID NO: 1940246 - RNA, 16 nt, Human herpesvirus 4 [Epstein-Barr virus]
cccucuguuucuucau

SEQ ID NO: 1940247 - RNA, 19 nt, Human herpesvirus 4 [Epstein-Barr virus]
augcucuggcgacuuggug

SEQ ID NO: 1940248 - RNA, 14 nt, Human herpesvirus 4 [Epstein-Barr virus]
caaacauguccugu

SEQ ID NO: 1940249 - RNA, 13 nt, Human herpesvirus 4 [Epstein-Barr virus]
aaagcugaagaac

SEQ ID NO: 1940250 - RNA, 12 nt, Human herpesvirus 4 [Epstein-Barr virus]
gaauaugaugag

SEQ ID NO: 1940251 - RNA, 16 nt, Human herpesvirus 4 [Epstein-Barr virus]
gacgagaaggaggaga

SEQ ID NO: 1940252 - RNA, 12 nt, Human herpesvirus 4 [Epstein-Barr virus]
gcggcugcugcc

SEQ ID NO: 1940253 - RNA, 21 nt, Human herpesvirus 4 [Epstein-Barr virus]
ccaucccaauucacaucucag

SEQ ID NO: 1940254 - RNA, 21 nt, Human herpesvirus 4 [Epstein-Barr virus]
ggaucgaaggagagcuggaug

SEQ ID NO: 1940255 - RNA, 14 nt, Human herpesvirus 4 [Epstein-Barr virus]
cauccccagagggc

SEQ ID NO: 1940256 - RNA, 16 nt, Human herpesvirus 4 [Epstein-Barr virus]
ucugcagagagccaca

SEQ ID NO: 1940257 - RNA, 18 nt, Human herpesvirus 4 [Epstein-Barr virus]
ccuauagauccugggccc

SEQ ID NO: 1940258 - RNA, 18 nt, Human herpesvirus 4 [Epstein-Barr virus]
gaugauauugaauuccac

SEQ ID NO: 1940259 - RNA, 16 nt, Human herpesvirus 4 [Epstein-Barr virus]
cguccuuguccaggag

SEQ ID NO: 1940260 - RNA, 13 nt, Human herpesvirus 4 [Epstein-Barr virus]
uagaaugugguaa

SEQ ID NO: 1940261 - RNA, 22 nt, Human herpesvirus 4 [Epstein-Barr virus]
caauucuacuguucaaacagca

SEQ ID NO: 1940262 - RNA, 12 nt, Human herpesvirus 4 [Epstein-Barr virus]
gugugcuguauu

SEQ ID NO: 1940263 - RNA, 22 nt, Human herpesvirus 4 [Epstein-Barr virus]
aguugguccaggguccaggaga

SEQ ID NO: 1940264 - RNA, 20 nt, Human herpesvirus 4 [Epstein-Barr virus]
cugcgagggggccuggugcc

SEQ ID NO: 1940265 - RNA, 15 nt, Human herpesvirus 4 [Epstein-Barr virus]
acacugaugagucug

SEQ ID NO: 1940266 - RNA, 13 nt, Human herpesvirus 4 [Epstein-Barr virus]
gugaaugcacgcc

SEQ ID NO: 1940267 - RNA, 22 nt, Human herpesvirus 4 [Epstein-Barr virus]
gugguugucuucccagacucug

SEQ ID NO: 1940268 - RNA, 16 nt, Human herpesvirus 4 [Epstein-Barr virus]
caguaacacagggugg

SEQ ID NO: 1940269 - RNA, 16 nt, Human herpesvirus 4 [Epstein-Barr virus]
ugucgagcaugagcuc

SEQ ID NO: 1940270 - RNA, 19 nt, Human herpesvirus 4 [Epstein-Barr virus]
ccuuggcaucaucagcgcc

SEQ ID NO: 1940271 - RNA, 16 nt, Human herpesvirus 4 [Epstein-Barr virus]
ucucggccuacgaggc

SEQ ID NO: 1940272 - RNA, 22 nt, Human herpesvirus 4 [Epstein-Barr virus]
uagugcgcgugaguucuuuagg

SEQ ID NO: 1940273 - RNA, 16 nt, Human herpesvirus 4 [Epstein-Barr virus]
gcuggccaggcuggug

SEQ ID NO: 1940274 - RNA, 17 nt, Human herpesvirus 4 [Epstein-Barr virus]
ugggaacaccgggcagg

SEQ ID NO: 1940275 - RNA, 21 nt, Human herpesvirus 4 [Epstein-Barr virus]
cucaauccauuaucuuggcac

SEQ ID NO: 1940276 - RNA, 21 nt, Human herpesvirus 4 [Epstein-Barr virus]
ucucggcacccaggcagccuu

SEQ ID NO: 1940277 - RNA, 19 nt, Human herpesvirus 4 [Epstein-Barr virus]
gcagcccggccgaggccug

SEQ ID NO: 1940278 - RNA, 23 nt, Human herpesvirus 4 [Epstein-Barr virus]
uccagacuccggggguccagccg

SEQ ID NO: 1940279 - RNA, 17 nt, Human herpesvirus 4 [Epstein-Barr virus]
uaccagaagagucauac

SEQ ID NO: 1940280 - RNA, 20 nt, Human herpesvirus 4 [Epstein-Barr virus]
ggggcugagaccaugcucag

SEQ ID NO: 1940281 - RNA, 17 nt, Human herpesvirus 4 [Epstein-Barr virus]
agggugaggcccagccc

SEQ ID NO: 1940282 - RNA, 17 nt, Human herpesvirus 4 [Epstein-Barr virus]
gguggccgcggcccagg

SEQ ID NO: 1940283 - RNA, 20 nt, Human herpesvirus 4 [Epstein-Barr virus]
gcgcaggggagggggcagga

SEQ ID NO: 1940284 - RNA, 20 nt, Human herpesvirus 4 [Epstein-Barr virus]
caggccgccuauggggccug

SEQ ID NO: 1940285 - RNA, 15 nt, Human herpesvirus 4 [Epstein-Barr virus]
agucuguacuuggga

SEQ ID NO: 1940286 - RNA, 21 nt, Human herpesvirus 4 [Epstein-Barr virus]
agccacacaaucagccgggag

SEQ ID NO: 1940287 - RNA, 23 nt, Human herpesvirus 4 [Epstein-Barr virus]
ucagggccacggcgugccagagg

SEQ ID NO: 1940288 - RNA, 22 nt, Human herpesvirus 4 [Epstein-Barr virus]
uuaaaacaguagaagaacugca

SEQ ID NO: 1940289 - RNA, 19 nt, Human herpesvirus 4 [Epstein-Barr virus]
caguacucggcuagccuga

SEQ ID NO: 1940290 - RNA, 18 nt, Human herpesvirus 4 [Epstein-Barr virus]
ccagaguucccggcugcu

SEQ ID NO: 1940291 - RNA, 17 nt, Human herpesvirus 4 [Epstein-Barr virus]
caaguguuuccagacac

SEQ ID NO: 1940292 - RNA, 17 nt, Human herpesvirus 4 [Epstein-Barr virus]
caccuugccggccaccu

SEQ ID NO: 1940293 - RNA, 17 nt, Human herpesvirus 4 [Epstein-Barr virus]
cgaacuccuccagcagu

SEQ ID NO: 1940294 - RNA, 17 nt, Human herpesvirus 4 [Epstein-Barr virus]
ggcguggagcugggccu

SEQ ID NO: 1940295 - RNA, 16 nt, Human herpesvirus 4 [Epstein-Barr virus]
acaauagaaguggaaa

SEQ ID NO: 1940296 - RNA, 19 nt, Human herpesvirus 4 [Epstein-Barr virus]
caauauccaucugcuucug

SEQ ID NO: 1940297 - RNA, 22 nt, Human herpesvirus 4 [Epstein-Barr virus]
uaaggccgggagaggcagcccc

SEQ ID NO: 1940298 - RNA, 13 nt, Human herpesvirus 4 [Epstein-Barr virus]
gugaggcccagcc

SEQ ID NO: 1940299 - RNA, 17 nt, Human herpesvirus 4 [Epstein-Barr virus]
ggaaaagagagcugaug

SEQ ID NO: 1940300 - RNA, 12 nt, Human herpesvirus 4 [Epstein-Barr virus]
agcauuugcaag

SEQ ID NO: 1940301 - RNA, 23 nt, Human herpesvirus 4 [Epstein-Barr virus]
accgcgcccuccucugggccgcc

SEQ ID NO: 1940302 - RNA, 20 nt, Human herpesvirus 4 [Epstein-Barr virus]
aggugucaauaauuucagug

SEQ ID NO: 1940303 - RNA, 14 nt, Human herpesvirus 4 [Epstein-Barr virus]
gucugacuuggccc

SEQ ID NO: 1940304 - RNA, 20 nt, Human herpesvirus 4 [Epstein-Barr virus]
uauccagagcugagugccca

SEQ ID NO: 1940305 - RNA, 14 nt, Human herpesvirus 4 [Epstein-Barr virus]
ccggacgcagaggc

SEQ ID NO: 1940306 - RNA, 19 nt, Human herpesvirus 4 [Epstein-Barr virus]
cugcacaaaggaaacugcu

SEQ ID NO: 1940307 - RNA, 12 nt, Human herpesvirus 4 [Epstein-Barr virus]
gagaaugacagc

SEQ ID NO: 1940308 - RNA, 12 nt, Human herpesvirus 4 [Epstein-Barr virus]
ggcugcugccaa

SEQ ID NO: 1940309 - RNA, 14 nt, Human herpesvirus 4 [Epstein-Barr virus]
ucgggggccugugu

SEQ ID NO: 1940310 - RNA, 13 nt, Human herpesvirus 4 [Epstein-Barr virus]
aggaugaggcuga

SEQ ID NO: 1940311 - RNA, 16 nt, Human herpesvirus 4 [Epstein-Barr virus]
cgccugacccucuugc

SEQ ID NO: 1940312 - RNA, 22 nt, Human herpesvirus 4 [Epstein-Barr virus]
uccacggggagacuuaugcuaa

SEQ ID NO: 1940313 - RNA, 17 nt, Human herpesvirus 4 [Epstein-Barr virus]
cgacaauaaaguugaug

SEQ ID NO: 1940314 - RNA, 13 nt, Human herpesvirus 4 [Epstein-Barr virus]
gccgcugccaggc

SEQ ID NO: 1940315 - RNA, 12 nt, Human herpesvirus 4 [Epstein-Barr virus]
aggcggaggcac

SEQ ID NO: 1940316 - RNA, 20 nt, Human herpesvirus 4 [Epstein-Barr virus]
cgucccugaguucuacaaug

SEQ ID NO: 1940317 - RNA, 13 nt, Human herpesvirus 4 [Epstein-Barr virus]
gaugaggcugaug

SEQ ID NO: 1940318 - RNA, 20 nt, Human herpesvirus 4 [Epstein-Barr virus]
uauuaauaaauaucuuccug

SEQ ID NO: 1940319 - RNA, 14 nt, Human herpesvirus 4 [Epstein-Barr virus]
gggcgaaggguggg

SEQ ID NO: 1940320 - RNA, 14 nt, Human herpesvirus 4 [Epstein-Barr virus]
aggcuaugaagaag

SEQ ID NO: 1940321 - RNA, 16 nt, Human herpesvirus 4 [Epstein-Barr virus]
ccccagacucaccccc

SEQ ID NO: 1940322 - RNA, 21 nt, Human herpesvirus 4 [Epstein-Barr virus]
acucuaaaaaucaaaacuuua

SEQ ID NO: 1940323 - RNA, 18 nt, Human herpesvirus 4 [Epstein-Barr virus]
cggucaaguaccagcugg

SEQ ID NO: 1940324 - RNA, 14 nt, Human herpesvirus 4 [Epstein-Barr virus]
gccgucccagggcc

SEQ ID NO: 1940325 - RNA, 20 nt, Human herpesvirus 4 [Epstein-Barr virus]
gcugcccauggaaugcucag

SEQ ID NO: 1940326 - RNA, 20 nt, Human herpesvirus 4 [Epstein-Barr virus]
cuggcugugcugacccuucu

SEQ ID NO: 1940327 - RNA, 18 nt, Human herpesvirus 4 [Epstein-Barr virus]
agugcuaugaccaugccc

SEQ ID NO: 1940328 - RNA, 12 nt, Human herpesvirus 4 [Epstein-Barr virus]
agcuccagggac

SEQ ID NO: 1940329 - RNA, 20 nt, Human herpesvirus 4 [Epstein-Barr virus]
ggccuccauccaguggggcu

SEQ ID NO: 1940330 - RNA, 11 nt, Human herpesvirus 4 [Epstein-Barr virus]
guagacagauc

SEQ ID NO: 1940331 - RNA, 19 nt, Human herpesvirus 4 [Epstein-Barr virus]
guccgccaggacggagaag

SEQ ID NO: 1940332 - RNA, 21 nt, Human herpesvirus 4 [Epstein-Barr virus]
gucuccccucugcagagagcc

SEQ ID NO: 1940333 - RNA, 19 nt, Human herpesvirus 4 [Epstein-Barr virus]
agagguugcgcugcuugcc

SEQ ID NO: 1940334 - RNA, 13 nt, Human herpesvirus 4 [Epstein-Barr virus]
cauggccaggcuc

SEQ ID NO: 1940335 - RNA, 17 nt, Human herpesvirus 4 [Epstein-Barr virus]
aggcuuucuaugccuga

SEQ ID NO: 1940336 - RNA, 20 nt, Human herpesvirus 4 [Epstein-Barr virus]
gcuucgaggucuccccugac

SEQ ID NO: 1940337 - RNA, 20 nt, Human herpesvirus 4 [Epstein-Barr virus]
ccuggcggcccagcccgacc

SEQ ID NO: 1940338 - RNA, 17 nt, Human herpesvirus 4 [Epstein-Barr virus]
uucaacacgaccaccua

SEQ ID NO: 1940339 - RNA, 22 nt, Human herpesvirus 4 [Epstein-Barr virus]
ugagccaggcuuucuaugccug

SEQ ID NO: 1940340 - RNA, 13 nt, Human herpesvirus 4 [Epstein-Barr virus]
ugaucagggagaa

SEQ ID NO: 1940341 - RNA, 18 nt, Human herpesvirus 4 [Epstein-Barr virus]
augacgcugcugcuacug

SEQ ID NO: 1940342 - RNA, 14 nt, Human herpesvirus 4 [Epstein-Barr virus]
gguggccggcagcc

SEQ ID NO: 1940343 - RNA, 23 nt, Human herpesvirus 4 [Epstein-Barr virus]
ugagaauaaggcucugaagcaac

SEQ ID NO: 1940344 - RNA, 15 nt, Human herpesvirus 4 [Epstein-Barr virus]
uugguaaaacaaggg

SEQ ID NO: 1940345 - RNA, 20 nt, Human herpesvirus 4 [Epstein-Barr virus]
cucacuucuacucuuggcag

SEQ ID NO: 1940346 - RNA, 19 nt, Human herpesvirus 4 [Epstein-Barr virus]
agguccuggacgagggggc

SEQ ID NO: 1940347 - RNA, 21 nt, Human herpesvirus 4 [Epstein-Barr virus]
cgaggcagacaaggccccgcc

SEQ ID NO: 1940348 - RNA, 14 nt, Human herpesvirus 4 [Epstein-Barr virus]
gacucaauuuccaa

SEQ ID NO: 1940349 - RNA, 17 nt, Human herpesvirus 4 [Epstein-Barr virus]
cccccuccauuccaccc

SEQ ID NO: 1940350 - RNA, 11 nt, Human herpesvirus 4 [Epstein-Barr virus]
cuccaccaccu

SEQ ID NO: 1940351 - RNA, 23 nt, Human herpesvirus 4 [Epstein-Barr virus]
agcccauucucguccaucucgau

SEQ ID NO: 1940352 - RNA, 23 nt, Human herpesvirus 4 [Epstein-Barr virus]
cgggcacgccuucgcccccucuu

SEQ ID NO: 1940353 - RNA, 15 nt, Human herpesvirus 4 [Epstein-Barr virus]
gcuggccugccugga

SEQ ID NO: 1940354 - RNA, 14 nt, Human herpesvirus 4 [Epstein-Barr virus]
cuccucgugcaccu

SEQ ID NO: 1940355 - RNA, 14 nt, Human herpesvirus 4 [Epstein-Barr virus]
caggggucucuaga

SEQ ID NO: 1940356 - RNA, 14 nt, Human herpesvirus 4 [Epstein-Barr virus]
acgcuggucuugaa

SEQ ID NO: 1940357 - RNA, 20 nt, Human herpesvirus 4 [Epstein-Barr virus]
uaaauucuccugccugccuc

SEQ ID NO: 1940358 - RNA, 20 nt, Human herpesvirus 4 [Epstein-Barr virus]
cuggccggccgcccccugac

SEQ ID NO: 1940359 - RNA, 13 nt, Human herpesvirus 4 [Epstein-Barr virus]
gggcggcggugga

SEQ ID NO: 1940360 - RNA, 20 nt, Human herpesvirus 4 [Epstein-Barr virus]
aaaaugucauaaccuggagu

SEQ ID NO: 1940361 - RNA, 20 nt, Human herpesvirus 4 [Epstein-Barr virus]
acaaaauggggguuggagaa

SEQ ID NO: 1940362 - RNA, 19 nt, Human herpesvirus 4 [Epstein-Barr virus]
cuugggauugcaacacgac

SEQ ID NO: 1940363 - RNA, 22 nt, Human herpesvirus 4 [Epstein-Barr virus]
ccugaguccaacauuaaagccu

SEQ ID NO: 1940364 - RNA, 20 nt, Human herpesvirus 4 [Epstein-Barr virus]
uucuguuaaggcuguugaca

SEQ ID NO: 1940365 - RNA, 22 nt, Human herpesvirus 4 [Epstein-Barr virus]
caggagacacacguggcuucca

SEQ ID NO: 1940366 - RNA, 17 nt, Human herpesvirus 4 [Epstein-Barr virus]
uagauggcgcgggugag

SEQ ID NO: 1940367 - RNA, 19 nt, Human herpesvirus 4 [Epstein-Barr virus]
ggggcucauggaggggcgg

SEQ ID NO: 1940368 - RNA, 19 nt, Human herpesvirus 4 [Epstein-Barr virus]
cuaggcuuuccugcaaggc

SEQ ID NO: 1940369 - RNA, 13 nt, Human herpesvirus 4 [Epstein-Barr virus]
gcagcauuuacaa

SEQ ID NO: 1940370 - RNA, 18 nt, Human herpesvirus 4 [Epstein-Barr virus]
ccagaagucggccacagg

SEQ ID NO: 1940371 - RNA, 15 nt, Human herpesvirus 4 [Epstein-Barr virus]
acugaauuuauaccc

SEQ ID NO: 1940372 - RNA, 19 nt, Human herpesvirus 4 [Epstein-Barr virus]
cgugagugacacugaugag

SEQ ID NO: 1940373 - RNA, 15 nt, Human herpesvirus 4 [Epstein-Barr virus]
ugcauacacugaauu

SEQ ID NO: 1940374 - RNA, 21 nt, Human herpesvirus 4 [Epstein-Barr virus]
uggaggcugcgccugagcugc

SEQ ID NO: 1940375 - RNA, 15 nt, Human herpesvirus 4 [Epstein-Barr virus]
agaggacuguucucu

SEQ ID NO: 1940376 - RNA, 22 nt, Human herpesvirus 4 [Epstein-Barr virus]
acugccuggggaaaauguaccc

SEQ ID NO: 1940377 - RNA, 14 nt, Human herpesvirus 4 [Epstein-Barr virus]
gguagccggcgcug

SEQ ID NO: 1940378 - RNA, 17 nt, Human herpesvirus 4 [Epstein-Barr virus]
accaagggcagggcaau

SEQ ID NO: 1940379 - RNA, 14 nt, Human herpesvirus 4 [Epstein-Barr virus]
cccagccccuccuc

SEQ ID NO: 1940380 - RNA, 14 nt, Human herpesvirus 4 [Epstein-Barr virus]
gcccuccucugggc

SEQ ID NO: 1940381 - RNA, 15 nt, Human herpesvirus 4 [Epstein-Barr virus]
cgaucccaggccuca

SEQ ID NO: 1940382 - RNA, 14 nt, Human herpesvirus 4 [Epstein-Barr virus]
gcggcuguggccuc

SEQ ID NO: 1940383 - RNA, 14 nt, Human herpesvirus 4 [Epstein-Barr virus]
cugagaaucuccug

SEQ ID NO: 1940384 - RNA, 19 nt, Human herpesvirus 4 [Epstein-Barr virus]
cggccguagcccaguccgc

SEQ ID NO: 1940385 - RNA, 15 nt, Human herpesvirus 4 [Epstein-Barr virus]
ggcucucaggccuca

SEQ ID NO: 1940386 - RNA, 16 nt, Human herpesvirus 4 [Epstein-Barr virus]
cuugccaauuggggug

SEQ ID NO: 1940387 - RNA, 18 nt, Human herpesvirus 4 [Epstein-Barr virus]
cccggggguggaggcugc

SEQ ID NO: 1940388 - RNA, 13 nt, Human herpesvirus 4 [Epstein-Barr virus]
cgcuacugcugcu

SEQ ID NO: 1940389 - RNA, 14 nt, Human herpesvirus 4 [Epstein-Barr virus]
ccggcuaucugcuu

SEQ ID NO: 1940390 - RNA, 11 nt, Human herpesvirus 4 [Epstein-Barr virus]
accagcuccag

SEQ ID NO: 1940391 - RNA, 13 nt, Human herpesvirus 4 [Epstein-Barr virus]
caggcuaugaaga

SEQ ID NO: 1940392 - RNA, 19 nt, Human herpesvirus 4 [Epstein-Barr virus]
gacaugugcauggccuggg

SEQ ID NO: 1940393 - RNA, 21 nt, Human herpesvirus 4 [Epstein-Barr virus]
cugugugcgcgccgccagcau

SEQ ID NO: 1940394 - RNA, 16 nt, Human herpesvirus 4 [Epstein-Barr virus]
gccccaauaugccaac

SEQ ID NO: 1940395 - RNA, 13 nt, Human herpesvirus 4 [Epstein-Barr virus]
cagcagcaguggu

SEQ ID NO: 1940396 - RNA, 17 nt, Human herpesvirus 4 [Epstein-Barr virus]
gugaugcuugugcuccu

SEQ ID NO: 1940397 - RNA, 17 nt, Human herpesvirus 4 [Epstein-Barr virus]
uuccuacaacucagccc

SEQ ID NO: 1940398 - RNA, 23 nt, Human herpesvirus 4 [Epstein-Barr virus]
gccugcaccaguggcugccccgg

SEQ ID NO: 1940399 - RNA, 19 nt, Human herpesvirus 4 [Epstein-Barr virus]
auuagcacgguagccuugg

SEQ ID NO: 1940400 - RNA, 22 nt, Human herpesvirus 4 [Epstein-Barr virus]
agccacacccaccuaugccaau

SEQ ID NO: 1940401 - RNA, 18 nt, Human herpesvirus 4 [Epstein-Barr virus]
ccugucucuuucuggcca

SEQ ID NO: 1940402 - RNA, 15 nt, Human herpesvirus 4 [Epstein-Barr virus]
gucggggcugcuggc

SEQ ID NO: 1940403 - RNA, 18 nt, Human herpesvirus 4 [Epstein-Barr virus]
gaggacggugucuguggu

SEQ ID NO: 1940404 - RNA, 21 nt, Human herpesvirus 4 [Epstein-Barr virus]
auuggacgucccuuuggagga

SEQ ID NO: 1940405 - RNA, 20 nt, Human herpesvirus 4 [Epstein-Barr virus]
cccgcgccgcaagcaugggc

SEQ ID NO: 1940406 - RNA, 15 nt, Human herpesvirus 4 [Epstein-Barr virus]
gugcagacgagcaug

SEQ ID NO: 1940407 - RNA, 20 nt, Human herpesvirus 4 [Epstein-Barr virus]
cucugcccuucagugucugg

SEQ ID NO: 1940408 - RNA, 22 nt, Human herpesvirus 4 [Epstein-Barr virus]
ggggcacucucgagggugccug

SEQ ID NO: 1940409 - RNA, 20 nt, Human herpesvirus 4 [Epstein-Barr virus]
caagcuuaugcagcaccuca

SEQ ID NO: 1940410 - RNA, 13 nt, Human herpesvirus 4 [Epstein-Barr virus]
ugaccaugcccag

SEQ ID NO: 1940411 - RNA, 18 nt, Human herpesvirus 4 [Epstein-Barr virus]
ccaccggggaggccaggu

SEQ ID NO: 1940412 - RNA, 19 nt, Human herpesvirus 4 [Epstein-Barr virus]
ggccucucuggcugugcug

SEQ ID NO: 1940413 - RNA, 23 nt, Human herpesvirus 4 [Epstein-Barr virus]
ggagauugauuuggaggaagagu

SEQ ID NO: 1940414 - RNA, 22 nt, Human herpesvirus 4 [Epstein-Barr virus]
ccggguuugauguuucuguggc

SEQ ID NO: 1940415 - RNA, 22 nt, Human herpesvirus 4 [Epstein-Barr virus]
cgagcagcgcggcagaggccuc

SEQ ID NO: 1940416 - RNA, 21 nt, Human herpesvirus 4 [Epstein-Barr virus]
ggccugccuggaucugagcua

SEQ ID NO: 1940417 - RNA, 17 nt, Human herpesvirus 4 [Epstein-Barr virus]
gcucgcccacacagcgc

SEQ ID NO: 1940418 - RNA, 16 nt, Human herpesvirus 4 [Epstein-Barr virus]
gucugcaccccagugg

SEQ ID NO: 1940419 - RNA, 23 nt, Human herpesvirus 4 [Epstein-Barr virus]
cccgccgugaacucugcccuuca

SEQ ID NO: 1940420 - RNA, 14 nt, Human herpesvirus 4 [Epstein-Barr virus]
gccgccgccagcag

SEQ ID NO: 1940421 - RNA, 21 nt, Human herpesvirus 4 [Epstein-Barr virus]
acgguggcuugggcuguggua

SEQ ID NO: 1940422 - RNA, 16 nt, Human herpesvirus 4 [Epstein-Barr virus]
ugaguccaacauuaaa

SEQ ID NO: 1940423 - RNA, 12 nt, Human herpesvirus 4 [Epstein-Barr virus]
ggcccagcccuc

SEQ ID NO: 1940424 - RNA, 14 nt, Human herpesvirus 4 [Epstein-Barr virus]
agggcaugcuuggg

SEQ ID NO: 1940425 - RNA, 14 nt, Human herpesvirus 4 [Epstein-Barr virus]
cccggccucccgcu

SEQ ID NO: 1940426 - RNA, 20 nt, Human herpesvirus 4 [Epstein-Barr virus]
auaauggugccugagggagg

SEQ ID NO: 1940427 - RNA, 18 nt, Human herpesvirus 4 [Epstein-Barr virus]
caaacucgacuucugaag

SEQ ID NO: 1940428 - RNA, 15 nt, Human herpesvirus 4 [Epstein-Barr virus]
auuuggaggaagagu

SEQ ID NO: 1940429 - RNA, 20 nt, Human herpesvirus 4 [Epstein-Barr virus]
ggggcgauaccuugggcauc

SEQ ID NO: 1940430 - RNA, 19 nt, Human herpesvirus 4 [Epstein-Barr virus]
gaacacucauggugugaga

SEQ ID NO: 1940431 - RNA, 17 nt, Human herpesvirus 4 [Epstein-Barr virus]
ggacaucauuagcccag

SEQ ID NO: 1940432 - RNA, 20 nt, Human herpesvirus 4 [Epstein-Barr virus]
acaugagaaaauacuucucu

SEQ ID NO: 1940433 - RNA, 18 nt, Human herpesvirus 4 [Epstein-Barr virus]
gaggcugaugauggccac

SEQ ID NO: 1940434 - RNA, 13 nt, Human herpesvirus 4 [Epstein-Barr virus]
ggcaggagcagga

SEQ ID NO: 1940435 - RNA, 18 nt, Human herpesvirus 4 [Epstein-Barr virus]
augucugacgaggggcca

SEQ ID NO: 1940436 - RNA, 14 nt, Human herpesvirus 4 [Epstein-Barr virus]
ggcgacgcggagag

SEQ ID NO: 1940437 - RNA, 21 nt, Human herpesvirus 4 [Epstein-Barr virus]
uuuccugcccucccacuuuua

SEQ ID NO: 1940438 - RNA, 23 nt, Human herpesvirus 4 [Epstein-Barr virus]
ucccagggccggaaccugagccu

SEQ ID NO: 1940439 - RNA, 18 nt, Human herpesvirus 4 [Epstein-Barr virus]
caucgccgccccaggggu

SEQ ID NO: 1940440 - RNA, 22 nt, Human herpesvirus 4 [Epstein-Barr virus]
auucccuaggaauuauuuacca

SEQ ID NO: 1940441 - RNA, 21 nt, Human herpesvirus 4 [Epstein-Barr virus]
cgauggucgucaucuggcucu

SEQ ID NO: 1940442 - RNA, 16 nt, Human herpesvirus 4 [Epstein-Barr virus]
cgugagucugcuggac

SEQ ID NO: 1940443 - RNA, 17 nt, Human herpesvirus 4 [Epstein-Barr virus]
gugcagccuaccgccac

SEQ ID NO: 1940444 - RNA, 22 nt, Human herpesvirus 4 [Epstein-Barr virus]
cuguugcgcccggcccuguaca

SEQ ID NO: 1940445 - RNA, 17 nt, Human herpesvirus 4 [Epstein-Barr virus]
guccaggguccaggaga

SEQ ID NO: 1940446 - RNA, 18 nt, Human herpesvirus 4 [Epstein-Barr virus]
cucuggggucucaggccu

SEQ ID NO: 1940447 - RNA, 18 nt, Human herpesvirus 4 [Epstein-Barr virus]
cuuuuacccccuggccac

SEQ ID NO: 1940448 - RNA, 23 nt, Human herpesvirus 4 [Epstein-Barr virus]
cucaagcuacucaaugagaggga

SEQ ID NO: 1940449 - RNA, 17 nt, Human herpesvirus 4 [Epstein-Barr virus]
cagauagccggccaggc

SEQ ID NO: 1940450 - RNA, 18 nt, Human herpesvirus 4 [Epstein-Barr virus]
ccuacgcugcccuagagg

SEQ ID NO: 1940451 - RNA, 14 nt, Human herpesvirus 4 [Epstein-Barr virus]
cgucacucagcucc

SEQ ID NO: 1940452 - RNA, 15 nt, Human herpesvirus 4 [Epstein-Barr virus]
ucuucauucuugcua

SEQ ID NO: 1940453 - RNA, 23 nt, Human herpesvirus 4 [Epstein-Barr virus]
aaccugagccugagccacaccca

SEQ ID NO: 1940454 - RNA, 13 nt, Human herpesvirus 4 [Epstein-Barr virus]
aggcugagaacug

SEQ ID NO: 1940455 - RNA, 21 nt, Human herpesvirus 4 [Epstein-Barr virus]
agaaggcuccggcggcagugg

SEQ ID NO: 1940456 - RNA, 20 nt, Human herpesvirus 4 [Epstein-Barr virus]
ugagagccaaaaauuugaua

SEQ ID NO: 1940457 - RNA, 18 nt, Human herpesvirus 4 [Epstein-Barr virus]
ugcacccacccccacccu

SEQ ID NO: 1940458 - RNA, 19 nt, Human herpesvirus 4 [Epstein-Barr virus]
gaacaucuggcuggggcau

SEQ ID NO: 1940459 - RNA, 17 nt, Human herpesvirus 4 [Epstein-Barr virus]
caagacucccugacggu

SEQ ID NO: 1940460 - RNA, 13 nt, Human herpesvirus 4 [Epstein-Barr virus]
guguuccacagcc

SEQ ID NO: 1940461 - RNA, 13 nt, Human herpesvirus 4 [Epstein-Barr virus]
gacaagaggcaga

SEQ ID NO: 1940462 - RNA, 23 nt, Human herpesvirus 4 [Epstein-Barr virus]
gcggguggaggagcuccgugagc

SEQ ID NO: 1940463 - RNA, 13 nt, Human herpesvirus 4 [Epstein-Barr virus]
gcccuuugccugg

SEQ ID NO: 1940464 - RNA, 21 nt, Human herpesvirus 4 [Epstein-Barr virus]
ugggcgcgggucccccuagcc

SEQ ID NO: 1940465 - RNA, 16 nt, Human herpesvirus 4 [Epstein-Barr virus]
gacgggguggugccug

SEQ ID NO: 1940466 - RNA, 15 nt, Human herpesvirus 4 [Epstein-Barr virus]
ggaugcaggaccuag

SEQ ID NO: 1940467 - RNA, 17 nt, Human herpesvirus 4 [Epstein-Barr virus]
guggcagccgcggccau

SEQ ID NO: 1940468 - RNA, 19 nt, Human herpesvirus 4 [Epstein-Barr virus]
uggcucgccucauccuggc

SEQ ID NO: 1940469 - RNA, 13 nt, Human herpesvirus 4 [Epstein-Barr virus]
cucgaccagcacg

SEQ ID NO: 1940470 - RNA, 15 nt, Human herpesvirus 4 [Epstein-Barr virus]
caagaggcagagagc

SEQ ID NO: 1940471 - RNA, 16 nt, Human herpesvirus 4 [Epstein-Barr virus]
cacucagacucuccgc

SEQ ID NO: 1940472 - RNA, 22 nt, Human herpesvirus 4 [Epstein-Barr virus]
aggcacaucuggaccuggacug

SEQ ID NO: 1940473 - RNA, 14 nt, Human herpesvirus 4 [Epstein-Barr virus]
auuuacaaacacua

SEQ ID NO: 1940474 - RNA, 22 nt, Human herpesvirus 4 [Epstein-Barr virus]
ggggcuaaccaaggacaacagc

SEQ ID NO: 1940475 - RNA, 18 nt, Human herpesvirus 4 [Epstein-Barr virus]
acgaucuucaagagucuc

SEQ ID NO: 1940476 - RNA, 20 nt, Human herpesvirus 4 [Epstein-Barr virus]
uggggccugugacuggugcu

SEQ ID NO: 1940477 - RNA, 11 nt, Human herpesvirus 4 [Epstein-Barr virus]
ccagaagcccc

SEQ ID NO: 1940478 - RNA, 17 nt, Human herpesvirus 4 [Epstein-Barr virus]
acgugagugacacugau

SEQ ID NO: 1940479 - RNA, 16 nt, Human herpesvirus 4 [Epstein-Barr virus]
cccaucuuggcccguc

SEQ ID NO: 1940480 - RNA, 22 nt, Human herpesvirus 4 [Epstein-Barr virus]
acuagcggcgagacccgaggca

SEQ ID NO: 1940481 - RNA, 14 nt, Human herpesvirus 4 [Epstein-Barr virus]
caggacacgugaca

SEQ ID NO: 1940482 - RNA, 21 nt, Human herpesvirus 4 [Epstein-Barr virus]
ccacgggaugacucaucucaa

SEQ ID NO: 1940483 - RNA, 16 nt, Human herpesvirus 4 [Epstein-Barr virus]
ccaccacgaugacucc

SEQ ID NO: 1940484 - RNA, 18 nt, Human herpesvirus 4 [Epstein-Barr virus]
uggaggcugcgccugagc

SEQ ID NO: 1940485 - RNA, 21 nt, Human herpesvirus 4 [Epstein-Barr virus]
augggggaggagagaccaaga

SEQ ID NO: 1940486 - RNA, 21 nt, Human herpesvirus 4 [Epstein-Barr virus]
ugaccuccuacacguuugccc

SEQ ID NO: 1940487 - RNA, 13 nt, Human herpesvirus 4 [Epstein-Barr virus]
gcagggcaaagcc

SEQ ID NO: 1940488 - RNA, 19 nt, Human herpesvirus 4 [Epstein-Barr virus]
gucccagggccggaaccug

SEQ ID NO: 1940489 - RNA, 18 nt, Human herpesvirus 4 [Epstein-Barr virus]
cagggccaggcgacgcuc

SEQ ID NO: 1940490 - RNA, 18 nt, Human herpesvirus 4 [Epstein-Barr virus]
ccgaggucagaaagaggc

SEQ ID NO: 1940491 - RNA, 20 nt, Human herpesvirus 4 [Epstein-Barr virus]
caagaacccccugcaggaca

SEQ ID NO: 1940492 - RNA, 11 nt, Human herpesvirus 4 [Epstein-Barr virus]
ugcauggccag

SEQ ID NO: 1940493 - RNA, 19 nt, Human herpesvirus 4 [Epstein-Barr virus]
cagaggccaucauggccga

SEQ ID NO: 1940494 - RNA, 15 nt, Human herpesvirus 4 [Epstein-Barr virus]
aggaggggcaggagc

SEQ ID NO: 1940495 - RNA, 14 nt, Human herpesvirus 4 [Epstein-Barr virus]
ccgccaccuccggg

SEQ ID NO: 1940496 - RNA, 17 nt, Human herpesvirus 4 [Epstein-Barr virus]
ccgcguguuugcugcuc

SEQ ID NO: 1940497 - RNA, 22 nt, Human herpesvirus 4 [Epstein-Barr virus]
gggaccggcuacgcgggccaca

SEQ ID NO: 1940498 - RNA, 20 nt, Human herpesvirus 4 [Epstein-Barr virus]
ugucggcuaaugccaugcag

SEQ ID NO: 1940499 - RNA, 15 nt, Human herpesvirus 4 [Epstein-Barr virus]
accucuguuccuucu

SEQ ID NO: 1940500 - RNA, 15 nt, Human herpesvirus 4 [Epstein-Barr virus]
aaugaacccaggggu

SEQ ID NO: 1940501 - RNA, 16 nt, Human herpesvirus 4 [Epstein-Barr virus]
aggauggaaagggcau

SEQ ID NO: 1940502 - RNA, 14 nt, Human herpesvirus 4 [Epstein-Barr virus]
cugacgcuccagga

SEQ ID NO: 1940503 - RNA, 21 nt, Human herpesvirus 4 [Epstein-Barr virus]
agcgaagcuagugcagggggc

SEQ ID NO: 1940504 - RNA, 12 nt, Human herpesvirus 4 [Epstein-Barr virus]
gcucuggcacug

SEQ ID NO: 1940505 - RNA, 21 nt, Human herpesvirus 4 [Epstein-Barr virus]
acaggccgccuauggggccug

SEQ ID NO: 1940506 - RNA, 12 nt, Human herpesvirus 4 [Epstein-Barr virus]
cgcccugucacc

SEQ ID NO: 1940507 - RNA, 23 nt, Human herpesvirus 4 [Epstein-Barr virus]
gcaccuguguccugggcaaggag

SEQ ID NO: 1940508 - RNA, 17 nt, Human herpesvirus 4 [Epstein-Barr virus]
uuacccucauugugcug

SEQ ID NO: 1940509 - RNA, 14 nt, Human herpesvirus 4 [Epstein-Barr virus]
gaugcugcagaggu

SEQ ID NO: 1940510 - RNA, 16 nt, Human herpesvirus 4 [Epstein-Barr virus]
cuccgccaccuccggg

SEQ ID NO: 1940511 - RNA, 15 nt, Human herpesvirus 4 [Epstein-Barr virus]
gccaagacauagaga

SEQ ID NO: 1940512 - RNA, 21 nt, Human herpesvirus 4 [Epstein-Barr virus]
ccuccacuuacaaccaagcca

SEQ ID NO: 1940513 - RNA, 13 nt, Human herpesvirus 4 [Epstein-Barr virus]
acagacccugggc

SEQ ID NO: 1940514 - RNA, 20 nt, Human herpesvirus 4 [Epstein-Barr virus]
gaaagucuauacggccacaa

SEQ ID NO: 1940515 - RNA, 14 nt, Human herpesvirus 4 [Epstein-Barr virus]
gucacagcugcugg

SEQ ID NO: 1940516 - RNA, 16 nt, Human herpesvirus 4 [Epstein-Barr virus]
uagugagccaggcuuu

SEQ ID NO: 1940517 - RNA, 23 nt, Human herpesvirus 4 [Epstein-Barr virus]
ccugcggcccacugaaaaaccag

SEQ ID NO: 1940518 - RNA, 15 nt, Human herpesvirus 4 [Epstein-Barr virus]
uucugcugcugcugg

SEQ ID NO: 1940519 - RNA, 19 nt, Human herpesvirus 4 [Epstein-Barr virus]
aggccccccgcaccagggc

SEQ ID NO: 1940520 - RNA, 16 nt, Human herpesvirus 4 [Epstein-Barr virus]
aucaucgggaaaggcg

SEQ ID NO: 1940521 - RNA, 14 nt, Human herpesvirus 4 [Epstein-Barr virus]
caggucuugccgug

SEQ ID NO: 1940522 - RNA, 19 nt, Human herpesvirus 4 [Epstein-Barr virus]
cgcagaccccagagcagcc

SEQ ID NO: 1940523 - RNA, 12 nt, Human herpesvirus 4 [Epstein-Barr virus]
auccuggccccc

SEQ ID NO: 1940524 - RNA, 21 nt, Human herpesvirus 4 [Epstein-Barr virus]
aggcuacaacaggcugcugaa

SEQ ID NO: 1940525 - RNA, 13 nt, Human herpesvirus 4 [Epstein-Barr virus]
agguugggccacg

SEQ ID NO: 1940526 - RNA, 19 nt, Human herpesvirus 4 [Epstein-Barr virus]
gccuuguucuuugaccuuu

SEQ ID NO: 1940527 - RNA, 17 nt, Human herpesvirus 4 [Epstein-Barr virus]
gguccaggagucugcug

SEQ ID NO: 1940528 - RNA, 16 nt, Human herpesvirus 4 [Epstein-Barr virus]
cugcuauucugagcac

SEQ ID NO: 1940529 - RNA, 13 nt, Human herpesvirus 4 [Epstein-Barr virus]
agucugcuggacu

SEQ ID NO: 1940530 - RNA, 20 nt, Human herpesvirus 4 [Epstein-Barr virus]
uagagugccgggcccgggac

SEQ ID NO: 1940531 - RNA, 13 nt, Human herpesvirus 4 [Epstein-Barr virus]
ccucugggccgcc

SEQ ID NO: 1940532 - RNA, 20 nt, Human herpesvirus 4 [Epstein-Barr virus]
gugguaacaggugggacaaa

SEQ ID NO: 1940533 - RNA, 19 nt, Human herpesvirus 4 [Epstein-Barr virus]
cgccagagacaaggcaggc

SEQ ID NO: 1940534 - RNA, 15 nt, Human herpesvirus 4 [Epstein-Barr virus]
cuccugccugccucu

SEQ ID NO: 1940535 - RNA, 19 nt, Human herpesvirus 4 [Epstein-Barr virus]
ggguauagagcauaugccg

SEQ ID NO: 1940536 - RNA, 14 nt, Human herpesvirus 4 [Epstein-Barr virus]
ugggagcacauucc

SEQ ID NO: 1940537 - RNA, 21 nt, Human herpesvirus 4 [Epstein-Barr virus]
caccagagggugagcccaccu

SEQ ID NO: 1940538 - RNA, 15 nt, Human herpesvirus 4 [Epstein-Barr virus]
ucaggcggaggcacu

SEQ ID NO: 1940539 - RNA, 22 nt, Human herpesvirus 4 [Epstein-Barr virus]
ugauuaggcacuggacacacau

SEQ ID NO: 1940540 - RNA, 18 nt, Human herpesvirus 4 [Epstein-Barr virus]
uaauucucuucuguuugc

SEQ ID NO: 1940541 - RNA, 23 nt, Human herpesvirus 4 [Epstein-Barr virus]
gcuacucuccgccguuccuucag

SEQ ID NO: 1940542 - RNA, 17 nt, Human herpesvirus 4 [Epstein-Barr virus]
aggcauuaccaugucau

SEQ ID NO: 1940543 - RNA, 16 nt, Human herpesvirus 4 [Epstein-Barr virus]
gugucgcguagcucug

SEQ ID NO: 1940544 - RNA, 16 nt, Human herpesvirus 4 [Epstein-Barr virus]
ccugggaggugcugag

SEQ ID NO: 1940545 - RNA, 23 nt, Human herpesvirus 4 [Epstein-Barr virus]
accugacuggcagaaaggcuggc

SEQ ID NO: 1940546 - RNA, 18 nt, Human herpesvirus 4 [Epstein-Barr virus]
gguagugauuuggacccg

SEQ ID NO: 1940547 - RNA, 18 nt, Human herpesvirus 4 [Epstein-Barr virus]
aggccgggagaggcagcc

SEQ ID NO: 1940548 - RNA, 9 nt, Human herpesvirus 4 [Epstein-Barr virus]
cuuccuguc

SEQ ID NO: 1940549 - RNA, 16 nt, Human herpesvirus 4 [Epstein-Barr virus]
gcaggagcaggagggg

SEQ ID NO: 1940550 - RNA, 23 nt, Human herpesvirus 4 [Epstein-Barr virus]
auucuccugccugccucugcucu

SEQ ID NO: 1940551 - RNA, 15 nt, Human herpesvirus 4 [Epstein-Barr virus]
cucccauguaagccu

SEQ ID NO: 1940552 - RNA, 21 nt, Human herpesvirus 4 [Epstein-Barr virus]
ggagauugauuuggaggaaga

SEQ ID NO: 1940553 - RNA, 15 nt, Human herpesvirus 4 [Epstein-Barr virus]
ggcagccuugcgugg

SEQ ID NO: 1940554 - RNA, 24 nt, Human herpesvirus 4 [Epstein-Barr virus]
ccuucgauuuuacgaugaaggagg

SEQ ID NO: 1940555 - RNA, 14 nt, Human herpesvirus 4 [Epstein-Barr virus]
cgccagcagggcac

SEQ ID NO: 1940556 - RNA, 14 nt, Human herpesvirus 4 [Epstein-Barr virus]
augaggagcaggca

SEQ ID NO: 1940557 - RNA, 15 nt, Human herpesvirus 4 [Epstein-Barr virus]
ugucacguguccugc

SEQ ID NO: 1940558 - RNA, 19 nt, Human herpesvirus 4 [Epstein-Barr virus]
agaucaucccacugggacg

SEQ ID NO: 1940559 - RNA, 18 nt, Human herpesvirus 4 [Epstein-Barr virus]
gcauccucaaggggcacg

SEQ ID NO: 1940560 - RNA, 18 nt, Human herpesvirus 4 [Epstein-Barr virus]
cagcuguucccagucucc

SEQ ID NO: 1940561 - RNA, 21 nt, Human herpesvirus 4 [Epstein-Barr virus]
ugggguccaggagucugcugc

SEQ ID NO: 1940562 - RNA, 15 nt, Human herpesvirus 4 [Epstein-Barr virus]
ugucuucccagacuc

SEQ ID NO: 1940563 - RNA, 23 nt, Human herpesvirus 4 [Epstein-Barr virus]
gauaucacacccucggagaucau

SEQ ID NO: 1940564 - RNA, 14 nt, Human herpesvirus 4 [Epstein-Barr virus]
caugagggcaccga

SEQ ID NO: 1940565 - RNA, 17 nt, Human herpesvirus 4 [Epstein-Barr virus]
ugucccuuucagugguc

SEQ ID NO: 1940566 - RNA, 14 nt, Human herpesvirus 4 [Epstein-Barr virus]
uguuucuggaaugc

SEQ ID NO: 1940567 - RNA, 20 nt, Human herpesvirus 4 [Epstein-Barr virus]
gagcuccgagagcuccgcca

SEQ ID NO: 1940568 - RNA, 15 nt, Human herpesvirus 4 [Epstein-Barr virus]
ccaggguccaggaga

SEQ ID NO: 1940569 - RNA, 15 nt, Human herpesvirus 4 [Epstein-Barr virus]
ggcacccccucugag

SEQ ID NO: 1940570 - RNA, 16 nt, Human herpesvirus 4 [Epstein-Barr virus]
ccccagaagcccccaa

SEQ ID NO: 1940571 - RNA, 13 nt, Human herpesvirus 4 [Epstein-Barr virus]
cuugugcuccuga

SEQ ID NO: 1940572 - RNA, 13 nt, Human herpesvirus 4 [Epstein-Barr virus]
ccuucugcugcug

SEQ ID NO: 1940573 - RNA, 13 nt, Human herpesvirus 4 [Epstein-Barr virus]
cugaguucuacaa

SEQ ID NO: 1940574 - RNA, 18 nt, Human herpesvirus 4 [Epstein-Barr virus]
gcauucagauuucuaguu

SEQ ID NO: 1940575 - RNA, 15 nt, Human herpesvirus 4 [Epstein-Barr virus]
aggauaaucaggcga

SEQ ID NO: 1940576 - RNA, 17 nt, Human herpesvirus 4 [Epstein-Barr virus]
gugacauucacugggac

SEQ ID NO: 1940577 - RNA, 15 nt, Human herpesvirus 4 [Epstein-Barr virus]
uggccccuguguaca

SEQ ID NO: 1940578 - RNA, 20 nt, Human herpesvirus 4 [Epstein-Barr virus]
uggcagggggccgggcgcgc

SEQ ID NO: 1940579 - RNA, 20 nt, Human herpesvirus 4 [Epstein-Barr virus]
gguuauaacugccagagcug

SEQ ID NO: 1940580 - RNA, 12 nt, Human herpesvirus 4 [Epstein-Barr virus]
cagagcaaaagc

SEQ ID NO: 1940581 - RNA, 20 nt, Human herpesvirus 4 [Epstein-Barr virus]
uggggauuacccgacccagc

SEQ ID NO: 1940582 - RNA, 21 nt, Human herpesvirus 4 [Epstein-Barr virus]
gaagagccgcuccguggcccc

SEQ ID NO: 1940583 - RNA, 13 nt, Human herpesvirus 4 [Epstein-Barr virus]
ugucccccuagcc

SEQ ID NO: 1940584 - RNA, 19 nt, Human herpesvirus 4 [Epstein-Barr virus]
ggcccacgugaacauccug

SEQ ID NO: 1940585 - RNA, 19 nt, Human herpesvirus 4 [Epstein-Barr virus]
gagcaggaggaggggcagg

SEQ ID NO: 1940586 - RNA, 20 nt, Human herpesvirus 4 [Epstein-Barr virus]
gauacaaaaacuugagucuc

SEQ ID NO: 1940587 - RNA, 19 nt, Human herpesvirus 4 [Epstein-Barr virus]
gagccggggguugcuucau

SEQ ID NO: 1940588 - RNA, 16 nt, Human herpesvirus 4 [Epstein-Barr virus]
ggcccccagcuucuga

SEQ ID NO: 1940589 - RNA, 14 nt, Human herpesvirus 4 [Epstein-Barr virus]
ccacaaaaaaugca

SEQ ID NO: 1940590 - RNA, 15 nt, Human herpesvirus 4 [Epstein-Barr virus]
agggcagcgaagaac

SEQ ID NO: 1940591 - RNA, 14 nt, Human herpesvirus 4 [Epstein-Barr virus]
agacucaggcccuc

SEQ ID NO: 1940592 - RNA, 22 nt, Human herpesvirus 4 [Epstein-Barr virus]
agagucuaucaggaccugggag

SEQ ID NO: 1940593 - RNA, 12 nt, Human herpesvirus 4 [Epstein-Barr virus]
guggagggccga

SEQ ID NO: 1940594 - RNA, 13 nt, Human herpesvirus 4 [Epstein-Barr virus]
auggccugggccc

SEQ ID NO: 1940595 - RNA, 22 nt, Human herpesvirus 4 [Epstein-Barr virus]
gauggcacgguccagaagcaga

SEQ ID NO: 1940596 - RNA, 16 nt, Human herpesvirus 4 [Epstein-Barr virus]
ugcguccucuaccugg

SEQ ID NO: 1940597 - RNA, 20 nt, Human herpesvirus 4 [Epstein-Barr virus]
ugggcaaaacucacaggaca

SEQ ID NO: 1940598 - RNA, 13 nt, Human herpesvirus 4 [Epstein-Barr virus]
ccgcugggccagg

SEQ ID NO: 1940599 - RNA, 18 nt, Human herpesvirus 4 [Epstein-Barr virus]
ucuaacugugucccacuc

SEQ ID NO: 1940600 - RNA, 23 nt, Human herpesvirus 4 [Epstein-Barr virus]
gacuguuuguggcggcaucaugu

SEQ ID NO: 1940601 - RNA, 14 nt, Human herpesvirus 4 [Epstein-Barr virus]
agacggggagguga

SEQ ID NO: 1940602 - RNA, 18 nt, Human herpesvirus 4 [Epstein-Barr virus]
cugagacagaggugcuca

SEQ ID NO: 1940603 - RNA, 14 nt, Human herpesvirus 4 [Epstein-Barr virus]
cgaaagcggcccag

SEQ ID NO: 1940604 - RNA, 21 nt, Human herpesvirus 4 [Epstein-Barr virus]
cagagccccuuuugccccccu

SEQ ID NO: 1940605 - RNA, 17 nt, Human herpesvirus 4 [Epstein-Barr virus]
acuggcacacacucccu

SEQ ID NO: 1940606 - RNA, 19 nt, Human herpesvirus 4 [Epstein-Barr virus]
ucaucucgcuggcucgccu

SEQ ID NO: 1940607 - RNA, 16 nt, Human herpesvirus 4 [Epstein-Barr virus]
gccucgugcaaccagg

SEQ ID NO: 1940608 - RNA, 14 nt, Human herpesvirus 4 [Epstein-Barr virus]
gcagggguggugga

SEQ ID NO: 1940609 - RNA, 16 nt, Human herpesvirus 4 [Epstein-Barr virus]
gccgcgcugcucgccc

SEQ ID NO: 1940610 - RNA, 19 nt, Human herpesvirus 4 [Epstein-Barr virus]
caggcacaucuggcaccug

SEQ ID NO: 1940611 - RNA, 12 nt, Human herpesvirus 4 [Epstein-Barr virus]
agagggaugggc

SEQ ID NO: 1940612 - RNA, 21 nt, Human herpesvirus 4 [Epstein-Barr virus]
acguccgugagagccuaccca

SEQ ID NO: 1940613 - RNA, 13 nt, Human herpesvirus 4 [Epstein-Barr virus]
cccggcggcugcu

SEQ ID NO: 1940614 - RNA, 14 nt, Human herpesvirus 4 [Epstein-Barr virus]
acucugaccaggac

SEQ ID NO: 1940615 - RNA, 19 nt, Human herpesvirus 4 [Epstein-Barr virus]
aucucggcuguuuguacuu

SEQ ID NO: 1940616 - RNA, 15 nt, Human herpesvirus 4 [Epstein-Barr virus]
uuaccagugugccag

SEQ ID NO: 1940617 - RNA, 22 nt, Human herpesvirus 4 [Epstein-Barr virus]
gguaaguuuucccuuccuuuaa

SEQ ID NO: 1940618 - RNA, 14 nt, Human herpesvirus 4 [Epstein-Barr virus]
ugaggugccacaga

SEQ ID NO: 1940619 - RNA, 22 nt, Human herpesvirus 4 [Epstein-Barr virus]
uucccgccuagagcauuugcaa

SEQ ID NO: 1940620 - RNA, 14 nt, Human herpesvirus 4 [Epstein-Barr virus]
cccugacgcugugg

SEQ ID NO: 1940621 - RNA, 23 nt, Human herpesvirus 4 [Epstein-Barr virus]
ccgccgcagaagagccgcuccgu

SEQ ID NO: 1940622 - RNA, 17 nt, Human herpesvirus 4 [Epstein-Barr virus]
agccgucgauaccgggu

SEQ ID NO: 1940623 - RNA, 20 nt, Human herpesvirus 4 [Epstein-Barr virus]
ccguugguggucagcagcag

SEQ ID NO: 1940624 - RNA, 14 nt, Human herpesvirus 4 [Epstein-Barr virus]
cacggaugccuggc

SEQ ID NO: 1940625 - RNA, 16 nt, Human herpesvirus 4 [Epstein-Barr virus]
ccagucaccuuccaga

SEQ ID NO: 1940626 - RNA, 22 nt, Human herpesvirus 4 [Epstein-Barr virus]
gcagauuuccgucagccagggu

SEQ ID NO: 1940627 - RNA, 12 nt, Human herpesvirus 4 [Epstein-Barr virus]
aggagcaggagc

SEQ ID NO: 1940628 - RNA, 15 nt, Human herpesvirus 4 [Epstein-Barr virus]
caccgggaugagcug

SEQ ID NO: 1940629 - RNA, 16 nt, Human herpesvirus 4 [Epstein-Barr virus]
uacuaacacgcaauaa

SEQ ID NO: 1940630 - RNA, 23 nt, Human herpesvirus 4 [Epstein-Barr virus]
auccuagagggacagcugacggu

SEQ ID NO: 1940631 - RNA, 14 nt, Human herpesvirus 4 [Epstein-Barr virus]
caugguguagacag

SEQ ID NO: 1940632 - RNA, 13 nt, Human herpesvirus 4 [Epstein-Barr virus]
ggcugaugauggc

SEQ ID NO: 1940633 - RNA, 12 nt, Human herpesvirus 4 [Epstein-Barr virus]
ggcagaggccuc

SEQ ID NO: 1940634 - RNA, 16 nt, Human herpesvirus 4 [Epstein-Barr virus]
cacucacccccgagga

SEQ ID NO: 1940635 - RNA, 16 nt, Human herpesvirus 4 [Epstein-Barr virus]
ccuagguacucuuggu

SEQ ID NO: 1940636 - RNA, 13 nt, Human herpesvirus 4 [Epstein-Barr virus]
caucuaaggucca

SEQ ID NO: 1940637 - RNA, 16 nt, Human herpesvirus 4 [Epstein-Barr virus]
cauugacccgaggauc

SEQ ID NO: 1940638 - RNA, 16 nt, Human herpesvirus 4 [Epstein-Barr virus]
uaaccuaugccuggaa

SEQ ID NO: 1940639 - RNA, 18 nt, Human herpesvirus 4 [Epstein-Barr virus]
gcccagggacauccccag

SEQ ID NO: 1940640 - RNA, 18 nt, Human herpesvirus 4 [Epstein-Barr virus]
ccuugggugaccuggcca

SEQ ID NO: 1940641 - RNA, 16 nt, Human herpesvirus 4 [Epstein-Barr virus]
cacagaggaggcuggu

SEQ ID NO: 1940642 - RNA, 13 nt, Human herpesvirus 4 [Epstein-Barr virus]
guggccaggcccg

SEQ ID NO: 1940643 - RNA, 20 nt, Human herpesvirus 4 [Epstein-Barr virus]
auucccucgaaucccuacca

SEQ ID NO: 1940644 - RNA, 17 nt, Human herpesvirus 4 [Epstein-Barr virus]
cuggccgccggauggcc

SEQ ID NO: 1940645 - RNA, 13 nt, Human herpesvirus 4 [Epstein-Barr virus]
aagguccaucccg

SEQ ID NO: 1940646 - RNA, 13 nt, Human herpesvirus 4 [Epstein-Barr virus]
ugcugccuggggg

SEQ ID NO: 1940647 - RNA, 15 nt, Human herpesvirus 4 [Epstein-Barr virus]
gugaggcggugccug

SEQ ID NO: 1940648 - RNA, 18 nt, Human herpesvirus 4 [Epstein-Barr virus]
agagauuucauccucaga

SEQ ID NO: 1940649 - RNA, 14 nt, Human herpesvirus 4 [Epstein-Barr virus]
uaauaaauaucuuc

SEQ ID NO: 1940650 - RNA, 19 nt, Human herpesvirus 4 [Epstein-Barr virus]
aucgcugguggcaguauuu

SEQ ID NO: 1940651 - RNA, 11 nt, Human herpesvirus 4 [Epstein-Barr virus]
cuuggaccaag

SEQ ID NO: 1940652 - RNA, 22 nt, Human herpesvirus 4 [Epstein-Barr virus]
gucccccuccauuccacccacu

SEQ ID NO: 1940653 - RNA, 14 nt, Human herpesvirus 4 [Epstein-Barr virus]
cagcgccagcaggg

SEQ ID NO: 1940654 - RNA, 18 nt, Human herpesvirus 4 [Epstein-Barr virus]
cauggagagguuugagaa

SEQ ID NO: 1940655 - RNA, 21 nt, Human herpesvirus 4 [Epstein-Barr virus]
caagaguuuaagcagcacuga

SEQ ID NO: 1940656 - RNA, 20 nt, Human herpesvirus 4 [Epstein-Barr virus]
cugagaccucuguguccaag

SEQ ID NO: 1940657 - RNA, 15 nt, Human herpesvirus 4 [Epstein-Barr virus]
acccagcccucgaga

SEQ ID NO: 1940658 - RNA, 14 nt, Human herpesvirus 4 [Epstein-Barr virus]
cagaaaagugagcc

SEQ ID NO: 1940659 - RNA, 12 nt, Human herpesvirus 4 [Epstein-Barr virus]
augggugcauuu

SEQ ID NO: 1940660 - RNA, 23 nt, Human herpesvirus 4 [Epstein-Barr virus]
ccuggagagcaugcaggucaggu

SEQ ID NO: 1940661 - RNA, 22 nt, Human herpesvirus 4 [Epstein-Barr virus]
ggguaggccauacgucuagcca

SEQ ID NO: 1940662 - RNA, 12 nt, Human herpesvirus 4 [Epstein-Barr virus]
gccacacccacc

SEQ ID NO: 1940663 - RNA, 21 nt, Human herpesvirus 4 [Epstein-Barr virus]
aauguuccuucucaugcuccu

SEQ ID NO: 1940664 - RNA, 22 nt, Human herpesvirus 4 [Epstein-Barr virus]
cugauaaugucuucaauagaca

SEQ ID NO: 1940665 - RNA, 12 nt, Human herpesvirus 4 [Epstein-Barr virus]
ugguugucuucc

SEQ ID NO: 1940666 - RNA, 22 nt, Human herpesvirus 4 [Epstein-Barr virus]
cuuaaaaaugugcagcuucucc

SEQ ID NO: 1940667 - RNA, 17 nt, Human herpesvirus 4 [Epstein-Barr virus]
cucgcucagagcuggga

SEQ ID NO: 1940668 - RNA, 14 nt, Human herpesvirus 4 [Epstein-Barr virus]
gcaucagaugagac

SEQ ID NO: 1940669 - RNA, 15 nt, Human herpesvirus 4 [Epstein-Barr virus]
uaacgggaagugugu

SEQ ID NO: 1940670 - RNA, 14 nt, Human herpesvirus 4 [Epstein-Barr virus]
ccucgugcaccuau

SEQ ID NO: 1940671 - RNA, 13 nt, Human herpesvirus 4 [Epstein-Barr virus]
acauggggcauua

SEQ ID NO: 1940672 - RNA, 16 nt, Human herpesvirus 4 [Epstein-Barr virus]
ggcgggaauggccgcc

SEQ ID NO: 1940673 - RNA, 16 nt, Human herpesvirus 4 [Epstein-Barr virus]
cagccgcggccaucac

SEQ ID NO: 1940674 - RNA, 14 nt, Human herpesvirus 4 [Epstein-Barr virus]
ccuggcggcccagc

SEQ ID NO: 1940675 - RNA, 18 nt, Human herpesvirus 4 [Epstein-Barr virus]
acaucuggaccuggacug

SEQ ID NO: 1940676 - RNA, 20 nt, Human herpesvirus 4 [Epstein-Barr virus]
cacgcuuuugucugccugga

SEQ ID NO: 1940677 - RNA, 13 nt, Human herpesvirus 4 [Epstein-Barr virus]
gguguccagcgcu

SEQ ID NO: 1940678 - RNA, 20 nt, Human herpesvirus 4 [Epstein-Barr virus]
cccggguacccuuucuacca

SEQ ID NO: 1940679 - RNA, 15 nt, Human herpesvirus 4 [Epstein-Barr virus]
ccacccccaccaccu

SEQ ID NO: 1940680 - RNA, 19 nt, Human herpesvirus 4 [Epstein-Barr virus]
cucagccugcuccugagaa

SEQ ID NO: 1940681 - RNA, 14 nt, Human herpesvirus 4 [Epstein-Barr virus]
ucgacgcuguuuug

SEQ ID NO: 1940682 - RNA, 23 nt, Human herpesvirus 4 [Epstein-Barr virus]
agcuccagggacagggcgcugca

SEQ ID NO: 1940683 - RNA, 24 nt, Human herpesvirus 4 [Epstein-Barr virus]
ccuguuccggccucgguggcagug

SEQ ID NO: 1940684 - RNA, 18 nt, Human herpesvirus 4 [Epstein-Barr virus]
agaugaagacgaggagau

SEQ ID NO: 1940685 - RNA, 13 nt, Human herpesvirus 4 [Epstein-Barr virus]
gccuggacugugg

SEQ ID NO: 1940686 - RNA, 13 nt, Human herpesvirus 4 [Epstein-Barr virus]
uauuuugggccag

SEQ ID NO: 1940687 - RNA, 20 nt, Human herpesvirus 4 [Epstein-Barr virus]
cugggaugaacccuggggca

SEQ ID NO: 1940688 - RNA, 15 nt, Human herpesvirus 4 [Epstein-Barr virus]
auccuaggcacggcc

SEQ ID NO: 1940689 - RNA, 16 nt, Human herpesvirus 4 [Epstein-Barr virus]
acgguggaacaggagc

SEQ ID NO: 1940690 - RNA, 23 nt, Human herpesvirus 4 [Epstein-Barr virus]
ccugagaaugcuuaucaagcuua

SEQ ID NO: 1940691 - RNA, 16 nt, Human herpesvirus 4 [Epstein-Barr virus]
cccucauugugcugaa

SEQ ID NO: 1940692 - RNA, 18 nt, Human herpesvirus 4 [Epstein-Barr virus]
cuggcaaagauccccagu

SEQ ID NO: 1940693 - RNA, 15 nt, Human herpesvirus 4 [Epstein-Barr virus]
cgcgacauguuucug

SEQ ID NO: 1940694 - RNA, 14 nt, Human herpesvirus 4 [Epstein-Barr virus]
ugagagccuaccca

SEQ ID NO: 1940695 - RNA, 14 nt, Human herpesvirus 4 [Epstein-Barr virus]
cggaguugagcccg

SEQ ID NO: 1940696 - RNA, 21 nt, Human herpesvirus 4 [Epstein-Barr virus]
cuagcuauaaaagaggccggg

SEQ ID NO: 1940697 - RNA, 14 nt, Human herpesvirus 4 [Epstein-Barr virus]
caacauuaaagccu

SEQ ID NO: 1940698 - RNA, 17 nt, Human herpesvirus 4 [Epstein-Barr virus]
acgguggaacaggagca

SEQ ID NO: 1940699 - RNA, 19 nt, Human herpesvirus 4 [Epstein-Barr virus]
gccucaaaguccugcacua

SEQ ID NO: 1940700 - RNA, 15 nt, Human herpesvirus 4 [Epstein-Barr virus]
ccucacgaccugugu

SEQ ID NO: 1940701 - RNA, 16 nt, Human herpesvirus 4 [Epstein-Barr virus]
uccauucccagcccca

SEQ ID NO: 1940702 - RNA, 13 nt, Human herpesvirus 4 [Epstein-Barr virus]
cccagcagaucca

SEQ ID NO: 1940703 - RNA, 18 nt, Human herpesvirus 4 [Epstein-Barr virus]
caacagcuagcagacauu

SEQ ID NO: 1940704 - RNA, 14 nt, Human herpesvirus 4 [Epstein-Barr virus]
cagggcagagaggc

SEQ ID NO: 1940705 - RNA, 21 nt, Human herpesvirus 4 [Epstein-Barr virus]
ccuggcuguacgccgccgcca

SEQ ID NO: 1940706 - RNA, 16 nt, Human herpesvirus 4 [Epstein-Barr virus]
ucuuccccugcagagu

SEQ ID NO: 1940707 - RNA, 17 nt, Human herpesvirus 4 [Epstein-Barr virus]
cggggagaacgguggcc

SEQ ID NO: 1940708 - RNA, 15 nt, Human herpesvirus 4 [Epstein-Barr virus]
ugccaauccaugcca

SEQ ID NO: 1940709 - RNA, 21 nt, Human herpesvirus 4 [Epstein-Barr virus]
agggcagacaccaccugcucg

SEQ ID NO: 1940710 - RNA, 17 nt, Human herpesvirus 4 [Epstein-Barr virus]
acugccuggggaaaaug

SEQ ID NO: 1940711 - RNA, 17 nt, Human herpesvirus 4 [Epstein-Barr virus]
cggaagaccaggagccc

SEQ ID NO: 1940712 - RNA, 17 nt, Human herpesvirus 4 [Epstein-Barr virus]
aagcuuuugaccaagcu

SEQ ID NO: 1940713 - RNA, 21 nt, Human herpesvirus 4 [Epstein-Barr virus]
ugucauaaccuggagucugca

SEQ ID NO: 1940714 - RNA, 12 nt, Human herpesvirus 4 [Epstein-Barr virus]
ugaacaccacca

SEQ ID NO: 1940715 - RNA, 17 nt, Human herpesvirus 4 [Epstein-Barr virus]
cuccucaaauguuccag

SEQ ID NO: 1940716 - RNA, 21 nt, Human herpesvirus 4 [Epstein-Barr virus]
gggcuggugggcucccucugg

SEQ ID NO: 1940717 - RNA, 22 nt, Human herpesvirus 4 [Epstein-Barr virus]
uuugggcacacuuaacuugacu

SEQ ID NO: 1940718 - RNA, 13 nt, Human herpesvirus 4 [Epstein-Barr virus]
ugcaccagcucca

SEQ ID NO: 1940719 - RNA, 19 nt, Human herpesvirus 4 [Epstein-Barr virus]
cucaaacggggaaggagga

SEQ ID NO: 1940720 - RNA, 23 nt, Human herpesvirus 4 [Epstein-Barr virus]
agagguuuugcuagggaggagac

SEQ ID NO: 1940721 - RNA, 18 nt, Human herpesvirus 4 [Epstein-Barr virus]
guggucuuagggcgccag

SEQ ID NO: 1940722 - RNA, 12 nt, Human herpesvirus 4 [Epstein-Barr virus]
uggcggcccagc

SEQ ID NO: 1940723 - RNA, 17 nt, Human herpesvirus 4 [Epstein-Barr virus]
gaagauugucacagcug

SEQ ID NO: 1940724 - RNA, 15 nt, Human herpesvirus 4 [Epstein-Barr virus]
caccccacacucccu

SEQ ID NO: 1940725 - RNA, 13 nt, Human herpesvirus 4 [Epstein-Barr virus]
ugaggugggcuga

SEQ ID NO: 1940726 - RNA, 13 nt, Human herpesvirus 4 [Epstein-Barr virus]
ccaucagcucgcc

SEQ ID NO: 1940727 - RNA, 16 nt, Human herpesvirus 4 [Epstein-Barr virus]
agcaccucaaccugga

SEQ ID NO: 1940728 - RNA, 16 nt, Human herpesvirus 4 [Epstein-Barr virus]
ugacuaggcaccacuu

SEQ ID NO: 1940729 - RNA, 19 nt, Human herpesvirus 4 [Epstein-Barr virus]
ccagucaccuuccagacua

SEQ ID NO: 1940730 - RNA, 23 nt, Human herpesvirus 4 [Epstein-Barr virus]
gguccuccacggggacacgcucc

SEQ ID NO: 1940731 - RNA, 14 nt, Human herpesvirus 4 [Epstein-Barr virus]
cuacaggcccgggc

SEQ ID NO: 1940732 - RNA, 14 nt, Human herpesvirus 4 [Epstein-Barr virus]
cccaccagccagcg

SEQ ID NO: 1940733 - RNA, 23 nt, Human herpesvirus 4 [Epstein-Barr virus]
ccagcaacagaucuugcugaggu

SEQ ID NO: 1940734 - RNA, 18 nt, Human herpesvirus 4 [Epstein-Barr virus]
uucuuagaugaggagcag

SEQ ID NO: 1940735 - RNA, 20 nt, Human herpesvirus 4 [Epstein-Barr virus]
uuccagacuaugcauacacu

SEQ ID NO: 1940736 - RNA, 18 nt, Human herpesvirus 4 [Epstein-Barr virus]
cagcagauccagggcccg

SEQ ID NO: 1940737 - RNA, 17 nt, Human herpesvirus 4 [Epstein-Barr virus]
uucccggacaauacacc

SEQ ID NO: 1940738 - RNA, 21 nt, Human herpesvirus 4 [Epstein-Barr virus]
gggcugguuggggagcuacag

SEQ ID NO: 1940739 - RNA, 17 nt, Human herpesvirus 4 [Epstein-Barr virus]
gacguguguggcuguag

SEQ ID NO: 1940740 - RNA, 19 nt, Human herpesvirus 4 [Epstein-Barr virus]
ugaggcugaugauggccac

SEQ ID NO: 1940741 - RNA, 15 nt, Human herpesvirus 4 [Epstein-Barr virus]
ugcucucgcacucuu

SEQ ID NO: 1940742 - RNA, 19 nt, Human herpesvirus 4 [Epstein-Barr virus]
cuuuugcaacgccuuuuuc

SEQ ID NO: 1940743 - RNA, 21 nt, Human herpesvirus 4 [Epstein-Barr virus]
ccccuccgagugaccagucac

SEQ ID NO: 1940744 - RNA, 21 nt, Human herpesvirus 4 [Epstein-Barr virus]
ggcgacuuuguuuagggacag

SEQ ID NO: 1940745 - RNA, 19 nt, Human herpesvirus 4 [Epstein-Barr virus]
ccuagugguuucggacaca

SEQ ID NO: 1940746 - RNA, 23 nt, Human herpesvirus 4 [Epstein-Barr virus]
uggauugcugaacuggggcuggu

SEQ ID NO: 1940747 - RNA, 22 nt, Human herpesvirus 4 [Epstein-Barr virus]
gagcggggagauaauguacaga

SEQ ID NO: 1940748 - RNA, 19 nt, Human herpesvirus 4 [Epstein-Barr virus]
ccaggcuuucuaugccuga

SEQ ID NO: 1940749 - RNA, 17 nt, Human herpesvirus 4 [Epstein-Barr virus]
cucugauggccuggaga

SEQ ID NO: 1940750 - RNA, 20 nt, Human herpesvirus 4 [Epstein-Barr virus]
ccagcagauccagggcccgu

SEQ ID NO: 1940751 - RNA, 22 nt, Human herpesvirus 4 [Epstein-Barr virus]
ucgcccacacagcgccagcagg

SEQ ID NO: 1940752 - RNA, 14 nt, Human herpesvirus 4 [Epstein-Barr virus]
cgcucccgggcaaa

SEQ ID NO: 1940753 - RNA, 17 nt, Human herpesvirus 4 [Epstein-Barr virus]
gugugcucuuucuucau

SEQ ID NO: 1940754 - RNA, 22 nt, Human herpesvirus 4 [Epstein-Barr virus]
agggagacacaucuggaccaga

SEQ ID NO: 1940755 - RNA, 19 nt, Human herpesvirus 4 [Epstein-Barr virus]
gguggaacaggagcaggag

SEQ ID NO: 1940756 - RNA, 23 nt, Human herpesvirus 4 [Epstein-Barr virus]
agcucuaacuuggcaucucuuuu

SEQ ID NO: 1940757 - RNA, 22 nt, Human herpesvirus 4 [Epstein-Barr virus]
cgcgccgcaagcaugggcgagg

SEQ ID NO: 1940758 - RNA, 19 nt, Human herpesvirus 4 [Epstein-Barr virus]
cggcucaggaucagggcca

SEQ ID NO: 1940759 - RNA, 21 nt, Human herpesvirus 4 [Epstein-Barr virus]
cacgugaacauccugcguggc

SEQ ID NO: 1940760 - RNA, 20 nt, Human herpesvirus 4 [Epstein-Barr virus]
cugauaaaguuguccugggc

SEQ ID NO: 1940761 - RNA, 18 nt, Human herpesvirus 4 [Epstein-Barr virus]
gcgucaggagacacggcu

SEQ ID NO: 1940762 - RNA, 20 nt, Human herpesvirus 4 [Epstein-Barr virus]
gcucuucgugcucuucaugu

SEQ ID NO: 1940763 - RNA, 16 nt, Human herpesvirus 4 [Epstein-Barr virus]
cucuacgccaggcucg

SEQ ID NO: 1940764 - RNA, 19 nt, Human herpesvirus 4 [Epstein-Barr virus]
caauaaauaaaaguacaga

SEQ ID NO: 1940765 - RNA, 17 nt, Human herpesvirus 4 [Epstein-Barr virus]
gaguucuacaaugccag

SEQ ID NO: 1940766 - RNA, 18 nt, Human herpesvirus 4 [Epstein-Barr virus]
ggaacuggcucagcuugg

SEQ ID NO: 1940767 - RNA, 22 nt, Human herpesvirus 4 [Epstein-Barr virus]
uguucucgugcaagcagcaccu

SEQ ID NO: 1940768 - RNA, 11 nt, Human herpesvirus 4 [Epstein-Barr virus]
uugaggaccca

SEQ ID NO: 1940769 - RNA, 16 nt, Human herpesvirus 4 [Epstein-Barr virus]
gccccgguccccccag

SEQ ID NO: 1940770 - RNA, 14 nt, Human herpesvirus 4 [Epstein-Barr virus]
gucuuguaaaacuu

SEQ ID NO: 1940771 - RNA, 19 nt, Human herpesvirus 4 [Epstein-Barr virus]
gacaaaauggggucugugg

SEQ ID NO: 1940772 - RNA, 17 nt, Human herpesvirus 4 [Epstein-Barr virus]
gaccucauccugcucau

SEQ ID NO: 1940773 - RNA, 15 nt, Human herpesvirus 4 [Epstein-Barr virus]
uuucagcaucacagg

SEQ ID NO: 1940774 - RNA, 19 nt, Human herpesvirus 4 [Epstein-Barr virus]
aggacccccgcgucacugu

SEQ ID NO: 1940775 - RNA, 14 nt, Human herpesvirus 4 [Epstein-Barr virus]
cccacucuugccuc

SEQ ID NO: 1940776 - RNA, 15 nt, Human herpesvirus 4 [Epstein-Barr virus]
acgccaaugccaacu

SEQ ID NO: 1940777 - RNA, 22 nt, Human herpesvirus 4 [Epstein-Barr virus]
acucacccccgaggagagggga

SEQ ID NO: 1940778 - RNA, 13 nt, Human herpesvirus 4 [Epstein-Barr virus]
cuuaugcagcacc

SEQ ID NO: 1940779 - RNA, 12 nt, Human herpesvirus 4 [Epstein-Barr virus]
caguauguacag

SEQ ID NO: 1940780 - RNA, 13 nt, Human herpesvirus 4 [Epstein-Barr virus]
gguaaaugcaccu

SEQ ID NO: 1940781 - RNA, 19 nt, Human herpesvirus 4 [Epstein-Barr virus]
uacccuuucuaccaggggc

SEQ ID NO: 1940782 - RNA, 16 nt, Human herpesvirus 4 [Epstein-Barr virus]
gaccaauacccaggau

SEQ ID NO: 1940783 - RNA, 12 nt, Human herpesvirus 4 [Epstein-Barr virus]
acgccaaugcca

SEQ ID NO: 1940784 - RNA, 23 nt, Human herpesvirus 4 [Epstein-Barr virus]
gucucaugggggaaugagggaaa

SEQ ID NO: 1940785 - RNA, 22 nt, Human herpesvirus 4 [Epstein-Barr virus]
cuucagcaguagcuugggaaca

SEQ ID NO: 1940786 - RNA, 13 nt, Human herpesvirus 4 [Epstein-Barr virus]
ccccuaggccugc

SEQ ID NO: 1940787 - RNA, 23 nt, Human herpesvirus 4 [Epstein-Barr virus]
agcuucagggaaaaacuggccau

SEQ ID NO: 1940788 - RNA, 20 nt, Human herpesvirus 4 [Epstein-Barr virus]
gauguccuggccgggcgccu

SEQ ID NO: 1940789 - RNA, 22 nt, Human herpesvirus 4 [Epstein-Barr virus]
gcagacuccgaauauccccaaa

SEQ ID NO: 1940790 - RNA, 13 nt, Human herpesvirus 4 [Epstein-Barr virus]
cgagcaugagcuc

SEQ ID NO: 1940791 - RNA, 15 nt, Human herpesvirus 4 [Epstein-Barr virus]
aggggggaccuuaac

SEQ ID NO: 1940792 - RNA, 14 nt, Human herpesvirus 4 [Epstein-Barr virus]
uggcacgacuguuc

SEQ ID NO: 1940793 - RNA, 17 nt, Human herpesvirus 4 [Epstein-Barr virus]
gcugcugcuacuggcuu

SEQ ID NO: 1940794 - RNA, 23 nt, Human herpesvirus 4 [Epstein-Barr virus]
caagccgggggagaagcaccuca

SEQ ID NO: 1940795 - RNA, 15 nt, Human herpesvirus 4 [Epstein-Barr virus]
acuccacagauggag

SEQ ID NO: 1940796 - RNA, 14 nt, Human herpesvirus 4 [Epstein-Barr virus]
uccgugggcccaga

SEQ ID NO: 1940797 - RNA, 20 nt, Human herpesvirus 4 [Epstein-Barr virus]
ccuccaacaggugcccgagc

SEQ ID NO: 1940798 - RNA, 23 nt, Human herpesvirus 4 [Epstein-Barr virus]
gccguccucuggacgcugguacc

SEQ ID NO: 1940799 - RNA, 18 nt, Human herpesvirus 4 [Epstein-Barr virus]
aggagacacggcucuguc

SEQ ID NO: 1940800 - RNA, 13 nt, Human herpesvirus 4 [Epstein-Barr virus]
cucugcauggaga

SEQ ID NO: 1940801 - RNA, 15 nt, Human herpesvirus 4 [Epstein-Barr virus]
gaaagcggcccagca

SEQ ID NO: 1940802 - RNA, 16 nt, Human herpesvirus 4 [Epstein-Barr virus]
ccguggccaggcccga

SEQ ID NO: 1940803 - RNA, 20 nt, Human herpesvirus 4 [Epstein-Barr virus]
gcggggcuccccagccacag

SEQ ID NO: 1940804 - RNA, 16 nt, Human herpesvirus 4 [Epstein-Barr virus]
cccagcccgccagcca

SEQ ID NO: 1940805 - RNA, 17 nt, Human herpesvirus 4 [Epstein-Barr virus]
cuaacacgaaugcccag

SEQ ID NO: 1940806 - RNA, 20 nt, Human herpesvirus 4 [Epstein-Barr virus]
cugccaacuuugagcugggc

SEQ ID NO: 1940807 - RNA, 15 nt, Human herpesvirus 4 [Epstein-Barr virus]
gaggcauaacggugg

SEQ ID NO: 1940808 - RNA, 15 nt, Human herpesvirus 4 [Epstein-Barr virus]
cgagcucuccagcca

SEQ ID NO: 1940809 - RNA, 21 nt, Human herpesvirus 4 [Epstein-Barr virus]
cacuugguaaguuuucccuuc

SEQ ID NO: 1940810 - RNA, 18 nt, Human herpesvirus 4 [Epstein-Barr virus]
uggaugcaucuaaggucc

SEQ ID NO: 1940811 - RNA, 20 nt, Human herpesvirus 4 [Epstein-Barr virus]
uggccuuccucugccuggcc

SEQ ID NO: 1940812 - RNA, 17 nt, Human herpesvirus 4 [Epstein-Barr virus]
gacugcgaucuggaccc

SEQ ID NO: 1940813 - RNA, 15 nt, Human herpesvirus 4 [Epstein-Barr virus]
caauggucgccaggg

SEQ ID NO: 1940814 - RNA, 16 nt, Human herpesvirus 4 [Epstein-Barr virus]
gccugaguccaacauu

SEQ ID NO: 1940815 - RNA, 16 nt, Human herpesvirus 4 [Epstein-Barr virus]
guccuugucugcugcc

SEQ ID NO: 1940816 - RNA, 20 nt, Human herpesvirus 4 [Epstein-Barr virus]
agcucugcacaggcuuggaa

SEQ ID NO: 1940817 - RNA, 11 nt, Human herpesvirus 4 [Epstein-Barr virus]
cucacaggaca

SEQ ID NO: 1940818 - RNA, 14 nt, Human herpesvirus 4 [Epstein-Barr virus]
ggugguggcagcag

SEQ ID NO: 1940819 - RNA, 18 nt, Human herpesvirus 4 [Epstein-Barr virus]
gccugcggacucaggcca

SEQ ID NO: 1940820 - RNA, 17 nt, Human herpesvirus 4 [Epstein-Barr virus]
ugggguccggucuugca

SEQ ID NO: 1940821 - RNA, 15 nt, Human herpesvirus 4 [Epstein-Barr virus]
ggccaugcgcuuugu

SEQ ID NO: 1940822 - RNA, 23 nt, Human herpesvirus 4 [Epstein-Barr virus]
cgcaggccccccgcaccagggcc

SEQ ID NO: 1940823 - RNA, 13 nt, Human herpesvirus 4 [Epstein-Barr virus]
caggcccccagcu

SEQ ID NO: 1940824 - RNA, 16 nt, Human herpesvirus 4 [Epstein-Barr virus]
cccaugccuccccagc

SEQ ID NO: 1940825 - RNA, 22 nt, Human herpesvirus 4 [Epstein-Barr virus]
cgcucuguuugaaacacaguuu

SEQ ID NO: 1940826 - RNA, 13 nt, Human herpesvirus 4 [Epstein-Barr virus]
caacagccagaau

SEQ ID NO: 1940827 - RNA, 17 nt, Human herpesvirus 4 [Epstein-Barr virus]
ccucuccauucccagcc

SEQ ID NO: 1940828 - RNA, 15 nt, Human herpesvirus 4 [Epstein-Barr virus]
ucguagagaucaggc

SEQ ID NO: 1940829 - RNA, 21 nt, Human herpesvirus 4 [Epstein-Barr virus]
caguugaaauaucuagcacgg

SEQ ID NO: 1940830 - RNA, 18 nt, Human herpesvirus 4 [Epstein-Barr virus]
ggccuccuggccagcacc

SEQ ID NO: 1940831 - RNA, 17 nt, Human herpesvirus 4 [Epstein-Barr virus]
acagucccgagaccggc

SEQ ID NO: 1940832 - RNA, 23 nt, Human herpesvirus 4 [Epstein-Barr virus]
ccgacuuauggcuagauuuccua

SEQ ID NO: 1940833 - RNA, 21 nt, Human herpesvirus 4 [Epstein-Barr virus]
agcccaagaagaagcccaccu

SEQ ID NO: 1940834 - RNA, 23 nt, Human herpesvirus 4 [Epstein-Barr virus]
gaacacggcaccgucagccacac

SEQ ID NO: 1940835 - RNA, 14 nt, Human herpesvirus 4 [Epstein-Barr virus]
agggcgccaucuag

SEQ ID NO: 1940836 - RNA, 16 nt, Human herpesvirus 4 [Epstein-Barr virus]
ggaaggaaaggccugc

SEQ ID NO: 1940837 - RNA, 17 nt, Human herpesvirus 4 [Epstein-Barr virus]
ucucuggcugugcugac

SEQ ID NO: 1940838 - RNA, 23 nt, Human herpesvirus 4 [Epstein-Barr virus]
aggcauuuuuggugcugccuggg

SEQ ID NO: 1940839 - RNA, 15 nt, Human herpesvirus 4 [Epstein-Barr virus]
cugauaaugucuuca

SEQ ID NO: 1940840 - RNA, 16 nt, Human herpesvirus 4 [Epstein-Barr virus]
cacggucauucugccg

SEQ ID NO: 1940841 - RNA, 19 nt, Human herpesvirus 4 [Epstein-Barr virus]
agggggacaagagcacaaa

SEQ ID NO: 1940842 - RNA, 21 nt, Human herpesvirus 4 [Epstein-Barr virus]
gaaacaggagauuggugugaa

SEQ ID NO: 1940843 - RNA, 22 nt, Human herpesvirus 4 [Epstein-Barr virus]
augcaauaaauaaaaguacaga

SEQ ID NO: 1940844 - RNA, 17 nt, Human herpesvirus 4 [Epstein-Barr virus]
uaucccugcugucucug

SEQ ID NO: 1940845 - RNA, 22 nt, Human herpesvirus 4 [Epstein-Barr virus]
aggagaaaaucugcuucucccc

SEQ ID NO: 1940846 - RNA, 18 nt, Human herpesvirus 4 [Epstein-Barr virus]
aauuguuaguuuaaacag

SEQ ID NO: 1940847 - RNA, 17 nt, Human herpesvirus 4 [Epstein-Barr virus]
caaugccaacuccccca

SEQ ID NO: 1940848 - RNA, 23 nt, Human herpesvirus 4 [Epstein-Barr virus]
cagagggcgaaugggcugcagca

SEQ ID NO: 1940849 - RNA, 13 nt, Human herpesvirus 4 [Epstein-Barr virus]
ugcugcagcacua

SEQ ID NO: 1940850 - RNA, 15 nt, Human herpesvirus 4 [Epstein-Barr virus]
agcuggccaggcugg

SEQ ID NO: 1940851 - RNA, 22 nt, Human herpesvirus 4 [Epstein-Barr virus]
ucaggcgacaguaacacagggu

SEQ ID NO: 1940852 - RNA, 13 nt, Human herpesvirus 4 [Epstein-Barr virus]
caggaacagccuc

SEQ ID NO: 1940853 - RNA, 22 nt, Human herpesvirus 4 [Epstein-Barr virus]
gagacguguguggcuguagcca

SEQ ID NO: 1940854 - RNA, 15 nt, Human herpesvirus 4 [Epstein-Barr virus]
ucccaaauaaauguu

SEQ ID NO: 1940855 - RNA, 21 nt, Human herpesvirus 4 [Epstein-Barr virus]
ccgcagaagagccgcuccgug

SEQ ID NO: 1940856 - RNA, 20 nt, Human herpesvirus 4 [Epstein-Barr virus]
ccuguggccccggcuggcca

SEQ ID NO: 1940857 - RNA, 16 nt, Human herpesvirus 4 [Epstein-Barr virus]
uggaaaagggcccagg

SEQ ID NO: 1940858 - RNA, 15 nt, Human herpesvirus 4 [Epstein-Barr virus]
ugcacggcccuccag

SEQ ID NO: 1940859 - RNA, 16 nt, Human herpesvirus 4 [Epstein-Barr virus]
ccccugccugcaugcu

SEQ ID NO: 1940860 - RNA, 19 nt, Human herpesvirus 4 [Epstein-Barr virus]
uaacggggaaugugugaca

SEQ ID NO: 1940861 - RNA, 18 nt, Human herpesvirus 4 [Epstein-Barr virus]
gacgccaaugccaacucc

SEQ ID NO: 1940862 - RNA, 23 nt, Human herpesvirus 4 [Epstein-Barr virus]
caugcuccuauggacacuuggua

SEQ ID NO: 1940863 - RNA, 13 nt, Human herpesvirus 4 [Epstein-Barr virus]
accagcugguggu

SEQ ID NO: 1940864 - RNA, 15 nt, Human herpesvirus 4 [Epstein-Barr virus]
cucccgcacccucaa

SEQ ID NO: 1940865 - RNA, 19 nt, Human herpesvirus 4 [Epstein-Barr virus]
aggucugacacccacgccu

SEQ ID NO: 1940866 - RNA, 19 nt, Human herpesvirus 4 [Epstein-Barr virus]
cgggcccagcccuccucag

SEQ ID NO: 1940867 - RNA, 13 nt, Human herpesvirus 4 [Epstein-Barr virus]
cgcucagagcugg

SEQ ID NO: 1940868 - RNA, 12 nt, Human herpesvirus 4 [Epstein-Barr virus]
cugguggcccag

SEQ ID NO: 1940869 - RNA, 14 nt, Human herpesvirus 4 [Epstein-Barr virus]
cuggccgcagcugg

SEQ ID NO: 1940870 - RNA, 16 nt, Human herpesvirus 4 [Epstein-Barr virus]
cuccugccugccucug

SEQ ID NO: 1940871 - RNA, 15 nt, Human herpesvirus 4 [Epstein-Barr virus]
ucuuacugcccagcc

SEQ ID NO: 1940872 - RNA, 22 nt, Human herpesvirus 4 [Epstein-Barr virus]
ucccgggcaaacagggcagaga

SEQ ID NO: 1940873 - RNA, 22 nt, Human herpesvirus 4 [Epstein-Barr virus]
agcccuucuucguuaugcacuc

SEQ ID NO: 1940874 - RNA, 21 nt, Human herpesvirus 4 [Epstein-Barr virus]
cugcccggacggccuagccau

SEQ ID NO: 1940875 - RNA, 16 nt, Human herpesvirus 4 [Epstein-Barr virus]
caccccggcgccaccu

SEQ ID NO: 1940876 - RNA, 21 nt, Human herpesvirus 4 [Epstein-Barr virus]
acuucaagaguuuaagcagca

SEQ ID NO: 1940877 - RNA, 15 nt, Human herpesvirus 4 [Epstein-Barr virus]
cagcaccugucccug

SEQ ID NO: 1940878 - RNA, 16 nt, Human herpesvirus 4 [Epstein-Barr virus]
acuucuacucuuggca

SEQ ID NO: 1940879 - RNA, 16 nt, Human herpesvirus 4 [Epstein-Barr virus]
gugguugucuucccag

SEQ ID NO: 1940880 - RNA, 17 nt, Human herpesvirus 4 [Epstein-Barr virus]
ucaccagggaggccugg

SEQ ID NO: 1940881 - RNA, 16 nt, Human herpesvirus 4 [Epstein-Barr virus]
gaggugcugaggcccg

SEQ ID NO: 1940882 - RNA, 22 nt, Human herpesvirus 4 [Epstein-Barr virus]
ucuccugccugccucugcucug

SEQ ID NO: 1940883 - RNA, 20 nt, Human herpesvirus 4 [Epstein-Barr virus]
uuugccaaccugcucucucu

SEQ ID NO: 1940884 - RNA, 20 nt, Human herpesvirus 4 [Epstein-Barr virus]
acgugcaaggauggaagaga

SEQ ID NO: 1940885 - RNA, 22 nt, Human herpesvirus 4 [Epstein-Barr virus]
ccuccaagcggcacagauuaga

SEQ ID NO: 1940886 - RNA, 21 nt, Human herpesvirus 4 [Epstein-Barr virus]
agagguagacgaggcacaggc

SEQ ID NO: 1940887 - RNA, 19 nt, Human herpesvirus 4 [Epstein-Barr virus]
ggcccagcccuccucagaa

SEQ ID NO: 1940888 - RNA, 15 nt, Human herpesvirus 4 [Epstein-Barr virus]
ggcugccagccucag

SEQ ID NO: 1940889 - RNA, 18 nt, Human herpesvirus 4 [Epstein-Barr virus]
ggugccuguggagauuag

SEQ ID NO: 1940890 - RNA, 18 nt, Human herpesvirus 4 [Epstein-Barr virus]
agagcauaugccgguggc

SEQ ID NO: 1940891 - RNA, 15 nt, Human herpesvirus 4 [Epstein-Barr virus]
cguccuuguccagga

SEQ ID NO: 1940892 - RNA, 15 nt, Human herpesvirus 4 [Epstein-Barr virus]
accacuaggaaccca

SEQ ID NO: 1940893 - RNA, 14 nt, Human herpesvirus 4 [Epstein-Barr virus]
cuggcugugcugac

SEQ ID NO: 1940894 - RNA, 14 nt, Human herpesvirus 4 [Epstein-Barr virus]
ccgcgccgcaagca

SEQ ID NO: 1940895 - RNA, 18 nt, Human herpesvirus 4 [Epstein-Barr virus]
gcucgucguucaggaaca

SEQ ID NO: 1940896 - RNA, 22 nt, Human herpesvirus 4 [Epstein-Barr virus]
ccugcaaacugacacacaggcc

SEQ ID NO: 1940897 - RNA, 19 nt, Human herpesvirus 4 [Epstein-Barr virus]
acugaauuuauacccagug

SEQ ID NO: 1940898 - RNA, 22 nt, Human herpesvirus 4 [Epstein-Barr virus]
ggcggguggagauagggaccag

SEQ ID NO: 1940899 - RNA, 18 nt, Human herpesvirus 4 [Epstein-Barr virus]
gucuacaucccauaccua

SEQ ID NO: 1940900 - RNA, 17 nt, Human herpesvirus 4 [Epstein-Barr virus]
caccagcuaacaggaca

SEQ ID NO: 1940901 - RNA, 16 nt, Human herpesvirus 4 [Epstein-Barr virus]
aaaaacuugagucucu

SEQ ID NO: 1940902 - RNA, 20 nt, Human herpesvirus 4 [Epstein-Barr virus]
uuagccccagccccuccucu

SEQ ID NO: 1940903 - RNA, 20 nt, Human herpesvirus 4 [Epstein-Barr virus]
cgagcagcgcggcagaggcc

SEQ ID NO: 1940904 - RNA, 16 nt, Human herpesvirus 4 [Epstein-Barr virus]
uaguuccaggugacag

SEQ ID NO: 1940905 - RNA, 16 nt, Human herpesvirus 4 [Epstein-Barr virus]
gacacaucuggaccag

SEQ ID NO: 1940906 - RNA, 19 nt, Human herpesvirus 4 [Epstein-Barr virus]
ucuaggacgcuguccgcca

SEQ ID NO: 1940907 - RNA, 18 nt, Human herpesvirus 4 [Epstein-Barr virus]
ugggcaugacacaggaca

SEQ ID NO: 1940908 - RNA, 14 nt, Human herpesvirus 4 [Epstein-Barr virus]
guggcuugggcugu

SEQ ID NO: 1940909 - RNA, 12 nt, Human herpesvirus 4 [Epstein-Barr virus]
cugaucagggaa

SEQ ID NO: 1940910 - RNA, 16 nt, Human herpesvirus 4 [Epstein-Barr virus]
caccaugguagccggc

SEQ ID NO: 1940911 - RNA, 14 nt, Human herpesvirus 4 [Epstein-Barr virus]
ugcggagggucaga

SEQ ID NO: 1940912 - RNA, 16 nt, Human herpesvirus 4 [Epstein-Barr virus]
aaggccugcugucauc

SEQ ID NO: 1940913 - RNA, 11 nt, Human herpesvirus 4 [Epstein-Barr virus]
uccccauggga

SEQ ID NO: 1940914 - RNA, 16 nt, Human herpesvirus 4 [Epstein-Barr virus]
ccaccgaccccauauc

SEQ ID NO: 1940915 - RNA, 20 nt, Human herpesvirus 4 [Epstein-Barr virus]
acccaucccggcccucuucc

SEQ ID NO: 1940916 - RNA, 15 nt, Human herpesvirus 4 [Epstein-Barr virus]
uaaaccuucugucug

SEQ ID NO: 1940917 - RNA, 21 nt, Human herpesvirus 4 [Epstein-Barr virus]
aacuagcggcgagacccgagg

SEQ ID NO: 1940918 - RNA, 16 nt, Human herpesvirus 4 [Epstein-Barr virus]
cucccgggguccagag

SEQ ID NO: 1940919 - RNA, 15 nt, Human herpesvirus 4 [Epstein-Barr virus]
gcaguccaggggcca

SEQ ID NO: 1940920 - RNA, 14 nt, Human herpesvirus 4 [Epstein-Barr virus]
gccgccagcagccc

SEQ ID NO: 1940921 - RNA, 12 nt, Human herpesvirus 4 [Epstein-Barr virus]
gauggguggaga

SEQ ID NO: 1940922 - RNA, 14 nt, Human herpesvirus 4 [Epstein-Barr virus]
caggcugcgccucc

SEQ ID NO: 1940923 - RNA, 14 nt, Human herpesvirus 4 [Epstein-Barr virus]
cgcucuggucgccc

SEQ ID NO: 1940924 - RNA, 15 nt, Human herpesvirus 4 [Epstein-Barr virus]
cacagcgccagcagg

SEQ ID NO: 1940925 - RNA, 21 nt, Human herpesvirus 4 [Epstein-Barr virus]
gaggggggcggcguggagcug

SEQ ID NO: 1940926 - RNA, 22 nt, Human herpesvirus 4 [Epstein-Barr virus]
cugggaggugauguagguugua

SEQ ID NO: 1940927 - RNA, 13 nt, Human herpesvirus 4 [Epstein-Barr virus]
gggggugggcacc

SEQ ID NO: 1940928 - RNA, 14 nt, Human herpesvirus 4 [Epstein-Barr virus]
guggugcuguccug

SEQ ID NO: 1940929 - RNA, 15 nt, Human herpesvirus 4 [Epstein-Barr virus]
acccccaccaccuca

SEQ ID NO: 1940930 - RNA, 11 nt, Human herpesvirus 4 [Epstein-Barr virus]
gagggggacaa

SEQ ID NO: 1940931 - RNA, 12 nt, Human herpesvirus 4 [Epstein-Barr virus]
cggcuguggccu

SEQ ID NO: 1940932 - RNA, 15 nt, Human herpesvirus 4 [Epstein-Barr virus]
ucgccugccacuucc

SEQ ID NO: 1940933 - RNA, 14 nt, Human herpesvirus 4 [Epstein-Barr virus]
caaccaauguaucc

SEQ ID NO: 1940934 - RNA, 15 nt, Human herpesvirus 4 [Epstein-Barr virus]
uuccacccacugaua

SEQ ID NO: 1940935 - RNA, 14 nt, Human herpesvirus 4 [Epstein-Barr virus]
agcuccgugggccc

SEQ ID NO: 1940936 - RNA, 21 nt, Human herpesvirus 4 [Epstein-Barr virus]
aucuuccugucggcucucuuu

SEQ ID NO: 1940937 - RNA, 17 nt, Human herpesvirus 4 [Epstein-Barr virus]
cauugaugaacugguca

SEQ ID NO: 1940938 - RNA, 16 nt, Human herpesvirus 4 [Epstein-Barr virus]
gaacaucuggcugggg

SEQ ID NO: 1940939 - RNA, 16 nt, Human herpesvirus 4 [Epstein-Barr virus]
uccaguaugccugccu

SEQ ID NO: 1940940 - RNA, 16 nt, Human herpesvirus 4 [Epstein-Barr virus]
gcucccgggcaaacag

SEQ ID NO: 1940941 - RNA, 23 nt, Human herpesvirus 4 [Epstein-Barr virus]
cccgggggaggagaagagaggcu

SEQ ID NO: 1940942 - RNA, 18 nt, Human herpesvirus 4 [Epstein-Barr virus]
gaugcauacgcugaguga

SEQ ID NO: 1940943 - RNA, 18 nt, Human herpesvirus 4 [Epstein-Barr virus]
cgggagggacgggccucu

SEQ ID NO: 1940944 - RNA, 16 nt, Human herpesvirus 4 [Epstein-Barr virus]
ccaugacgcugcugcu

SEQ ID NO: 1940945 - RNA, 15 nt, Human herpesvirus 4 [Epstein-Barr virus]
ccgcagguggcugcu

SEQ ID NO: 1940946 - RNA, 21 nt, Human herpesvirus 4 [Epstein-Barr virus]
ucggguccuagcacaaaccag

SEQ ID NO: 1940947 - RNA, 19 nt, Human herpesvirus 4 [Epstein-Barr virus]
ggugccgacaccggggugc

SEQ ID NO: 1940948 - RNA, 13 nt, Human herpesvirus 4 [Epstein-Barr virus]
ccagggccagcaa

SEQ ID NO: 1940949 - RNA, 22 nt, Human herpesvirus 4 [Epstein-Barr virus]
gaacuggggcugguggccuggg

SEQ ID NO: 1940950 - RNA, 19 nt, Human herpesvirus 4 [Epstein-Barr virus]
uguucuuggcggacaucau

SEQ ID NO: 1940951 - RNA, 22 nt, Human herpesvirus 4 [Epstein-Barr virus]
agcagauuuccgucagccaggg

SEQ ID NO: 1940952 - RNA, 17 nt, Human herpesvirus 4 [Epstein-Barr virus]
auccgccaggaccugga

SEQ ID NO: 1940953 - RNA, 15 nt, Human herpesvirus 4 [Epstein-Barr virus]
gcauacggcuuucca

SEQ ID NO: 1940954 - RNA, 18 nt, Human herpesvirus 4 [Epstein-Barr virus]
caagcuuaugcagcaccu

SEQ ID NO: 1940955 - RNA, 21 nt, Human herpesvirus 4 [Epstein-Barr virus]
caaauaaacauuuuauuggua

SEQ ID NO: 1940956 - RNA, 15 nt, Human herpesvirus 4 [Epstein-Barr virus]
gauugggugguggca

SEQ ID NO: 1940957 - RNA, 19 nt, Human herpesvirus 4 [Epstein-Barr virus]
ggccgccacccucccccug

SEQ ID NO: 1940958 - RNA, 13 nt, Human herpesvirus 4 [Epstein-Barr virus]
ugaaucuccaccu

SEQ ID NO: 1940959 - RNA, 21 nt, Human herpesvirus 4 [Epstein-Barr virus]
acuccuaugcauuuccugccc

SEQ ID NO: 1940960 - RNA, 22 nt, Human herpesvirus 4 [Epstein-Barr virus]
caagggaggagugcugcaggua

SEQ ID NO: 1940961 - RNA, 20 nt, Human herpesvirus 4 [Epstein-Barr virus]
ucaaccugauucccccugcu

SEQ ID NO: 1940962 - RNA, 20 nt, Human herpesvirus 4 [Epstein-Barr virus]
guccaguuuuuaugugccuc

SEQ ID NO: 1940963 - RNA, 21 nt, Human herpesvirus 4 [Epstein-Barr virus]
ugccccgguccccccagaagc

SEQ ID NO: 1940964 - RNA, 21 nt, Human herpesvirus 4 [Epstein-Barr virus]
agcaggaggaggggcaggagg

SEQ ID NO: 1940965 - RNA, 18 nt, Human herpesvirus 4 [Epstein-Barr virus]
ucaucauaacugagcagg

SEQ ID NO: 1940966 - RNA, 12 nt, Human herpesvirus 4 [Epstein-Barr virus]
cugccgccgccu

SEQ ID NO: 1940967 - RNA, 14 nt, Human herpesvirus 4 [Epstein-Barr virus]
ggaggaugccagcc

SEQ ID NO: 1940968 - RNA, 19 nt, Human herpesvirus 4 [Epstein-Barr virus]
ccaaugacccacuccagug

SEQ ID NO: 1940969 - RNA, 22 nt, Human herpesvirus 4 [Epstein-Barr virus]
ucccccaaacauguccuguuag

SEQ ID NO: 1940970 - RNA, 16 nt, Human herpesvirus 4 [Epstein-Barr virus]
gaccaucacauggggc

SEQ ID NO: 1940971 - RNA, 23 nt, Human herpesvirus 4 [Epstein-Barr virus]
cgaccagucaugucgagcaugag

SEQ ID NO: 1940972 - RNA, 21 nt, Human herpesvirus 4 [Epstein-Barr virus]
agccccgggcccagcccuccu

SEQ ID NO: 1940973 - RNA, 13 nt, Human herpesvirus 4 [Epstein-Barr virus]
cccagcccucgag

SEQ ID NO: 1940974 - RNA, 14 nt, Human herpesvirus 4 [Epstein-Barr virus]
gccgcuucagacag

SEQ ID NO: 1940975 - RNA, 17 nt, Human herpesvirus 4 [Epstein-Barr virus]
cugcucccgccucaggg

SEQ ID NO: 1940976 - RNA, 20 nt, Human herpesvirus 4 [Epstein-Barr virus]
gccccaauucuugcacccac

SEQ ID NO: 1940977 - RNA, 13 nt, Human herpesvirus 4 [Epstein-Barr virus]
aggucgcggacca

SEQ ID NO: 1940978 - RNA, 16 nt, Human herpesvirus 4 [Epstein-Barr virus]
ccccagcccgccagcc

SEQ ID NO: 1940979 - RNA, 19 nt, Human herpesvirus 4 [Epstein-Barr virus]
agaacugcaagauaucaca

SEQ ID NO: 1940980 - RNA, 21 nt, Human herpesvirus 4 [Epstein-Barr virus]
uaacacuacuuguuucuggaa

SEQ ID NO: 1940981 - RNA, 21 nt, Human herpesvirus 4 [Epstein-Barr virus]
agugcauggauauagcucugc

SEQ ID NO: 1940982 - RNA, 17 nt, Human herpesvirus 4 [Epstein-Barr virus]
ucccgccccuguccacu

SEQ ID NO: 1940983 - RNA, 14 nt, Human herpesvirus 4 [Epstein-Barr virus]
cccaaugugcaugg

SEQ ID NO: 1940984 - RNA, 19 nt, Human herpesvirus 4 [Epstein-Barr virus]
gcgccgcccgggggccagu

SEQ ID NO: 1940985 - RNA, 17 nt, Human herpesvirus 4 [Epstein-Barr virus]
cucguaaaaguccagcg

SEQ ID NO: 1940986 - RNA, 14 nt, Human herpesvirus 4 [Epstein-Barr virus]
cagcccgcaccccc

SEQ ID NO: 1940987 - RNA, 22 nt, Human herpesvirus 4 [Epstein-Barr virus]
cuaucaggaccugggagggcca

SEQ ID NO: 1940988 - RNA, 12 nt, Human herpesvirus 4 [Epstein-Barr virus]
accacugaggga

SEQ ID NO: 1940989 - RNA, 18 nt, Human herpesvirus 4 [Epstein-Barr virus]
ggccugugucuucugucu

SEQ ID NO: 1940990 - RNA, 15 nt, Human herpesvirus 4 [Epstein-Barr virus]
gaccuguugcuucag

SEQ ID NO: 1940991 - RNA, 19 nt, Human herpesvirus 4 [Epstein-Barr virus]
ccaucuuaggagcccgggc

SEQ ID NO: 1940992 - RNA, 20 nt, Human herpesvirus 4 [Epstein-Barr virus]
cccccuggcggcccagcccg

SEQ ID NO: 1940993 - RNA, 21 nt, Human herpesvirus 4 [Epstein-Barr virus]
ccugauauugucccccuagcc

SEQ ID NO: 1940994 - RNA, 19 nt, Human herpesvirus 4 [Epstein-Barr virus]
uccagggcccguuccaggc

SEQ ID NO: 1940995 - RNA, 14 nt, Human herpesvirus 4 [Epstein-Barr virus]
gccgcuccguggcc

SEQ ID NO: 1940996 - RNA, 20 nt, Human herpesvirus 4 [Epstein-Barr virus]
cagaaaacucugcauggaga

SEQ ID NO: 1940997 - RNA, 17 nt, Human herpesvirus 4 [Epstein-Barr virus]
cagacaugguguagaca

SEQ ID NO: 1940998 - RNA, 15 nt, Human herpesvirus 4 [Epstein-Barr virus]
agucccgagcggccu

SEQ ID NO: 1940999 - RNA, 14 nt, Human herpesvirus 4 [Epstein-Barr virus]
aaggaggggcggca

SEQ ID NO: 1941000 - RNA, 14 nt, Human herpesvirus 4 [Epstein-Barr virus]
gcaugacacaggac

SEQ ID NO: 1941001 - RNA, 17 nt, Human herpesvirus 4 [Epstein-Barr virus]
gaagcguucuucacugu

SEQ ID NO: 1941002 - RNA, 23 nt, Human herpesvirus 4 [Epstein-Barr virus]
ugguggcccagcaacuaagagcc

SEQ ID NO: 1941003 - RNA, 15 nt, Human herpesvirus 4 [Epstein-Barr virus]
agagguucagggacu

SEQ ID NO: 1941004 - RNA, 21 nt, Human herpesvirus 4 [Epstein-Barr virus]
gagcaugaucaggacccuggg

SEQ ID NO: 1941005 - RNA, 21 nt, Human herpesvirus 4 [Epstein-Barr virus]
ugccuacgggcgcaccugugu

SEQ ID NO: 1941006 - RNA, 19 nt, Human herpesvirus 4 [Epstein-Barr virus]
caacaaggagugccucugg

SEQ ID NO: 1941007 - RNA, 19 nt, Human herpesvirus 4 [Epstein-Barr virus]
cuugacuguaaucacuggc

SEQ ID NO: 1941008 - RNA, 19 nt, Human herpesvirus 4 [Epstein-Barr virus]
cgacugggggcaaagccag

SEQ ID NO: 1941009 - RNA, 16 nt, Human herpesvirus 4 [Epstein-Barr virus]
cagucaccuuccagac

SEQ ID NO: 1941010 - RNA, 21 nt, Human herpesvirus 4 [Epstein-Barr virus]
caggaggaggggcaggagcag

SEQ ID NO: 1941011 - RNA, 19 nt, Human herpesvirus 4 [Epstein-Barr virus]
cugaggaccuguugcuuca

SEQ ID NO: 1941012 - RNA, 14 nt, Human herpesvirus 4 [Epstein-Barr virus]
gcccccgccagcgc

SEQ ID NO: 1941013 - RNA, 16 nt, Human herpesvirus 4 [Epstein-Barr virus]
uccggcccuuugccug

SEQ ID NO: 1941014 - RNA, 13 nt, Human herpesvirus 4 [Epstein-Barr virus]
ugauggugcagag

SEQ ID NO: 1941015 - RNA, 22 nt, Human herpesvirus 4 [Epstein-Barr virus]
cugggcugccccgggcccaccc

SEQ ID NO: 1941016 - RNA, 15 nt, Human herpesvirus 4 [Epstein-Barr virus]
augcgauucugaacu

SEQ ID NO: 1941017 - RNA, 13 nt, Human herpesvirus 4 [Epstein-Barr virus]
cccaaugugcaug

SEQ ID NO: 1941018 - RNA, 12 nt, Human herpesvirus 4 [Epstein-Barr virus]
ccgcugggccag

SEQ ID NO: 1941019 - RNA, 16 nt, Human herpesvirus 4 [Epstein-Barr virus]
aguucuacaaugccag

SEQ ID NO: 1941020 - RNA, 16 nt, Human herpesvirus 4 [Epstein-Barr virus]
ugggaccuacaggaca

SEQ ID NO: 1941021 - RNA, 13 nt, Human herpesvirus 4 [Epstein-Barr virus]
cuggccugccugg

SEQ ID NO: 1941022 - RNA, 21 nt, Human herpesvirus 4 [Epstein-Barr virus]
caccuugacuguaaucacugg

SEQ ID NO: 1941023 - RNA, 22 nt, Human herpesvirus 4 [Epstein-Barr virus]
ccccccgccuuugggcacccca

SEQ ID NO: 1941024 - RNA, 14 nt, Human herpesvirus 4 [Epstein-Barr virus]
ggaggugaagaugg

SEQ ID NO: 1941025 - RNA, 16 nt, Human herpesvirus 4 [Epstein-Barr virus]
cugcaccaguggcugc

SEQ ID NO: 1941026 - RNA, 16 nt, Human herpesvirus 4 [Epstein-Barr virus]
auuugggagggaccac

SEQ ID NO: 1941027 - RNA, 13 nt, Human herpesvirus 4 [Epstein-Barr virus]
ucagauugccuuc

SEQ ID NO: 1941028 - RNA, 12 nt, Human herpesvirus 4 [Epstein-Barr virus]
acucacaggaca

SEQ ID NO: 1941029 - RNA, 15 nt, Human herpesvirus 4 [Epstein-Barr virus]
agggaggacacugcc

SEQ ID NO: 1941030 - RNA, 18 nt, Human herpesvirus 4 [Epstein-Barr virus]
gccgccagcauggcagcc

SEQ ID NO: 1941031 - RNA, 13 nt, Human herpesvirus 4 [Epstein-Barr virus]
guuuaaggaauga

SEQ ID NO: 1941032 - RNA, 15 nt, Human herpesvirus 4 [Epstein-Barr virus]
cacgccguggcccug

SEQ ID NO: 1941033 - RNA, 15 nt, Human herpesvirus 4 [Epstein-Barr virus]
gagccggcggccucg

SEQ ID NO: 1941034 - RNA, 23 nt, Human herpesvirus 4 [Epstein-Barr virus]
ggcgcucugcgccagccccgccc

SEQ ID NO: 1941035 - RNA, 20 nt, Human herpesvirus 4 [Epstein-Barr virus]
cccuccauuccacccacuga

SEQ ID NO: 1941036 - RNA, 22 nt, Human herpesvirus 4 [Epstein-Barr virus]
aagccgggggagaagcaccuca

SEQ ID NO: 1941037 - RNA, 18 nt, Human herpesvirus 4 [Epstein-Barr virus]
gucuucaaucuucuucau

SEQ ID NO: 1941038 - RNA, 19 nt, Human herpesvirus 4 [Epstein-Barr virus]
ggaugaggcugaugauggc

SEQ ID NO: 1941039 - RNA, 16 nt, Human herpesvirus 4 [Epstein-Barr virus]
gcucucguugccaaaa

SEQ ID NO: 1941040 - RNA, 18 nt, Human herpesvirus 4 [Epstein-Barr virus]
ccauauuggggcaauggc

SEQ ID NO: 1941041 - RNA, 13 nt, Human herpesvirus 4 [Epstein-Barr virus]
aguccggggagaa

SEQ ID NO: 1941042 - RNA, 13 nt, Human herpesvirus 4 [Epstein-Barr virus]
cugcuuucugccg

SEQ ID NO: 1941043 - RNA, 19 nt, Human herpesvirus 4 [Epstein-Barr virus]
gcucaggaucagggccaag

SEQ ID NO: 1941044 - RNA, 22 nt, Human herpesvirus 4 [Epstein-Barr virus]
gaucccauuuuucacuacggga

SEQ ID NO: 1941045 - RNA, 13 nt, Human herpesvirus 4 [Epstein-Barr virus]
gccagaggcgacg

SEQ ID NO: 1941046 - RNA, 21 nt, Human herpesvirus 4 [Epstein-Barr virus]
gugccagaugugccugggcua

SEQ ID NO: 1941047 - RNA, 14 nt, Human herpesvirus 4 [Epstein-Barr virus]
cugggcagccagag

SEQ ID NO: 1941048 - RNA, 12 nt, Human herpesvirus 4 [Epstein-Barr virus]
ucaagagcuucc

SEQ ID NO: 1941049 - RNA, 20 nt, Human herpesvirus 4 [Epstein-Barr virus]
cugucucggccuccuggcca

SEQ ID NO: 1941050 - RNA, 21 nt, Human herpesvirus 4 [Epstein-Barr virus]
gcagcccgcaccccccgccac

SEQ ID NO: 1941051 - RNA, 13 nt, Human herpesvirus 4 [Epstein-Barr virus]
ccuaagcagcuga

SEQ ID NO: 1941052 - RNA, 14 nt, Human herpesvirus 4 [Epstein-Barr virus]
agcuccuugugcag

SEQ ID NO: 1941053 - RNA, 18 nt, Human herpesvirus 4 [Epstein-Barr virus]
uucccagcuaguagcccu

SEQ ID NO: 1941054 - RNA, 18 nt, Human herpesvirus 4 [Epstein-Barr virus]
caggcagaggaaggccac

SEQ ID NO: 1941055 - RNA, 23 nt, Human herpesvirus 4 [Epstein-Barr virus]
cuggcauacuuuuugccacccag

SEQ ID NO: 1941056 - RNA, 16 nt, Human herpesvirus 4 [Epstein-Barr virus]
aggccgguuuugcagu

SEQ ID NO: 1941057 - RNA, 15 nt, Human herpesvirus 4 [Epstein-Barr virus]
caaugagagggacuu

SEQ ID NO: 1941058 - RNA, 21 nt, Human herpesvirus 4 [Epstein-Barr virus]
cacccggggaaccggccccgu

SEQ ID NO: 1941059 - RNA, 19 nt, Human herpesvirus 4 [Epstein-Barr virus]
ccacccgucccggguacaa

SEQ ID NO: 1941060 - RNA, 15 nt, Human herpesvirus 4 [Epstein-Barr virus]
accacaacagccaga

SEQ ID NO: 1941061 - RNA, 23 nt, Human herpesvirus 4 [Epstein-Barr virus]
cuggaggacggucuggcacugga

SEQ ID NO: 1941062 - RNA, 15 nt, Human herpesvirus 4 [Epstein-Barr virus]
ggccccggcuggcca

SEQ ID NO: 1941063 - RNA, 12 nt, Human herpesvirus 4 [Epstein-Barr virus]
uuuggcaacgag

SEQ ID NO: 1941064 - RNA, 22 nt, Human herpesvirus 4 [Epstein-Barr virus]
gggcggcucaggaucagggcca

SEQ ID NO: 1941065 - RNA, 17 nt, Human herpesvirus 4 [Epstein-Barr virus]
cccgccuagagcauuug

SEQ ID NO: 1941066 - RNA, 13 nt, Human herpesvirus 4 [Epstein-Barr virus]
cgcaccaccgcag

SEQ ID NO: 1941067 - RNA, 16 nt, Human herpesvirus 4 [Epstein-Barr virus]
agcuccgugggcccag

SEQ ID NO: 1941068 - RNA, 18 nt, Human herpesvirus 4 [Epstein-Barr virus]
uggaagagaggggcaggg

SEQ ID NO: 1941069 - RNA, 17 nt, Human herpesvirus 4 [Epstein-Barr virus]
ccagcauggcagccggg

SEQ ID NO: 1941070 - RNA, 14 nt, Human herpesvirus 4 [Epstein-Barr virus]
ccauuccacccacu

SEQ ID NO: 1941071 - RNA, 17 nt, Human herpesvirus 4 [Epstein-Barr virus]
cguguuucucccacugu

SEQ ID NO: 1941072 - RNA, 15 nt, Human herpesvirus 4 [Epstein-Barr virus]
aaaaaaugcaacaau

SEQ ID NO: 1941073 - RNA, 20 nt, Human herpesvirus 4 [Epstein-Barr virus]
cgucgggaaacacagcucug

SEQ ID NO: 1941074 - RNA, 22 nt, Human herpesvirus 4 [Epstein-Barr virus]
acgugucgcguagcucugguag

SEQ ID NO: 1941075 - RNA, 22 nt, Human herpesvirus 4 [Epstein-Barr virus]
gagaggcgggaauggccgccac

SEQ ID NO: 1941076 - RNA, 18 nt, Human herpesvirus 4 [Epstein-Barr virus]
ggagcuccgagagcuccg

SEQ ID NO: 1941077 - RNA, 17 nt, Human herpesvirus 4 [Epstein-Barr virus]
aacugacacacaggccu

SEQ ID NO: 1941078 - RNA, 21 nt, Human herpesvirus 4 [Epstein-Barr virus]
uugucuucccagacucugcuu

SEQ ID NO: 1941079 - RNA, 22 nt, Human herpesvirus 4 [Epstein-Barr virus]
gguccucauaaggcgguggggg

SEQ ID NO: 1941080 - RNA, 17 nt, Human herpesvirus 4 [Epstein-Barr virus]
uggcggggccuugucug

SEQ ID NO: 1941081 - RNA, 13 nt, Human herpesvirus 4 [Epstein-Barr virus]
ggaugaagaucca

SEQ ID NO: 1941082 - RNA, 16 nt, Human herpesvirus 4 [Epstein-Barr virus]
caacgaucccaggccu

SEQ ID NO: 1941083 - RNA, 23 nt, Human herpesvirus 4 [Epstein-Barr virus]
gcuuaaaaaugugcagcuucucc

SEQ ID NO: 1941084 - RNA, 13 nt, Human herpesvirus 4 [Epstein-Barr virus]
aauguaucccaaa

SEQ ID NO: 1941085 - RNA, 19 nt, Human herpesvirus 4 [Epstein-Barr virus]
cucaucugugagacaagcc

SEQ ID NO: 1941086 - RNA, 21 nt, Human herpesvirus 4 [Epstein-Barr virus]
ugccauggccauucgacaggc

SEQ ID NO: 1941087 - RNA, 17 nt, Human herpesvirus 4 [Epstein-Barr virus]
ccagcgcuggcuccagg

SEQ ID NO: 1941088 - RNA, 22 nt, Human herpesvirus 4 [Epstein-Barr virus]
gccagagcggcauccucaaggg

SEQ ID NO: 1941089 - RNA, 20 nt, Human herpesvirus 4 [Epstein-Barr virus]
gcccccaaaaguagaggcuc

SEQ ID NO: 1941090 - RNA, 18 nt, Human herpesvirus 4 [Epstein-Barr virus]
gcccccaccacucccacc

SEQ ID NO: 1941091 - RNA, 21 nt, Human herpesvirus 4 [Epstein-Barr virus]
ggaggagaagagaggcuuccc

SEQ ID NO: 1941092 - RNA, 10 nt, Human herpesvirus 4 [Epstein-Barr virus]
caggagcagg

SEQ ID NO: 1941093 - RNA, 21 nt, Human herpesvirus 4 [Epstein-Barr virus]
ugcacagaucugaccacggcc

SEQ ID NO: 1941094 - RNA, 20 nt, Human herpesvirus 4 [Epstein-Barr virus]
caguggaccucaaagaagag

SEQ ID NO: 1941095 - RNA, 16 nt, Human herpesvirus 4 [Epstein-Barr virus]
uauugaaaccacgccu

SEQ ID NO: 1941096 - RNA, 13 nt, Human herpesvirus 4 [Epstein-Barr virus]
guugguggcacug

SEQ ID NO: 1941097 - RNA, 21 nt, Human herpesvirus 4 [Epstein-Barr virus]
gggacgcagaaugugcaggga

SEQ ID NO: 1941098 - RNA, 18 nt, Human herpesvirus 4 [Epstein-Barr virus]
ggcccacuggaugcagga

SEQ ID NO: 1941099 - RNA, 20 nt, Human herpesvirus 4 [Epstein-Barr virus]
aggccccccgcaccagggcc

SEQ ID NO: 1941100 - RNA, 20 nt, Human herpesvirus 4 [Epstein-Barr virus]
gucccgccucuccguacccc

SEQ ID NO: 1941101 - RNA, 15 nt, Human herpesvirus 4 [Epstein-Barr virus]
cgccaaugccaacuc

SEQ ID NO: 1941102 - RNA, 14 nt, Human herpesvirus 4 [Epstein-Barr virus]
acgccagagacaag

SEQ ID NO: 1941103 - RNA, 21 nt, Human herpesvirus 4 [Epstein-Barr virus]
acaaccuuggacccugcugcg

SEQ ID NO: 1941104 - RNA, 20 nt, Human herpesvirus 4 [Epstein-Barr virus]
gaaaauaguuccaggugaca

SEQ ID NO: 1941105 - RNA, 17 nt, Human herpesvirus 4 [Epstein-Barr virus]
caugcuguaccugauga

SEQ ID NO: 1941106 - RNA, 17 nt, Human herpesvirus 4 [Epstein-Barr virus]
aggucuucucugacaaa

SEQ ID NO: 1941107 - RNA, 13 nt, Human herpesvirus 4 [Epstein-Barr virus]
agagguuuugcua

SEQ ID NO: 1941108 - RNA, 14 nt, Human herpesvirus 4 [Epstein-Barr virus]
ggggcuggccugcc

SEQ ID NO: 1941109 - RNA, 15 nt, Human herpesvirus 4 [Epstein-Barr virus]
uugaucuucuucucc

SEQ ID NO: 1941110 - RNA, 19 nt, Human herpesvirus 4 [Epstein-Barr virus]
aaaugaacccagggguggc

SEQ ID NO: 1941111 - RNA, 12 nt, Human herpesvirus 4 [Epstein-Barr virus]
uguguacauaau

SEQ ID NO: 1941112 - RNA, 15 nt, Human herpesvirus 4 [Epstein-Barr virus]
gacuggcggcacugu

SEQ ID NO: 1941113 - RNA, 15 nt, Human herpesvirus 4 [Epstein-Barr virus]
uuguaagacaaucac

SEQ ID NO: 1941114 - RNA, 20 nt, Human herpesvirus 4 [Epstein-Barr virus]
uccucguuaguccaagagaa

SEQ ID NO: 1941115 - RNA, 14 nt, Human herpesvirus 4 [Epstein-Barr virus]
cugcauggccaggc

SEQ ID NO: 1941116 - RNA, 11 nt, Human herpesvirus 4 [Epstein-Barr virus]
uagucagucug

SEQ ID NO: 1941117 - RNA, 23 nt, Human herpesvirus 4 [Epstein-Barr virus]
gaagcgccgguacuuguuaagga

SEQ ID NO: 1941118 - RNA, 15 nt, Human herpesvirus 4 [Epstein-Barr virus]
ggagagggccagaga

SEQ ID NO: 1941119 - RNA, 21 nt, Human herpesvirus 4 [Epstein-Barr virus]
cgcgacauguuucuggugagc

SEQ ID NO: 1941120 - RNA, 14 nt, Human herpesvirus 4 [Epstein-Barr virus]
cugucaccaggccu

SEQ ID NO: 1941121 - RNA, 18 nt, Human herpesvirus 4 [Epstein-Barr virus]
ucacugagaaucuccugu

SEQ ID NO: 1941122 - RNA, 20 nt, Human herpesvirus 4 [Epstein-Barr virus]
auguacccaucccggcccuc

SEQ ID NO: 1941123 - RNA, 12 nt, Human herpesvirus 4 [Epstein-Barr virus]
cucggaggugcc

SEQ ID NO: 1941124 - RNA, 12 nt, Human herpesvirus 4 [Epstein-Barr virus]
uugccuggggcu

SEQ ID NO: 1941125 - RNA, 16 nt, Human herpesvirus 4 [Epstein-Barr virus]
gcagguggcugcugcc

SEQ ID NO: 1941126 - RNA, 17 nt, Human herpesvirus 4 [Epstein-Barr virus]
cagaggacuaauguucu

SEQ ID NO: 1941127 - RNA, 15 nt, Human herpesvirus 4 [Epstein-Barr virus]
cagcggauggugggg

SEQ ID NO: 1941128 - RNA, 13 nt, Human herpesvirus 4 [Epstein-Barr virus]
cugcccuccucca

SEQ ID NO: 1941129 - RNA, 16 nt, Human herpesvirus 4 [Epstein-Barr virus]
acuucuucucugcucg

SEQ ID NO: 1941130 - RNA, 22 nt, Human herpesvirus 4 [Epstein-Barr virus]
aggcacaucuggcaccuguccu

SEQ ID NO: 1941131 - RNA, 15 nt, Human herpesvirus 4 [Epstein-Barr virus]
gccuccagcucggcc

SEQ ID NO: 1941132 - RNA, 15 nt, Human herpesvirus 4 [Epstein-Barr virus]
accaaugccaaagcu

SEQ ID NO: 1941133 - RNA, 17 nt, Human herpesvirus 4 [Epstein-Barr virus]
ucaaucuucuucauagc

SEQ ID NO: 1941134 - RNA, 16 nt, Human herpesvirus 4 [Epstein-Barr virus]
cuuucgacugucauuu

SEQ ID NO: 1941135 - RNA, 14 nt, Human herpesvirus 4 [Epstein-Barr virus]
cccccgccuuuggg

SEQ ID NO: 1941136 - RNA, 16 nt, Human herpesvirus 4 [Epstein-Barr virus]
aaaccacgccugcuuc

SEQ ID NO: 1941137 - RNA, 23 nt, Human herpesvirus 4 [Epstein-Barr virus]
cacaaaaugaggaacggugauua

SEQ ID NO: 1941138 - RNA, 13 nt, Human herpesvirus 4 [Epstein-Barr virus]
ccaccccacacuc

SEQ ID NO: 1941139 - RNA, 14 nt, Human herpesvirus 4 [Epstein-Barr virus]
auagcauggccgcc

SEQ ID NO: 1941140 - RNA, 18 nt, Human herpesvirus 4 [Epstein-Barr virus]
cgaagaacacuccacaga

SEQ ID NO: 1941141 - RNA, 17 nt, Human herpesvirus 4 [Epstein-Barr virus]
gccaccguggccaggcc

SEQ ID NO: 1941142 - RNA, 18 nt, Human herpesvirus 4 [Epstein-Barr virus]
gccagucuccgggucagg

SEQ ID NO: 1941143 - RNA, 18 nt, Human herpesvirus 4 [Epstein-Barr virus]
gaggccucugggguccag

SEQ ID NO: 1941144 - RNA, 14 nt, Human herpesvirus 4 [Epstein-Barr virus]
uuaggcacuggaca

SEQ ID NO: 1941145 - RNA, 13 nt, Human herpesvirus 4 [Epstein-Barr virus]
gugccuccagagc

SEQ ID NO: 1941146 - RNA, 18 nt, Human herpesvirus 4 [Epstein-Barr virus]
gguggcccucgguggugg

SEQ ID NO: 1941147 - RNA, 20 nt, Human herpesvirus 4 [Epstein-Barr virus]
cacccucccccugccccguu

SEQ ID NO: 1941148 - RNA, 14 nt, Human herpesvirus 4 [Epstein-Barr virus]
ugcugaugugcugc

SEQ ID NO: 1941149 - RNA, 16 nt, Human herpesvirus 4 [Epstein-Barr virus]
gucacucagcuccgcg

SEQ ID NO: 1941150 - RNA, 20 nt, Human herpesvirus 4 [Epstein-Barr virus]
uuugacugacacauaaacau

SEQ ID NO: 1941151 - RNA, 23 nt, Human herpesvirus 4 [Epstein-Barr virus]
ggccgaggcugagggggcgguca

SEQ ID NO: 1941152 - RNA, 16 nt, Human herpesvirus 4 [Epstein-Barr virus]
ugcaaugcccacccac

SEQ ID NO: 1941153 - RNA, 13 nt, Human herpesvirus 4 [Epstein-Barr virus]
gacucuugaagau

SEQ ID NO: 1941154 - RNA, 19 nt, Human herpesvirus 4 [Epstein-Barr virus]
cccacuaucacccauggcc

SEQ ID NO: 1941155 - RNA, 23 nt, Human herpesvirus 4 [Epstein-Barr virus]
cacucuuuuuucaacgcagucuu

SEQ ID NO: 1941156 - RNA, 18 nt, Human herpesvirus 4 [Epstein-Barr virus]
aggacauguuugggggag

SEQ ID NO: 1941157 - RNA, 15 nt, Human herpesvirus 4 [Epstein-Barr virus]
gcuguugacaugagc

SEQ ID NO: 1941158 - RNA, 15 nt, Human herpesvirus 4 [Epstein-Barr virus]
cagcgcuggcuccag

SEQ ID NO: 1941159 - RNA, 23 nt, Human herpesvirus 4 [Epstein-Barr virus]
caggguggcuacuugcucagguu

SEQ ID NO: 1941160 - RNA, 12 nt, Human herpesvirus 4 [Epstein-Barr virus]
cucccaccaccc

SEQ ID NO: 1941161 - RNA, 18 nt, Human herpesvirus 4 [Epstein-Barr virus]
caugcucuuugaugggga

SEQ ID NO: 1941162 - RNA, 17 nt, Human herpesvirus 4 [Epstein-Barr virus]
auagaggggagcagagg

SEQ ID NO: 1941163 - RNA, 14 nt, Human herpesvirus 4 [Epstein-Barr virus]
gacaguaacacagg

SEQ ID NO: 1941164 - RNA, 15 nt, Human herpesvirus 4 [Epstein-Barr virus]
cccagcuucugaggc

SEQ ID NO: 1941165 - RNA, 16 nt, Human herpesvirus 4 [Epstein-Barr virus]
agaccucgaguccggg

SEQ ID NO: 1941166 - RNA, 21 nt, Human herpesvirus 4 [Epstein-Barr virus]
aacuggccaugcaggccugga

SEQ ID NO: 1941167 - RNA, 22 nt, Human herpesvirus 4 [Epstein-Barr virus]
cuuccacccccuggagccagcg

SEQ ID NO: 1941168 - RNA, 21 nt, Human herpesvirus 4 [Epstein-Barr virus]
ccuagccaccguggccaggcc

SEQ ID NO: 1941169 - RNA, 19 nt, Human herpesvirus 4 [Epstein-Barr virus]
ggcgacaguaacacagggu

SEQ ID NO: 1941170 - RNA, 18 nt, Human herpesvirus 4 [Epstein-Barr virus]
ggugcccgagccccgccu

SEQ ID NO: 1941171 - RNA, 16 nt, Human herpesvirus 4 [Epstein-Barr virus]
uggucuuuuaugagcc

SEQ ID NO: 1941172 - RNA, 18 nt, Human herpesvirus 4 [Epstein-Barr virus]
cccauauuggggcaaugg

SEQ ID NO: 1941173 - RNA, 23 nt, Human herpesvirus 4 [Epstein-Barr virus]
ugacuguuuguggcggcaucaug

SEQ ID NO: 1941174 - RNA, 17 nt, Human herpesvirus 4 [Epstein-Barr virus]
aacaaggagugccucug

SEQ ID NO: 1941175 - RNA, 22 nt, Human herpesvirus 4 [Epstein-Barr virus]
gccucgccuucuccucagccuc

SEQ ID NO: 1941176 - RNA, 14 nt, Human herpesvirus 4 [Epstein-Barr virus]
ggaucucccgcgcc

SEQ ID NO: 1941177 - RNA, 17 nt, Human herpesvirus 4 [Epstein-Barr virus]
ggccacugcaggcugga

SEQ ID NO: 1941178 - RNA, 17 nt, Human herpesvirus 4 [Epstein-Barr virus]
gccaugcacggcccuga

SEQ ID NO: 1941179 - RNA, 15 nt, Human herpesvirus 4 [Epstein-Barr virus]
gcccaccagccagcg

SEQ ID NO: 1941180 - RNA, 16 nt, Human herpesvirus 4 [Epstein-Barr virus]
acaaaaccacugaccu

SEQ ID NO: 1941181 - RNA, 17 nt, Human herpesvirus 4 [Epstein-Barr virus]
uccuacaacucagcccc

SEQ ID NO: 1941182 - RNA, 16 nt, Human herpesvirus 4 [Epstein-Barr virus]
uuguuggggaaaacac

SEQ ID NO: 1941183 - RNA, 20 nt, Human herpesvirus 4 [Epstein-Barr virus]
ccagccgggugcacacgcuc

SEQ ID NO: 1941184 - RNA, 20 nt, Human herpesvirus 4 [Epstein-Barr virus]
gcuggacgugaaccuccccc

SEQ ID NO: 1941185 - RNA, 13 nt, Human herpesvirus 4 [Epstein-Barr virus]
aguugggguccuc

SEQ ID NO: 1941186 - RNA, 17 nt, Human herpesvirus 4 [Epstein-Barr virus]
guccuaggugggauaua

SEQ ID NO: 1941187 - RNA, 18 nt, Human herpesvirus 4 [Epstein-Barr virus]
gcaccagcuaacaggaca

SEQ ID NO: 1941188 - RNA, 14 nt, Human herpesvirus 4 [Epstein-Barr virus]
uucgacugucauuu

SEQ ID NO: 1941189 - RNA, 15 nt, Human herpesvirus 4 [Epstein-Barr virus]
accguggccaggccc

SEQ ID NO: 1941190 - RNA, 17 nt, Human herpesvirus 4 [Epstein-Barr virus]
cgaaggcguggguguca

SEQ ID NO: 1941191 - RNA, 23 nt, Human herpesvirus 4 [Epstein-Barr virus]
uggggccaccggggaggccaggu

SEQ ID NO: 1941192 - RNA, 16 nt, Human herpesvirus 4 [Epstein-Barr virus]
uggcacgggcagagga

SEQ ID NO: 1941193 - RNA, 16 nt, Human herpesvirus 4 [Epstein-Barr virus]
cgccagcagggcacag

SEQ ID NO: 1941194 - RNA, 21 nt, Human herpesvirus 4 [Epstein-Barr virus]
cagcagcagcccggccgaggc

SEQ ID NO: 1941195 - RNA, 16 nt, Human herpesvirus 4 [Epstein-Barr virus]
ucggggcaugcugccc

SEQ ID NO: 1941196 - RNA, 19 nt, Human herpesvirus 4 [Epstein-Barr virus]
gacuccgaauauccccaaa

SEQ ID NO: 1941197 - RNA, 17 nt, Human herpesvirus 4 [Epstein-Barr virus]
aucuggcucuccugugu

SEQ ID NO: 1941198 - RNA, 17 nt, Human herpesvirus 4 [Epstein-Barr virus]
acgggguggugccuggu

SEQ ID NO: 1941199 - RNA, 14 nt, Human herpesvirus 4 [Epstein-Barr virus]
ugcacucucucccc

SEQ ID NO: 1941200 - RNA, 18 nt, Human herpesvirus 4 [Epstein-Barr virus]
gggacgggguggugccug

SEQ ID NO: 1941201 - RNA, 17 nt, Human herpesvirus 4 [Epstein-Barr virus]
gccacccucccccugcc

SEQ ID NO: 1941202 - RNA, 19 nt, Human herpesvirus 4 [Epstein-Barr virus]
gacaugcugaugugcugcc

SEQ ID NO: 1941203 - RNA, 22 nt, Human herpesvirus 4 [Epstein-Barr virus]
aagcaugggggaaaccugcgaa

SEQ ID NO: 1941204 - RNA, 17 nt, Human herpesvirus 4 [Epstein-Barr virus]
ugauauugaauuccaca

SEQ ID NO: 1941205 - RNA, 14 nt, Human herpesvirus 4 [Epstein-Barr virus]
agcuuuugaccaag

SEQ ID NO: 1941206 - RNA, 13 nt, Human herpesvirus 4 [Epstein-Barr virus]
caucagcucgccc

SEQ ID NO: 1941207 - RNA, 18 nt, Human herpesvirus 4 [Epstein-Barr virus]
ccguggagccgggggcau

SEQ ID NO: 1941208 - RNA, 16 nt, Human herpesvirus 4 [Epstein-Barr virus]
uuauggcagagcuuug

SEQ ID NO: 1941209 - RNA, 22 nt, Human herpesvirus 4 [Epstein-Barr virus]
uaacacuacuuguuucuggaau

SEQ ID NO: 1941210 - RNA, 12 nt, Human herpesvirus 4 [Epstein-Barr virus]
cuccucagccuc

SEQ ID NO: 1941211 - RNA, 15 nt, Human herpesvirus 4 [Epstein-Barr virus]
cuccuuagacugagc

SEQ ID NO: 1941212 - RNA, 14 nt, Human herpesvirus 4 [Epstein-Barr virus]
caccugcuagagaa

SEQ ID NO: 1941213 - RNA, 20 nt, Human herpesvirus 4 [Epstein-Barr virus]
gaagcuggccaggcugguga

SEQ ID NO: 1941214 - RNA, 15 nt, Human herpesvirus 4 [Epstein-Barr virus]
uaaauaucuuccugu

SEQ ID NO: 1941215 - RNA, 13 nt, Human herpesvirus 4 [Epstein-Barr virus]
auaggccucugcc

SEQ ID NO: 1941216 - RNA, 14 nt, Human herpesvirus 4 [Epstein-Barr virus]
cauccgagaggaug

SEQ ID NO: 1941217 - RNA, 18 nt, Human herpesvirus 4 [Epstein-Barr virus]
ggacgggguggugccugg

SEQ ID NO: 1941218 - RNA, 14 nt, Human herpesvirus 4 [Epstein-Barr virus]
ggaaaaacuggcca

SEQ ID NO: 1941219 - RNA, 22 nt, Human herpesvirus 4 [Epstein-Barr virus]
cgucgacgcuguuuugcagcug

SEQ ID NO: 1941220 - RNA, 16 nt, Human herpesvirus 4 [Epstein-Barr virus]
cuggucuuuuaugagc

SEQ ID NO: 1941221 - RNA, 20 nt, Human herpesvirus 4 [Epstein-Barr virus]
cacucaggaagcuggccagg

SEQ ID NO: 1941222 - RNA, 23 nt, Human herpesvirus 4 [Epstein-Barr virus]
ggcggacugcgccuuuaggcgua

SEQ ID NO: 1941223 - RNA, 16 nt, Human herpesvirus 4 [Epstein-Barr virus]
aggacgauagcccagg

SEQ ID NO: 1941224 - RNA, 16 nt, Human herpesvirus 4 [Epstein-Barr virus]
cacaacagccagaauc

SEQ ID NO: 1941225 - RNA, 13 nt, Human herpesvirus 4 [Epstein-Barr virus]
cauguccacugag

SEQ ID NO: 1941226 - RNA, 14 nt, Human herpesvirus 4 [Epstein-Barr virus]
ucucagaugcagug

SEQ ID NO: 1941227 - RNA, 17 nt, Human herpesvirus 4 [Epstein-Barr virus]
gggcgggcuugugcuug

SEQ ID NO: 1941228 - RNA, 15 nt, Human herpesvirus 4 [Epstein-Barr virus]
ugacagcugucaccc

SEQ ID NO: 1941229 - RNA, 14 nt, Human herpesvirus 4 [Epstein-Barr virus]
cugugguugucuuc

SEQ ID NO: 1941230 - RNA, 22 nt, Human herpesvirus 4 [Epstein-Barr virus]
agggucagcacagccagagagg

SEQ ID NO: 1941231 - RNA, 19 nt, Human herpesvirus 4 [Epstein-Barr virus]
caauuaggcuaaaagcagc

SEQ ID NO: 1941232 - RNA, 16 nt, Human herpesvirus 4 [Epstein-Barr virus]
ggugcaccagcuccag

SEQ ID NO: 1941233 - RNA, 17 nt, Human herpesvirus 4 [Epstein-Barr virus]
cuccugauuugcucuuc

SEQ ID NO: 1941234 - RNA, 18 nt, Human herpesvirus 4 [Epstein-Barr virus]
uacguuggcuucugcugc

SEQ ID NO: 1941235 - RNA, 14 nt, Human herpesvirus 4 [Epstein-Barr virus]
gucaaguaccagcu

SEQ ID NO: 1941236 - RNA, 23 nt, Human herpesvirus 4 [Epstein-Barr virus]
cuggcacugcuagcgucacugau

SEQ ID NO: 1941237 - RNA, 18 nt, Human herpesvirus 4 [Epstein-Barr virus]
ggcgagacuuggaccaag

SEQ ID NO: 1941238 - RNA, 15 nt, Human herpesvirus 4 [Epstein-Barr virus]
gcuccagggccagca

SEQ ID NO: 1941239 - RNA, 21 nt, Human herpesvirus 4 [Epstein-Barr virus]
cugacagagccgugucuccug

SEQ ID NO: 1941240 - RNA, 17 nt, Human herpesvirus 4 [Epstein-Barr virus]
cuggcugugcugacccu

SEQ ID NO: 1941241 - RNA, 16 nt, Human herpesvirus 4 [Epstein-Barr virus]
acaaguaccagcccuu

SEQ ID NO: 1941242 - RNA, 13 nt, Human herpesvirus 4 [Epstein-Barr virus]
accgucagccaca

SEQ ID NO: 1941243 - RNA, 19 nt, Human herpesvirus 4 [Epstein-Barr virus]
cugcgagggggccuggugc

SEQ ID NO: 1941244 - RNA, 22 nt, Human herpesvirus 4 [Epstein-Barr virus]
cucgugcaaccaggcccacugc

SEQ ID NO: 1941245 - RNA, 23 nt, Human herpesvirus 4 [Epstein-Barr virus]
gcgcgcccugucaccaggccugc

SEQ ID NO: 1941246 - RNA, 20 nt, Human herpesvirus 4 [Epstein-Barr virus]
cguuauugaaaccacgccug

SEQ ID NO: 1941247 - RNA, 13 nt, Human herpesvirus 4 [Epstein-Barr virus]
gcaccggagccac

SEQ ID NO: 1941248 - RNA, 20 nt, Human herpesvirus 4 [Epstein-Barr virus]
ggaccggaucgaaggagagc

SEQ ID NO: 1941249 - RNA, 14 nt, Human herpesvirus 4 [Epstein-Barr virus]
ccucauccuggccc

SEQ ID NO: 1941250 - RNA, 12 nt, Human herpesvirus 4 [Epstein-Barr virus]
ccugauuuuccu

SEQ ID NO: 1941251 - RNA, 20 nt, Human herpesvirus 4 [Epstein-Barr virus]
cggccuccuggccagcaccc

SEQ ID NO: 1941252 - RNA, 15 nt, Human herpesvirus 4 [Epstein-Barr virus]
cuuacuccccuaccc

SEQ ID NO: 1941253 - RNA, 21 nt, Human herpesvirus 4 [Epstein-Barr virus]
uggcuccccauagacucccau

SEQ ID NO: 1941254 - RNA, 23 nt, Human herpesvirus 4 [Epstein-Barr virus]
agggaagagggaaaagagacugc

SEQ ID NO: 1941255 - RNA, 17 nt, Human herpesvirus 4 [Epstein-Barr virus]
caaugggggaggagaga

SEQ ID NO: 1941256 - RNA, 22 nt, Human herpesvirus 4 [Epstein-Barr virus]
cccaauauccaucugcuucugg

SEQ ID NO: 1941257 - RNA, 21 nt, Human herpesvirus 4 [Epstein-Barr virus]
cugcgaaacuugggggcaggc

SEQ ID NO: 1941258 - RNA, 15 nt, Human herpesvirus 4 [Epstein-Barr virus]
cuggccguggccagg

SEQ ID NO: 1941259 - RNA, 15 nt, Human herpesvirus 4 [Epstein-Barr virus]
gaggacuaauguucu

SEQ ID NO: 1941260 - RNA, 18 nt, Human herpesvirus 4 [Epstein-Barr virus]
agggggccuggugccaga

SEQ ID NO: 1941261 - RNA, 20 nt, Human herpesvirus 4 [Epstein-Barr virus]
acacgggggugcccccacca

SEQ ID NO: 1941262 - RNA, 19 nt, Human herpesvirus 4 [Epstein-Barr virus]
ugagucaucccguggagag

SEQ ID NO: 1941263 - RNA, 13 nt, Human herpesvirus 4 [Epstein-Barr virus]
gugggguggugua

SEQ ID NO: 1941264 - RNA, 12 nt, Human herpesvirus 4 [Epstein-Barr virus]
ccuguugauggu

SEQ ID NO: 1941265 - RNA, 16 nt, Human herpesvirus 4 [Epstein-Barr virus]
uccgccaugaccagca

SEQ ID NO: 1941266 - RNA, 18 nt, Human herpesvirus 4 [Epstein-Barr virus]
cugacacagacuuggccu

SEQ ID NO: 1941267 - RNA, 21 nt, Human herpesvirus 4 [Epstein-Barr virus]
cccauaaaaauaagugcaugg

SEQ ID NO: 1941268 - RNA, 22 nt, Human herpesvirus 4 [Epstein-Barr virus]
acacuuauguuucaagcagcuc

SEQ ID NO: 1941269 - RNA, 15 nt, Human herpesvirus 4 [Epstein-Barr virus]
caaucaccagccacc

SEQ ID NO: 1941270 - RNA, 15 nt, Human herpesvirus 4 [Epstein-Barr virus]
aggccgcugccaggc

SEQ ID NO: 1941271 - RNA, 21 nt, Human herpesvirus 4 [Epstein-Barr virus]
agccuugcguggugcuguccu

SEQ ID NO: 1941272 - RNA, 17 nt, Human herpesvirus 4 [Epstein-Barr virus]
cugagccugagccacac

SEQ ID NO: 1941273 - RNA, 18 nt, Human herpesvirus 4 [Epstein-Barr virus]
caggucccccuccacggg

SEQ ID NO: 1941274 - RNA, 22 nt, Human herpesvirus 4 [Epstein-Barr virus]
gguuucaauuuugggagcucca

SEQ ID NO: 1941275 - RNA, 17 nt, Human herpesvirus 4 [Epstein-Barr virus]
aauccgcgcagccuguu

SEQ ID NO: 1941276 - RNA, 15 nt, Human herpesvirus 4 [Epstein-Barr virus]
ggcugagaacugacg

SEQ ID NO: 1941277 - RNA, 14 nt, Human herpesvirus 4 [Epstein-Barr virus]
cucugggugcugag

SEQ ID NO: 1941278 - RNA, 22 nt, Human herpesvirus 4 [Epstein-Barr virus]
uaccggcgagcaugaucaggac

SEQ ID NO: 1941279 - RNA, 22 nt, Human herpesvirus 4 [Epstein-Barr virus]
caaccaauguaucccaaauaaa

SEQ ID NO: 1941280 - RNA, 14 nt, Human herpesvirus 4 [Epstein-Barr virus]
cauccgaggcugag

SEQ ID NO: 1941281 - RNA, 14 nt, Human herpesvirus 4 [Epstein-Barr virus]
acugcaaacccugg

SEQ ID NO: 1941282 - RNA, 20 nt, Human herpesvirus 4 [Epstein-Barr virus]
gugucauuuagaaaccuugc

SEQ ID NO: 1941283 - RNA, 14 nt, Human herpesvirus 4 [Epstein-Barr virus]
gaagcgaagcagcu

SEQ ID NO: 1941284 - RNA, 23 nt, Human herpesvirus 4 [Epstein-Barr virus]
cuccacagaguacgcgacugagg

SEQ ID NO: 1941285 - RNA, 15 nt, Human herpesvirus 4 [Epstein-Barr virus]
cuggccgccguggcc

SEQ ID NO: 1941286 - RNA, 23 nt, Human herpesvirus 4 [Epstein-Barr virus]
agccccaauucuugcacccaccc

SEQ ID NO: 1941287 - RNA, 14 nt, Human herpesvirus 4 [Epstein-Barr virus]
gaagauugaagaca

SEQ ID NO: 1941288 - RNA, 15 nt, Human herpesvirus 4 [Epstein-Barr virus]
gcugccccgggccca

SEQ ID NO: 1941289 - RNA, 21 nt, Human herpesvirus 4 [Epstein-Barr virus]
auagcaggacggggggcuggc

SEQ ID NO: 1941290 - RNA, 19 nt, Human herpesvirus 4 [Epstein-Barr virus]
uccguccuuguccaggaga

SEQ ID NO: 1941291 - RNA, 14 nt, Human herpesvirus 4 [Epstein-Barr virus]
uaaaauucuggauc

SEQ ID NO: 1941292 - RNA, 14 nt, Human herpesvirus 4 [Epstein-Barr virus]
ccgccagcagcccc

SEQ ID NO: 1941293 - RNA, 18 nt, Human herpesvirus 4 [Epstein-Barr virus]
agcccccucccgccccug

SEQ ID NO: 1941294 - RNA, 14 nt, Human herpesvirus 4 [Epstein-Barr virus]
gcaaguuuugcccg

SEQ ID NO: 1941295 - RNA, 15 nt, Human herpesvirus 4 [Epstein-Barr virus]
ccggggcggcggugg

SEQ ID NO: 1941296 - RNA, 14 nt, Human herpesvirus 4 [Epstein-Barr virus]
gcgggugaggccac

SEQ ID NO: 1941297 - RNA, 19 nt, Human herpesvirus 4 [Epstein-Barr virus]
accugcuaaccagauguga

SEQ ID NO: 1941298 - RNA, 21 nt, Human herpesvirus 4 [Epstein-Barr virus]
cugaccggcucggccacgcug

SEQ ID NO: 1941299 - RNA, 13 nt, Human herpesvirus 4 [Epstein-Barr virus]
cugagugcccagg

SEQ ID NO: 1941300 - RNA, 18 nt, Human herpesvirus 4 [Epstein-Barr virus]
cuaaggccgggagaggca

SEQ ID NO: 1941301 - RNA, 13 nt, Human herpesvirus 4 [Epstein-Barr virus]
ccagcaggcucag

SEQ ID NO: 1941302 - RNA, 21 nt, Human herpesvirus 4 [Epstein-Barr virus]
cucgaguaggugccuccagag

SEQ ID NO: 1941303 - RNA, 22 nt, Human herpesvirus 4 [Epstein-Barr virus]
guccaguuuuuaugugccucgg

SEQ ID NO: 1941304 - RNA, 22 nt, Human herpesvirus 4 [Epstein-Barr virus]
cgggcagaggacacgcuggucu

SEQ ID NO: 1941305 - RNA, 11 nt, Human herpesvirus 4 [Epstein-Barr virus]
gcccacccacu

SEQ ID NO: 1941306 - RNA, 16 nt, Human herpesvirus 4 [Epstein-Barr virus]
gcccgucuuacugccc

SEQ ID NO: 1941307 - RNA, 23 nt, Human herpesvirus 4 [Epstein-Barr virus]
augcccccuuuguggugggacug

SEQ ID NO: 1941308 - RNA, 14 nt, Human herpesvirus 4 [Epstein-Barr virus]
cucugcauggagaa

SEQ ID NO: 1941309 - RNA, 19 nt, Human herpesvirus 4 [Epstein-Barr virus]
gucuccccucugcagagag

SEQ ID NO: 1941310 - RNA, 22 nt, Human herpesvirus 4 [Epstein-Barr virus]
ugugucccccuccauuccaccc

SEQ ID NO: 1941311 - RNA, 21 nt, Human herpesvirus 4 [Epstein-Barr virus]
gugcgcaacgccggccugcug

SEQ ID NO: 1941312 - RNA, 18 nt, Human herpesvirus 4 [Epstein-Barr virus]
auuugccuaacauggagg

SEQ ID NO: 1941313 - RNA, 22 nt, Human herpesvirus 4 [Epstein-Barr virus]
aggccaugcgcgcccugucacc

SEQ ID NO: 1941314 - RNA, 15 nt, Human herpesvirus 4 [Epstein-Barr virus]
uuugauaaaccuuaa

SEQ ID NO: 1941315 - RNA, 17 nt, Human herpesvirus 4 [Epstein-Barr virus]
auaaugucuucaauaga

SEQ ID NO: 1941316 - RNA, 15 nt, Human herpesvirus 4 [Epstein-Barr virus]
cagccacggcgaccu

SEQ ID NO: 1941317 - RNA, 13 nt, Human herpesvirus 4 [Epstein-Barr virus]
ucugcuggacucc

SEQ ID NO: 1941318 - RNA, 19 nt, Human herpesvirus 4 [Epstein-Barr virus]
gcuacaaacacgggccugg

SEQ ID NO: 1941319 - RNA, 15 nt, Human herpesvirus 4 [Epstein-Barr virus]
gcuugccaaaauugg

SEQ ID NO: 1941320 - RNA, 24 nt, Human herpesvirus 4 [Epstein-Barr virus]
aacccuugcccucuccagcaacca

SEQ ID NO: 1941321 - RNA, 16 nt, Human herpesvirus 4 [Epstein-Barr virus]
guccuccacggggaca

SEQ ID NO: 1941322 - RNA, 21 nt, Human herpesvirus 4 [Epstein-Barr virus]
ucccgggcaaacagggcagag

SEQ ID NO: 1941323 - RNA, 20 nt, Human herpesvirus 4 [Epstein-Barr virus]
ccaaguguuuccagacacca

SEQ ID NO: 1941324 - RNA, 11 nt, Human herpesvirus 4 [Epstein-Barr virus]
cagcucaccua

SEQ ID NO: 1941325 - RNA, 17 nt, Human herpesvirus 4 [Epstein-Barr virus]
cuauagauccugggccc

SEQ ID NO: 1941326 - RNA, 18 nt, Human herpesvirus 4 [Epstein-Barr virus]
aaguaccagcuggugguc

SEQ ID NO: 1941327 - RNA, 21 nt, Human herpesvirus 4 [Epstein-Barr virus]
gcugcucggggcaugcugccc

SEQ ID NO: 1941328 - RNA, 20 nt, Human herpesvirus 4 [Epstein-Barr virus]
uggucauggccagcuuugag

SEQ ID NO: 1941329 - RNA, 19 nt, Human herpesvirus 4 [Epstein-Barr virus]
cccgggucccgccucuccg

SEQ ID NO: 1941330 - RNA, 12 nt, Human herpesvirus 4 [Epstein-Barr virus]
acaggacauguu

SEQ ID NO: 1941331 - RNA, 21 nt, Human herpesvirus 4 [Epstein-Barr virus]
gacgggcaucuuaucagagag

SEQ ID NO: 1941332 - RNA, 22 nt, Human herpesvirus 4 [Epstein-Barr virus]
guuauuacugauugucgcuggc

SEQ ID NO: 1941333 - RNA, 19 nt, Human herpesvirus 4 [Epstein-Barr virus]
aggcgguuagggaggacac

SEQ ID NO: 1941334 - RNA, 20 nt, Human herpesvirus 4 [Epstein-Barr virus]
aaucucgcucagagcuggga

SEQ ID NO: 1941335 - RNA, 20 nt, Human herpesvirus 4 [Epstein-Barr virus]
gauucucuaaucccucuggg

SEQ ID NO: 1941336 - RNA, 16 nt, Human herpesvirus 4 [Epstein-Barr virus]
gcugaugugcugcccc

SEQ ID NO: 1941337 - RNA, 13 nt, Human herpesvirus 4 [Epstein-Barr virus]
auuucauccucag

SEQ ID NO: 1941338 - RNA, 16 nt, Human herpesvirus 4 [Epstein-Barr virus]
ggccucaaaggccucg

SEQ ID NO: 1941339 - RNA, 23 nt, Human herpesvirus 4 [Epstein-Barr virus]
ccagcuaguagcccuuggaacug

SEQ ID NO: 1941340 - RNA, 12 nt, Human herpesvirus 4 [Epstein-Barr virus]
auguacccaucc

SEQ ID NO: 1941341 - RNA, 13 nt, Human herpesvirus 4 [Epstein-Barr virus]
cuuucuaugccug

SEQ ID NO: 1941342 - RNA, 18 nt, Human herpesvirus 4 [Epstein-Barr virus]
agucccgggggaggagaa

SEQ ID NO: 1941343 - RNA, 19 nt, Human herpesvirus 4 [Epstein-Barr virus]
gcagcagugugugaagauu

SEQ ID NO: 1941344 - RNA, 19 nt, Human herpesvirus 4 [Epstein-Barr virus]
gccccccgcaccagggcca

SEQ ID NO: 1941345 - RNA, 16 nt, Human herpesvirus 4 [Epstein-Barr virus]
gagacguguguggcug

SEQ ID NO: 1941346 - RNA, 18 nt, Human herpesvirus 4 [Epstein-Barr virus]
cguuggcuucugcugcug

SEQ ID NO: 1941347 - RNA, 18 nt, Human herpesvirus 4 [Epstein-Barr virus]
aaaucaacuacaagcagc

SEQ ID NO: 1941348 - RNA, 23 nt, Human herpesvirus 4 [Epstein-Barr virus]
gaacuguacuaaauuugcugaca

SEQ ID NO: 1941349 - RNA, 16 nt, Human herpesvirus 4 [Epstein-Barr virus]
ggcgcgggucugggau

SEQ ID NO: 1941350 - RNA, 22 nt, Human herpesvirus 4 [Epstein-Barr virus]
ccacaaacaccaguguccagag

SEQ ID NO: 1941351 - RNA, 14 nt, Human herpesvirus 4 [Epstein-Barr virus]
cacucuuaccuucc

SEQ ID NO: 1941352 - RNA, 19 nt, Human herpesvirus 4 [Epstein-Barr virus]
uucaggggaaucucugcca

SEQ ID NO: 1941353 - RNA, 15 nt, Human herpesvirus 4 [Epstein-Barr virus]
cuuucuaccaggggc

SEQ ID NO: 1941354 - RNA, 19 nt, Human herpesvirus 4 [Epstein-Barr virus]
cgaucuggacccuauggag

SEQ ID NO: 1941355 - RNA, 14 nt, Human herpesvirus 4 [Epstein-Barr virus]
gcagggugcacaga

SEQ ID NO: 1941356 - RNA, 12 nt, Human herpesvirus 4 [Epstein-Barr virus]
ggcggcccagcc

SEQ ID NO: 1941357 - RNA, 21 nt, Human herpesvirus 4 [Epstein-Barr virus]
ugcugcagguaaaccuucugu

SEQ ID NO: 1941358 - RNA, 23 nt, Human herpesvirus 4 [Epstein-Barr virus]
augugccucgguggccugcucac

SEQ ID NO: 1941359 - RNA, 14 nt, Human herpesvirus 4 [Epstein-Barr virus]
cugacgaggggcca

SEQ ID NO: 1941360 - RNA, 16 nt, Human herpesvirus 4 [Epstein-Barr virus]
agaugucaaacauggu

SEQ ID NO: 1941361 - RNA, 14 nt, Human herpesvirus 4 [Epstein-Barr virus]
aggcguccgccccg

SEQ ID NO: 1941362 - RNA, 19 nt, Human herpesvirus 4 [Epstein-Barr virus]
ucccacugggacggggugg

SEQ ID NO: 1941363 - RNA, 15 nt, Human herpesvirus 4 [Epstein-Barr virus]
cgccugagcugccug

SEQ ID NO: 1941364 - RNA, 14 nt, Human herpesvirus 4 [Epstein-Barr virus]
gcucucaggccuca

SEQ ID NO: 1941365 - RNA, 23 nt, Human herpesvirus 4 [Epstein-Barr virus]
uccagcgcucuggucgcccccuc

SEQ ID NO: 1941366 - RNA, 12 nt, Human herpesvirus 4 [Epstein-Barr virus]
cuucaccaccac

SEQ ID NO: 1941367 - RNA, 19 nt, Human herpesvirus 4 [Epstein-Barr virus]
agcgggaggggcaggagca

SEQ ID NO: 1941368 - RNA, 14 nt, Human herpesvirus 4 [Epstein-Barr virus]
gacaguaccacaag

SEQ ID NO: 1941369 - RNA, 17 nt, Human herpesvirus 4 [Epstein-Barr virus]
accuuccuguguucucc

SEQ ID NO: 1941370 - RNA, 15 nt, Human herpesvirus 4 [Epstein-Barr virus]
gcaccugucccuggg

SEQ ID NO: 1941371 - RNA, 18 nt, Human herpesvirus 4 [Epstein-Barr virus]
agguguuguguccuguau

SEQ ID NO: 1941372 - RNA, 22 nt, Human herpesvirus 4 [Epstein-Barr virus]
cucauggaggggcggcagcgga

SEQ ID NO: 1941373 - RNA, 17 nt, Human herpesvirus 4 [Epstein-Barr virus]
gguguagugggugggca

SEQ ID NO: 1941374 - RNA, 21 nt, Human herpesvirus 4 [Epstein-Barr virus]
acucuccgcuuuaagaccaag

SEQ ID NO: 1941375 - RNA, 15 nt, Human herpesvirus 4 [Epstein-Barr virus]
gcaccaccgcagcca

SEQ ID NO: 1941376 - RNA, 23 nt, Human herpesvirus 4 [Epstein-Barr virus]
cacggggccgugcaccugccauc

SEQ ID NO: 1941377 - RNA, 16 nt, Human herpesvirus 4 [Epstein-Barr virus]
cacgggccuggggcca

SEQ ID NO: 1941378 - RNA, 16 nt, Human herpesvirus 4 [Epstein-Barr virus]
gccaucaccucuugau

SEQ ID NO: 1941379 - RNA, 22 nt, Human herpesvirus 4 [Epstein-Barr virus]
gcguccucuaccuggucaagag

SEQ ID NO: 1941380 - RNA, 17 nt, Human herpesvirus 4 [Epstein-Barr virus]
aucaacuucagcuccag

SEQ ID NO: 1941381 - RNA, 17 nt, Human herpesvirus 4 [Epstein-Barr virus]
gacggugggcaugacac

SEQ ID NO: 1941382 - RNA, 17 nt, Human herpesvirus 4 [Epstein-Barr virus]
agccggcggccucggag

SEQ ID NO: 1941383 - RNA, 18 nt, Human herpesvirus 4 [Epstein-Barr virus]
cccagcagauccagggcc

SEQ ID NO: 1941384 - RNA, 15 nt, Human herpesvirus 4 [Epstein-Barr virus]
cauucccccaugaga

SEQ ID NO: 1941385 - RNA, 18 nt, Human herpesvirus 4 [Epstein-Barr virus]
aauggccguccucuggac

SEQ ID NO: 1941386 - RNA, 13 nt, Human herpesvirus 4 [Epstein-Barr virus]
uggaucuggggcu

SEQ ID NO: 1941387 - RNA, 19 nt, Human herpesvirus 4 [Epstein-Barr virus]
gggcacgagauggcccagu

SEQ ID NO: 1941388 - RNA, 14 nt, Human herpesvirus 4 [Epstein-Barr virus]
uuucuaugccugaa

SEQ ID NO: 1941389 - RNA, 19 nt, Human herpesvirus 4 [Epstein-Barr virus]
ccaccggcuuggcccucuc

SEQ ID NO: 1941390 - RNA, 17 nt, Human herpesvirus 4 [Epstein-Barr virus]
guagaggcucaggccau

SEQ ID NO: 1941391 - RNA, 15 nt, Human herpesvirus 4 [Epstein-Barr virus]
ucgugaguccagggc

SEQ ID NO: 1941392 - RNA, 24 nt, Human herpesvirus 4 [Epstein-Barr virus]
gguuggcaugguauuggucgucuu

SEQ ID NO: 1941393 - RNA, 23 nt, Human herpesvirus 4 [Epstein-Barr virus]
cggcuguggccucuacgccaggc

SEQ ID NO: 1941394 - RNA, 18 nt, Human herpesvirus 4 [Epstein-Barr virus]
uccccccagaagccccca

SEQ ID NO: 1941395 - RNA, 21 nt, Human herpesvirus 4 [Epstein-Barr virus]
gaugcugccgcuacugcugcu

SEQ ID NO: 1941396 - RNA, 22 nt, Human herpesvirus 4 [Epstein-Barr virus]
cgggucaggucgcggaccaggg

SEQ ID NO: 1941397 - RNA, 16 nt, Human herpesvirus 4 [Epstein-Barr virus]
ggugccggggcccacg

SEQ ID NO: 1941398 - RNA, 18 nt, Human herpesvirus 4 [Epstein-Barr virus]
cuacaccccugagaaccc

SEQ ID NO: 1941399 - RNA, 23 nt, Human herpesvirus 4 [Epstein-Barr virus]
ccaucaccuggguacccaaacca

SEQ ID NO: 1941400 - RNA, 23 nt, Human herpesvirus 4 [Epstein-Barr virus]
caguugacggacgugcccagcuc

SEQ ID NO: 1941401 - RNA, 15 nt, Human herpesvirus 4 [Epstein-Barr virus]
caccgcagccacguc

SEQ ID NO: 1941402 - RNA, 19 nt, Human herpesvirus 4 [Epstein-Barr virus]
gagcagagguugggccacg

SEQ ID NO: 1941403 - RNA, 20 nt, Human herpesvirus 4 [Epstein-Barr virus]
uccagcccuugcgccgccuc

SEQ ID NO: 1941404 - RNA, 21 nt, Human herpesvirus 4 [Epstein-Barr virus]
uuaucagagaggccucugggg

SEQ ID NO: 1941405 - RNA, 22 nt, Human herpesvirus 4 [Epstein-Barr virus]
cacggagcagggcaacauugca

SEQ ID NO: 1941406 - RNA, 14 nt, Human herpesvirus 4 [Epstein-Barr virus]
cgggaggggcagga

SEQ ID NO: 1941407 - RNA, 19 nt, Human herpesvirus 4 [Epstein-Barr virus]
aacucccccaaacaugucc

SEQ ID NO: 1941408 - RNA, 16 nt, Human herpesvirus 4 [Epstein-Barr virus]
accucauccugcucau

SEQ ID NO: 1941409 - RNA, 14 nt, Human herpesvirus 4 [Epstein-Barr virus]
uucugucucggccu

SEQ ID NO: 1941410 - RNA, 16 nt, Human herpesvirus 4 [Epstein-Barr virus]
caagguugaagagcag

SEQ ID NO: 1941411 - RNA, 14 nt, Human herpesvirus 4 [Epstein-Barr virus]
cugccacaaggcca

SEQ ID NO: 1941412 - RNA, 13 nt, Human herpesvirus 4 [Epstein-Barr virus]
uccgcugggccag

SEQ ID NO: 1941413 - RNA, 16 nt, Human herpesvirus 4 [Epstein-Barr virus]
gagcgcacgugacaga

SEQ ID NO: 1941414 - RNA, 17 nt, Human herpesvirus 4 [Epstein-Barr virus]
ggagccagcgcuggggg

SEQ ID NO: 1941415 - RNA, 17 nt, Human herpesvirus 4 [Epstein-Barr virus]
uuugccuugugugcugu

SEQ ID NO: 1941416 - RNA, 19 nt, Human herpesvirus 4 [Epstein-Barr virus]
agccaccccagacaggaga

SEQ ID NO: 1941417 - RNA, 14 nt, Human herpesvirus 4 [Epstein-Barr virus]
ccuggaucugagcu

SEQ ID NO: 1941418 - RNA, 19 nt, Human herpesvirus 4 [Epstein-Barr virus]
cucagaauuucugcuagcu

SEQ ID NO: 1941419 - RNA, 19 nt, Human herpesvirus 4 [Epstein-Barr virus]
cucccgggcaaacagggca

SEQ ID NO: 1941420 - RNA, 12 nt, Human herpesvirus 4 [Epstein-Barr virus]
aguggcggugga

SEQ ID NO: 1941421 - RNA, 22 nt, Human herpesvirus 4 [Epstein-Barr virus]
gcaggccccccgcaccagggcc

SEQ ID NO: 1941422 - RNA, 16 nt, Human herpesvirus 4 [Epstein-Barr virus]
agcgucaggagagggc

SEQ ID NO: 1941423 - RNA, 23 nt, Human herpesvirus 4 [Epstein-Barr virus]
caacgcauccaccaucaauguca

SEQ ID NO: 1941424 - RNA, 15 nt, Human herpesvirus 4 [Epstein-Barr virus]
cgaagcgagacagua

SEQ ID NO: 1941425 - RNA, 15 nt, Human herpesvirus 4 [Epstein-Barr virus]
uccuaggagaaggag

SEQ ID NO: 1941426 - RNA, 19 nt, Human herpesvirus 4 [Epstein-Barr virus]
aaguugaugauauugaauu

SEQ ID NO: 1941427 - RNA, 22 nt, Human herpesvirus 4 [Epstein-Barr virus]
ucgucguucaggaacagccucc

SEQ ID NO: 1941428 - RNA, 20 nt, Human herpesvirus 4 [Epstein-Barr virus]
agaugagauagaggaccgga

SEQ ID NO: 1941429 - RNA, 18 nt, Human herpesvirus 4 [Epstein-Barr virus]
ugguccaggguccaggag

SEQ ID NO: 1941430 - RNA, 16 nt, Human herpesvirus 4 [Epstein-Barr virus]
auuggcagcagcucug

SEQ ID NO: 1941431 - RNA, 17 nt, Human herpesvirus 4 [Epstein-Barr virus]
uguguuccuaaaaaaug

SEQ ID NO: 1941432 - RNA, 15 nt, Human herpesvirus 4 [Epstein-Barr virus]
aaaucugacacuuua

SEQ ID NO: 1941433 - RNA, 19 nt, Human herpesvirus 4 [Epstein-Barr virus]
gugguuauuuugggccagg

SEQ ID NO: 1941434 - RNA, 17 nt, Human herpesvirus 4 [Epstein-Barr virus]
acagguacuaacacgca

SEQ ID NO: 1941435 - RNA, 17 nt, Human herpesvirus 4 [Epstein-Barr virus]
ccaaacuuuguccagau

SEQ ID NO: 1941436 - RNA, 13 nt, Human herpesvirus 4 [Epstein-Barr virus]
gcgccaccugcag

SEQ ID NO: 1941437 - RNA, 22 nt, Human herpesvirus 4 [Epstein-Barr virus]
ccccaaaaguagaggcucaggc

SEQ ID NO: 1941438 - RNA, 22 nt, Human herpesvirus 4 [Epstein-Barr virus]
acgcauccaccaucaaugucac

SEQ ID NO: 1941439 - RNA, 20 nt, Human herpesvirus 4 [Epstein-Barr virus]
uccucauuucaguggcccuc

SEQ ID NO: 1941440 - RNA, 16 nt, Human herpesvirus 4 [Epstein-Barr virus]
gccaugaccagcagca

SEQ ID NO: 1941441 - RNA, 15 nt, Human herpesvirus 4 [Epstein-Barr virus]
ggggcugguggccug

SEQ ID NO: 1941442 - RNA, 17 nt, Human herpesvirus 4 [Epstein-Barr virus]
agccacuacggccacgu

SEQ ID NO: 1941443 - RNA, 17 nt, Human herpesvirus 4 [Epstein-Barr virus]
cucagguuucugggcau

SEQ ID NO: 1941444 - RNA, 17 nt, Human herpesvirus 4 [Epstein-Barr virus]
cagcugaguccccuccu

SEQ ID NO: 1941445 - RNA, 20 nt, Human herpesvirus 4 [Epstein-Barr virus]
auuuggacaucuaguggcag

SEQ ID NO: 1941446 - RNA, 15 nt, Human herpesvirus 4 [Epstein-Barr virus]
cugaccaucacaugg

SEQ ID NO: 1941447 - RNA, 14 nt, Human herpesvirus 4 [Epstein-Barr virus]
gcucuuggucaagg

SEQ ID NO: 1941448 - RNA, 14 nt, Human herpesvirus 4 [Epstein-Barr virus]
ucugauuauagcuc

SEQ ID NO: 1941449 - RNA, 13 nt, Human herpesvirus 4 [Epstein-Barr virus]
auccgccaggacc

SEQ ID NO: 1941450 - RNA, 20 nt, Human herpesvirus 4 [Epstein-Barr virus]
ccagcuaacaggacauguuu

SEQ ID NO: 1941451 - RNA, 12 nt, Human herpesvirus 4 [Epstein-Barr virus]
gauccgccagga

SEQ ID NO: 1941452 - RNA, 14 nt, Human herpesvirus 4 [Epstein-Barr virus]
caagcugacagaag

SEQ ID NO: 1941453 - RNA, 15 nt, Human herpesvirus 4 [Epstein-Barr virus]
uggggcaauggcgac

SEQ ID NO: 1941454 - RNA, 16 nt, Human herpesvirus 4 [Epstein-Barr virus]
cuuccagagaggcgca

SEQ ID NO: 1941455 - RNA, 11 nt, Human herpesvirus 4 [Epstein-Barr virus]
caguauuuugc

SEQ ID NO: 1941456 - RNA, 23 nt, Human herpesvirus 4 [Epstein-Barr virus]
cccaaacucgacuucugaagaug

SEQ ID NO: 1941457 - RNA, 13 nt, Human herpesvirus 4 [Epstein-Barr virus]
cgcauccuaggca

SEQ ID NO: 1941458 - RNA, 18 nt, Human herpesvirus 4 [Epstein-Barr virus]
agggccacggcgugccag

SEQ ID NO: 1941459 - RNA, 15 nt, Human herpesvirus 4 [Epstein-Barr virus]
aacuuugagcugggc

SEQ ID NO: 1941460 - RNA, 14 nt, Human herpesvirus 4 [Epstein-Barr virus]
uggggcugagacca

SEQ ID NO: 1941461 - RNA, 14 nt, Human herpesvirus 4 [Epstein-Barr virus]
gcaaagggacccac

SEQ ID NO: 1941462 - RNA, 22 nt, Human herpesvirus 4 [Epstein-Barr virus]
gcccuuuuaacauuggcagcag

SEQ ID NO: 1941463 - RNA, 17 nt, Human herpesvirus 4 [Epstein-Barr virus]
cagcaacgcccagggac

SEQ ID NO: 1941464 - RNA, 16 nt, Human herpesvirus 4 [Epstein-Barr virus]
cgcuuacagccagaga

SEQ ID NO: 1941465 - RNA, 14 nt, Human herpesvirus 4 [Epstein-Barr virus]
aacacgaaugccca

SEQ ID NO: 1941466 - RNA, 19 nt, Human herpesvirus 4 [Epstein-Barr virus]
acacgcuuuugucugccug

SEQ ID NO: 1941467 - RNA, 16 nt, Human herpesvirus 4 [Epstein-Barr virus]
cccucccgcacccuca

SEQ ID NO: 1941468 - RNA, 22 nt, Human herpesvirus 4 [Epstein-Barr virus]
ucugcgccagccccgcccuccc

SEQ ID NO: 1941469 - RNA, 17 nt, Human herpesvirus 4 [Epstein-Barr virus]
uggccagguacgggcug

SEQ ID NO: 1941470 - RNA, 21 nt, Human herpesvirus 4 [Epstein-Barr virus]
gagcagaaggccauggagaac

SEQ ID NO: 1941471 - RNA, 15 nt, Human herpesvirus 4 [Epstein-Barr virus]
ucccgugcuuuuugc

SEQ ID NO: 1941472 - RNA, 13 nt, Human herpesvirus 4 [Epstein-Barr virus]
gaaaccccacgga

SEQ ID NO: 1941473 - RNA, 19 nt, Human herpesvirus 4 [Epstein-Barr virus]
ucugaccgacgggcaucuu

SEQ ID NO: 1941474 - RNA, 20 nt, Human herpesvirus 4 [Epstein-Barr virus]
gcagugguguuugcuugccc

SEQ ID NO: 1941475 - RNA, 19 nt, Human herpesvirus 4 [Epstein-Barr virus]
gccacugcaggcuggacgu

SEQ ID NO: 1941476 - RNA, 16 nt, Human herpesvirus 4 [Epstein-Barr virus]
gcugaccggcucggcc

SEQ ID NO: 1941477 - RNA, 23 nt, Human herpesvirus 4 [Epstein-Barr virus]
caaggucuggaggacggucuggc

SEQ ID NO: 1941478 - RNA, 21 nt, Human herpesvirus 4 [Epstein-Barr virus]
caccuugaggugccacagagc

SEQ ID NO: 1941479 - RNA, 14 nt, Human herpesvirus 4 [Epstein-Barr virus]
uccaaggcccaaca

SEQ ID NO: 1941480 - RNA, 19 nt, Human herpesvirus 4 [Epstein-Barr virus]
uagacagaaauugggugac

SEQ ID NO: 1941481 - RNA, 20 nt, Human herpesvirus 4 [Epstein-Barr virus]
gcuucaaguuaccuucuuuc

SEQ ID NO: 1941482 - RNA, 16 nt, Human herpesvirus 4 [Epstein-Barr virus]
cauuccuaggagaagg

SEQ ID NO: 1941483 - RNA, 12 nt, Human herpesvirus 4 [Epstein-Barr virus]
ggugaggcccag

SEQ ID NO: 1941484 - RNA, 20 nt, Human herpesvirus 4 [Epstein-Barr virus]
ugggagcaaccagcugguca

SEQ ID NO: 1941485 - RNA, 14 nt, Human herpesvirus 4 [Epstein-Barr virus]
cacgucgucagaga

SEQ ID NO: 1941486 - RNA, 22 nt, Human herpesvirus 4 [Epstein-Barr virus]
cgcccuaccucuuuuggcuggc

SEQ ID NO: 1941487 - RNA, 15 nt, Human herpesvirus 4 [Epstein-Barr virus]
ugaugacgccgagac

SEQ ID NO: 1941488 - RNA, 16 nt, Human herpesvirus 4 [Epstein-Barr virus]
cgggggugggcgguga

SEQ ID NO: 1941489 - RNA, 17 nt, Human herpesvirus 4 [Epstein-Barr virus]
uguggccggugcugcca

SEQ ID NO: 1941490 - RNA, 14 nt, Human herpesvirus 4 [Epstein-Barr virus]
caccucgggcucaa

SEQ ID NO: 1941491 - RNA, 23 nt, Human herpesvirus 4 [Epstein-Barr virus]
auuaaaggccaauuggcacucac

SEQ ID NO: 1941492 - RNA, 15 nt, Human herpesvirus 4 [Epstein-Barr virus]
ccaugcgcgcccugu

SEQ ID NO: 1941493 - RNA, 22 nt, Human herpesvirus 4 [Epstein-Barr virus]
gaugcugcagagguucagggac

SEQ ID NO: 1941494 - RNA, 17 nt, Human herpesvirus 4 [Epstein-Barr virus]
ggccacaaagagggggc

SEQ ID NO: 1941495 - RNA, 21 nt, Human herpesvirus 4 [Epstein-Barr virus]
gaccauggaugugaaugcccc

SEQ ID NO: 1941496 - RNA, 18 nt, Human herpesvirus 4 [Epstein-Barr virus]
uacaacucagccccaucu

SEQ ID NO: 1941497 - RNA, 12 nt, Human herpesvirus 4 [Epstein-Barr virus]
uggggggggugg

SEQ ID NO: 1941498 - RNA, 17 nt, Human herpesvirus 4 [Epstein-Barr virus]
aggcccagcccccuccc

SEQ ID NO: 1941499 - RNA, 16 nt, Human herpesvirus 4 [Epstein-Barr virus]
aucugagggcagugau

SEQ ID NO: 1941500 - RNA, 21 nt, Human herpesvirus 4 [Epstein-Barr virus]
guauugcgcuggccgagccug

SEQ ID NO: 1941501 - RNA, 13 nt, Human herpesvirus 4 [Epstein-Barr virus]
gaagacgaggaga

SEQ ID NO: 1941502 - RNA, 17 nt, Human herpesvirus 4 [Epstein-Barr virus]
gaccugugugcuguauu

SEQ ID NO: 1941503 - RNA, 22 nt, Human herpesvirus 4 [Epstein-Barr virus]
gaaucuccugugcuucagcagu

SEQ ID NO: 1941504 - RNA, 17 nt, Human herpesvirus 4 [Epstein-Barr virus]
augcauccgcaccacag

SEQ ID NO: 1941505 - RNA, 17 nt, Human herpesvirus 4 [Epstein-Barr virus]
cgagcuccgugggccca

SEQ ID NO: 1941506 - RNA, 19 nt, Human herpesvirus 4 [Epstein-Barr virus]
ggcugcgccugagcugccu

SEQ ID NO: 1941507 - RNA, 23 nt, Human herpesvirus 4 [Epstein-Barr virus]
ucugcuggacuccgaggaccagg

SEQ ID NO: 1941508 - RNA, 11 nt, Human herpesvirus 4 [Epstein-Barr virus]
gguauuccuca

SEQ ID NO: 1941509 - RNA, 23 nt, Human herpesvirus 4 [Epstein-Barr virus]
guuggagagauucgagaggauga

SEQ ID NO: 1941510 - RNA, 13 nt, Human herpesvirus 4 [Epstein-Barr virus]
cuuucuccuucaa

SEQ ID NO: 1941511 - RNA, 14 nt, Human herpesvirus 4 [Epstein-Barr virus]
gacccugguacagg

SEQ ID NO: 1941512 - RNA, 16 nt, Human herpesvirus 4 [Epstein-Barr virus]
cagguggcugcugcca

SEQ ID NO: 1941513 - RNA, 20 nt, Human herpesvirus 4 [Epstein-Barr virus]
auaccuauagauccugggcc

SEQ ID NO: 1941514 - RNA, 15 nt, Human herpesvirus 4 [Epstein-Barr virus]
caaccaagccacuac

SEQ ID NO: 1941515 - RNA, 16 nt, Human herpesvirus 4 [Epstein-Barr virus]
gucauggcggacugcg

SEQ ID NO: 1941516 - RNA, 16 nt, Human herpesvirus 4 [Epstein-Barr virus]
gcauccuaggcacggc

SEQ ID NO: 1941517 - RNA, 16 nt, Human herpesvirus 4 [Epstein-Barr virus]
auggauuacuggucuu

SEQ ID NO: 1941518 - RNA, 20 nt, Human herpesvirus 4 [Epstein-Barr virus]
ugcuggucauggcggacugc

SEQ ID NO: 1941519 - RNA, 21 nt, Human herpesvirus 4 [Epstein-Barr virus]
ugugcugaagcccaagaagaa

SEQ ID NO: 1941520 - RNA, 15 nt, Human herpesvirus 4 [Epstein-Barr virus]
ccaucagcucgccca

SEQ ID NO: 1941521 - RNA, 19 nt, Human herpesvirus 4 [Epstein-Barr virus]
gcgucaggagagggccaga

SEQ ID NO: 1941522 - RNA, 18 nt, Human herpesvirus 4 [Epstein-Barr virus]
aucccugucucccaccca

SEQ ID NO: 1941523 - RNA, 16 nt, Human herpesvirus 4 [Epstein-Barr virus]
cacuuuguacagacuu

SEQ ID NO: 1941524 - RNA, 18 nt, Human herpesvirus 4 [Epstein-Barr virus]
cacuugugguucuccuga

SEQ ID NO: 1941525 - RNA, 21 nt, Human herpesvirus 4 [Epstein-Barr virus]
cuaccucuguuccuucugcuc

SEQ ID NO: 1941526 - RNA, 19 nt, Human herpesvirus 4 [Epstein-Barr virus]
ccucucuggcugugcugac

SEQ ID NO: 1941527 - RNA, 15 nt, Human herpesvirus 4 [Epstein-Barr virus]
ucucccucagagucu

SEQ ID NO: 1941528 - RNA, 22 nt, Human herpesvirus 4 [Epstein-Barr virus]
cuggacgcgcagugccaagagc

SEQ ID NO: 1941529 - RNA, 21 nt, Human herpesvirus 4 [Epstein-Barr virus]
agucugacuacucagaugaag

SEQ ID NO: 1941530 - RNA, 15 nt, Human herpesvirus 4 [Epstein-Barr virus]
gucaaguaccagcug

SEQ ID NO: 1941531 - RNA, 16 nt, Human herpesvirus 4 [Epstein-Barr virus]
auaccgagauguacau

SEQ ID NO: 1941532 - RNA, 15 nt, Human herpesvirus 4 [Epstein-Barr virus]
cccaagccuggaugu

SEQ ID NO: 1941533 - RNA, 12 nt, Human herpesvirus 4 [Epstein-Barr virus]
auuccacccacu

SEQ ID NO: 1941534 - RNA, 18 nt, Human herpesvirus 4 [Epstein-Barr virus]
ggcaggcuacaacaggcu

SEQ ID NO: 1941535 - RNA, 17 nt, Human herpesvirus 4 [Epstein-Barr virus]
uggcacgacuguuccua

SEQ ID NO: 1941536 - RNA, 20 nt, Human herpesvirus 4 [Epstein-Barr virus]
gcucaaggcagucuccaccu

SEQ ID NO: 1941537 - RNA, 19 nt, Human herpesvirus 4 [Epstein-Barr virus]
caaggugucaauaauuuca

SEQ ID NO: 1941538 - RNA, 18 nt, Human herpesvirus 4 [Epstein-Barr virus]
aauucuugcacccacccc

SEQ ID NO: 1941539 - RNA, 19 nt, Human herpesvirus 4 [Epstein-Barr virus]
gcccagaggaggccccggc

SEQ ID NO: 1941540 - RNA, 22 nt, Human herpesvirus 4 [Epstein-Barr virus]
ugcuggagauuuucccacugug

SEQ ID NO: 1941541 - RNA, 21 nt, Human herpesvirus 4 [Epstein-Barr virus]
gaaccugagccugagccacac

SEQ ID NO: 1941542 - RNA, 21 nt, Human herpesvirus 4 [Epstein-Barr virus]
gcuugaggccagagacgagcu

SEQ ID NO: 1941543 - RNA, 23 nt, Human herpesvirus 4 [Epstein-Barr virus]
acauuaaccucaaccacaaaaug

SEQ ID NO: 1941544 - RNA, 19 nt, Human herpesvirus 4 [Epstein-Barr virus]
aucuguugacgguguaacu

SEQ ID NO: 1941545 - RNA, 23 nt, Human herpesvirus 4 [Epstein-Barr virus]
gagguaaugauuacgcaggccac

SEQ ID NO: 1941546 - RNA, 15 nt, Human herpesvirus 4 [Epstein-Barr virus]
aguuggucaggcuga

SEQ ID NO: 1941547 - RNA, 14 nt, Human herpesvirus 4 [Epstein-Barr virus]
uggcagcagcucug

SEQ ID NO: 1941548 - RNA, 15 nt, Human herpesvirus 4 [Epstein-Barr virus]
acggaaaucugcucu

SEQ ID NO: 1941549 - RNA, 13 nt, Human herpesvirus 4 [Epstein-Barr virus]
caccuggccaggg

SEQ ID NO: 1941550 - RNA, 19 nt, Human herpesvirus 4 [Epstein-Barr virus]
cacuugggcacggagagug

SEQ ID NO: 1941551 - RNA, 15 nt, Human herpesvirus 4 [Epstein-Barr virus]
aggggguacggagag

SEQ ID NO: 1941552 - RNA, 17 nt, Human herpesvirus 4 [Epstein-Barr virus]
auggccguccucuggac

SEQ ID NO: 1941553 - RNA, 22 nt, Human herpesvirus 4 [Epstein-Barr virus]
uggccuccagcucggccagcag

SEQ ID NO: 1941554 - RNA, 23 nt, Human herpesvirus 4 [Epstein-Barr virus]
gaagacccaucugagggcaguga

SEQ ID NO: 1941555 - RNA, 20 nt, Human herpesvirus 4 [Epstein-Barr virus]
cagcagggcacagaggugau

SEQ ID NO: 1941556 - RNA, 12 nt, Human herpesvirus 4 [Epstein-Barr virus]
ggugggcugcug

SEQ ID NO: 1941557 - RNA, 13 nt, Human herpesvirus 4 [Epstein-Barr virus]
auuguacagagcu

SEQ ID NO: 1941558 - RNA, 14 nt, Human herpesvirus 4 [Epstein-Barr virus]
ugucuuccacacca

SEQ ID NO: 1941559 - RNA, 24 nt, Human herpesvirus 4 [Epstein-Barr virus]
gcaaccagcacgucgucagagagg

SEQ ID NO: 1941560 - RNA, 22 nt, Human herpesvirus 4 [Epstein-Barr virus]
gcagcugugugcgcgccgccag

SEQ ID NO: 1941561 - RNA, 15 nt, Human herpesvirus 4 [Epstein-Barr virus]
aucaucgggaaaggc

SEQ ID NO: 1941562 - RNA, 15 nt, Human herpesvirus 4 [Epstein-Barr virus]
acacagcucuggcag

SEQ ID NO: 1941563 - RNA, 20 nt, Human herpesvirus 4 [Epstein-Barr virus]
cagcuggacgcgcagugcca

SEQ ID NO: 1941564 - RNA, 19 nt, Human herpesvirus 4 [Epstein-Barr virus]
gccacggcgucaaacaggu

SEQ ID NO: 1941565 - RNA, 17 nt, Human herpesvirus 4 [Epstein-Barr virus]
ugccugccucugcucug

SEQ ID NO: 1941566 - RNA, 19 nt, Human herpesvirus 4 [Epstein-Barr virus]
ugccuccggccgccccggg

SEQ ID NO: 1941567 - RNA, 23 nt, Human herpesvirus 4 [Epstein-Barr virus]
cuauuggguuaacggguggaagc

SEQ ID NO: 1941568 - RNA, 20 nt, Human herpesvirus 4 [Epstein-Barr virus]
ccccacaaacaccagugucc

SEQ ID NO: 1941569 - RNA, 18 nt, Human herpesvirus 4 [Epstein-Barr virus]
uagguguccagcgcucug

SEQ ID NO: 1941570 - RNA, 22 nt, Human herpesvirus 4 [Epstein-Barr virus]
caaacugacacacaggccuggc

SEQ ID NO: 1941571 - RNA, 11 nt, Human herpesvirus 4 [Epstein-Barr virus]
gaccacccgga

SEQ ID NO: 1941572 - RNA, 20 nt, Human herpesvirus 4 [Epstein-Barr virus]
cccggcuggccgccguggcc

SEQ ID NO: 1941573 - RNA, 17 nt, Human herpesvirus 4 [Epstein-Barr virus]
gagcuuccuggccggcc

SEQ ID NO: 1941574 - RNA, 16 nt, Human herpesvirus 4 [Epstein-Barr virus]
cuacucuuggcagcag

SEQ ID NO: 1941575 - RNA, 19 nt, Human herpesvirus 4 [Epstein-Barr virus]
gccagucuccgggucaggu

SEQ ID NO: 1941576 - RNA, 17 nt, Human herpesvirus 4 [Epstein-Barr virus]
acuccuggcauacuuuu

SEQ ID NO: 1941577 - RNA, 21 nt, Human herpesvirus 4 [Epstein-Barr virus]
cucgccgcuaguugguccagg

SEQ ID NO: 1941578 - RNA, 15 nt, Human herpesvirus 4 [Epstein-Barr virus]
cgcuguaacgugucg

SEQ ID NO: 1941579 - RNA, 18 nt, Human herpesvirus 4 [Epstein-Barr virus]
agcccccuccuccagguc

SEQ ID NO: 1941580 - RNA, 20 nt, Human herpesvirus 4 [Epstein-Barr virus]
cugcucggggcaugcugccc

SEQ ID NO: 1941581 - RNA, 12 nt, Human herpesvirus 4 [Epstein-Barr virus]
uaaacaagcuga

SEQ ID NO: 1941582 - RNA, 12 nt, Human herpesvirus 4 [Epstein-Barr virus]
uguccucccggg

SEQ ID NO: 1941583 - RNA, 16 nt, Human herpesvirus 4 [Epstein-Barr virus]
cugccccguugcaccg

SEQ ID NO: 1941584 - RNA, 14 nt, Human herpesvirus 4 [Epstein-Barr virus]
ucggcaccuccucg

SEQ ID NO: 1941585 - RNA, 14 nt, Human herpesvirus 4 [Epstein-Barr virus]
auugccuucuguua

SEQ ID NO: 1941586 - RNA, 12 nt, Human herpesvirus 4 [Epstein-Barr virus]
gugcucuucaug

SEQ ID NO: 1941587 - RNA, 14 nt, Human herpesvirus 4 [Epstein-Barr virus]
ugugcgcccugcuc

SEQ ID NO: 1941588 - RNA, 21 nt, Human herpesvirus 4 [Epstein-Barr virus]
gcagcugaggggcaaccugaa

SEQ ID NO: 1941589 - RNA, 23 nt, Human herpesvirus 4 [Epstein-Barr virus]
ucagaccucugcacaacacaacu

SEQ ID NO: 1941590 - RNA, 15 nt, Human herpesvirus 4 [Epstein-Barr virus]
cgguggccugcucac

SEQ ID NO: 1941591 - RNA, 16 nt, Human herpesvirus 4 [Epstein-Barr virus]
guggaacagaugcugu

SEQ ID NO: 1941592 - RNA, 15 nt, Human herpesvirus 4 [Epstein-Barr virus]
uggggccauaguggc

SEQ ID NO: 1941593 - RNA, 15 nt, Human herpesvirus 4 [Epstein-Barr virus]
agguaaucucuggua

SEQ ID NO: 1941594 - RNA, 22 nt, Human herpesvirus 4 [Epstein-Barr virus]
gccagcgccuccucgcaggccc

SEQ ID NO: 1941595 - RNA, 14 nt, Human herpesvirus 4 [Epstein-Barr virus]
caccguggccaggc

SEQ ID NO: 1941596 - RNA, 23 nt, Human herpesvirus 4 [Epstein-Barr virus]
gccgguuuugcagucgcugcugc

SEQ ID NO: 1941597 - RNA, 11 nt, Human herpesvirus 4 [Epstein-Barr virus]
aaaauaugcaa

SEQ ID NO: 1941598 - RNA, 12 nt, Human herpesvirus 4 [Epstein-Barr virus]
aagcugaagaac

SEQ ID NO: 1941599 - RNA, 19 nt, Human herpesvirus 4 [Epstein-Barr virus]
caagcuuuugaccaagcua

SEQ ID NO: 1941600 - RNA, 20 nt, Human herpesvirus 4 [Epstein-Barr virus]
uggcagaaucaccagagccc

SEQ ID NO: 1941601 - RNA, 11 nt, Human herpesvirus 4 [Epstein-Barr virus]
ccaaguacaga

SEQ ID NO: 1941602 - RNA, 14 nt, Human herpesvirus 4 [Epstein-Barr virus]
gggaagcucagcag

SEQ ID NO: 1941603 - RNA, 14 nt, Human herpesvirus 4 [Epstein-Barr virus]
gcgccguggccacc

SEQ ID NO: 1941604 - RNA, 14 nt, Human herpesvirus 4 [Epstein-Barr virus]
aaccacugaccugg

SEQ ID NO: 1941605 - RNA, 19 nt, Human herpesvirus 4 [Epstein-Barr virus]
ugucaaggcucugcacagg

SEQ ID NO: 1941606 - RNA, 16 nt, Human herpesvirus 4 [Epstein-Barr virus]
ccuucuccucagccuc

SEQ ID NO: 1941607 - RNA, 16 nt, Human herpesvirus 4 [Epstein-Barr virus]
accccccccaccacca

SEQ ID NO: 1941608 - RNA, 16 nt, Human herpesvirus 4 [Epstein-Barr virus]
auugaggacccaccuu

SEQ ID NO: 1941609 - RNA, 12 nt, Human herpesvirus 4 [Epstein-Barr virus]
ugcaguccuccg

SEQ ID NO: 1941610 - RNA, 15 nt, Human herpesvirus 4 [Epstein-Barr virus]
cagucgcuggcuggu

SEQ ID NO: 1941611 - RNA, 16 nt, Human herpesvirus 4 [Epstein-Barr virus]
guggcagcaggcgcug

SEQ ID NO: 1941612 - RNA, 21 nt, Human herpesvirus 4 [Epstein-Barr virus]
cggccaggcagaggaaggcca

SEQ ID NO: 1941613 - RNA, 19 nt, Human herpesvirus 4 [Epstein-Barr virus]
ccugaugagucacacccca

SEQ ID NO: 1941614 - RNA, 17 nt, Human herpesvirus 4 [Epstein-Barr virus]
acugacucucccuccau

SEQ ID NO: 1941615 - RNA, 13 nt, Human herpesvirus 4 [Epstein-Barr virus]
cugucucccaccc

SEQ ID NO: 1941616 - RNA, 15 nt, Human herpesvirus 4 [Epstein-Barr virus]
cucuccagccacggc

SEQ ID NO: 1941617 - RNA, 12 nt, Human herpesvirus 4 [Epstein-Barr virus]
ugacgguggugg

SEQ ID NO: 1941618 - RNA, 23 nt, Human herpesvirus 4 [Epstein-Barr virus]
aaauccucacgaccugugucugu

SEQ ID NO: 1941619 - RNA, 14 nt, Human herpesvirus 4 [Epstein-Barr virus]
uguuucaagcagcu

SEQ ID NO: 1941620 - RNA, 21 nt, Human herpesvirus 4 [Epstein-Barr virus]
ggcacacauuacggugcugga

SEQ ID NO: 1941621 - RNA, 17 nt, Human herpesvirus 4 [Epstein-Barr virus]
uguggugggacugagau

SEQ ID NO: 1941622 - RNA, 14 nt, Human herpesvirus 4 [Epstein-Barr virus]
uccgucagccaggg

SEQ ID NO: 1941623 - RNA, 11 nt, Human herpesvirus 4 [Epstein-Barr virus]
cucauuucagu

SEQ ID NO: 1941624 - RNA, 13 nt, Human herpesvirus 4 [Epstein-Barr virus]
uacccaucccggc

SEQ ID NO: 1941625 - RNA, 14 nt, Human herpesvirus 4 [Epstein-Barr virus]
gucccggguacaag

SEQ ID NO: 1941626 - RNA, 18 nt, Human herpesvirus 4 [Epstein-Barr virus]
cuuugaugaggcugaaau

SEQ ID NO: 1941627 - RNA, 18 nt, Human herpesvirus 4 [Epstein-Barr virus]
acagcgccagcagggcac

SEQ ID NO: 1941628 - RNA, 20 nt, Human herpesvirus 4 [Epstein-Barr virus]
ugugcugacccuucugcugc

SEQ ID NO: 1941629 - RNA, 11 nt, Human herpesvirus 4 [Epstein-Barr virus]
augccaaagcu

SEQ ID NO: 1941630 - RNA, 17 nt, Human herpesvirus 4 [Epstein-Barr virus]
cgacugccgccgccucc

SEQ ID NO: 1941631 - RNA, 16 nt, Human herpesvirus 4 [Epstein-Barr virus]
uguagccacccguccc

SEQ ID NO: 1941632 - RNA, 17 nt, Human herpesvirus 4 [Epstein-Barr virus]
cacgguuauggcagagc

SEQ ID NO: 1941633 - RNA, 16 nt, Human herpesvirus 4 [Epstein-Barr virus]
agcaacgcccagggac

SEQ ID NO: 1941634 - RNA, 21 nt, Human herpesvirus 4 [Epstein-Barr virus]
gccaaccugcucucucuggag

SEQ ID NO: 1941635 - RNA, 13 nt, Human herpesvirus 4 [Epstein-Barr virus]
ucuucucugcucg

SEQ ID NO: 1941636 - RNA, 20 nt, Human herpesvirus 4 [Epstein-Barr virus]
uggcuugcuccaccagcuuc

SEQ ID NO: 1941637 - RNA, 13 nt, Human herpesvirus 4 [Epstein-Barr virus]
gcgggaggggcag

SEQ ID NO: 1941638 - RNA, 18 nt, Human herpesvirus 4 [Epstein-Barr virus]
cggggaaaagagagcuga

SEQ ID NO: 1941639 - RNA, 16 nt, Human herpesvirus 4 [Epstein-Barr virus]
gcgagcaugaucagga

SEQ ID NO: 1941640 - RNA, 20 nt, Human herpesvirus 4 [Epstein-Barr virus]
agcucgcccacacagcgcca

SEQ ID NO: 1941641 - RNA, 23 nt, Human herpesvirus 4 [Epstein-Barr virus]
gccacgcgucagcaaaccagcuu

SEQ ID NO: 1941642 - RNA, 22 nt, Human herpesvirus 4 [Epstein-Barr virus]
uguaacacuacuuguuucugga

SEQ ID NO: 1941643 - RNA, 17 nt, Human herpesvirus 4 [Epstein-Barr virus]
cgagcagcgcggcagag

SEQ ID NO: 1941644 - RNA, 21 nt, Human herpesvirus 4 [Epstein-Barr virus]
uacccaauuuguucugcaugu

SEQ ID NO: 1941645 - RNA, 18 nt, Human herpesvirus 4 [Epstein-Barr virus]
ggucaagcaaacggccug

SEQ ID NO: 1941646 - RNA, 12 nt, Human herpesvirus 4 [Epstein-Barr virus]
agcgccuccucg

SEQ ID NO: 1941647 - RNA, 22 nt, Human herpesvirus 4 [Epstein-Barr virus]
acggccucgugcaaccaggccc

SEQ ID NO: 1941648 - RNA, 16 nt, Human herpesvirus 4 [Epstein-Barr virus]
uuguuaguuuaaacag

SEQ ID NO: 1941649 - RNA, 19 nt, Human herpesvirus 4 [Epstein-Barr virus]
ccagagcagcccgcacccc

SEQ ID NO: 1941650 - RNA, 14 nt, Human herpesvirus 4 [Epstein-Barr virus]
ggccugagagccgg

SEQ ID NO: 1941651 - RNA, 21 nt, Human herpesvirus 4 [Epstein-Barr virus]
cauaggcuugccugacugacu

SEQ ID NO: 1941652 - RNA, 19 nt, Human herpesvirus 4 [Epstein-Barr virus]
ccgguccccccagaagccc

SEQ ID NO: 1941653 - RNA, 13 nt, Human herpesvirus 4 [Epstein-Barr virus]
gguccgugcggcu

SEQ ID NO: 1941654 - RNA, 13 nt, Human herpesvirus 4 [Epstein-Barr virus]
cgagauggcccag

SEQ ID NO: 1941655 - RNA, 16 nt, Human herpesvirus 4 [Epstein-Barr virus]
gcugacauauguacaa

SEQ ID NO: 1941656 - RNA, 14 nt, Human herpesvirus 4 [Epstein-Barr virus]
gguggaggcugcgc

SEQ ID NO: 1941657 - RNA, 16 nt, Human herpesvirus 4 [Epstein-Barr virus]
gccaggacgcugcugu

SEQ ID NO: 1941658 - RNA, 14 nt, Human herpesvirus 4 [Epstein-Barr virus]
uuccuuuucaucau

SEQ ID NO: 1941659 - RNA, 14 nt, Human herpesvirus 4 [Epstein-Barr virus]
cacccacuacaccc

SEQ ID NO: 1941660 - RNA, 23 nt, Human herpesvirus 4 [Epstein-Barr virus]
caucugcuucuggcucuucuggg

SEQ ID NO: 1941661 - RNA, 19 nt, Human herpesvirus 4 [Epstein-Barr virus]
cgugcuuuuugccaggccu

SEQ ID NO: 1941662 - RNA, 20 nt, Human herpesvirus 4 [Epstein-Barr virus]
ucccggcgcucgucguucag

SEQ ID NO: 1941663 - RNA, 18 nt, Human herpesvirus 4 [Epstein-Barr virus]
ugacuggcagaaaggcug

SEQ ID NO: 1941664 - RNA, 14 nt, Human herpesvirus 4 [Epstein-Barr virus]
cugccuaacggucg

SEQ ID NO: 1941665 - RNA, 15 nt, Human herpesvirus 4 [Epstein-Barr virus]
gggagggacgggccu

SEQ ID NO: 1941666 - RNA, 14 nt, Human herpesvirus 4 [Epstein-Barr virus]
acucuuggcagcag

SEQ ID NO: 1941667 - RNA, 19 nt, Human herpesvirus 4 [Epstein-Barr virus]
cuuuuauuuauugcaucac

SEQ ID NO: 1941668 - RNA, 19 nt, Human herpesvirus 4 [Epstein-Barr virus]
ugccucagauagccggacc

SEQ ID NO: 1941669 - RNA, 24 nt, Human herpesvirus 4 [Epstein-Barr virus]
gaaggcuccggcggcaguggaccu

SEQ ID NO: 1941670 - RNA, 22 nt, Human herpesvirus 4 [Epstein-Barr virus]
agagcugagugcccagggcaga

SEQ ID NO: 1941671 - RNA, 11 nt, Human herpesvirus 4 [Epstein-Barr virus]
agaccaaggcc

SEQ ID NO: 1941672 - RNA, 22 nt, Human herpesvirus 4 [Epstein-Barr virus]
caccugucugacuuggccccug

SEQ ID NO: 1941673 - RNA, 14 nt, Human herpesvirus 4 [Epstein-Barr virus]
caccagcuccaggg

SEQ ID NO: 1941674 - RNA, 22 nt, Human herpesvirus 4 [Epstein-Barr virus]
ugguaguaggcacaucuggacc

SEQ ID NO: 1941675 - RNA, 19 nt, Human herpesvirus 4 [Epstein-Barr virus]
gcaagauccuucuggcacg

SEQ ID NO: 1941676 - RNA, 15 nt, Human herpesvirus 4 [Epstein-Barr virus]
aaacaggagauuggu

SEQ ID NO: 1941677 - RNA, 12 nt, Human herpesvirus 4 [Epstein-Barr virus]
agaccccaaaaa

SEQ ID NO: 1941678 - RNA, 21 nt, Human herpesvirus 4 [Epstein-Barr virus]
ggcucucccaacacaauagaa

SEQ ID NO: 1941679 - RNA, 15 nt, Human herpesvirus 4 [Epstein-Barr virus]
acucgugggaaaaug

SEQ ID NO: 1941680 - RNA, 18 nt, Human herpesvirus 4 [Epstein-Barr virus]
gacuaucaaccacuagga

SEQ ID NO: 1941681 - RNA, 13 nt, Human herpesvirus 4 [Epstein-Barr virus]
acucuucauucuu

SEQ ID NO: 1941682 - RNA, 17 nt, Human herpesvirus 4 [Epstein-Barr virus]
guggcagugauguucug

SEQ ID NO: 1941683 - RNA, 15 nt, Human herpesvirus 4 [Epstein-Barr virus]
cuccuaucacaggga

SEQ ID NO: 1941684 - RNA, 22 nt, Human herpesvirus 4 [Epstein-Barr virus]
caggagcgggaggggcaggagc

SEQ ID NO: 1941685 - RNA, 12 nt, Human herpesvirus 4 [Epstein-Barr virus]
cucccacuguca

SEQ ID NO: 1941686 - RNA, 16 nt, Human herpesvirus 4 [Epstein-Barr virus]
auacucaucugugaga

SEQ ID NO: 1941687 - RNA, 18 nt, Human herpesvirus 4 [Epstein-Barr virus]
gaaggcgcaggggagggg

SEQ ID NO: 1941688 - RNA, 14 nt, Human herpesvirus 4 [Epstein-Barr virus]
ccugccuggaucug

SEQ ID NO: 1941689 - RNA, 12 nt, Human herpesvirus 4 [Epstein-Barr virus]
ggcggugccugu

SEQ ID NO: 1941690 - RNA, 15 nt, Human herpesvirus 4 [Epstein-Barr virus]
ucuccaucagggcca

SEQ ID NO: 1941691 - RNA, 14 nt, Human herpesvirus 4 [Epstein-Barr virus]
aacagucuucaggu

SEQ ID NO: 1941692 - RNA, 17 nt, Human herpesvirus 4 [Epstein-Barr virus]
cuuuaaaggggagaugu

SEQ ID NO: 1941693 - RNA, 16 nt, Human herpesvirus 4 [Epstein-Barr virus]
aggagaauagagggga

SEQ ID NO: 1941694 - RNA, 22 nt, Human herpesvirus 4 [Epstein-Barr virus]
gacucccauguaagccugccuc

SEQ ID NO: 1941695 - RNA, 22 nt, Human herpesvirus 4 [Epstein-Barr virus]
uccacugccccgguccccccag

SEQ ID NO: 1941696 - RNA, 14 nt, Human herpesvirus 4 [Epstein-Barr virus]
agccaccccagaca

SEQ ID NO: 1941697 - RNA, 23 nt, Human herpesvirus 4 [Epstein-Barr virus]
ugcagcaccucagcuguucccag

SEQ ID NO: 1941698 - RNA, 17 nt, Human herpesvirus 4 [Epstein-Barr virus]
ggccaccgacgagcaga

SEQ ID NO: 1941699 - RNA, 17 nt, Human herpesvirus 4 [Epstein-Barr virus]
gcuggggcuggugcuca

SEQ ID NO: 1941700 - RNA, 15 nt, Human herpesvirus 4 [Epstein-Barr virus]
ggccagcaggccggc

SEQ ID NO: 1941701 - RNA, 14 nt, Human herpesvirus 4 [Epstein-Barr virus]
cucaugcgccagag

SEQ ID NO: 1941702 - RNA, 21 nt, Human herpesvirus 4 [Epstein-Barr virus]
agagugccgggcccgggacag

SEQ ID NO: 1941703 - RNA, 21 nt, Human herpesvirus 4 [Epstein-Barr virus]
gugucuggcggccgcugcgcc

SEQ ID NO: 1941704 - RNA, 16 nt, Human herpesvirus 4 [Epstein-Barr virus]
caggacauguuugggg

SEQ ID NO: 1941705 - RNA, 14 nt, Human herpesvirus 4 [Epstein-Barr virus]
ccuggcccacugga

SEQ ID NO: 1941706 - RNA, 20 nt, Human herpesvirus 4 [Epstein-Barr virus]
gagggacaguaccacaagcu

SEQ ID NO: 1941707 - RNA, 19 nt, Human herpesvirus 4 [Epstein-Barr virus]
ggugagaaguugguggugg

SEQ ID NO: 1941708 - RNA, 16 nt, Human herpesvirus 4 [Epstein-Barr virus]
ggugcguggucgggag

SEQ ID NO: 1941709 - RNA, 15 nt, Human herpesvirus 4 [Epstein-Barr virus]
cagcagacaaggaca

SEQ ID NO: 1941710 - RNA, 15 nt, Human herpesvirus 4 [Epstein-Barr virus]
cgacgagcagaggac

SEQ ID NO: 1941711 - RNA, 13 nt, Human herpesvirus 4 [Epstein-Barr virus]
cgccccgggcccg

SEQ ID NO: 1941712 - RNA, 19 nt, Human herpesvirus 4 [Epstein-Barr virus]
guugccgugguugggcaga

SEQ ID NO: 1941713 - RNA, 19 nt, Human herpesvirus 4 [Epstein-Barr virus]
cuguccuugucugcugcca

SEQ ID NO: 1941714 - RNA, 13 nt, Human herpesvirus 4 [Epstein-Barr virus]
gccguccucugga

SEQ ID NO: 1941715 - RNA, 13 nt, Human herpesvirus 4 [Epstein-Barr virus]
cccuucugcugcu

SEQ ID NO: 1941716 - RNA, 18 nt, Human herpesvirus 4 [Epstein-Barr virus]
gucgugguuuucugcccc

SEQ ID NO: 1941717 - RNA, 13 nt, Human herpesvirus 4 [Epstein-Barr virus]
cgaguccaagcug

SEQ ID NO: 1941718 - RNA, 21 nt, Human herpesvirus 4 [Epstein-Barr virus]
gagccauuggcaugggcggga

SEQ ID NO: 1941719 - RNA, 15 nt, Human herpesvirus 4 [Epstein-Barr virus]
ggaggggcggcagcg

SEQ ID NO: 1941720 - RNA, 15 nt, Human herpesvirus 4 [Epstein-Barr virus]
augccaauccaugcc

SEQ ID NO: 1941721 - RNA, 17 nt, Human herpesvirus 4 [Epstein-Barr virus]
gaacaucuggcuggggc

SEQ ID NO: 1941722 - RNA, 12 nt, Human herpesvirus 4 [Epstein-Barr virus]
uaggaauuauuu

SEQ ID NO: 1941723 - RNA, 13 nt, Human herpesvirus 4 [Epstein-Barr virus]
gagcggcugugag

SEQ ID NO: 1941724 - RNA, 24 nt, Human herpesvirus 4 [Epstein-Barr virus]
uaccagcccuuuuuccaguggcau

SEQ ID NO: 1941725 - RNA, 18 nt, Human herpesvirus 4 [Epstein-Barr virus]
gacauuucucauaauggu

SEQ ID NO: 1941726 - RNA, 20 nt, Human herpesvirus 4 [Epstein-Barr virus]
ccagugcgaggaacuggcuc

SEQ ID NO: 1941727 - RNA, 16 nt, Human herpesvirus 4 [Epstein-Barr virus]
cacucccgaggcacuu

SEQ ID NO: 1941728 - RNA, 15 nt, Human herpesvirus 4 [Epstein-Barr virus]
cggcaccuagcccac

SEQ ID NO: 1941729 - RNA, 23 nt, Human herpesvirus 4 [Epstein-Barr virus]
aaucaccgccguaaucuguggug

SEQ ID NO: 1941730 - RNA, 16 nt, Human herpesvirus 4 [Epstein-Barr virus]
ggccacacuggggacc

SEQ ID NO: 1941731 - RNA, 23 nt, Human herpesvirus 4 [Epstein-Barr virus]
cauggaggauugaggacccaccu

SEQ ID NO: 1941732 - RNA, 15 nt, Human herpesvirus 4 [Epstein-Barr virus]
ccuguguccugggca

SEQ ID NO: 1941733 - RNA, 20 nt, Human herpesvirus 4 [Epstein-Barr virus]
cgcccagggacauccccaga

SEQ ID NO: 1941734 - RNA, 22 nt, Human herpesvirus 4 [Epstein-Barr virus]
gcaucaugcgugaccaccuggc

SEQ ID NO: 1941735 - RNA, 22 nt, Human herpesvirus 4 [Epstein-Barr virus]
accuuaacuggcacacacuccc

SEQ ID NO: 1941736 - RNA, 18 nt, Human herpesvirus 4 [Epstein-Barr virus]
auagacaagaggcagaga

SEQ ID NO: 1941737 - RNA, 13 nt, Human herpesvirus 4 [Epstein-Barr virus]
accauaugaugac

SEQ ID NO: 1941738 - RNA, 16 nt, Human herpesvirus 4 [Epstein-Barr virus]
gcuacaaacacgggcc

SEQ ID NO: 1941739 - RNA, 19 nt, Human herpesvirus 4 [Epstein-Barr virus]
gccccuaggccugccacgu

SEQ ID NO: 1941740 - RNA, 15 nt, Human herpesvirus 4 [Epstein-Barr virus]
cagguggcugcugcc

SEQ ID NO: 1941741 - RNA, 22 nt, Human herpesvirus 4 [Epstein-Barr virus]
ccgucucggugcgcagacccca

SEQ ID NO: 1941742 - RNA, 14 nt, Human herpesvirus 4 [Epstein-Barr virus]
gucuucaauagaca

SEQ ID NO: 1941743 - RNA, 18 nt, Human herpesvirus 4 [Epstein-Barr virus]
ugcagcaacgcccaggga

SEQ ID NO: 1941744 - RNA, 16 nt, Human herpesvirus 4 [Epstein-Barr virus]
cccggggguggcagcc

SEQ ID NO: 1941745 - RNA, 19 nt, Human herpesvirus 4 [Epstein-Barr virus]
cacuggugguggaggagga

SEQ ID NO: 1941746 - RNA, 22 nt, Human herpesvirus 4 [Epstein-Barr virus]
gagcccauucucguccaucucg

SEQ ID NO: 1941747 - RNA, 18 nt, Human herpesvirus 4 [Epstein-Barr virus]
ggacagcacaacaagaaa

SEQ ID NO: 1941748 - RNA, 15 nt, Human herpesvirus 4 [Epstein-Barr virus]
cacaggcauugcuaa

SEQ ID NO: 1941749 - RNA, 19 nt, Human herpesvirus 4 [Epstein-Barr virus]
ugcgaaacuugggggcagg

SEQ ID NO: 1941750 - RNA, 13 nt, Human herpesvirus 4 [Epstein-Barr virus]
auguccuguggug

SEQ ID NO: 1941751 - RNA, 13 nt, Human herpesvirus 4 [Epstein-Barr virus]
uguccagaugucc

SEQ ID NO: 1941752 - RNA, 12 nt, Human herpesvirus 4 [Epstein-Barr virus]
gucugcugccau

SEQ ID NO: 1941753 - RNA, 13 nt, Human herpesvirus 4 [Epstein-Barr virus]
auaacgcaggucc

SEQ ID NO: 1941754 - RNA, 19 nt, Human herpesvirus 4 [Epstein-Barr virus]
ugccgcguguuugcugcuc

SEQ ID NO: 1941755 - RNA, 20 nt, Human herpesvirus 4 [Epstein-Barr virus]
gggauugcaacacgacggga

SEQ ID NO: 1941756 - RNA, 21 nt, Human herpesvirus 4 [Epstein-Barr virus]
cacuaucacccauggccaggc

SEQ ID NO: 1941757 - RNA, 15 nt, Human herpesvirus 4 [Epstein-Barr virus]
ccaggaccuggaugc

SEQ ID NO: 1941758 - RNA, 12 nt, Human herpesvirus 4 [Epstein-Barr virus]
uucuccugauuu

SEQ ID NO: 1941759 - RNA, 14 nt, Human herpesvirus 4 [Epstein-Barr virus]
uacaccuggcugua

SEQ ID NO: 1941760 - RNA, 18 nt, Human herpesvirus 4 [Epstein-Barr virus]
cggggaaggaggauggcc

SEQ ID NO: 1941761 - RNA, 22 nt, Human herpesvirus 4 [Epstein-Barr virus]
ccacucaggaagcuggccaggc

SEQ ID NO: 1941762 - RNA, 11 nt, Human herpesvirus 4 [Epstein-Barr virus]
cuccaggcucc

SEQ ID NO: 1941763 - RNA, 12 nt, Human herpesvirus 4 [Epstein-Barr virus]
acuccgccacca

SEQ ID NO: 1941764 - RNA, 19 nt, Human herpesvirus 4 [Epstein-Barr virus]
cugcagugggccucucugg

SEQ ID NO: 1941765 - RNA, 14 nt, Human herpesvirus 4 [Epstein-Barr virus]
gccugggaggugcu

SEQ ID NO: 1941766 - RNA, 13 nt, Human herpesvirus 4 [Epstein-Barr virus]
cggcgccucuugu

SEQ ID NO: 1941767 - RNA, 19 nt, Human herpesvirus 4 [Epstein-Barr virus]
auguggugccauguggcau

SEQ ID NO: 1941768 - RNA, 19 nt, Human herpesvirus 4 [Epstein-Barr virus]
gggucucggcacccaggca

SEQ ID NO: 1941769 - RNA, 17 nt, Human herpesvirus 4 [Epstein-Barr virus]
cccgagaccggcuccgg

SEQ ID NO: 1941770 - RNA, 17 nt, Human herpesvirus 4 [Epstein-Barr virus]
cacacacucccuuagcc

SEQ ID NO: 1941771 - RNA, 22 nt, Human herpesvirus 4 [Epstein-Barr virus]
ccagccccaauucuugcaccca

SEQ ID NO: 1941772 - RNA, 15 nt, Human herpesvirus 4 [Epstein-Barr virus]
guggggcugagacca

SEQ ID NO: 1941773 - RNA, 19 nt, Human herpesvirus 4 [Epstein-Barr virus]
ugggucgccugacccucuu

SEQ ID NO: 1941774 - RNA, 17 nt, Human herpesvirus 4 [Epstein-Barr virus]
cuccagcggcuaccugu

SEQ ID NO: 1941775 - RNA, 16 nt, Human herpesvirus 4 [Epstein-Barr virus]
ggcgaaugggcugcag

SEQ ID NO: 1941776 - RNA, 17 nt, Human herpesvirus 4 [Epstein-Barr virus]
cuggggugugaagggca

SEQ ID NO: 1941777 - RNA, 19 nt, Human herpesvirus 4 [Epstein-Barr virus]
agaugagccucucaaaggc

SEQ ID NO: 1941778 - RNA, 23 nt, Human herpesvirus 4 [Epstein-Barr virus]
gaagcccccaaaaguagaggcuc

SEQ ID NO: 1941779 - RNA, 15 nt, Human herpesvirus 4 [Epstein-Barr virus]
agaaugcccaccaga

SEQ ID NO: 1941780 - RNA, 21 nt, Human herpesvirus 4 [Epstein-Barr virus]
ugacuggcagaaaggcuggcc

SEQ ID NO: 1941781 - RNA, 17 nt, Human herpesvirus 4 [Epstein-Barr virus]
ugggugcacagguggcc

SEQ ID NO: 1941782 - RNA, 14 nt, Human herpesvirus 4 [Epstein-Barr virus]
ccuaugccuggaag

SEQ ID NO: 1941783 - RNA, 19 nt, Human herpesvirus 4 [Epstein-Barr virus]
ggcuccggauucaccggca

SEQ ID NO: 1941784 - RNA, 17 nt, Human herpesvirus 4 [Epstein-Barr virus]
ggccucgugcaaccagg

SEQ ID NO: 1941785 - RNA, 16 nt, Human herpesvirus 4 [Epstein-Barr virus]
gguuagcguggacagu

SEQ ID NO: 1941786 - RNA, 19 nt, Human herpesvirus 4 [Epstein-Barr virus]
cgcccucacgggccaucuc

SEQ ID NO: 1941787 - RNA, 16 nt, Human herpesvirus 4 [Epstein-Barr virus]
ccaugaaucugacucu

SEQ ID NO: 1941788 - RNA, 16 nt, Human herpesvirus 4 [Epstein-Barr virus]
ccuccuggccagcacc

SEQ ID NO: 1941789 - RNA, 20 nt, Human herpesvirus 4 [Epstein-Barr virus]
aggauggaagagaggggcag

SEQ ID NO: 1941790 - RNA, 18 nt, Human herpesvirus 4 [Epstein-Barr virus]
cuggggucucaggccucc

SEQ ID NO: 1941791 - RNA, 16 nt, Human herpesvirus 4 [Epstein-Barr virus]
agggcucaccagggag

SEQ ID NO: 1941792 - RNA, 16 nt, Human herpesvirus 4 [Epstein-Barr virus]
gccugagccacaccca

SEQ ID NO: 1941793 - RNA, 21 nt, Human herpesvirus 4 [Epstein-Barr virus]
gccagacucucuucagugacc

SEQ ID NO: 1941794 - RNA, 15 nt, Human herpesvirus 4 [Epstein-Barr virus]
cauuggcagcagcuc

SEQ ID NO: 1941795 - RNA, 13 nt, Human herpesvirus 4 [Epstein-Barr virus]
cugcggggaggag

SEQ ID NO: 1941796 - RNA, 16 nt, Human herpesvirus 4 [Epstein-Barr virus]
ugaaugcacgccaaca

SEQ ID NO: 1941797 - RNA, 23 nt, Human herpesvirus 4 [Epstein-Barr virus]
gaaacccaaguuuccuugccauc

SEQ ID NO: 1941798 - RNA, 16 nt, Human herpesvirus 4 [Epstein-Barr virus]
cucagguuucugggca

SEQ ID NO: 1941799 - RNA, 21 nt, Human herpesvirus 4 [Epstein-Barr virus]
cccuagagguuuugcuaggga

SEQ ID NO: 1941800 - RNA, 14 nt, Human herpesvirus 4 [Epstein-Barr virus]
gcgggggccucagc

SEQ ID NO: 1941801 - RNA, 13 nt, Human herpesvirus 4 [Epstein-Barr virus]
ggcagggggccgg

SEQ ID NO: 1941802 - RNA, 19 nt, Human herpesvirus 4 [Epstein-Barr virus]
gccgucucaaacggggaag

SEQ ID NO: 1941803 - RNA, 16 nt, Human herpesvirus 4 [Epstein-Barr virus]
aauauuaauaaauauc

SEQ ID NO: 1941804 - RNA, 13 nt, Human herpesvirus 4 [Epstein-Barr virus]
gcagaaggggccc

SEQ ID NO: 1941805 - RNA, 15 nt, Human herpesvirus 4 [Epstein-Barr virus]
acagguagcaaggac

SEQ ID NO: 1941806 - RNA, 16 nt, Human herpesvirus 4 [Epstein-Barr virus]
gggugaggcggugccu

SEQ ID NO: 1941807 - RNA, 19 nt, Human herpesvirus 4 [Epstein-Barr virus]
gauuggaaaagggcccagg

SEQ ID NO: 1941808 - RNA, 12 nt, Human herpesvirus 4 [Epstein-Barr virus]
caagcagcucac

SEQ ID NO: 1941809 - RNA, 14 nt, Human herpesvirus 4 [Epstein-Barr virus]
cugcguggcaccaa

SEQ ID NO: 1941810 - RNA, 18 nt, Human herpesvirus 4 [Epstein-Barr virus]
ccaugcccagacucaucu

SEQ ID NO: 1941811 - RNA, 12 nt, Human herpesvirus 4 [Epstein-Barr virus]
acccaacaaagc

SEQ ID NO: 1941812 - RNA, 21 nt, Human herpesvirus 4 [Epstein-Barr virus]
cuccggcggcaguggaccuca

SEQ ID NO: 1941813 - RNA, 15 nt, Human herpesvirus 4 [Epstein-Barr virus]
ccgccucccccagcc

SEQ ID NO: 1941814 - RNA, 17 nt, Human herpesvirus 4 [Epstein-Barr virus]
ccugcggacucaggcca

SEQ ID NO: 1941815 - RNA, 18 nt, Human herpesvirus 4 [Epstein-Barr virus]
ggccugugacuggugcuu

SEQ ID NO: 1941816 - RNA, 15 nt, Human herpesvirus 4 [Epstein-Barr virus]
aagguccugggccuc

SEQ ID NO: 1941817 - RNA, 18 nt, Human herpesvirus 4 [Epstein-Barr virus]
cgagggccucuggcacgc

SEQ ID NO: 1941818 - RNA, 14 nt, Human herpesvirus 4 [Epstein-Barr virus]
gccagacuccgcca

SEQ ID NO: 1941819 - RNA, 19 nt, Human herpesvirus 4 [Epstein-Barr virus]
uacucuucauucuugcuau

SEQ ID NO: 1941820 - RNA, 15 nt, Human herpesvirus 4 [Epstein-Barr virus]
caaggacaggugcca

SEQ ID NO: 1941821 - RNA, 16 nt, Human herpesvirus 4 [Epstein-Barr virus]
aggcuccuggaucugg

SEQ ID NO: 1941822 - RNA, 13 nt, Human herpesvirus 4 [Epstein-Barr virus]
ggguggacaugag

SEQ ID NO: 1941823 - RNA, 16 nt, Human herpesvirus 4 [Epstein-Barr virus]
guucccuaagcagcug

SEQ ID NO: 1941824 - RNA, 22 nt, Human herpesvirus 4 [Epstein-Barr virus]
cacaggguggggguggacauga

SEQ ID NO: 1941825 - RNA, 16 nt, Human herpesvirus 4 [Epstein-Barr virus]
gcccuccucugggccg

SEQ ID NO: 1941826 - RNA, 14 nt, Human herpesvirus 4 [Epstein-Barr virus]
gacuggcggcacug

SEQ ID NO: 1941827 - RNA, 11 nt, Human herpesvirus 4 [Epstein-Barr virus]
gcggcccagca

SEQ ID NO: 1941828 - RNA, 22 nt, Human herpesvirus 4 [Epstein-Barr virus]
ucuggggcuggccugccuggau

SEQ ID NO: 1941829 - RNA, 23 nt, Human herpesvirus 4 [Epstein-Barr virus]
aggcccuaauucagccaccuccc

SEQ ID NO: 1941830 - RNA, 15 nt, Human herpesvirus 4 [Epstein-Barr virus]
cugggccgcccggcc

SEQ ID NO: 1941831 - RNA, 11 nt, Human herpesvirus 4 [Epstein-Barr virus]
aucuguugacg

SEQ ID NO: 1941832 - RNA, 19 nt, Human herpesvirus 4 [Epstein-Barr virus]
ggcccguuccaggcucucc

SEQ ID NO: 1941833 - RNA, 12 nt, Human herpesvirus 4 [Epstein-Barr virus]
caagcagcaccu

SEQ ID NO: 1941834 - RNA, 21 nt, Human herpesvirus 4 [Epstein-Barr virus]
ugccccccuggcggcccagcc

SEQ ID NO: 1941835 - RNA, 13 nt, Human herpesvirus 4 [Epstein-Barr virus]
cugaccaggacau

SEQ ID NO: 1941836 - RNA, 14 nt, Human herpesvirus 4 [Epstein-Barr virus]
cgagaauuggcaga

SEQ ID NO: 1941837 - RNA, 17 nt, Human herpesvirus 4 [Epstein-Barr virus]
ggcggacaucauuagcc

SEQ ID NO: 1941838 - RNA, 16 nt, Human herpesvirus 4 [Epstein-Barr virus]
gggcaugcuugggcau

SEQ ID NO: 1941839 - RNA, 17 nt, Human herpesvirus 4 [Epstein-Barr virus]
cgcagaggccugcacca

SEQ ID NO: 1941840 - RNA, 18 nt, Human herpesvirus 4 [Epstein-Barr virus]
acgcucagugcggugcua

SEQ ID NO: 1941841 - RNA, 19 nt, Human herpesvirus 4 [Epstein-Barr virus]
cacucaugguacggugaua

SEQ ID NO: 1941842 - RNA, 22 nt, Human herpesvirus 4 [Epstein-Barr virus]
cggcgaugucggggcugcuggc

SEQ ID NO: 1941843 - RNA, 12 nt, Human herpesvirus 4 [Epstein-Barr virus]
gccacacugggg

SEQ ID NO: 1941844 - RNA, 22 nt, Human herpesvirus 4 [Epstein-Barr virus]
ccagaaagauacccagagcaaa

SEQ ID NO: 1941845 - RNA, 16 nt, Human herpesvirus 4 [Epstein-Barr virus]
gauuuccgucagccag

SEQ ID NO: 1941846 - RNA, 17 nt, Human herpesvirus 4 [Epstein-Barr virus]
aggucgaccaccucaac

SEQ ID NO: 1941847 - RNA, 20 nt, Human herpesvirus 4 [Epstein-Barr virus]
cucgcgccccaucuuggccc

SEQ ID NO: 1941848 - RNA, 20 nt, Human herpesvirus 4 [Epstein-Barr virus]
aggauauuaggcaaggguga

SEQ ID NO: 1941849 - RNA, 16 nt, Human herpesvirus 4 [Epstein-Barr virus]
accucccccccagacc

SEQ ID NO: 1941850 - RNA, 21 nt, Human herpesvirus 4 [Epstein-Barr virus]
ggccaccuucuccaucuccau

SEQ ID NO: 1941851 - RNA, 21 nt, Human herpesvirus 4 [Epstein-Barr virus]
caacaggugcccgagccccgc

SEQ ID NO: 1941852 - RNA, 22 nt, Human herpesvirus 4 [Epstein-Barr virus]
cagaggaggacaugugcauggc

SEQ ID NO: 1941853 - RNA, 12 nt, Human herpesvirus 4 [Epstein-Barr virus]
gccugccucugc

SEQ ID NO: 1941854 - RNA, 17 nt, Human herpesvirus 4 [Epstein-Barr virus]
gaggcggaagaccagga

SEQ ID NO: 1941855 - RNA, 12 nt, Human herpesvirus 4 [Epstein-Barr virus]
acauauguacaa

SEQ ID NO: 1941856 - RNA, 13 nt, Human herpesvirus 4 [Epstein-Barr virus]
caguccuccgcau

SEQ ID NO: 1941857 - RNA, 19 nt, Human herpesvirus 4 [Epstein-Barr virus]
uagccaccguggccaggcc

SEQ ID NO: 1941858 - RNA, 17 nt, Human herpesvirus 4 [Epstein-Barr virus]
ggcgcucugcgccagcc

SEQ ID NO: 1941859 - RNA, 18 nt, Human herpesvirus 4 [Epstein-Barr virus]
uggucgcccccucugccu

SEQ ID NO: 1941860 - RNA, 23 nt, Human herpesvirus 4 [Epstein-Barr virus]
ccugcgcuacuaugacaccuauc

SEQ ID NO: 1941861 - RNA, 15 nt, Human herpesvirus 4 [Epstein-Barr virus]
cagaccugugugcug

SEQ ID NO: 1941862 - RNA, 17 nt, Human herpesvirus 4 [Epstein-Barr virus]
cucccgcccugagcugg

SEQ ID NO: 1941863 - RNA, 14 nt, Human herpesvirus 4 [Epstein-Barr virus]
acaggggagguggc

SEQ ID NO: 1941864 - RNA, 21 nt, Human herpesvirus 4 [Epstein-Barr virus]
agccagguguacgcccuggcg

SEQ ID NO: 1941865 - RNA, 13 nt, Human herpesvirus 4 [Epstein-Barr virus]
cccgacaauaaag

SEQ ID NO: 1941866 - RNA, 17 nt, Human herpesvirus 4 [Epstein-Barr virus]
cuccaagugcaacaauc

SEQ ID NO: 1941867 - RNA, 14 nt, Human herpesvirus 4 [Epstein-Barr virus]
ggcucaggccgccg

SEQ ID NO: 1941868 - RNA, 17 nt, Human herpesvirus 4 [Epstein-Barr virus]
gacuggcacgguggcuu

SEQ ID NO: 1941869 - RNA, 17 nt, Human herpesvirus 4 [Epstein-Barr virus]
cugacccuucugcugcu

SEQ ID NO: 1941870 - RNA, 18 nt, Human herpesvirus 4 [Epstein-Barr virus]
caacagacuaaccaagcc

SEQ ID NO: 1941871 - RNA, 18 nt, Human herpesvirus 4 [Epstein-Barr virus]
gcaccgaacauggguaau

SEQ ID NO: 1941872 - RNA, 15 nt, Human herpesvirus 4 [Epstein-Barr virus]
ccagggguggcagug

SEQ ID NO: 1941873 - RNA, 17 nt, Human herpesvirus 4 [Epstein-Barr virus]
acuguuccuauaugcuc

SEQ ID NO: 1941874 - RNA, 19 nt, Human herpesvirus 4 [Epstein-Barr virus]
gcccgacgaacuccuccag

SEQ ID NO: 1941875 - RNA, 22 nt, Human herpesvirus 4 [Epstein-Barr virus]
ccggguacccuuucuaccaggg

SEQ ID NO: 1941876 - RNA, 21 nt, Human herpesvirus 4 [Epstein-Barr virus]
caaggaaacaaaaccacugac

SEQ ID NO: 1941877 - RNA, 19 nt, Human herpesvirus 4 [Epstein-Barr virus]
gaaucuugauaaaacaggu

SEQ ID NO: 1941878 - RNA, 20 nt, Human herpesvirus 4 [Epstein-Barr virus]
cggaggacgauagcccaggc

SEQ ID NO: 1941879 - RNA, 19 nt, Human herpesvirus 4 [Epstein-Barr virus]
cucugcauggagaagcugg

SEQ ID NO: 1941880 - RNA, 17 nt, Human herpesvirus 4 [Epstein-Barr virus]
ccccagcugcaucuucc

SEQ ID NO: 1941881 - RNA, 13 nt, Human herpesvirus 4 [Epstein-Barr virus]
guguuugcuugcc

SEQ ID NO: 1941882 - RNA, 14 nt, Human herpesvirus 4 [Epstein-Barr virus]
uaaaacuccacaga

SEQ ID NO: 1941883 - RNA, 16 nt, Human herpesvirus 4 [Epstein-Barr virus]
aggagauccgccagga

SEQ ID NO: 1941884 - RNA, 18 nt, Human herpesvirus 4 [Epstein-Barr virus]
auggccacgacuauccag

SEQ ID NO: 1941885 - RNA, 22 nt, Human herpesvirus 4 [Epstein-Barr virus]
ccuccccaauggggcuggcagu

SEQ ID NO: 1941886 - RNA, 17 nt, Human herpesvirus 4 [Epstein-Barr virus]
gucaggagggcagagag

SEQ ID NO: 1941887 - RNA, 21 nt, Human herpesvirus 4 [Epstein-Barr virus]
uggccgugcuggaugagguua

SEQ ID NO: 1941888 - RNA, 19 nt, Human herpesvirus 4 [Epstein-Barr virus]
ggucaaguaccagcuggug

SEQ ID NO: 1941889 - RNA, 14 nt, Human herpesvirus 4 [Epstein-Barr virus]
cugucacugugcac

SEQ ID NO: 1941890 - RNA, 21 nt, Human herpesvirus 4 [Epstein-Barr virus]
guggccucuacgccaggcucg

SEQ ID NO: 1941891 - RNA, 22 nt, Human herpesvirus 4 [Epstein-Barr virus]
ugcggcagaaauugaaagugcu

SEQ ID NO: 1941892 - RNA, 15 nt, Human herpesvirus 4 [Epstein-Barr virus]
ucagugcggugcuac

SEQ ID NO: 1941893 - RNA, 13 nt, Human herpesvirus 4 [Epstein-Barr virus]
cccaagccuggau

SEQ ID NO: 1941894 - RNA, 14 nt, Human herpesvirus 4 [Epstein-Barr virus]
ucacccauggccag

SEQ ID NO: 1941895 - RNA, 16 nt, Human herpesvirus 4 [Epstein-Barr virus]
ugccugccucugcucu

SEQ ID NO: 1941896 - RNA, 12 nt, Human herpesvirus 4 [Epstein-Barr virus]
cuggcugugcug

SEQ ID NO: 1941897 - RNA, 17 nt, Human herpesvirus 4 [Epstein-Barr virus]
gcuggccgcagcuggcg

SEQ ID NO: 1941898 - RNA, 18 nt, Human herpesvirus 4 [Epstein-Barr virus]
auugaaaccacgccugcu

SEQ ID NO: 1941899 - RNA, 22 nt, Human herpesvirus 4 [Epstein-Barr virus]
cuguaacugugguuuccaugac

SEQ ID NO: 1941900 - RNA, 18 nt, Human herpesvirus 4 [Epstein-Barr virus]
cgcagguggcugcugcca

SEQ ID NO: 1941901 - RNA, 16 nt, Human herpesvirus 4 [Epstein-Barr virus]
gcaggaggaggggcag

SEQ ID NO: 1941902 - RNA, 14 nt, Human herpesvirus 4 [Epstein-Barr virus]
auauugucccccua

SEQ ID NO: 1941903 - RNA, 12 nt, Human herpesvirus 4 [Epstein-Barr virus]
gaggcgcagccc

SEQ ID NO: 1941904 - RNA, 18 nt, Human herpesvirus 4 [Epstein-Barr virus]
cccagguaccuuccugug

SEQ ID NO: 1941905 - RNA, 18 nt, Human herpesvirus 4 [Epstein-Barr virus]
cugaucugggagaugaga

SEQ ID NO: 1941906 - RNA, 18 nt, Human herpesvirus 4 [Epstein-Barr virus]
gugaguccagggcccugg

SEQ ID NO: 1941907 - RNA, 19 nt, Human herpesvirus 4 [Epstein-Barr virus]
agcggcauccucaaggggc

SEQ ID NO: 1941908 - RNA, 18 nt, Human herpesvirus 4 [Epstein-Barr virus]
cgcagcccagcccuccgc

SEQ ID NO: 1941909 - RNA, 15 nt, Human herpesvirus 4 [Epstein-Barr virus]
ggcgguuagggagga

SEQ ID NO: 1941910 - RNA, 20 nt, Human herpesvirus 4 [Epstein-Barr virus]
gacucccauguaagccugcc

SEQ ID NO: 1941911 - RNA, 16 nt, Human herpesvirus 4 [Epstein-Barr virus]
ggcugcaaagggaccc

SEQ ID NO: 1941912 - RNA, 13 nt, Human herpesvirus 4 [Epstein-Barr virus]
uucacuuccucug

SEQ ID NO: 1941913 - RNA, 12 nt, Human herpesvirus 4 [Epstein-Barr virus]
gccuuccucugc

SEQ ID NO: 1941914 - RNA, 13 nt, Human herpesvirus 4 [Epstein-Barr virus]
ccgugucuccuga

SEQ ID NO: 1941915 - RNA, 19 nt, Human herpesvirus 4 [Epstein-Barr virus]
ggcagcagcucuggcacug

SEQ ID NO: 1941916 - RNA, 16 nt, Human herpesvirus 4 [Epstein-Barr virus]
gcuccgugagcaggag

SEQ ID NO: 1941917 - RNA, 17 nt, Human herpesvirus 4 [Epstein-Barr virus]
cuuccagagaggcgcag

SEQ ID NO: 1941918 - RNA, 17 nt, Human herpesvirus 4 [Epstein-Barr virus]
auuggacacccacccug

SEQ ID NO: 1941919 - RNA, 18 nt, Human herpesvirus 4 [Epstein-Barr virus]
cuagagcauuugcaaguc

SEQ ID NO: 1941920 - RNA, 16 nt, Human herpesvirus 4 [Epstein-Barr virus]
ggggcaggaggggcag

SEQ ID NO: 1941921 - RNA, 12 nt, Human herpesvirus 4 [Epstein-Barr virus]
acuguccagaca

SEQ ID NO: 1941922 - RNA, 23 nt, Human herpesvirus 4 [Epstein-Barr virus]
uucggucaaguaccagcuggugg

SEQ ID NO: 1941923 - RNA, 12 nt, Human herpesvirus 4 [Epstein-Barr virus]
ccccagccacag

SEQ ID NO: 1941924 - RNA, 14 nt, Human herpesvirus 4 [Epstein-Barr virus]
agcagcagcccggc

SEQ ID NO: 1941925 - RNA, 19 nt, Human herpesvirus 4 [Epstein-Barr virus]
gaggcggaagaccaggagc

SEQ ID NO: 1941926 - RNA, 19 nt, Human herpesvirus 4 [Epstein-Barr virus]
cuaggcugaaaagccacau

SEQ ID NO: 1941927 - RNA, 14 nt, Human herpesvirus 4 [Epstein-Barr virus]
guaccagcuggugg

SEQ ID NO: 1941928 - RNA, 21 nt, Human herpesvirus 4 [Epstein-Barr virus]
guggagguugucaaaaucaaa

SEQ ID NO: 1941929 - RNA, 23 nt, Human herpesvirus 4 [Epstein-Barr virus]
ccuccacuuacaaccaagccacu

SEQ ID NO: 1941930 - RNA, 16 nt, Human herpesvirus 4 [Epstein-Barr virus]
acgacaucugggagug

SEQ ID NO: 1941931 - RNA, 21 nt, Human herpesvirus 4 [Epstein-Barr virus]
cacuuucuuugcaauuugccu

SEQ ID NO: 1941932 - RNA, 19 nt, Human herpesvirus 4 [Epstein-Barr virus]
acaucuggcuggggcauua

SEQ ID NO: 1941933 - RNA, 13 nt, Human herpesvirus 4 [Epstein-Barr virus]
cgagaaggaggag

SEQ ID NO: 1941934 - RNA, 16 nt, Human herpesvirus 4 [Epstein-Barr virus]
caccagggaggccugg

SEQ ID NO: 1941935 - RNA, 14 nt, Human herpesvirus 4 [Epstein-Barr virus]
acgccugcuucacg

SEQ ID NO: 1941936 - RNA, 16 nt, Human herpesvirus 4 [Epstein-Barr virus]
caggcagccuugcgug

SEQ ID NO: 1941937 - RNA, 17 nt, Human herpesvirus 4 [Epstein-Barr virus]
cgucaucuggcucuccu

SEQ ID NO: 1941938 - RNA, 22 nt, Human herpesvirus 4 [Epstein-Barr virus]
cauccaucaacuucagcuccag

SEQ ID NO: 1941939 - RNA, 19 nt, Human herpesvirus 4 [Epstein-Barr virus]
ggcgccgcagggguggugg

SEQ ID NO: 1941940 - RNA, 23 nt, Human herpesvirus 4 [Epstein-Barr virus]
cccaguugacggacgugcccagc

SEQ ID NO: 1941941 - RNA, 17 nt, Human herpesvirus 4 [Epstein-Barr virus]
cgccgcagaagagccgc

SEQ ID NO: 1941942 - RNA, 15 nt, Human herpesvirus 4 [Epstein-Barr virus]
cucccgccucaggga

SEQ ID NO: 1941943 - RNA, 21 nt, Human herpesvirus 4 [Epstein-Barr virus]
cauguugucacgucacucagc

SEQ ID NO: 1941944 - RNA, 14 nt, Human herpesvirus 4 [Epstein-Barr virus]
uccuccuguuucug

SEQ ID NO: 1941945 - RNA, 12 nt, Human herpesvirus 4 [Epstein-Barr virus]
ucccaggccuca

SEQ ID NO: 1941946 - RNA, 15 nt, Human herpesvirus 4 [Epstein-Barr virus]
gcccccggagcccug

SEQ ID NO: 1941947 - RNA, 16 nt, Human herpesvirus 4 [Epstein-Barr virus]
gcuccguggccccggg

SEQ ID NO: 1941948 - RNA, 18 nt, Human herpesvirus 4 [Epstein-Barr virus]
uggagagaggcaaauguc

SEQ ID NO: 1941949 - RNA, 15 nt, Human herpesvirus 4 [Epstein-Barr virus]
ccagcucggccagca

SEQ ID NO: 1941950 - RNA, 21 nt, Human herpesvirus 4 [Epstein-Barr virus]
agcaacccccggcucucaggc

SEQ ID NO: 1941951 - RNA, 15 nt, Human herpesvirus 4 [Epstein-Barr virus]
acggcaugccuaaug

SEQ ID NO: 1941952 - RNA, 22 nt, Human herpesvirus 4 [Epstein-Barr virus]
agaggcgggggguaugugcugc

SEQ ID NO: 1941953 - RNA, 22 nt, Human herpesvirus 4 [Epstein-Barr virus]
gccuccaacaggugcccgagcc

SEQ ID NO: 1941954 - RNA, 15 nt, Human herpesvirus 4 [Epstein-Barr virus]
ugucucggccuccug

SEQ ID NO: 1941955 - RNA, 19 nt, Human herpesvirus 4 [Epstein-Barr virus]
cggcccgucuuacugccca

SEQ ID NO: 1941956 - RNA, 17 nt, Human herpesvirus 4 [Epstein-Barr virus]
cgccaggcucgcuuuuc

SEQ ID NO: 1941957 - RNA, 21 nt, Human herpesvirus 4 [Epstein-Barr virus]
ccgggucaggucgcggaccag

SEQ ID NO: 1941958 - RNA, 17 nt, Human herpesvirus 4 [Epstein-Barr virus]
aggcuacaacaggcugc

SEQ ID NO: 1941959 - RNA, 17 nt, Human herpesvirus 4 [Epstein-Barr virus]
aguaggugccuccagag

SEQ ID NO: 1941960 - RNA, 18 nt, Human herpesvirus 4 [Epstein-Barr virus]
ggacagacccugggccuu

SEQ ID NO: 1941961 - RNA, 17 nt, Human herpesvirus 4 [Epstein-Barr virus]
uggccgccguggccaac

SEQ ID NO: 1941962 - RNA, 13 nt, Human herpesvirus 4 [Epstein-Barr virus]
gacgcugcugcua

SEQ ID NO: 1941963 - RNA, 13 nt, Human herpesvirus 4 [Epstein-Barr virus]
ggguaagaggagg

SEQ ID NO: 1941964 - RNA, 16 nt, Human herpesvirus 4 [Epstein-Barr virus]
ccucgccuucuccuca

SEQ ID NO: 1941965 - RNA, 19 nt, Human herpesvirus 4 [Epstein-Barr virus]
gcugccccaauaugccaac

SEQ ID NO: 1941966 - RNA, 13 nt, Human herpesvirus 4 [Epstein-Barr virus]
gacgaggaggaag

SEQ ID NO: 1941967 - RNA, 20 nt, Human herpesvirus 4 [Epstein-Barr virus]
cccgggcccagcccuccuca

SEQ ID NO: 1941968 - RNA, 23 nt, Human herpesvirus 4 [Epstein-Barr virus]
agagaggccucugccgcgcugcu

SEQ ID NO: 1941969 - RNA, 11 nt, Human herpesvirus 4 [Epstein-Barr virus]
cuaagcagcug

SEQ ID NO: 1941970 - RNA, 15 nt, Human herpesvirus 4 [Epstein-Barr virus]
gcaccuguguccugg

SEQ ID NO: 1941971 - RNA, 15 nt, Human herpesvirus 4 [Epstein-Barr virus]
gaaucugggcuggga

SEQ ID NO: 1941972 - RNA, 21 nt, Human herpesvirus 4 [Epstein-Barr virus]
agaugaccaugauggugcaga

SEQ ID NO: 1941973 - RNA, 13 nt, Human herpesvirus 4 [Epstein-Barr virus]
cccucccccugcc

SEQ ID NO: 1941974 - RNA, 18 nt, Human herpesvirus 4 [Epstein-Barr virus]
cgccaccacggugcagcc

SEQ ID NO: 1941975 - RNA, 21 nt, Human herpesvirus 4 [Epstein-Barr virus]
ccaacaggugcccgagccccg

SEQ ID NO: 1941976 - RNA, 19 nt, Human herpesvirus 4 [Epstein-Barr virus]
acugcgagggggccuggug

SEQ ID NO: 1941977 - RNA, 22 nt, Human herpesvirus 4 [Epstein-Barr virus]
guauccaccuagaaagagccau

SEQ ID NO: 1941978 - RNA, 15 nt, Human herpesvirus 4 [Epstein-Barr virus]
uaacacaccacacag

SEQ ID NO: 1941979 - RNA, 19 nt, Human herpesvirus 4 [Epstein-Barr virus]
caccgucuacccagaggag

SEQ ID NO: 1941980 - RNA, 14 nt, Human herpesvirus 4 [Epstein-Barr virus]
guaagcauggggcu

SEQ ID NO: 1941981 - RNA, 13 nt, Human herpesvirus 4 [Epstein-Barr virus]
ccucggagucuuc

SEQ ID NO: 1941982 - RNA, 13 nt, Human herpesvirus 4 [Epstein-Barr virus]
cgauagcccaggc

SEQ ID NO: 1941983 - RNA, 16 nt, Human herpesvirus 4 [Epstein-Barr virus]
ugacuuggccccugug

SEQ ID NO: 1941984 - RNA, 17 nt, Human herpesvirus 4 [Epstein-Barr virus]
acacccccacuuuucca

SEQ ID NO: 1941985 - RNA, 14 nt, Human herpesvirus 4 [Epstein-Barr virus]
agcacuuugaaaga

SEQ ID NO: 1941986 - RNA, 19 nt, Human herpesvirus 4 [Epstein-Barr virus]
gcuccguccuuguccagga

SEQ ID NO: 1941987 - RNA, 20 nt, Human herpesvirus 4 [Epstein-Barr virus]
ccuucucugauggccuggag

SEQ ID NO: 1941988 - RNA, 21 nt, Human herpesvirus 4 [Epstein-Barr virus]
ugccucgaguaggugccucca

SEQ ID NO: 1941989 - RNA, 23 nt, Human herpesvirus 4 [Epstein-Barr virus]
cacccgucccggguacaaguccc

SEQ ID NO: 1941990 - RNA, 15 nt, Human herpesvirus 4 [Epstein-Barr virus]
ccaccagcuucucaa

SEQ ID NO: 1941991 - RNA, 14 nt, Human herpesvirus 4 [Epstein-Barr virus]
ucuagcaucugcua

SEQ ID NO: 1941992 - RNA, 15 nt, Human herpesvirus 4 [Epstein-Barr virus]
uggcuacuugcucag

SEQ ID NO: 1941993 - RNA, 16 nt, Human herpesvirus 4 [Epstein-Barr virus]
agacacaucuggacca

SEQ ID NO: 1941994 - RNA, 12 nt, Human herpesvirus 4 [Epstein-Barr virus]
uagagcauuugc

SEQ ID NO: 1941995 - RNA, 15 nt, Human herpesvirus 4 [Epstein-Barr virus]
aauucagccaccucc

SEQ ID NO: 1941996 - RNA, 19 nt, Human herpesvirus 4 [Epstein-Barr virus]
caccacccccaccaccucc

SEQ ID NO: 1941997 - RNA, 21 nt, Human herpesvirus 4 [Epstein-Barr virus]
auccaucugcuucuggcucuu

SEQ ID NO: 1941998 - RNA, 15 nt, Human herpesvirus 4 [Epstein-Barr virus]
cguuggaugcagucc

SEQ ID NO: 1941999 - RNA, 21 nt, Human herpesvirus 4 [Epstein-Barr virus]
caucgacacacgagccauaga

SEQ ID NO: 1942000 - RNA, 15 nt, Human herpesvirus 4 [Epstein-Barr virus]
cacuggugguggagg

SEQ ID NO: 1942001 - RNA, 12 nt, Human herpesvirus 4 [Epstein-Barr virus]
uggagaggccac

SEQ ID NO: 1942002 - RNA, 14 nt, Human herpesvirus 4 [Epstein-Barr virus]
ggcgcucugcgcca

SEQ ID NO: 1942003 - RNA, 17 nt, Human herpesvirus 4 [Epstein-Barr virus]
agccccuaggccugcca

SEQ ID NO: 1942004 - RNA, 15 nt, Human herpesvirus 4 [Epstein-Barr virus]
gccuugcguggugcu

SEQ ID NO: 1942005 - RNA, 15 nt, Human herpesvirus 4 [Epstein-Barr virus]
ucaggaucagggcca

SEQ ID NO: 1942006 - RNA, 21 nt, Human herpesvirus 4 [Epstein-Barr virus]
caccuuaacuggcacacacuc

SEQ ID NO: 1942007 - RNA, 17 nt, Human herpesvirus 4 [Epstein-Barr virus]
gacgccgagaccuaugu

SEQ ID NO: 1942008 - RNA, 15 nt, Human herpesvirus 4 [Epstein-Barr virus]
auaaaagaggccggg

SEQ ID NO: 1942009 - RNA, 13 nt, Human herpesvirus 4 [Epstein-Barr virus]
gcccucuccagca

SEQ ID NO: 1942010 - RNA, 12 nt, Human herpesvirus 4 [Epstein-Barr virus]
cuacaguauuuu

SEQ ID NO: 1942011 - RNA, 22 nt, Human herpesvirus 4 [Epstein-Barr virus]
agauuguuccaggucagaccua

SEQ ID NO: 1942012 - RNA, 21 nt, Human herpesvirus 4 [Epstein-Barr virus]
gaagcccaagaagaagcccac

SEQ ID NO: 1942013 - RNA, 15 nt, Human herpesvirus 4 [Epstein-Barr virus]
ucccgggcaaacagg

SEQ ID NO: 1942014 - RNA, 22 nt, Human herpesvirus 4 [Epstein-Barr virus]
cucagagucuacucgaccagca

SEQ ID NO: 1942015 - RNA, 14 nt, Human herpesvirus 4 [Epstein-Barr virus]
gcgaccccucgugg

SEQ ID NO: 1942016 - RNA, 22 nt, Human herpesvirus 4 [Epstein-Barr virus]
cauaacaaucuugugaaccaga

SEQ ID NO: 1942017 - RNA, 21 nt, Human herpesvirus 4 [Epstein-Barr virus]
guggccaacgcaggcacggcc

SEQ ID NO: 1942018 - RNA, 17 nt, Human herpesvirus 4 [Epstein-Barr virus]
ccccccagaagccccca

SEQ ID NO: 1942019 - RNA, 14 nt, Human herpesvirus 4 [Epstein-Barr virus]
auugagaucagaaa

SEQ ID NO: 1942020 - RNA, 15 nt, Human herpesvirus 4 [Epstein-Barr virus]
cugacccuucugcug

SEQ ID NO: 1942021 - RNA, 23 nt, Human herpesvirus 4 [Epstein-Barr virus]
cuggccaccacaucggacgggca

SEQ ID NO: 1942022 - RNA, 18 nt, Human herpesvirus 4 [Epstein-Barr virus]
ggacagcagcguccuggc

SEQ ID NO: 1942023 - RNA, 18 nt, Human herpesvirus 4 [Epstein-Barr virus]
uucugaggcggcuguggc

SEQ ID NO: 1942024 - RNA, 17 nt, Human herpesvirus 4 [Epstein-Barr virus]
cucgucguucaggaaca

SEQ ID NO: 1942025 - RNA, 20 nt, Human herpesvirus 4 [Epstein-Barr virus]
aggccugccaaagagccaga

SEQ ID NO: 1942026 - RNA, 20 nt, Human herpesvirus 4 [Epstein-Barr virus]
cacggcgucaaacaggugag

SEQ ID NO: 1942027 - RNA, 17 nt, Human herpesvirus 4 [Epstein-Barr virus]
aaaguugaugauauuga

SEQ ID NO: 1942028 - RNA, 13 nt, Human herpesvirus 4 [Epstein-Barr virus]
cacagcugcuggu

SEQ ID NO: 1942029 - RNA, 17 nt, Human herpesvirus 4 [Epstein-Barr virus]
ugcacuauauucuccag

SEQ ID NO: 1942030 - RNA, 13 nt, Human herpesvirus 4 [Epstein-Barr virus]
uccauuucauugc

SEQ ID NO: 1942031 - RNA, 23 nt, Human herpesvirus 4 [Epstein-Barr virus]
ccuccaaucaccagccaccuucc

SEQ ID NO: 1942032 - RNA, 13 nt, Human herpesvirus 4 [Epstein-Barr virus]
cggggaagaggac

SEQ ID NO: 1942033 - RNA, 13 nt, Human herpesvirus 4 [Epstein-Barr virus]
ccggccgaggccu

SEQ ID NO: 1942034 - RNA, 19 nt, Human herpesvirus 4 [Epstein-Barr virus]
aguaggcacaucuggaccu

SEQ ID NO: 1942035 - RNA, 14 nt, Human herpesvirus 4 [Epstein-Barr virus]
ugguggucagcagc

SEQ ID NO: 1942036 - RNA, 11 nt, Human herpesvirus 4 [Epstein-Barr virus]
cuacaccaccc

SEQ ID NO: 1942037 - RNA, 13 nt, Human herpesvirus 4 [Epstein-Barr virus]
uguuacuucuuuu

SEQ ID NO: 1942038 - RNA, 17 nt, Human herpesvirus 4 [Epstein-Barr virus]
acuuuuauuucaguucu

SEQ ID NO: 1942039 - RNA, 13 nt, Human herpesvirus 4 [Epstein-Barr virus]
auuguugcgcccu

SEQ ID NO: 1942040 - RNA, 14 nt, Human herpesvirus 4 [Epstein-Barr virus]
ccugagcugccugg

SEQ ID NO: 1942041 - RNA, 16 nt, Human herpesvirus 4 [Epstein-Barr virus]
ugcugcugcuggucau

SEQ ID NO: 1942042 - RNA, 17 nt, Human herpesvirus 4 [Epstein-Barr virus]
cgguggaacaggagcag

SEQ ID NO: 1942043 - RNA, 19 nt, Human herpesvirus 4 [Epstein-Barr virus]
gugguggcagcaggcgcug

SEQ ID NO: 1942044 - RNA, 22 nt, Human herpesvirus 4 [Epstein-Barr virus]
uccacccccuggagccagcgcu

SEQ ID NO: 1942045 - RNA, 19 nt, Human herpesvirus 4 [Epstein-Barr virus]
agucuacucgaccagcacg

SEQ ID NO: 1942046 - RNA, 16 nt, Human herpesvirus 4 [Epstein-Barr virus]
cugcaccccaguggac

SEQ ID NO: 1942047 - RNA, 22 nt, Human herpesvirus 4 [Epstein-Barr virus]
ccuuuggcuccuccuguuucug

SEQ ID NO: 1942048 - RNA, 17 nt, Human herpesvirus 4 [Epstein-Barr virus]
aggccaccguggcccgc

SEQ ID NO: 1942049 - RNA, 18 nt, Human herpesvirus 4 [Epstein-Barr virus]
cuaauguucucuaacugu

SEQ ID NO: 1942050 - RNA, 22 nt, Human herpesvirus 4 [Epstein-Barr virus]
uaggugccgacaccggggugcc

SEQ ID NO: 1942051 - RNA, 12 nt, Human herpesvirus 4 [Epstein-Barr virus]
uccgccaccucc

SEQ ID NO: 1942052 - RNA, 20 nt, Human herpesvirus 4 [Epstein-Barr virus]
cucccaccaccguuaugccu

SEQ ID NO: 1942053 - RNA, 12 nt, Human herpesvirus 4 [Epstein-Barr virus]
gggacaccugca

SEQ ID NO: 1942054 - RNA, 16 nt, Human herpesvirus 4 [Epstein-Barr virus]
gugaccacugagggag

SEQ ID NO: 1942055 - RNA, 18 nt, Human herpesvirus 4 [Epstein-Barr virus]
cgcggacuccgugaccaa

SEQ ID NO: 1942056 - RNA, 19 nt, Human herpesvirus 4 [Epstein-Barr virus]
agcucugguaguaggcaca

SEQ ID NO: 1942057 - RNA, 13 nt, Human herpesvirus 4 [Epstein-Barr virus]
cgggccaucuccg

SEQ ID NO: 1942058 - RNA, 23 nt, Human herpesvirus 4 [Epstein-Barr virus]
cccacuaucacccauggccaggc

SEQ ID NO: 1942059 - RNA, 20 nt, Human herpesvirus 4 [Epstein-Barr virus]
uccgcagguggcugcugcca

SEQ ID NO: 1942060 - RNA, 16 nt, Human herpesvirus 4 [Epstein-Barr virus]
cguuggcauucuacua

SEQ ID NO: 1942061 - RNA, 15 nt, Human herpesvirus 4 [Epstein-Barr virus]
ccucagaggaggagg

SEQ ID NO: 1942062 - RNA, 14 nt, Human herpesvirus 4 [Epstein-Barr virus]
ugagccacacccac

SEQ ID NO: 1942063 - RNA, 21 nt, Human herpesvirus 4 [Epstein-Barr virus]
gggccaggucacagaccagcc

SEQ ID NO: 1942064 - RNA, 22 nt, Human herpesvirus 4 [Epstein-Barr virus]
guccucaaggauggcacgggca

SEQ ID NO: 1942065 - RNA, 13 nt, Human herpesvirus 4 [Epstein-Barr virus]
aacauaaaugccc

SEQ ID NO: 1942066 - RNA, 23 nt, Human herpesvirus 4 [Epstein-Barr virus]
cacaggacaacggcauucccgug

SEQ ID NO: 1942067 - RNA, 22 nt, Human herpesvirus 4 [Epstein-Barr virus]
cccacgugaacauccugcgugg

SEQ ID NO: 1942068 - RNA, 18 nt, Human herpesvirus 4 [Epstein-Barr virus]
cauguguacuuguccuca

SEQ ID NO: 1942069 - RNA, 13 nt, Human herpesvirus 4 [Epstein-Barr virus]
caccagaucgccu

SEQ ID NO: 1942070 - RNA, 17 nt, Human herpesvirus 4 [Epstein-Barr virus]
agggaaaggaagggggc

SEQ ID NO: 1942071 - RNA, 15 nt, Human herpesvirus 4 [Epstein-Barr virus]
cagggguguaguggg

SEQ ID NO: 1942072 - RNA, 16 nt, Human herpesvirus 4 [Epstein-Barr virus]
ggucgcccccucugcc

SEQ ID NO: 1942073 - RNA, 18 nt, Human herpesvirus 4 [Epstein-Barr virus]
gguccuccacggggacac

SEQ ID NO: 1942074 - RNA, 19 nt, Human herpesvirus 4 [Epstein-Barr virus]
ggagacacaucuggaccag

SEQ ID NO: 1942075 - RNA, 15 nt, Human herpesvirus 4 [Epstein-Barr virus]
cagacucugcuuucu

SEQ ID NO: 1942076 - RNA, 19 nt, Human herpesvirus 4 [Epstein-Barr virus]
cucugauggccuggagagc

SEQ ID NO: 1942077 - RNA, 17 nt, Human herpesvirus 4 [Epstein-Barr virus]
cuacaccaccccaccau

SEQ ID NO: 1942078 - RNA, 20 nt, Human herpesvirus 4 [Epstein-Barr virus]
ugggaacacggagaucucag

SEQ ID NO: 1942079 - RNA, 15 nt, Human herpesvirus 4 [Epstein-Barr virus]
augcgaaacuacagg

SEQ ID NO: 1942080 - RNA, 15 nt, Human herpesvirus 4 [Epstein-Barr virus]
cgccucauccuggcc

SEQ ID NO: 1942081 - RNA, 24 nt, Human herpesvirus 4 [Epstein-Barr virus]
cacuuuguacagacuuuuggcaau

SEQ ID NO: 1942082 - RNA, 17 nt, Human herpesvirus 4 [Epstein-Barr virus]
cggagcccugcccuccu

SEQ ID NO: 1942083 - RNA, 18 nt, Human herpesvirus 4 [Epstein-Barr virus]
gagaggcccgggggccuu

SEQ ID NO: 1942084 - RNA, 20 nt, Human herpesvirus 4 [Epstein-Barr virus]
uuccaugacgcugcugcuac

SEQ ID NO: 1942085 - RNA, 18 nt, Human herpesvirus 4 [Epstein-Barr virus]
gcaggcauuuuuggugcu

SEQ ID NO: 1942086 - RNA, 22 nt, Human herpesvirus 4 [Epstein-Barr virus]
acgccugcuucacgccucguuu

SEQ ID NO: 1942087 - RNA, 17 nt, Human herpesvirus 4 [Epstein-Barr virus]
uguauaaugacuaugag

SEQ ID NO: 1942088 - RNA, 17 nt, Human herpesvirus 4 [Epstein-Barr virus]
ccuccauuccacccacu

SEQ ID NO: 1942089 - RNA, 13 nt, Human herpesvirus 4 [Epstein-Barr virus]
guugggguccuca

SEQ ID NO: 1942090 - RNA, 17 nt, Human herpesvirus 4 [Epstein-Barr virus]
gcacgguccagaagcag

SEQ ID NO: 1942091 - RNA, 18 nt, Human herpesvirus 4 [Epstein-Barr virus]
uuaaggugguuauuuugg

SEQ ID NO: 1942092 - RNA, 21 nt, Human herpesvirus 4 [Epstein-Barr virus]
cggguggagauagggaccaga

SEQ ID NO: 1942093 - RNA, 21 nt, Human herpesvirus 4 [Epstein-Barr virus]
cuucugaggcggcuguggccu

SEQ ID NO: 1942094 - RNA, 15 nt, Human herpesvirus 4 [Epstein-Barr virus]
acgcuccuucuuggc

SEQ ID NO: 1942095 - RNA, 19 nt, Human herpesvirus 4 [Epstein-Barr virus]
ccuccaaucaccagccacc

SEQ ID NO: 1942096 - RNA, 14 nt, Human herpesvirus 4 [Epstein-Barr virus]
cggggcggcggugg

SEQ ID NO: 1942097 - RNA, 12 nt, Human herpesvirus 4 [Epstein-Barr virus]
cccgggagccac

SEQ ID NO: 1942098 - RNA, 19 nt, Human herpesvirus 4 [Epstein-Barr virus]
cuugaucuucuucucccuc

SEQ ID NO: 1942099 - RNA, 15 nt, Human herpesvirus 4 [Epstein-Barr virus]
uuccuucucaugcuc

SEQ ID NO: 1942100 - RNA, 23 nt, Human herpesvirus 4 [Epstein-Barr virus]
cccguccagcaggcucaggccgc

SEQ ID NO: 1942101 - RNA, 17 nt, Human herpesvirus 4 [Epstein-Barr virus]
agcgccuccucgcaggc

SEQ ID NO: 1942102 - RNA, 17 nt, Human herpesvirus 4 [Epstein-Barr virus]
gagcuugaggccagaga

SEQ ID NO: 1942103 - RNA, 21 nt, Human herpesvirus 4 [Epstein-Barr virus]
ccccggggacaccugcacgag

SEQ ID NO: 1942104 - RNA, 15 nt, Human herpesvirus 4 [Epstein-Barr virus]
ggccacacagccuga

SEQ ID NO: 1942105 - RNA, 15 nt, Human herpesvirus 4 [Epstein-Barr virus]
accaggcgccgcagg

SEQ ID NO: 1942106 - RNA, 16 nt, Human herpesvirus 4 [Epstein-Barr virus]
cauguaacaagaacug

SEQ ID NO: 1942107 - RNA, 11 nt, Human herpesvirus 4 [Epstein-Barr virus]
ccgaacauggg

SEQ ID NO: 1942108 - RNA, 14 nt, Human herpesvirus 4 [Epstein-Barr virus]
agauccugggcccc

SEQ ID NO: 1942109 - RNA, 22 nt, Human herpesvirus 4 [Epstein-Barr virus]
ccgaugcccaccagccagcgac

SEQ ID NO: 1942110 - RNA, 12 nt, Human herpesvirus 4 [Epstein-Barr virus]
cacaccauccca

SEQ ID NO: 1942111 - RNA, 21 nt, Human herpesvirus 4 [Epstein-Barr virus]
ucuuccugucggcucucuuug

SEQ ID NO: 1942112 - RNA, 20 nt, Human herpesvirus 4 [Epstein-Barr virus]
gggcaucuuaucagagaggc

SEQ ID NO: 1942113 - RNA, 18 nt, Human herpesvirus 4 [Epstein-Barr virus]
gccgcuuacagccagaga

SEQ ID NO: 1942114 - RNA, 14 nt, Human herpesvirus 4 [Epstein-Barr virus]
cggcucucaggccu

SEQ ID NO: 1942115 - RNA, 16 nt, Human herpesvirus 4 [Epstein-Barr virus]
cagcuccagggccagc

SEQ ID NO: 1942116 - RNA, 13 nt, Human herpesvirus 4 [Epstein-Barr virus]
cgaccugccaaag

SEQ ID NO: 1942117 - RNA, 22 nt, Human herpesvirus 4 [Epstein-Barr virus]
ccucugaugguggccggcagcc

SEQ ID NO: 1942118 - RNA, 17 nt, Human herpesvirus 4 [Epstein-Barr virus]
cgccuggggauaagaaa

SEQ ID NO: 1942119 - RNA, 14 nt, Human herpesvirus 4 [Epstein-Barr virus]
ccgccagcgccucc

SEQ ID NO: 1942120 - RNA, 22 nt, Human herpesvirus 4 [Epstein-Barr virus]
gagacggugaccugacuggcag

SEQ ID NO: 1942121 - RNA, 14 nt, Human herpesvirus 4 [Epstein-Barr virus]
cagucgcugcugca

SEQ ID NO: 1942122 - RNA, 13 nt, Human herpesvirus 4 [Epstein-Barr virus]
cugcugcugcugg

SEQ ID NO: 1942123 - RNA, 14 nt, Human herpesvirus 4 [Epstein-Barr virus]
gcugagcgugugca

SEQ ID NO: 1942124 - RNA, 23 nt, Human herpesvirus 4 [Epstein-Barr virus]
aacauuugaggaggcacacaaaa

SEQ ID NO: 1942125 - RNA, 17 nt, Human herpesvirus 4 [Epstein-Barr virus]
gccguggcgccugggga

SEQ ID NO: 1942126 - RNA, 22 nt, Human herpesvirus 4 [Epstein-Barr virus]
uguccucccgggguccagaguu

SEQ ID NO: 1942127 - RNA, 13 nt, Human herpesvirus 4 [Epstein-Barr virus]
cuacaacaggcug

SEQ ID NO: 1942128 - RNA, 14 nt, Human herpesvirus 4 [Epstein-Barr virus]
acuacuuguuucug

SEQ ID NO: 1942129 - RNA, 13 nt, Human herpesvirus 4 [Epstein-Barr virus]
cacauucggguga

SEQ ID NO: 1942130 - RNA, 19 nt, Human herpesvirus 4 [Epstein-Barr virus]
ucccccaaacauguccugu

SEQ ID NO: 1942131 - RNA, 15 nt, Human herpesvirus 4 [Epstein-Barr virus]
uacuuugggguauuc

SEQ ID NO: 1942132 - RNA, 19 nt, Human herpesvirus 4 [Epstein-Barr virus]
cccaggcagccuugcgugg

SEQ ID NO: 1942133 - RNA, 18 nt, Human herpesvirus 4 [Epstein-Barr virus]
agcucaaccgccagggcg

SEQ ID NO: 1942134 - RNA, 13 nt, Human herpesvirus 4 [Epstein-Barr virus]
ucgaguucucuag

SEQ ID NO: 1942135 - RNA, 17 nt, Human herpesvirus 4 [Epstein-Barr virus]
cccggcccucuuccgug

SEQ ID NO: 1942136 - RNA, 21 nt, Human herpesvirus 4 [Epstein-Barr virus]
cgaggcugagaacugacgcuc

SEQ ID NO: 1942137 - RNA, 20 nt, Human herpesvirus 4 [Epstein-Barr virus]
ccuagagguuuugcuaggga

SEQ ID NO: 1942138 - RNA, 17 nt, Human herpesvirus 4 [Epstein-Barr virus]
uucuggccaaccugccu

SEQ ID NO: 1942139 - RNA, 23 nt, Human herpesvirus 4 [Epstein-Barr virus]
ucuuguaacggcauagggggagg

SEQ ID NO: 1942140 - RNA, 22 nt, Human herpesvirus 4 [Epstein-Barr virus]
aguaaccacauauacuggagau

SEQ ID NO: 1942141 - RNA, 14 nt, Human herpesvirus 4 [Epstein-Barr virus]
cagcgcuggcucca

SEQ ID NO: 1942142 - RNA, 12 nt, Human herpesvirus 4 [Epstein-Barr virus]
cccucuccagca

SEQ ID NO: 1942143 - RNA, 14 nt, Human herpesvirus 4 [Epstein-Barr virus]
caugacacaggaca

SEQ ID NO: 1942144 - RNA, 18 nt, Human herpesvirus 4 [Epstein-Barr virus]
cagcagcccggccgaggc

SEQ ID NO: 1942145 - RNA, 20 nt, Human herpesvirus 4 [Epstein-Barr virus]
cucuucagugaccggacggg

SEQ ID NO: 1942146 - RNA, 17 nt, Human herpesvirus 4 [Epstein-Barr virus]
gaugucggggcugcugg

SEQ ID NO: 1942147 - RNA, 22 nt, Human herpesvirus 4 [Epstein-Barr virus]
accucuguuccuucugcuccag

SEQ ID NO: 1942148 - RNA, 21 nt, Human herpesvirus 4 [Epstein-Barr virus]
cggccugcuggccgagcugga

SEQ ID NO: 1942149 - RNA, 16 nt, Human herpesvirus 4 [Epstein-Barr virus]
guuaacuuucuccccu

SEQ ID NO: 1942150 - RNA, 20 nt, Human herpesvirus 4 [Epstein-Barr virus]
ugcugccagagccucugcca

SEQ ID NO: 1942151 - RNA, 15 nt, Human herpesvirus 4 [Epstein-Barr virus]
ugccugccuguaauu

SEQ ID NO: 1942152 - RNA, 18 nt, Human herpesvirus 4 [Epstein-Barr virus]
ugaagcaacccccggcuc

SEQ ID NO: 1942153 - RNA, 17 nt, Human herpesvirus 4 [Epstein-Barr virus]
gccauucgacaggccau

SEQ ID NO: 1942154 - RNA, 13 nt, Human herpesvirus 4 [Epstein-Barr virus]
cguggagguuguc

SEQ ID NO: 1942155 - RNA, 17 nt, Human herpesvirus 4 [Epstein-Barr virus]
guguccagguguggaaa

SEQ ID NO: 1942156 - RNA, 16 nt, Human herpesvirus 4 [Epstein-Barr virus]
acugcgagggggccug

SEQ ID NO: 1942157 - RNA, 15 nt, Human herpesvirus 4 [Epstein-Barr virus]
cguccuuugggaaca

SEQ ID NO: 1942158 - RNA, 18 nt, Human herpesvirus 4 [Epstein-Barr virus]
cacaccaucccaauucac

SEQ ID NO: 1942159 - RNA, 14 nt, Human herpesvirus 4 [Epstein-Barr virus]
ccagcagggcacag

SEQ ID NO: 1942160 - RNA, 17 nt, Human herpesvirus 4 [Epstein-Barr virus]
gagaagggagacacauc

SEQ ID NO: 1942161 - RNA, 13 nt, Human herpesvirus 4 [Epstein-Barr virus]
ccaugaccagcag

SEQ ID NO: 1942162 - RNA, 17 nt, Human herpesvirus 4 [Epstein-Barr virus]
uaaaauuuacaccugac

SEQ ID NO: 1942163 - RNA, 22 nt, Human herpesvirus 4 [Epstein-Barr virus]
ccacuaucacccauggccaggc

SEQ ID NO: 1942164 - RNA, 21 nt, Human herpesvirus 4 [Epstein-Barr virus]
cucuggucgcccccucugccu

SEQ ID NO: 1942165 - RNA, 13 nt, Human herpesvirus 4 [Epstein-Barr virus]
gaaccagaaagau

SEQ ID NO: 1942166 - RNA, 16 nt, Human herpesvirus 4 [Epstein-Barr virus]
aggauaaucugggcag

SEQ ID NO: 1942167 - RNA, 19 nt, Human herpesvirus 4 [Epstein-Barr virus]
auacuucucuagagccagg

SEQ ID NO: 1942168 - RNA, 23 nt, Human herpesvirus 4 [Epstein-Barr virus]
aauaaauaucuuccugucggcuc

SEQ ID NO: 1942169 - RNA, 18 nt, Human herpesvirus 4 [Epstein-Barr virus]
ggcugcuauagugagcca

SEQ ID NO: 1942170 - RNA, 14 nt, Human herpesvirus 4 [Epstein-Barr virus]
auguccacugagca

SEQ ID NO: 1942171 - RNA, 16 nt, Human herpesvirus 4 [Epstein-Barr virus]
auugccauguccaagu

SEQ ID NO: 1942172 - RNA, 23 nt, Human herpesvirus 4 [Epstein-Barr virus]
cccagccuacucuccacucccag

SEQ ID NO: 1942173 - RNA, 20 nt, Human herpesvirus 4 [Epstein-Barr virus]
ugcugcucggggcaugcugc

SEQ ID NO: 1942174 - RNA, 14 nt, Human herpesvirus 4 [Epstein-Barr virus]
uuuacaucugcccg

SEQ ID NO: 1942175 - RNA, 18 nt, Human herpesvirus 4 [Epstein-Barr virus]
ggagccaccacagcacaa

SEQ ID NO: 1942176 - RNA, 21 nt, Human herpesvirus 4 [Epstein-Barr virus]
uccgggucaggucgcggacca

SEQ ID NO: 1942177 - RNA, 15 nt, Human herpesvirus 4 [Epstein-Barr virus]
ggaggacgugaguga

SEQ ID NO: 1942178 - RNA, 21 nt, Human herpesvirus 4 [Epstein-Barr virus]
gccgccggauggccuaugggu

SEQ ID NO: 1942179 - RNA, 15 nt, Human herpesvirus 4 [Epstein-Barr virus]
cucccgccccugucc

SEQ ID NO: 1942180 - RNA, 19 nt, Human herpesvirus 4 [Epstein-Barr virus]
cugccgcuacugcugcuac

SEQ ID NO: 1942181 - RNA, 16 nt, Human herpesvirus 4 [Epstein-Barr virus]
cccagcccuccucaga

SEQ ID NO: 1942182 - RNA, 14 nt, Human herpesvirus 4 [Epstein-Barr virus]
gcacccggggaacc

SEQ ID NO: 1942183 - RNA, 22 nt, Human herpesvirus 4 [Epstein-Barr virus]
auuuacgguuagugugccucug

SEQ ID NO: 1942184 - RNA, 13 nt, Human herpesvirus 4 [Epstein-Barr virus]
ccgccagcagccc

SEQ ID NO: 1942185 - RNA, 14 nt, Human herpesvirus 4 [Epstein-Barr virus]
caugagcuccucuc

SEQ ID NO: 1942186 - RNA, 22 nt, Human herpesvirus 4 [Epstein-Barr virus]
cacucauggugugagacuggaa

SEQ ID NO: 1942187 - RNA, 23 nt, Human herpesvirus 4 [Epstein-Barr virus]
cagcgagagcgacgaggaugaag

SEQ ID NO: 1942188 - RNA, 19 nt, Human herpesvirus 4 [Epstein-Barr virus]
cgcccugucccuggagcug

SEQ ID NO: 1942189 - RNA, 20 nt, Human herpesvirus 4 [Epstein-Barr virus]
uagcagaagacuccugccug

SEQ ID NO: 1942190 - RNA, 16 nt, Human herpesvirus 4 [Epstein-Barr virus]
acgacuauccaggucu

SEQ ID NO: 1942191 - RNA, 19 nt, Human herpesvirus 4 [Epstein-Barr virus]
uccuacacacaucagaccu

SEQ ID NO: 1942192 - RNA, 16 nt, Human herpesvirus 4 [Epstein-Barr virus]
cugcguccucuaccug

SEQ ID NO: 1942193 - RNA, 18 nt, Human herpesvirus 4 [Epstein-Barr virus]
ggagggcacucgcccacu

SEQ ID NO: 1942194 - RNA, 24 nt, Human herpesvirus 4 [Epstein-Barr virus]
cucugaugguggccggcagccugg

SEQ ID NO: 1942195 - RNA, 14 nt, Human herpesvirus 4 [Epstein-Barr virus]
aaggccgcugccag

SEQ ID NO: 1942196 - RNA, 22 nt, Human herpesvirus 4 [Epstein-Barr virus]
gcuccgugagcaggagcuugag

SEQ ID NO: 1942197 - RNA, 15 nt, Human herpesvirus 4 [Epstein-Barr virus]
ggcaggaggggcagg

SEQ ID NO: 1942198 - RNA, 14 nt, Human herpesvirus 4 [Epstein-Barr virus]
gaacccuagccacc

SEQ ID NO: 1942199 - RNA, 21 nt, Human herpesvirus 4 [Epstein-Barr virus]
agggaguguuccacaguaaug

SEQ ID NO: 1942200 - RNA, 12 nt, Human herpesvirus 4 [Epstein-Barr virus]
auguucagagcu

SEQ ID NO: 1942201 - RNA, 17 nt, Human herpesvirus 4 [Epstein-Barr virus]
cgccuuaugaggaccca

SEQ ID NO: 1942202 - RNA, 21 nt, Human herpesvirus 4 [Epstein-Barr virus]
ggcccugagcauggcggccug

SEQ ID NO: 1942203 - RNA, 19 nt, Human herpesvirus 4 [Epstein-Barr virus]
cuccguccuuguccaggag

SEQ ID NO: 1942204 - RNA, 17 nt, Human herpesvirus 4 [Epstein-Barr virus]
uccacaccauccacagc

SEQ ID NO: 1942205 - RNA, 12 nt, Human herpesvirus 4 [Epstein-Barr virus]
agcuucaaguua

SEQ ID NO: 1942206 - RNA, 20 nt, Human herpesvirus 4 [Epstein-Barr virus]
ugcugaggcccguccccuga

SEQ ID NO: 1942207 - RNA, 17 nt, Human herpesvirus 4 [Epstein-Barr virus]
guggguccccucugccg

SEQ ID NO: 1942208 - RNA, 13 nt, Human herpesvirus 4 [Epstein-Barr virus]
ccccgccaccacg

SEQ ID NO: 1942209 - RNA, 17 nt, Human herpesvirus 4 [Epstein-Barr virus]
aacuuugagcugggcaa

SEQ ID NO: 1942210 - RNA, 17 nt, Human herpesvirus 4 [Epstein-Barr virus]
caaacagcagcagcagu

SEQ ID NO: 1942211 - RNA, 16 nt, Human herpesvirus 4 [Epstein-Barr virus]
cgaaucugacauuucu

SEQ ID NO: 1942212 - RNA, 23 nt, Human herpesvirus 4 [Epstein-Barr virus]
aggccucucucgaguucucuagc

SEQ ID NO: 1942213 - RNA, 22 nt, Human herpesvirus 4 [Epstein-Barr virus]
ugacgcuccaggaucucccgcg

SEQ ID NO: 1942214 - RNA, 15 nt, Human herpesvirus 4 [Epstein-Barr virus]
ucagccuccaacagg

SEQ ID NO: 1942215 - RNA, 19 nt, Human herpesvirus 4 [Epstein-Barr virus]
gcauuaauguccagugggg

SEQ ID NO: 1942216 - RNA, 18 nt, Human herpesvirus 4 [Epstein-Barr virus]
cagugccuccgccugagc

SEQ ID NO: 1942217 - RNA, 13 nt, Human herpesvirus 4 [Epstein-Barr virus]
cccagacucugcu

SEQ ID NO: 1942218 - RNA, 19 nt, Human herpesvirus 4 [Epstein-Barr virus]
cgaggcugagggggcgguc

SEQ ID NO: 1942219 - RNA, 18 nt, Human herpesvirus 4 [Epstein-Barr virus]
acuuccacagcaauggca

SEQ ID NO: 1942220 - RNA, 18 nt, Human herpesvirus 4 [Epstein-Barr virus]
gcuccggauucaccggca

SEQ ID NO: 1942221 - RNA, 13 nt, Human herpesvirus 4 [Epstein-Barr virus]
ggccuuagcccag

SEQ ID NO: 1942222 - RNA, 15 nt, Human herpesvirus 4 [Epstein-Barr virus]
gggaugaacccuggg

SEQ ID NO: 1942223 - RNA, 11 nt, Human herpesvirus 4 [Epstein-Barr virus]
cgggagccacg

SEQ ID NO: 1942224 - RNA, 23 nt, Human herpesvirus 4 [Epstein-Barr virus]
cagauuuccgaaccuugucuuca

SEQ ID NO: 1942225 - RNA, 19 nt, Human herpesvirus 4 [Epstein-Barr virus]
ccgcuccguggccccggga

SEQ ID NO: 1942226 - RNA, 17 nt, Human herpesvirus 4 [Epstein-Barr virus]
ugcccauggaaugcuca

SEQ ID NO: 1942227 - RNA, 23 nt, Human herpesvirus 4 [Epstein-Barr virus]
guggcacacauuacggugcugga

SEQ ID NO: 1942228 - RNA, 23 nt, Human herpesvirus 4 [Epstein-Barr virus]
aggggcucgaauaugaugaggac

SEQ ID NO: 1942229 - RNA, 17 nt, Human herpesvirus 4 [Epstein-Barr virus]
guuauguuuuccccaug

SEQ ID NO: 1942230 - RNA, 21 nt, Human herpesvirus 4 [Epstein-Barr virus]
gucaggucgcggaccaggguc

SEQ ID NO: 1942231 - RNA, 21 nt, Human herpesvirus 4 [Epstein-Barr virus]
ugguuccccccaucuuugagg

SEQ ID NO: 1942232 - RNA, 13 nt, Human herpesvirus 4 [Epstein-Barr virus]
ucuccccugacgc

SEQ ID NO: 1942233 - RNA, 19 nt, Human herpesvirus 4 [Epstein-Barr virus]
ccgggcccagcccuccuca

SEQ ID NO: 1942234 - RNA, 18 nt, Human herpesvirus 4 [Epstein-Barr virus]
gcuguugacaugagcaug

SEQ ID NO: 1942235 - RNA, 19 nt, Human herpesvirus 4 [Epstein-Barr virus]
cucagagagcauuucaggc

SEQ ID NO: 1942236 - RNA, 19 nt, Human herpesvirus 4 [Epstein-Barr virus]
gauuaggcacuggacacac

SEQ ID NO: 1942237 - RNA, 16 nt, Human herpesvirus 4 [Epstein-Barr virus]
gcaaccuugggggcaa

SEQ ID NO: 1942238 - RNA, 22 nt, Human herpesvirus 4 [Epstein-Barr virus]
gcaccuccucgaaggugcagcu

SEQ ID NO: 1942239 - RNA, 23 nt, Human herpesvirus 4 [Epstein-Barr virus]
gguugucuucccagacucugcuu

SEQ ID NO: 1942240 - RNA, 17 nt, Human herpesvirus 4 [Epstein-Barr virus]
uaggagcccgggccagc

SEQ ID NO: 1942241 - RNA, 14 nt, Human herpesvirus 4 [Epstein-Barr virus]
ccucuaaguacagg

SEQ ID NO: 1942242 - RNA, 13 nt, Human herpesvirus 4 [Epstein-Barr virus]
ugcguggcuggac

SEQ ID NO: 1942243 - RNA, 19 nt, Human herpesvirus 4 [Epstein-Barr virus]
cguggugcuguccugcuga

SEQ ID NO: 1942244 - RNA, 14 nt, Human herpesvirus 4 [Epstein-Barr virus]
agccuccgggccgc

SEQ ID NO: 1942245 - RNA, 20 nt, Human herpesvirus 4 [Epstein-Barr virus]
cuucagcuccagggccagca

SEQ ID NO: 1942246 - RNA, 18 nt, Human herpesvirus 4 [Epstein-Barr virus]
ugccgugguugggcagaa

SEQ ID NO: 1942247 - RNA, 21 nt, Human herpesvirus 4 [Epstein-Barr virus]
cagggcccguuccaggcucuc

SEQ ID NO: 1942248 - RNA, 15 nt, Human herpesvirus 4 [Epstein-Barr virus]
agugguucuccugau

SEQ ID NO: 1942249 - RNA, 14 nt, Human herpesvirus 4 [Epstein-Barr virus]
uaagcuuaugagcg

SEQ ID NO: 1942250 - RNA, 17 nt, Human herpesvirus 4 [Epstein-Barr virus]
ggacccccggagucugg

SEQ ID NO: 1942251 - RNA, 18 nt, Human herpesvirus 4 [Epstein-Barr virus]
auagaggggagcagaggu

SEQ ID NO: 1942252 - RNA, 12 nt, Human herpesvirus 4 [Epstein-Barr virus]
gcguggguguca

SEQ ID NO: 1942253 - RNA, 18 nt, Human herpesvirus 4 [Epstein-Barr virus]
uaaacauugcaccuugcc

SEQ ID NO: 1942254 - RNA, 15 nt, Human herpesvirus 4 [Epstein-Barr virus]
cccaauucacaucuc

SEQ ID NO: 1942255 - RNA, 19 nt, Human herpesvirus 4 [Epstein-Barr virus]
gauggccuccagcucggcc

SEQ ID NO: 1942256 - RNA, 20 nt, Human herpesvirus 4 [Epstein-Barr virus]
cccgacaaugagcggggaga

SEQ ID NO: 1942257 - RNA, 16 nt, Human herpesvirus 4 [Epstein-Barr virus]
aacuugggggcaggcu

SEQ ID NO: 1942258 - RNA, 16 nt, Human herpesvirus 4 [Epstein-Barr virus]
uaaaugcaccuugacu

SEQ ID NO: 1942259 - RNA, 15 nt, Human herpesvirus 4 [Epstein-Barr virus]
ugauaaugucuucaa

SEQ ID NO: 1942260 - RNA, 17 nt, Human herpesvirus 4 [Epstein-Barr virus]
cugcggcccacugaaaa

SEQ ID NO: 1942261 - RNA, 20 nt, Human herpesvirus 4 [Epstein-Barr virus]
gucuugccguggcgccuggg

SEQ ID NO: 1942262 - RNA, 16 nt, Human herpesvirus 4 [Epstein-Barr virus]
gaccaaugccaaagcu

SEQ ID NO: 1942263 - RNA, 15 nt, Human herpesvirus 4 [Epstein-Barr virus]
aggggcaggagcagg

SEQ ID NO: 1942264 - RNA, 16 nt, Human herpesvirus 4 [Epstein-Barr virus]
cccuccucugggccgc

SEQ ID NO: 1942265 - RNA, 19 nt, Human herpesvirus 4 [Epstein-Barr virus]
ccagcuccgugguccugag

SEQ ID NO: 1942266 - RNA, 21 nt, Human herpesvirus 4 [Epstein-Barr virus]
cggcaucaccguggagccggg

SEQ ID NO: 1942267 - RNA, 13 nt, Human herpesvirus 4 [Epstein-Barr virus]
cuuccaugucuac

SEQ ID NO: 1942268 - RNA, 21 nt, Human herpesvirus 4 [Epstein-Barr virus]
cuccucgcaggccccccgcac

SEQ ID NO: 1942269 - RNA, 16 nt, Human herpesvirus 4 [Epstein-Barr virus]
uuagccccagccccuc

SEQ ID NO: 1942270 - RNA, 15 nt, Human herpesvirus 4 [Epstein-Barr virus]
cugagcaccaacaca

SEQ ID NO: 1942271 - RNA, 17 nt, Human herpesvirus 4 [Epstein-Barr virus]
gcuccaccagcuucuca

SEQ ID NO: 1942272 - RNA, 19 nt, Human herpesvirus 4 [Epstein-Barr virus]
acguacccauaacugggca

SEQ ID NO: 1942273 - RNA, 16 nt, Human herpesvirus 4 [Epstein-Barr virus]
auuacuggcgugaauu

SEQ ID NO: 1942274 - RNA, 9 nt, Human herpesvirus 4 [Epstein-Barr virus]
cuggcucuc

SEQ ID NO: 1942275 - RNA, 15 nt, Human herpesvirus 4 [Epstein-Barr virus]
guucccggcacacca

SEQ ID NO: 1942276 - RNA, 22 nt, Human herpesvirus 4 [Epstein-Barr virus]
gcagccacguccagacuccggg

SEQ ID NO: 1942277 - RNA, 19 nt, Human herpesvirus 4 [Epstein-Barr virus]
ggagcacauuccccccgcc

SEQ ID NO: 1942278 - RNA, 14 nt, Human herpesvirus 4 [Epstein-Barr virus]
gcuaauagcuuucu

SEQ ID NO: 1942279 - RNA, 14 nt, Human herpesvirus 4 [Epstein-Barr virus]
gaccggcgcgggag

SEQ ID NO: 1942280 - RNA, 15 nt, Human herpesvirus 4 [Epstein-Barr virus]
ugguucuccugauuu

SEQ ID NO: 1942281 - RNA, 16 nt, Human herpesvirus 4 [Epstein-Barr virus]
uccauuccacccacug

SEQ ID NO: 1942282 - RNA, 15 nt, Human herpesvirus 4 [Epstein-Barr virus]
caggguccaggagaa

SEQ ID NO: 1942283 - RNA, 13 nt, Human herpesvirus 4 [Epstein-Barr virus]
gaccugugucugu

SEQ ID NO: 1942284 - RNA, 20 nt, Human herpesvirus 4 [Epstein-Barr virus]
caggccccccgcaccagggc

SEQ ID NO: 1942285 - RNA, 20 nt, Human herpesvirus 4 [Epstein-Barr virus]
gaugcccaccagccagcgac

SEQ ID NO: 1942286 - RNA, 15 nt, Human herpesvirus 4 [Epstein-Barr virus]
caccugcacagaucu

SEQ ID NO: 1942287 - RNA, 21 nt, Human herpesvirus 4 [Epstein-Barr virus]
cagaccagccccucaucccug

SEQ ID NO: 1942288 - RNA, 20 nt, Human herpesvirus 4 [Epstein-Barr virus]
gccaaccugcucucucugga

SEQ ID NO: 1942289 - RNA, 18 nt, Human herpesvirus 4 [Epstein-Barr virus]
gccccgaaagcggcccag

SEQ ID NO: 1942290 - RNA, 14 nt, Human herpesvirus 4 [Epstein-Barr virus]
ggcccuggcccacc

SEQ ID NO: 1942291 - RNA, 23 nt, Human herpesvirus 4 [Epstein-Barr virus]
cagcgaccggcagaucccgcauu

SEQ ID NO: 1942292 - RNA, 18 nt, Human herpesvirus 4 [Epstein-Barr virus]
uagccaccguggccaggc

SEQ ID NO: 1942293 - RNA, 23 nt, Human herpesvirus 4 [Epstein-Barr virus]
gacgaagacccaucugagggcag

SEQ ID NO: 1942294 - RNA, 14 nt, Human herpesvirus 4 [Epstein-Barr virus]
cuccucgcaggccc

SEQ ID NO: 1942295 - RNA, 17 nt, Human herpesvirus 4 [Epstein-Barr virus]
cgcaacgccggccugcu

SEQ ID NO: 1942296 - RNA, 15 nt, Human herpesvirus 4 [Epstein-Barr virus]
gacuggggugugaag

SEQ ID NO: 1942297 - RNA, 15 nt, Human herpesvirus 4 [Epstein-Barr virus]
ucgcugcugcagcua

SEQ ID NO: 1942298 - RNA, 12 nt, Human herpesvirus 4 [Epstein-Barr virus]
gaagugggaccu

SEQ ID NO: 1942299 - RNA, 22 nt, Human herpesvirus 4 [Epstein-Barr virus]
gggcugguuggggagcuacaga

SEQ ID NO: 1942300 - RNA, 18 nt, Human herpesvirus 4 [Epstein-Barr virus]
guggaggggggcggcgug

SEQ ID NO: 1942301 - RNA, 17 nt, Human herpesvirus 4 [Epstein-Barr virus]
ugcccagacucaucuca

SEQ ID NO: 1942302 - RNA, 22 nt, Human herpesvirus 4 [Epstein-Barr virus]
aaaacucugcauggagaagcug

SEQ ID NO: 1942303 - RNA, 22 nt, Human herpesvirus 4 [Epstein-Barr virus]
uugcccucuccagcaaccaaug

SEQ ID NO: 1942304 - RNA, 19 nt, Human herpesvirus 4 [Epstein-Barr virus]
caugucugacgaggggcca

SEQ ID NO: 1942305 - RNA, 12 nt, Human herpesvirus 4 [Epstein-Barr virus]
cccggcucucag

SEQ ID NO: 1942306 - RNA, 14 nt, Human herpesvirus 4 [Epstein-Barr virus]
accacgcucuguuu

SEQ ID NO: 1942307 - RNA, 13 nt, Human herpesvirus 4 [Epstein-Barr virus]
agaagcuggacgu

SEQ ID NO: 1942308 - RNA, 21 nt, Human herpesvirus 4 [Epstein-Barr virus]
cagcccuuuuaacauuggcag

SEQ ID NO: 1942309 - RNA, 22 nt, Human herpesvirus 4 [Epstein-Barr virus]
uggcauugcggguggauagccu

SEQ ID NO: 1942310 - RNA, 14 nt, Human herpesvirus 4 [Epstein-Barr virus]
cuuccacagcaaug

SEQ ID NO: 1942311 - RNA, 21 nt, Human herpesvirus 4 [Epstein-Barr virus]
ugcugaauauugccagcgccu

SEQ ID NO: 1942312 - RNA, 19 nt, Human herpesvirus 4 [Epstein-Barr virus]
uggacuggggugugaaggg

SEQ ID NO: 1942313 - RNA, 16 nt, Human herpesvirus 4 [Epstein-Barr virus]
aggaggggcaggaggg

SEQ ID NO: 1942314 - RNA, 19 nt, Human herpesvirus 4 [Epstein-Barr virus]
cggaucgaaggagagcugg

SEQ ID NO: 1942315 - RNA, 15 nt, Human herpesvirus 4 [Epstein-Barr virus]
cggaaaucugcucuu

SEQ ID NO: 1942316 - RNA, 12 nt, Human herpesvirus 4 [Epstein-Barr virus]
agucgcugcugc

SEQ ID NO: 1942317 - RNA, 18 nt, Human herpesvirus 4 [Epstein-Barr virus]
aggcggaagaccaggagc

SEQ ID NO: 1942318 - RNA, 21 nt, Human herpesvirus 4 [Epstein-Barr virus]
gcagauagccggccaggcaga

SEQ ID NO: 1942319 - RNA, 23 nt, Human herpesvirus 4 [Epstein-Barr virus]
cucuaaaaaucaaaacuuuagag

SEQ ID NO: 1942320 - RNA, 15 nt, Human herpesvirus 4 [Epstein-Barr virus]
cucgugcaagcagca

SEQ ID NO: 1942321 - RNA, 17 nt, Human herpesvirus 4 [Epstein-Barr virus]
uuaagagucccuccuca

SEQ ID NO: 1942322 - RNA, 18 nt, Human herpesvirus 4 [Epstein-Barr virus]
acucccauguaagccugc

SEQ ID NO: 1942323 - RNA, 17 nt, Human herpesvirus 4 [Epstein-Barr virus]
ggacccggaccaaugcc

SEQ ID NO: 1942324 - RNA, 19 nt, Human herpesvirus 4 [Epstein-Barr virus]
aaaguuguccugggcugcc

SEQ ID NO: 1942325 - RNA, 12 nt, Human herpesvirus 4 [Epstein-Barr virus]
aucaucugaaaa

SEQ ID NO: 1942326 - RNA, 16 nt, Human herpesvirus 4 [Epstein-Barr virus]
gggaggcccaggaccu

SEQ ID NO: 1942327 - RNA, 22 nt, Human herpesvirus 4 [Epstein-Barr virus]
cuugcguggugcuguccugcug

SEQ ID NO: 1942328 - RNA, 18 nt, Human herpesvirus 4 [Epstein-Barr virus]
cagugaugaacaccacca

SEQ ID NO: 1942329 - RNA, 14 nt, Human herpesvirus 4 [Epstein-Barr virus]
cguguguggcugua

SEQ ID NO: 1942330 - RNA, 16 nt, Human herpesvirus 4 [Epstein-Barr virus]
acgcugguacccgcca

SEQ ID NO: 1942331 - RNA, 20 nt, Human herpesvirus 4 [Epstein-Barr virus]
cuaauggccguccucuggac

SEQ ID NO: 1942332 - RNA, 23 nt, Human herpesvirus 4 [Epstein-Barr virus]
ugcaagauaucacacccucggag

SEQ ID NO: 1942333 - RNA, 22 nt, Human herpesvirus 4 [Epstein-Barr virus]
cugaggguugguguccucccgg

SEQ ID NO: 1942334 - RNA, 21 nt, Human herpesvirus 4 [Epstein-Barr virus]
ugguggcauuaauguccagug

SEQ ID NO: 1942335 - RNA, 20 nt, Human herpesvirus 4 [Epstein-Barr virus]
cccagaccugugugcuguau

SEQ ID NO: 1942336 - RNA, 18 nt, Human herpesvirus 4 [Epstein-Barr virus]
aauucccucgaaucccua

SEQ ID NO: 1942337 - RNA, 14 nt, Human herpesvirus 4 [Epstein-Barr virus]
cacccccaccaccu

SEQ ID NO: 1942338 - RNA, 16 nt, Human herpesvirus 4 [Epstein-Barr virus]
aggcucuccagcccca

SEQ ID NO: 1942339 - RNA, 13 nt, Human herpesvirus 4 [Epstein-Barr virus]
gcguugccagacu

SEQ ID NO: 1942340 - RNA, 16 nt, Human herpesvirus 4 [Epstein-Barr virus]
gaccagcguguuucau

SEQ ID NO: 1942341 - RNA, 21 nt, Human herpesvirus 4 [Epstein-Barr virus]
gccucgaguaggugccuccag

SEQ ID NO: 1942342 - RNA, 15 nt, Human herpesvirus 4 [Epstein-Barr virus]
ccagcccuccucaga

SEQ ID NO: 1942343 - RNA, 13 nt, Human herpesvirus 4 [Epstein-Barr virus]
ggccaccaacguc

SEQ ID NO: 1942344 - RNA, 12 nt, Human herpesvirus 4 [Epstein-Barr virus]
guagaugagccu

SEQ ID NO: 1942345 - RNA, 17 nt, Human herpesvirus 4 [Epstein-Barr virus]
uccuagaaacugugcca

SEQ ID NO: 1942346 - RNA, 14 nt, Human herpesvirus 4 [Epstein-Barr virus]
ucagcacagccaga

SEQ ID NO: 1942347 - RNA, 22 nt, Human herpesvirus 4 [Epstein-Barr virus]
aaggugucaauaauuucaguga

SEQ ID NO: 1942348 - RNA, 23 nt, Human herpesvirus 4 [Epstein-Barr virus]
gaucgauuggaaaagggcccagg

SEQ ID NO: 1942349 - RNA, 19 nt, Human herpesvirus 4 [Epstein-Barr virus]
cagccgcuucagacagccg

SEQ ID NO: 1942350 - RNA, 22 nt, Human herpesvirus 4 [Epstein-Barr virus]
agaagcuacaaacacgggccug

SEQ ID NO: 1942351 - RNA, 21 nt, Human herpesvirus 4 [Epstein-Barr virus]
ugcccagacucaucucaaggg

SEQ ID NO: 1942352 - RNA, 17 nt, Human herpesvirus 4 [Epstein-Barr virus]
gcccccggagcccugcc

SEQ ID NO: 1942353 - RNA, 15 nt, Human herpesvirus 4 [Epstein-Barr virus]
gugcuguugggccuu

SEQ ID NO: 1942354 - RNA, 14 nt, Human herpesvirus 4 [Epstein-Barr virus]
cgaguggcagaauc

SEQ ID NO: 1942355 - RNA, 16 nt, Human herpesvirus 4 [Epstein-Barr virus]
ucuccugugugacccc

SEQ ID NO: 1942356 - RNA, 21 nt, Human herpesvirus 4 [Epstein-Barr virus]
ugcaucuuaccccuggcuucc

SEQ ID NO: 1942357 - RNA, 13 nt, Human herpesvirus 4 [Epstein-Barr virus]
ggaggagugcugc

SEQ ID NO: 1942358 - RNA, 16 nt, Human herpesvirus 4 [Epstein-Barr virus]
uccaggggccacacag

SEQ ID NO: 1942359 - RNA, 12 nt, Human herpesvirus 4 [Epstein-Barr virus]
gcccuggucagg

SEQ ID NO: 1942360 - RNA, 13 nt, Human herpesvirus 4 [Epstein-Barr virus]
cgggucucgccgc

SEQ ID NO: 1942361 - RNA, 16 nt, Human herpesvirus 4 [Epstein-Barr virus]
uggcacgguccagaag

SEQ ID NO: 1942362 - RNA, 15 nt, Human herpesvirus 4 [Epstein-Barr virus]
ccaccguggccaggc

SEQ ID NO: 1942363 - RNA, 23 nt, Human herpesvirus 4 [Epstein-Barr virus]
cuuggcagcaguggccagcucau

SEQ ID NO: 1942364 - RNA, 16 nt, Human herpesvirus 4 [Epstein-Barr virus]
caggaggggcaggagc

SEQ ID NO: 1942365 - RNA, 14 nt, Human herpesvirus 4 [Epstein-Barr virus]
cucuaaucccucug

SEQ ID NO: 1942366 - RNA, 23 nt, Human herpesvirus 4 [Epstein-Barr virus]
gcccugcccuccuccacccagca

SEQ ID NO: 1942367 - RNA, 12 nt, Human herpesvirus 4 [Epstein-Barr virus]
uggcagcagugg

SEQ ID NO: 1942368 - RNA, 16 nt, Human herpesvirus 4 [Epstein-Barr virus]
cggggguggaggcugc

SEQ ID NO: 1942369 - RNA, 19 nt, Human herpesvirus 4 [Epstein-Barr virus]
cucccaauauccaucugcu

SEQ ID NO: 1942370 - RNA, 12 nt, Human herpesvirus 4 [Epstein-Barr virus]
caacgccccugc

SEQ ID NO: 1942371 - RNA, 14 nt, Human herpesvirus 4 [Epstein-Barr virus]
ggacaugugcaugg

SEQ ID NO: 1942372 - RNA, 19 nt, Human herpesvirus 4 [Epstein-Barr virus]
accgccuuaugaggaccca

SEQ ID NO: 1942373 - RNA, 15 nt, Human herpesvirus 4 [Epstein-Barr virus]
agguagacgaggcac

SEQ ID NO: 1942374 - RNA, 22 nt, Human herpesvirus 4 [Epstein-Barr virus]
cccgcuuuugcgaccccucuga

SEQ ID NO: 1942375 - RNA, 12 nt, Human herpesvirus 4 [Epstein-Barr virus]
accggugggcuc

SEQ ID NO: 1942376 - RNA, 15 nt, Human herpesvirus 4 [Epstein-Barr virus]
ugcagucgcugcugc

SEQ ID NO: 1942377 - RNA, 18 nt, Human herpesvirus 4 [Epstein-Barr virus]
gugccugacggugccgcu

SEQ ID NO: 1942378 - RNA, 22 nt, Human herpesvirus 4 [Epstein-Barr virus]
cggggcgauaccuugggcauca

SEQ ID NO: 1942379 - RNA, 14 nt, Human herpesvirus 4 [Epstein-Barr virus]
gaagaucgugaggc

SEQ ID NO: 1942380 - RNA, 17 nt, Human herpesvirus 4 [Epstein-Barr virus]
ucacauugcaucgcuca

SEQ ID NO: 1942381 - RNA, 13 nt, Human herpesvirus 4 [Epstein-Barr virus]
acuacaccagucc

SEQ ID NO: 1942382 - RNA, 17 nt, Human herpesvirus 4 [Epstein-Barr virus]
ccgucaaggccucggag

SEQ ID NO: 1942383 - RNA, 14 nt, Human herpesvirus 4 [Epstein-Barr virus]
uuaaagccuccucg

SEQ ID NO: 1942384 - RNA, 13 nt, Human herpesvirus 4 [Epstein-Barr virus]
gccacguccccgg

SEQ ID NO: 1942385 - RNA, 18 nt, Human herpesvirus 4 [Epstein-Barr virus]
aagggcccagggucacug

SEQ ID NO: 1942386 - RNA, 15 nt, Human herpesvirus 4 [Epstein-Barr virus]
cuuuaaaggggagau

SEQ ID NO: 1942387 - RNA, 15 nt, Human herpesvirus 4 [Epstein-Barr virus]
gcccuggaggccuca

SEQ ID NO: 1942388 - RNA, 17 nt, Human herpesvirus 4 [Epstein-Barr virus]
cgagcagaaggccaugg

SEQ ID NO: 1942389 - RNA, 16 nt, Human herpesvirus 4 [Epstein-Barr virus]
cugcucucucuggaga

SEQ ID NO: 1942390 - RNA, 17 nt, Human herpesvirus 4 [Epstein-Barr virus]
caaggcagucuccaccu

SEQ ID NO: 1942391 - RNA, 16 nt, Human herpesvirus 4 [Epstein-Barr virus]
gccacacugucugucu

SEQ ID NO: 1942392 - RNA, 19 nt, Human herpesvirus 4 [Epstein-Barr virus]
auuugcugacauauguaca

SEQ ID NO: 1942393 - RNA, 16 nt, Human herpesvirus 4 [Epstein-Barr virus]
gguugcgcugcuugcc

SEQ ID NO: 1942394 - RNA, 19 nt, Human herpesvirus 4 [Epstein-Barr virus]
ggggcucaaggaggggcgg

SEQ ID NO: 1942395 - RNA, 17 nt, Human herpesvirus 4 [Epstein-Barr virus]
cuuggccccuguguaca

SEQ ID NO: 1942396 - RNA, 16 nt, Human herpesvirus 4 [Epstein-Barr virus]
gccacagagcaucaga

SEQ ID NO: 1942397 - RNA, 18 nt, Human herpesvirus 4 [Epstein-Barr virus]
cugacaccggugacagug

SEQ ID NO: 1942398 - RNA, 14 nt, Human herpesvirus 4 [Epstein-Barr virus]
gagucccuccucac

SEQ ID NO: 1942399 - RNA, 17 nt, Human herpesvirus 4 [Epstein-Barr virus]
acugauuuugggcacac

SEQ ID NO: 1942400 - RNA, 22 nt, Human herpesvirus 4 [Epstein-Barr virus]
gcggcccagcagauccagggcc

SEQ ID NO: 1942401 - RNA, 15 nt, Human herpesvirus 4 [Epstein-Barr virus]
caaacauaaaugccc

SEQ ID NO: 1942402 - RNA, 18 nt, Human herpesvirus 4 [Epstein-Barr virus]
ccgcccccaccaccccca

SEQ ID NO: 1942403 - RNA, 13 nt, Human herpesvirus 4 [Epstein-Barr virus]
accccacggagca

SEQ ID NO: 1942404 - RNA, 13 nt, Human herpesvirus 4 [Epstein-Barr virus]
ugggugggcauug

SEQ ID NO: 1942405 - RNA, 19 nt, Human herpesvirus 4 [Epstein-Barr virus]
ggcagcggacgguggggcu

SEQ ID NO: 1942406 - RNA, 19 nt, Human herpesvirus 4 [Epstein-Barr virus]
gagcagucgcauggcggga

SEQ ID NO: 1942407 - RNA, 15 nt, Human herpesvirus 4 [Epstein-Barr virus]
ccaugacgcugcugc

SEQ ID NO: 1942408 - RNA, 18 nt, Human herpesvirus 4 [Epstein-Barr virus]
acugcuagcgucacugau

SEQ ID NO: 1942409 - RNA, 17 nt, Human herpesvirus 4 [Epstein-Barr virus]
cagcucaaccgccaggg

SEQ ID NO: 1942410 - RNA, 20 nt, Human herpesvirus 4 [Epstein-Barr virus]
uugguccaggguccaggaga

SEQ ID NO: 1942411 - RNA, 14 nt, Human herpesvirus 4 [Epstein-Barr virus]
acuguucucugcuc

SEQ ID NO: 1942412 - RNA, 16 nt, Human herpesvirus 4 [Epstein-Barr virus]
ucacgucacucagcuc

SEQ ID NO: 1942413 - RNA, 18 nt, Human herpesvirus 4 [Epstein-Barr virus]
guuucuggaaugcuucua

SEQ ID NO: 1942414 - RNA, 15 nt, Human herpesvirus 4 [Epstein-Barr virus]
aaaggggagauguua

SEQ ID NO: 1942415 - RNA, 16 nt, Human herpesvirus 4 [Epstein-Barr virus]
ccccucccgccccugu

SEQ ID NO: 1942416 - RNA, 11 nt, Human herpesvirus 4 [Epstein-Barr virus]
cccagccacag

SEQ ID NO: 1942417 - RNA, 11 nt, Human herpesvirus 4 [Epstein-Barr virus]
uugggguccuc

SEQ ID NO: 1942418 - RNA, 21 nt, Human herpesvirus 4 [Epstein-Barr virus]
ggggcacucucgagggugccu

SEQ ID NO: 1942419 - RNA, 11 nt, Human herpesvirus 4 [Epstein-Barr virus]
guggaggcucg

SEQ ID NO: 1942420 - RNA, 20 nt, Human herpesvirus 4 [Epstein-Barr virus]
cagcuuaacgggaagagaag

SEQ ID NO: 1942421 - RNA, 22 nt, Human herpesvirus 4 [Epstein-Barr virus]
caacgccuuuuuccuagcuuau

SEQ ID NO: 1942422 - RNA, 24 nt, Human herpesvirus 4 [Epstein-Barr virus]
ggccagacggcgcuugcgucugcc

SEQ ID NO: 1942423 - RNA, 22 nt, Human herpesvirus 4 [Epstein-Barr virus]
cuccggauucaccggcaccgcc

SEQ ID NO: 1942424 - RNA, 21 nt, Human herpesvirus 4 [Epstein-Barr virus]
cuccaacgaggaucccgcagg

SEQ ID NO: 1942425 - RNA, 22 nt, Human herpesvirus 4 [Epstein-Barr virus]
guguauugcucucguugccaaa

SEQ ID NO: 1942426 - RNA, 13 nt, Human herpesvirus 4 [Epstein-Barr virus]
ggccugcugucau

SEQ ID NO: 1942427 - RNA, 18 nt, Human herpesvirus 4 [Epstein-Barr virus]
gccucuccguacccccuc

SEQ ID NO: 1942428 - RNA, 17 nt, Human herpesvirus 4 [Epstein-Barr virus]
gucuccuuguugaccuc

SEQ ID NO: 1942429 - RNA, 20 nt, Human herpesvirus 4 [Epstein-Barr virus]
auacucaucugugagacaag

SEQ ID NO: 1942430 - RNA, 23 nt, Human herpesvirus 4 [Epstein-Barr virus]
gucacgugaccuuuuccgccggc

SEQ ID NO: 1942431 - RNA, 21 nt, Human herpesvirus 4 [Epstein-Barr virus]
ggcgcaggggagggggcagga

SEQ ID NO: 1942432 - RNA, 20 nt, Human herpesvirus 4 [Epstein-Barr virus]
cuggccaugaaucugacucu

SEQ ID NO: 1942433 - RNA, 15 nt, Human herpesvirus 4 [Epstein-Barr virus]
uaugccauggccauu

SEQ ID NO: 1942434 - RNA, 16 nt, Human herpesvirus 4 [Epstein-Barr virus]
acauauccagagcuga

SEQ ID NO: 1942435 - RNA, 20 nt, Human herpesvirus 4 [Epstein-Barr virus]
uagccggcgcuguguggcug

SEQ ID NO: 1942436 - RNA, 21 nt, Human herpesvirus 4 [Epstein-Barr virus]
agaccccugggcucucaggaa

SEQ ID NO: 1942437 - RNA, 14 nt, Human herpesvirus 4 [Epstein-Barr virus]
ggacccugcugcga

SEQ ID NO: 1942438 - RNA, 13 nt, Human herpesvirus 4 [Epstein-Barr virus]
gcucgcagcugga

SEQ ID NO: 1942439 - RNA, 13 nt, Human herpesvirus 4 [Epstein-Barr virus]
ugauugagaucag

SEQ ID NO: 1942440 - RNA, 17 nt, Human herpesvirus 4 [Epstein-Barr virus]
gucgugguuuucugccc

SEQ ID NO: 1942441 - RNA, 21 nt, Human herpesvirus 4 [Epstein-Barr virus]
acgcaauuagagugccgggcc

SEQ ID NO: 1942442 - RNA, 17 nt, Human herpesvirus 4 [Epstein-Barr virus]
cccauauuggggcaaug

SEQ ID NO: 1942443 - RNA, 16 nt, Human herpesvirus 4 [Epstein-Barr virus]
ccugauuugcucuucg

SEQ ID NO: 1942444 - RNA, 22 nt, Human herpesvirus 4 [Epstein-Barr virus]
cuggacccuauggagggcagcg

SEQ ID NO: 1942445 - RNA, 14 nt, Human herpesvirus 4 [Epstein-Barr virus]
ggaaucucugccaa

SEQ ID NO: 1942446 - RNA, 19 nt, Human herpesvirus 4 [Epstein-Barr virus]
auguaagccugccucgagu

SEQ ID NO: 1942447 - RNA, 17 nt, Human herpesvirus 4 [Epstein-Barr virus]
ggaggcacuggagcaga

SEQ ID NO: 1942448 - RNA, 18 nt, Human herpesvirus 4 [Epstein-Barr virus]
uacgccgccgccagcagc

SEQ ID NO: 1942449 - RNA, 16 nt, Human herpesvirus 4 [Epstein-Barr virus]
gauauugaauuccaca

SEQ ID NO: 1942450 - RNA, 18 nt, Human herpesvirus 4 [Epstein-Barr virus]
augcugccgcuacugcug

SEQ ID NO: 1942451 - RNA, 15 nt, Human herpesvirus 4 [Epstein-Barr virus]
augcaggccuggaca

SEQ ID NO: 1942452 - RNA, 15 nt, Human herpesvirus 4 [Epstein-Barr virus]
ccagaaagucccgag

SEQ ID NO: 1942453 - RNA, 23 nt, Human herpesvirus 4 [Epstein-Barr virus]
agacuucagguggucauguuucc

SEQ ID NO: 1942454 - RNA, 20 nt, Human herpesvirus 4 [Epstein-Barr virus]
cuauaaagacaagccugcgu

SEQ ID NO: 1942455 - RNA, 20 nt, Human herpesvirus 4 [Epstein-Barr virus]
auagagaugguguccggaga

SEQ ID NO: 1942456 - RNA, 17 nt, Human herpesvirus 4 [Epstein-Barr virus]
gucuccagcggcuaccu

SEQ ID NO: 1942457 - RNA, 20 nt, Human herpesvirus 4 [Epstein-Barr virus]
acccgaaaucugacacuuua

SEQ ID NO: 1942458 - RNA, 13 nt, Human herpesvirus 4 [Epstein-Barr virus]
gccauccuccuuc

SEQ ID NO: 1942459 - RNA, 15 nt, Human herpesvirus 4 [Epstein-Barr virus]
caguggcccucagaa

SEQ ID NO: 1942460 - RNA, 13 nt, Human herpesvirus 4 [Epstein-Barr virus]
cggggggcuggcg

SEQ ID NO: 1942461 - RNA, 13 nt, Human herpesvirus 4 [Epstein-Barr virus]
uagccggccaggc

SEQ ID NO: 1942462 - RNA, 18 nt, Human herpesvirus 4 [Epstein-Barr virus]
ucugggccgcccggccuc

SEQ ID NO: 1942463 - RNA, 13 nt, Human herpesvirus 4 [Epstein-Barr virus]
caugucucagagg

SEQ ID NO: 1942464 - RNA, 12 nt, Human herpesvirus 4 [Epstein-Barr virus]
aucuccuaggcu

SEQ ID NO: 1942465 - RNA, 13 nt, Human herpesvirus 4 [Epstein-Barr virus]
ugguccugagggg

SEQ ID NO: 1942466 - RNA, 21 nt, Human herpesvirus 4 [Epstein-Barr virus]
cccagacucugcuuucugccg

SEQ ID NO: 1942467 - RNA, 17 nt, Human herpesvirus 4 [Epstein-Barr virus]
aggaggcggaagaccag

SEQ ID NO: 1942468 - RNA, 16 nt, Human herpesvirus 4 [Epstein-Barr virus]
acuggggcugguggcc

SEQ ID NO: 1942469 - RNA, 22 nt, Human herpesvirus 4 [Epstein-Barr virus]
cuagcggcgagacccgaggcag

SEQ ID NO: 1942470 - RNA, 16 nt, Human herpesvirus 4 [Epstein-Barr virus]
ccccgcaccagggcca

SEQ ID NO: 1942471 - RNA, 23 nt, Human herpesvirus 4 [Epstein-Barr virus]
gcaggccccccgcaccagggcca

SEQ ID NO: 1942472 - RNA, 18 nt, Human herpesvirus 4 [Epstein-Barr virus]
gcaccggagccaccacag

SEQ ID NO: 1942473 - RNA, 17 nt, Human herpesvirus 4 [Epstein-Barr virus]
cugcgaugaggcggugg

SEQ ID NO: 1942474 - RNA, 18 nt, Human herpesvirus 4 [Epstein-Barr virus]
ugacggucgccauugccc

SEQ ID NO: 1942475 - RNA, 14 nt, Human herpesvirus 4 [Epstein-Barr virus]
caggagagggccag

SEQ ID NO: 1942476 - RNA, 16 nt, Human herpesvirus 4 [Epstein-Barr virus]
aucuuugacugacaca

SEQ ID NO: 1942477 - RNA, 17 nt, Human herpesvirus 4 [Epstein-Barr virus]
uccuuggagcuguaacu

SEQ ID NO: 1942478 - RNA, 13 nt, Human herpesvirus 4 [Epstein-Barr virus]
gaggccugcacca

SEQ ID NO: 1942479 - RNA, 15 nt, Human herpesvirus 4 [Epstein-Barr virus]
augcaaugcccaccc

SEQ ID NO: 1942480 - RNA, 18 nt, Human herpesvirus 4 [Epstein-Barr virus]
ggaggaggacgugaguga

SEQ ID NO: 1942481 - RNA, 19 nt, Human herpesvirus 4 [Epstein-Barr virus]
cgaacgaugaggaacguga

SEQ ID NO: 1942482 - RNA, 20 nt, Human herpesvirus 4 [Epstein-Barr virus]
ucaggagguacaugggccac

SEQ ID NO: 1942483 - RNA, 23 nt, Human herpesvirus 4 [Epstein-Barr virus]
guuccccccagccugaggaacau

SEQ ID NO: 1942484 - RNA, 15 nt, Human herpesvirus 4 [Epstein-Barr virus]
acgggcuggugggcu

SEQ ID NO: 1942485 - RNA, 16 nt, Human herpesvirus 4 [Epstein-Barr virus]
agccuccaacaggugc

SEQ ID NO: 1942486 - RNA, 13 nt, Human herpesvirus 4 [Epstein-Barr virus]
ugcaagcagcacc

SEQ ID NO: 1942487 - RNA, 18 nt, Human herpesvirus 4 [Epstein-Barr virus]
ggugcuugugguguggga

SEQ ID NO: 1942488 - RNA, 23 nt, Human herpesvirus 4 [Epstein-Barr virus]
aagugauuaggagcagggcccag

SEQ ID NO: 1942489 - RNA, 15 nt, Human herpesvirus 4 [Epstein-Barr virus]
aggagcaggaggggc

SEQ ID NO: 1942490 - RNA, 14 nt, Human herpesvirus 4 [Epstein-Barr virus]
gaugagcuggagac

SEQ ID NO: 1942491 - RNA, 17 nt, Human herpesvirus 4 [Epstein-Barr virus]
caccacccccaccaccu

SEQ ID NO: 1942492 - RNA, 16 nt, Human herpesvirus 4 [Epstein-Barr virus]
gagucccuccucacca

SEQ ID NO: 1942493 - RNA, 14 nt, Human herpesvirus 4 [Epstein-Barr virus]
agguucucggucag

SEQ ID NO: 1942494 - RNA, 18 nt, Human herpesvirus 4 [Epstein-Barr virus]
agcgcacgugacagauuu

SEQ ID NO: 1942495 - RNA, 21 nt, Human herpesvirus 4 [Epstein-Barr virus]
acuacaccaucaccgucggca

SEQ ID NO: 1942496 - RNA, 21 nt, Human herpesvirus 4 [Epstein-Barr virus]
uggugggcuccuuagacugag

SEQ ID NO: 1942497 - RNA, 12 nt, Human herpesvirus 4 [Epstein-Barr virus]
ggcucucuuuga

SEQ ID NO: 1942498 - RNA, 19 nt, Human herpesvirus 4 [Epstein-Barr virus]
agcgcucuggucgcccccu

SEQ ID NO: 1942499 - RNA, 18 nt, Human herpesvirus 4 [Epstein-Barr virus]
cguuuaaacgagagaaga

SEQ ID NO: 1942500 - RNA, 19 nt, Human herpesvirus 4 [Epstein-Barr virus]
cagcugacggugggcauga

SEQ ID NO: 1942501 - RNA, 23 nt, Human herpesvirus 4 [Epstein-Barr virus]
uccagcucggccagcaggccggc

SEQ ID NO: 1942502 - RNA, 21 nt, Human herpesvirus 4 [Epstein-Barr virus]
agggcgcucugcgccagcccc

SEQ ID NO: 1942503 - RNA, 18 nt, Human herpesvirus 4 [Epstein-Barr virus]
gcugcagguaaaccuucu

SEQ ID NO: 1942504 - RNA, 18 nt, Human herpesvirus 4 [Epstein-Barr virus]
uuuccgauagaauagcug

SEQ ID NO: 1942505 - RNA, 12 nt, Human herpesvirus 4 [Epstein-Barr virus]
aggacauguuug

SEQ ID NO: 1942506 - RNA, 15 nt, Human herpesvirus 4 [Epstein-Barr virus]
ucgcaacacuguaua

SEQ ID NO: 1942507 - RNA, 22 nt, Human herpesvirus 4 [Epstein-Barr virus]
agguguacgcccuggcgguuga

SEQ ID NO: 1942508 - RNA, 20 nt, Human herpesvirus 4 [Epstein-Barr virus]
augguggccggcagccuggc

SEQ ID NO: 1942509 - RNA, 13 nt, Human herpesvirus 4 [Epstein-Barr virus]
cccgcaccagggc

SEQ ID NO: 1942510 - RNA, 15 nt, Human herpesvirus 4 [Epstein-Barr virus]
gaucuccuuuggcuc

SEQ ID NO: 1942511 - RNA, 13 nt, Human herpesvirus 4 [Epstein-Barr virus]
agucaccugcaca

SEQ ID NO: 1942512 - RNA, 13 nt, Human herpesvirus 4 [Epstein-Barr virus]
cucaccaugguag

SEQ ID NO: 1942513 - RNA, 19 nt, Human herpesvirus 4 [Epstein-Barr virus]
guguggcuguagccacccg

SEQ ID NO: 1942514 - RNA, 15 nt, Human herpesvirus 4 [Epstein-Barr virus]
uggcauaauuuccuc

SEQ ID NO: 1942515 - RNA, 16 nt, Human herpesvirus 4 [Epstein-Barr virus]
ugcaccagcuccaggg

SEQ ID NO: 1942516 - RNA, 23 nt, Human herpesvirus 4 [Epstein-Barr virus]
ccugccggaguuuucucccccag

SEQ ID NO: 1942517 - RNA, 15 nt, Human herpesvirus 4 [Epstein-Barr virus]
uuauacccaauuugu

SEQ ID NO: 1942518 - RNA, 19 nt, Human herpesvirus 4 [Epstein-Barr virus]
uccaccagcuucucaaagg

SEQ ID NO: 1942519 - RNA, 19 nt, Human herpesvirus 4 [Epstein-Barr virus]
cuucuggcucuucugggaa

SEQ ID NO: 1942520 - RNA, 21 nt, Human herpesvirus 4 [Epstein-Barr virus]
uaaagagacucaggcccucau

SEQ ID NO: 1942521 - RNA, 14 nt, Human herpesvirus 4 [Epstein-Barr virus]
ucuccagcaaccaa

SEQ ID NO: 1942522 - RNA, 18 nt, Human herpesvirus 4 [Epstein-Barr virus]
aagagacuucacagagca

SEQ ID NO: 1942523 - RNA, 15 nt, Human herpesvirus 4 [Epstein-Barr virus]
uggaccaagggcagg

SEQ ID NO: 1942524 - RNA, 20 nt, Human herpesvirus 4 [Epstein-Barr virus]
ccaucaacuucagcuccagg

SEQ ID NO: 1942525 - RNA, 18 nt, Human herpesvirus 4 [Epstein-Barr virus]
caagagccaucaccucuu

SEQ ID NO: 1942526 - RNA, 18 nt, Human herpesvirus 4 [Epstein-Barr virus]
ggcuuacaagaauaacau

SEQ ID NO: 1942527 - RNA, 21 nt, Human herpesvirus 4 [Epstein-Barr virus]
gagucagccuugcccccgcca

SEQ ID NO: 1942528 - RNA, 14 nt, Human herpesvirus 4 [Epstein-Barr virus]
ucucuggcugugcu

SEQ ID NO: 1942529 - RNA, 21 nt, Human herpesvirus 4 [Epstein-Barr virus]
cuggcucuucugggaacaccc

SEQ ID NO: 1942530 - RNA, 24 nt, Human herpesvirus 4 [Epstein-Barr virus]
uggucgggagaacgaaggcguggg

SEQ ID NO: 1942531 - RNA, 12 nt, Human herpesvirus 4 [Epstein-Barr virus]
gcagaggccugc

SEQ ID NO: 1942532 - RNA, 19 nt, Human herpesvirus 4 [Epstein-Barr virus]
gaccaggucgaccaccuca

SEQ ID NO: 1942533 - RNA, 12 nt, Human herpesvirus 4 [Epstein-Barr virus]
gagcaggagcag

SEQ ID NO: 1942534 - RNA, 14 nt, Human herpesvirus 4 [Epstein-Barr virus]
gcagcggccuuacu

SEQ ID NO: 1942535 - RNA, 15 nt, Human herpesvirus 4 [Epstein-Barr virus]
cuacccucuuaggga

SEQ ID NO: 1942536 - RNA, 12 nt, Human herpesvirus 4 [Epstein-Barr virus]
cauggugugaga

SEQ ID NO: 1942537 - RNA, 20 nt, Human herpesvirus 4 [Epstein-Barr virus]
guuaaacugaaucuccaccu

SEQ ID NO: 1942538 - RNA, 14 nt, Human herpesvirus 4 [Epstein-Barr virus]
agcagcucaccuau

SEQ ID NO: 1942539 - RNA, 16 nt, Human herpesvirus 4 [Epstein-Barr virus]
cuccaacaggugcccg

SEQ ID NO: 1942540 - RNA, 16 nt, Human herpesvirus 4 [Epstein-Barr virus]
accugagccugagcca

SEQ ID NO: 1942541 - RNA, 14 nt, Human herpesvirus 4 [Epstein-Barr virus]
ucuuugcaauuugc

SEQ ID NO: 1942542 - RNA, 15 nt, Human herpesvirus 4 [Epstein-Barr virus]
gccggccugcuggcc

SEQ ID NO: 1942543 - RNA, 12 nt, Human herpesvirus 4 [Epstein-Barr virus]
caccuuugcuau

SEQ ID NO: 1942544 - RNA, 21 nt, Human herpesvirus 4 [Epstein-Barr virus]
gcgacuucgggggcgacugcc

SEQ ID NO: 1942545 - RNA, 18 nt, Human herpesvirus 4 [Epstein-Barr virus]
cucuuuguggccuuccuc

SEQ ID NO: 1942546 - RNA, 22 nt, Human herpesvirus 4 [Epstein-Barr virus]
aagcuuaugcagcaccucagcu

SEQ ID NO: 1942547 - RNA, 13 nt, Human herpesvirus 4 [Epstein-Barr virus]
ucacagcugcugg

SEQ ID NO: 1942548 - RNA, 22 nt, Human herpesvirus 4 [Epstein-Barr virus]
augcaacagaggauuggcugca

SEQ ID NO: 1942549 - RNA, 22 nt, Human herpesvirus 4 [Epstein-Barr virus]
caccaguguccagagaggaaga

SEQ ID NO: 1942550 - RNA, 14 nt, Human herpesvirus 4 [Epstein-Barr virus]
ugacugacucuccc

SEQ ID NO: 1942551 - RNA, 23 nt, Human herpesvirus 4 [Epstein-Barr virus]
cgucacucggacuaucaaccacu

SEQ ID NO: 1942552 - RNA, 15 nt, Human herpesvirus 4 [Epstein-Barr virus]
cgcuccguccuuguc

SEQ ID NO: 1942553 - RNA, 22 nt, Human herpesvirus 4 [Epstein-Barr virus]
agccacacaaucagccgggagg

SEQ ID NO: 1942554 - RNA, 18 nt, Human herpesvirus 4 [Epstein-Barr virus]
cccggguucgggcacgcc

SEQ ID NO: 1942555 - RNA, 13 nt, Human herpesvirus 4 [Epstein-Barr virus]
gcgucucauuccc

SEQ ID NO: 1942556 - RNA, 24 nt, Human herpesvirus 4 [Epstein-Barr virus]
ggcuccauguccuguggugugcuu

SEQ ID NO: 1942557 - RNA, 14 nt, Human herpesvirus 4 [Epstein-Barr virus]
agaaucugggcugg

SEQ ID NO: 1942558 - RNA, 17 nt, Human herpesvirus 4 [Epstein-Barr virus]
auggucgaugaacaagu

SEQ ID NO: 1942559 - RNA, 20 nt, Human herpesvirus 4 [Epstein-Barr virus]
uuuggcauguguacuugucc

SEQ ID NO: 1942560 - RNA, 14 nt, Human herpesvirus 4 [Epstein-Barr virus]
ccauucucguccau

SEQ ID NO: 1942561 - RNA, 17 nt, Human herpesvirus 4 [Epstein-Barr virus]
ugcacacgcucagcuca

SEQ ID NO: 1942562 - RNA, 18 nt, Human herpesvirus 4 [Epstein-Barr virus]
aggaugagaccaguggca

SEQ ID NO: 1942563 - RNA, 19 nt, Human herpesvirus 4 [Epstein-Barr virus]
uaccugguauuucugacau

SEQ ID NO: 1942564 - RNA, 14 nt, Human herpesvirus 4 [Epstein-Barr virus]
uaacuggcacacac

SEQ ID NO: 1942565 - RNA, 18 nt, Human herpesvirus 4 [Epstein-Barr virus]
gcgagaauuggcagacac

SEQ ID NO: 1942566 - RNA, 14 nt, Human herpesvirus 4 [Epstein-Barr virus]
gaggagauccgcca

SEQ ID NO: 1942567 - RNA, 17 nt, Human herpesvirus 4 [Epstein-Barr virus]
caaggcaguagaggaca

SEQ ID NO: 1942568 - RNA, 15 nt, Human herpesvirus 4 [Epstein-Barr virus]
agggggccuggugcc

SEQ ID NO: 1942569 - RNA, 23 nt, Human herpesvirus 4 [Epstein-Barr virus]
cugccggaguuuucucccccaga

SEQ ID NO: 1942570 - RNA, 14 nt, Human herpesvirus 4 [Epstein-Barr virus]
uggcugugcugacc

SEQ ID NO: 1942571 - RNA, 19 nt, Human herpesvirus 4 [Epstein-Barr virus]
gccugccaaagagccagau

SEQ ID NO: 1942572 - RNA, 18 nt, Human herpesvirus 4 [Epstein-Barr virus]
gcgcccugucaccaggcc

SEQ ID NO: 1942573 - RNA, 20 nt, Human herpesvirus 4 [Epstein-Barr virus]
aaauguuacuucuuuugcuc

SEQ ID NO: 1942574 - RNA, 20 nt, Human herpesvirus 4 [Epstein-Barr virus]
agagauuucauccucagagg

SEQ ID NO: 1942575 - RNA, 13 nt, Human herpesvirus 4 [Epstein-Barr virus]
agcuaacaggaca

SEQ ID NO: 1942576 - RNA, 22 nt, Human herpesvirus 4 [Epstein-Barr virus]
caggaggaggggcaggagcagg

SEQ ID NO: 1942577 - RNA, 15 nt, Human herpesvirus 4 [Epstein-Barr virus]
cacccaccuaugcca

SEQ ID NO: 1942578 - RNA, 20 nt, Human herpesvirus 4 [Epstein-Barr virus]
cucuaagacccgucgggcca

SEQ ID NO: 1942579 - RNA, 15 nt, Human herpesvirus 4 [Epstein-Barr virus]
gcccccgccagcgcc

SEQ ID NO: 1942580 - RNA, 19 nt, Human herpesvirus 4 [Epstein-Barr virus]
ucgccuucuccucagccuc

SEQ ID NO: 1942581 - RNA, 16 nt, Human herpesvirus 4 [Epstein-Barr virus]
guguuccacagccugc

SEQ ID NO: 1942582 - RNA, 23 nt, Human herpesvirus 4 [Epstein-Barr virus]
gugugaagauugucacagcugcu

SEQ ID NO: 1942583 - RNA, 18 nt, Human herpesvirus 4 [Epstein-Barr virus]
ccucauucccccaugaga

SEQ ID NO: 1942584 - RNA, 23 nt, Human herpesvirus 4 [Epstein-Barr virus]
gcucuucguuaaaauaacacaag

SEQ ID NO: 1942585 - RNA, 21 nt, Human herpesvirus 4 [Epstein-Barr virus]
gacaggcacaacggcugugac

SEQ ID NO: 1942586 - RNA, 22 nt, Human herpesvirus 4 [Epstein-Barr virus]
ggacggaggacgauagcccagg

SEQ ID NO: 1942587 - RNA, 19 nt, Human herpesvirus 4 [Epstein-Barr virus]
cccgggggaggagaagaga

SEQ ID NO: 1942588 - RNA, 16 nt, Human herpesvirus 4 [Epstein-Barr virus]
aauacaagaguucucu

SEQ ID NO: 1942589 - RNA, 21 nt, Human herpesvirus 4 [Epstein-Barr virus]
cugcgagggggccuggugcca

SEQ ID NO: 1942590 - RNA, 19 nt, Human herpesvirus 4 [Epstein-Barr virus]
ugccuugcucucagcacuu

SEQ ID NO: 1942591 - RNA, 19 nt, Human herpesvirus 4 [Epstein-Barr virus]
aagauacccagagcaaaag

SEQ ID NO: 1942592 - RNA, 13 nt, Human herpesvirus 4 [Epstein-Barr virus]
ggcgggcgggcuu

SEQ ID NO: 1942593 - RNA, 22 nt, Human herpesvirus 4 [Epstein-Barr virus]
accuccgggggcacugucgaga

SEQ ID NO: 1942594 - RNA, 19 nt, Human herpesvirus 4 [Epstein-Barr virus]
gccucuuguguucuugccg

SEQ ID NO: 1942595 - RNA, 15 nt, Human herpesvirus 4 [Epstein-Barr virus]
gucuuuuaugagcca

SEQ ID NO: 1942596 - RNA, 20 nt, Human herpesvirus 4 [Epstein-Barr virus]
gugaaacuggcuucugugac

SEQ ID NO: 1942597 - RNA, 20 nt, Human herpesvirus 4 [Epstein-Barr virus]
uuaaaaggggcagcaaucuc

SEQ ID NO: 1942598 - RNA, 18 nt, Human herpesvirus 4 [Epstein-Barr virus]
gcuguccuucugucacaa

SEQ ID NO: 1942599 - RNA, 15 nt, Human herpesvirus 4 [Epstein-Barr virus]
ggcgacugggggcaa

SEQ ID NO: 1942600 - RNA, 18 nt, Human herpesvirus 4 [Epstein-Barr virus]
cuuguccuuggugugcac

SEQ ID NO: 1942601 - RNA, 23 nt, Human herpesvirus 4 [Epstein-Barr virus]
gcauggcgggaguauggggccag

SEQ ID NO: 1942602 - RNA, 14 nt, Human herpesvirus 4 [Epstein-Barr virus]
acugucacugugca

SEQ ID NO: 1942603 - RNA, 12 nt, Human herpesvirus 4 [Epstein-Barr virus]
acuauaccaaag

SEQ ID NO: 1942604 - RNA, 17 nt, Human herpesvirus 4 [Epstein-Barr virus]
guggucaccgcgaccaa

SEQ ID NO: 1942605 - RNA, 14 nt, Human herpesvirus 4 [Epstein-Barr virus]
uggccggggccgug

SEQ ID NO: 1942606 - RNA, 18 nt, Human herpesvirus 4 [Epstein-Barr virus]
gagggcagcgaagaacac

SEQ ID NO: 1942607 - RNA, 22 nt, Human herpesvirus 4 [Epstein-Barr virus]
ugcucucagcacuuugccagca

SEQ ID NO: 1942608 - RNA, 19 nt, Human herpesvirus 4 [Epstein-Barr virus]
caggcacggucgccccucc

SEQ ID NO: 1942609 - RNA, 21 nt, Human herpesvirus 4 [Epstein-Barr virus]
uauuaauaaauaucuuccugu

SEQ ID NO: 1942610 - RNA, 20 nt, Human herpesvirus 4 [Epstein-Barr virus]
gaugguggggcuuguuucaa

SEQ ID NO: 1942611 - RNA, 18 nt, Human herpesvirus 4 [Epstein-Barr virus]
ucaugcuccuauggacac

SEQ ID NO: 1942612 - RNA, 20 nt, Human herpesvirus 4 [Epstein-Barr virus]
gguccuccacggggacacgc

SEQ ID NO: 1942613 - RNA, 15 nt, Human herpesvirus 4 [Epstein-Barr virus]
ccugggagggccauc

SEQ ID NO: 1942614 - RNA, 16 nt, Human herpesvirus 4 [Epstein-Barr virus]
gcaggcuacaacaggc

SEQ ID NO: 1942615 - RNA, 22 nt, Human herpesvirus 4 [Epstein-Barr virus]
agccagggugaccuggcucagg

SEQ ID NO: 1942616 - RNA, 16 nt, Human herpesvirus 4 [Epstein-Barr virus]
cgugccagaggcccuc

SEQ ID NO: 1942617 - RNA, 23 nt, Human herpesvirus 4 [Epstein-Barr virus]
uuaacgggaagagaaguggggag

SEQ ID NO: 1942618 - RNA, 19 nt, Human herpesvirus 4 [Epstein-Barr virus]
cccagggcagacugcacag

SEQ ID NO: 1942619 - RNA, 16 nt, Human herpesvirus 4 [Epstein-Barr virus]
agcagaugugcccaag

SEQ ID NO: 1942620 - RNA, 12 nt, Human herpesvirus 4 [Epstein-Barr virus]
ccucugggagaa

SEQ ID NO: 1942621 - RNA, 18 nt, Human herpesvirus 4 [Epstein-Barr virus]
uguuggauuggcugucau

SEQ ID NO: 1942622 - RNA, 16 nt, Human herpesvirus 4 [Epstein-Barr virus]
gaagcagaugugccca

SEQ ID NO: 1942623 - RNA, 14 nt, Human herpesvirus 4 [Epstein-Barr virus]
gccgggcgcgcucc

SEQ ID NO: 1942624 - RNA, 19 nt, Human herpesvirus 4 [Epstein-Barr virus]
ucggucaaguaccagcugg

SEQ ID NO: 1942625 - RNA, 17 nt, Human herpesvirus 4 [Epstein-Barr virus]
cugauaaugucuucaau

SEQ ID NO: 1942626 - RNA, 21 nt, Human herpesvirus 4 [Epstein-Barr virus]
caucccauaccuacaccaccc

SEQ ID NO: 1942627 - RNA, 23 nt, Human herpesvirus 4 [Epstein-Barr virus]
gccguccacggccguagcccagu

SEQ ID NO: 1942628 - RNA, 21 nt, Human herpesvirus 4 [Epstein-Barr virus]
ucaaccugauucccccugcuc

SEQ ID NO: 1942629 - RNA, 15 nt, Human herpesvirus 4 [Epstein-Barr virus]
ggggagagaaagaga

SEQ ID NO: 1942630 - RNA, 20 nt, Human herpesvirus 4 [Epstein-Barr virus]
gcgucuguuuguguagugag

SEQ ID NO: 1942631 - RNA, 15 nt, Human herpesvirus 4 [Epstein-Barr virus]
auucuggcacgucau

SEQ ID NO: 1942632 - RNA, 19 nt, Human herpesvirus 4 [Epstein-Barr virus]
cucggccuccuggccagca

SEQ ID NO: 1942633 - RNA, 13 nt, Human herpesvirus 4 [Epstein-Barr virus]
gcaaccagcacgu

SEQ ID NO: 1942634 - RNA, 15 nt, Human herpesvirus 4 [Epstein-Barr virus]
gcggcccacugaaaa

SEQ ID NO: 1942635 - RNA, 22 nt, Human herpesvirus 4 [Epstein-Barr virus]
cguuugugauucccagaaagaa

SEQ ID NO: 1942636 - RNA, 18 nt, Human herpesvirus 4 [Epstein-Barr virus]
aaucaccuuaacuggcac

SEQ ID NO: 1942637 - RNA, 16 nt, Human herpesvirus 4 [Epstein-Barr virus]
uccaggguccaggaga

SEQ ID NO: 1942638 - RNA, 13 nt, Human herpesvirus 4 [Epstein-Barr virus]
gucguuugauucu

SEQ ID NO: 1942639 - RNA, 16 nt, Human herpesvirus 4 [Epstein-Barr virus]
uuacuucuuuugcucu

SEQ ID NO: 1942640 - RNA, 19 nt, Human herpesvirus 4 [Epstein-Barr virus]
uucauccucagaggaggag

SEQ ID NO: 1942641 - RNA, 21 nt, Human herpesvirus 4 [Epstein-Barr virus]
uccugcaggggguucuugcua

SEQ ID NO: 1942642 - RNA, 13 nt, Human herpesvirus 4 [Epstein-Barr virus]
aggucuaugggga

SEQ ID NO: 1942643 - RNA, 14 nt, Human herpesvirus 4 [Epstein-Barr virus]
gcauuuuuggugcu

SEQ ID NO: 1942644 - RNA, 16 nt, Human herpesvirus 4 [Epstein-Barr virus]
gcccacacagcgccag

SEQ ID NO: 1942645 - RNA, 13 nt, Human herpesvirus 4 [Epstein-Barr virus]
ugcauggccaggc

SEQ ID NO: 1942646 - RNA, 22 nt, Human herpesvirus 4 [Epstein-Barr virus]
gaagcagauagccggccaggca

SEQ ID NO: 1942647 - RNA, 22 nt, Human herpesvirus 4 [Epstein-Barr virus]
gaauacccugcauggccaggcc

SEQ ID NO: 1942648 - RNA, 14 nt, Human herpesvirus 4 [Epstein-Barr virus]
gcacuguugcgccc

SEQ ID NO: 1942649 - RNA, 20 nt, Human herpesvirus 4 [Epstein-Barr virus]
gggaaagaggucccauguac

SEQ ID NO: 1942650 - RNA, 22 nt, Human herpesvirus 4 [Epstein-Barr virus]
ccaggcuggugacaaacucucu

SEQ ID NO: 1942651 - RNA, 15 nt, Human herpesvirus 4 [Epstein-Barr virus]
acaggacuaaccaug

SEQ ID NO: 1942652 - RNA, 21 nt, Human herpesvirus 4 [Epstein-Barr virus]
cuucuaggcauuaccauguca

SEQ ID NO: 1942653 - RNA, 13 nt, Human herpesvirus 4 [Epstein-Barr virus]
auuagcagccucc

SEQ ID NO: 1942654 - RNA, 15 nt, Human herpesvirus 4 [Epstein-Barr virus]
ggccggugcugccag

SEQ ID NO: 1942655 - RNA, 18 nt, Human herpesvirus 4 [Epstein-Barr virus]
cagagccucugccacaag

SEQ ID NO: 1942656 - RNA, 14 nt, Human herpesvirus 4 [Epstein-Barr virus]
gaaggcuugccaaa

SEQ ID NO: 1942657 - RNA, 21 nt, Human herpesvirus 4 [Epstein-Barr virus]
gugccuaaacgugauggugcu

SEQ ID NO: 1942658 - RNA, 19 nt, Human herpesvirus 4 [Epstein-Barr virus]
accagcccuuuuuccagug

SEQ ID NO: 1942659 - RNA, 18 nt, Human herpesvirus 4 [Epstein-Barr virus]
aggcccuaauucagccac

SEQ ID NO: 1942660 - RNA, 17 nt, Human herpesvirus 4 [Epstein-Barr virus]
cuccuggaucuggggcu

SEQ ID NO: 1942661 - RNA, 20 nt, Human herpesvirus 4 [Epstein-Barr virus]
uccaugacgcugcugcuacu

SEQ ID NO: 1942662 - RNA, 14 nt, Human herpesvirus 4 [Epstein-Barr virus]
guacgugccucaga

SEQ ID NO: 1942663 - RNA, 15 nt, Human herpesvirus 4 [Epstein-Barr virus]
uuccuauaugcucuc

SEQ ID NO: 1942664 - RNA, 14 nt, Human herpesvirus 4 [Epstein-Barr virus]
gauagccggccagg

SEQ ID NO: 1942665 - RNA, 18 nt, Human herpesvirus 4 [Epstein-Barr virus]
aagguggaggggggcggc

SEQ ID NO: 1942666 - RNA, 15 nt, Human herpesvirus 4 [Epstein-Barr virus]
ccugaggggcggugg

SEQ ID NO: 1942667 - RNA, 18 nt, Human herpesvirus 4 [Epstein-Barr virus]
cucuggucgcccccucug

SEQ ID NO: 1942668 - RNA, 16 nt, Human herpesvirus 4 [Epstein-Barr virus]
aucccaaauaaauguu

SEQ ID NO: 1942669 - RNA, 15 nt, Human herpesvirus 4 [Epstein-Barr virus]
gcaggccccccgcac

SEQ ID NO: 1942670 - RNA, 22 nt, Human herpesvirus 4 [Epstein-Barr virus]
uggacacuugugguucuccuga

SEQ ID NO: 1942671 - RNA, 21 nt, Human herpesvirus 4 [Epstein-Barr virus]
gcugagaacugacgcuccagg

SEQ ID NO: 1942672 - RNA, 18 nt, Human herpesvirus 4 [Epstein-Barr virus]
cagccugcaccaguggcu

SEQ ID NO: 1942673 - RNA, 22 nt, Human herpesvirus 4 [Epstein-Barr virus]
cuccgaugcccaccagccagcg

SEQ ID NO: 1942674 - RNA, 16 nt, Human herpesvirus 4 [Epstein-Barr virus]
cucaccguggcagaca

SEQ ID NO: 1942675 - RNA, 13 nt, Human herpesvirus 4 [Epstein-Barr virus]
aguaccagcuggu

SEQ ID NO: 1942676 - RNA, 22 nt, Human herpesvirus 4 [Epstein-Barr virus]
auaaauuaagagucccuccuca

SEQ ID NO: 1942677 - RNA, 13 nt, Human herpesvirus 4 [Epstein-Barr virus]
ggcaccccacggg

SEQ ID NO: 1942678 - RNA, 21 nt, Human herpesvirus 4 [Epstein-Barr virus]
cacccuggccgugcuggauga

SEQ ID NO: 1942679 - RNA, 21 nt, Human herpesvirus 4 [Epstein-Barr virus]
ccuaucacgggggucaagcaa

SEQ ID NO: 1942680 - RNA, 19 nt, Human herpesvirus 4 [Epstein-Barr virus]
ggagcuccgugagcaggag

SEQ ID NO: 1942681 - RNA, 15 nt, Human herpesvirus 4 [Epstein-Barr virus]
cagauguccaggggu

SEQ ID NO: 1942682 - RNA, 12 nt, Human herpesvirus 4 [Epstein-Barr virus]
cuggucagggga

SEQ ID NO: 1942683 - RNA, 17 nt, Human herpesvirus 4 [Epstein-Barr virus]
gucuaccucuguuccuu

SEQ ID NO: 1942684 - RNA, 18 nt, Human herpesvirus 4 [Epstein-Barr virus]
uaaaguuggucaggcuga

SEQ ID NO: 1942685 - RNA, 17 nt, Human herpesvirus 4 [Epstein-Barr virus]
aggacaacagcuagcag

SEQ ID NO: 1942686 - RNA, 18 nt, Human herpesvirus 4 [Epstein-Barr virus]
acugcguccaccuggcca

SEQ ID NO: 1942687 - RNA, 23 nt, Human herpesvirus 4 [Epstein-Barr virus]
gcagauagccggccaggcagagg

SEQ ID NO: 1942688 - RNA, 19 nt, Human herpesvirus 4 [Epstein-Barr virus]
agauuuucccacugugccu

SEQ ID NO: 1942689 - RNA, 23 nt, Human herpesvirus 4 [Epstein-Barr virus]
cauaacgguggugggaggcccag

SEQ ID NO: 1942690 - RNA, 19 nt, Human herpesvirus 4 [Epstein-Barr virus]
gauuucuaguuaccacagg

SEQ ID NO: 1942691 - RNA, 21 nt, Human herpesvirus 4 [Epstein-Barr virus]
aaaaucaacuacaagcagcua

SEQ ID NO: 1942692 - RNA, 20 nt, Human herpesvirus 4 [Epstein-Barr virus]
accagggggcagucugagaa

SEQ ID NO: 1942693 - RNA, 15 nt, Human herpesvirus 4 [Epstein-Barr virus]
aaugcgauucugaac

SEQ ID NO: 1942694 - RNA, 10 nt, Human herpesvirus 4 [Epstein-Barr virus]
gcagcuccgc

SEQ ID NO: 1942695 - RNA, 13 nt, Human herpesvirus 4 [Epstein-Barr virus]
cccagcagcagcc

SEQ ID NO: 1942696 - RNA, 18 nt, Human herpesvirus 4 [Epstein-Barr virus]
gaugacugagcgcacggc

SEQ ID NO: 1942697 - RNA, 19 nt, Human herpesvirus 4 [Epstein-Barr virus]
ucugcggaucagucgcugg

SEQ ID NO: 1942698 - RNA, 18 nt, Human herpesvirus 4 [Epstein-Barr virus]
cacuguugcgcccggccc

SEQ ID NO: 1942699 - RNA, 22 nt, Human herpesvirus 4 [Epstein-Barr virus]
aguugacggacgugcccagcuc

SEQ ID NO: 1942700 - RNA, 19 nt, Human herpesvirus 4 [Epstein-Barr virus]
gacgcgcagugccaagagc

SEQ ID NO: 1942701 - RNA, 14 nt, Human herpesvirus 4 [Epstein-Barr virus]
ccuggagccagcgc

SEQ ID NO: 1942702 - RNA, 14 nt, Human herpesvirus 4 [Epstein-Barr virus]
cgcugaagccaggc

SEQ ID NO: 1942703 - RNA, 14 nt, Human herpesvirus 4 [Epstein-Barr virus]
auguauugggacuu

SEQ ID NO: 1942704 - RNA, 15 nt, Human herpesvirus 4 [Epstein-Barr virus]
uggaucuggggcugg

SEQ ID NO: 1942705 - RNA, 13 nt, Human herpesvirus 4 [Epstein-Barr virus]
cucucccacggac

SEQ ID NO: 1942706 - RNA, 11 nt, Human herpesvirus 4 [Epstein-Barr virus]
ggccuccuggc

SEQ ID NO: 1942707 - RNA, 21 nt, Human herpesvirus 4 [Epstein-Barr virus]
accuccaccaccuucaccacc

SEQ ID NO: 1942708 - RNA, 22 nt, Human herpesvirus 4 [Epstein-Barr virus]
cgaguaggugccuccagagccc

SEQ ID NO: 1942709 - RNA, 15 nt, Human herpesvirus 4 [Epstein-Barr virus]
cuguauuuacaaaca

SEQ ID NO: 1942710 - RNA, 20 nt, Human herpesvirus 4 [Epstein-Barr virus]
agccugucgauaucccugcu

SEQ ID NO: 1942711 - RNA, 16 nt, Human herpesvirus 4 [Epstein-Barr virus]
cacauauacuggagau

SEQ ID NO: 1942712 - RNA, 17 nt, Human herpesvirus 4 [Epstein-Barr virus]
cuacacggccucaaagg

SEQ ID NO: 1942713 - RNA, 12 nt, Human herpesvirus 4 [Epstein-Barr virus]
ggcgaggggcgc

SEQ ID NO: 1942714 - RNA, 21 nt, Human herpesvirus 4 [Epstein-Barr virus]
ggagauccgccaggaccugga

SEQ ID NO: 1942715 - RNA, 21 nt, Human herpesvirus 4 [Epstein-Barr virus]
gggagacacaucuggaccaga

SEQ ID NO: 1942716 - RNA, 21 nt, Human herpesvirus 4 [Epstein-Barr virus]
auucuaugggaauaacaaggg

SEQ ID NO: 1942717 - RNA, 13 nt, Human herpesvirus 4 [Epstein-Barr virus]
cggcguggagcug

SEQ ID NO: 1942718 - RNA, 20 nt, Human herpesvirus 4 [Epstein-Barr virus]
agccuacucuccacucccag

SEQ ID NO: 1942719 - RNA, 21 nt, Human herpesvirus 4 [Epstein-Barr virus]
acggccacguccccggccucc

SEQ ID NO: 1942720 - RNA, 16 nt, Human herpesvirus 4 [Epstein-Barr virus]
guccagcggggccgca

SEQ ID NO: 1942721 - RNA, 23 nt, Human herpesvirus 4 [Epstein-Barr virus]
gccacaaccgccgugucagcugu

SEQ ID NO: 1942722 - RNA, 21 nt, Human herpesvirus 4 [Epstein-Barr virus]
aggaagaguaccccagugacg

SEQ ID NO: 1942723 - RNA, 15 nt, Human herpesvirus 4 [Epstein-Barr virus]
gcccagugcacccag

SEQ ID NO: 1942724 - RNA, 18 nt, Human herpesvirus 4 [Epstein-Barr virus]
caucuauuagcagccucc

SEQ ID NO: 1942725 - RNA, 17 nt, Human herpesvirus 4 [Epstein-Barr virus]
cagcuccagggccagca

SEQ ID NO: 1942726 - RNA, 22 nt, Human herpesvirus 4 [Epstein-Barr virus]
cucuggcugugcugacccuucu

SEQ ID NO: 1942727 - RNA, 19 nt, Human herpesvirus 4 [Epstein-Barr virus]
gggccugugacuggugcuu

SEQ ID NO: 1942728 - RNA, 22 nt, Human herpesvirus 4 [Epstein-Barr virus]
ccaccauaugaugacgccgaga

SEQ ID NO: 1942729 - RNA, 24 nt, Human herpesvirus 4 [Epstein-Barr virus]
acaacugcuauucugagcaccaac

SEQ ID NO: 1942730 - RNA, 20 nt, Human herpesvirus 4 [Epstein-Barr virus]
ucuggccgguggauccucca

SEQ ID NO: 1942731 - RNA, 12 nt, Human herpesvirus 4 [Epstein-Barr virus]
uacccaucacac

SEQ ID NO: 1942732 - RNA, 14 nt, Human herpesvirus 4 [Epstein-Barr virus]
augauauugaauuc

SEQ ID NO: 1942733 - RNA, 16 nt, Human herpesvirus 4 [Epstein-Barr virus]
gcacacgcucagcuca

SEQ ID NO: 1942734 - RNA, 15 nt, Human herpesvirus 4 [Epstein-Barr virus]
ugggagggagccugc

SEQ ID NO: 1942735 - RNA, 16 nt, Human herpesvirus 4 [Epstein-Barr virus]
gucuuugccaaccugc

SEQ ID NO: 1942736 - RNA, 15 nt, Human herpesvirus 4 [Epstein-Barr virus]
uucuacgaugaggaa

SEQ ID NO: 1942737 - RNA, 23 nt, Human herpesvirus 4 [Epstein-Barr virus]
caccccaguggacaaggcaguag

SEQ ID NO: 1942738 - RNA, 19 nt, Human herpesvirus 4 [Epstein-Barr virus]
gcaccggagccaccacagc

SEQ ID NO: 1942739 - RNA, 14 nt, Human herpesvirus 4 [Epstein-Barr virus]
ugugucuucugucu

SEQ ID NO: 1942740 - RNA, 16 nt, Human herpesvirus 4 [Epstein-Barr virus]
caggacggagaagcgg

SEQ ID NO: 1942741 - RNA, 19 nt, Human herpesvirus 4 [Epstein-Barr virus]
cagggcccguuccaggcuc

SEQ ID NO: 1942742 - RNA, 22 nt, Human herpesvirus 4 [Epstein-Barr virus]
auccaggaggaggacgugagug

SEQ ID NO: 1942743 - RNA, 12 nt, Human herpesvirus 4 [Epstein-Barr virus]
gcccccaccacc

SEQ ID NO: 1942744 - RNA, 16 nt, Human herpesvirus 4 [Epstein-Barr virus]
uuuccgucagccaggg

SEQ ID NO: 1942745 - RNA, 15 nt, Human herpesvirus 4 [Epstein-Barr virus]
acuacaauguuccuu

SEQ ID NO: 1942746 - RNA, 15 nt, Human herpesvirus 4 [Epstein-Barr virus]
gaguucccggcugcu

SEQ ID NO: 1942747 - RNA, 13 nt, Human herpesvirus 4 [Epstein-Barr virus]
aggacccugggcc

SEQ ID NO: 1942748 - RNA, 17 nt, Human herpesvirus 4 [Epstein-Barr virus]
gagggcagacaccaccu

SEQ ID NO: 1942749 - RNA, 22 nt, Human herpesvirus 4 [Epstein-Barr virus]
cuuuuacagugguucuccugau

SEQ ID NO: 1942750 - RNA, 14 nt, Human herpesvirus 4 [Epstein-Barr virus]
cugaaucuccaccu

SEQ ID NO: 1942751 - RNA, 10 nt, Human herpesvirus 4 [Epstein-Barr virus]
cagcccagcc

SEQ ID NO: 1942752 - RNA, 14 nt, Human herpesvirus 4 [Epstein-Barr virus]
ccgggcaaacaggg

SEQ ID NO: 1942753 - RNA, 16 nt, Human herpesvirus 4 [Epstein-Barr virus]
ucagcaucacagguua

SEQ ID NO: 1942754 - RNA, 20 nt, Human herpesvirus 4 [Epstein-Barr virus]
cugaccgaauggggcagugg

SEQ ID NO: 1942755 - RNA, 12 nt, Human herpesvirus 4 [Epstein-Barr virus]
gauguauuacca

SEQ ID NO: 1942756 - RNA, 19 nt, Human herpesvirus 4 [Epstein-Barr virus]
ggaauauuaauaaauaucu

SEQ ID NO: 1942757 - RNA, 17 nt, Human herpesvirus 4 [Epstein-Barr virus]
caccccacggccaugcu

SEQ ID NO: 1942758 - RNA, 14 nt, Human herpesvirus 4 [Epstein-Barr virus]
ggugcuugugaagg

SEQ ID NO: 1942759 - RNA, 14 nt, Human herpesvirus 4 [Epstein-Barr virus]
ccgcgcccuccucu

SEQ ID NO: 1942760 - RNA, 11 nt, Human herpesvirus 4 [Epstein-Barr virus]
ggaggcugcua

SEQ ID NO: 1942761 - RNA, 13 nt, Human herpesvirus 4 [Epstein-Barr virus]
gaggcggugccug

SEQ ID NO: 1942762 - RNA, 23 nt, Human herpesvirus 4 [Epstein-Barr virus]
gcugguggccugggaggugcuga

SEQ ID NO: 1942763 - RNA, 15 nt, Human herpesvirus 4 [Epstein-Barr virus]
uggcacgguccagaa

SEQ ID NO: 1942764 - RNA, 12 nt, Human herpesvirus 4 [Epstein-Barr virus]
cagaacaucacu

SEQ ID NO: 1942765 - RNA, 21 nt, Human herpesvirus 4 [Epstein-Barr virus]
cagaaaaucgcagcagggucc

SEQ ID NO: 1942766 - RNA, 15 nt, Human herpesvirus 4 [Epstein-Barr virus]
gaggugauguagagg

SEQ ID NO: 1942767 - RNA, 22 nt, Human herpesvirus 4 [Epstein-Barr virus]
acaggagacguggguccccucu

SEQ ID NO: 1942768 - RNA, 21 nt, Human herpesvirus 4 [Epstein-Barr virus]
gagguacaugggccacugcag

SEQ ID NO: 1942769 - RNA, 15 nt, Human herpesvirus 4 [Epstein-Barr virus]
accgcgcccuccucu

SEQ ID NO: 1942770 - RNA, 17 nt, Human herpesvirus 4 [Epstein-Barr virus]
agaccaauacccaggau

SEQ ID NO: 1942771 - RNA, 16 nt, Human herpesvirus 4 [Epstein-Barr virus]
ucgccuucuccucagc

SEQ ID NO: 1942772 - RNA, 18 nt, Human herpesvirus 4 [Epstein-Barr virus]
ugcugggucgccugaccc

SEQ ID NO: 1942773 - RNA, 21 nt, Human herpesvirus 4 [Epstein-Barr virus]
ccaggcgguuagggaggacac

SEQ ID NO: 1942774 - RNA, 17 nt, Human herpesvirus 4 [Epstein-Barr virus]
caugcaggucagguccc

SEQ ID NO: 1942775 - RNA, 18 nt, Human herpesvirus 4 [Epstein-Barr virus]
agggaagcguucuucacu

SEQ ID NO: 1942776 - RNA, 22 nt, Human herpesvirus 4 [Epstein-Barr virus]
acugcagugggccucucuggcu

SEQ ID NO: 1942777 - RNA, 18 nt, Human herpesvirus 4 [Epstein-Barr virus]
cugcacuauauucuccag

SEQ ID NO: 1942778 - RNA, 22 nt, Human herpesvirus 4 [Epstein-Barr virus]
ugggugcaagaauuggggcugg

SEQ ID NO: 1942779 - RNA, 13 nt, Human herpesvirus 4 [Epstein-Barr virus]
gauguagacaagu

SEQ ID NO: 1942780 - RNA, 17 nt, Human herpesvirus 4 [Epstein-Barr virus]
cucggggcaugcugccc

SEQ ID NO: 1942781 - RNA, 22 nt, Human herpesvirus 4 [Epstein-Barr virus]
cugcccuccuccacccagcagc

SEQ ID NO: 1942782 - RNA, 18 nt, Human herpesvirus 4 [Epstein-Barr virus]
cguuuacuaauggaauau

SEQ ID NO: 1942783 - RNA, 14 nt, Human herpesvirus 4 [Epstein-Barr virus]
gccgggagaggcag

SEQ ID NO: 1942784 - RNA, 19 nt, Human herpesvirus 4 [Epstein-Barr virus]
gcucgucguucaggaacag

SEQ ID NO: 1942785 - RNA, 12 nt, Human herpesvirus 4 [Epstein-Barr virus]
aauaaaaacagc

SEQ ID NO: 1942786 - RNA, 21 nt, Human herpesvirus 4 [Epstein-Barr virus]
ggcacugcguccaccuggcca

SEQ ID NO: 1942787 - RNA, 18 nt, Human herpesvirus 4 [Epstein-Barr virus]
auguagcuauacuuucuu

SEQ ID NO: 1942788 - RNA, 14 nt, Human herpesvirus 4 [Epstein-Barr virus]
gucaagcaaacggc

SEQ ID NO: 1942789 - RNA, 14 nt, Human herpesvirus 4 [Epstein-Barr virus]
gacaccagauguuu

SEQ ID NO: 1942790 - RNA, 12 nt, Human herpesvirus 4 [Epstein-Barr virus]
cuagagggacag

SEQ ID NO: 1942791 - RNA, 17 nt, Human herpesvirus 4 [Epstein-Barr virus]
ugcacccacccccaccc

SEQ ID NO: 1942792 - RNA, 17 nt, Human herpesvirus 4 [Epstein-Barr virus]
cagagucuacucgacca

SEQ ID NO: 1942793 - RNA, 16 nt, Human herpesvirus 4 [Epstein-Barr virus]
gaauauuaauaaauau

SEQ ID NO: 1942794 - RNA, 16 nt, Human herpesvirus 4 [Epstein-Barr virus]
ccuggcggcccagccc

SEQ ID NO: 1942795 - RNA, 15 nt, Human herpesvirus 4 [Epstein-Barr virus]
ggcugcgguggugcg

SEQ ID NO: 1942796 - RNA, 15 nt, Human herpesvirus 4 [Epstein-Barr virus]
cuggcacacacuccc

SEQ ID NO: 1942797 - RNA, 14 nt, Human herpesvirus 4 [Epstein-Barr virus]
guuaacauggacau

SEQ ID NO: 1942798 - RNA, 22 nt, Human herpesvirus 4 [Epstein-Barr virus]
ugcgaaaacgaaagugcuugaa

SEQ ID NO: 1942799 - RNA, 21 nt, Human herpesvirus 4 [Epstein-Barr virus]
acaggacuaaccaugccaucu

SEQ ID NO: 1942800 - RNA, 17 nt, Human herpesvirus 4 [Epstein-Barr virus]
gcgccgguggggaaggc

SEQ ID NO: 1942801 - RNA, 19 nt, Human herpesvirus 4 [Epstein-Barr virus]
uccucauuggcuuugcccu

SEQ ID NO: 1942802 - RNA, 19 nt, Human herpesvirus 4 [Epstein-Barr virus]
ccagagggcgaaugggcug

SEQ ID NO: 1942803 - RNA, 20 nt, Human herpesvirus 4 [Epstein-Barr virus]
caccgucagccacacaauca

SEQ ID NO: 1942804 - RNA, 22 nt, Human herpesvirus 4 [Epstein-Barr virus]
agggauaugaaggugucauuga

SEQ ID NO: 1942805 - RNA, 17 nt, Human herpesvirus 4 [Epstein-Barr virus]
gugccauaccacacccc

SEQ ID NO: 1942806 - RNA, 15 nt, Human herpesvirus 4 [Epstein-Barr virus]
ugaguccagggcccu

SEQ ID NO: 1942807 - RNA, 12 nt, Human herpesvirus 4 [Epstein-Barr virus]
ccaucugcuucu

SEQ ID NO: 1942808 - RNA, 14 nt, Human herpesvirus 4 [Epstein-Barr virus]
agcagcaguggugu

SEQ ID NO: 1942809 - RNA, 15 nt, Human herpesvirus 4 [Epstein-Barr virus]
gagucugcuggacuc

SEQ ID NO: 1942810 - RNA, 20 nt, Human herpesvirus 4 [Epstein-Barr virus]
caacaggugcccgagccccg

SEQ ID NO: 1942811 - RNA, 19 nt, Human herpesvirus 4 [Epstein-Barr virus]
gcuggacuccgaggaccag

SEQ ID NO: 1942812 - RNA, 14 nt, Human herpesvirus 4 [Epstein-Barr virus]
cuugaacgugugcu

SEQ ID NO: 1942813 - RNA, 12 nt, Human herpesvirus 4 [Epstein-Barr virus]
ggcgcggcugga

SEQ ID NO: 1942814 - RNA, 14 nt, Human herpesvirus 4 [Epstein-Barr virus]
ggagccguggccuu

SEQ ID NO: 1942815 - RNA, 16 nt, Human herpesvirus 4 [Epstein-Barr virus]
ggcucaggccaugcgc

SEQ ID NO: 1942816 - RNA, 18 nt, Human herpesvirus 4 [Epstein-Barr virus]
gccaccggggaggccagg

SEQ ID NO: 1942817 - RNA, 15 nt, Human herpesvirus 4 [Epstein-Barr virus]
aaaaucaaaacuuua

SEQ ID NO: 1942818 - RNA, 20 nt, Human herpesvirus 4 [Epstein-Barr virus]
guggcgguggaacacggcac

SEQ ID NO: 1942819 - RNA, 16 nt, Human herpesvirus 4 [Epstein-Barr virus]
ggcacaccagacaugg

SEQ ID NO: 1942820 - RNA, 20 nt, Human herpesvirus 4 [Epstein-Barr virus]
gucccccuccauuccaccca

SEQ ID NO: 1942821 - RNA, 15 nt, Human herpesvirus 4 [Epstein-Barr virus]
gcagucgcugcugca

SEQ ID NO: 1942822 - RNA, 14 nt, Human herpesvirus 4 [Epstein-Barr virus]
accuaugccuggaa

SEQ ID NO: 1942823 - RNA, 20 nt, Human herpesvirus 4 [Epstein-Barr virus]
cagcccuuaacacaccacac

SEQ ID NO: 1942824 - RNA, 14 nt, Human herpesvirus 4 [Epstein-Barr virus]
ugugugcuguauuu

SEQ ID NO: 1942825 - RNA, 14 nt, Human herpesvirus 4 [Epstein-Barr virus]
gcuuaaaaaugugc

SEQ ID NO: 1942826 - RNA, 22 nt, Human herpesvirus 4 [Epstein-Barr virus]
ggaggccagguagcccagcguc

SEQ ID NO: 1942827 - RNA, 17 nt, Human herpesvirus 4 [Epstein-Barr virus]
aucccccggacaccaga

SEQ ID NO: 1942828 - RNA, 18 nt, Human herpesvirus 4 [Epstein-Barr virus]
ucagaccugaucagggaa

SEQ ID NO: 1942829 - RNA, 19 nt, Human herpesvirus 4 [Epstein-Barr virus]
caucucaagggaggagugc

SEQ ID NO: 1942830 - RNA, 22 nt, Human herpesvirus 4 [Epstein-Barr virus]
gcaggagcaggaggaggggcag

SEQ ID NO: 1942831 - RNA, 15 nt, Human herpesvirus 4 [Epstein-Barr virus]
gucaccaggccugcc

SEQ ID NO: 1942832 - RNA, 17 nt, Human herpesvirus 4 [Epstein-Barr virus]
accacucccaccacccc

SEQ ID NO: 1942833 - RNA, 20 nt, Human herpesvirus 4 [Epstein-Barr virus]
gcagcccggccgaggccugc

SEQ ID NO: 1942834 - RNA, 15 nt, Human herpesvirus 4 [Epstein-Barr virus]
ugcagggugcacaga

SEQ ID NO: 1942835 - RNA, 15 nt, Human herpesvirus 4 [Epstein-Barr virus]
ugaggaaaggccuuu

SEQ ID NO: 1942836 - RNA, 11 nt, Human herpesvirus 4 [Epstein-Barr virus]
acccuggggca

SEQ ID NO: 1942837 - RNA, 20 nt, Human herpesvirus 4 [Epstein-Barr virus]
ggccagguacaggaccugga

SEQ ID NO: 1942838 - RNA, 18 nt, Human herpesvirus 4 [Epstein-Barr virus]
aucuuaccccuggcuucc

SEQ ID NO: 1942839 - RNA, 16 nt, Human herpesvirus 4 [Epstein-Barr virus]
uuauugaaaccacgcc

SEQ ID NO: 1942840 - RNA, 15 nt, Human herpesvirus 4 [Epstein-Barr virus]
ccgaucagagcccca

SEQ ID NO: 1942841 - RNA, 14 nt, Human herpesvirus 4 [Epstein-Barr virus]
ugccuccagagccc

SEQ ID NO: 1942842 - RNA, 13 nt, Human herpesvirus 4 [Epstein-Barr virus]
gccgccgccagca

SEQ ID NO: 1942843 - RNA, 22 nt, Human herpesvirus 4 [Epstein-Barr virus]
gccuguuuguccagcagggccu

SEQ ID NO: 1942844 - RNA, 20 nt, Human herpesvirus 4 [Epstein-Barr virus]
caaacaggugagucagccuu

SEQ ID NO: 1942845 - RNA, 23 nt, Human herpesvirus 4 [Epstein-Barr virus]
cagggugaacacuugggcacgga

SEQ ID NO: 1942846 - RNA, 18 nt, Human herpesvirus 4 [Epstein-Barr virus]
guccaggagucugcugcg

SEQ ID NO: 1942847 - RNA, 14 nt, Human herpesvirus 4 [Epstein-Barr virus]
ucugaggcggcugu

SEQ ID NO: 1942848 - RNA, 18 nt, Human herpesvirus 4 [Epstein-Barr virus]
cgggcacugcguccaccu

SEQ ID NO: 1942849 - RNA, 13 nt, Human herpesvirus 4 [Epstein-Barr virus]
cuucagugucugg

SEQ ID NO: 1942850 - RNA, 16 nt, Human herpesvirus 4 [Epstein-Barr virus]
cggcguggagcugggc

SEQ ID NO: 1942851 - RNA, 19 nt, Human herpesvirus 4 [Epstein-Barr virus]
gccucagcgucaggagagg

SEQ ID NO: 1942852 - RNA, 19 nt, Human herpesvirus 4 [Epstein-Barr virus]
ucgcuggcauacucuucau

SEQ ID NO: 1942853 - RNA, 16 nt, Human herpesvirus 4 [Epstein-Barr virus]
gaagcaugggggaaac

SEQ ID NO: 1942854 - RNA, 14 nt, Human herpesvirus 4 [Epstein-Barr virus]
cgccgcaagcaugg

SEQ ID NO: 1942855 - RNA, 16 nt, Human herpesvirus 4 [Epstein-Barr virus]
agcaccggagccacca

SEQ ID NO: 1942856 - RNA, 18 nt, Human herpesvirus 4 [Epstein-Barr virus]
gaccgggagccucagugu

SEQ ID NO: 1942857 - RNA, 20 nt, Human herpesvirus 4 [Epstein-Barr virus]
ucccaggccuuagcccagag

SEQ ID NO: 1942858 - RNA, 20 nt, Human herpesvirus 4 [Epstein-Barr virus]
agcgccgcgguuucagcauc

SEQ ID NO: 1942859 - RNA, 17 nt, Human herpesvirus 4 [Epstein-Barr virus]
aauaaauguuacuucuu

SEQ ID NO: 1942860 - RNA, 18 nt, Human herpesvirus 4 [Epstein-Barr virus]
cucuuucuggccaaccug

SEQ ID NO: 1942861 - RNA, 13 nt, Human herpesvirus 4 [Epstein-Barr virus]
ccugcuucacgcc

SEQ ID NO: 1942862 - RNA, 17 nt, Human herpesvirus 4 [Epstein-Barr virus]
cgauguacccccgggga

SEQ ID NO: 1942863 - RNA, 17 nt, Human herpesvirus 4 [Epstein-Barr virus]
cugccuuacacuggaaa

SEQ ID NO: 1942864 - RNA, 16 nt, Human herpesvirus 4 [Epstein-Barr virus]
ccaagcaccacccagc

SEQ ID NO: 1942865 - RNA, 12 nt, Human herpesvirus 4 [Epstein-Barr virus]
agauagggacca

SEQ ID NO: 1942866 - RNA, 13 nt, Human herpesvirus 4 [Epstein-Barr virus]
cugacgcuccagg

SEQ ID NO: 1942867 - RNA, 20 nt, Human herpesvirus 4 [Epstein-Barr virus]
ugccccgguccccccagaag

SEQ ID NO: 1942868 - RNA, 17 nt, Human herpesvirus 4 [Epstein-Barr virus]
ccuccuggccagcaccc

SEQ ID NO: 1942869 - RNA, 13 nt, Human herpesvirus 4 [Epstein-Barr virus]
gccgcgcugcucg

SEQ ID NO: 1942870 - RNA, 13 nt, Human herpesvirus 4 [Epstein-Barr virus]
gccggagggacag

SEQ ID NO: 1942871 - RNA, 13 nt, Human herpesvirus 4 [Epstein-Barr virus]
uucugucuguaaa

SEQ ID NO: 1942872 - RNA, 17 nt, Human herpesvirus 4 [Epstein-Barr virus]
gccaugaccagcagcag

SEQ ID NO: 1942873 - RNA, 16 nt, Human herpesvirus 4 [Epstein-Barr virus]
cacacgaagccugccu

SEQ ID NO: 1942874 - RNA, 23 nt, Human herpesvirus 4 [Epstein-Barr virus]
caggccgccaugcucagggccac

SEQ ID NO: 1942875 - RNA, 14 nt, Human herpesvirus 4 [Epstein-Barr virus]
cuccauuccaccca

SEQ ID NO: 1942876 - RNA, 20 nt, Human herpesvirus 4 [Epstein-Barr virus]
gcggcucaggaucagggcca

SEQ ID NO: 1942877 - RNA, 12 nt, Human herpesvirus 4 [Epstein-Barr virus]
cagguggcugcu

SEQ ID NO: 1942878 - RNA, 14 nt, Human herpesvirus 4 [Epstein-Barr virus]
aguacagacuuuga

SEQ ID NO: 1942879 - RNA, 20 nt, Human herpesvirus 4 [Epstein-Barr virus]
acacuccauuaauuccacua

SEQ ID NO: 1942880 - RNA, 14 nt, Human herpesvirus 4 [Epstein-Barr virus]
aggcuucccgccua

SEQ ID NO: 1942881 - RNA, 15 nt, Human herpesvirus 4 [Epstein-Barr virus]
acaacggcugugacu

SEQ ID NO: 1942882 - RNA, 18 nt, Human herpesvirus 4 [Epstein-Barr virus]
gcuaucuuugcugaagau

SEQ ID NO: 1942883 - RNA, 22 nt, Human herpesvirus 4 [Epstein-Barr virus]
ccagugacgaagacccaucuga

SEQ ID NO: 1942884 - RNA, 15 nt, Human herpesvirus 4 [Epstein-Barr virus]
cagagcggcauccuc

SEQ ID NO: 1942885 - RNA, 16 nt, Human herpesvirus 4 [Epstein-Barr virus]
cccauguacagcacaa

SEQ ID NO: 1942886 - RNA, 13 nt, Human herpesvirus 4 [Epstein-Barr virus]
ccgagagcuccgc

SEQ ID NO: 1942887 - RNA, 17 nt, Human herpesvirus 4 [Epstein-Barr virus]
ugggagcaaccagcugg

SEQ ID NO: 1942888 - RNA, 17 nt, Human herpesvirus 4 [Epstein-Barr virus]
ccuugcucgcagcugga

SEQ ID NO: 1942889 - RNA, 13 nt, Human herpesvirus 4 [Epstein-Barr virus]
ucguuaugcacuc

SEQ ID NO: 1942890 - RNA, 15 nt, Human herpesvirus 4 [Epstein-Barr virus]
gcuuaugcagcaccu

SEQ ID NO: 1942891 - RNA, 15 nt, Human herpesvirus 4 [Epstein-Barr virus]
acugucacugugcac

SEQ ID NO: 1942892 - RNA, 22 nt, Human herpesvirus 4 [Epstein-Barr virus]
ucgugcucuucauguccacuga

SEQ ID NO: 1942893 - RNA, 22 nt, Human herpesvirus 4 [Epstein-Barr virus]
accugcacgagaccccugggcu

SEQ ID NO: 1942894 - RNA, 16 nt, Human herpesvirus 4 [Epstein-Barr virus]
gcugcgccugagcugc

SEQ ID NO: 1942895 - RNA, 20 nt, Human herpesvirus 4 [Epstein-Barr virus]
gacacuuuagagcucuggag

SEQ ID NO: 1942896 - RNA, 18 nt, Human herpesvirus 4 [Epstein-Barr virus]
gaggaggacaugugcaug

SEQ ID NO: 1942897 - RNA, 21 nt, Human herpesvirus 4 [Epstein-Barr virus]
ggcugugguaaccggugggcu

SEQ ID NO: 1942898 - RNA, 14 nt, Human herpesvirus 4 [Epstein-Barr virus]
gggagggagccugc

SEQ ID NO: 1942899 - RNA, 14 nt, Human herpesvirus 4 [Epstein-Barr virus]
gggcaggagcagga

SEQ ID NO: 1942900 - RNA, 19 nt, Human herpesvirus 4 [Epstein-Barr virus]
cgccagccaccccagacag

SEQ ID NO: 1942901 - RNA, 18 nt, Human herpesvirus 4 [Epstein-Barr virus]
cugucucugaaggaucca

SEQ ID NO: 1942902 - RNA, 20 nt, Human herpesvirus 4 [Epstein-Barr virus]
gugggccucucuggcugugc

SEQ ID NO: 1942903 - RNA, 20 nt, Human herpesvirus 4 [Epstein-Barr virus]
gcguugcgcaccaccgcagc

SEQ ID NO: 1942904 - RNA, 16 nt, Human herpesvirus 4 [Epstein-Barr virus]
uccuugucugcugcca

SEQ ID NO: 1942905 - RNA, 13 nt, Human herpesvirus 4 [Epstein-Barr virus]
uaacauccgagac

SEQ ID NO: 1942906 - RNA, 17 nt, Human herpesvirus 4 [Epstein-Barr virus]
uuacaaccaagccacua

SEQ ID NO: 1942907 - RNA, 15 nt, Human herpesvirus 4 [Epstein-Barr virus]
cagaaagaggcucug

SEQ ID NO: 1942908 - RNA, 18 nt, Human herpesvirus 4 [Epstein-Barr virus]
ugccuaauggccguccuc

SEQ ID NO: 1942909 - RNA, 13 nt, Human herpesvirus 4 [Epstein-Barr virus]
augaacccugggg

SEQ ID NO: 1942910 - RNA, 18 nt, Human herpesvirus 4 [Epstein-Barr virus]
ccagccagcgacugaucc

SEQ ID NO: 1942911 - RNA, 16 nt, Human herpesvirus 4 [Epstein-Barr virus]
cgguggaacaggagca

SEQ ID NO: 1942912 - RNA, 21 nt, Human herpesvirus 4 [Epstein-Barr virus]
cgggcaggcauuuuuggugcu

SEQ ID NO: 1942913 - RNA, 13 nt, Human herpesvirus 4 [Epstein-Barr virus]
cagccacgcagga

SEQ ID NO: 1942914 - RNA, 18 nt, Human herpesvirus 4 [Epstein-Barr virus]
ggggcaggaggggcagga

SEQ ID NO: 1942915 - RNA, 20 nt, Human herpesvirus 4 [Epstein-Barr virus]
gacccuucugcugcugcugg

SEQ ID NO: 1942916 - RNA, 23 nt, Human herpesvirus 4 [Epstein-Barr virus]
gccgagaucucuugcgcccaggc

SEQ ID NO: 1942917 - RNA, 22 nt, Human herpesvirus 4 [Epstein-Barr virus]
gccaggcucgcggaagagccca

SEQ ID NO: 1942918 - RNA, 21 nt, Human herpesvirus 4 [Epstein-Barr virus]
ggcgacuuggugccaccaucu

SEQ ID NO: 1942919 - RNA, 22 nt, Human herpesvirus 4 [Epstein-Barr virus]
uccacagccccacucuugccuc

SEQ ID NO: 1942920 - RNA, 13 nt, Human herpesvirus 4 [Epstein-Barr virus]
gcaggagcaggag

SEQ ID NO: 1942921 - RNA, 17 nt, Human herpesvirus 4 [Epstein-Barr virus]
aggugauguagaggcgc

SEQ ID NO: 1942922 - RNA, 14 nt, Human herpesvirus 4 [Epstein-Barr virus]
uaacauugaugaac

SEQ ID NO: 1942923 - RNA, 18 nt, Human herpesvirus 4 [Epstein-Barr virus]
uagaagugugucccccuc

SEQ ID NO: 1942924 - RNA, 22 nt, Human herpesvirus 4 [Epstein-Barr virus]
aggugggacaaaauggggucug

SEQ ID NO: 1942925 - RNA, 17 nt, Human herpesvirus 4 [Epstein-Barr virus]
ucagagaggccucuggg

SEQ ID NO: 1942926 - RNA, 23 nt, Human herpesvirus 4 [Epstein-Barr virus]
cgccagggcguacaccuggcugu

SEQ ID NO: 1942927 - RNA, 15 nt, Human herpesvirus 4 [Epstein-Barr virus]
cauccucagaggagg

SEQ ID NO: 1942928 - RNA, 23 nt, Human herpesvirus 4 [Epstein-Barr virus]
accuggaaauggccuaggagaga

SEQ ID NO: 1942929 - RNA, 22 nt, Human herpesvirus 4 [Epstein-Barr virus]
uauuaauaaacaauuacagaua

SEQ ID NO: 1942930 - RNA, 17 nt, Human herpesvirus 4 [Epstein-Barr virus]
cuaugcaugagccacag

SEQ ID NO: 1942931 - RNA, 22 nt, Human herpesvirus 4 [Epstein-Barr virus]
uugccugaagcuugcuggggcg

SEQ ID NO: 1942932 - RNA, 20 nt, Human herpesvirus 4 [Epstein-Barr virus]
gauuccugauuuuccucauu

SEQ ID NO: 1942933 - RNA, 13 nt, Human herpesvirus 4 [Epstein-Barr virus]
gacguggcugcgg

SEQ ID NO: 1942934 - RNA, 15 nt, Human herpesvirus 4 [Epstein-Barr virus]
cgaagcggucucaga

SEQ ID NO: 1942935 - RNA, 14 nt, Human herpesvirus 4 [Epstein-Barr virus]
agcuccggcugccc

SEQ ID NO: 1942936 - RNA, 20 nt, Human herpesvirus 4 [Epstein-Barr virus]
guuaucaccguaccaugagu

SEQ ID NO: 1942937 - RNA, 19 nt, Human herpesvirus 4 [Epstein-Barr virus]
acccuugguauugcgcugg

SEQ ID NO: 1942938 - RNA, 21 nt, Human herpesvirus 4 [Epstein-Barr virus]
uggugcgguuauaacugccag

SEQ ID NO: 1942939 - RNA, 10 nt, Human herpesvirus 4 [Epstein-Barr virus]
uggggagcua

SEQ ID NO: 1942940 - RNA, 18 nt, Human herpesvirus 4 [Epstein-Barr virus]
uaggugccuccagagccc

SEQ ID NO: 1942941 - RNA, 20 nt, Human herpesvirus 4 [Epstein-Barr virus]
accuccaaucaccagccacc

SEQ ID NO: 1942942 - RNA, 16 nt, Human herpesvirus 4 [Epstein-Barr virus]
aggccaccgucuaccc

SEQ ID NO: 1942943 - RNA, 16 nt, Human herpesvirus 4 [Epstein-Barr virus]
ucuacaaugccagggg

SEQ ID NO: 1942944 - RNA, 19 nt, Human herpesvirus 4 [Epstein-Barr virus]
gcugccgcuacugcugcua

SEQ ID NO: 1942945 - RNA, 21 nt, Human herpesvirus 4 [Epstein-Barr virus]
cacugaccugguuaacagacu

SEQ ID NO: 1942946 - RNA, 16 nt, Human herpesvirus 4 [Epstein-Barr virus]
gagcaggaggggcagg

SEQ ID NO: 1942947 - RNA, 19 nt, Human herpesvirus 4 [Epstein-Barr virus]
cugacccuucugcugcugc

SEQ ID NO: 1942948 - RNA, 16 nt, Human herpesvirus 4 [Epstein-Barr virus]
gcccccaccacuccca

SEQ ID NO: 1942949 - RNA, 16 nt, Human herpesvirus 4 [Epstein-Barr virus]
cauggcggacugcgcc

SEQ ID NO: 1942950 - RNA, 16 nt, Human herpesvirus 4 [Epstein-Barr virus]
gcaacauugcagggcu

SEQ ID NO: 1942951 - RNA, 12 nt, Human herpesvirus 4 [Epstein-Barr virus]
augcuaucuugu

SEQ ID NO: 1942952 - RNA, 15 nt, Human herpesvirus 4 [Epstein-Barr virus]
ccuggccaggcaccc

SEQ ID NO: 1942953 - RNA, 19 nt, Human herpesvirus 4 [Epstein-Barr virus]
agguacuaacacgcaauaa

SEQ ID NO: 1942954 - RNA, 16 nt, Human herpesvirus 4 [Epstein-Barr virus]
guuauaacugccagag

SEQ ID NO: 1942955 - RNA, 21 nt, Human herpesvirus 4 [Epstein-Barr virus]
cugccccucagccugcuccug

SEQ ID NO: 1942956 - RNA, 21 nt, Human herpesvirus 4 [Epstein-Barr virus]
cucccacuuuuaccccagucc

SEQ ID NO: 1942957 - RNA, 18 nt, Human herpesvirus 4 [Epstein-Barr virus]
acacgcuggucuugaauu

SEQ ID NO: 1942958 - RNA, 12 nt, Human herpesvirus 4 [Epstein-Barr virus]
ucuuugcuucac

SEQ ID NO: 1942959 - RNA, 14 nt, Human herpesvirus 4 [Epstein-Barr virus]
caggcuccuggauc

SEQ ID NO: 1942960 - RNA, 16 nt, Human herpesvirus 4 [Epstein-Barr virus]
uuagacagguaacuca

SEQ ID NO: 1942961 - RNA, 22 nt, Human herpesvirus 4 [Epstein-Barr virus]
ccuagugguuucggacacaccg

SEQ ID NO: 1942962 - RNA, 11 nt, Human herpesvirus 4 [Epstein-Barr virus]
guggcauugcg

SEQ ID NO: 1942963 - RNA, 18 nt, Human herpesvirus 4 [Epstein-Barr virus]
uccccggggacaccugca

SEQ ID NO: 1942964 - RNA, 14 nt, Human herpesvirus 4 [Epstein-Barr virus]
acuucagcuccagg

SEQ ID NO: 1942965 - RNA, 17 nt, Human herpesvirus 4 [Epstein-Barr virus]
cucuccagcaaccaaug

SEQ ID NO: 1942966 - RNA, 17 nt, Human herpesvirus 4 [Epstein-Barr virus]
cauccgccacccccguc

SEQ ID NO: 1942967 - RNA, 21 nt, Human herpesvirus 4 [Epstein-Barr virus]
cuugaccaguguguacauucc

SEQ ID NO: 1942968 - RNA, 16 nt, Human herpesvirus 4 [Epstein-Barr virus]
gugaggagcgcccacc

SEQ ID NO: 1942969 - RNA, 15 nt, Human herpesvirus 4 [Epstein-Barr virus]
acugccgccgccucc

SEQ ID NO: 1942970 - RNA, 15 nt, Human herpesvirus 4 [Epstein-Barr virus]
acauggugucuguaa

SEQ ID NO: 1942971 - RNA, 18 nt, Human herpesvirus 4 [Epstein-Barr virus]
cuuggcccucucacuucu

SEQ ID NO: 1942972 - RNA, 15 nt, Human herpesvirus 4 [Epstein-Barr virus]
acccagcagcagccc

SEQ ID NO: 1942973 - RNA, 17 nt, Human herpesvirus 4 [Epstein-Barr virus]
uacccggucgcauggug

SEQ ID NO: 1942974 - RNA, 16 nt, Human herpesvirus 4 [Epstein-Barr virus]
accugccggagggaca

SEQ ID NO: 1942975 - RNA, 16 nt, Human herpesvirus 4 [Epstein-Barr virus]
gggcugguggccuggg

SEQ ID NO: 1942976 - RNA, 17 nt, Human herpesvirus 4 [Epstein-Barr virus]
uacagugguucuccuga

SEQ ID NO: 1942977 - RNA, 15 nt, Human herpesvirus 4 [Epstein-Barr virus]
cuguguccugggcaa

SEQ ID NO: 1942978 - RNA, 17 nt, Human herpesvirus 4 [Epstein-Barr virus]
cggcugugagcgcacgu

SEQ ID NO: 1942979 - RNA, 23 nt, Human herpesvirus 4 [Epstein-Barr virus]
uauccagagcugagugcccaggg

SEQ ID NO: 1942980 - RNA, 22 nt, Human herpesvirus 4 [Epstein-Barr virus]
acuaggaaacggcgagcagggu

SEQ ID NO: 1942981 - RNA, 21 nt, Human herpesvirus 4 [Epstein-Barr virus]
gaaucuaguaugaaggcuggc

SEQ ID NO: 1942982 - RNA, 18 nt, Human herpesvirus 4 [Epstein-Barr virus]
caaugggagcacauuccc

SEQ ID NO: 1942983 - RNA, 20 nt, Human herpesvirus 4 [Epstein-Barr virus]
cugaacaucucauccccaga

SEQ ID NO: 1942984 - RNA, 21 nt, Human herpesvirus 4 [Epstein-Barr virus]
acaauagaauuuuugcagcua

SEQ ID NO: 1942985 - RNA, 19 nt, Human herpesvirus 4 [Epstein-Barr virus]
gcugcgacaggcccucgag

SEQ ID NO: 1942986 - RNA, 15 nt, Human herpesvirus 4 [Epstein-Barr virus]
uagaggcucaggcca

SEQ ID NO: 1942987 - RNA, 15 nt, Human herpesvirus 4 [Epstein-Barr virus]
gcaccagggccaggc

SEQ ID NO: 1942988 - RNA, 13 nt, Human herpesvirus 4 [Epstein-Barr virus]
aaggaggggcggc

SEQ ID NO: 1942989 - RNA, 18 nt, Human herpesvirus 4 [Epstein-Barr virus]
ggaggaggggggcaguga

SEQ ID NO: 1942990 - RNA, 21 nt, Human herpesvirus 4 [Epstein-Barr virus]
ugcuuuuugccaggccuguca

SEQ ID NO: 1942991 - RNA, 20 nt, Human herpesvirus 4 [Epstein-Barr virus]
gcagcucaccuauggucacu

SEQ ID NO: 1942992 - RNA, 15 nt, Human herpesvirus 4 [Epstein-Barr virus]
gaugacaccauggcc

SEQ ID NO: 1942993 - RNA, 20 nt, Human herpesvirus 4 [Epstein-Barr virus]
ccagccuguuuguccagcag

SEQ ID NO: 1942994 - RNA, 14 nt, Human herpesvirus 4 [Epstein-Barr virus]
gcacagccagagag

SEQ ID NO: 1942995 - RNA, 20 nt, Human herpesvirus 4 [Epstein-Barr virus]
ucuugucggacgaggaggaa

SEQ ID NO: 1942996 - RNA, 17 nt, Human herpesvirus 4 [Epstein-Barr virus]
aucuaguaugaaggcug

SEQ ID NO: 1942997 - RNA, 19 nt, Human herpesvirus 4 [Epstein-Barr virus]
ugccagaugugccugggcu

SEQ ID NO: 1942998 - RNA, 16 nt, Human herpesvirus 4 [Epstein-Barr virus]
accaggcccacugcaa

SEQ ID NO: 1942999 - RNA, 12 nt, Human herpesvirus 4 [Epstein-Barr virus]
aggaacagccuc

SEQ ID NO: 1943000 - RNA, 19 nt, Human herpesvirus 4 [Epstein-Barr virus]
gugggauggcggggccuug

SEQ ID NO: 1943001 - RNA, 18 nt, Human herpesvirus 4 [Epstein-Barr virus]
gcacaggaugacagcugu

SEQ ID NO: 1943002 - RNA, 14 nt, Human herpesvirus 4 [Epstein-Barr virus]
gauccgcaggggcg

SEQ ID NO: 1943003 - RNA, 21 nt, Human herpesvirus 4 [Epstein-Barr virus]
ccuucggacccugguacagga

SEQ ID NO: 1943004 - RNA, 21 nt, Human herpesvirus 4 [Epstein-Barr virus]
agggagacacaucuggaccag

SEQ ID NO: 1943005 - RNA, 18 nt, Human herpesvirus 4 [Epstein-Barr virus]
cgugugcacccggcugga

SEQ ID NO: 1943006 - RNA, 17 nt, Human herpesvirus 4 [Epstein-Barr virus]
accugauucccccugcu

SEQ ID NO: 1943007 - RNA, 14 nt, Human herpesvirus 4 [Epstein-Barr virus]
gcuggccgcagcug

SEQ ID NO: 1943008 - RNA, 21 nt, Human herpesvirus 4 [Epstein-Barr virus]
cacuuuguacagacuuuuggc

SEQ ID NO: 1943009 - RNA, 21 nt, Human herpesvirus 4 [Epstein-Barr virus]
gcaacugcguccucuaccugg

SEQ ID NO: 1943010 - RNA, 15 nt, Human herpesvirus 4 [Epstein-Barr virus]
caguguggcccgauc

SEQ ID NO: 1943011 - RNA, 13 nt, Human herpesvirus 4 [Epstein-Barr virus]
cugcuggucaugg

SEQ ID NO: 1943012 - RNA, 18 nt, Human herpesvirus 4 [Epstein-Barr virus]
acgccgccgccagcagcc

SEQ ID NO: 1943013 - RNA, 14 nt, Human herpesvirus 4 [Epstein-Barr virus]
cagggccgugcaug

SEQ ID NO: 1943014 - RNA, 13 nt, Human herpesvirus 4 [Epstein-Barr virus]
aucgccugccacu

SEQ ID NO: 1943015 - RNA, 23 nt, Human herpesvirus 4 [Epstein-Barr virus]
caaagcugaagaacggacugcgg

SEQ ID NO: 1943016 - RNA, 17 nt, Human herpesvirus 4 [Epstein-Barr virus]
ccuuguccgcugggcca

SEQ ID NO: 1943017 - RNA, 16 nt, Human herpesvirus 4 [Epstein-Barr virus]
guaaccuaugccugga

SEQ ID NO: 1943018 - RNA, 13 nt, Human herpesvirus 4 [Epstein-Barr virus]
gggguggaggcug

SEQ ID NO: 1943019 - RNA, 12 nt, Human herpesvirus 4 [Epstein-Barr virus]
cggccucaaagg

SEQ ID NO: 1943020 - RNA, 14 nt, Human herpesvirus 4 [Epstein-Barr virus]
auuuugccugaagc

SEQ ID NO: 1943021 - RNA, 21 nt, Human herpesvirus 4 [Epstein-Barr virus]
aagccuucuccuggacccugg

SEQ ID NO: 1943022 - RNA, 20 nt, Human herpesvirus 4 [Epstein-Barr virus]
cgagcagaaggccauggaga

SEQ ID NO: 1943023 - RNA, 13 nt, Human herpesvirus 4 [Epstein-Barr virus]
uuugcgaccccuc

SEQ ID NO: 1943024 - RNA, 17 nt, Human herpesvirus 4 [Epstein-Barr virus]
cgccuuguuucucagag

SEQ ID NO: 1943025 - RNA, 16 nt, Human herpesvirus 4 [Epstein-Barr virus]
cucuaaucccucuggg

SEQ ID NO: 1943026 - RNA, 18 nt, Human herpesvirus 4 [Epstein-Barr virus]
agaaggggcccuguacau

SEQ ID NO: 1943027 - RNA, 17 nt, Human herpesvirus 4 [Epstein-Barr virus]
caccucaaccuggagac

SEQ ID NO: 1943028 - RNA, 14 nt, Human herpesvirus 4 [Epstein-Barr virus]
agcuccucuccaaa

SEQ ID NO: 1943029 - RNA, 23 nt, Human herpesvirus 4 [Epstein-Barr virus]
agccuguucauagagaaagggaa

SEQ ID NO: 1943030 - RNA, 18 nt, Human herpesvirus 4 [Epstein-Barr virus]
ugggaggcccaggaccuu

SEQ ID NO: 1943031 - RNA, 22 nt, Human herpesvirus 4 [Epstein-Barr virus]
gguccagaagcagauagccggc

SEQ ID NO: 1943032 - RNA, 17 nt, Human herpesvirus 4 [Epstein-Barr virus]
gaggccagguagcccag

SEQ ID NO: 1943033 - RNA, 20 nt, Human herpesvirus 4 [Epstein-Barr virus]
agaggaggaggaugaagauc

SEQ ID NO: 1943034 - RNA, 15 nt, Human herpesvirus 4 [Epstein-Barr virus]
agcacgguagccuug

SEQ ID NO: 1943035 - RNA, 17 nt, Human herpesvirus 4 [Epstein-Barr virus]
gcacugugggggucggg

SEQ ID NO: 1943036 - RNA, 13 nt, Human herpesvirus 4 [Epstein-Barr virus]
cacaucucaggga

SEQ ID NO: 1943037 - RNA, 17 nt, Human herpesvirus 4 [Epstein-Barr virus]
ggcacaccagacauggu

SEQ ID NO: 1943038 - RNA, 15 nt, Human herpesvirus 4 [Epstein-Barr virus]
gaguccagggcccug

SEQ ID NO: 1943039 - RNA, 18 nt, Human herpesvirus 4 [Epstein-Barr virus]
cagcucaaccgccagggc

SEQ ID NO: 1943040 - RNA, 17 nt, Human herpesvirus 4 [Epstein-Barr virus]
ggacacacauggcacuc

SEQ ID NO: 1943041 - RNA, 17 nt, Human herpesvirus 4 [Epstein-Barr virus]
gccuugagggcaaagac

SEQ ID NO: 1943042 - RNA, 17 nt, Human herpesvirus 4 [Epstein-Barr virus]
agguggcugcugccaaa

SEQ ID NO: 1943043 - RNA, 20 nt, Human herpesvirus 4 [Epstein-Barr virus]
cagauagugaacguggaggu

SEQ ID NO: 1943044 - RNA, 22 nt, Human herpesvirus 4 [Epstein-Barr virus]
agccccuuuugccccccuggcg

SEQ ID NO: 1943045 - RNA, 17 nt, Human herpesvirus 4 [Epstein-Barr virus]
gccgugguugggcagaa

SEQ ID NO: 1943046 - RNA, 15 nt, Human herpesvirus 4 [Epstein-Barr virus]
cccagcccccucccg

SEQ ID NO: 1943047 - RNA, 18 nt, Human herpesvirus 4 [Epstein-Barr virus]
uuggugcugccugggggc

SEQ ID NO: 1943048 - RNA, 21 nt, Human herpesvirus 4 [Epstein-Barr virus]
guggccggugcugccagagcc

SEQ ID NO: 1943049 - RNA, 17 nt, Human herpesvirus 4 [Epstein-Barr virus]
cacccauggccaggcuc

SEQ ID NO: 1943050 - RNA, 23 nt, Human herpesvirus 4 [Epstein-Barr virus]
agaaucaccagagcccagaggag

SEQ ID NO: 1943051 - RNA, 23 nt, Human herpesvirus 4 [Epstein-Barr virus]
gacugcaaacccuggccgccgga

SEQ ID NO: 1943052 - RNA, 17 nt, Human herpesvirus 4 [Epstein-Barr virus]
ugcuggccgcagcuggc

SEQ ID NO: 1943053 - RNA, 19 nt, Human herpesvirus 4 [Epstein-Barr virus]
agacaugcagacuccaggu

SEQ ID NO: 1943054 - RNA, 23 nt, Human herpesvirus 4 [Epstein-Barr virus]
gucuaccucuguuccuucugcuc

SEQ ID NO: 1943055 - RNA, 22 nt, Human herpesvirus 4 [Epstein-Barr virus]
ccaaaaguagaggcucaggcca

SEQ ID NO: 1943056 - RNA, 22 nt, Human herpesvirus 4 [Epstein-Barr virus]
gcagcuagagcggguggaggag

SEQ ID NO: 1943057 - RNA, 17 nt, Human herpesvirus 4 [Epstein-Barr virus]
auugaaaccacgccugc

SEQ ID NO: 1943058 - RNA, 20 nt, Human herpesvirus 4 [Epstein-Barr virus]
cagacuccgaauauccccaa

SEQ ID NO: 1943059 - RNA, 17 nt, Human herpesvirus 4 [Epstein-Barr virus]
cucagcacuuugccagc

SEQ ID NO: 1943060 - RNA, 20 nt, Human herpesvirus 4 [Epstein-Barr virus]
caagcagguauugcagcugg

SEQ ID NO: 1943061 - RNA, 16 nt, Human herpesvirus 4 [Epstein-Barr virus]
uagagguuuugcuagg

SEQ ID NO: 1943062 - RNA, 17 nt, Human herpesvirus 4 [Epstein-Barr virus]
uccagccaguggucuac

SEQ ID NO: 1943063 - RNA, 23 nt, Human herpesvirus 4 [Epstein-Barr virus]
gaagcuagugcagggggcucggc

SEQ ID NO: 1943064 - RNA, 22 nt, Human herpesvirus 4 [Epstein-Barr virus]
cuugcuccaccagcuucucaaa

SEQ ID NO: 1943065 - RNA, 21 nt, Human herpesvirus 4 [Epstein-Barr virus]
cggcuagccugacuaagggug

SEQ ID NO: 1943066 - RNA, 15 nt, Human herpesvirus 4 [Epstein-Barr virus]
caggcucuccagccc

SEQ ID NO: 1943067 - RNA, 18 nt, Human herpesvirus 4 [Epstein-Barr virus]
auaugguuccccccaucu

SEQ ID NO: 1943068 - RNA, 15 nt, Human herpesvirus 4 [Epstein-Barr virus]
caccuugaggugcca

SEQ ID NO: 1943069 - RNA, 17 nt, Human herpesvirus 4 [Epstein-Barr virus]
guccuugucugcugcca

SEQ ID NO: 1943070 - RNA, 17 nt, Human herpesvirus 4 [Epstein-Barr virus]
gaaaaucugcuucuccc

SEQ ID NO: 1943071 - RNA, 21 nt, Human herpesvirus 4 [Epstein-Barr virus]
cggggugccuuagagucccug

SEQ ID NO: 1943072 - RNA, 13 nt, Human herpesvirus 4 [Epstein-Barr virus]
gguauuuggacga

SEQ ID NO: 1943073 - RNA, 21 nt, Human herpesvirus 4 [Epstein-Barr virus]
ugcggaucagucgcuggcugg

SEQ ID NO: 1943074 - RNA, 16 nt, Human herpesvirus 4 [Epstein-Barr virus]
cugccaucgggacaga

SEQ ID NO: 1943075 - RNA, 18 nt, Human herpesvirus 4 [Epstein-Barr virus]
aggcuccggcggcagugg

SEQ ID NO: 1943076 - RNA, 19 nt, Human herpesvirus 4 [Epstein-Barr virus]
guccccgagggugaggccc

SEQ ID NO: 1943077 - RNA, 21 nt, Human herpesvirus 4 [Epstein-Barr virus]
cagcaaccaauguaucccaaa

SEQ ID NO: 1943078 - RNA, 22 nt, Human herpesvirus 4 [Epstein-Barr virus]
guaaaaagcgggccugagucca

SEQ ID NO: 1943079 - RNA, 21 nt, Human herpesvirus 4 [Epstein-Barr virus]
ucccagaaagaagugggaccu

SEQ ID NO: 1943080 - RNA, 18 nt, Human herpesvirus 4 [Epstein-Barr virus]
aacggugauuaggcacug

SEQ ID NO: 1943081 - RNA, 16 nt, Human herpesvirus 4 [Epstein-Barr virus]
aaagcggcccagcaga

SEQ ID NO: 1943082 - RNA, 15 nt, Human herpesvirus 4 [Epstein-Barr virus]
ugaccaagcuaccag

SEQ ID NO: 1943083 - RNA, 13 nt, Human herpesvirus 4 [Epstein-Barr virus]
cuguagccacccg

SEQ ID NO: 1943084 - RNA, 18 nt, Human herpesvirus 4 [Epstein-Barr virus]
guguccagguguggaaaa

SEQ ID NO: 1943085 - RNA, 19 nt, Human herpesvirus 4 [Epstein-Barr virus]
cccgcaccccccgccacca

SEQ ID NO: 1943086 - RNA, 21 nt, Human herpesvirus 4 [Epstein-Barr virus]
augauagcagaagacuccugc

SEQ ID NO: 1943087 - RNA, 13 nt, Human herpesvirus 4 [Epstein-Barr virus]
ucacuguccagac

SEQ ID NO: 1943088 - RNA, 16 nt, Human herpesvirus 4 [Epstein-Barr virus]
cuuguccgcugggcca

SEQ ID NO: 1943089 - RNA, 23 nt, Human herpesvirus 4 [Epstein-Barr virus]
uuaacgggaggaaacaggaggag

SEQ ID NO: 1943090 - RNA, 16 nt, Human herpesvirus 4 [Epstein-Barr virus]
ccccaaaaacguccaa

SEQ ID NO: 1943091 - RNA, 21 nt, Human herpesvirus 4 [Epstein-Barr virus]
ugacagcuacgaaacugacca

SEQ ID NO: 1943092 - RNA, 16 nt, Human herpesvirus 4 [Epstein-Barr virus]
cucaggaucagggcca

SEQ ID NO: 1943093 - RNA, 14 nt, Human herpesvirus 4 [Epstein-Barr virus]
cuaguuaccacagg

SEQ ID NO: 1943094 - RNA, 22 nt, Human herpesvirus 4 [Epstein-Barr virus]
cuggcuccccauagacucccau

SEQ ID NO: 1943095 - RNA, 21 nt, Human herpesvirus 4 [Epstein-Barr virus]
uggacccuauggagggcagcg

SEQ ID NO: 1943096 - RNA, 17 nt, Human herpesvirus 4 [Epstein-Barr virus]
uauugaaaccacgccug

SEQ ID NO: 1943097 - RNA, 15 nt, Human herpesvirus 4 [Epstein-Barr virus]
agcuccagggccagc

SEQ ID NO: 1943098 - RNA, 12 nt, Human herpesvirus 4 [Epstein-Barr virus]
ccuggcucgccu

SEQ ID NO: 1943099 - RNA, 22 nt, Human herpesvirus 4 [Epstein-Barr virus]
ucagcuucgaggucuccccuga

SEQ ID NO: 1943100 - RNA, 13 nt, Human herpesvirus 4 [Epstein-Barr virus]
aauucccgccucc

SEQ ID NO: 1943101 - RNA, 20 nt, Human herpesvirus 4 [Epstein-Barr virus]
cucccauguaagccugccuc

SEQ ID NO: 1943102 - RNA, 17 nt, Human herpesvirus 4 [Epstein-Barr virus]
ccagcccuccucagaaa

SEQ ID NO: 1943103 - RNA, 12 nt, Human herpesvirus 4 [Epstein-Barr virus]
gucccuccucac

SEQ ID NO: 1943104 - RNA, 20 nt, Human herpesvirus 4 [Epstein-Barr virus]
aaugggcgcgggucccccua

SEQ ID NO: 1943105 - RNA, 17 nt, Human herpesvirus 4 [Epstein-Barr virus]
aggacauguuuggggag

SEQ ID NO: 1943106 - RNA, 20 nt, Human herpesvirus 4 [Epstein-Barr virus]
gaaguuuuaacaccugacca

SEQ ID NO: 1943107 - RNA, 18 nt, Human herpesvirus 4 [Epstein-Barr virus]
cuaaucgcugguggcagu

SEQ ID NO: 1943108 - RNA, 15 nt, Human herpesvirus 4 [Epstein-Barr virus]
guccaggggccacac

SEQ ID NO: 1943109 - RNA, 23 nt, Human herpesvirus 4 [Epstein-Barr virus]
uaccgccacgcgucagcaaacca

SEQ ID NO: 1943110 - RNA, 16 nt, Human herpesvirus 4 [Epstein-Barr virus]
uccucaccacucgaaa

SEQ ID NO: 1943111 - RNA, 18 nt, Human herpesvirus 4 [Epstein-Barr virus]
gcccuggaggccucaggc

SEQ ID NO: 1943112 - RNA, 21 nt, Human herpesvirus 4 [Epstein-Barr virus]
gcauuggcugcaaagggaccc

SEQ ID NO: 1943113 - RNA, 14 nt, Human herpesvirus 4 [Epstein-Barr virus]
ugccucugggugcu

SEQ ID NO: 1943114 - RNA, 22 nt, Human herpesvirus 4 [Epstein-Barr virus]
gcccccucuuuguggccuuccu

SEQ ID NO: 1943115 - RNA, 23 nt, Human herpesvirus 4 [Epstein-Barr virus]
caauuggcacucacccccgagga

SEQ ID NO: 1943116 - RNA, 23 nt, Human herpesvirus 4 [Epstein-Barr virus]
caggugccuuuuguacaagcuuu

SEQ ID NO: 1943117 - RNA, 12 nt, Human herpesvirus 4 [Epstein-Barr virus]
agugcagggggc

SEQ ID NO: 1943118 - RNA, 15 nt, Human herpesvirus 4 [Epstein-Barr virus]
aaacugaaucuccac

SEQ ID NO: 1943119 - RNA, 13 nt, Human herpesvirus 4 [Epstein-Barr virus]
ccgaggcacuugc

SEQ ID NO: 1943120 - RNA, 12 nt, Human herpesvirus 4 [Epstein-Barr virus]
gccccucagccu

SEQ ID NO: 1943121 - RNA, 22 nt, Human herpesvirus 4 [Epstein-Barr virus]
ugagggacguaucugggcacuu

SEQ ID NO: 1943122 - RNA, 18 nt, Human herpesvirus 4 [Epstein-Barr virus]
aucaccuggguacccaaa

SEQ ID NO: 1943123 - RNA, 15 nt, Human herpesvirus 4 [Epstein-Barr virus]
caugcacggcccuga

SEQ ID NO: 1943124 - RNA, 15 nt, Human herpesvirus 4 [Epstein-Barr virus]
acaucugcccggcua

SEQ ID NO: 1943125 - RNA, 16 nt, Human herpesvirus 4 [Epstein-Barr virus]
ggccccggucacccca

SEQ ID NO: 1943126 - RNA, 11 nt, Human herpesvirus 4 [Epstein-Barr virus]
acuuccuggga

SEQ ID NO: 1943127 - RNA, 17 nt, Human herpesvirus 4 [Epstein-Barr virus]
cagccccgcccucccca

SEQ ID NO: 1943128 - RNA, 22 nt, Human herpesvirus 4 [Epstein-Barr virus]
acgugccucagauagccggacc

SEQ ID NO: 1943129 - RNA, 21 nt, Human herpesvirus 4 [Epstein-Barr virus]
caugacagucccguugguggu

SEQ ID NO: 1943130 - RNA, 15 nt, Human herpesvirus 4 [Epstein-Barr virus]
ugguggcagcaggcg

SEQ ID NO: 1943131 - RNA, 17 nt, Human herpesvirus 4 [Epstein-Barr virus]
ggcuagacgcagcugug

SEQ ID NO: 1943132 - RNA, 16 nt, Human herpesvirus 4 [Epstein-Barr virus]
gcacucugaccaggac

SEQ ID NO: 1943133 - RNA, 15 nt, Human herpesvirus 4 [Epstein-Barr virus]
cgccaccggcuuggc

SEQ ID NO: 1943134 - RNA, 20 nt, Human herpesvirus 4 [Epstein-Barr virus]
cucagaauugucacugagaa

SEQ ID NO: 1943135 - RNA, 18 nt, Human herpesvirus 4 [Epstein-Barr virus]
cagaucccauuuuucacu

SEQ ID NO: 1943136 - RNA, 14 nt, Human herpesvirus 4 [Epstein-Barr virus]
caaccaggcccacu

SEQ ID NO: 1943137 - RNA, 17 nt, Human herpesvirus 4 [Epstein-Barr virus]
gcugaccggcucggcca

SEQ ID NO: 1943138 - RNA, 14 nt, Human herpesvirus 4 [Epstein-Barr virus]
ggccggugcugcca

SEQ ID NO: 1943139 - RNA, 16 nt, Human herpesvirus 4 [Epstein-Barr virus]
gaugagcacgugugga

SEQ ID NO: 1943140 - RNA, 23 nt, Human herpesvirus 4 [Epstein-Barr virus]
cuagauuuccuacaacucagccc

SEQ ID NO: 1943141 - RNA, 20 nt, Human herpesvirus 4 [Epstein-Barr virus]
gagaggccucugccgcgcug

SEQ ID NO: 1943142 - RNA, 19 nt, Human herpesvirus 4 [Epstein-Barr virus]
acacggaaaccacaacagc

SEQ ID NO: 1943143 - RNA, 12 nt, Human herpesvirus 4 [Epstein-Barr virus]
gcccccugaccu

SEQ ID NO: 1943144 - RNA, 12 nt, Human herpesvirus 4 [Epstein-Barr virus]
gcaggggcgccg

SEQ ID NO: 1943145 - RNA, 18 nt, Human herpesvirus 4 [Epstein-Barr virus]
aacauaaaugccccaucu

SEQ ID NO: 1943146 - RNA, 23 nt, Human herpesvirus 4 [Epstein-Barr virus]
ccucagcgcagggaugccuggac

SEQ ID NO: 1943147 - RNA, 15 nt, Human herpesvirus 4 [Epstein-Barr virus]
uggccgccggauggc

SEQ ID NO: 1943148 - RNA, 15 nt, Human herpesvirus 4 [Epstein-Barr virus]
cgcuccgcgcucggc

SEQ ID NO: 1943149 - RNA, 17 nt, Human herpesvirus 4 [Epstein-Barr virus]
acccagccacuuacagc

SEQ ID NO: 1943150 - RNA, 20 nt, Human herpesvirus 4 [Epstein-Barr virus]
gaaucgguaaggaggggcuc

SEQ ID NO: 1943151 - RNA, 15 nt, Human herpesvirus 4 [Epstein-Barr virus]
caggugcacgcuccc

SEQ ID NO: 1943152 - RNA, 22 nt, Human herpesvirus 4 [Epstein-Barr virus]
cuccuuggagcuguaacugugg

SEQ ID NO: 1943153 - RNA, 14 nt, Human herpesvirus 4 [Epstein-Barr virus]
cggggaggccaggu

SEQ ID NO: 1943154 - RNA, 22 nt, Human herpesvirus 4 [Epstein-Barr virus]
ugcccccuuuguggugggacug

SEQ ID NO: 1943155 - RNA, 18 nt, Human herpesvirus 4 [Epstein-Barr virus]
gcacagaucugaccacgg

SEQ ID NO: 1943156 - RNA, 23 nt, Human herpesvirus 4 [Epstein-Barr virus]
ggguggcagcccccuccuccagg

SEQ ID NO: 1943157 - RNA, 21 nt, Human herpesvirus 4 [Epstein-Barr virus]
ggagggcgcucugcgccagcc

SEQ ID NO: 1943158 - RNA, 17 nt, Human herpesvirus 4 [Epstein-Barr virus]
cgcuuccacccccugga

SEQ ID NO: 1943159 - RNA, 12 nt, Human herpesvirus 4 [Epstein-Barr virus]
gcugcuggucau

SEQ ID NO: 1943160 - RNA, 20 nt, Human herpesvirus 4 [Epstein-Barr virus]
ggcccuccagcguggucaua

SEQ ID NO: 1943161 - RNA, 15 nt, Human herpesvirus 4 [Epstein-Barr virus]
ggaggaggggcagga

SEQ ID NO: 1943162 - RNA, 20 nt, Human herpesvirus 4 [Epstein-Barr virus]
ccagugccuccgccugagcc

SEQ ID NO: 1943163 - RNA, 17 nt, Human herpesvirus 4 [Epstein-Barr virus]
cugucucuuucuggcca

SEQ ID NO: 1943164 - RNA, 18 nt, Human herpesvirus 4 [Epstein-Barr virus]
guggccccggcuggccau

SEQ ID NO: 1943165 - RNA, 23 nt, Human herpesvirus 4 [Epstein-Barr virus]
ccacugagcaagauccuucuggc

SEQ ID NO: 1943166 - RNA, 22 nt, Human herpesvirus 4 [Epstein-Barr virus]
aaggagugccucugggugcuga

SEQ ID NO: 1943167 - RNA, 21 nt, Human herpesvirus 4 [Epstein-Barr virus]
guaauccuugggugaccuggc

SEQ ID NO: 1943168 - RNA, 14 nt, Human herpesvirus 4 [Epstein-Barr virus]
gcuuacagccagag

SEQ ID NO: 1943169 - RNA, 20 nt, Human herpesvirus 4 [Epstein-Barr virus]
gcgagcagcgcggcagaggc

SEQ ID NO: 1943170 - RNA, 23 nt, Human herpesvirus 4 [Epstein-Barr virus]
cuggcuuucguccucuggcucuc

SEQ ID NO: 1943171 - RNA, 22 nt, Human herpesvirus 4 [Epstein-Barr virus]
aggggucaccuuggauccccuu

SEQ ID NO: 1943172 - RNA, 23 nt, Human herpesvirus 4 [Epstein-Barr virus]
ccuaaacgugauggugcuggucu

SEQ ID NO: 1943173 - RNA, 20 nt, Human herpesvirus 4 [Epstein-Barr virus]
ugagcagggcuucguccagg

SEQ ID NO: 1943174 - RNA, 23 nt, Human herpesvirus 4 [Epstein-Barr virus]
acacugccaagguugaagagcag

SEQ ID NO: 1943175 - RNA, 19 nt, Human herpesvirus 4 [Epstein-Barr virus]
gugaugguacggaugauca

SEQ ID NO: 1943176 - RNA, 15 nt, Human herpesvirus 4 [Epstein-Barr virus]
cuaacacgcaauaaa

SEQ ID NO: 1943177 - RNA, 17 nt, Human herpesvirus 4 [Epstein-Barr virus]
ucauccgaggcugagaa

SEQ ID NO: 1943178 - RNA, 20 nt, Human herpesvirus 4 [Epstein-Barr virus]
aucgggcuuuguugggucug

SEQ ID NO: 1943179 - RNA, 13 nt, Human herpesvirus 4 [Epstein-Barr virus]
cuggucaucagcc

SEQ ID NO: 1943180 - RNA, 12 nt, Human herpesvirus 4 [Epstein-Barr virus]
cuugcuggggcg

SEQ ID NO: 1943181 - RNA, 20 nt, Human herpesvirus 4 [Epstein-Barr virus]
gcacguuuaccagugugcca

SEQ ID NO: 1943182 - RNA, 14 nt, Human herpesvirus 4 [Epstein-Barr virus]
ucuacaaugccagg

SEQ ID NO: 1943183 - RNA, 17 nt, Human herpesvirus 4 [Epstein-Barr virus]
agcagcuggauguacag

SEQ ID NO: 1943184 - RNA, 20 nt, Human herpesvirus 4 [Epstein-Barr virus]
uacgcccgacaauaaaguug

SEQ ID NO: 1943185 - RNA, 18 nt, Human herpesvirus 4 [Epstein-Barr virus]
cagaggacuguucucugc

SEQ ID NO: 1943186 - RNA, 22 nt, Human herpesvirus 4 [Epstein-Barr virus]
cuggaggucuucucugacaaau

SEQ ID NO: 1943187 - RNA, 13 nt, Human herpesvirus 4 [Epstein-Barr virus]
ggugcccccacca

SEQ ID NO: 1943188 - RNA, 12 nt, Human herpesvirus 4 [Epstein-Barr virus]
gugggaggccca

SEQ ID NO: 1943189 - RNA, 12 nt, Human herpesvirus 4 [Epstein-Barr virus]
gcccagcccccu

SEQ ID NO: 1943190 - RNA, 12 nt, Human herpesvirus 4 [Epstein-Barr virus]
cagaugugccug

SEQ ID NO: 1943191 - RNA, 22 nt, Human herpesvirus 4 [Epstein-Barr virus]
gcggcaagggcucaccagggag

SEQ ID NO: 1943192 - RNA, 14 nt, Human herpesvirus 4 [Epstein-Barr virus]
ccaggccucagcgu

SEQ ID NO: 1943193 - RNA, 22 nt, Human herpesvirus 4 [Epstein-Barr virus]
cggcgcucgucguucaggaaca

SEQ ID NO: 1943194 - RNA, 22 nt, Human herpesvirus 4 [Epstein-Barr virus]
cucuugucggacgaggaggaag

SEQ ID NO: 1943195 - RNA, 15 nt, Human herpesvirus 4 [Epstein-Barr virus]
acccuucugcugcug

SEQ ID NO: 1943196 - RNA, 16 nt, Human herpesvirus 4 [Epstein-Barr virus]
gcuggacgagguccug

SEQ ID NO: 1943197 - RNA, 21 nt, Human herpesvirus 4 [Epstein-Barr virus]
ccuagccccgggcccagcccu

SEQ ID NO: 1943198 - RNA, 14 nt, Human herpesvirus 4 [Epstein-Barr virus]
ccuccagagccccu

SEQ ID NO: 1943199 - RNA, 23 nt, Human herpesvirus 4 [Epstein-Barr virus]
gcgcaacgccggccugcuggccg

SEQ ID NO: 1943200 - RNA, 13 nt, Human herpesvirus 4 [Epstein-Barr virus]
cuuucuaccaggg

SEQ ID NO: 1943201 - RNA, 21 nt, Human herpesvirus 4 [Epstein-Barr virus]
agacacgucguucaugagagg

SEQ ID NO: 1943202 - RNA, 18 nt, Human herpesvirus 4 [Epstein-Barr virus]
acagggguauguggugcc

SEQ ID NO: 1943203 - RNA, 22 nt, Human herpesvirus 4 [Epstein-Barr virus]
cuccuggaucuggggcuggccu

SEQ ID NO: 1943204 - RNA, 18 nt, Human herpesvirus 4 [Epstein-Barr virus]
gcagaccccagagcagcc

SEQ ID NO: 1943205 - RNA, 14 nt, Human herpesvirus 4 [Epstein-Barr virus]
uguuuguacuucuu

SEQ ID NO: 1943206 - RNA, 20 nt, Human herpesvirus 4 [Epstein-Barr virus]
gccuacugauggccaucuuu

SEQ ID NO: 1943207 - RNA, 14 nt, Human herpesvirus 4 [Epstein-Barr virus]
cuagcuucagggaa

SEQ ID NO: 1943208 - RNA, 12 nt, Human herpesvirus 4 [Epstein-Barr virus]
gggaugagcugg

SEQ ID NO: 1943209 - RNA, 14 nt, Human herpesvirus 4 [Epstein-Barr virus]
agccccacucuugc

SEQ ID NO: 1943210 - RNA, 17 nt, Human herpesvirus 4 [Epstein-Barr virus]
ugagcccaccugucuga

SEQ ID NO: 1943211 - RNA, 23 nt, Human herpesvirus 4 [Epstein-Barr virus]
caauccauuaucuuggcaccccg

SEQ ID NO: 1943212 - RNA, 12 nt, Human herpesvirus 4 [Epstein-Barr virus]
agcccuccucag

SEQ ID NO: 1943213 - RNA, 14 nt, Human herpesvirus 4 [Epstein-Barr virus]
uccuugucugcugc

SEQ ID NO: 1943214 - RNA, 15 nt, Human herpesvirus 4 [Epstein-Barr virus]
gguggagauagggac

SEQ ID NO: 1943215 - RNA, 23 nt, Human herpesvirus 4 [Epstein-Barr virus]
uccuggccgggcgccugcuccac

SEQ ID NO: 1943216 - RNA, 18 nt, Human herpesvirus 4 [Epstein-Barr virus]
cucgcggaagagcccaaa

SEQ ID NO: 1943217 - RNA, 21 nt, Human herpesvirus 4 [Epstein-Barr virus]
cgcgcugcucgccccugguag

SEQ ID NO: 1943218 - RNA, 12 nt, Human herpesvirus 4 [Epstein-Barr virus]
cuggccaaccug

SEQ ID NO: 1943219 - RNA, 20 nt, Human herpesvirus 4 [Epstein-Barr virus]
ccacuuacaaccaagccacu

SEQ ID NO: 1943220 - RNA, 23 nt, Human herpesvirus 4 [Epstein-Barr virus]
ggggcaaagccagcgcacccggg

SEQ ID NO: 1943221 - RNA, 15 nt, Human herpesvirus 4 [Epstein-Barr virus]
ugaggcaauggccac

SEQ ID NO: 1943222 - RNA, 14 nt, Human herpesvirus 4 [Epstein-Barr virus]
aagaagauugaaga

SEQ ID NO: 1943223 - RNA, 23 nt, Human herpesvirus 4 [Epstein-Barr virus]
gcccagcccuccucagaaaacuc

SEQ ID NO: 1943224 - RNA, 16 nt, Human herpesvirus 4 [Epstein-Barr virus]
agccccagccccuccu

SEQ ID NO: 1943225 - RNA, 13 nt, Human herpesvirus 4 [Epstein-Barr virus]
uauugaauuccac

SEQ ID NO: 1943226 - RNA, 13 nt, Human herpesvirus 4 [Epstein-Barr virus]
gagaucaggccaa

SEQ ID NO: 1943227 - RNA, 14 nt, Human herpesvirus 4 [Epstein-Barr virus]
gucacugugcacuc

SEQ ID NO: 1943228 - RNA, 16 nt, Human herpesvirus 4 [Epstein-Barr virus]
ccgggaggugcugggu

SEQ ID NO: 1943229 - RNA, 22 nt, Human herpesvirus 4 [Epstein-Barr virus]
guggcccucgguggugggcugc

SEQ ID NO: 1943230 - RNA, 16 nt, Human herpesvirus 4 [Epstein-Barr virus]
uguuucccgacgccaa

SEQ ID NO: 1943231 - RNA, 20 nt, Human herpesvirus 4 [Epstein-Barr virus]
ccagguacaggaccuggaaa

SEQ ID NO: 1943232 - RNA, 18 nt, Human herpesvirus 4 [Epstein-Barr virus]
ucgggcaagauggagagg

SEQ ID NO: 1943233 - RNA, 22 nt, Human herpesvirus 4 [Epstein-Barr virus]
uguggaaaaucucgcucagagc

SEQ ID NO: 1943234 - RNA, 22 nt, Human herpesvirus 4 [Epstein-Barr virus]
ccgcugggccaggucacagacc

SEQ ID NO: 1943235 - RNA, 15 nt, Human herpesvirus 4 [Epstein-Barr virus]
ucggugcgcagaccc

SEQ ID NO: 1943236 - RNA, 19 nt, Human herpesvirus 4 [Epstein-Barr virus]
cacuacuacaccgagcaga

SEQ ID NO: 1943237 - RNA, 19 nt, Human herpesvirus 4 [Epstein-Barr virus]
ggagcacucggggcccuuu

SEQ ID NO: 1943238 - RNA, 17 nt, Human herpesvirus 4 [Epstein-Barr virus]
gggacgaggacgagaag

SEQ ID NO: 1943239 - RNA, 15 nt, Human herpesvirus 4 [Epstein-Barr virus]
gcaguccuugugucu

SEQ ID NO: 1943240 - RNA, 15 nt, Human herpesvirus 4 [Epstein-Barr virus]
accaugccaucucug

SEQ ID NO: 1943241 - RNA, 19 nt, Human herpesvirus 4 [Epstein-Barr virus]
uuggcaacgagagcaauac

SEQ ID NO: 1943242 - RNA, 16 nt, Human herpesvirus 4 [Epstein-Barr virus]
gccucuacgccccaga

SEQ ID NO: 1943243 - RNA, 14 nt, Human herpesvirus 4 [Epstein-Barr virus]
gggaguaaggccgc

SEQ ID NO: 1943244 - RNA, 23 nt, Human herpesvirus 4 [Epstein-Barr virus]
agcuccgugagcaggagcuugag

SEQ ID NO: 1943245 - RNA, 16 nt, Human herpesvirus 4 [Epstein-Barr virus]
ccuggcuuccacucac

SEQ ID NO: 1943246 - RNA, 12 nt, Human herpesvirus 4 [Epstein-Barr virus]
cuuuauaugaaa

SEQ ID NO: 1943247 - RNA, 16 nt, Human herpesvirus 4 [Epstein-Barr virus]
cuccgccguccacucu

SEQ ID NO: 1943248 - RNA, 15 nt, Human herpesvirus 4 [Epstein-Barr virus]
uaccuuccucugccc

SEQ ID NO: 1943249 - RNA, 19 nt, Human herpesvirus 4 [Epstein-Barr virus]
gcccacgucuuuaccaccu

SEQ ID NO: 1943250 - RNA, 16 nt, Human herpesvirus 4 [Epstein-Barr virus]
aaggcucugcacagga

SEQ ID NO: 1943251 - RNA, 18 nt, Human herpesvirus 4 [Epstein-Barr virus]
cuucaggggaaucucugc

SEQ ID NO: 1943252 - RNA, 12 nt, Human herpesvirus 4 [Epstein-Barr virus]
cauacagcagcu

SEQ ID NO: 1943253 - RNA, 15 nt, Human herpesvirus 4 [Epstein-Barr virus]
acggaugcugcagag

SEQ ID NO: 1943254 - RNA, 16 nt, Human herpesvirus 4 [Epstein-Barr virus]
acuacaauguuccuuc

SEQ ID NO: 1943255 - RNA, 22 nt, Human herpesvirus 4 [Epstein-Barr virus]
ggguaacauuguacagagcugu

SEQ ID NO: 1943256 - RNA, 17 nt, Human herpesvirus 4 [Epstein-Barr virus]
gccaaugggggaggaga

SEQ ID NO: 1943257 - RNA, 15 nt, Human herpesvirus 4 [Epstein-Barr virus]
auguggugggggcua

SEQ ID NO: 1943258 - RNA, 13 nt, Human herpesvirus 4 [Epstein-Barr virus]
caugucagcucca

SEQ ID NO: 1943259 - RNA, 19 nt, Human herpesvirus 4 [Epstein-Barr virus]
agaccucgaguccggggag

SEQ ID NO: 1943260 - RNA, 15 nt, Human herpesvirus 4 [Epstein-Barr virus]
gaggaggggcaggag

SEQ ID NO: 1943261 - RNA, 12 nt, Human herpesvirus 4 [Epstein-Barr virus]
aacaggcugcug

SEQ ID NO: 1943262 - RNA, 23 nt, Human herpesvirus 4 [Epstein-Barr virus]
aacuggggcugguggccugggag

SEQ ID NO: 1943263 - RNA, 15 nt, Human herpesvirus 4 [Epstein-Barr virus]
ugguucaguggacac

SEQ ID NO: 1943264 - RNA, 22 nt, Human herpesvirus 4 [Epstein-Barr virus]
ugcgacggcuuuagccuggccu

SEQ ID NO: 1943265 - RNA, 15 nt, Human herpesvirus 4 [Epstein-Barr virus]
gcucauaccuccacu

SEQ ID NO: 1943266 - RNA, 18 nt, Human herpesvirus 4 [Epstein-Barr virus]
cgggaggggcaggagcag

SEQ ID NO: 1943267 - RNA, 21 nt, Human herpesvirus 4 [Epstein-Barr virus]
gacccuccugucaccaccucc

SEQ ID NO: 1943268 - RNA, 16 nt, Human herpesvirus 4 [Epstein-Barr virus]
gcucaccccugugcag

SEQ ID NO: 1943269 - RNA, 18 nt, Human herpesvirus 4 [Epstein-Barr virus]
cucggggcuggggagaug

SEQ ID NO: 1943270 - RNA, 20 nt, Human herpesvirus 4 [Epstein-Barr virus]
ucugcccccugucucuuucu

SEQ ID NO: 1943271 - RNA, 14 nt, Human herpesvirus 4 [Epstein-Barr virus]
acccccaccacccc

SEQ ID NO: 1943272 - RNA, 13 nt, Human herpesvirus 4 [Epstein-Barr virus]
cgcagaggccauc

SEQ ID NO: 1943273 - RNA, 23 nt, Human herpesvirus 4 [Epstein-Barr virus]
accaacaagcagguauugcagcu

SEQ ID NO: 1943274 - RNA, 17 nt, Human herpesvirus 4 [Epstein-Barr virus]
gccagccggcucgaccg

SEQ ID NO: 1943275 - RNA, 15 nt, Human herpesvirus 4 [Epstein-Barr virus]
ucucuuaugccugug

SEQ ID NO: 1943276 - RNA, 21 nt, Human herpesvirus 4 [Epstein-Barr virus]
caggcagccuugcguggugcu

SEQ ID NO: 1943277 - RNA, 20 nt, Human herpesvirus 4 [Epstein-Barr virus]
accagcuucgagagccacga

SEQ ID NO: 1943278 - RNA, 14 nt, Human herpesvirus 4 [Epstein-Barr virus]
ccugccucugcucu

SEQ ID NO: 1943279 - RNA, 20 nt, Human herpesvirus 4 [Epstein-Barr virus]
gccuccagcucggccagcag

SEQ ID NO: 1943280 - RNA, 19 nt, Human herpesvirus 4 [Epstein-Barr virus]
aaauaaauguuacuucuuu

SEQ ID NO: 1943281 - RNA, 18 nt, Human herpesvirus 4 [Epstein-Barr virus]
cgggcccagcccuccuca

SEQ ID NO: 1943282 - RNA, 11 nt, Human herpesvirus 4 [Epstein-Barr virus]
aaccugagccu

SEQ ID NO: 1943283 - RNA, 22 nt, Human herpesvirus 4 [Epstein-Barr virus]
ugccauuguuuaccgccaucgc

SEQ ID NO: 1943284 - RNA, 21 nt, Human herpesvirus 4 [Epstein-Barr virus]
acugggaugaacccuggggca

SEQ ID NO: 1943285 - RNA, 13 nt, Human herpesvirus 4 [Epstein-Barr virus]
cgaggggccaggu

SEQ ID NO: 1943286 - RNA, 13 nt, Human herpesvirus 4 [Epstein-Barr virus]
ggcauucagauuu

SEQ ID NO: 1943287 - RNA, 13 nt, Human herpesvirus 4 [Epstein-Barr virus]
auucacaucucag

SEQ ID NO: 1943288 - RNA, 21 nt, Human herpesvirus 4 [Epstein-Barr virus]
guaucccaaauaaauguuacu

SEQ ID NO: 1943289 - RNA, 18 nt, Human herpesvirus 4 [Epstein-Barr virus]
ccgccaggaccuggaugc

SEQ ID NO: 1943290 - RNA, 22 nt, Human herpesvirus 4 [Epstein-Barr virus]
gcggaggccgagcagggacugg

SEQ ID NO: 1943291 - RNA, 16 nt, Human herpesvirus 4 [Epstein-Barr virus]
cuguuccuucugcucc

SEQ ID NO: 1943292 - RNA, 22 nt, Human herpesvirus 4 [Epstein-Barr virus]
cccacgguggaacaggagcagg

SEQ ID NO: 1943293 - RNA, 14 nt, Human herpesvirus 4 [Epstein-Barr virus]
acuccaccugccgg

SEQ ID NO: 1943294 - RNA, 20 nt, Human herpesvirus 4 [Epstein-Barr virus]
uagcgacauuuaccugguga

SEQ ID NO: 1943295 - RNA, 14 nt, Human herpesvirus 4 [Epstein-Barr virus]
caucacaagucaca

SEQ ID NO: 1943296 - RNA, 20 nt, Human herpesvirus 4 [Epstein-Barr virus]
cacuuccacagcaauggcac

SEQ ID NO: 1943297 - RNA, 16 nt, Human herpesvirus 4 [Epstein-Barr virus]
ugucggggcugcuggc

SEQ ID NO: 1943298 - RNA, 18 nt, Human herpesvirus 4 [Epstein-Barr virus]
aucacaucaagcagaaag

SEQ ID NO: 1943299 - RNA, 17 nt, Human herpesvirus 4 [Epstein-Barr virus]
guccgccaugaccagca

SEQ ID NO: 1943300 - RNA, 19 nt, Human herpesvirus 4 [Epstein-Barr virus]
guauaaagaaugcccacca

SEQ ID NO: 1943301 - RNA, 19 nt, Human herpesvirus 4 [Epstein-Barr virus]
acgaacuccuccagcagug

SEQ ID NO: 1943302 - RNA, 21 nt, Human herpesvirus 4 [Epstein-Barr virus]
caucaggcgaaggcggagaag

SEQ ID NO: 1943303 - RNA, 17 nt, Human herpesvirus 4 [Epstein-Barr virus]
gcagagguugggccacg

SEQ ID NO: 1943304 - RNA, 17 nt, Human herpesvirus 4 [Epstein-Barr virus]
aggcagaggaaggccac

SEQ ID NO: 1943305 - RNA, 13 nt, Human herpesvirus 4 [Epstein-Barr virus]
ucuggcacugcua

SEQ ID NO: 1943306 - RNA, 16 nt, Human herpesvirus 4 [Epstein-Barr virus]
cggguagaccacuggc

SEQ ID NO: 1943307 - RNA, 15 nt, Human herpesvirus 4 [Epstein-Barr virus]
guaaccuaugccugg

SEQ ID NO: 1943308 - RNA, 13 nt, Human herpesvirus 4 [Epstein-Barr virus]
cccacccuggaac

SEQ ID NO: 1943309 - RNA, 23 nt, Human herpesvirus 4 [Epstein-Barr virus]
gugggccucucuggcugugcuga

SEQ ID NO: 1943310 - RNA, 16 nt, Human herpesvirus 4 [Epstein-Barr virus]
ugcugaugugcugccc

SEQ ID NO: 1943311 - RNA, 20 nt, Human herpesvirus 4 [Epstein-Barr virus]
gucccaaacauaaaugcccc

SEQ ID NO: 1943312 - RNA, 15 nt, Human herpesvirus 4 [Epstein-Barr virus]
ggugaaggcucgacg

SEQ ID NO: 1943313 - RNA, 13 nt, Human herpesvirus 4 [Epstein-Barr virus]
gcaggaggggcag

SEQ ID NO: 1943314 - RNA, 15 nt, Human herpesvirus 4 [Epstein-Barr virus]
ugaacuuuaacauug

SEQ ID NO: 1943315 - RNA, 11 nt, Human herpesvirus 4 [Epstein-Barr virus]
ugaccaacaug

SEQ ID NO: 1943316 - RNA, 15 nt, Human herpesvirus 4 [Epstein-Barr virus]
cccaacagucuucag

SEQ ID NO: 1943317 - RNA, 20 nt, Human herpesvirus 4 [Epstein-Barr virus]
ggcugacguccaccccaccc

SEQ ID NO: 1943318 - RNA, 13 nt, Human herpesvirus 4 [Epstein-Barr virus]
agacccaucugag

SEQ ID NO: 1943319 - RNA, 19 nt, Human herpesvirus 4 [Epstein-Barr virus]
gcacguggguuucugcccc

SEQ ID NO: 1943320 - RNA, 18 nt, Human herpesvirus 4 [Epstein-Barr virus]
gcuaguugguccaggguc

SEQ ID NO: 1943321 - RNA, 22 nt, Human herpesvirus 4 [Epstein-Barr virus]
caccaggccugccaaagagcca

SEQ ID NO: 1943322 - RNA, 16 nt, Human herpesvirus 4 [Epstein-Barr virus]
uccugcacuauauucu

SEQ ID NO: 1943323 - RNA, 13 nt, Human herpesvirus 4 [Epstein-Barr virus]
gacaggcugcgcc

SEQ ID NO: 1943324 - RNA, 18 nt, Human herpesvirus 4 [Epstein-Barr virus]
gacccaaagugagggggc

SEQ ID NO: 1943325 - RNA, 12 nt, Human herpesvirus 4 [Epstein-Barr virus]
ccccccagccug

SEQ ID NO: 1943326 - RNA, 21 nt, Human herpesvirus 4 [Epstein-Barr virus]
ccuugaucuucuucucccuca

SEQ ID NO: 1943327 - RNA, 13 nt, Human herpesvirus 4 [Epstein-Barr virus]
ucuaacaguucac

SEQ ID NO: 1943328 - RNA, 20 nt, Human herpesvirus 4 [Epstein-Barr virus]
aagcaacccccggcucucag

SEQ ID NO: 1943329 - RNA, 18 nt, Human herpesvirus 4 [Epstein-Barr virus]
acucaggaagcuggccag

SEQ ID NO: 1943330 - RNA, 14 nt, Human herpesvirus 4 [Epstein-Barr virus]
augucggggcugcu

SEQ ID NO: 1943331 - RNA, 16 nt, Human herpesvirus 4 [Epstein-Barr virus]
uaagagucccuccuca

SEQ ID NO: 1943332 - RNA, 15 nt, Human herpesvirus 4 [Epstein-Barr virus]
gcgcucgucguucag

SEQ ID NO: 1943333 - RNA, 18 nt, Human herpesvirus 4 [Epstein-Barr virus]
caaggcaguagaggacac

SEQ ID NO: 1943334 - RNA, 15 nt, Human herpesvirus 4 [Epstein-Barr virus]
ucagcacagccagag

SEQ ID NO: 1943335 - RNA, 15 nt, Human herpesvirus 4 [Epstein-Barr virus]
cuugcccucuccagc

SEQ ID NO: 1943336 - RNA, 22 nt, Human herpesvirus 4 [Epstein-Barr virus]
gcaggcauuuuuggugcugccu

SEQ ID NO: 1943337 - RNA, 20 nt, Human herpesvirus 4 [Epstein-Barr virus]
gaggggcucgaauaugauga

SEQ ID NO: 1943338 - RNA, 19 nt, Human herpesvirus 4 [Epstein-Barr virus]
gugucccccuccauuccac

SEQ ID NO: 1943339 - RNA, 23 nt, Human herpesvirus 4 [Epstein-Barr virus]
ugagguaaaaagcgggccugagu

SEQ ID NO: 1943340 - RNA, 14 nt, Human herpesvirus 4 [Epstein-Barr virus]
cccugugcuucuac

SEQ ID NO: 1943341 - RNA, 14 nt, Human herpesvirus 4 [Epstein-Barr virus]
cccugcugucucug

SEQ ID NO: 1943342 - RNA, 23 nt, Human herpesvirus 4 [Epstein-Barr virus]
cuuggacuucucauuagucagga

SEQ ID NO: 1943343 - RNA, 15 nt, Human herpesvirus 4 [Epstein-Barr virus]
uaccuccacuuacaa

SEQ ID NO: 1943344 - RNA, 22 nt, Human herpesvirus 4 [Epstein-Barr virus]
aucccaguuguuauucccaccu

SEQ ID NO: 1943345 - RNA, 13 nt, Human herpesvirus 4 [Epstein-Barr virus]
cuucugcugcugc

SEQ ID NO: 1943346 - RNA, 17 nt, Human herpesvirus 4 [Epstein-Barr virus]
agaaaagagagcggcug

SEQ ID NO: 1943347 - RNA, 18 nt, Human herpesvirus 4 [Epstein-Barr virus]
cacccccuggagccagcg

SEQ ID NO: 1943348 - RNA, 14 nt, Human herpesvirus 4 [Epstein-Barr virus]
caggacggagaagc

SEQ ID NO: 1943349 - RNA, 16 nt, Human herpesvirus 4 [Epstein-Barr virus]
cugggaggaaguuuua

SEQ ID NO: 1943350 - RNA, 16 nt, Human herpesvirus 4 [Epstein-Barr virus]
aggccggcugacaugg

SEQ ID NO: 1943351 - RNA, 20 nt, Human herpesvirus 4 [Epstein-Barr virus]
gaauuccccugccugcaugc

SEQ ID NO: 1943352 - RNA, 22 nt, Human herpesvirus 4 [Epstein-Barr virus]
uuugaucuuugacugacacaua

SEQ ID NO: 1943353 - RNA, 13 nt, Human herpesvirus 4 [Epstein-Barr virus]
augauccuguaca

SEQ ID NO: 1943354 - RNA, 13 nt, Human herpesvirus 4 [Epstein-Barr virus]
aggaucagggcca

SEQ ID NO: 1943355 - RNA, 23 nt, Human herpesvirus 4 [Epstein-Barr virus]
gcacaacaagaaaucccaguugu

SEQ ID NO: 1943356 - RNA, 17 nt, Human herpesvirus 4 [Epstein-Barr virus]
acccucauugugcugaa

SEQ ID NO: 1943357 - RNA, 20 nt, Human herpesvirus 4 [Epstein-Barr virus]
ucucaggccucccagucuau

SEQ ID NO: 1943358 - RNA, 13 nt, Human herpesvirus 4 [Epstein-Barr virus]
acacagugggcuu

SEQ ID NO: 1943359 - RNA, 14 nt, Human herpesvirus 4 [Epstein-Barr virus]
ggccgcugccaggc

SEQ ID NO: 1943360 - RNA, 11 nt, Human herpesvirus 4 [Epstein-Barr virus]
acggccuggca

SEQ ID NO: 1943361 - RNA, 15 nt, Human herpesvirus 4 [Epstein-Barr virus]
cagcuccagggacag

SEQ ID NO: 1943362 - RNA, 12 nt, Human herpesvirus 4 [Epstein-Barr virus]
ggguaggggagu

SEQ ID NO: 1943363 - RNA, 14 nt, Human herpesvirus 4 [Epstein-Barr virus]
uugcccguggggau

SEQ ID NO: 1943364 - RNA, 19 nt, Human herpesvirus 4 [Epstein-Barr virus]
guacagacuuuuggcaaug

SEQ ID NO: 1943365 - RNA, 15 nt, Human herpesvirus 4 [Epstein-Barr virus]
gacgcggugcugacc

SEQ ID NO: 1943366 - RNA, 24 nt, Human herpesvirus 4 [Epstein-Barr virus]
gcagaagagccgcuccguggcccc

SEQ ID NO: 1943367 - RNA, 13 nt, Human herpesvirus 4 [Epstein-Barr virus]
gacguguguggcu

SEQ ID NO: 1943368 - RNA, 21 nt, Human herpesvirus 4 [Epstein-Barr virus]
caggugcccgagccccgccug

SEQ ID NO: 1943369 - RNA, 19 nt, Human herpesvirus 4 [Epstein-Barr virus]
gaggacggugucugugguu

SEQ ID NO: 1943370 - RNA, 18 nt, Human herpesvirus 4 [Epstein-Barr virus]
cugcagcuaugggguccc

SEQ ID NO: 1943371 - RNA, 21 nt, Human herpesvirus 4 [Epstein-Barr virus]
ucuguacaauggggccaggac

SEQ ID NO: 1943372 - RNA, 19 nt, Human herpesvirus 4 [Epstein-Barr virus]
gccuguuuguccagcaggg

SEQ ID NO: 1943373 - RNA, 18 nt, Human herpesvirus 4 [Epstein-Barr virus]
gucacauauccagagcug

SEQ ID NO: 1943374 - RNA, 13 nt, Human herpesvirus 4 [Epstein-Barr virus]
gcgccgccagcau

SEQ ID NO: 1943375 - RNA, 21 nt, Human herpesvirus 4 [Epstein-Barr virus]
ucagaagcuacaaacacgggc

SEQ ID NO: 1943376 - RNA, 19 nt, Human herpesvirus 4 [Epstein-Barr virus]
gaggagcuccgugagcagg

SEQ ID NO: 1943377 - RNA, 19 nt, Human herpesvirus 4 [Epstein-Barr virus]
ggcgagacuuggaccaagg

SEQ ID NO: 1943378 - RNA, 14 nt, Human herpesvirus 4 [Epstein-Barr virus]
caggggcgagcagc

SEQ ID NO: 1943379 - RNA, 16 nt, Human herpesvirus 4 [Epstein-Barr virus]
gaaaagagagcugaug

SEQ ID NO: 1943380 - RNA, 20 nt, Human herpesvirus 4 [Epstein-Barr virus]
ugucugugguugucuuccca

SEQ ID NO: 1943381 - RNA, 16 nt, Human herpesvirus 4 [Epstein-Barr virus]
gagcgggaggggcagg

SEQ ID NO: 1943382 - RNA, 18 nt, Human herpesvirus 4 [Epstein-Barr virus]
ggacccggaccaaugcca

SEQ ID NO: 1943383 - RNA, 18 nt, Human herpesvirus 4 [Epstein-Barr virus]
ccucgaguccggggagaa

SEQ ID NO: 1943384 - RNA, 13 nt, Human herpesvirus 4 [Epstein-Barr virus]
agccugaggaaca

SEQ ID NO: 1943385 - RNA, 12 nt, Human herpesvirus 4 [Epstein-Barr virus]
gaggggccaggu

SEQ ID NO: 1943386 - RNA, 21 nt, Human herpesvirus 4 [Epstein-Barr virus]
ccuccggccgccccgggcccg

SEQ ID NO: 1943387 - RNA, 21 nt, Human herpesvirus 4 [Epstein-Barr virus]
ccgcagccacguccagacucc

SEQ ID NO: 1943388 - RNA, 19 nt, Human herpesvirus 4 [Epstein-Barr virus]
cgcccuggcgguugagcug

SEQ ID NO: 1943389 - RNA, 22 nt, Human herpesvirus 4 [Epstein-Barr virus]
ccagcuggugguccgcauguuu

SEQ ID NO: 1943390 - RNA, 21 nt, Human herpesvirus 4 [Epstein-Barr virus]
ugccuguggccccggcuggcc

SEQ ID NO: 1943391 - RNA, 23 nt, Human herpesvirus 4 [Epstein-Barr virus]
guaacuugucuacaucccauacc

SEQ ID NO: 1943392 - RNA, 16 nt, Human herpesvirus 4 [Epstein-Barr virus]
ccaagauagugaccaa

SEQ ID NO: 1943393 - RNA, 15 nt, Human herpesvirus 4 [Epstein-Barr virus]
cagcgccagcagggc

SEQ ID NO: 1943394 - RNA, 20 nt, Human herpesvirus 4 [Epstein-Barr virus]
caggggaaucucugccaacu

SEQ ID NO: 1943395 - RNA, 14 nt, Human herpesvirus 4 [Epstein-Barr virus]
gggugcucccccug

SEQ ID NO: 1943396 - RNA, 17 nt, Human herpesvirus 4 [Epstein-Barr virus]
ccucagcuguucccagu

SEQ ID NO: 1943397 - RNA, 17 nt, Human herpesvirus 4 [Epstein-Barr virus]
cauaaguccucauggca

SEQ ID NO: 1943398 - RNA, 19 nt, Human herpesvirus 4 [Epstein-Barr virus]
gagcagggcaaagccacaa

SEQ ID NO: 1943399 - RNA, 16 nt, Human herpesvirus 4 [Epstein-Barr virus]
ccucagauagccggac

SEQ ID NO: 1943400 - RNA, 13 nt, Human herpesvirus 4 [Epstein-Barr virus]
gcugcuggucaug

SEQ ID NO: 1943401 - RNA, 11 nt, Human herpesvirus 4 [Epstein-Barr virus]
cccggacggcc

SEQ ID NO: 1943402 - RNA, 18 nt, Human herpesvirus 4 [Epstein-Barr virus]
gacugggggcaaagccag

SEQ ID NO: 1943403 - RNA, 18 nt, Human herpesvirus 4 [Epstein-Barr virus]
gagcuccgugagcaggag

SEQ ID NO: 1943404 - RNA, 17 nt, Human herpesvirus 4 [Epstein-Barr virus]
uguggaagaggaaacag

SEQ ID NO: 1943405 - RNA, 20 nt, Human herpesvirus 4 [Epstein-Barr virus]
gccucucaaaggccuuggac

SEQ ID NO: 1943406 - RNA, 21 nt, Human herpesvirus 4 [Epstein-Barr virus]
cacgucguucaugagaggcgu

SEQ ID NO: 1943407 - RNA, 13 nt, Human herpesvirus 4 [Epstein-Barr virus]
uauagaggcucuc

SEQ ID NO: 1943408 - RNA, 16 nt, Human herpesvirus 4 [Epstein-Barr virus]
acguggcugcgguggu

SEQ ID NO: 1943409 - RNA, 19 nt, Human herpesvirus 4 [Epstein-Barr virus]
gccaaccuuuccaucacug

SEQ ID NO: 1943410 - RNA, 20 nt, Human herpesvirus 4 [Epstein-Barr virus]
aucuggcagcuuuuggccuu

SEQ ID NO: 1943411 - RNA, 14 nt, Human herpesvirus 4 [Epstein-Barr virus]
aguccucauggcag

SEQ ID NO: 1943412 - RNA, 19 nt, Human herpesvirus 4 [Epstein-Barr virus]
cacguuugcccgcuuccuc

SEQ ID NO: 1943413 - RNA, 17 nt, Human herpesvirus 4 [Epstein-Barr virus]
aagggacccacggugga

SEQ ID NO: 1943414 - RNA, 16 nt, Human herpesvirus 4 [Epstein-Barr virus]
cgcugcugcuacuggc

SEQ ID NO: 1943415 - RNA, 17 nt, Human herpesvirus 4 [Epstein-Barr virus]
acccucuugcacuccaa

SEQ ID NO: 1943416 - RNA, 14 nt, Human herpesvirus 4 [Epstein-Barr virus]
uacccaacagucuu

SEQ ID NO: 1943417 - RNA, 22 nt, Human herpesvirus 4 [Epstein-Barr virus]
cugccaacuuugagcugggcaa

SEQ ID NO: 1943418 - RNA, 16 nt, Human herpesvirus 4 [Epstein-Barr virus]
caucggagucgguggg

SEQ ID NO: 1943419 - RNA, 23 nt, Human herpesvirus 4 [Epstein-Barr virus]
agcuuugccccaaucgcgugcca

SEQ ID NO: 1943420 - RNA, 14 nt, Human herpesvirus 4 [Epstein-Barr virus]
gaccucuacacgcu

SEQ ID NO: 1943421 - RNA, 11 nt, Human herpesvirus 4 [Epstein-Barr virus]
guccagugggg

SEQ ID NO: 1943422 - RNA, 20 nt, Human herpesvirus 4 [Epstein-Barr virus]
gggccaggcugucgccagcc

SEQ ID NO: 1943423 - RNA, 19 nt, Human herpesvirus 4 [Epstein-Barr virus]
cacuguauaaagaaugccc

SEQ ID NO: 1943424 - RNA, 16 nt, Human herpesvirus 4 [Epstein-Barr virus]
gaggcagagagccagu

SEQ ID NO: 1943425 - RNA, 23 nt, Human herpesvirus 4 [Epstein-Barr virus]
cugauaauacgcccgacaauaaa

SEQ ID NO: 1943426 - RNA, 17 nt, Human herpesvirus 4 [Epstein-Barr virus]
agcauggcggccuggca

SEQ ID NO: 1943427 - RNA, 15 nt, Human herpesvirus 4 [Epstein-Barr virus]
caccccaccauauga

SEQ ID NO: 1943428 - RNA, 14 nt, Human herpesvirus 4 [Epstein-Barr virus]
gcaagcaugggcga

SEQ ID NO: 1943429 - RNA, 16 nt, Human herpesvirus 4 [Epstein-Barr virus]
acccgucccggguaca

SEQ ID NO: 1943430 - RNA, 23 nt, Human herpesvirus 4 [Epstein-Barr virus]
uguagguguccagcgcucugguc

SEQ ID NO: 1943431 - RNA, 20 nt, Human herpesvirus 4 [Epstein-Barr virus]
gcauuuuuggugcugccugg

SEQ ID NO: 1943432 - RNA, 14 nt, Human herpesvirus 4 [Epstein-Barr virus]
uguuccuucucaug

SEQ ID NO: 1943433 - RNA, 22 nt, Human herpesvirus 4 [Epstein-Barr virus]
ggccaugcaggccuggacagca

SEQ ID NO: 1943434 - RNA, 24 nt, Human herpesvirus 4 [Epstein-Barr virus]
ggcagcagcucuggcacugcuagc

SEQ ID NO: 1943435 - RNA, 14 nt, Human herpesvirus 4 [Epstein-Barr virus]
cauggccugggccc

SEQ ID NO: 1943436 - RNA, 18 nt, Human herpesvirus 4 [Epstein-Barr virus]
caccacccccaccacccc

SEQ ID NO: 1943437 - RNA, 18 nt, Human herpesvirus 4 [Epstein-Barr virus]
ggccaaaagggcucugac

SEQ ID NO: 1943438 - RNA, 18 nt, Human herpesvirus 4 [Epstein-Barr virus]
cuaguaugaaggcuggca

SEQ ID NO: 1943439 - RNA, 21 nt, Human herpesvirus 4 [Epstein-Barr virus]
agcccuccucagaaaacucug

SEQ ID NO: 1943440 - RNA, 12 nt, Human herpesvirus 4 [Epstein-Barr virus]
ugagaaugccaa

SEQ ID NO: 1943441 - RNA, 20 nt, Human herpesvirus 4 [Epstein-Barr virus]
gucagcuguguacgugccuc

SEQ ID NO: 1943442 - RNA, 14 nt, Human herpesvirus 4 [Epstein-Barr virus]
cgggcuugugcuug

SEQ ID NO: 1943443 - RNA, 16 nt, Human herpesvirus 4 [Epstein-Barr virus]
agcccgccagccaccc

SEQ ID NO: 1943444 - RNA, 19 nt, Human herpesvirus 4 [Epstein-Barr virus]
gccugaauuccccugccug

SEQ ID NO: 1943445 - RNA, 12 nt, Human herpesvirus 4 [Epstein-Barr virus]
gaaaagccacau

SEQ ID NO: 1943446 - RNA, 13 nt, Human herpesvirus 4 [Epstein-Barr virus]
acucccuccagaa

SEQ ID NO: 1943447 - RNA, 20 nt, Human herpesvirus 4 [Epstein-Barr virus]
aguaacagguaaucucuggu

SEQ ID NO: 1943448 - RNA, 14 nt, Human herpesvirus 4 [Epstein-Barr virus]
ccucaucccugacc

SEQ ID NO: 1943449 - RNA, 21 nt, Human herpesvirus 4 [Epstein-Barr virus]
gugacaugcuauggugccggg

SEQ ID NO: 1943450 - RNA, 18 nt, Human herpesvirus 4 [Epstein-Barr virus]
uucacuuccucugcuuuu

SEQ ID NO: 1943451 - RNA, 21 nt, Human herpesvirus 4 [Epstein-Barr virus]
cgagaggaugaggcugaugau

SEQ ID NO: 1943452 - RNA, 19 nt, Human herpesvirus 4 [Epstein-Barr virus]
cggugccgcuccuuugcgg

SEQ ID NO: 1943453 - RNA, 18 nt, Human herpesvirus 4 [Epstein-Barr virus]
gccgguggauccuccacc

SEQ ID NO: 1943454 - RNA, 19 nt, Human herpesvirus 4 [Epstein-Barr virus]
cugccccaauaugccaacc

SEQ ID NO: 1943455 - RNA, 20 nt, Human herpesvirus 4 [Epstein-Barr virus]
uguagcgccgcgguuucagc

SEQ ID NO: 1943456 - RNA, 16 nt, Human herpesvirus 4 [Epstein-Barr virus]
aggagagcuggauggu

SEQ ID NO: 1943457 - RNA, 18 nt, Human herpesvirus 4 [Epstein-Barr virus]
uccaguuuuuaugugccu

SEQ ID NO: 1943458 - RNA, 18 nt, Human herpesvirus 4 [Epstein-Barr virus]
ccagcaaaaccagcccgg

SEQ ID NO: 1943459 - RNA, 17 nt, Human herpesvirus 4 [Epstein-Barr virus]
gccucucuggcugugcu

SEQ ID NO: 1943460 - RNA, 19 nt, Human herpesvirus 4 [Epstein-Barr virus]
cgucacugauuuugggcac

SEQ ID NO: 1943461 - RNA, 16 nt, Human herpesvirus 4 [Epstein-Barr virus]
cuccauuccacccacu

SEQ ID NO: 1943462 - RNA, 22 nt, Human herpesvirus 4 [Epstein-Barr virus]
cugcuucuggcucuucugggaa

SEQ ID NO: 1943463 - RNA, 12 nt, Human herpesvirus 4 [Epstein-Barr virus]
ugcaggcuggac

SEQ ID NO: 1943464 - RNA, 16 nt, Human herpesvirus 4 [Epstein-Barr virus]
cugagacagaggugcu

SEQ ID NO: 1943465 - RNA, 14 nt, Human herpesvirus 4 [Epstein-Barr virus]
aagccgggggagaa

SEQ ID NO: 1943466 - RNA, 21 nt, Human herpesvirus 4 [Epstein-Barr virus]
cugguuguaaccuaugccugg

SEQ ID NO: 1943467 - RNA, 19 nt, Human herpesvirus 4 [Epstein-Barr virus]
gguuuccaugacgcugcug

SEQ ID NO: 1943468 - RNA, 18 nt, Human herpesvirus 4 [Epstein-Barr virus]
gcuucccgccuagagcau

SEQ ID NO: 1943469 - RNA, 17 nt, Human herpesvirus 4 [Epstein-Barr virus]
caccggagccaccacag

SEQ ID NO: 1943470 - RNA, 15 nt, Human herpesvirus 4 [Epstein-Barr virus]
gucccuuuggaggac

SEQ ID NO: 1943471 - RNA, 12 nt, Human herpesvirus 4 [Epstein-Barr virus]
ggacgcugcugu

SEQ ID NO: 1943472 - RNA, 15 nt, Human herpesvirus 4 [Epstein-Barr virus]
cucugccgcgcugcu

SEQ ID NO: 1943473 - RNA, 19 nt, Human herpesvirus 4 [Epstein-Barr virus]
cuuauguuucaagcagcuc

SEQ ID NO: 1943474 - RNA, 20 nt, Human herpesvirus 4 [Epstein-Barr virus]
ccagccuacucuccacuccc

SEQ ID NO: 1943475 - RNA, 13 nt, Human herpesvirus 4 [Epstein-Barr virus]
gaugcaacagagg

SEQ ID NO: 1943476 - RNA, 14 nt, Human herpesvirus 4 [Epstein-Barr virus]
accgcgcccuccuc

SEQ ID NO: 1943477 - RNA, 17 nt, Human herpesvirus 4 [Epstein-Barr virus]
ucucuagagccaggcua

SEQ ID NO: 1943478 - RNA, 21 nt, Human herpesvirus 4 [Epstein-Barr virus]
ccaggcaccggucucguccau

SEQ ID NO: 1943479 - RNA, 13 nt, Human herpesvirus 4 [Epstein-Barr virus]
guacuaacacgca

SEQ ID NO: 1943480 - RNA, 14 nt, Human herpesvirus 4 [Epstein-Barr virus]
cgcccugagcugga

SEQ ID NO: 1943481 - RNA, 16 nt, Human herpesvirus 4 [Epstein-Barr virus]
gacaugcuauggugcc

SEQ ID NO: 1943482 - RNA, 15 nt, Human herpesvirus 4 [Epstein-Barr virus]
gccccgggcccagcc

SEQ ID NO: 1943483 - RNA, 20 nt, Human herpesvirus 4 [Epstein-Barr virus]
aggggcuuguucuuggcgga

SEQ ID NO: 1943484 - RNA, 14 nt, Human herpesvirus 4 [Epstein-Barr virus]
gcaaacccuggccg

SEQ ID NO: 1943485 - RNA, 17 nt, Human herpesvirus 4 [Epstein-Barr virus]
augucggcuaaugccau

SEQ ID NO: 1943486 - RNA, 18 nt, Human herpesvirus 4 [Epstein-Barr virus]
aggagcuccgagagcucc

SEQ ID NO: 1943487 - RNA, 18 nt, Human herpesvirus 4 [Epstein-Barr virus]
cuggccaggcuggugaca

SEQ ID NO: 1943488 - RNA, 19 nt, Human herpesvirus 4 [Epstein-Barr virus]
cugagaauaaggcucugaa

SEQ ID NO: 1943489 - RNA, 19 nt, Human herpesvirus 4 [Epstein-Barr virus]
caacagacugcggggagga

SEQ ID NO: 1943490 - RNA, 22 nt, Human herpesvirus 4 [Epstein-Barr virus]
uguagccacccgucccggguac

SEQ ID NO: 1943491 - RNA, 21 nt, Human herpesvirus 4 [Epstein-Barr virus]
cuucggucaaguaccagcugg

SEQ ID NO: 1943492 - RNA, 22 nt, Human herpesvirus 4 [Epstein-Barr virus]
cuguacgccgccgccagcagcc

SEQ ID NO: 1943493 - RNA, 15 nt, Human herpesvirus 4 [Epstein-Barr virus]
caccggggaggccag

SEQ ID NO: 1943494 - RNA, 15 nt, Human herpesvirus 4 [Epstein-Barr virus]
caccgugggaaaaua

SEQ ID NO: 1943495 - RNA, 22 nt, Human herpesvirus 4 [Epstein-Barr virus]
gcaccgauagcauggccgccag

SEQ ID NO: 1943496 - RNA, 13 nt, Human herpesvirus 4 [Epstein-Barr virus]
cggacugcgccuu

SEQ ID NO: 1943497 - RNA, 17 nt, Human herpesvirus 4 [Epstein-Barr virus]
cggaggucgacccuccu

SEQ ID NO: 1943498 - RNA, 18 nt, Human herpesvirus 4 [Epstein-Barr virus]
acuguucaaacagcagca

SEQ ID NO: 1943499 - RNA, 13 nt, Human herpesvirus 4 [Epstein-Barr virus]
cccggcgccaccu

SEQ ID NO: 1943500 - RNA, 22 nt, Human herpesvirus 4 [Epstein-Barr virus]
cgccccugcguugaacccaccc

SEQ ID NO: 1943501 - RNA, 17 nt, Human herpesvirus 4 [Epstein-Barr virus]
gggugaggccacgcuuu

SEQ ID NO: 1943502 - RNA, 19 nt, Human herpesvirus 4 [Epstein-Barr virus]
gguuguauguucagagcuc

SEQ ID NO: 1943503 - RNA, 19 nt, Human herpesvirus 4 [Epstein-Barr virus]
cggcaucggguccuagcac

SEQ ID NO: 1943504 - RNA, 17 nt, Human herpesvirus 4 [Epstein-Barr virus]
cagagcugagugcccag

SEQ ID NO: 1943505 - RNA, 22 nt, Human herpesvirus 4 [Epstein-Barr virus]
ccguuccaggcucuccagcccc

SEQ ID NO: 1943506 - RNA, 23 nt, Human herpesvirus 4 [Epstein-Barr virus]
uagauaaauuaagagucccuccu

SEQ ID NO: 1943507 - RNA, 19 nt, Human herpesvirus 4 [Epstein-Barr virus]
ucaucugaaaaugacaggc

SEQ ID NO: 1943508 - RNA, 22 nt, Human herpesvirus 4 [Epstein-Barr virus]
ggcgcucugcgccagccccgcc

SEQ ID NO: 1943509 - RNA, 17 nt, Human herpesvirus 4 [Epstein-Barr virus]
uacuccuggcauacuuu

SEQ ID NO: 1943510 - RNA, 11 nt, Human herpesvirus 4 [Epstein-Barr virus]
caccugccauc

SEQ ID NO: 1943511 - RNA, 18 nt, Human herpesvirus 4 [Epstein-Barr virus]
ugaagauggccucaaagu

SEQ ID NO: 1943512 - RNA, 24 nt, Human herpesvirus 4 [Epstein-Barr virus]
cgaugaacgccuacgcagaggcca

SEQ ID NO: 1943513 - RNA, 19 nt, Human herpesvirus 4 [Epstein-Barr virus]
acuaauggaauauuaauaa

SEQ ID NO: 1943514 - RNA, 17 nt, Human herpesvirus 4 [Epstein-Barr virus]
uccaguuccccccagcc

SEQ ID NO: 1943515 - RNA, 23 nt, Human herpesvirus 4 [Epstein-Barr virus]
caggcacccccucugaggaccug

SEQ ID NO: 1943516 - RNA, 19 nt, Human herpesvirus 4 [Epstein-Barr virus]
guccagccacgcaggaugu

SEQ ID NO: 1943517 - RNA, 16 nt, Human herpesvirus 4 [Epstein-Barr virus]
gcgagcucuccagcca

SEQ ID NO: 1943518 - RNA, 21 nt, Human herpesvirus 4 [Epstein-Barr virus]
auccacagccccacucuugcc

SEQ ID NO: 1943519 - RNA, 17 nt, Human herpesvirus 4 [Epstein-Barr virus]
gccccggucaccccaga

SEQ ID NO: 1943520 - RNA, 16 nt, Human herpesvirus 4 [Epstein-Barr virus]
agcagcucuggcacug

SEQ ID NO: 1943521 - RNA, 23 nt, Human herpesvirus 4 [Epstein-Barr virus]
aguaggcgguggggcugagacca

SEQ ID NO: 1943522 - RNA, 20 nt, Human herpesvirus 4 [Epstein-Barr virus]
caggccaccgucuacccaga

SEQ ID NO: 1943523 - RNA, 17 nt, Human herpesvirus 4 [Epstein-Barr virus]
ccagaugacugagcgca

SEQ ID NO: 1943524 - RNA, 21 nt, Human herpesvirus 4 [Epstein-Barr virus]
gaggagcuccgugagcaggag

SEQ ID NO: 1943525 - RNA, 23 nt, Human herpesvirus 4 [Epstein-Barr virus]
ccgccguaaucuguggugggcuc

SEQ ID NO: 1943526 - RNA, 16 nt, Human herpesvirus 4 [Epstein-Barr virus]
aucuccaucagggcca

SEQ ID NO: 1943527 - RNA, 13 nt, Human herpesvirus 4 [Epstein-Barr virus]
cucucaggccuca

SEQ ID NO: 1943528 - RNA, 15 nt, Human herpesvirus 4 [Epstein-Barr virus]
uguccugcugaaggg

SEQ ID NO: 1943529 - RNA, 12 nt, Human herpesvirus 4 [Epstein-Barr virus]
gccgucauucca

SEQ ID NO: 1943530 - RNA, 13 nt, Human herpesvirus 4 [Epstein-Barr virus]
cugaguaggcuug

SEQ ID NO: 1943531 - RNA, 21 nt, Human herpesvirus 4 [Epstein-Barr virus]
caggauuucugcguccuggua

SEQ ID NO: 1943532 - RNA, 20 nt, Human herpesvirus 4 [Epstein-Barr virus]
agaucacggcugucuagacg

SEQ ID NO: 1943533 - RNA, 10 nt, Human herpesvirus 4 [Epstein-Barr virus]
ccgcagcugg

SEQ ID NO: 1943534 - RNA, 17 nt, Human herpesvirus 4 [Epstein-Barr virus]
gcccaccagccagcgac

SEQ ID NO: 1943535 - RNA, 21 nt, Human herpesvirus 4 [Epstein-Barr virus]
ggcgggacuggcacgguggcu

SEQ ID NO: 1943536 - RNA, 22 nt, Human herpesvirus 4 [Epstein-Barr virus]
guacgugcgugaucaugagggc

SEQ ID NO: 1943537 - RNA, 22 nt, Human herpesvirus 4 [Epstein-Barr virus]
ggcccacgucuuuaccaccuca

SEQ ID NO: 1943538 - RNA, 22 nt, Human herpesvirus 4 [Epstein-Barr virus]
guggugggcuccuuagacugag

SEQ ID NO: 1943539 - RNA, 17 nt, Human herpesvirus 4 [Epstein-Barr virus]
gcgcaacgccggccugc

SEQ ID NO: 1943540 - RNA, 22 nt, Human herpesvirus 4 [Epstein-Barr virus]
ugaggguugguguccucccggg

SEQ ID NO: 1943541 - RNA, 11 nt, Human herpesvirus 4 [Epstein-Barr virus]
caccuccacca

SEQ ID NO: 1943542 - RNA, 23 nt, Human herpesvirus 4 [Epstein-Barr virus]
uauaauuuaaccaaacagugguc

SEQ ID NO: 1943543 - RNA, 12 nt, Human herpesvirus 4 [Epstein-Barr virus]
caaucucuccca

SEQ ID NO: 1943544 - RNA, 17 nt, Human herpesvirus 4 [Epstein-Barr virus]
ccuuggggguggugggc

SEQ ID NO: 1943545 - RNA, 20 nt, Human herpesvirus 4 [Epstein-Barr virus]
gcuuaacgggaagagaagug

SEQ ID NO: 1943546 - RNA, 17 nt, Human herpesvirus 4 [Epstein-Barr virus]
gcagaggccaucauggc

SEQ ID NO: 1943547 - RNA, 12 nt, Human herpesvirus 4 [Epstein-Barr virus]
uggccuggagag

SEQ ID NO: 1943548 - RNA, 13 nt, Human herpesvirus 4 [Epstein-Barr virus]
cguaucugggcac

SEQ ID NO: 1943549 - RNA, 22 nt, Human herpesvirus 4 [Epstein-Barr virus]
aaagugguucaguggacaccca

SEQ ID NO: 1943550 - RNA, 17 nt, Human herpesvirus 4 [Epstein-Barr virus]
acccagggguggcagug

SEQ ID NO: 1943551 - RNA, 15 nt, Human herpesvirus 4 [Epstein-Barr virus]
accucauccugcuca

SEQ ID NO: 1943552 - RNA, 17 nt, Human herpesvirus 4 [Epstein-Barr virus]
gcccagggacaucccca

SEQ ID NO: 1943553 - RNA, 21 nt, Human herpesvirus 4 [Epstein-Barr virus]
gcuccguccuuguccaggaga

SEQ ID NO: 1943554 - RNA, 18 nt, Human herpesvirus 4 [Epstein-Barr virus]
gccaggcugucgccagcc

SEQ ID NO: 1943555 - RNA, 22 nt, Human herpesvirus 4 [Epstein-Barr virus]
gcucuggucgcccccucugccu

SEQ ID NO: 1943556 - RNA, 20 nt, Human herpesvirus 4 [Epstein-Barr virus]
ggacaugucacguguccugc

SEQ ID NO: 1943557 - RNA, 22 nt, Human herpesvirus 4 [Epstein-Barr virus]
ccuggacacaagagccaucacc

SEQ ID NO: 1943558 - RNA, 19 nt, Human herpesvirus 4 [Epstein-Barr virus]
agggccgucacuccagcca

SEQ ID NO: 1943559 - RNA, 23 nt, Human herpesvirus 4 [Epstein-Barr virus]
gcacuccaagugcaacaaucugg

SEQ ID NO: 1943560 - RNA, 14 nt, Human herpesvirus 4 [Epstein-Barr virus]
aagaaucggguggc

SEQ ID NO: 1943561 - RNA, 17 nt, Human herpesvirus 4 [Epstein-Barr virus]
agcccggccgaggccug

SEQ ID NO: 1943562 - RNA, 14 nt, Human herpesvirus 4 [Epstein-Barr virus]
aggagaaggagccu

SEQ ID NO: 1943563 - RNA, 16 nt, Human herpesvirus 4 [Epstein-Barr virus]
guccgcuccuacacca

SEQ ID NO: 1943564 - RNA, 18 nt, Human herpesvirus 4 [Epstein-Barr virus]
gcgagacuuggaccaagg

SEQ ID NO: 1943565 - RNA, 16 nt, Human herpesvirus 4 [Epstein-Barr virus]
gggcagccagagccag

SEQ ID NO: 1943566 - RNA, 23 nt, Human herpesvirus 4 [Epstein-Barr virus]
caauguaucccaaauaaauguua

SEQ ID NO: 1943567 - RNA, 15 nt, Human herpesvirus 4 [Epstein-Barr virus]
uacgcgacugagggg

SEQ ID NO: 1943568 - RNA, 17 nt, Human herpesvirus 4 [Epstein-Barr virus]
auguuuuccccauguug

SEQ ID NO: 1943569 - RNA, 18 nt, Human herpesvirus 4 [Epstein-Barr virus]
cacagccugcaccagugg

SEQ ID NO: 1943570 - RNA, 12 nt, Human herpesvirus 4 [Epstein-Barr virus]
ggcaugcugccc

SEQ ID NO: 1943571 - RNA, 16 nt, Human herpesvirus 4 [Epstein-Barr virus]
gccugaagcuugcugg

SEQ ID NO: 1943572 - RNA, 16 nt, Human herpesvirus 4 [Epstein-Barr virus]
cccggccgaggccugc

SEQ ID NO: 1943573 - RNA, 15 nt, Human herpesvirus 4 [Epstein-Barr virus]
cacacucccuccaga

SEQ ID NO: 1943574 - RNA, 21 nt, Human herpesvirus 4 [Epstein-Barr virus]
gcaauggcacggaugccuggc

SEQ ID NO: 1943575 - RNA, 19 nt, Human herpesvirus 4 [Epstein-Barr virus]
ggccacggcgugccagagg

SEQ ID NO: 1943576 - RNA, 14 nt, Human herpesvirus 4 [Epstein-Barr virus]
aagcuuaugagcga

SEQ ID NO: 1943577 - RNA, 21 nt, Human herpesvirus 4 [Epstein-Barr virus]
uccggcugcccgucucggccu

SEQ ID NO: 1943578 - RNA, 18 nt, Human herpesvirus 4 [Epstein-Barr virus]
agcugccgcgauguaccc

SEQ ID NO: 1943579 - RNA, 18 nt, Human herpesvirus 4 [Epstein-Barr virus]
gaugguguuggagacggu

SEQ ID NO: 1943580 - RNA, 20 nt, Human herpesvirus 4 [Epstein-Barr virus]
gaguuggcaucuuccuccuu

SEQ ID NO: 1943581 - RNA, 17 nt, Human herpesvirus 4 [Epstein-Barr virus]
gucuccccucgagcgcc

SEQ ID NO: 1943582 - RNA, 15 nt, Human herpesvirus 4 [Epstein-Barr virus]
acguggcuuccagag

SEQ ID NO: 1943583 - RNA, 22 nt, Human herpesvirus 4 [Epstein-Barr virus]
acgcuguccgccaggacggaga

SEQ ID NO: 1943584 - RNA, 11 nt, Human herpesvirus 4 [Epstein-Barr virus]
cucucaggccu

SEQ ID NO: 1943585 - RNA, 14 nt, Human herpesvirus 4 [Epstein-Barr virus]
gcggugccugugga

SEQ ID NO: 1943586 - RNA, 16 nt, Human herpesvirus 4 [Epstein-Barr virus]
gccaugcuaucuugua

SEQ ID NO: 1943587 - RNA, 17 nt, Human herpesvirus 4 [Epstein-Barr virus]
ggugaggacggugucug

SEQ ID NO: 1943588 - RNA, 14 nt, Human herpesvirus 4 [Epstein-Barr virus]
gaagaagcccaccu

SEQ ID NO: 1943589 - RNA, 18 nt, Human herpesvirus 4 [Epstein-Barr virus]
uugcaaucccaaguacag

SEQ ID NO: 1943590 - RNA, 15 nt, Human herpesvirus 4 [Epstein-Barr virus]
gcgucauuucuucca

SEQ ID NO: 1943591 - RNA, 14 nt, Human herpesvirus 4 [Epstein-Barr virus]
cagcagggcacaga

SEQ ID NO: 1943592 - RNA, 21 nt, Human herpesvirus 4 [Epstein-Barr virus]
ccaccuagaaagagccauggu

SEQ ID NO: 1943593 - RNA, 17 nt, Human herpesvirus 4 [Epstein-Barr virus]
ugaugcuugugcuccug

SEQ ID NO: 1943594 - RNA, 14 nt, Human herpesvirus 4 [Epstein-Barr virus]
gauagaauagcugc

SEQ ID NO: 1943595 - RNA, 22 nt, Human herpesvirus 4 [Epstein-Barr virus]
cuaagcuaauagcggccgaaga

SEQ ID NO: 1943596 - RNA, 12 nt, Human herpesvirus 4 [Epstein-Barr virus]
cccaaguacaga

SEQ ID NO: 1943597 - RNA, 17 nt, Human herpesvirus 4 [Epstein-Barr virus]
cugagcaccaacacaac

SEQ ID NO: 1943598 - RNA, 14 nt, Human herpesvirus 4 [Epstein-Barr virus]
caugacgcugcugc

SEQ ID NO: 1943599 - RNA, 14 nt, Human herpesvirus 4 [Epstein-Barr virus]
cacucugaccagga

SEQ ID NO: 1943600 - RNA, 20 nt, Human herpesvirus 4 [Epstein-Barr virus]
ugcccagcuccgugguccug

SEQ ID NO: 1943601 - RNA, 22 nt, Human herpesvirus 4 [Epstein-Barr virus]
cuuugcugaagaugauggaccc

SEQ ID NO: 1943602 - RNA, 15 nt, Human herpesvirus 4 [Epstein-Barr virus]
acugaaaaaccagac

SEQ ID NO: 1943603 - RNA, 17 nt, Human herpesvirus 4 [Epstein-Barr virus]
acucuggggucucaggc

SEQ ID NO: 1943604 - RNA, 21 nt, Human herpesvirus 4 [Epstein-Barr virus]
uccugaagcgaagcagcuccg

SEQ ID NO: 1943605 - RNA, 23 nt, Human herpesvirus 4 [Epstein-Barr virus]
ccccaucuuccagcgcaagcuug

SEQ ID NO: 1943606 - RNA, 20 nt, Human herpesvirus 4 [Epstein-Barr virus]
cucugcauggagaagcugga

SEQ ID NO: 1943607 - RNA, 15 nt, Human herpesvirus 4 [Epstein-Barr virus]
ucaagagaucagcaa

SEQ ID NO: 1943608 - RNA, 21 nt, Human herpesvirus 4 [Epstein-Barr virus]
gcuuugccggcauccagugcg

SEQ ID NO: 1943609 - RNA, 17 nt, Human herpesvirus 4 [Epstein-Barr virus]
auuucugcuagcuucag

SEQ ID NO: 1943610 - RNA, 14 nt, Human herpesvirus 4 [Epstein-Barr virus]
agagaggccucugg

SEQ ID NO: 1943611 - RNA, 22 nt, Human herpesvirus 4 [Epstein-Barr virus]
gaacaauuccccggggacaccu

SEQ ID NO: 1943612 - RNA, 23 nt, Human herpesvirus 4 [Epstein-Barr virus]
cucagagggggugccugugccuc

SEQ ID NO: 1943613 - RNA, 15 nt, Human herpesvirus 4 [Epstein-Barr virus]
cuggcaacuccucuu

SEQ ID NO: 1943614 - RNA, 14 nt, Human herpesvirus 4 [Epstein-Barr virus]
gacguguguggcug

SEQ ID NO: 1943615 - RNA, 22 nt, Human herpesvirus 4 [Epstein-Barr virus]
gacaauacacccaucuggaguu

SEQ ID NO: 1943616 - RNA, 16 nt, Human herpesvirus 4 [Epstein-Barr virus]
ggcucaggccgccgca

SEQ ID NO: 1943617 - RNA, 17 nt, Human herpesvirus 4 [Epstein-Barr virus]
cacuggcuuaugcgugg

SEQ ID NO: 1943618 - RNA, 15 nt, Human herpesvirus 4 [Epstein-Barr virus]
cagaggaaggccaca

SEQ ID NO: 1943619 - RNA, 17 nt, Human herpesvirus 4 [Epstein-Barr virus]
gugcaaggauggaagag

SEQ ID NO: 1943620 - RNA, 21 nt, Human herpesvirus 4 [Epstein-Barr virus]
ugcucaaggcagucuccaccu

SEQ ID NO: 1943621 - RNA, 23 nt, Human herpesvirus 4 [Epstein-Barr virus]
ccugcguugaacccaccccuccu

SEQ ID NO: 1943622 - RNA, 19 nt, Human herpesvirus 4 [Epstein-Barr virus]
ccagagaggcccacugcag

SEQ ID NO: 1943623 - RNA, 12 nt, Human herpesvirus 4 [Epstein-Barr virus]
ucuaaugauguc

SEQ ID NO: 1943624 - RNA, 15 nt, Human herpesvirus 4 [Epstein-Barr virus]
cggguucgggcacgc

SEQ ID NO: 1943625 - RNA, 15 nt, Human herpesvirus 4 [Epstein-Barr virus]
gaugcaacagaggau

SEQ ID NO: 1943626 - RNA, 12 nt, Human herpesvirus 4 [Epstein-Barr virus]
cucucgcacucu

SEQ ID NO: 1943627 - RNA, 14 nt, Human herpesvirus 4 [Epstein-Barr virus]
ggaggaggggcagg

SEQ ID NO: 1943628 - RNA, 16 nt, Human herpesvirus 4 [Epstein-Barr virus]
uguuucucagagagca

SEQ ID NO: 1943629 - RNA, 17 nt, Human herpesvirus 4 [Epstein-Barr virus]
ccugucggcucucuuug

SEQ ID NO: 1943630 - RNA, 23 nt, Human herpesvirus 4 [Epstein-Barr virus]
aggaacuccgcccaggucuugcc

SEQ ID NO: 1943631 - RNA, 12 nt, Human herpesvirus 4 [Epstein-Barr virus]
ucucauccccag

SEQ ID NO: 1943632 - RNA, 21 nt, Human herpesvirus 4 [Epstein-Barr virus]
acggccucaaaggccucggcg

SEQ ID NO: 1943633 - RNA, 22 nt, Human herpesvirus 4 [Epstein-Barr virus]
ucagcuguguacgugccucaga

SEQ ID NO: 1943634 - RNA, 15 nt, Human herpesvirus 4 [Epstein-Barr virus]
aaacaugggcugcua

SEQ ID NO: 1943635 - RNA, 18 nt, Human herpesvirus 4 [Epstein-Barr virus]
caccacucccaccacccc

SEQ ID NO: 1943636 - RNA, 12 nt, Human herpesvirus 4 [Epstein-Barr virus]
gagaggccucug

SEQ ID NO: 1943637 - RNA, 18 nt, Human herpesvirus 4 [Epstein-Barr virus]
ggagcuguaacugugguu

SEQ ID NO: 1943638 - RNA, 13 nt, Human herpesvirus 4 [Epstein-Barr virus]
augaggaaggggc

SEQ ID NO: 1943639 - RNA, 11 nt, Human herpesvirus 4 [Epstein-Barr virus]
auccagggccc

SEQ ID NO: 1943640 - RNA, 15 nt, Human herpesvirus 4 [Epstein-Barr virus]
agcgacgaggaugaa

SEQ ID NO: 1943641 - RNA, 20 nt, Human herpesvirus 4 [Epstein-Barr virus]
auacgcccgacaauaaaguu

SEQ ID NO: 1943642 - RNA, 12 nt, Human herpesvirus 4 [Epstein-Barr virus]
ccaagagcugcc

SEQ ID NO: 1943643 - RNA, 16 nt, Human herpesvirus 4 [Epstein-Barr virus]
gcaccggagccaccac

SEQ ID NO: 1943644 - RNA, 15 nt, Human herpesvirus 4 [Epstein-Barr virus]
cagcgcggcagaggc

SEQ ID NO: 1943645 - RNA, 20 nt, Human herpesvirus 4 [Epstein-Barr virus]
agaugccgugaaugcacgcc

SEQ ID NO: 1943646 - RNA, 21 nt, Human herpesvirus 4 [Epstein-Barr virus]
aggguggacagcagcguccug

SEQ ID NO: 1943647 - RNA, 13 nt, Human herpesvirus 4 [Epstein-Barr virus]
ugucagaccugaa

SEQ ID NO: 1943648 - RNA, 17 nt, Human herpesvirus 4 [Epstein-Barr virus]
gcaaacugacacacagg

SEQ ID NO: 1943649 - RNA, 12 nt, Human herpesvirus 4 [Epstein-Barr virus]
ccggugcugcca

SEQ ID NO: 1943650 - RNA, 22 nt, Human herpesvirus 4 [Epstein-Barr virus]
aaaccuccaaucaccagccacc

SEQ ID NO: 1943651 - RNA, 21 nt, Human herpesvirus 4 [Epstein-Barr virus]
ugcccuccuccacccagcagc

SEQ ID NO: 1943652 - RNA, 14 nt, Human herpesvirus 4 [Epstein-Barr virus]
ucacauauccagag

SEQ ID NO: 1943653 - RNA, 16 nt, Human herpesvirus 4 [Epstein-Barr virus]
cuggugggcucccucu

SEQ ID NO: 1943654 - RNA, 17 nt, Human herpesvirus 4 [Epstein-Barr virus]
gccucggccugggguaa

SEQ ID NO: 1943655 - RNA, 23 nt, Human herpesvirus 4 [Epstein-Barr virus]
aggcuugccugacugacucuccc

SEQ ID NO: 1943656 - RNA, 15 nt, Human herpesvirus 4 [Epstein-Barr virus]
cugucaccaccuccc

SEQ ID NO: 1943657 - RNA, 18 nt, Human herpesvirus 4 [Epstein-Barr virus]
gcugccgaagcagauggc

SEQ ID NO: 1943658 - RNA, 21 nt, Human herpesvirus 4 [Epstein-Barr virus]
ugcaauaaauaaaaguacaga

SEQ ID NO: 1943659 - RNA, 11 nt, Human herpesvirus 4 [Epstein-Barr virus]
ucacagcugcu

SEQ ID NO: 1943660 - RNA, 17 nt, Human herpesvirus 4 [Epstein-Barr virus]
gacauguuucuggugag

SEQ ID NO: 1943661 - RNA, 16 nt, Human herpesvirus 4 [Epstein-Barr virus]
cccagggguggcagug

SEQ ID NO: 1943662 - RNA, 15 nt, Human herpesvirus 4 [Epstein-Barr virus]
cacaccuuggcgggu

SEQ ID NO: 1943663 - RNA, 19 nt, Human herpesvirus 4 [Epstein-Barr virus]
ugugccucgucuaccucug

SEQ ID NO: 1943664 - RNA, 18 nt, Human herpesvirus 4 [Epstein-Barr virus]
gggacgcagaaugugcag

SEQ ID NO: 1943665 - RNA, 14 nt, Human herpesvirus 4 [Epstein-Barr virus]
caacugucacacca

SEQ ID NO: 1943666 - RNA, 15 nt, Human herpesvirus 4 [Epstein-Barr virus]
guggcauugcgggug

SEQ ID NO: 1943667 - RNA, 14 nt, Human herpesvirus 4 [Epstein-Barr virus]
gagggccucuggca

SEQ ID NO: 1943668 - RNA, 15 nt, Human herpesvirus 4 [Epstein-Barr virus]
agccaccacagcaca

SEQ ID NO: 1943669 - RNA, 21 nt, Human herpesvirus 4 [Epstein-Barr virus]
auugcugagaaccugcugcua

SEQ ID NO: 1943670 - RNA, 20 nt, Human herpesvirus 4 [Epstein-Barr virus]
cgaaucugacauuucucaua

SEQ ID NO: 1943671 - RNA, 16 nt, Human herpesvirus 4 [Epstein-Barr virus]
ucagauugccuucugu

SEQ ID NO: 1943672 - RNA, 15 nt, Human herpesvirus 4 [Epstein-Barr virus]
guaccagcugguggu

SEQ ID NO: 1943673 - RNA, 20 nt, Human herpesvirus 4 [Epstein-Barr virus]
aauguuccagaagucggcca

SEQ ID NO: 1943674 - RNA, 24 nt, Human herpesvirus 4 [Epstein-Barr virus]
aacuuuacuuuuauuucaguucug

SEQ ID NO: 1943675 - RNA, 20 nt, Human herpesvirus 4 [Epstein-Barr virus]
cacacgccagagacaaggca

SEQ ID NO: 1943676 - RNA, 13 nt, Human herpesvirus 4 [Epstein-Barr virus]
ccgccaggaccug

SEQ ID NO: 1943677 - RNA, 17 nt, Human herpesvirus 4 [Epstein-Barr virus]
caucagccgcugcgcaa

SEQ ID NO: 1943678 - RNA, 17 nt, Human herpesvirus 4 [Epstein-Barr virus]
agauucagacgagucug

SEQ ID NO: 1943679 - RNA, 20 nt, Human herpesvirus 4 [Epstein-Barr virus]
acgggcaucuuaucagagag

SEQ ID NO: 1943680 - RNA, 18 nt, Human herpesvirus 4 [Epstein-Barr virus]
cuggccguggccagguac

SEQ ID NO: 1943681 - RNA, 16 nt, Human herpesvirus 4 [Epstein-Barr virus]
gacggugucugugguu

SEQ ID NO: 1943682 - RNA, 20 nt, Human herpesvirus 4 [Epstein-Barr virus]
ugcugccgcuacugcugcua

SEQ ID NO: 1943683 - RNA, 18 nt, Human herpesvirus 4 [Epstein-Barr virus]
ggaacaaacaugggcugc

SEQ ID NO: 1943684 - RNA, 11 nt, Human herpesvirus 4 [Epstein-Barr virus]
cggagggacag

SEQ ID NO: 1943685 - RNA, 21 nt, Human herpesvirus 4 [Epstein-Barr virus]
auccuagagggacagcugacg

SEQ ID NO: 1943686 - RNA, 19 nt, Human herpesvirus 4 [Epstein-Barr virus]
ggccugcuggccgagcugg

SEQ ID NO: 1943687 - RNA, 20 nt, Human herpesvirus 4 [Epstein-Barr virus]
agcuuaaagagacucaggcc

SEQ ID NO: 1943688 - RNA, 23 nt, Human herpesvirus 4 [Epstein-Barr virus]
cucagggccacggcgugccagag

SEQ ID NO: 1943689 - RNA, 15 nt, Human herpesvirus 4 [Epstein-Barr virus]
ggcaaggagcuguuu

SEQ ID NO: 1943690 - RNA, 17 nt, Human herpesvirus 4 [Epstein-Barr virus]
gccccgguccccccaga

SEQ ID NO: 1943691 - RNA, 22 nt, Human herpesvirus 4 [Epstein-Barr virus]
agucccaacccaaaaccacaca

SEQ ID NO: 1943692 - RNA, 17 nt, Human herpesvirus 4 [Epstein-Barr virus]
uugucccugagauguga

SEQ ID NO: 1943693 - RNA, 14 nt, Human herpesvirus 4 [Epstein-Barr virus]
agcagguggcacac

SEQ ID NO: 1943694 - RNA, 15 nt, Human herpesvirus 4 [Epstein-Barr virus]
ccagagcaaaagcaa

SEQ ID NO: 1943695 - RNA, 13 nt, Human herpesvirus 4 [Epstein-Barr virus]
ggugaggcccagc

SEQ ID NO: 1943696 - RNA, 16 nt, Human herpesvirus 4 [Epstein-Barr virus]
cucuuggcagcagugg

SEQ ID NO: 1943697 - RNA, 18 nt, Human herpesvirus 4 [Epstein-Barr virus]
uguuuacaucugcccggc

SEQ ID NO: 1943698 - RNA, 22 nt, Human herpesvirus 4 [Epstein-Barr virus]
ugccccggggcuaaccaaggac

SEQ ID NO: 1943699 - RNA, 16 nt, Human herpesvirus 4 [Epstein-Barr virus]
cgacaucgccgcccca

SEQ ID NO: 1943700 - RNA, 23 nt, Human herpesvirus 4 [Epstein-Barr virus]
ucuaacacgcuuuugucugccug

SEQ ID NO: 1943701 - RNA, 13 nt, Human herpesvirus 4 [Epstein-Barr virus]
gguauugcagcug

SEQ ID NO: 1943702 - RNA, 17 nt, Human herpesvirus 4 [Epstein-Barr virus]
gugggacguuuagaaac

SEQ ID NO: 1943703 - RNA, 19 nt, Human herpesvirus 4 [Epstein-Barr virus]
cccauacaugucucagagg

SEQ ID NO: 1943704 - RNA, 19 nt, Human herpesvirus 4 [Epstein-Barr virus]
agguguccagcgcucuggu

SEQ ID NO: 1943705 - RNA, 15 nt, Human herpesvirus 4 [Epstein-Barr virus]
gccgccgccagcagc

SEQ ID NO: 1943706 - RNA, 13 nt, Human herpesvirus 4 [Epstein-Barr virus]
caggcagccuugc

SEQ ID NO: 1943707 - RNA, 20 nt, Human herpesvirus 4 [Epstein-Barr virus]
cuccggacgcagaggccugc

SEQ ID NO: 1943708 - RNA, 23 nt, Human herpesvirus 4 [Epstein-Barr virus]
uggagagauuucauccucagagg

SEQ ID NO: 1943709 - RNA, 23 nt, Human herpesvirus 4 [Epstein-Barr virus]
agaggagaauagaggggagcaga

SEQ ID NO: 1943710 - RNA, 21 nt, Human herpesvirus 4 [Epstein-Barr virus]
caaaaucaaaguaguuggagc

SEQ ID NO: 1943711 - RNA, 17 nt, Human herpesvirus 4 [Epstein-Barr virus]
cugcccuccuccaccca

SEQ ID NO: 1943712 - RNA, 17 nt, Human herpesvirus 4 [Epstein-Barr virus]
cauccacagccccacuc

SEQ ID NO: 1943713 - RNA, 22 nt, Human herpesvirus 4 [Epstein-Barr virus]
gcuuccacccccuggagccagc

SEQ ID NO: 1943714 - RNA, 19 nt, Human herpesvirus 4 [Epstein-Barr virus]
uaaagaucuaccccagcug

SEQ ID NO: 1943715 - RNA, 22 nt, Human herpesvirus 4 [Epstein-Barr virus]
ggcggcagcggacgguggggcu

SEQ ID NO: 1943716 - RNA, 16 nt, Human herpesvirus 4 [Epstein-Barr virus]
cucggccuccuggcca

SEQ ID NO: 1943717 - RNA, 14 nt, Human herpesvirus 4 [Epstein-Barr virus]
ggcagucuccaccu

SEQ ID NO: 1943718 - RNA, 18 nt, Human herpesvirus 4 [Epstein-Barr virus]
cauuuuauuuacagccau

SEQ ID NO: 1943719 - RNA, 14 nt, Human herpesvirus 4 [Epstein-Barr virus]
gaguguagaggugg

SEQ ID NO: 1943720 - RNA, 23 nt, Human herpesvirus 4 [Epstein-Barr virus]
ccuuaaauucaccuaagaauggg

SEQ ID NO: 1943721 - RNA, 17 nt, Human herpesvirus 4 [Epstein-Barr virus]
ccagcucggccagcagg

SEQ ID NO: 1943722 - RNA, 12 nt, Human herpesvirus 4 [Epstein-Barr virus]
cacaacagccag

SEQ ID NO: 1943723 - RNA, 16 nt, Human herpesvirus 4 [Epstein-Barr virus]
cugcacagaacaucac

SEQ ID NO: 1943724 - RNA, 13 nt, Human herpesvirus 4 [Epstein-Barr virus]
guccaucccggag

SEQ ID NO: 1943725 - RNA, 18 nt, Human herpesvirus 4 [Epstein-Barr virus]
ccccgaaagcggcccagc

SEQ ID NO: 1943726 - RNA, 15 nt, Human herpesvirus 4 [Epstein-Barr virus]
cacacagcgccagca

SEQ ID NO: 1943727 - RNA, 18 nt, Human herpesvirus 4 [Epstein-Barr virus]
aucacccauggccaggcu

SEQ ID NO: 1943728 - RNA, 16 nt, Human herpesvirus 4 [Epstein-Barr virus]
agcuccgccaccuccg

SEQ ID NO: 1943729 - RNA, 23 nt, Human herpesvirus 4 [Epstein-Barr virus]
ucgaugccgcuuacagccagaga

SEQ ID NO: 1943730 - RNA, 18 nt, Human herpesvirus 4 [Epstein-Barr virus]
ugacccauaccaggugcc

SEQ ID NO: 1943731 - RNA, 15 nt, Human herpesvirus 4 [Epstein-Barr virus]
accccuaccucggca

SEQ ID NO: 1943732 - RNA, 15 nt, Human herpesvirus 4 [Epstein-Barr virus]
aacucagccccaucu

SEQ ID NO: 1943733 - RNA, 13 nt, Human herpesvirus 4 [Epstein-Barr virus]
ggccgcugccagg

SEQ ID NO: 1943734 - RNA, 15 nt, Human herpesvirus 4 [Epstein-Barr virus]
ucuauccaggaggag

SEQ ID NO: 1943735 - RNA, 19 nt, Human herpesvirus 4 [Epstein-Barr virus]
ggaggacacugccaagguu

SEQ ID NO: 1943736 - RNA, 15 nt, Human herpesvirus 4 [Epstein-Barr virus]
uucccgccuccccuc

SEQ ID NO: 1943737 - RNA, 18 nt, Human herpesvirus 4 [Epstein-Barr virus]
aaaacucugcauggagaa

SEQ ID NO: 1943738 - RNA, 16 nt, Human herpesvirus 4 [Epstein-Barr virus]
ugggcugcuauaguga

SEQ ID NO: 1943739 - RNA, 23 nt, Human herpesvirus 4 [Epstein-Barr virus]
ggcuggacgucuuguccuuggug

SEQ ID NO: 1943740 - RNA, 15 nt, Human herpesvirus 4 [Epstein-Barr virus]
aagauacccagagca

SEQ ID NO: 1943741 - RNA, 17 nt, Human herpesvirus 4 [Epstein-Barr virus]
auaccuugggcaucaug

SEQ ID NO: 1943742 - RNA, 18 nt, Human herpesvirus 4 [Epstein-Barr virus]
ggccauucgacaggccau

SEQ ID NO: 1943743 - RNA, 15 nt, Human herpesvirus 4 [Epstein-Barr virus]
ggauggccuccagcu

SEQ ID NO: 1943744 - RNA, 22 nt, Human herpesvirus 4 [Epstein-Barr virus]
cuugaccaguguguacauucca

SEQ ID NO: 1943745 - RNA, 20 nt, Human herpesvirus 4 [Epstein-Barr virus]
caaacugacacacaggccug

SEQ ID NO: 1943746 - RNA, 13 nt, Human herpesvirus 4 [Epstein-Barr virus]
cucacaggacaug

SEQ ID NO: 1943747 - RNA, 14 nt, Human herpesvirus 4 [Epstein-Barr virus]
ggccagcuuugagc

SEQ ID NO: 1943748 - RNA, 16 nt, Human herpesvirus 4 [Epstein-Barr virus]
aggcccagcccccucu

SEQ ID NO: 1943749 - RNA, 13 nt, Human herpesvirus 4 [Epstein-Barr virus]
ccuccuggccagc

SEQ ID NO: 1943750 - RNA, 23 nt, Human herpesvirus 4 [Epstein-Barr virus]
cacagaucugaccacggcccacg

SEQ ID NO: 1943751 - RNA, 16 nt, Human herpesvirus 4 [Epstein-Barr virus]
cagccaccuccccugu

SEQ ID NO: 1943752 - RNA, 13 nt, Human herpesvirus 4 [Epstein-Barr virus]
gcuaaccagaugu

SEQ ID NO: 1943753 - RNA, 11 nt, Human herpesvirus 4 [Epstein-Barr virus]
agggaggagac

SEQ ID NO: 1943754 - RNA, 21 nt, Human herpesvirus 4 [Epstein-Barr virus]
gcgacauguuucuggugagcc

SEQ ID NO: 1943755 - RNA, 14 nt, Human herpesvirus 4 [Epstein-Barr virus]
ccuggugccagacu

SEQ ID NO: 1943756 - RNA, 12 nt, Human herpesvirus 4 [Epstein-Barr virus]
gcagggcccagu

SEQ ID NO: 1943757 - RNA, 19 nt, Human herpesvirus 4 [Epstein-Barr virus]
acucauuacuuguucuuuu

SEQ ID NO: 1943758 - RNA, 14 nt, Human herpesvirus 4 [Epstein-Barr virus]
gcagcaccucagcu

SEQ ID NO: 1943759 - RNA, 14 nt, Human herpesvirus 4 [Epstein-Barr virus]
ugcucucucuggag

SEQ ID NO: 1943760 - RNA, 18 nt, Human herpesvirus 4 [Epstein-Barr virus]
aaccuuggacccugcugc

SEQ ID NO: 1943761 - RNA, 16 nt, Human herpesvirus 4 [Epstein-Barr virus]
aguagcccuuggaacu

SEQ ID NO: 1943762 - RNA, 12 nt, Human herpesvirus 4 [Epstein-Barr virus]
acaggcugcgcc

SEQ ID NO: 1943763 - RNA, 14 nt, Human herpesvirus 4 [Epstein-Barr virus]
gcuacucuccgccg

SEQ ID NO: 1943764 - RNA, 13 nt, Human herpesvirus 4 [Epstein-Barr virus]
gcauaaugggagg

SEQ ID NO: 1943765 - RNA, 16 nt, Human herpesvirus 4 [Epstein-Barr virus]
gugugaagggcagggc

SEQ ID NO: 1943766 - RNA, 22 nt, Human herpesvirus 4 [Epstein-Barr virus]
ucgagauuguuuacaucugccc

SEQ ID NO: 1943767 - RNA, 23 nt, Human herpesvirus 4 [Epstein-Barr virus]
guggccuucucugauggccugga

SEQ ID NO: 1943768 - RNA, 19 nt, Human herpesvirus 4 [Epstein-Barr virus]
ccugccaaagagccagauc

SEQ ID NO: 1943769 - RNA, 14 nt, Human herpesvirus 4 [Epstein-Barr virus]
cgggcuccaugucc

SEQ ID NO: 1943770 - RNA, 13 nt, Human herpesvirus 4 [Epstein-Barr virus]
gccgaguggcaga

SEQ ID NO: 1943771 - RNA, 20 nt, Human herpesvirus 4 [Epstein-Barr virus]
ccuacaccaagauagugacc

SEQ ID NO: 1943772 - RNA, 21 nt, Human herpesvirus 4 [Epstein-Barr virus]
gagugccgggcccgggacagc

SEQ ID NO: 1943773 - RNA, 17 nt, Human herpesvirus 4 [Epstein-Barr virus]
gagacuggcaacuccuc

SEQ ID NO: 1943774 - RNA, 15 nt, Human herpesvirus 4 [Epstein-Barr virus]
caucuauuagcagcc

SEQ ID NO: 1943775 - RNA, 22 nt, Human herpesvirus 4 [Epstein-Barr virus]
ggccucgucaggagggcagaga

SEQ ID NO: 1943776 - RNA, 14 nt, Human herpesvirus 4 [Epstein-Barr virus]
caccaacacaacca

SEQ ID NO: 1943777 - RNA, 17 nt, Human herpesvirus 4 [Epstein-Barr virus]
aucuuugcugaagauga

SEQ ID NO: 1943778 - RNA, 19 nt, Human herpesvirus 4 [Epstein-Barr virus]
uccccgagggugaggccca

SEQ ID NO: 1943779 - RNA, 14 nt, Human herpesvirus 4 [Epstein-Barr virus]
gugguucuccugau

SEQ ID NO: 1943780 - RNA, 23 nt, Human herpesvirus 4 [Epstein-Barr virus]
uaacgggggaaggaaaggccugc

SEQ ID NO: 1943781 - RNA, 14 nt, Human herpesvirus 4 [Epstein-Barr virus]
cugggugcugagcg

SEQ ID NO: 1943782 - RNA, 18 nt, Human herpesvirus 4 [Epstein-Barr virus]
gccagagcggcauccuca

SEQ ID NO: 1943783 - RNA, 23 nt, Human herpesvirus 4 [Epstein-Barr virus]
aucccaguuguuauucccaccuc

SEQ ID NO: 1943784 - RNA, 18 nt, Human herpesvirus 4 [Epstein-Barr virus]
cucgacgcgggcccgggu

SEQ ID NO: 1943785 - RNA, 17 nt, Human herpesvirus 4 [Epstein-Barr virus]
ccuugucuuugguggau

SEQ ID NO: 1943786 - RNA, 22 nt, Human herpesvirus 4 [Epstein-Barr virus]
ccuuucccccacccuggaacaa

SEQ ID NO: 1943787 - RNA, 14 nt, Human herpesvirus 4 [Epstein-Barr virus]
gugccauggugcca

SEQ ID NO: 1943788 - RNA, 20 nt, Human herpesvirus 4 [Epstein-Barr virus]
gaacaguaaacacugccaua

SEQ ID NO: 1943789 - RNA, 16 nt, Human herpesvirus 4 [Epstein-Barr virus]
ucggacgaggaggaag

SEQ ID NO: 1943790 - RNA, 15 nt, Human herpesvirus 4 [Epstein-Barr virus]
caccagcuccaggga

SEQ ID NO: 1943791 - RNA, 13 nt, Human herpesvirus 4 [Epstein-Barr virus]
cagagggugagcc

SEQ ID NO: 1943792 - RNA, 21 nt, Human herpesvirus 4 [Epstein-Barr virus]
ccaccuguguaaccucacugu

SEQ ID NO: 1943793 - RNA, 15 nt, Human herpesvirus 4 [Epstein-Barr virus]
ugagugcccagggca

SEQ ID NO: 1943794 - RNA, 13 nt, Human herpesvirus 4 [Epstein-Barr virus]
acggggaaggagg

SEQ ID NO: 1943795 - RNA, 21 nt, Human herpesvirus 4 [Epstein-Barr virus]
agggacccacgguggaacagg

SEQ ID NO: 1943796 - RNA, 14 nt, Human herpesvirus 4 [Epstein-Barr virus]
cuaaccaaggacaa

SEQ ID NO: 1943797 - RNA, 20 nt, Human herpesvirus 4 [Epstein-Barr virus]
ggcacgggcagaggacacgc

SEQ ID NO: 1943798 - RNA, 16 nt, Human herpesvirus 4 [Epstein-Barr virus]
acagucuucaggucug

SEQ ID NO: 1943799 - RNA, 20 nt, Human herpesvirus 4 [Epstein-Barr virus]
ucugcuucgcguccuuuggg

SEQ ID NO: 1943800 - RNA, 16 nt, Human herpesvirus 4 [Epstein-Barr virus]
gccuaucauguuucaa

SEQ ID NO: 1943801 - RNA, 21 nt, Human herpesvirus 4 [Epstein-Barr virus]
ucccugggggccugugucuuc

SEQ ID NO: 1943802 - RNA, 13 nt, Human herpesvirus 4 [Epstein-Barr virus]
gcuggccgagcug

SEQ ID NO: 1943803 - RNA, 18 nt, Human herpesvirus 4 [Epstein-Barr virus]
cucacuucuacucuuggc

SEQ ID NO: 1943804 - RNA, 18 nt, Human herpesvirus 4 [Epstein-Barr virus]
gccgcuaguugguccagg

SEQ ID NO: 1943805 - RNA, 19 nt, Human herpesvirus 4 [Epstein-Barr virus]
ggcgccgaaagcaggaaug

SEQ ID NO: 1943806 - RNA, 15 nt, Human herpesvirus 4 [Epstein-Barr virus]
ucugacgaggggcca

SEQ ID NO: 1943807 - RNA, 20 nt, Human herpesvirus 4 [Epstein-Barr virus]
aggcauuuuuggugcugccu

SEQ ID NO: 1943808 - RNA, 23 nt, Human herpesvirus 4 [Epstein-Barr virus]
gagaggcuucccgccuagagcau

SEQ ID NO: 1943809 - RNA, 13 nt, Human herpesvirus 4 [Epstein-Barr virus]
ggcauccuucaga

SEQ ID NO: 1943810 - RNA, 17 nt, Human herpesvirus 4 [Epstein-Barr virus]
cugaucugggagaugag

SEQ ID NO: 1943811 - RNA, 20 nt, Human herpesvirus 4 [Epstein-Barr virus]
gcggacccgaucagagcccc

SEQ ID NO: 1943812 - RNA, 13 nt, Human herpesvirus 4 [Epstein-Barr virus]
auccuggccccca

SEQ ID NO: 1943813 - RNA, 17 nt, Human herpesvirus 4 [Epstein-Barr virus]
agugccaagagcugccu

SEQ ID NO: 1943814 - RNA, 18 nt, Human herpesvirus 4 [Epstein-Barr virus]
acagaggaggcuggugcc

SEQ ID NO: 1943815 - RNA, 23 nt, Human herpesvirus 4 [Epstein-Barr virus]
gaagcuacaaacacgggccuggg

SEQ ID NO: 1943816 - RNA, 19 nt, Human herpesvirus 4 [Epstein-Barr virus]
aggcgggaauggccgccac

SEQ ID NO: 1943817 - RNA, 19 nt, Human herpesvirus 4 [Epstein-Barr virus]
uggcagcccccuccuccag

SEQ ID NO: 1943818 - RNA, 18 nt, Human herpesvirus 4 [Epstein-Barr virus]
cuuggaccaagggcaggg

SEQ ID NO: 1943819 - RNA, 22 nt, Human herpesvirus 4 [Epstein-Barr virus]
gcccugcaaacugacacacagg

SEQ ID NO: 1943820 - RNA, 17 nt, Human herpesvirus 4 [Epstein-Barr virus]
aaggccgcugccaggcc

SEQ ID NO: 1943821 - RNA, 15 nt, Human herpesvirus 4 [Epstein-Barr virus]
augaacccuggggca

SEQ ID NO: 1943822 - RNA, 16 nt, Human herpesvirus 4 [Epstein-Barr virus]
cggccgcugcgcccug

SEQ ID NO: 1943823 - RNA, 16 nt, Human herpesvirus 4 [Epstein-Barr virus]
gaucuucuucucccuc

SEQ ID NO: 1943824 - RNA, 14 nt, Human herpesvirus 4 [Epstein-Barr virus]
auggcggccuggca

SEQ ID NO: 1943825 - RNA, 19 nt, Human herpesvirus 4 [Epstein-Barr virus]
ggaacggugggaagcucag

SEQ ID NO: 1943826 - RNA, 22 nt, Human herpesvirus 4 [Epstein-Barr virus]
gcauggcagcagacaaggacag

SEQ ID NO: 1943827 - RNA, 13 nt, Human herpesvirus 4 [Epstein-Barr virus]
caccagcuccagg

SEQ ID NO: 1943828 - RNA, 17 nt, Human herpesvirus 4 [Epstein-Barr virus]
ccgcagaagagccgcuc

SEQ ID NO: 1943829 - RNA, 17 nt, Human herpesvirus 4 [Epstein-Barr virus]
ccggggguggaggcugc

SEQ ID NO: 1943830 - RNA, 10 nt, Human herpesvirus 4 [Epstein-Barr virus]
guccacugcc

SEQ ID NO: 1943831 - RNA, 20 nt, Human herpesvirus 4 [Epstein-Barr virus]
cacccacugauaauacgccc

SEQ ID NO: 1943832 - RNA, 16 nt, Human herpesvirus 4 [Epstein-Barr virus]
ccacgauguagccgcu

SEQ ID NO: 1943833 - RNA, 21 nt, Human herpesvirus 4 [Epstein-Barr virus]
ucugguugauaaucucaaaga

SEQ ID NO: 1943834 - RNA, 22 nt, Human herpesvirus 4 [Epstein-Barr virus]
ugucaccaggccugccaaagag

SEQ ID NO: 1943835 - RNA, 15 nt, Human herpesvirus 4 [Epstein-Barr virus]
caugacgcugcugcu

SEQ ID NO: 1943836 - RNA, 17 nt, Human herpesvirus 4 [Epstein-Barr virus]
caggaggaggggcagga

SEQ ID NO: 1943837 - RNA, 17 nt, Human herpesvirus 4 [Epstein-Barr virus]
agcgcggcagaggccuc

SEQ ID NO: 1943838 - RNA, 22 nt, Human herpesvirus 4 [Epstein-Barr virus]
caguccaggggccacacagccu

SEQ ID NO: 1943839 - RNA, 18 nt, Human herpesvirus 4 [Epstein-Barr virus]
ccauggugagacaccugg

SEQ ID NO: 1943840 - RNA, 15 nt, Human herpesvirus 4 [Epstein-Barr virus]
accagagcccagagg

SEQ ID NO: 1943841 - RNA, 16 nt, Human herpesvirus 4 [Epstein-Barr virus]
gccacaaagagggggc

SEQ ID NO: 1943842 - RNA, 14 nt, Human herpesvirus 4 [Epstein-Barr virus]
cuccuucuuggccu

SEQ ID NO: 1943843 - RNA, 23 nt, Human herpesvirus 4 [Epstein-Barr virus]
gcuaugaagaagauugaagacaa

SEQ ID NO: 1943844 - RNA, 18 nt, Human herpesvirus 4 [Epstein-Barr virus]
aggcagacaaggccccgc

SEQ ID NO: 1943845 - RNA, 17 nt, Human herpesvirus 4 [Epstein-Barr virus]
cucuccacucccagucc

SEQ ID NO: 1943846 - RNA, 13 nt, Human herpesvirus 4 [Epstein-Barr virus]
cgcgcccuccucu

SEQ ID NO: 1943847 - RNA, 20 nt, Human herpesvirus 4 [Epstein-Barr virus]
cgucaggagacacggcucug

SEQ ID NO: 1943848 - RNA, 20 nt, Human herpesvirus 4 [Epstein-Barr virus]
ucuuacaccagaggccacaa

SEQ ID NO: 1943849 - RNA, 23 nt, Human herpesvirus 4 [Epstein-Barr virus]
cauucucaucuacaauggcuggu

SEQ ID NO: 1943850 - RNA, 22 nt, Human herpesvirus 4 [Epstein-Barr virus]
agcagaugugcccaagccugga

SEQ ID NO: 1943851 - RNA, 16 nt, Human herpesvirus 4 [Epstein-Barr virus]
gggccuuccagagcuc

SEQ ID NO: 1943852 - RNA, 13 nt, Human herpesvirus 4 [Epstein-Barr virus]
uggagaugcucug

SEQ ID NO: 1943853 - RNA, 15 nt, Human herpesvirus 4 [Epstein-Barr virus]
acaccgggcaggucc

SEQ ID NO: 1943854 - RNA, 16 nt, Human herpesvirus 4 [Epstein-Barr virus]
cucuaccuuccacgac

SEQ ID NO: 1943855 - RNA, 23 nt, Human herpesvirus 4 [Epstein-Barr virus]
cuaccucuguuccuucugcucca

SEQ ID NO: 1943856 - RNA, 22 nt, Human herpesvirus 4 [Epstein-Barr virus]
cacuccuaugcauuuccugccc

SEQ ID NO: 1943857 - RNA, 23 nt, Human herpesvirus 4 [Epstein-Barr virus]
acgaggggccagguacaggaccu

SEQ ID NO: 1943858 - RNA, 23 nt, Human herpesvirus 4 [Epstein-Barr virus]
aggagucugcugcggcuaugcag

SEQ ID NO: 1943859 - RNA, 16 nt, Human herpesvirus 4 [Epstein-Barr virus]
cucaggcggaggcacu

SEQ ID NO: 1943860 - RNA, 22 nt, Human herpesvirus 4 [Epstein-Barr virus]
cagacuuagggccggggccgag

SEQ ID NO: 1943861 - RNA, 18 nt, Human herpesvirus 4 [Epstein-Barr virus]
cuacugccuuacacugga

SEQ ID NO: 1943862 - RNA, 18 nt, Human herpesvirus 4 [Epstein-Barr virus]
cugacccuucugcugcug

SEQ ID NO: 1943863 - RNA, 14 nt, Human herpesvirus 4 [Epstein-Barr virus]
gacgaggggccagg

SEQ ID NO: 1943864 - RNA, 24 nt, Human herpesvirus 4 [Epstein-Barr virus]
uccgacgccugcggacucaggcca

SEQ ID NO: 1943865 - RNA, 17 nt, Human herpesvirus 4 [Epstein-Barr virus]
cucagcuccgcgcucaa

SEQ ID NO: 1943866 - RNA, 19 nt, Human herpesvirus 4 [Epstein-Barr virus]
cuugaagguggaggggggc

SEQ ID NO: 1943867 - RNA, 19 nt, Human herpesvirus 4 [Epstein-Barr virus]
caguccuugugucucuauc

SEQ ID NO: 1943868 - RNA, 17 nt, Human herpesvirus 4 [Epstein-Barr virus]
ccacgucaaggcccgga

SEQ ID NO: 1943869 - RNA, 16 nt, Human herpesvirus 4 [Epstein-Barr virus]
gccaccguggccaggc

SEQ ID NO: 1943870 - RNA, 19 nt, Human herpesvirus 4 [Epstein-Barr virus]
uccaguuuuuaugugccuc

SEQ ID NO: 1943871 - RNA, 15 nt, Human herpesvirus 4 [Epstein-Barr virus]
cuccacccagcagca

SEQ ID NO: 1943872 - RNA, 15 nt, Human herpesvirus 4 [Epstein-Barr virus]
ccauccccagcccag

SEQ ID NO: 1943873 - RNA, 16 nt, Human herpesvirus 4 [Epstein-Barr virus]
caggcacaucuggcac

SEQ ID NO: 1943874 - RNA, 16 nt, Human herpesvirus 4 [Epstein-Barr virus]
ggaagcuggccaggcu

SEQ ID NO: 1943875 - RNA, 15 nt, Human herpesvirus 4 [Epstein-Barr virus]
ggaacacccccaccc

SEQ ID NO: 1943876 - RNA, 12 nt, Human herpesvirus 4 [Epstein-Barr virus]
cccgucgggcca

SEQ ID NO: 1943877 - RNA, 19 nt, Human herpesvirus 4 [Epstein-Barr virus]
aguccagggcccuggucag

SEQ ID NO: 1943878 - RNA, 16 nt, Human herpesvirus 4 [Epstein-Barr virus]
gccaggauaaucaggc

SEQ ID NO: 1943879 - RNA, 17 nt, Human herpesvirus 4 [Epstein-Barr virus]
ccaaucaccagccaccu

SEQ ID NO: 1943880 - RNA, 14 nt, Human herpesvirus 4 [Epstein-Barr virus]
acaaucuugugaac

SEQ ID NO: 1943881 - RNA, 22 nt, Human herpesvirus 4 [Epstein-Barr virus]
acgcaggauguucacgugggcc

SEQ ID NO: 1943882 - RNA, 19 nt, Human herpesvirus 4 [Epstein-Barr virus]
cccgucccggguacaaguc

SEQ ID NO: 1943883 - RNA, 18 nt, Human herpesvirus 4 [Epstein-Barr virus]
gcacauauaccgcucggc

SEQ ID NO: 1943884 - RNA, 17 nt, Human herpesvirus 4 [Epstein-Barr virus]
gucccauguacagcaca

SEQ ID NO: 1943885 - RNA, 15 nt, Human herpesvirus 4 [Epstein-Barr virus]
gccgagaccuaugua

SEQ ID NO: 1943886 - RNA, 16 nt, Human herpesvirus 4 [Epstein-Barr virus]
gccuggcggguggaga

SEQ ID NO: 1943887 - RNA, 19 nt, Human herpesvirus 4 [Epstein-Barr virus]
uucuguacaauggggccag

SEQ ID NO: 1943888 - RNA, 15 nt, Human herpesvirus 4 [Epstein-Barr virus]
cagaauugucacuga

SEQ ID NO: 1943889 - RNA, 22 nt, Human herpesvirus 4 [Epstein-Barr virus]
accuuggccgguggcuguggac

SEQ ID NO: 1943890 - RNA, 22 nt, Human herpesvirus 4 [Epstein-Barr virus]
uucccggcugcucccgccucag

SEQ ID NO: 1943891 - RNA, 22 nt, Human herpesvirus 4 [Epstein-Barr virus]
uuaugagcgauuuuaucacagg

SEQ ID NO: 1943892 - RNA, 17 nt, Human herpesvirus 4 [Epstein-Barr virus]
gcugcuguccacccugg

SEQ ID NO: 1943893 - RNA, 23 nt, Human herpesvirus 4 [Epstein-Barr virus]
cagggccaagacauagagauggu

SEQ ID NO: 1943894 - RNA, 23 nt, Human herpesvirus 4 [Epstein-Barr virus]
uccuauggacacuugugguucuc

SEQ ID NO: 1943895 - RNA, 22 nt, Human herpesvirus 4 [Epstein-Barr virus]
gcccguuccaggcucuccagcc

SEQ ID NO: 1943896 - RNA, 18 nt, Human herpesvirus 4 [Epstein-Barr virus]
guucuccaggcuccugga

SEQ ID NO: 1943897 - RNA, 15 nt, Human herpesvirus 4 [Epstein-Barr virus]
gcgugaauugugccc

SEQ ID NO: 1943898 - RNA, 16 nt, Human herpesvirus 4 [Epstein-Barr virus]
ugggcgcgugcacaua

SEQ ID NO: 1943899 - RNA, 22 nt, Human herpesvirus 4 [Epstein-Barr virus]
gucaaacaggugagucagccuu

SEQ ID NO: 1943900 - RNA, 19 nt, Human herpesvirus 4 [Epstein-Barr virus]
uggcccugcaaacugacac

SEQ ID NO: 1943901 - RNA, 16 nt, Human herpesvirus 4 [Epstein-Barr virus]
uccaggagucugcugc

SEQ ID NO: 1943902 - RNA, 14 nt, Human herpesvirus 4 [Epstein-Barr virus]
acacgaaugcccag

SEQ ID NO: 1943903 - RNA, 14 nt, Human herpesvirus 4 [Epstein-Barr virus]
ugguugucuuccca

SEQ ID NO: 1943904 - RNA, 18 nt, Human herpesvirus 4 [Epstein-Barr virus]
gagccugagccacaccca

SEQ ID NO: 1943905 - RNA, 14 nt, Human herpesvirus 4 [Epstein-Barr virus]
augacgcugcugcu

SEQ ID NO: 1943906 - RNA, 22 nt, Human herpesvirus 4 [Epstein-Barr virus]
ggauccccgccggggcuagggg

SEQ ID NO: 1943907 - RNA, 16 nt, Human herpesvirus 4 [Epstein-Barr virus]
ggacgggguggugccu

SEQ ID NO: 1943908 - RNA, 14 nt, Human herpesvirus 4 [Epstein-Barr virus]
gagcagaaggccau

SEQ ID NO: 1943909 - RNA, 18 nt, Human herpesvirus 4 [Epstein-Barr virus]
cccagacucugcuuucug

SEQ ID NO: 1943910 - RNA, 17 nt, Human herpesvirus 4 [Epstein-Barr virus]
ccccaaaaguagaggcu

SEQ ID NO: 1943911 - RNA, 20 nt, Human herpesvirus 4 [Epstein-Barr virus]
ccuucugcugcugcugguca

SEQ ID NO: 1943912 - RNA, 16 nt, Human herpesvirus 4 [Epstein-Barr virus]
cggcugcugagaccuc

SEQ ID NO: 1943913 - RNA, 19 nt, Human herpesvirus 4 [Epstein-Barr virus]
uggcgccguuugacuguuu

SEQ ID NO: 1943914 - RNA, 15 nt, Human herpesvirus 4 [Epstein-Barr virus]
cgggcaagauggaga

SEQ ID NO: 1943915 - RNA, 13 nt, Human herpesvirus 4 [Epstein-Barr virus]
gggacaccugcac

SEQ ID NO: 1943916 - RNA, 20 nt, Human herpesvirus 4 [Epstein-Barr virus]
auggaagagaggggcaggga

SEQ ID NO: 1943917 - RNA, 14 nt, Human herpesvirus 4 [Epstein-Barr virus]
cuccuggccagcac

SEQ ID NO: 1943918 - RNA, 17 nt, Human herpesvirus 4 [Epstein-Barr virus]
ggagcuggugcaccugc

SEQ ID NO: 1943919 - RNA, 14 nt, Human herpesvirus 4 [Epstein-Barr virus]
gaccgugccauccu

SEQ ID NO: 1943920 - RNA, 14 nt, Human herpesvirus 4 [Epstein-Barr virus]
agaccaaggcccua

SEQ ID NO: 1943921 - RNA, 13 nt, Human herpesvirus 4 [Epstein-Barr virus]
ccaucauguguuu

SEQ ID NO: 1943922 - RNA, 23 nt, Human herpesvirus 4 [Epstein-Barr virus]
gcuucuucguauauguguugaga

SEQ ID NO: 1943923 - RNA, 18 nt, Human herpesvirus 4 [Epstein-Barr virus]
gucaaggcucugcacagg

SEQ ID NO: 1943924 - RNA, 20 nt, Human herpesvirus 4 [Epstein-Barr virus]
ggccgcccgccuggcucgcc

SEQ ID NO: 1943925 - RNA, 20 nt, Human herpesvirus 4 [Epstein-Barr virus]
gugacgaagacccaucugag

SEQ ID NO: 1943926 - RNA, 19 nt, Human herpesvirus 4 [Epstein-Barr virus]
ggacaugcugaugugcugc

SEQ ID NO: 1943927 - RNA, 18 nt, Human herpesvirus 4 [Epstein-Barr virus]
aaguaguuggagcucaag

SEQ ID NO: 1943928 - RNA, 22 nt, Human herpesvirus 4 [Epstein-Barr virus]
gccaccggggaggccagguagc

SEQ ID NO: 1943929 - RNA, 18 nt, Human herpesvirus 4 [Epstein-Barr virus]
ccucgaaggugcagcugg

SEQ ID NO: 1943930 - RNA, 22 nt, Human herpesvirus 4 [Epstein-Barr virus]
ccagggguggcaguggaugggg

SEQ ID NO: 1943931 - RNA, 19 nt, Human herpesvirus 4 [Epstein-Barr virus]
cgggcggcucaggaucagg

SEQ ID NO: 1943932 - RNA, 14 nt, Human herpesvirus 4 [Epstein-Barr virus]
cugcuucuggcucu

SEQ ID NO: 1943933 - RNA, 23 nt, Human herpesvirus 4 [Epstein-Barr virus]
cagggugcacagacuagcgagga

SEQ ID NO: 1943934 - RNA, 20 nt, Human herpesvirus 4 [Epstein-Barr virus]
gcacucucgagggugccugu

SEQ ID NO: 1943935 - RNA, 17 nt, Human herpesvirus 4 [Epstein-Barr virus]
uuugccagcaacuuaua

SEQ ID NO: 1943936 - RNA, 19 nt, Human herpesvirus 4 [Epstein-Barr virus]
cuucucccacccuguacac

SEQ ID NO: 1943937 - RNA, 20 nt, Human herpesvirus 4 [Epstein-Barr virus]
ugcagugggccucucuggcu

SEQ ID NO: 1943938 - RNA, 13 nt, Human herpesvirus 4 [Epstein-Barr virus]
cgacgcucccggg

SEQ ID NO: 1943939 - RNA, 18 nt, Human herpesvirus 4 [Epstein-Barr virus]
ggcggcgaugucggggcu

SEQ ID NO: 1943940 - RNA, 17 nt, Human herpesvirus 4 [Epstein-Barr virus]
acaaggagugccucugg

SEQ ID NO: 1943941 - RNA, 14 nt, Human herpesvirus 4 [Epstein-Barr virus]
aucagggccaggcu

SEQ ID NO: 1943942 - RNA, 17 nt, Human herpesvirus 4 [Epstein-Barr virus]
cuccagcucggccagca

SEQ ID NO: 1943943 - RNA, 16 nt, Human herpesvirus 4 [Epstein-Barr virus]
ugucuccugacgccaa

SEQ ID NO: 1943944 - RNA, 16 nt, Human herpesvirus 4 [Epstein-Barr virus]
aggggggaaucuuguu

SEQ ID NO: 1943945 - RNA, 12 nt, Human herpesvirus 4 [Epstein-Barr virus]
ccagagcugagu

SEQ ID NO: 1943946 - RNA, 17 nt, Human herpesvirus 4 [Epstein-Barr virus]
gcuccgagagcuccgcc

SEQ ID NO: 1943947 - RNA, 19 nt, Human herpesvirus 4 [Epstein-Barr virus]
gucuguaaucucuaaagau

SEQ ID NO: 1943948 - RNA, 20 nt, Human herpesvirus 4 [Epstein-Barr virus]
uccgcuuuaagaccaaggcc

SEQ ID NO: 1943949 - RNA, 23 nt, Human herpesvirus 4 [Epstein-Barr virus]
ugcuucuggaccgugccauccuc

SEQ ID NO: 1943950 - RNA, 16 nt, Human herpesvirus 4 [Epstein-Barr virus]
gagaagagaggcuucc

SEQ ID NO: 1943951 - RNA, 18 nt, Human herpesvirus 4 [Epstein-Barr virus]
ccagucuccgggucaggu

SEQ ID NO: 1943952 - RNA, 17 nt, Human herpesvirus 4 [Epstein-Barr virus]
gcucgcagcuggaggaa

SEQ ID NO: 1943953 - RNA, 23 nt, Human herpesvirus 4 [Epstein-Barr virus]
ccacaacugcuauucugagcacc

SEQ ID NO: 1943954 - RNA, 21 nt, Human herpesvirus 4 [Epstein-Barr virus]
caggcauuuuuggugcugccu

SEQ ID NO: 1943955 - RNA, 18 nt, Human herpesvirus 4 [Epstein-Barr virus]
auccaaacccccuccccu

SEQ ID NO: 1943956 - RNA, 16 nt, Human herpesvirus 4 [Epstein-Barr virus]
gggcuggccugccugg

SEQ ID NO: 1943957 - RNA, 18 nt, Human herpesvirus 4 [Epstein-Barr virus]
gugcuggagauuuuccca

SEQ ID NO: 1943958 - RNA, 16 nt, Human herpesvirus 4 [Epstein-Barr virus]
uauagcucugcacagg

SEQ ID NO: 1943959 - RNA, 13 nt, Human herpesvirus 4 [Epstein-Barr virus]
aggacgcuguccg

SEQ ID NO: 1943960 - RNA, 17 nt, Human herpesvirus 4 [Epstein-Barr virus]
caggcuuggaaacaccc

SEQ ID NO: 1943961 - RNA, 13 nt, Human herpesvirus 4 [Epstein-Barr virus]
gaccgcccaccga

SEQ ID NO: 1943962 - RNA, 14 nt, Human herpesvirus 4 [Epstein-Barr virus]
agcuccagggccag

SEQ ID NO: 1943963 - RNA, 18 nt, Human herpesvirus 4 [Epstein-Barr virus]
cugacacacaggccuggc

SEQ ID NO: 1943964 - RNA, 18 nt, Human herpesvirus 4 [Epstein-Barr virus]
ggcccggggguggcagcc

SEQ ID NO: 1943965 - RNA, 16 nt, Human herpesvirus 4 [Epstein-Barr virus]
gccaugcucagggcca

SEQ ID NO: 1943966 - RNA, 15 nt, Human herpesvirus 4 [Epstein-Barr virus]
gccaaagcugaagaa

SEQ ID NO: 1943967 - RNA, 18 nt, Human herpesvirus 4 [Epstein-Barr virus]
cgggcgccugcuccaccg

SEQ ID NO: 1943968 - RNA, 19 nt, Human herpesvirus 4 [Epstein-Barr virus]
ggcgaccuguuccgcuucu

SEQ ID NO: 1943969 - RNA, 22 nt, Human herpesvirus 4 [Epstein-Barr virus]
gugccagacucucuucagugac

SEQ ID NO: 1943970 - RNA, 19 nt, Human herpesvirus 4 [Epstein-Barr virus]
cuccugccugccucugcuc

SEQ ID NO: 1943971 - RNA, 11 nt, Human herpesvirus 4 [Epstein-Barr virus]
aguaccagcug

SEQ ID NO: 1943972 - RNA, 22 nt, Human herpesvirus 4 [Epstein-Barr virus]
gugcgguuauaacugccagagc

SEQ ID NO: 1943973 - RNA, 12 nt, Human herpesvirus 4 [Epstein-Barr virus]
gguugggcagaa

SEQ ID NO: 1943974 - RNA, 21 nt, Human herpesvirus 4 [Epstein-Barr virus]
ccggaucgaaggagagcugga

SEQ ID NO: 1943975 - RNA, 20 nt, Human herpesvirus 4 [Epstein-Barr virus]
cugacccucgcgccccaucu

SEQ ID NO: 1943976 - RNA, 15 nt, Human herpesvirus 4 [Epstein-Barr virus]
ccacuacaccccuga

SEQ ID NO: 1943977 - RNA, 22 nt, Human herpesvirus 4 [Epstein-Barr virus]
gucuucggucaaguaccagcug

SEQ ID NO: 1943978 - RNA, 14 nt, Human herpesvirus 4 [Epstein-Barr virus]
ucugccacaaggcc

SEQ ID NO: 1943979 - RNA, 19 nt, Human herpesvirus 4 [Epstein-Barr virus]
gcacagaacaucacugcca

SEQ ID NO: 1943980 - RNA, 15 nt, Human herpesvirus 4 [Epstein-Barr virus]
caugcucagggccac

SEQ ID NO: 1943981 - RNA, 15 nt, Human herpesvirus 4 [Epstein-Barr virus]
cggcgccucuugucg

SEQ ID NO: 1943982 - RNA, 23 nt, Human herpesvirus 4 [Epstein-Barr virus]
cacuccuaugcauuuccugcccu

SEQ ID NO: 1943983 - RNA, 15 nt, Human herpesvirus 4 [Epstein-Barr virus]
ucuacccuccccaug

SEQ ID NO: 1943984 - RNA, 22 nt, Human herpesvirus 4 [Epstein-Barr virus]
gcuaguggcgcugcguggcacc

SEQ ID NO: 1943985 - RNA, 17 nt, Human herpesvirus 4 [Epstein-Barr virus]
cgcagccacguccagac

SEQ ID NO: 1943986 - RNA, 18 nt, Human herpesvirus 4 [Epstein-Barr virus]
cucagaggaggaggauga

SEQ ID NO: 1943987 - RNA, 15 nt, Human herpesvirus 4 [Epstein-Barr virus]
acuugaggugggcug

SEQ ID NO: 1943988 - RNA, 21 nt, Human herpesvirus 4 [Epstein-Barr virus]
cccgggaccgcgcccuccucu

SEQ ID NO: 1943989 - RNA, 23 nt, Human herpesvirus 4 [Epstein-Barr virus]
agaacccccugcaggacacguga

SEQ ID NO: 1943990 - RNA, 22 nt, Human herpesvirus 4 [Epstein-Barr virus]
gcggcgaugucggggcugcugg

SEQ ID NO: 1943991 - RNA, 19 nt, Human herpesvirus 4 [Epstein-Barr virus]
gguagccuugggggccugg

SEQ ID NO: 1943992 - RNA, 16 nt, Human herpesvirus 4 [Epstein-Barr virus]
gccugccucugcucug

SEQ ID NO: 1943993 - RNA, 14 nt, Human herpesvirus 4 [Epstein-Barr virus]
cuugugcuuguacu

SEQ ID NO: 1943994 - RNA, 21 nt, Human herpesvirus 4 [Epstein-Barr virus]
auauggcuauacacaggagcc

SEQ ID NO: 1943995 - RNA, 15 nt, Human herpesvirus 4 [Epstein-Barr virus]
accaagggcagggca

SEQ ID NO: 1943996 - RNA, 12 nt, Human herpesvirus 4 [Epstein-Barr virus]
ggagaggggagu

SEQ ID NO: 1943997 - RNA, 20 nt, Human herpesvirus 4 [Epstein-Barr virus]
cgacuacgagggccucuggc

SEQ ID NO: 1943998 - RNA, 18 nt, Human herpesvirus 4 [Epstein-Barr virus]
uggcugccgaagcagaug

SEQ ID NO: 1943999 - RNA, 15 nt, Human herpesvirus 4 [Epstein-Barr virus]
uccaagcggcacaga

SEQ ID NO: 1944000 - RNA, 10 nt, Human herpesvirus 4 [Epstein-Barr virus]
ucagcuccag

SEQ ID NO: 1944001 - RNA, 22 nt, Human herpesvirus 4 [Epstein-Barr virus]
ugauacucaccaagauuguucc

SEQ ID NO: 1944002 - RNA, 15 nt, Human herpesvirus 4 [Epstein-Barr virus]
cuuguuucucagaga

SEQ ID NO: 1944003 - RNA, 16 nt, Human herpesvirus 4 [Epstein-Barr virus]
uuuccuucuugaccuu

SEQ ID NO: 1944004 - RNA, 19 nt, Human herpesvirus 4 [Epstein-Barr virus]
ugcaucuaagguccauccc

SEQ ID NO: 1944005 - RNA, 21 nt, Human herpesvirus 4 [Epstein-Barr virus]
aguugguccaggguccaggag

SEQ ID NO: 1944006 - RNA, 21 nt, Human herpesvirus 4 [Epstein-Barr virus]
gugucugugguugucuuccca

SEQ ID NO: 1944007 - RNA, 21 nt, Human herpesvirus 4 [Epstein-Barr virus]
ggcccucgguggugggcugcu

SEQ ID NO: 1944008 - RNA, 20 nt, Human herpesvirus 4 [Epstein-Barr virus]
ucagcucgcccacacagcgc

SEQ ID NO: 1944009 - RNA, 16 nt, Human herpesvirus 4 [Epstein-Barr virus]
ucaggcuaugaagaag

SEQ ID NO: 1944010 - RNA, 15 nt, Human herpesvirus 4 [Epstein-Barr virus]
ggcggaggcacugga

SEQ ID NO: 1944011 - RNA, 13 nt, Human herpesvirus 4 [Epstein-Barr virus]
uccagagccccuu

SEQ ID NO: 1944012 - RNA, 16 nt, Human herpesvirus 4 [Epstein-Barr virus]
acugauugucgcuggc

SEQ ID NO: 1944013 - RNA, 18 nt, Human herpesvirus 4 [Epstein-Barr virus]
uagggacagacccugggc

SEQ ID NO: 1944014 - RNA, 23 nt, Human herpesvirus 4 [Epstein-Barr virus]
cugcagugggccucucuggcugu

SEQ ID NO: 1944015 - RNA, 11 nt, Human herpesvirus 4 [Epstein-Barr virus]
ucuguggcagu

SEQ ID NO: 1944016 - RNA, 15 nt, Human herpesvirus 4 [Epstein-Barr virus]
aggccaauuggcacu

SEQ ID NO: 1944017 - RNA, 17 nt, Human herpesvirus 4 [Epstein-Barr virus]
cucgguggugggcugcu

SEQ ID NO: 1944018 - RNA, 18 nt, Human herpesvirus 4 [Epstein-Barr virus]
cauucugccgucucaaac

SEQ ID NO: 1944019 - RNA, 11 nt, Human herpesvirus 4 [Epstein-Barr virus]
cguccuggccc

SEQ ID NO: 1944020 - RNA, 18 nt, Human herpesvirus 4 [Epstein-Barr virus]
gaaucaccagagcccaga

SEQ ID NO: 1944021 - RNA, 21 nt, Human herpesvirus 4 [Epstein-Barr virus]
ugcgagaauuggcagacaccu

SEQ ID NO: 1944022 - RNA, 17 nt, Human herpesvirus 4 [Epstein-Barr virus]
accccuccuaugcgccc

SEQ ID NO: 1944023 - RNA, 13 nt, Human herpesvirus 4 [Epstein-Barr virus]
acauacaucccug

SEQ ID NO: 1944024 - RNA, 15 nt, Human herpesvirus 4 [Epstein-Barr virus]
ucucgcccaagcugc

SEQ ID NO: 1944025 - RNA, 16 nt, Human herpesvirus 4 [Epstein-Barr virus]
guccgacgccugcgga

SEQ ID NO: 1944026 - RNA, 16 nt, Human herpesvirus 4 [Epstein-Barr virus]
aguugguccagggucc

SEQ ID NO: 1944027 - RNA, 20 nt, Human herpesvirus 4 [Epstein-Barr virus]
acugccacauuggacaccca

SEQ ID NO: 1944028 - RNA, 16 nt, Human herpesvirus 4 [Epstein-Barr virus]
ggccucggccuggggu

SEQ ID NO: 1944029 - RNA, 15 nt, Human herpesvirus 4 [Epstein-Barr virus]
gaagucgguguccag

SEQ ID NO: 1944030 - RNA, 22 nt, Human herpesvirus 4 [Epstein-Barr virus]
gucacccaugccuccccagcaa

SEQ ID NO: 1944031 - RNA, 19 nt, Human herpesvirus 4 [Epstein-Barr virus]
acugcgggugucucaagcu

SEQ ID NO: 1944032 - RNA, 15 nt, Human herpesvirus 4 [Epstein-Barr virus]
agguggcugcugcca

SEQ ID NO: 1944033 - RNA, 18 nt, Human herpesvirus 4 [Epstein-Barr virus]
agaucgugaggccugaga

SEQ ID NO: 1944034 - RNA, 19 nt, Human herpesvirus 4 [Epstein-Barr virus]
ggccaaggugguagcguug

SEQ ID NO: 1944035 - RNA, 14 nt, Human herpesvirus 4 [Epstein-Barr virus]
cgccgccgccagca

SEQ ID NO: 1944036 - RNA, 15 nt, Human herpesvirus 4 [Epstein-Barr virus]
acccggacccggacc

SEQ ID NO: 1944037 - RNA, 15 nt, Human herpesvirus 4 [Epstein-Barr virus]
gccacccgucccggg

SEQ ID NO: 1944038 - RNA, 23 nt, Human herpesvirus 4 [Epstein-Barr virus]
caaagguguagaagugugucccc

SEQ ID NO: 1944039 - RNA, 18 nt, Human herpesvirus 4 [Epstein-Barr virus]
cucguagagaucaggcca

SEQ ID NO: 1944040 - RNA, 20 nt, Human herpesvirus 4 [Epstein-Barr virus]
gcgcaacgccggccugcugg

SEQ ID NO: 1944041 - RNA, 15 nt, Human herpesvirus 4 [Epstein-Barr virus]
cucuucaaccuuggc

SEQ ID NO: 1944042 - RNA, 16 nt, Human herpesvirus 4 [Epstein-Barr virus]
cccucggugggccaga

SEQ ID NO: 1944043 - RNA, 14 nt, Human herpesvirus 4 [Epstein-Barr virus]
cggucaaguaccag

SEQ ID NO: 1944044 - RNA, 13 nt, Human herpesvirus 4 [Epstein-Barr virus]
uggcugccccggc

SEQ ID NO: 1944045 - RNA, 19 nt, Human herpesvirus 4 [Epstein-Barr virus]
gcccccucuuuguggccuu

SEQ ID NO: 1944046 - RNA, 15 nt, Human herpesvirus 4 [Epstein-Barr virus]
aaccccuauauccua

SEQ ID NO: 1944047 - RNA, 21 nt, Human herpesvirus 4 [Epstein-Barr virus]
accuccacuuacaaccaagcc

SEQ ID NO: 1944048 - RNA, 15 nt, Human herpesvirus 4 [Epstein-Barr virus]
gggugacacagugcc

SEQ ID NO: 1944049 - RNA, 14 nt, Human herpesvirus 4 [Epstein-Barr virus]
gcugcaccuggaca

SEQ ID NO: 1944050 - RNA, 19 nt, Human herpesvirus 4 [Epstein-Barr virus]
agagccccuuuugcccccc

SEQ ID NO: 1944051 - RNA, 14 nt, Human herpesvirus 4 [Epstein-Barr virus]
gccuggggcucaga

SEQ ID NO: 1944052 - RNA, 22 nt, Human herpesvirus 4 [Epstein-Barr virus]
guugccgugguugggcagaacc

SEQ ID NO: 1944053 - RNA, 11 nt, Human herpesvirus 4 [Epstein-Barr virus]
ggacaugucac

SEQ ID NO: 1944054 - RNA, 15 nt, Human herpesvirus 4 [Epstein-Barr virus]
caaggacaacagcua

SEQ ID NO: 1944055 - RNA, 18 nt, Human herpesvirus 4 [Epstein-Barr virus]
ucgcgugacggcauucgu

SEQ ID NO: 1944056 - RNA, 19 nt, Human herpesvirus 4 [Epstein-Barr virus]
uccaagaaaccccacggag

SEQ ID NO: 1944057 - RNA, 22 nt, Human herpesvirus 4 [Epstein-Barr virus]
ccucgaguaggugccuccagag

SEQ ID NO: 1944058 - RNA, 17 nt, Human herpesvirus 4 [Epstein-Barr virus]
cgaggcccugcaagcca

SEQ ID NO: 1944059 - RNA, 14 nt, Human herpesvirus 4 [Epstein-Barr virus]
ggagagaagggaga

SEQ ID NO: 1944060 - RNA, 19 nt, Human herpesvirus 4 [Epstein-Barr virus]
gccaaccugccucucuuau

SEQ ID NO: 1944061 - RNA, 18 nt, Human herpesvirus 4 [Epstein-Barr virus]
uagcauggccgccagagu

SEQ ID NO: 1944062 - RNA, 15 nt, Human herpesvirus 4 [Epstein-Barr virus]
gcagguaauaaagcu

SEQ ID NO: 1944063 - RNA, 16 nt, Human herpesvirus 4 [Epstein-Barr virus]
gaggcguccgccccga

SEQ ID NO: 1944064 - RNA, 13 nt, Human herpesvirus 4 [Epstein-Barr virus]
aagcauggggcuc

SEQ ID NO: 1944065 - RNA, 19 nt, Human herpesvirus 4 [Epstein-Barr virus]
gaaaauguacccaucccgg

SEQ ID NO: 1944066 - RNA, 18 nt, Human herpesvirus 4 [Epstein-Barr virus]
cccuccauaggccucugc

SEQ ID NO: 1944067 - RNA, 20 nt, Human herpesvirus 4 [Epstein-Barr virus]
cccagguaccuuccuguguu

SEQ ID NO: 1944068 - RNA, 16 nt, Human herpesvirus 4 [Epstein-Barr virus]
cugucccuggagcugg

SEQ ID NO: 1944069 - RNA, 17 nt, Human herpesvirus 4 [Epstein-Barr virus]
cugugcuucagcaguag

SEQ ID NO: 1944070 - RNA, 22 nt, Human herpesvirus 4 [Epstein-Barr virus]
agcccccucccgccccugucca

SEQ ID NO: 1944071 - RNA, 18 nt, Human herpesvirus 4 [Epstein-Barr virus]
gagcgggaggggcaggag

SEQ ID NO: 1944072 - RNA, 20 nt, Human herpesvirus 4 [Epstein-Barr virus]
auguuuggguuauugacauc

SEQ ID NO: 1944073 - RNA, 20 nt, Human herpesvirus 4 [Epstein-Barr virus]
cgggucaggucgcggaccag

SEQ ID NO: 1944074 - RNA, 19 nt, Human herpesvirus 4 [Epstein-Barr virus]
gcacgguggcuugggcugu

SEQ ID NO: 1944075 - RNA, 17 nt, Human herpesvirus 4 [Epstein-Barr virus]
acuucauucucaaacag

SEQ ID NO: 1944076 - RNA, 22 nt, Human herpesvirus 4 [Epstein-Barr virus]
ugccggcccuuacaacagguuu

SEQ ID NO: 1944077 - RNA, 14 nt, Human herpesvirus 4 [Epstein-Barr virus]
uggcuacuugcuca

SEQ ID NO: 1944078 - RNA, 20 nt, Human herpesvirus 4 [Epstein-Barr virus]
cccgggugggcugguugggg

SEQ ID NO: 1944079 - RNA, 19 nt, Human herpesvirus 4 [Epstein-Barr virus]
gacgcacacggaaaccaca

SEQ ID NO: 1944080 - RNA, 15 nt, Human herpesvirus 4 [Epstein-Barr virus]
gauggugcuggucuc

SEQ ID NO: 1944081 - RNA, 12 nt, Human herpesvirus 4 [Epstein-Barr virus]
cacccgucccgg

SEQ ID NO: 1944082 - RNA, 15 nt, Human herpesvirus 4 [Epstein-Barr virus]
gccagguagcccagc

SEQ ID NO: 1944083 - RNA, 18 nt, Human herpesvirus 4 [Epstein-Barr virus]
ucagggaaaaacuggcca

SEQ ID NO: 1944084 - RNA, 17 nt, Human herpesvirus 4 [Epstein-Barr virus]
ugccucugggugcugag

SEQ ID NO: 1944085 - RNA, 17 nt, Human herpesvirus 4 [Epstein-Barr virus]
guugggguccucaagga

SEQ ID NO: 1944086 - RNA, 13 nt, Human herpesvirus 4 [Epstein-Barr virus]
aaggagggcuggu

SEQ ID NO: 1944087 - RNA, 20 nt, Human herpesvirus 4 [Epstein-Barr virus]
gcucccgggcaaacagggca

SEQ ID NO: 1944088 - RNA, 17 nt, Human herpesvirus 4 [Epstein-Barr virus]
ugcaacaaucuggacuc

SEQ ID NO: 1944089 - RNA, 23 nt, Human herpesvirus 4 [Epstein-Barr virus]
cuggaggcaauggucgccagggu

SEQ ID NO: 1944090 - RNA, 14 nt, Human herpesvirus 4 [Epstein-Barr virus]
agcaguagcuuggg

SEQ ID NO: 1944091 - RNA, 15 nt, Human herpesvirus 4 [Epstein-Barr virus]
caggcggaggcacug

SEQ ID NO: 1944092 - RNA, 15 nt, Human herpesvirus 4 [Epstein-Barr virus]
ccgcaccagggccag

SEQ ID NO: 1944093 - RNA, 14 nt, Human herpesvirus 4 [Epstein-Barr virus]
caaccuggagacaa

SEQ ID NO: 1944094 - RNA, 15 nt, Human herpesvirus 4 [Epstein-Barr virus]
gcucuucugggaaca

SEQ ID NO: 1944095 - RNA, 14 nt, Human herpesvirus 4 [Epstein-Barr virus]
uucccagacucugc

SEQ ID NO: 1944096 - RNA, 18 nt, Human herpesvirus 4 [Epstein-Barr virus]
cacgccugcuucacgccu

SEQ ID NO: 1944097 - RNA, 14 nt, Human herpesvirus 4 [Epstein-Barr virus]
caggucaggucccc

SEQ ID NO: 1944098 - RNA, 18 nt, Human herpesvirus 4 [Epstein-Barr virus]
gccaagguccugggccuc

SEQ ID NO: 1944099 - RNA, 17 nt, Human herpesvirus 4 [Epstein-Barr virus]
augggaccucuuuccca

SEQ ID NO: 1944100 - RNA, 14 nt, Human herpesvirus 4 [Epstein-Barr virus]
uuaacaccugcagc

SEQ ID NO: 1944101 - RNA, 18 nt, Human herpesvirus 4 [Epstein-Barr virus]
cugcguccaccuggccac

SEQ ID NO: 1944102 - RNA, 21 nt, Human herpesvirus 4 [Epstein-Barr virus]
gugugacaugcuauggugccg

SEQ ID NO: 1944103 - RNA, 20 nt, Human herpesvirus 4 [Epstein-Barr virus]
cggacccugguacaggacca

SEQ ID NO: 1944104 - RNA, 12 nt, Human herpesvirus 4 [Epstein-Barr virus]
ggucauggcgga

SEQ ID NO: 1944105 - RNA, 22 nt, Human herpesvirus 4 [Epstein-Barr virus]
uaccuugggcaucaugcagggu

SEQ ID NO: 1944106 - RNA, 22 nt, Human herpesvirus 4 [Epstein-Barr virus]
uagcccaggcacaucuggcacc

SEQ ID NO: 1944107 - RNA, 13 nt, Human herpesvirus 4 [Epstein-Barr virus]
gauccccagugga

SEQ ID NO: 1944108 - RNA, 17 nt, Human herpesvirus 4 [Epstein-Barr virus]
ggccauaguggcggcag

SEQ ID NO: 1944109 - RNA, 19 nt, Human herpesvirus 4 [Epstein-Barr virus]
cacgcuccgcgcucggccu

SEQ ID NO: 1944110 - RNA, 15 nt, Human herpesvirus 4 [Epstein-Barr virus]
auucagauuucuagu

SEQ ID NO: 1944111 - RNA, 16 nt, Human herpesvirus 4 [Epstein-Barr virus]
cucaggaagcuggcca

SEQ ID NO: 1944112 - RNA, 19 nt, Human herpesvirus 4 [Epstein-Barr virus]
uaccucuguuccuucugcu

SEQ ID NO: 1944113 - RNA, 14 nt, Human herpesvirus 4 [Epstein-Barr virus]
uagaugcugccgcu

SEQ ID NO: 1944114 - RNA, 16 nt, Human herpesvirus 4 [Epstein-Barr virus]
ucauaaccccuaccuc

SEQ ID NO: 1944115 - RNA, 21 nt, Human herpesvirus 4 [Epstein-Barr virus]
cagccuugcguggugcugucc

SEQ ID NO: 1944116 - RNA, 12 nt, Human herpesvirus 4 [Epstein-Barr virus]
gaacgcccagua

SEQ ID NO: 1944117 - RNA, 16 nt, Human herpesvirus 4 [Epstein-Barr virus]
gggacuggcggcacug

SEQ ID NO: 1944118 - RNA, 14 nt, Human herpesvirus 4 [Epstein-Barr virus]
gccggccaggcaga

SEQ ID NO: 1944119 - RNA, 15 nt, Human herpesvirus 4 [Epstein-Barr virus]
aguaaggccgcugcc

SEQ ID NO: 1944120 - RNA, 19 nt, Human herpesvirus 4 [Epstein-Barr virus]
gcgcagugccaagagcugc

SEQ ID NO: 1944121 - RNA, 12 nt, Human herpesvirus 4 [Epstein-Barr virus]
ccaggcucucca

SEQ ID NO: 1944122 - RNA, 13 nt, Human herpesvirus 4 [Epstein-Barr virus]
agcagggcccagu

SEQ ID NO: 1944123 - RNA, 20 nt, Human herpesvirus 4 [Epstein-Barr virus]
cugagcagggcaaagccaca

SEQ ID NO: 1944124 - RNA, 18 nt, Human herpesvirus 4 [Epstein-Barr virus]
auuggacacccacccugc

SEQ ID NO: 1944125 - RNA, 17 nt, Human herpesvirus 4 [Epstein-Barr virus]
agccugacucucaugua

SEQ ID NO: 1944126 - RNA, 15 nt, Human herpesvirus 4 [Epstein-Barr virus]
uugauuuggaggaag

SEQ ID NO: 1944127 - RNA, 22 nt, Human herpesvirus 4 [Epstein-Barr virus]
ggcucaggcggaggcacuggag

SEQ ID NO: 1944128 - RNA, 19 nt, Human herpesvirus 4 [Epstein-Barr virus]
cguaggucuauggggaccc

SEQ ID NO: 1944129 - RNA, 19 nt, Human herpesvirus 4 [Epstein-Barr virus]
gucaauaauuucagugaaa

SEQ ID NO: 1944130 - RNA, 22 nt, Human herpesvirus 4 [Epstein-Barr virus]
cgcagcugugugcgcgccgcca

SEQ ID NO: 1944131 - RNA, 19 nt, Human herpesvirus 4 [Epstein-Barr virus]
gagcugcaccggagccugc

SEQ ID NO: 1944132 - RNA, 17 nt, Human herpesvirus 4 [Epstein-Barr virus]
uuccgugccucgggccu

SEQ ID NO: 1944133 - RNA, 22 nt, Human herpesvirus 4 [Epstein-Barr virus]
cagcucuaacuuggcaucucuu

SEQ ID NO: 1944134 - RNA, 18 nt, Human herpesvirus 4 [Epstein-Barr virus]
gcccacacagcgccagca

SEQ ID NO: 1944135 - RNA, 22 nt, Human herpesvirus 4 [Epstein-Barr virus]
ggcugcugccgucccagggccg

SEQ ID NO: 1944136 - RNA, 21 nt, Human herpesvirus 4 [Epstein-Barr virus]
acaugucacguguccugcagg

SEQ ID NO: 1944137 - RNA, 22 nt, Human herpesvirus 4 [Epstein-Barr virus]
ggcacguuuaccagugugccag

SEQ ID NO: 1944138 - RNA, 17 nt, Human herpesvirus 4 [Epstein-Barr virus]
uccccucguucccccga

SEQ ID NO: 1944139 - RNA, 22 nt, Human herpesvirus 4 [Epstein-Barr virus]
cagggaaaaacuggccaugcag

SEQ ID NO: 1944140 - RNA, 17 nt, Human herpesvirus 4 [Epstein-Barr virus]
caucuacgcggagcugc

SEQ ID NO: 1944141 - RNA, 23 nt, Human herpesvirus 4 [Epstein-Barr virus]
ucaacaagcuaccgaugauucug

SEQ ID NO: 1944142 - RNA, 14 nt, Human herpesvirus 4 [Epstein-Barr virus]
aagcaacugcugca

SEQ ID NO: 1944143 - RNA, 18 nt, Human herpesvirus 4 [Epstein-Barr virus]
caacauuaaagccuccuc

SEQ ID NO: 1944144 - RNA, 14 nt, Human herpesvirus 4 [Epstein-Barr virus]
gggaggggcaggag

SEQ ID NO: 1944145 - RNA, 13 nt, Human herpesvirus 4 [Epstein-Barr virus]
gcugccaggccgc

SEQ ID NO: 1944146 - RNA, 16 nt, Human herpesvirus 4 [Epstein-Barr virus]
ccccuggagccagcgc

SEQ ID NO: 1944147 - RNA, 16 nt, Human herpesvirus 4 [Epstein-Barr virus]
caucauuagcccagcc

SEQ ID NO: 1944148 - RNA, 13 nt, Human herpesvirus 4 [Epstein-Barr virus]
acgugcccagcuc

SEQ ID NO: 1944149 - RNA, 18 nt, Human herpesvirus 4 [Epstein-Barr virus]
uggggccagaggcgacgc

SEQ ID NO: 1944150 - RNA, 19 nt, Human herpesvirus 4 [Epstein-Barr virus]
cugcguccucuaccugguc

SEQ ID NO: 1944151 - RNA, 11 nt, Human herpesvirus 4 [Epstein-Barr virus]
acaccauccca

SEQ ID NO: 1944152 - RNA, 16 nt, Human herpesvirus 4 [Epstein-Barr virus]
caguggacacccacca

SEQ ID NO: 1944153 - RNA, 20 nt, Human herpesvirus 4 [Epstein-Barr virus]
uguaucccaaauaaauguua

SEQ ID NO: 1944154 - RNA, 14 nt, Human herpesvirus 4 [Epstein-Barr virus]
gcguggugcugucc

SEQ ID NO: 1944155 - RNA, 17 nt, Human herpesvirus 4 [Epstein-Barr virus]
gcaauugggcauaccca

SEQ ID NO: 1944156 - RNA, 20 nt, Human herpesvirus 4 [Epstein-Barr virus]
cacgacuacgagggccucug

SEQ ID NO: 1944157 - RNA, 17 nt, Human herpesvirus 4 [Epstein-Barr virus]
cucuucauguccacuga

SEQ ID NO: 1944158 - RNA, 13 nt, Human herpesvirus 4 [Epstein-Barr virus]
gcauccucaaggg

SEQ ID NO: 1944159 - RNA, 13 nt, Human herpesvirus 4 [Epstein-Barr virus]
guagccuuggggg

SEQ ID NO: 1944160 - RNA, 18 nt, Human herpesvirus 4 [Epstein-Barr virus]
gcgccagcagggcacaga

SEQ ID NO: 1944161 - RNA, 20 nt, Human herpesvirus 4 [Epstein-Barr virus]
gacacccacggaagcccucu

SEQ ID NO: 1944162 - RNA, 13 nt, Human herpesvirus 4 [Epstein-Barr virus]
auuccccugccug

SEQ ID NO: 1944163 - RNA, 16 nt, Human herpesvirus 4 [Epstein-Barr virus]
agaagauugaagacaa

SEQ ID NO: 1944164 - RNA, 20 nt, Human herpesvirus 4 [Epstein-Barr virus]
ugaagaucgugaggccugag

SEQ ID NO: 1944165 - RNA, 15 nt, Human herpesvirus 4 [Epstein-Barr virus]
gggcugguggccugg

SEQ ID NO: 1944166 - RNA, 18 nt, Human herpesvirus 4 [Epstein-Barr virus]
gcaggaccuagaaugugg

SEQ ID NO: 1944167 - RNA, 23 nt, Human herpesvirus 4 [Epstein-Barr virus]
cuaggcgggcgggcuugugcuug

SEQ ID NO: 1944168 - RNA, 15 nt, Human herpesvirus 4 [Epstein-Barr virus]
cucccuuagccacac

SEQ ID NO: 1944169 - RNA, 21 nt, Human herpesvirus 4 [Epstein-Barr virus]
aaaaagcgggccugaguccaa

SEQ ID NO: 1944170 - RNA, 19 nt, Human herpesvirus 4 [Epstein-Barr virus]
cccucguggcauccuucag

SEQ ID NO: 1944171 - RNA, 22 nt, Human herpesvirus 4 [Epstein-Barr virus]
uguuuguggcggcaucauguuu

SEQ ID NO: 1944172 - RNA, 20 nt, Human herpesvirus 4 [Epstein-Barr virus]
ccaacaggugcccgagcccc

SEQ ID NO: 1944173 - RNA, 20 nt, Human herpesvirus 4 [Epstein-Barr virus]
agggcccagggucacuggcu

SEQ ID NO: 1944174 - RNA, 20 nt, Human herpesvirus 4 [Epstein-Barr virus]
agcagcguccuggccccauu

SEQ ID NO: 1944175 - RNA, 23 nt, Human herpesvirus 4 [Epstein-Barr virus]
auagcaggucuccagagggcaga

SEQ ID NO: 1944176 - RNA, 14 nt, Human herpesvirus 4 [Epstein-Barr virus]
gccuaggagagaag

SEQ ID NO: 1944177 - RNA, 18 nt, Human herpesvirus 4 [Epstein-Barr virus]
aaggauggcacgggcaga

SEQ ID NO: 1944178 - RNA, 13 nt, Human herpesvirus 4 [Epstein-Barr virus]
gaagggcagggcu

SEQ ID NO: 1944179 - RNA, 13 nt, Human herpesvirus 4 [Epstein-Barr virus]
acuuccucugcuu

SEQ ID NO: 1944180 - RNA, 22 nt, Human herpesvirus 4 [Epstein-Barr virus]
accuacgccauuaagaacaagu

SEQ ID NO: 1944181 - RNA, 18 nt, Human herpesvirus 4 [Epstein-Barr virus]
ccugagccugagccacac

SEQ ID NO: 1944182 - RNA, 18 nt, Human herpesvirus 4 [Epstein-Barr virus]
cauuuuuagccccagccc

SEQ ID NO: 1944183 - RNA, 16 nt, Human herpesvirus 4 [Epstein-Barr virus]
cgcuaguugguccagg

SEQ ID NO: 1944184 - RNA, 20 nt, Human herpesvirus 4 [Epstein-Barr virus]
gaacacggcaccgucagcca

SEQ ID NO: 1944185 - RNA, 15 nt, Human herpesvirus 4 [Epstein-Barr virus]
cuugcucgcagcugg

SEQ ID NO: 1944186 - RNA, 18 nt, Human herpesvirus 4 [Epstein-Barr virus]
ggaggcaauggucgccag

SEQ ID NO: 1944187 - RNA, 16 nt, Human herpesvirus 4 [Epstein-Barr virus]
gccaugcuucuuacac

SEQ ID NO: 1944188 - RNA, 21 nt, Human herpesvirus 4 [Epstein-Barr virus]
cucauggaggggcggcagcgg

SEQ ID NO: 1944189 - RNA, 16 nt, Human herpesvirus 4 [Epstein-Barr virus]
ggcaguagaggacacc

SEQ ID NO: 1944190 - RNA, 18 nt, Human herpesvirus 4 [Epstein-Barr virus]
ucagcuccagggccagca

SEQ ID NO: 1944191 - RNA, 18 nt, Human herpesvirus 4 [Epstein-Barr virus]
acagacuuggccuugggg

SEQ ID NO: 1944192 - RNA, 16 nt, Human herpesvirus 4 [Epstein-Barr virus]
gcaauugggcauaccc

SEQ ID NO: 1944193 - RNA, 11 nt, Human herpesvirus 4 [Epstein-Barr virus]
acgggccucua

SEQ ID NO: 1944194 - RNA, 12 nt, Human herpesvirus 4 [Epstein-Barr virus]
cgccuagagcau

SEQ ID NO: 1944195 - RNA, 18 nt, Human herpesvirus 4 [Epstein-Barr virus]
cuggagcuggugcaccug

SEQ ID NO: 1944196 - RNA, 23 nt, Human herpesvirus 4 [Epstein-Barr virus]
ccgcugcacaaaggaaacugcug

SEQ ID NO: 1944197 - RNA, 20 nt, Human herpesvirus 4 [Epstein-Barr virus]
uuggggguggugggcuccuu

SEQ ID NO: 1944198 - RNA, 20 nt, Human herpesvirus 4 [Epstein-Barr virus]
cgucauggcauccgccgcga

SEQ ID NO: 1944199 - RNA, 18 nt, Human herpesvirus 4 [Epstein-Barr virus]
caccgagcagaaggccau

SEQ ID NO: 1944200 - RNA, 16 nt, Human herpesvirus 4 [Epstein-Barr virus]
aauaaauaucuuccug

SEQ ID NO: 1944201 - RNA, 14 nt, Human herpesvirus 4 [Epstein-Barr virus]
aacugacagagccg

SEQ ID NO: 1944202 - RNA, 22 nt, Human herpesvirus 4 [Epstein-Barr virus]
cucuucgggcaagauggagagg

SEQ ID NO: 1944203 - RNA, 19 nt, Human herpesvirus 4 [Epstein-Barr virus]
ccgcagccgcugaagccag

SEQ ID NO: 1944204 - RNA, 21 nt, Human herpesvirus 4 [Epstein-Barr virus]
guucaaaccggaggaugcccc

SEQ ID NO: 1944205 - RNA, 20 nt, Human herpesvirus 4 [Epstein-Barr virus]
acugcuagcgucacugauuu

SEQ ID NO: 1944206 - RNA, 12 nt, Human herpesvirus 4 [Epstein-Barr virus]
uugggggggugg

SEQ ID NO: 1944207 - RNA, 15 nt, Human herpesvirus 4 [Epstein-Barr virus]
cuggggcugguggcc

SEQ ID NO: 1944208 - RNA, 18 nt, Human herpesvirus 4 [Epstein-Barr virus]
ggccaggcgacgcucccg

SEQ ID NO: 1944209 - RNA, 18 nt, Human herpesvirus 4 [Epstein-Barr virus]
cccagcgcuggcuccagg

SEQ ID NO: 1944210 - RNA, 13 nt, Human herpesvirus 4 [Epstein-Barr virus]
gggggaggagaga

SEQ ID NO: 1944211 - RNA, 13 nt, Human herpesvirus 4 [Epstein-Barr virus]
cuuacagccagag

SEQ ID NO: 1944212 - RNA, 22 nt, Human herpesvirus 4 [Epstein-Barr virus]
uucugcuccagugccuccgccu

SEQ ID NO: 1944213 - RNA, 22 nt, Human herpesvirus 4 [Epstein-Barr virus]
agagggugagcccaccugucug

SEQ ID NO: 1944214 - RNA, 21 nt, Human herpesvirus 4 [Epstein-Barr virus]
acugguuguaaccuaugccug

SEQ ID NO: 1944215 - RNA, 22 nt, Human herpesvirus 4 [Epstein-Barr virus]
gcugcucggggcaugcugcccg

SEQ ID NO: 1944216 - RNA, 15 nt, Human herpesvirus 4 [Epstein-Barr virus]
ggagcaggagcggga

SEQ ID NO: 1944217 - RNA, 15 nt, Human herpesvirus 4 [Epstein-Barr virus]
gcucaaccgccaggg

SEQ ID NO: 1944218 - RNA, 18 nt, Human herpesvirus 4 [Epstein-Barr virus]
ggccccgggagccacggc

SEQ ID NO: 1944219 - RNA, 15 nt, Human herpesvirus 4 [Epstein-Barr virus]
cgcugggacugccug

SEQ ID NO: 1944220 - RNA, 21 nt, Human herpesvirus 4 [Epstein-Barr virus]
aggggcaggagcaggaggagg

SEQ ID NO: 1944221 - RNA, 19 nt, Human herpesvirus 4 [Epstein-Barr virus]
cagggccaagacauagaga

SEQ ID NO: 1944222 - RNA, 13 nt, Human herpesvirus 4 [Epstein-Barr virus]
gccggggccgaga

SEQ ID NO: 1944223 - RNA, 14 nt, Human herpesvirus 4 [Epstein-Barr virus]
gugcaccugcuaga

SEQ ID NO: 1944224 - RNA, 13 nt, Human herpesvirus 4 [Epstein-Barr virus]
guacgugccucag

SEQ ID NO: 1944225 - RNA, 19 nt, Human herpesvirus 4 [Epstein-Barr virus]
cccagcccgccagccaccc

SEQ ID NO: 1944226 - RNA, 22 nt, Human herpesvirus 4 [Epstein-Barr virus]
gagccagaucuaaggccgggag

SEQ ID NO: 1944227 - RNA, 20 nt, Human herpesvirus 4 [Epstein-Barr virus]
gacgcagaaugugcagggau

SEQ ID NO: 1944228 - RNA, 13 nt, Human herpesvirus 4 [Epstein-Barr virus]
guguccugggcaa

SEQ ID NO: 1944229 - RNA, 17 nt, Human herpesvirus 4 [Epstein-Barr virus]
caaacugacacacaggc

SEQ ID NO: 1944230 - RNA, 17 nt, Human herpesvirus 4 [Epstein-Barr virus]
uggcagcaguggccagc

SEQ ID NO: 1944231 - RNA, 13 nt, Human herpesvirus 4 [Epstein-Barr virus]
augucagcuccac

SEQ ID NO: 1944232 - RNA, 15 nt, Human herpesvirus 4 [Epstein-Barr virus]
gaggacggugucugu

SEQ ID NO: 1944233 - RNA, 16 nt, Human herpesvirus 4 [Epstein-Barr virus]
ggaguccaugaccagg

SEQ ID NO: 1944234 - RNA, 15 nt, Human herpesvirus 4 [Epstein-Barr virus]
agcgagacaguacuc

SEQ ID NO: 1944235 - RNA, 15 nt, Human herpesvirus 4 [Epstein-Barr virus]
ccucguuuacuaaug

SEQ ID NO: 1944236 - RNA, 20 nt, Human herpesvirus 4 [Epstein-Barr virus]
cugaggcggcuguggccucu

SEQ ID NO: 1944237 - RNA, 15 nt, Human herpesvirus 4 [Epstein-Barr virus]
gucuuugccaaccug

SEQ ID NO: 1944238 - RNA, 13 nt, Human herpesvirus 4 [Epstein-Barr virus]
ucaaggauggcac

SEQ ID NO: 1944239 - RNA, 16 nt, Human herpesvirus 4 [Epstein-Barr virus]
cuagcgaggauaaucu

SEQ ID NO: 1944240 - RNA, 14 nt, Human herpesvirus 4 [Epstein-Barr virus]
cugcacaacacaac

SEQ ID NO: 1944241 - RNA, 12 nt, Human herpesvirus 4 [Epstein-Barr virus]
ucggugggccag

SEQ ID NO: 1944242 - RNA, 21 nt, Human herpesvirus 4 [Epstein-Barr virus]
gcugcccggacggccuagcca

SEQ ID NO: 1944243 - RNA, 17 nt, Human herpesvirus 4 [Epstein-Barr virus]
caguaaacacugccaua

SEQ ID NO: 1944244 - RNA, 22 nt, Human herpesvirus 4 [Epstein-Barr virus]
cacugaauuuauacccagugag

SEQ ID NO: 1944245 - RNA, 22 nt, Human herpesvirus 4 [Epstein-Barr virus]
aucaucagcgccguccacggcc

SEQ ID NO: 1944246 - RNA, 21 nt, Human herpesvirus 4 [Epstein-Barr virus]
gaaaccugcgaaacuuggggg

SEQ ID NO: 1944247 - RNA, 14 nt, Human herpesvirus 4 [Epstein-Barr virus]
agugccucugggug

SEQ ID NO: 1944248 - RNA, 20 nt, Human herpesvirus 4 [Epstein-Barr virus]
caccuugaggugccacagag

SEQ ID NO: 1944249 - RNA, 15 nt, Human herpesvirus 4 [Epstein-Barr virus]
gauugucacagcugc

SEQ ID NO: 1944250 - RNA, 15 nt, Human herpesvirus 4 [Epstein-Barr virus]
ugugaucauggaaac

SEQ ID NO: 1944251 - RNA, 21 nt, Human herpesvirus 4 [Epstein-Barr virus]
ggaggcccccggcuggccgcc

SEQ ID NO: 1944252 - RNA, 14 nt, Human herpesvirus 4 [Epstein-Barr virus]
ccggguggugagga

SEQ ID NO: 1944253 - RNA, 19 nt, Human herpesvirus 4 [Epstein-Barr virus]
cgauuggaaaagggcccag

SEQ ID NO: 1944254 - RNA, 22 nt, Human herpesvirus 4 [Epstein-Barr virus]
uucuaugggaauaacaagggaa

SEQ ID NO: 1944255 - RNA, 14 nt, Human herpesvirus 4 [Epstein-Barr virus]
gcgccgccagcaug

SEQ ID NO: 1944256 - RNA, 16 nt, Human herpesvirus 4 [Epstein-Barr virus]
cgggucccccuagccc

SEQ ID NO: 1944257 - RNA, 10 nt, Human herpesvirus 4 [Epstein-Barr virus]
cuacaggaca

SEQ ID NO: 1944258 - RNA, 15 nt, Human herpesvirus 4 [Epstein-Barr virus]
uggaacccuagccac

SEQ ID NO: 1944259 - RNA, 17 nt, Human herpesvirus 4 [Epstein-Barr virus]
auggccgccacccuccc

SEQ ID NO: 1944260 - RNA, 12 nt, Human herpesvirus 4 [Epstein-Barr virus]
cagaagccccca

SEQ ID NO: 1944261 - RNA, 16 nt, Human herpesvirus 4 [Epstein-Barr virus]
gcugcucgccccuggu

SEQ ID NO: 1944262 - RNA, 16 nt, Human herpesvirus 4 [Epstein-Barr virus]
cuugcccucuccagca

SEQ ID NO: 1944263 - RNA, 19 nt, Human herpesvirus 4 [Epstein-Barr virus]
ccggugucggcaccuagcc

SEQ ID NO: 1944264 - RNA, 22 nt, Human herpesvirus 4 [Epstein-Barr virus]
aggccgccaugcucagggccac

SEQ ID NO: 1944265 - RNA, 18 nt, Human herpesvirus 4 [Epstein-Barr virus]
uaccgaugauucuggcca

SEQ ID NO: 1944266 - RNA, 17 nt, Human herpesvirus 4 [Epstein-Barr virus]
aacuugucuacauccca

SEQ ID NO: 1944267 - RNA, 13 nt, Human herpesvirus 4 [Epstein-Barr virus]
agcgggugcagua

SEQ ID NO: 1944268 - RNA, 14 nt, Human herpesvirus 4 [Epstein-Barr virus]
acgcagaggccugc

SEQ ID NO: 1944269 - RNA, 22 nt, Human herpesvirus 4 [Epstein-Barr virus]
gaaaauaguuccaggugacagc

SEQ ID NO: 1944270 - RNA, 13 nt, Human herpesvirus 4 [Epstein-Barr virus]
cuggccagcaccc

SEQ ID NO: 1944271 - RNA, 14 nt, Human herpesvirus 4 [Epstein-Barr virus]
ugccccucagccug

SEQ ID NO: 1944272 - RNA, 19 nt, Human herpesvirus 4 [Epstein-Barr virus]
ccguguuucucccacuguc

SEQ ID NO: 1944273 - RNA, 18 nt, Human herpesvirus 4 [Epstein-Barr virus]
agccacggcgucaaacag

SEQ ID NO: 1944274 - RNA, 17 nt, Human herpesvirus 4 [Epstein-Barr virus]
cugccacaaggccagcu

SEQ ID NO: 1944275 - RNA, 21 nt, Human herpesvirus 4 [Epstein-Barr virus]
ugcaauuugccuaacauggag

SEQ ID NO: 1944276 - RNA, 14 nt, Human herpesvirus 4 [Epstein-Barr virus]
cucaucucaaggga

SEQ ID NO: 1944277 - RNA, 23 nt, Human herpesvirus 4 [Epstein-Barr virus]
cccaugaccaacaugagggcacc

SEQ ID NO: 1944278 - RNA, 19 nt, Human herpesvirus 4 [Epstein-Barr virus]
cugaaaaugacaggcugcg

SEQ ID NO: 1944279 - RNA, 19 nt, Human herpesvirus 4 [Epstein-Barr virus]
aggacacccaccaccaggc

SEQ ID NO: 1944280 - RNA, 20 nt, Human herpesvirus 4 [Epstein-Barr virus]
aagcccaagaagaagcccac

SEQ ID NO: 1944281 - RNA, 16 nt, Human herpesvirus 4 [Epstein-Barr virus]
ugccuguggccccggc

SEQ ID NO: 1944282 - RNA, 17 nt, Human herpesvirus 4 [Epstein-Barr virus]
uuucccccacccuggaa

SEQ ID NO: 1944283 - RNA, 14 nt, Human herpesvirus 4 [Epstein-Barr virus]
acaauguuccuucu

SEQ ID NO: 1944284 - RNA, 17 nt, Human herpesvirus 4 [Epstein-Barr virus]
ucgcccccucugccucc

SEQ ID NO: 1944285 - RNA, 15 nt, Human herpesvirus 4 [Epstein-Barr virus]
aucuauuagcagccu

SEQ ID NO: 1944286 - RNA, 20 nt, Human herpesvirus 4 [Epstein-Barr virus]
ggucccuagaaauggugcca

SEQ ID NO: 1944287 - RNA, 19 nt, Human herpesvirus 4 [Epstein-Barr virus]
cacggcgugccagaggccc

SEQ ID NO: 1944288 - RNA, 11 nt, Human herpesvirus 4 [Epstein-Barr virus]
ucucagggaca

SEQ ID NO: 1944289 - RNA, 15 nt, Human herpesvirus 4 [Epstein-Barr virus]
uuuaaggaaugaaca

SEQ ID NO: 1944290 - RNA, 20 nt, Human herpesvirus 4 [Epstein-Barr virus]
aggcaauggccaccgcagag

SEQ ID NO: 1944291 - RNA, 12 nt, Human herpesvirus 4 [Epstein-Barr virus]
cucgcucagagc

SEQ ID NO: 1944292 - RNA, 19 nt, Human herpesvirus 4 [Epstein-Barr virus]
acgggaacaucaaccagug

SEQ ID NO: 1944293 - RNA, 15 nt, Human herpesvirus 4 [Epstein-Barr virus]
aggagugcugcaggu

SEQ ID NO: 1944294 - RNA, 16 nt, Human herpesvirus 4 [Epstein-Barr virus]
gccagagccucugcca

SEQ ID NO: 1944295 - RNA, 20 nt, Human herpesvirus 4 [Epstein-Barr virus]
gcagauuuccgucagccagg

SEQ ID NO: 1944296 - RNA, 16 nt, Human herpesvirus 4 [Epstein-Barr virus]
ugccucccugccccuc

SEQ ID NO: 1944297 - RNA, 13 nt, Human herpesvirus 4 [Epstein-Barr virus]
acaugcugaugug

SEQ ID NO: 1944298 - RNA, 14 nt, Human herpesvirus 4 [Epstein-Barr virus]
cauggccgagaagc

SEQ ID NO: 1944299 - RNA, 18 nt, Human herpesvirus 4 [Epstein-Barr virus]
accaggccugccaaagag

SEQ ID NO: 1944300 - RNA, 23 nt, Human herpesvirus 4 [Epstein-Barr virus]
guugucacgucacucagcuccgc

SEQ ID NO: 1944301 - RNA, 16 nt, Human herpesvirus 4 [Epstein-Barr virus]
acgcuuccacccccug

SEQ ID NO: 1944302 - RNA, 15 nt, Human herpesvirus 4 [Epstein-Barr virus]
auagccggccaggca

SEQ ID NO: 1944303 - RNA, 17 nt, Human herpesvirus 4 [Epstein-Barr virus]
ccaggccucagcgucag

SEQ ID NO: 1944304 - RNA, 20 nt, Human herpesvirus 4 [Epstein-Barr virus]
aacacauauacgaagaagcg

SEQ ID NO: 1944305 - RNA, 14 nt, Human herpesvirus 4 [Epstein-Barr virus]
gcucugucaguuau

SEQ ID NO: 1944306 - RNA, 13 nt, Human herpesvirus 4 [Epstein-Barr virus]
aaggcucugaagc

SEQ ID NO: 1944307 - RNA, 14 nt, Human herpesvirus 4 [Epstein-Barr virus]
ggcucaccagggag

SEQ ID NO: 1944308 - RNA, 14 nt, Human herpesvirus 4 [Epstein-Barr virus]
aagcuacaaacacg

SEQ ID NO: 1944309 - RNA, 18 nt, Human herpesvirus 4 [Epstein-Barr virus]
cucuuggugcagcccuuu

SEQ ID NO: 1944310 - RNA, 23 nt, Human herpesvirus 4 [Epstein-Barr virus]
acagccccacucuugccucggcg

SEQ ID NO: 1944311 - RNA, 20 nt, Human herpesvirus 4 [Epstein-Barr virus]
uccgagagcuccgccaccuc

SEQ ID NO: 1944312 - RNA, 16 nt, Human herpesvirus 4 [Epstein-Barr virus]
aagucaggauucucua

SEQ ID NO: 1944313 - RNA, 13 nt, Human herpesvirus 4 [Epstein-Barr virus]
cugcgccuuuagg

SEQ ID NO: 1944314 - RNA, 18 nt, Human herpesvirus 4 [Epstein-Barr virus]
cgccgccagcauggcagc

SEQ ID NO: 1944315 - RNA, 16 nt, Human herpesvirus 4 [Epstein-Barr virus]
cuggauucuuacagca

SEQ ID NO: 1944316 - RNA, 21 nt, Human herpesvirus 4 [Epstein-Barr virus]
gggaacaugagaaaauacuuc

SEQ ID NO: 1944317 - RNA, 14 nt, Human herpesvirus 4 [Epstein-Barr virus]
gagcuguuuggcuc

SEQ ID NO: 1944318 - RNA, 20 nt, Human herpesvirus 4 [Epstein-Barr virus]
acgggucucacgagggucug

SEQ ID NO: 1944319 - RNA, 14 nt, Human herpesvirus 4 [Epstein-Barr virus]
cacccccaccaccc

SEQ ID NO: 1944320 - RNA, 20 nt, Human herpesvirus 4 [Epstein-Barr virus]
augaugacgccgagaccuau

SEQ ID NO: 1944321 - RNA, 14 nt, Human herpesvirus 4 [Epstein-Barr virus]
gcaugcaggucagg

SEQ ID NO: 1944322 - RNA, 16 nt, Human herpesvirus 4 [Epstein-Barr virus]
uugaugugacuuguga

SEQ ID NO: 1944323 - RNA, 13 nt, Human herpesvirus 4 [Epstein-Barr virus]
ccacguccagacu

SEQ ID NO: 1944324 - RNA, 22 nt, Human herpesvirus 4 [Epstein-Barr virus]
aacacgacgggaaugacgggcu

SEQ ID NO: 1944325 - RNA, 23 nt, Human herpesvirus 4 [Epstein-Barr virus]
aucaaggaaacaaaaccacugac

SEQ ID NO: 1944326 - RNA, 19 nt, Human herpesvirus 4 [Epstein-Barr virus]
accugcacagaucugacca

SEQ ID NO: 1944327 - RNA, 23 nt, Human herpesvirus 4 [Epstein-Barr virus]
gcuucagcaguagcuugggaaca

SEQ ID NO: 1944328 - RNA, 14 nt, Human herpesvirus 4 [Epstein-Barr virus]
uccagaaaaugccg

SEQ ID NO: 1944329 - RNA, 23 nt, Human herpesvirus 4 [Epstein-Barr virus]
aucaccccgaguccaaggcccaa

SEQ ID NO: 1944330 - RNA, 17 nt, Human herpesvirus 4 [Epstein-Barr virus]
acaggugggacaaaaug

SEQ ID NO: 1944331 - RNA, 21 nt, Human herpesvirus 4 [Epstein-Barr virus]
aggcccuaauucagccaccuc

SEQ ID NO: 1944332 - RNA, 22 nt, Human herpesvirus 4 [Epstein-Barr virus]
agugccauguguguccagugcc

SEQ ID NO: 1944333 - RNA, 22 nt, Human herpesvirus 4 [Epstein-Barr virus]
caguagcuugggaacaccgggc

SEQ ID NO: 1944334 - RNA, 15 nt, Human herpesvirus 4 [Epstein-Barr virus]
ucgugagucugcugg

SEQ ID NO: 1944335 - RNA, 16 nt, Human herpesvirus 4 [Epstein-Barr virus]
cgaggucuccccugac

SEQ ID NO: 1944336 - RNA, 17 nt, Human herpesvirus 4 [Epstein-Barr virus]
cggggcagcgccggugg

SEQ ID NO: 1944337 - RNA, 22 nt, Human herpesvirus 4 [Epstein-Barr virus]
ggggcaggagcaggaggggcag

SEQ ID NO: 1944338 - RNA, 15 nt, Human herpesvirus 4 [Epstein-Barr virus]
gucuacuucgccaug

SEQ ID NO: 1944339 - RNA, 18 nt, Human herpesvirus 4 [Epstein-Barr virus]
agugcccuggaggccuca

SEQ ID NO: 1944340 - RNA, 16 nt, Human herpesvirus 4 [Epstein-Barr virus]
agaacugacgcuccag

SEQ ID NO: 1944341 - RNA, 14 nt, Human herpesvirus 4 [Epstein-Barr virus]
ucugcuucuggacc

SEQ ID NO: 1944342 - RNA, 16 nt, Human herpesvirus 4 [Epstein-Barr virus]
ugccuccagagccccu

SEQ ID NO: 1944343 - RNA, 16 nt, Human herpesvirus 4 [Epstein-Barr virus]
ucaucccacugggacg

SEQ ID NO: 1944344 - RNA, 17 nt, Human herpesvirus 4 [Epstein-Barr virus]
caggagcuugaggccag

SEQ ID NO: 1944345 - RNA, 13 nt, Human herpesvirus 4 [Epstein-Barr virus]
cugaccacucagg

SEQ ID NO: 1944346 - RNA, 15 nt, Human herpesvirus 4 [Epstein-Barr virus]
uacaaccccuuccac

SEQ ID NO: 1944347 - RNA, 22 nt, Human herpesvirus 4 [Epstein-Barr virus]
guaccagcuggugguccgcaug

SEQ ID NO: 1944348 - RNA, 20 nt, Human herpesvirus 4 [Epstein-Barr virus]
gagaugugcgcccugcucuc

SEQ ID NO: 1944349 - RNA, 13 nt, Human herpesvirus 4 [Epstein-Barr virus]
guccgcugggcca

SEQ ID NO: 1944350 - RNA, 17 nt, Human herpesvirus 4 [Epstein-Barr virus]
cagugucccugcugccc

SEQ ID NO: 1944351 - RNA, 14 nt, Human herpesvirus 4 [Epstein-Barr virus]
gcaaaacucacagg

SEQ ID NO: 1944352 - RNA, 19 nt, Human herpesvirus 4 [Epstein-Barr virus]
ggguggaacgcuccagcuu

SEQ ID NO: 1944353 - RNA, 14 nt, Human herpesvirus 4 [Epstein-Barr virus]
caggcucggcaccu

SEQ ID NO: 1944354 - RNA, 17 nt, Human herpesvirus 4 [Epstein-Barr virus]
gggcccgcuucauucac

SEQ ID NO: 1944355 - RNA, 17 nt, Human herpesvirus 4 [Epstein-Barr virus]
cagucccaccacaaagg

SEQ ID NO: 1944356 - RNA, 15 nt, Human herpesvirus 4 [Epstein-Barr virus]
ccacccccaccaccc

SEQ ID NO: 1944357 - RNA, 16 nt, Human herpesvirus 4 [Epstein-Barr virus]
cgggaugacucaucuc

SEQ ID NO: 1944358 - RNA, 19 nt, Human herpesvirus 4 [Epstein-Barr virus]
acccauaccaggugccuuu

SEQ ID NO: 1944359 - RNA, 16 nt, Human herpesvirus 4 [Epstein-Barr virus]
uaggcacaucuggacc

SEQ ID NO: 1944360 - RNA, 17 nt, Human herpesvirus 4 [Epstein-Barr virus]
ugggccacugcaggcug

SEQ ID NO: 1944361 - RNA, 17 nt, Human herpesvirus 4 [Epstein-Barr virus]
gcauucuacuaggaaac

SEQ ID NO: 1944362 - RNA, 16 nt, Human herpesvirus 4 [Epstein-Barr virus]
aauaccgagauguaca

SEQ ID NO: 1944363 - RNA, 17 nt, Human herpesvirus 4 [Epstein-Barr virus]
cacaacggcugugacua

SEQ ID NO: 1944364 - RNA, 18 nt, Human herpesvirus 4 [Epstein-Barr virus]
aucaaccuguauaaugac

SEQ ID NO: 1944365 - RNA, 22 nt, Human herpesvirus 4 [Epstein-Barr virus]
gucaaggccaacucagaccccg

SEQ ID NO: 1944366 - RNA, 20 nt, Human herpesvirus 4 [Epstein-Barr virus]
gcuucuuagaugaggagcag

SEQ ID NO: 1944367 - RNA, 16 nt, Human herpesvirus 4 [Epstein-Barr virus]
guacccgccaagcacg

SEQ ID NO: 1944368 - RNA, 13 nt, Human herpesvirus 4 [Epstein-Barr virus]
auaaaaguacaga

SEQ ID NO: 1944369 - RNA, 17 nt, Human herpesvirus 4 [Epstein-Barr virus]
ucucggcuguuuguacu

SEQ ID NO: 1944370 - RNA, 14 nt, Human herpesvirus 4 [Epstein-Barr virus]
uggcaaagggcaug

SEQ ID NO: 1944371 - RNA, 23 nt, Human herpesvirus 4 [Epstein-Barr virus]
ucagccuccaacaggugcccgag

SEQ ID NO: 1944372 - RNA, 18 nt, Human herpesvirus 4 [Epstein-Barr virus]
ccagcagauccagggccc

SEQ ID NO: 1944373 - RNA, 20 nt, Human herpesvirus 4 [Epstein-Barr virus]
gcuuagugccccccuugaga

SEQ ID NO: 1944374 - RNA, 17 nt, Human herpesvirus 4 [Epstein-Barr virus]
gacuuuuggcaauggga

SEQ ID NO: 1944375 - RNA, 18 nt, Human herpesvirus 4 [Epstein-Barr virus]
cuucccagacucugcuuu

SEQ ID NO: 1944376 - RNA, 15 nt, Human herpesvirus 4 [Epstein-Barr virus]
gugccucugggugcu

SEQ ID NO: 1944377 - RNA, 14 nt, Human herpesvirus 4 [Epstein-Barr virus]
ccuuggcaugacgu

SEQ ID NO: 1944378 - RNA, 17 nt, Human herpesvirus 4 [Epstein-Barr virus]
ucaucaucgggaaaggc

SEQ ID NO: 1944379 - RNA, 21 nt, Human herpesvirus 4 [Epstein-Barr virus]
acacucuggggucucaggccu

SEQ ID NO: 1944380 - RNA, 15 nt, Human herpesvirus 4 [Epstein-Barr virus]
cccuggaggccucag

SEQ ID NO: 1944381 - RNA, 22 nt, Human herpesvirus 4 [Epstein-Barr virus]
ccguccccugaccggcgcggga

SEQ ID NO: 1944382 - RNA, 21 nt, Human herpesvirus 4 [Epstein-Barr virus]
agcgcucuggucgcccccucu

SEQ ID NO: 1944383 - RNA, 20 nt, Human herpesvirus 4 [Epstein-Barr virus]
ucuacaaccccuuccacgug

SEQ ID NO: 1944384 - RNA, 23 nt, Human herpesvirus 4 [Epstein-Barr virus]
cgguagccuugggggccuggacu

SEQ ID NO: 1944385 - RNA, 15 nt, Human herpesvirus 4 [Epstein-Barr virus]
cagggacauccccag

SEQ ID NO: 1944386 - RNA, 16 nt, Human herpesvirus 4 [Epstein-Barr virus]
ccaggucuugccgugg

SEQ ID NO: 1944387 - RNA, 17 nt, Human herpesvirus 4 [Epstein-Barr virus]
gaccaaugccaaagcug

SEQ ID NO: 1944388 - RNA, 14 nt, Human herpesvirus 4 [Epstein-Barr virus]
gcgcgccgccagca

SEQ ID NO: 1944389 - RNA, 18 nt, Human herpesvirus 4 [Epstein-Barr virus]
cgaggaacuggcucagcu

SEQ ID NO: 1944390 - RNA, 23 nt, Human herpesvirus 4 [Epstein-Barr virus]
uugggccugcggggaacugagcc

SEQ ID NO: 1944391 - RNA, 22 nt, Human herpesvirus 4 [Epstein-Barr virus]
aucggguggcuuccagaaaaug

SEQ ID NO: 1944392 - RNA, 18 nt, Human herpesvirus 4 [Epstein-Barr virus]
ggaggagacguguguggc

SEQ ID NO: 1944393 - RNA, 22 nt, Human herpesvirus 4 [Epstein-Barr virus]
ccccuggacacuuauguuucaa

SEQ ID NO: 1944394 - RNA, 14 nt, Human herpesvirus 4 [Epstein-Barr virus]
guggucgugcugcu

SEQ ID NO: 1944395 - RNA, 21 nt, Human herpesvirus 4 [Epstein-Barr virus]
gcauccaacgcuuccaccccc

SEQ ID NO: 1944396 - RNA, 22 nt, Human herpesvirus 4 [Epstein-Barr virus]
uaggggcgaagggugggggugg

SEQ ID NO: 1944397 - RNA, 19 nt, Human herpesvirus 4 [Epstein-Barr virus]
uacuggcuuucguccucug

SEQ ID NO: 1944398 - RNA, 15 nt, Human herpesvirus 4 [Epstein-Barr virus]
cgucacucagcuccg

SEQ ID NO: 1944399 - RNA, 13 nt, Human herpesvirus 4 [Epstein-Barr virus]
ccugacugacucu

SEQ ID NO: 1944400 - RNA, 22 nt, Human herpesvirus 4 [Epstein-Barr virus]
cagcgaagaacacuccacagau

SEQ ID NO: 1944401 - RNA, 21 nt, Human herpesvirus 4 [Epstein-Barr virus]
gccuugguuucagccucacug

SEQ ID NO: 1944402 - RNA, 13 nt, Human herpesvirus 4 [Epstein-Barr virus]
cgcggcuggaugc

SEQ ID NO: 1944403 - RNA, 14 nt, Human herpesvirus 4 [Epstein-Barr virus]
aucuuccugucggc

SEQ ID NO: 1944404 - RNA, 17 nt, Human herpesvirus 4 [Epstein-Barr virus]
ccggcccuuugccuggg

SEQ ID NO: 1944405 - RNA, 22 nt, Human herpesvirus 4 [Epstein-Barr virus]
agcacaagugauuaggagcagg

SEQ ID NO: 1944406 - RNA, 14 nt, Human herpesvirus 4 [Epstein-Barr virus]
caguagaggacacc

SEQ ID NO: 1944407 - RNA, 13 nt, Human herpesvirus 4 [Epstein-Barr virus]
ccaccuccccugu

SEQ ID NO: 1944408 - RNA, 12 nt, Human herpesvirus 4 [Epstein-Barr virus]
agccacauucau

SEQ ID NO: 1944409 - RNA, 15 nt, Human herpesvirus 4 [Epstein-Barr virus]
ccagcagauccaggg

SEQ ID NO: 1944410 - RNA, 17 nt, Human herpesvirus 4 [Epstein-Barr virus]
agacuaugcauacacug

SEQ ID NO: 1944411 - RNA, 21 nt, Human herpesvirus 4 [Epstein-Barr virus]
cccugcagaguaauugcagug

SEQ ID NO: 1944412 - RNA, 19 nt, Human herpesvirus 4 [Epstein-Barr virus]
cucuccagcaaccaaugua

SEQ ID NO: 1944413 - RNA, 13 nt, Human herpesvirus 4 [Epstein-Barr virus]
gccggugcugcca

SEQ ID NO: 1944414 - RNA, 20 nt, Human herpesvirus 4 [Epstein-Barr virus]
cccagcuaguagcccuugga

SEQ ID NO: 1944415 - RNA, 15 nt, Human herpesvirus 4 [Epstein-Barr virus]
gcguguuugcugcuc

SEQ ID NO: 1944416 - RNA, 15 nt, Human herpesvirus 4 [Epstein-Barr virus]
cgcuugcgucugccc

SEQ ID NO: 1944417 - RNA, 13 nt, Human herpesvirus 4 [Epstein-Barr virus]
gcuagggaggaga

SEQ ID NO: 1944418 - RNA, 20 nt, Human herpesvirus 4 [Epstein-Barr virus]
gggguccggucuugcaggga

SEQ ID NO: 1944419 - RNA, 12 nt, Human herpesvirus 4 [Epstein-Barr virus]
gcagccuggcuc

SEQ ID NO: 1944420 - RNA, 16 nt, Human herpesvirus 4 [Epstein-Barr virus]
agcacuuugccagcaa

SEQ ID NO: 1944421 - RNA, 14 nt, Human herpesvirus 4 [Epstein-Barr virus]
ccagagcccagagg

SEQ ID NO: 1944422 - RNA, 19 nt, Human herpesvirus 4 [Epstein-Barr virus]
ccacugugccuaaacguga

SEQ ID NO: 1944423 - RNA, 12 nt, Human herpesvirus 4 [Epstein-Barr virus]
caaacaugggcu

SEQ ID NO: 1944424 - RNA, 19 nt, Human herpesvirus 4 [Epstein-Barr virus]
ucagcucaaccgccagggc

SEQ ID NO: 1944425 - RNA, 22 nt, Human herpesvirus 4 [Epstein-Barr virus]
ggccucgccuucuccucagccu

SEQ ID NO: 1944426 - RNA, 18 nt, Human herpesvirus 4 [Epstein-Barr virus]
gccacggcgugccagagg

SEQ ID NO: 1944427 - RNA, 13 nt, Human herpesvirus 4 [Epstein-Barr virus]
caguggcccucag

SEQ ID NO: 1944428 - RNA, 20 nt, Human herpesvirus 4 [Epstein-Barr virus]
aaagcuaacuguacauacug

SEQ ID NO: 1944429 - RNA, 16 nt, Human herpesvirus 4 [Epstein-Barr virus]
cagaccccagagcagc

SEQ ID NO: 1944430 - RNA, 21 nt, Human herpesvirus 4 [Epstein-Barr virus]
aagaggaggagggcggguggc

SEQ ID NO: 1944431 - RNA, 21 nt, Human herpesvirus 4 [Epstein-Barr virus]
uaccucuguuccuucugcucc

SEQ ID NO: 1944432 - RNA, 21 nt, Human herpesvirus 4 [Epstein-Barr virus]
ggaugagguuagcguggacag

SEQ ID NO: 1944433 - RNA, 15 nt, Human herpesvirus 4 [Epstein-Barr virus]
cacccuguacacccc

SEQ ID NO: 1944434 - RNA, 13 nt, Human herpesvirus 4 [Epstein-Barr virus]
caacccaaaacca

SEQ ID NO: 1944435 - RNA, 20 nt, Human herpesvirus 4 [Epstein-Barr virus]
cucugccaacuuugagcugg

SEQ ID NO: 1944436 - RNA, 23 nt, Human herpesvirus 4 [Epstein-Barr virus]
gggccuggugccagacucucuuc

SEQ ID NO: 1944437 - RNA, 16 nt, Human herpesvirus 4 [Epstein-Barr virus]
cuccaucagggccagg

SEQ ID NO: 1944438 - RNA, 17 nt, Human herpesvirus 4 [Epstein-Barr virus]
gcccuggaggccucagg

SEQ ID NO: 1944439 - RNA, 23 nt, Human herpesvirus 4 [Epstein-Barr virus]
ggaaucuuguuggaauggggcgu

SEQ ID NO: 1944440 - RNA, 16 nt, Human herpesvirus 4 [Epstein-Barr virus]
ucccauguuuguaacu

SEQ ID NO: 1944441 - RNA, 12 nt, Human herpesvirus 4 [Epstein-Barr virus]
gaauuggggcug

SEQ ID NO: 1944442 - RNA, 22 nt, Human herpesvirus 4 [Epstein-Barr virus]
acccugggccggggccuccauc

SEQ ID NO: 1944443 - RNA, 19 nt, Human herpesvirus 4 [Epstein-Barr virus]
gggaaugacgggcucccuc

SEQ ID NO: 1944444 - RNA, 15 nt, Human herpesvirus 4 [Epstein-Barr virus]
aucggacgggcaggc

SEQ ID NO: 1944445 - RNA, 15 nt, Human herpesvirus 4 [Epstein-Barr virus]
aggcagccuugcgug

SEQ ID NO: 1944446 - RNA, 15 nt, Human herpesvirus 4 [Epstein-Barr virus]
ggccguccucuggac

SEQ ID NO: 1944447 - RNA, 14 nt, Human herpesvirus 4 [Epstein-Barr virus]
cacuggaugcagga

SEQ ID NO: 1944448 - RNA, 20 nt, Human herpesvirus 4 [Epstein-Barr virus]
augcaauaaauaaaaguaca

SEQ ID NO: 1944449 - RNA, 21 nt, Human herpesvirus 4 [Epstein-Barr virus]
agucaggagguacaugggcca

SEQ ID NO: 1944450 - RNA, 23 nt, Human herpesvirus 4 [Epstein-Barr virus]
acucucucccccgggcgcugccu

SEQ ID NO: 1944451 - RNA, 20 nt, Human herpesvirus 4 [Epstein-Barr virus]
gccgcagaagagccgcuccg

SEQ ID NO: 1944452 - RNA, 23 nt, Human herpesvirus 4 [Epstein-Barr virus]
cgcgcuaccuccuaucacaggga

SEQ ID NO: 1944453 - RNA, 19 nt, Human herpesvirus 4 [Epstein-Barr virus]
aucagggccaagacauaga

SEQ ID NO: 1944454 - RNA, 15 nt, Human herpesvirus 4 [Epstein-Barr virus]
guuccccccagccug

SEQ ID NO: 1944455 - RNA, 17 nt, Human herpesvirus 4 [Epstein-Barr virus]
aggccaugcgcgcccug

SEQ ID NO: 1944456 - RNA, 23 nt, Human herpesvirus 4 [Epstein-Barr virus]
gacgggcaucuuaucagagaggc

SEQ ID NO: 1944457 - RNA, 21 nt, Human herpesvirus 4 [Epstein-Barr virus]
uggugcuguccugcugaaggg

SEQ ID NO: 1944458 - RNA, 23 nt, Human herpesvirus 4 [Epstein-Barr virus]
gcgugacggcauucgugagcagg

SEQ ID NO: 1944459 - RNA, 15 nt, Human herpesvirus 4 [Epstein-Barr virus]
cugauaauacgcccg

SEQ ID NO: 1944460 - RNA, 15 nt, Human herpesvirus 4 [Epstein-Barr virus]
cgccgccagcagccc

SEQ ID NO: 1944461 - RNA, 15 nt, Human herpesvirus 4 [Epstein-Barr virus]
gccaacgcucagugc

SEQ ID NO: 1944462 - RNA, 21 nt, Human herpesvirus 4 [Epstein-Barr virus]
agagggcagacguuaguaaca

SEQ ID NO: 1944463 - RNA, 22 nt, Human herpesvirus 4 [Epstein-Barr virus]
ugauucaucagaagcuacaaac

SEQ ID NO: 1944464 - RNA, 13 nt, Human herpesvirus 4 [Epstein-Barr virus]
acgccggccugcu

SEQ ID NO: 1944465 - RNA, 20 nt, Human herpesvirus 4 [Epstein-Barr virus]
ggcuggugacaaacucucuc

SEQ ID NO: 1944466 - RNA, 17 nt, Human herpesvirus 4 [Epstein-Barr virus]
ccuuacacuggaaagug

SEQ ID NO: 1944467 - RNA, 19 nt, Human herpesvirus 4 [Epstein-Barr virus]
cgcccugucaccaggccug

SEQ ID NO: 1944468 - RNA, 22 nt, Human herpesvirus 4 [Epstein-Barr virus]
ucuucauucuugcuauccugac

SEQ ID NO: 1944469 - RNA, 13 nt, Human herpesvirus 4 [Epstein-Barr virus]
cugcguccucuac

SEQ ID NO: 1944470 - RNA, 14 nt, Human herpesvirus 4 [Epstein-Barr virus]
cgugcaugcagcgc

SEQ ID NO: 1944471 - RNA, 13 nt, Human herpesvirus 4 [Epstein-Barr virus]
uccccggccuccc

SEQ ID NO: 1944472 - RNA, 12 nt, Human herpesvirus 4 [Epstein-Barr virus]
gugcccagggca

SEQ ID NO: 1944473 - RNA, 21 nt, Human herpesvirus 4 [Epstein-Barr virus]
gucuucggucaaguaccagcu

SEQ ID NO: 1944474 - RNA, 15 nt, Human herpesvirus 4 [Epstein-Barr virus]
aucaccagagcccag

SEQ ID NO: 1944475 - RNA, 17 nt, Human herpesvirus 4 [Epstein-Barr virus]
agauuagaagaugaugc

SEQ ID NO: 1944476 - RNA, 18 nt, Human herpesvirus 4 [Epstein-Barr virus]
ccucugccuccggccgcc

SEQ ID NO: 1944477 - RNA, 12 nt, Human herpesvirus 4 [Epstein-Barr virus]
gaggggcaggag

SEQ ID NO: 1944478 - RNA, 15 nt, Human herpesvirus 4 [Epstein-Barr virus]
agcaucagaugagac

SEQ ID NO: 1944479 - RNA, 15 nt, Human herpesvirus 4 [Epstein-Barr virus]
gaagauugucacagc

SEQ ID NO: 1944480 - RNA, 17 nt, Human herpesvirus 4 [Epstein-Barr virus]
caaaacuuuagaggcga

SEQ ID NO: 1944481 - RNA, 14 nt, Human herpesvirus 4 [Epstein-Barr virus]
ucccacugugccua

SEQ ID NO: 1944482 - RNA, 16 nt, Human herpesvirus 4 [Epstein-Barr virus]
cucggggcuggggaga

SEQ ID NO: 1944483 - RNA, 16 nt, Human herpesvirus 4 [Epstein-Barr virus]
aaagucccgagcggcc

SEQ ID NO: 1944484 - RNA, 14 nt, Human herpesvirus 4 [Epstein-Barr virus]
ggugacacagugcc

SEQ ID NO: 1944485 - RNA, 18 nt, Human herpesvirus 4 [Epstein-Barr virus]
ccuugcccucuccagcaa

SEQ ID NO: 1944486 - RNA, 20 nt, Human herpesvirus 4 [Epstein-Barr virus]
cagggcaacauugcagggcu

SEQ ID NO: 1944487 - RNA, 21 nt, Human herpesvirus 4 [Epstein-Barr virus]
gaaucaaaaucagaccacccg

SEQ ID NO: 1944488 - RNA, 21 nt, Human herpesvirus 4 [Epstein-Barr virus]
aguacugcagugggccucucu

SEQ ID NO: 1944489 - RNA, 21 nt, Human herpesvirus 4 [Epstein-Barr virus]
ggccuccagcucggccagcag

SEQ ID NO: 1944490 - RNA, 21 nt, Human herpesvirus 4 [Epstein-Barr virus]
cucacuucuacucuuggcagc

SEQ ID NO: 1944491 - RNA, 18 nt, Human herpesvirus 4 [Epstein-Barr virus]
gugcccgagccccgccug

SEQ ID NO: 1944492 - RNA, 15 nt, Human herpesvirus 4 [Epstein-Barr virus]
caucagcgccgucca

SEQ ID NO: 1944493 - RNA, 21 nt, Human herpesvirus 4 [Epstein-Barr virus]
gaggcggaagaccaggagccc

SEQ ID NO: 1944494 - RNA, 15 nt, Human herpesvirus 4 [Epstein-Barr virus]
cuuggcagcaguggc

SEQ ID NO: 1944495 - RNA, 21 nt, Human herpesvirus 4 [Epstein-Barr virus]
uguccgcagguggcugcugcc

SEQ ID NO: 1944496 - RNA, 21 nt, Human herpesvirus 4 [Epstein-Barr virus]
auggcauaaugggagggagcc

SEQ ID NO: 1944497 - RNA, 18 nt, Human herpesvirus 4 [Epstein-Barr virus]
cuagccguccuguccaag

SEQ ID NO: 1944498 - RNA, 16 nt, Human herpesvirus 4 [Epstein-Barr virus]
ccugcguugaacccac

SEQ ID NO: 1944499 - RNA, 19 nt, Human herpesvirus 4 [Epstein-Barr virus]
cucagaauugucacugaga

SEQ ID NO: 1944500 - RNA, 23 nt, Human herpesvirus 4 [Epstein-Barr virus]
caggugcccgagccccgccuggc

SEQ ID NO: 1944501 - RNA, 13 nt, Human herpesvirus 4 [Epstein-Barr virus]
augcagaaggggc

SEQ ID NO: 1944502 - RNA, 22 nt, Human herpesvirus 4 [Epstein-Barr virus]
gccaaugacccacuccagugcg

SEQ ID NO: 1944503 - RNA, 16 nt, Human herpesvirus 4 [Epstein-Barr virus]
gaccaaggcccuagcc

SEQ ID NO: 1944504 - RNA, 22 nt, Human herpesvirus 4 [Epstein-Barr virus]
cucaacaaggagugccucuggg

SEQ ID NO: 1944505 - RNA, 19 nt, Human herpesvirus 4 [Epstein-Barr virus]
gugccuaaacgugauggug

SEQ ID NO: 1944506 - RNA, 17 nt, Human herpesvirus 4 [Epstein-Barr virus]
gcucaggaucagggcca

SEQ ID NO: 1944507 - RNA, 18 nt, Human herpesvirus 4 [Epstein-Barr virus]
gcagcagacaaggacagg

SEQ ID NO: 1944508 - RNA, 14 nt, Human herpesvirus 4 [Epstein-Barr virus]
ggccguccucugga

SEQ ID NO: 1944509 - RNA, 19 nt, Human herpesvirus 4 [Epstein-Barr virus]
agagauuucauccucagag

SEQ ID NO: 1944510 - RNA, 18 nt, Human herpesvirus 4 [Epstein-Barr virus]
aggauggaagagaggggc

SEQ ID NO: 1944511 - RNA, 22 nt, Human herpesvirus 4 [Epstein-Barr virus]
gcucccgggcaaacagggcaga

SEQ ID NO: 1944512 - RNA, 14 nt, Human herpesvirus 4 [Epstein-Barr virus]
ccuaagcagcugag

SEQ ID NO: 1944513 - RNA, 16 nt, Human herpesvirus 4 [Epstein-Barr virus]
cuuccagaaaaugccg

SEQ ID NO: 1944514 - RNA, 16 nt, Human herpesvirus 4 [Epstein-Barr virus]
uccagccgggugcaca

SEQ ID NO: 1944515 - RNA, 12 nt, Human herpesvirus 4 [Epstein-Barr virus]
cggccugcuggc

SEQ ID NO: 1944516 - RNA, 14 nt, Human herpesvirus 4 [Epstein-Barr virus]
cuuccagagcucua

SEQ ID NO: 1944517 - RNA, 16 nt, Human herpesvirus 4 [Epstein-Barr virus]
cucgagagaggccucu

SEQ ID NO: 1944518 - RNA, 18 nt, Human herpesvirus 4 [Epstein-Barr virus]
gcucagacuuagggccgg

SEQ ID NO: 1944519 - RNA, 14 nt, Human herpesvirus 4 [Epstein-Barr virus]
gcagcagcucuggc

SEQ ID NO: 1944520 - RNA, 18 nt, Human herpesvirus 4 [Epstein-Barr virus]
acggcgucaaacagguga

SEQ ID NO: 1944521 - RNA, 17 nt, Human herpesvirus 4 [Epstein-Barr virus]
ccgccgccugcggccca

SEQ ID NO: 1944522 - RNA, 14 nt, Human herpesvirus 4 [Epstein-Barr virus]
auucucuucuguuu

SEQ ID NO: 1944523 - RNA, 21 nt, Human herpesvirus 4 [Epstein-Barr virus]
cagagcccagaggaggccccg

SEQ ID NO: 1944524 - RNA, 17 nt, Human herpesvirus 4 [Epstein-Barr virus]
aggggcucgaauaugau

SEQ ID NO: 1944525 - RNA, 17 nt, Human herpesvirus 4 [Epstein-Barr virus]
cccgguccccccagaag

SEQ ID NO: 1944526 - RNA, 17 nt, Human herpesvirus 4 [Epstein-Barr virus]
ggagacguguguggcug

SEQ ID NO: 1944527 - RNA, 16 nt, Human herpesvirus 4 [Epstein-Barr virus]
aggcugcgccugagcu

SEQ ID NO: 1944528 - RNA, 15 nt, Human herpesvirus 4 [Epstein-Barr virus]
uaaaaaugugcagcu

SEQ ID NO: 1944529 - RNA, 14 nt, Human herpesvirus 4 [Epstein-Barr virus]
gcaaggauggaaga

SEQ ID NO: 1944530 - RNA, 16 nt, Human herpesvirus 4 [Epstein-Barr virus]
ggccaccggggaggcc

SEQ ID NO: 1944531 - RNA, 16 nt, Human herpesvirus 4 [Epstein-Barr virus]
cacagcgccagcaggg

SEQ ID NO: 1944532 - RNA, 15 nt, Human herpesvirus 4 [Epstein-Barr virus]
ugggcuugauggccc

SEQ ID NO: 1944533 - RNA, 22 nt, Human herpesvirus 4 [Epstein-Barr virus]
ggccaggcgacgcucccgggca

SEQ ID NO: 1944534 - RNA, 16 nt, Human herpesvirus 4 [Epstein-Barr virus]
aggcgacgcuccuggg

SEQ ID NO: 1944535 - RNA, 23 nt, Human herpesvirus 4 [Epstein-Barr virus]
gcagucucaaucucucccacgga

SEQ ID NO: 1944536 - RNA, 18 nt, Human herpesvirus 4 [Epstein-Barr virus]
cuggaucuggggcuggcc

SEQ ID NO: 1944537 - RNA, 17 nt, Human herpesvirus 4 [Epstein-Barr virus]
ugggccucucuggcugu

SEQ ID NO: 1944538 - RNA, 15 nt, Human herpesvirus 4 [Epstein-Barr virus]
ggguacaagucccgg

SEQ ID NO: 1944539 - RNA, 16 nt, Human herpesvirus 4 [Epstein-Barr virus]
cgaaaguaggcggugg

SEQ ID NO: 1944540 - RNA, 20 nt, Human herpesvirus 4 [Epstein-Barr virus]
gcaauaaauaaaaguacaga

SEQ ID NO: 1944541 - RNA, 18 nt, Human herpesvirus 4 [Epstein-Barr virus]
uaugcaugagccacaggc

SEQ ID NO: 1944542 - RNA, 13 nt, Human herpesvirus 4 [Epstein-Barr virus]
gauggcacgggca

SEQ ID NO: 1944543 - RNA, 15 nt, Human herpesvirus 4 [Epstein-Barr virus]
cgagggcagacacca

SEQ ID NO: 1944544 - RNA, 21 nt, Human herpesvirus 4 [Epstein-Barr virus]
ccuucucugauggccuggaga

SEQ ID NO: 1944545 - RNA, 21 nt, Human herpesvirus 4 [Epstein-Barr virus]
gcuaugaccaugcccagacuc

SEQ ID NO: 1944546 - RNA, 20 nt, Human herpesvirus 4 [Epstein-Barr virus]
guuaagcugcaccuggacau

SEQ ID NO: 1944547 - RNA, 21 nt, Human herpesvirus 4 [Epstein-Barr virus]
gguggcagcccccuccuccag

SEQ ID NO: 1944548 - RNA, 13 nt, Human herpesvirus 4 [Epstein-Barr virus]
cuuacugcccagc

SEQ ID NO: 1944549 - RNA, 13 nt, Human herpesvirus 4 [Epstein-Barr virus]
cuccaucagggcc

SEQ ID NO: 1944550 - RNA, 22 nt, Human herpesvirus 4 [Epstein-Barr virus]
cgagaggaugauccuguacaaa

SEQ ID NO: 1944551 - RNA, 21 nt, Human herpesvirus 4 [Epstein-Barr virus]
aggaacggugauuaggcacug

SEQ ID NO: 1944552 - RNA, 21 nt, Human herpesvirus 4 [Epstein-Barr virus]
ggcagcgaagaacacuccaca

SEQ ID NO: 1944553 - RNA, 16 nt, Human herpesvirus 4 [Epstein-Barr virus]
cagggcagagaggcgg

SEQ ID NO: 1944554 - RNA, 17 nt, Human herpesvirus 4 [Epstein-Barr virus]
agccaggcucgcggaag

SEQ ID NO: 1944555 - RNA, 14 nt, Human herpesvirus 4 [Epstein-Barr virus]
uuggcgucucaggc

SEQ ID NO: 1944556 - RNA, 21 nt, Human herpesvirus 4 [Epstein-Barr virus]
acucaccaagauuguuccagg

SEQ ID NO: 1944557 - RNA, 22 nt, Human herpesvirus 4 [Epstein-Barr virus]
gcagacaccuuuacccagcccu

SEQ ID NO: 1944558 - RNA, 19 nt, Human herpesvirus 4 [Epstein-Barr virus]
ggcagcggaugguggggcu

SEQ ID NO: 1944559 - RNA, 15 nt, Human herpesvirus 4 [Epstein-Barr virus]
gaguaauugcagugg

SEQ ID NO: 1944560 - RNA, 15 nt, Human herpesvirus 4 [Epstein-Barr virus]
ggcagcuuuuggccu

SEQ ID NO: 1944561 - RNA, 16 nt, Human herpesvirus 4 [Epstein-Barr virus]
cacgagauggcccagu

SEQ ID NO: 1944562 - RNA, 15 nt, Human herpesvirus 4 [Epstein-Barr virus]
cucaagcccuucuuc

SEQ ID NO: 1944563 - RNA, 15 nt, Human herpesvirus 4 [Epstein-Barr virus]
cugcugcugcugguc

SEQ ID NO: 1944564 - RNA, 18 nt, Human herpesvirus 4 [Epstein-Barr virus]
uagcuauuugaucuuuga

SEQ ID NO: 1944565 - RNA, 22 nt, Human herpesvirus 4 [Epstein-Barr virus]
ugcccuggaggccucaggcaac

SEQ ID NO: 1944566 - RNA, 17 nt, Human herpesvirus 4 [Epstein-Barr virus]
ggcgacaguaacacagg

SEQ ID NO: 1944567 - RNA, 23 nt, Human herpesvirus 4 [Epstein-Barr virus]
cuuggcccucucacuucuacucu

SEQ ID NO: 1944568 - RNA, 15 nt, Human herpesvirus 4 [Epstein-Barr virus]
caugagcauggaaga

SEQ ID NO: 1944569 - RNA, 21 nt, Human herpesvirus 4 [Epstein-Barr virus]
cugugucccacuccaccugcc

SEQ ID NO: 1944570 - RNA, 17 nt, Human herpesvirus 4 [Epstein-Barr virus]
cacguagccuauuugca

SEQ ID NO: 1944571 - RNA, 21 nt, Human herpesvirus 4 [Epstein-Barr virus]
caggugccugacggugccgcu

SEQ ID NO: 1944572 - RNA, 18 nt, Human herpesvirus 4 [Epstein-Barr virus]
gggcggcguggagcuggg

SEQ ID NO: 1944573 - RNA, 14 nt, Human herpesvirus 4 [Epstein-Barr virus]
ggcgacugccgccg

SEQ ID NO: 1944574 - RNA, 14 nt, Human herpesvirus 4 [Epstein-Barr virus]
cucagccugcuccu

SEQ ID NO: 1944575 - RNA, 12 nt, Human herpesvirus 4 [Epstein-Barr virus]
ccgcccugagcu

SEQ ID NO: 1944576 - RNA, 17 nt, Human herpesvirus 4 [Epstein-Barr virus]
gccaccacggugcagcc

SEQ ID NO: 1944577 - RNA, 18 nt, Human herpesvirus 4 [Epstein-Barr virus]
gcagcugaguccccuccu

SEQ ID NO: 1944578 - RNA, 21 nt, Human herpesvirus 4 [Epstein-Barr virus]
gggccacggcgugccagaggc

SEQ ID NO: 1944579 - RNA, 12 nt, Human herpesvirus 4 [Epstein-Barr virus]
cuccggcugccc

SEQ ID NO: 1944580 - RNA, 15 nt, Human herpesvirus 4 [Epstein-Barr virus]
cagggcaaagccaca

SEQ ID NO: 1944581 - RNA, 21 nt, Human herpesvirus 4 [Epstein-Barr virus]
uaaacauugcaccuugccggc

SEQ ID NO: 1944582 - RNA, 19 nt, Human herpesvirus 4 [Epstein-Barr virus]
cugaggcccguccccugac

SEQ ID NO: 1944583 - RNA, 20 nt, Human herpesvirus 4 [Epstein-Barr virus]
cggguggagauagggaccag

SEQ ID NO: 1944584 - RNA, 20 nt, Human herpesvirus 4 [Epstein-Barr virus]
gggcgcaccuguguccuggg

SEQ ID NO: 1944585 - RNA, 24 nt, Human herpesvirus 4 [Epstein-Barr virus]
gaugaggcugaugauggccacgac

SEQ ID NO: 1944586 - RNA, 22 nt, Human herpesvirus 4 [Epstein-Barr virus]
uaaggugguuauuuugggccag

SEQ ID NO: 1944587 - RNA, 16 nt, Human herpesvirus 4 [Epstein-Barr virus]
aggccgcugccaggcc

SEQ ID NO: 1944588 - RNA, 21 nt, Human herpesvirus 4 [Epstein-Barr virus]
auggcacggaugccuggcgcu

SEQ ID NO: 1944589 - RNA, 17 nt, Human herpesvirus 4 [Epstein-Barr virus]
ccugaccgaauggggca

SEQ ID NO: 1944590 - RNA, 18 nt, Human herpesvirus 4 [Epstein-Barr virus]
gacccccgggcgccccca

SEQ ID NO: 1944591 - RNA, 22 nt, Human herpesvirus 4 [Epstein-Barr virus]
agccaggcuuucuaugccugaa

SEQ ID NO: 1944592 - RNA, 18 nt, Human herpesvirus 4 [Epstein-Barr virus]
cccaaagggacucaaugg

SEQ ID NO: 1944593 - RNA, 16 nt, Human herpesvirus 4 [Epstein-Barr virus]
gcgcccuccucugggc

SEQ ID NO: 1944594 - RNA, 14 nt, Human herpesvirus 4 [Epstein-Barr virus]
acaccauggccucg

SEQ ID NO: 1944595 - RNA, 18 nt, Human herpesvirus 4 [Epstein-Barr virus]
cacccacugauaauacgc

SEQ ID NO: 1944596 - RNA, 15 nt, Human herpesvirus 4 [Epstein-Barr virus]
uggccguccucugga

SEQ ID NO: 1944597 - RNA, 19 nt, Human herpesvirus 4 [Epstein-Barr virus]
acugugguuuccaugacgc

SEQ ID NO: 1944598 - RNA, 18 nt, Human herpesvirus 4 [Epstein-Barr virus]
ggcggcgguggauagaga

SEQ ID NO: 1944599 - RNA, 21 nt, Human herpesvirus 4 [Epstein-Barr virus]
cucaggccaccgucuacccag

SEQ ID NO: 1944600 - RNA, 21 nt, Human herpesvirus 4 [Epstein-Barr virus]
ugcccgcuuccuccgcagucc

SEQ ID NO: 1944601 - RNA, 18 nt, Human herpesvirus 4 [Epstein-Barr virus]
gauacucaucugugagac

SEQ ID NO: 1944602 - RNA, 14 nt, Human herpesvirus 4 [Epstein-Barr virus]
ccugugccauacca

SEQ ID NO: 1944603 - RNA, 17 nt, Human herpesvirus 4 [Epstein-Barr virus]
cugcugcugcuggucau

SEQ ID NO: 1944604 - RNA, 20 nt, Human herpesvirus 4 [Epstein-Barr virus]
guguauuucuggccaucugu

SEQ ID NO: 1944605 - RNA, 21 nt, Human herpesvirus 4 [Epstein-Barr virus]
cugccacuuccacagcaaugg

SEQ ID NO: 1944606 - RNA, 23 nt, Human herpesvirus 4 [Epstein-Barr virus]
ugcccuccuccacccagcagcag

SEQ ID NO: 1944607 - RNA, 19 nt, Human herpesvirus 4 [Epstein-Barr virus]
cuuuaggcguaacuugucu

SEQ ID NO: 1944608 - RNA, 17 nt, Human herpesvirus 4 [Epstein-Barr virus]
aaaauauauugcaaaau

SEQ ID NO: 1944609 - RNA, 14 nt, Human herpesvirus 4 [Epstein-Barr virus]
cggcccguggccug

SEQ ID NO: 1944610 - RNA, 20 nt, Human herpesvirus 4 [Epstein-Barr virus]
ccuugcccucuccagcaacc

SEQ ID NO: 1944611 - RNA, 18 nt, Human herpesvirus 4 [Epstein-Barr virus]
acuccaggcccccgggug

SEQ ID NO: 1944612 - RNA, 11 nt, Human herpesvirus 4 [Epstein-Barr virus]
gggaggacacu

SEQ ID NO: 1944613 - RNA, 16 nt, Human herpesvirus 4 [Epstein-Barr virus]
aaaggaaacugcugac

SEQ ID NO: 1944614 - RNA, 15 nt, Human herpesvirus 4 [Epstein-Barr virus]
gcauggcggccuggc

SEQ ID NO: 1944615 - RNA, 22 nt, Human herpesvirus 4 [Epstein-Barr virus]
caguaugcucgaagcauugggc

SEQ ID NO: 1944616 - RNA, 17 nt, Human herpesvirus 4 [Epstein-Barr virus]
gcauuggcugcaaaggg

SEQ ID NO: 1944617 - RNA, 11 nt, Human herpesvirus 4 [Epstein-Barr virus]
cugcaggacac

SEQ ID NO: 1944618 - RNA, 11 nt, Human herpesvirus 4 [Epstein-Barr virus]
gcagcuccgcc

SEQ ID NO: 1944619 - RNA, 18 nt, Human herpesvirus 4 [Epstein-Barr virus]
uuaagagucccuccucac

SEQ ID NO: 1944620 - RNA, 13 nt, Human herpesvirus 4 [Epstein-Barr virus]
ucuucuucucccu

SEQ ID NO: 1944621 - RNA, 12 nt, Human herpesvirus 4 [Epstein-Barr virus]
ccagcaggcuca

SEQ ID NO: 1944622 - RNA, 12 nt, Human herpesvirus 4 [Epstein-Barr virus]
cugggaggugcu

SEQ ID NO: 1944623 - RNA, 20 nt, Human herpesvirus 4 [Epstein-Barr virus]
gacuuuuggcaaugggagca

SEQ ID NO: 1944624 - RNA, 18 nt, Human herpesvirus 4 [Epstein-Barr virus]
cagcgggggaccacauac

SEQ ID NO: 1944625 - RNA, 17 nt, Human herpesvirus 4 [Epstein-Barr virus]
gcaugguggcuucuuag

SEQ ID NO: 1944626 - RNA, 21 nt, Human herpesvirus 4 [Epstein-Barr virus]
gcaggagcgggaggggcagga

SEQ ID NO: 1944627 - RNA, 21 nt, Human herpesvirus 4 [Epstein-Barr virus]
cuucuggcacgacuguuccua

SEQ ID NO: 1944628 - RNA, 19 nt, Human herpesvirus 4 [Epstein-Barr virus]
uggccgguggauccuccac

SEQ ID NO: 1944629 - RNA, 21 nt, Human herpesvirus 4 [Epstein-Barr virus]
gucucggccuacgaggcccug

SEQ ID NO: 1944630 - RNA, 17 nt, Human herpesvirus 4 [Epstein-Barr virus]
agcaccucaaccuggag

SEQ ID NO: 1944631 - RNA, 16 nt, Human herpesvirus 4 [Epstein-Barr virus]
ccagcggggagagggu

SEQ ID NO: 1944632 - RNA, 14 nt, Human herpesvirus 4 [Epstein-Barr virus]
ugagugcccagggc

SEQ ID NO: 1944633 - RNA, 19 nt, Human herpesvirus 4 [Epstein-Barr virus]
uugcgccgccuaaugcauc

SEQ ID NO: 1944634 - RNA, 15 nt, Human herpesvirus 4 [Epstein-Barr virus]
cgacaauaaaguuga

SEQ ID NO: 1944635 - RNA, 22 nt, Human herpesvirus 4 [Epstein-Barr virus]
ggugaccacugagggaguguuc

SEQ ID NO: 1944636 - RNA, 18 nt, Human herpesvirus 4 [Epstein-Barr virus]
uagcgccccuauaaccac

SEQ ID NO: 1944637 - RNA, 20 nt, Human herpesvirus 4 [Epstein-Barr virus]
gcacugcguccaccuggcca

SEQ ID NO: 1944638 - RNA, 13 nt, Human herpesvirus 4 [Epstein-Barr virus]
cggagucuucaag

SEQ ID NO: 1944639 - RNA, 18 nt, Human herpesvirus 4 [Epstein-Barr virus]
aggccaugcgcgcccugu

SEQ ID NO: 1944640 - RNA, 12 nt, Human herpesvirus 4 [Epstein-Barr virus]
gcaagauggaga

SEQ ID NO: 1944641 - RNA, 11 nt, Human herpesvirus 4 [Epstein-Barr virus]
cuacugcugcu

SEQ ID NO: 1944642 - RNA, 21 nt, Human herpesvirus 4 [Epstein-Barr virus]
ccggugcugccagagccucug

SEQ ID NO: 1944643 - RNA, 16 nt, Human herpesvirus 4 [Epstein-Barr virus]
ugcugcuggucauggc

SEQ ID NO: 1944644 - RNA, 20 nt, Human herpesvirus 4 [Epstein-Barr virus]
caccuguccuugucugcugc

SEQ ID NO: 1944645 - RNA, 20 nt, Human herpesvirus 4 [Epstein-Barr virus]
agcauggccgccagaguucc

SEQ ID NO: 1944646 - RNA, 16 nt, Human herpesvirus 4 [Epstein-Barr virus]
cauucccuugcucgca

SEQ ID NO: 1944647 - RNA, 15 nt, Human herpesvirus 4 [Epstein-Barr virus]
gccuccucccaacgc

SEQ ID NO: 1944648 - RNA, 20 nt, Human herpesvirus 4 [Epstein-Barr virus]
cguuaaaacaguagaagaac

SEQ ID NO: 1944649 - RNA, 15 nt, Human herpesvirus 4 [Epstein-Barr virus]
ggacgaggaggcgga

SEQ ID NO: 1944650 - RNA, 13 nt, Human herpesvirus 4 [Epstein-Barr virus]
gagggggccuggu

SEQ ID NO: 1944651 - RNA, 18 nt, Human herpesvirus 4 [Epstein-Barr virus]
cggcggccucggaggugc

SEQ ID NO: 1944652 - RNA, 16 nt, Human herpesvirus 4 [Epstein-Barr virus]
acucgaaacuauggca

SEQ ID NO: 1944653 - RNA, 10 nt, Human herpesvirus 4 [Epstein-Barr virus]
cuuguuucaa

SEQ ID NO: 1944654 - RNA, 12 nt, Human herpesvirus 4 [Epstein-Barr virus]
cgaggggccagg

SEQ ID NO: 1944655 - RNA, 18 nt, Human herpesvirus 4 [Epstein-Barr virus]
gccagcaaaaccagcccg

SEQ ID NO: 1944656 - RNA, 17 nt, Human herpesvirus 4 [Epstein-Barr virus]
ugguccaggguccagga

SEQ ID NO: 1944657 - RNA, 19 nt, Human herpesvirus 4 [Epstein-Barr virus]
cagaaucaccagagcccag

SEQ ID NO: 1944658 - RNA, 21 nt, Human herpesvirus 4 [Epstein-Barr virus]
cccaccuaugccaauccaugc

SEQ ID NO: 1944659 - RNA, 14 nt, Human herpesvirus 4 [Epstein-Barr virus]
guuggcgggacugg

SEQ ID NO: 1944660 - RNA, 20 nt, Human herpesvirus 4 [Epstein-Barr virus]
uugagcgccguggccaccuu

SEQ ID NO: 1944661 - RNA, 15 nt, Human herpesvirus 4 [Epstein-Barr virus]
gacuucugaagaugu

SEQ ID NO: 1944662 - RNA, 14 nt, Human herpesvirus 4 [Epstein-Barr virus]
ugcaccggagccug

SEQ ID NO: 1944663 - RNA, 17 nt, Human herpesvirus 4 [Epstein-Barr virus]
ucuucaagauugggugg

SEQ ID NO: 1944664 - RNA, 17 nt, Human herpesvirus 4 [Epstein-Barr virus]
gcguuucugcggaucag

SEQ ID NO: 1944665 - RNA, 21 nt, Human herpesvirus 4 [Epstein-Barr virus]
gcucaccagggaggccuggga

SEQ ID NO: 1944666 - RNA, 14 nt, Human herpesvirus 4 [Epstein-Barr virus]
gccuccgccugagc

SEQ ID NO: 1944667 - RNA, 23 nt, Human herpesvirus 4 [Epstein-Barr virus]
agcggcccagcagauccagggcc

SEQ ID NO: 1944668 - RNA, 19 nt, Human herpesvirus 4 [Epstein-Barr virus]
cgcaccuguguccugggca

SEQ ID NO: 1944669 - RNA, 16 nt, Human herpesvirus 4 [Epstein-Barr virus]
cuguucaaacagcagc

SEQ ID NO: 1944670 - RNA, 21 nt, Human herpesvirus 4 [Epstein-Barr virus]
gcgaugccucuacgccccaga

SEQ ID NO: 1944671 - RNA, 22 nt, Human herpesvirus 4 [Epstein-Barr virus]
acgaggaggcggaagaccagga

SEQ ID NO: 1944672 - RNA, 18 nt, Human herpesvirus 4 [Epstein-Barr virus]
acucuuguugcuagccuc

SEQ ID NO: 1944673 - RNA, 12 nt, Human herpesvirus 4 [Epstein-Barr virus]
ggcccagccccc

SEQ ID NO: 1944674 - RNA, 14 nt, Human herpesvirus 4 [Epstein-Barr virus]
cagggacuggcggc

SEQ ID NO: 1944675 - RNA, 15 nt, Human herpesvirus 4 [Epstein-Barr virus]
ccagcagcagcccgg

SEQ ID NO: 1944676 - RNA, 22 nt, Human herpesvirus 4 [Epstein-Barr virus]
cgcucagcucaaccgccagggc

SEQ ID NO: 1944677 - RNA, 18 nt, Human herpesvirus 4 [Epstein-Barr virus]
gacccaucugagggcagu

SEQ ID NO: 1944678 - RNA, 15 nt, Human herpesvirus 4 [Epstein-Barr virus]
cuggagagcaugcag

SEQ ID NO: 1944679 - RNA, 17 nt, Human herpesvirus 4 [Epstein-Barr virus]
agcacuuugaaagaugu

SEQ ID NO: 1944680 - RNA, 16 nt, Human herpesvirus 4 [Epstein-Barr virus]
agggucagcacagcca

SEQ ID NO: 1944681 - RNA, 15 nt, Human herpesvirus 4 [Epstein-Barr virus]
cggugaucagggaga

SEQ ID NO: 1944682 - RNA, 22 nt, Human herpesvirus 4 [Epstein-Barr virus]
cgugaaccucccccccagaccu

SEQ ID NO: 1944683 - RNA, 15 nt, Human herpesvirus 4 [Epstein-Barr virus]
cugggcagccagagc

SEQ ID NO: 1944684 - RNA, 15 nt, Human herpesvirus 4 [Epstein-Barr virus]
accauggacgaggac

SEQ ID NO: 1944685 - RNA, 13 nt, Human herpesvirus 4 [Epstein-Barr virus]
ugcuugccccggg

SEQ ID NO: 1944686 - RNA, 19 nt, Human herpesvirus 4 [Epstein-Barr virus]
ucagagcugggaagaaugg

SEQ ID NO: 1944687 - RNA, 18 nt, Human herpesvirus 4 [Epstein-Barr virus]
acugauggccaucuuuca

SEQ ID NO: 1944688 - RNA, 22 nt, Human herpesvirus 4 [Epstein-Barr virus]
aucaucucgcuggcucgccuca

SEQ ID NO: 1944689 - RNA, 18 nt, Human herpesvirus 4 [Epstein-Barr virus]
gcgcacccggggaaccgg

SEQ ID NO: 1944690 - RNA, 14 nt, Human herpesvirus 4 [Epstein-Barr virus]
aggcugcgccugag

SEQ ID NO: 1944691 - RNA, 14 nt, Human herpesvirus 4 [Epstein-Barr virus]
aaaaucagaccacc

SEQ ID NO: 1944692 - RNA, 12 nt, Human herpesvirus 4 [Epstein-Barr virus]
gaggccugagag

SEQ ID NO: 1944693 - RNA, 20 nt, Human herpesvirus 4 [Epstein-Barr virus]
gccggaugccugccuaugga

SEQ ID NO: 1944694 - RNA, 16 nt, Human herpesvirus 4 [Epstein-Barr virus]
caucuagcgggagaug

SEQ ID NO: 1944695 - RNA, 19 nt, Human herpesvirus 4 [Epstein-Barr virus]
aggaggggcaggagcagga

SEQ ID NO: 1944696 - RNA, 15 nt, Human herpesvirus 4 [Epstein-Barr virus]
cagcagcagcagugg

SEQ ID NO: 1944697 - RNA, 20 nt, Human herpesvirus 4 [Epstein-Barr virus]
acggggccgugcaccugcca

SEQ ID NO: 1944698 - RNA, 13 nt, Human herpesvirus 4 [Epstein-Barr virus]
ugcccgagccccg

SEQ ID NO: 1944699 - RNA, 17 nt, Human herpesvirus 4 [Epstein-Barr virus]
ccaucuggcagcuuuug

SEQ ID NO: 1944700 - RNA, 18 nt, Human herpesvirus 4 [Epstein-Barr virus]
ggagauagggaccagagg

SEQ ID NO: 1944701 - RNA, 15 nt, Human herpesvirus 4 [Epstein-Barr virus]
aagaugucaaacaug

SEQ ID NO: 1944702 - RNA, 20 nt, Human herpesvirus 4 [Epstein-Barr virus]
cacauuggacacccacccug

SEQ ID NO: 1944703 - RNA, 13 nt, Human herpesvirus 4 [Epstein-Barr virus]
cagcucggccagc

SEQ ID NO: 1944704 - RNA, 20 nt, Human herpesvirus 4 [Epstein-Barr virus]
caccagcuccagggacaggg

SEQ ID NO: 1944705 - RNA, 15 nt, Human herpesvirus 4 [Epstein-Barr virus]
cugcuucuggcucuu

SEQ ID NO: 1944706 - RNA, 22 nt, Human herpesvirus 4 [Epstein-Barr virus]
uccccuuguauuugcuauucaa

SEQ ID NO: 1944707 - RNA, 20 nt, Human herpesvirus 4 [Epstein-Barr virus]
ucgucaggagggcagagagg

SEQ ID NO: 1944708 - RNA, 17 nt, Human herpesvirus 4 [Epstein-Barr virus]
ugccaugcacggcccug

SEQ ID NO: 1944709 - RNA, 22 nt, Human herpesvirus 4 [Epstein-Barr virus]
uccaauagaggagcuccgagag

SEQ ID NO: 1944710 - RNA, 17 nt, Human herpesvirus 4 [Epstein-Barr virus]
guacccauaacugggca

SEQ ID NO: 1944711 - RNA, 17 nt, Human herpesvirus 4 [Epstein-Barr virus]
gcugccguuauugccug

SEQ ID NO: 1944712 - RNA, 15 nt, Human herpesvirus 4 [Epstein-Barr virus]
cgccucguguuucac

SEQ ID NO: 1944713 - RNA, 21 nt, Human herpesvirus 4 [Epstein-Barr virus]
ucgauuggaaaagggcccagg

SEQ ID NO: 1944714 - RNA, 20 nt, Human herpesvirus 4 [Epstein-Barr virus]
ccgagaccaaggcggcugcu

SEQ ID NO: 1944715 - RNA, 15 nt, Human herpesvirus 4 [Epstein-Barr virus]
gugucauuuagaaac

SEQ ID NO: 1944716 - RNA, 19 nt, Human herpesvirus 4 [Epstein-Barr virus]
cacucaggaagcuggccag

SEQ ID NO: 1944717 - RNA, 12 nt, Human herpesvirus 4 [Epstein-Barr virus]
caucuuccuccu

SEQ ID NO: 1944718 - RNA, 17 nt, Human herpesvirus 4 [Epstein-Barr virus]
ggccaggacgcugcugu

SEQ ID NO: 1944719 - RNA, 15 nt, Human herpesvirus 4 [Epstein-Barr virus]
gcacggcacccuccc

SEQ ID NO: 1944720 - RNA, 14 nt, Human herpesvirus 4 [Epstein-Barr virus]
gccaacucccccaa

SEQ ID NO: 1944721 - RNA, 20 nt, Human herpesvirus 4 [Epstein-Barr virus]
cacugauuuugggcacacuu

SEQ ID NO: 1944722 - RNA, 13 nt, Human herpesvirus 4 [Epstein-Barr virus]
uccauuccaccca

SEQ ID NO: 1944723 - RNA, 23 nt, Human herpesvirus 4 [Epstein-Barr virus]
aaagcggcccagcagauccaggg

SEQ ID NO: 1944724 - RNA, 17 nt, Human herpesvirus 4 [Epstein-Barr virus]
gccuccuggccagcacc

SEQ ID NO: 1944725 - RNA, 23 nt, Human herpesvirus 4 [Epstein-Barr virus]
uuccucaucguucgguggggugg

SEQ ID NO: 1944726 - RNA, 19 nt, Human herpesvirus 4 [Epstein-Barr virus]
ggccuuguccgcugggcca

SEQ ID NO: 1944727 - RNA, 20 nt, Human herpesvirus 4 [Epstein-Barr virus]
ccacauacaucccugucucc

SEQ ID NO: 1944728 - RNA, 20 nt, Human herpesvirus 4 [Epstein-Barr virus]
cgcuccgcgcucggccuaga

SEQ ID NO: 1944729 - RNA, 20 nt, Human herpesvirus 4 [Epstein-Barr virus]
acuggggugugaagggcagg

SEQ ID NO: 1944730 - RNA, 14 nt, Human herpesvirus 4 [Epstein-Barr virus]
uccggaggggacca

SEQ ID NO: 1944731 - RNA, 18 nt, Human herpesvirus 4 [Epstein-Barr virus]
cagacuccggggguccag

SEQ ID NO: 1944732 - RNA, 14 nt, Human herpesvirus 4 [Epstein-Barr virus]
gagacguggguccc

SEQ ID NO: 1944733 - RNA, 23 nt, Human herpesvirus 4 [Epstein-Barr virus]
accuuuuaauucucuucuguuug

SEQ ID NO: 1944734 - RNA, 15 nt, Human herpesvirus 4 [Epstein-Barr virus]
caggagucugcugcg

SEQ ID NO: 1944735 - RNA, 21 nt, Human herpesvirus 4 [Epstein-Barr virus]
cuccaccgccgguuaacuuua

SEQ ID NO: 1944736 - RNA, 15 nt, Human herpesvirus 4 [Epstein-Barr virus]
uugugugccuccuca

SEQ ID NO: 1944737 - RNA, 19 nt, Human herpesvirus 4 [Epstein-Barr virus]
ccucggcgccaacgcgcca

SEQ ID NO: 1944738 - RNA, 17 nt, Human herpesvirus 4 [Epstein-Barr virus]
gcccauggaaugcucag

SEQ ID NO: 1944739 - RNA, 15 nt, Human herpesvirus 4 [Epstein-Barr virus]
caccgucagccacac

SEQ ID NO: 1944740 - RNA, 22 nt, Human herpesvirus 4 [Epstein-Barr virus]
cagacggcgcuugcgucugccc

SEQ ID NO: 1944741 - RNA, 13 nt, Human herpesvirus 4 [Epstein-Barr virus]
guuagugugccuc

SEQ ID NO: 1944742 - RNA, 20 nt, Human herpesvirus 4 [Epstein-Barr virus]
uacagcaggauuccugauuu

SEQ ID NO: 1944743 - RNA, 23 nt, Human herpesvirus 4 [Epstein-Barr virus]
ucuccucagccuccaacaggugc

SEQ ID NO: 1944744 - RNA, 15 nt, Human herpesvirus 4 [Epstein-Barr virus]
gcaagucaggauucu

SEQ ID NO: 1944745 - RNA, 19 nt, Human herpesvirus 4 [Epstein-Barr virus]
cuccccaauggggcuggca

SEQ ID NO: 1944746 - RNA, 15 nt, Human herpesvirus 4 [Epstein-Barr virus]
ccuaucauguuucaa

SEQ ID NO: 1944747 - RNA, 13 nt, Human herpesvirus 4 [Epstein-Barr virus]
cuccccagccaca

SEQ ID NO: 1944748 - RNA, 18 nt, Human herpesvirus 4 [Epstein-Barr virus]
aaagagacucaggcccuc

SEQ ID NO: 1944749 - RNA, 16 nt, Human herpesvirus 4 [Epstein-Barr virus]
agggaaaggaaggggg

SEQ ID NO: 1944750 - RNA, 15 nt, Human herpesvirus 4 [Epstein-Barr virus]
gcuccggcugcccgu

SEQ ID NO: 1944751 - RNA, 17 nt, Human herpesvirus 4 [Epstein-Barr virus]
caauaaaguugaugaua

SEQ ID NO: 1944752 - RNA, 23 nt, Human herpesvirus 4 [Epstein-Barr virus]
cggcauccucaaggggcacgaga

SEQ ID NO: 1944753 - RNA, 21 nt, Human herpesvirus 4 [Epstein-Barr virus]
ugaagcagaugugcccaagcc

SEQ ID NO: 1944754 - RNA, 21 nt, Human herpesvirus 4 [Epstein-Barr virus]
agcuacgaaacugaccagaug

SEQ ID NO: 1944755 - RNA, 23 nt, Human herpesvirus 4 [Epstein-Barr virus]
cucaggccaugcgcgcccuguca

SEQ ID NO: 1944756 - RNA, 20 nt, Human herpesvirus 4 [Epstein-Barr virus]
accuggacauagaggggcau

SEQ ID NO: 1944757 - RNA, 22 nt, Human herpesvirus 4 [Epstein-Barr virus]
gccuggggauaagaaacacgcu

SEQ ID NO: 1944758 - RNA, 14 nt, Human herpesvirus 4 [Epstein-Barr virus]
uuacaauaaaauga

SEQ ID NO: 1944759 - RNA, 21 nt, Human herpesvirus 4 [Epstein-Barr virus]
cguguucccuaagcagcugag

SEQ ID NO: 1944760 - RNA, 21 nt, Human herpesvirus 4 [Epstein-Barr virus]
ggucccaggccuuagcccaga

SEQ ID NO: 1944761 - RNA, 15 nt, Human herpesvirus 4 [Epstein-Barr virus]
gcucggggcaugcug

SEQ ID NO: 1944762 - RNA, 20 nt, Human herpesvirus 4 [Epstein-Barr virus]
cagugggccucucuggcugu

SEQ ID NO: 1944763 - RNA, 17 nt, Human herpesvirus 4 [Epstein-Barr virus]
caccccuccuacacaca

SEQ ID NO: 1944764 - RNA, 19 nt, Human herpesvirus 4 [Epstein-Barr virus]
gcgcuguggagagaggcaa

SEQ ID NO: 1944765 - RNA, 21 nt, Human herpesvirus 4 [Epstein-Barr virus]
ugcuuuuaacucuuaaaacuu

SEQ ID NO: 1944766 - RNA, 21 nt, Human herpesvirus 4 [Epstein-Barr virus]
ucguagcuuugaugaggcuga

SEQ ID NO: 1944767 - RNA, 18 nt, Human herpesvirus 4 [Epstein-Barr virus]
uaacacgaaugcccaggc

SEQ ID NO: 1944768 - RNA, 18 nt, Human herpesvirus 4 [Epstein-Barr virus]
ccuugcccccgccagcgc

SEQ ID NO: 1944769 - RNA, 16 nt, Human herpesvirus 4 [Epstein-Barr virus]
ugugaaccagaaagau

SEQ ID NO: 1944770 - RNA, 22 nt, Human herpesvirus 4 [Epstein-Barr virus]
accggugacagugcuuacugcg

SEQ ID NO: 1944771 - RNA, 18 nt, Human herpesvirus 4 [Epstein-Barr virus]
ucacgucacucagcuccg

SEQ ID NO: 1944772 - RNA, 21 nt, Human herpesvirus 4 [Epstein-Barr virus]
cagaccucugcacaacacaac

SEQ ID NO: 1944773 - RNA, 18 nt, Human herpesvirus 4 [Epstein-Barr virus]
agaggagggggauccgga

SEQ ID NO: 1944774 - RNA, 23 nt, Human herpesvirus 4 [Epstein-Barr virus]
cacccggacccggaccaaugcca

SEQ ID NO: 1944775 - RNA, 16 nt, Human herpesvirus 4 [Epstein-Barr virus]
ggcgcuguuauggcca

SEQ ID NO: 1944776 - RNA, 20 nt, Human herpesvirus 4 [Epstein-Barr virus]
gaguaaggccgcugccaggc

SEQ ID NO: 1944777 - RNA, 23 nt, Human herpesvirus 4 [Epstein-Barr virus]
agaucagaaaauaaaaagaaugu

SEQ ID NO: 1944778 - RNA, 19 nt, Human herpesvirus 4 [Epstein-Barr virus]
ugcugcuagccgcccuggc

SEQ ID NO: 1944779 - RNA, 15 nt, Human herpesvirus 4 [Epstein-Barr virus]
cguccaccuggccac

SEQ ID NO: 1944780 - RNA, 23 nt, Human herpesvirus 4 [Epstein-Barr virus]
ucagccagggugaccuggcucag

SEQ ID NO: 1944781 - RNA, 14 nt, Human herpesvirus 4 [Epstein-Barr virus]
accuacaccacccc

SEQ ID NO: 1944782 - RNA, 19 nt, Human herpesvirus 4 [Epstein-Barr virus]
ggccccccgcaccagggcc

SEQ ID NO: 1944783 - RNA, 18 nt, Human herpesvirus 4 [Epstein-Barr virus]
acguuggcuucugcugcu

SEQ ID NO: 1944784 - RNA, 17 nt, Human herpesvirus 4 [Epstein-Barr virus]
ccgggcccagcccuccu

SEQ ID NO: 1944785 - RNA, 21 nt, Human herpesvirus 4 [Epstein-Barr virus]
acugcagugggccucucuggc

SEQ ID NO: 1944786 - RNA, 20 nt, Human herpesvirus 4 [Epstein-Barr virus]
ggguccaagguugugcugua

SEQ ID NO: 1944787 - RNA, 21 nt, Human herpesvirus 4 [Epstein-Barr virus]
gaccggaucgaaggagagcug

SEQ ID NO: 1944788 - RNA, 14 nt, Human herpesvirus 4 [Epstein-Barr virus]
cucgagagaggccu

SEQ ID NO: 1944789 - RNA, 16 nt, Human herpesvirus 4 [Epstein-Barr virus]
acauuggcagcagcuc

SEQ ID NO: 1944790 - RNA, 20 nt, Human herpesvirus 4 [Epstein-Barr virus]
cagugggcuucgggggccug

SEQ ID NO: 1944791 - RNA, 12 nt, Human herpesvirus 4 [Epstein-Barr virus]
cuucugcugcug

SEQ ID NO: 1944792 - RNA, 23 nt, Human herpesvirus 4 [Epstein-Barr virus]
ggaacacggcaccgucagccaca

SEQ ID NO: 1944793 - RNA, 23 nt, Human herpesvirus 4 [Epstein-Barr virus]
ccccuguccacugccccgguccc

SEQ ID NO: 1944794 - RNA, 14 nt, Human herpesvirus 4 [Epstein-Barr virus]
uccgagaggauggc

SEQ ID NO: 1944795 - RNA, 22 nt, Human herpesvirus 4 [Epstein-Barr virus]
aucccaauucacaucucaggga

SEQ ID NO: 1944796 - RNA, 12 nt, Human herpesvirus 4 [Epstein-Barr virus]
aguuaccuucuu

SEQ ID NO: 1944797 - RNA, 19 nt, Human herpesvirus 4 [Epstein-Barr virus]
acguggcuuccagagaggc

SEQ ID NO: 1944798 - RNA, 14 nt, Human herpesvirus 4 [Epstein-Barr virus]
uuuggcuugcucca

SEQ ID NO: 1944799 - RNA, 19 nt, Human herpesvirus 4 [Epstein-Barr virus]
ucccauguaagccugccuc

SEQ ID NO: 1944800 - RNA, 20 nt, Human herpesvirus 4 [Epstein-Barr virus]
gacggcgcuugcgucugccc

SEQ ID NO: 1944801 - RNA, 20 nt, Human herpesvirus 4 [Epstein-Barr virus]
acugcgguugucacuuucuu

SEQ ID NO: 1944802 - RNA, 12 nt, Human herpesvirus 4 [Epstein-Barr virus]
gugagcccaccu

SEQ ID NO: 1944803 - RNA, 13 nt, Human herpesvirus 4 [Epstein-Barr virus]
auucuccugccug

SEQ ID NO: 1944804 - RNA, 20 nt, Human herpesvirus 4 [Epstein-Barr virus]
gucacaaccucacugucauu

SEQ ID NO: 1944805 - RNA, 17 nt, Human herpesvirus 4 [Epstein-Barr virus]
ggacaggugccagaugu

SEQ ID NO: 1944806 - RNA, 18 nt, Human herpesvirus 4 [Epstein-Barr virus]
cacuuccacagcaauggc

SEQ ID NO: 1944807 - RNA, 12 nt, Human herpesvirus 4 [Epstein-Barr virus]
cagccaccuccc

SEQ ID NO: 1944808 - RNA, 23 nt, Human herpesvirus 4 [Epstein-Barr virus]
cuucugcugcugcuggucauggc

SEQ ID NO: 1944809 - RNA, 17 nt, Human herpesvirus 4 [Epstein-Barr virus]
acacuccauuaauucca

SEQ ID NO: 1944810 - RNA, 19 nt, Human herpesvirus 4 [Epstein-Barr virus]
ucucagggacaacagguca

SEQ ID NO: 1944811 - RNA, 23 nt, Human herpesvirus 4 [Epstein-Barr virus]
acuggaacuguacuaaauuugcu

SEQ ID NO: 1944812 - RNA, 20 nt, Human herpesvirus 4 [Epstein-Barr virus]
agcuggaggccauccuccuu

SEQ ID NO: 1944813 - RNA, 21 nt, Human herpesvirus 4 [Epstein-Barr virus]
gauuaggagcagggcccagug

SEQ ID NO: 1944814 - RNA, 16 nt, Human herpesvirus 4 [Epstein-Barr virus]
aggcccaacagcaccg

SEQ ID NO: 1944815 - RNA, 14 nt, Human herpesvirus 4 [Epstein-Barr virus]
gcuggcaguccuug

SEQ ID NO: 1944816 - RNA, 23 nt, Human herpesvirus 4 [Epstein-Barr virus]
gugguuuccaugacgcugcugcu

SEQ ID NO: 1944817 - RNA, 22 nt, Human herpesvirus 4 [Epstein-Barr virus]
cugcgaugagggccuuccagag

SEQ ID NO: 1944818 - RNA, 14 nt, Human herpesvirus 4 [Epstein-Barr virus]
gguacgauggcgga

SEQ ID NO: 1944819 - RNA, 14 nt, Human herpesvirus 4 [Epstein-Barr virus]
cgccaggaccugga

SEQ ID NO: 1944820 - RNA, 14 nt, Human herpesvirus 4 [Epstein-Barr virus]
uaugaaaaugugua

SEQ ID NO: 1944821 - RNA, 22 nt, Human herpesvirus 4 [Epstein-Barr virus]
acaaucuugugaaccagaaaga

SEQ ID NO: 1944822 - RNA, 16 nt, Human herpesvirus 4 [Epstein-Barr virus]
gaagaguacgugcaga

SEQ ID NO: 1944823 - RNA, 23 nt, Human herpesvirus 4 [Epstein-Barr virus]
ccuucugcugcugcuggucaugg

SEQ ID NO: 1944824 - RNA, 19 nt, Human herpesvirus 4 [Epstein-Barr virus]
uguagccacccgucccggg

SEQ ID NO: 1944825 - RNA, 17 nt, Human herpesvirus 4 [Epstein-Barr virus]
auugggugaccacugag

SEQ ID NO: 1944826 - RNA, 16 nt, Human herpesvirus 4 [Epstein-Barr virus]
gucagcacagccagag

SEQ ID NO: 1944827 - RNA, 22 nt, Human herpesvirus 4 [Epstein-Barr virus]
ggucgcuagauggcgcggguga

SEQ ID NO: 1944828 - RNA, 12 nt, Human herpesvirus 4 [Epstein-Barr virus]
cucuguuccuuc

SEQ ID NO: 1944829 - RNA, 22 nt, Human herpesvirus 4 [Epstein-Barr virus]
agcccaagaagaagcccaccua

SEQ ID NO: 1944830 - RNA, 16 nt, Human herpesvirus 4 [Epstein-Barr virus]
ucacuuucuuugcaau

SEQ ID NO: 1944831 - RNA, 16 nt, Human herpesvirus 4 [Epstein-Barr virus]
ccaagcggcacagauu

SEQ ID NO: 1944832 - RNA, 21 nt, Human herpesvirus 4 [Epstein-Barr virus]
gaacacggagaucucagaauu

SEQ ID NO: 1944833 - RNA, 13 nt, Human herpesvirus 4 [Epstein-Barr virus]
ggugggcugcuga

SEQ ID NO: 1944834 - RNA, 18 nt, Human herpesvirus 4 [Epstein-Barr virus]
gugcugcguugggaacug

SEQ ID NO: 1944835 - RNA, 21 nt, Human herpesvirus 4 [Epstein-Barr virus]
ccagcccccucccgccccugu

SEQ ID NO: 1944836 - RNA, 20 nt, Human herpesvirus 4 [Epstein-Barr virus]
ccugaccgaauggggcagug

SEQ ID NO: 1944837 - RNA, 16 nt, Human herpesvirus 4 [Epstein-Barr virus]
gaugugcccaagccug

SEQ ID NO: 1944838 - RNA, 14 nt, Human herpesvirus 4 [Epstein-Barr virus]
cuggcacacacucc

SEQ ID NO: 1944839 - RNA, 10 nt, Human herpesvirus 4 [Epstein-Barr virus]
aggggcggca

SEQ ID NO: 1944840 - RNA, 19 nt, Human herpesvirus 4 [Epstein-Barr virus]
ugggaagcucagcaguugu

SEQ ID NO: 1944841 - RNA, 18 nt, Human herpesvirus 4 [Epstein-Barr virus]
aaauuuagcacgucccaa

SEQ ID NO: 1944842 - RNA, 22 nt, Human herpesvirus 4 [Epstein-Barr virus]
auggagagauuucauccucaga

SEQ ID NO: 1944843 - RNA, 17 nt, Human herpesvirus 4 [Epstein-Barr virus]
augcuugugcuccugau

SEQ ID NO: 1944844 - RNA, 13 nt, Human herpesvirus 4 [Epstein-Barr virus]
auggguccucaua

SEQ ID NO: 1944845 - RNA, 20 nt, Human herpesvirus 4 [Epstein-Barr virus]
cauuagcccagccgcaaaua

SEQ ID NO: 1944846 - RNA, 15 nt, Human herpesvirus 4 [Epstein-Barr virus]
ccccagaagccccca

SEQ ID NO: 1944847 - RNA, 20 nt, Human herpesvirus 4 [Epstein-Barr virus]
ccccggagcccugcccuccu

SEQ ID NO: 1944848 - RNA, 15 nt, Human herpesvirus 4 [Epstein-Barr virus]
ucauauguaugccuu

SEQ ID NO: 1944849 - RNA, 11 nt, Human herpesvirus 4 [Epstein-Barr virus]
gggcugccccg

SEQ ID NO: 1944850 - RNA, 16 nt, Human herpesvirus 4 [Epstein-Barr virus]
ccgccagcgccuccuc

SEQ ID NO: 1944851 - RNA, 23 nt, Human herpesvirus 4 [Epstein-Barr virus]
ccuagaaacugugccauggugcc

SEQ ID NO: 1944852 - RNA, 16 nt, Human herpesvirus 4 [Epstein-Barr virus]
agacguggguccccuc

SEQ ID NO: 1944853 - RNA, 17 nt, Human herpesvirus 4 [Epstein-Barr virus]
agaagugugucccccuc

SEQ ID NO: 1944854 - RNA, 15 nt, Human herpesvirus 4 [Epstein-Barr virus]
acgcagaaugugcag

SEQ ID NO: 1944855 - RNA, 16 nt, Human herpesvirus 4 [Epstein-Barr virus]
aggucaggucccccuc

SEQ ID NO: 1944856 - RNA, 20 nt, Human herpesvirus 4 [Epstein-Barr virus]
agccugauauugucccccua

SEQ ID NO: 1944857 - RNA, 14 nt, Human herpesvirus 4 [Epstein-Barr virus]
agccucugccacaa

SEQ ID NO: 1944858 - RNA, 18 nt, Human herpesvirus 4 [Epstein-Barr virus]
agccccgcccuccccauc

SEQ ID NO: 1944859 - RNA, 14 nt, Human herpesvirus 4 [Epstein-Barr virus]
agcccacuccccuc

SEQ ID NO: 1944860 - RNA, 14 nt, Human herpesvirus 4 [Epstein-Barr virus]
caguggcugccccg

SEQ ID NO: 1944861 - RNA, 21 nt, Human herpesvirus 4 [Epstein-Barr virus]
cgccucagggaucguggacuc

SEQ ID NO: 1944862 - RNA, 21 nt, Human herpesvirus 4 [Epstein-Barr virus]
cgccacccucccccugccccg

SEQ ID NO: 1944863 - RNA, 19 nt, Human herpesvirus 4 [Epstein-Barr virus]
gcccucauuccacggcccg

SEQ ID NO: 1944864 - RNA, 21 nt, Human herpesvirus 4 [Epstein-Barr virus]
gcccuccucugggccgcccgg

SEQ ID NO: 1944865 - RNA, 19 nt, Human herpesvirus 4 [Epstein-Barr virus]
gcagaggccugcaccaguu

SEQ ID NO: 1944866 - RNA, 12 nt, Human herpesvirus 4 [Epstein-Barr virus]
cugcgccuccug

SEQ ID NO: 1944867 - RNA, 15 nt, Human herpesvirus 4 [Epstein-Barr virus]
cuguccacugccccg

SEQ ID NO: 1944868 - RNA, 23 nt, Human herpesvirus 4 [Epstein-Barr virus]
cugccucgaguaggugccuccag

SEQ ID NO: 1944869 - RNA, 17 nt, Human herpesvirus 4 [Epstein-Barr virus]
ucgugcuaagcguccug

SEQ ID NO: 1944870 - RNA, 14 nt, Human herpesvirus 4 [Epstein-Barr virus]
ucguccgccuacug

SEQ ID NO: 1944871 - RNA, 15 nt, Human herpesvirus 4 [Epstein-Barr virus]
uccugccugccucug

SEQ ID NO: 1944872 - RNA, 14 nt, Human herpesvirus 4 [Epstein-Barr virus]
uccccggccucccg

SEQ ID NO: 1944873 - RNA, 23 nt, Human herpesvirus 4 [Epstein-Barr virus]
ucccgagcggccuccgccgucca

SEQ ID NO: 1944874 - RNA, 15 nt, Human herpesvirus 4 [Epstein-Barr virus]
gagcuggacgagguc

SEQ ID NO: 1944875 - RNA, 17 nt, Human herpesvirus 4 [Epstein-Barr virus]
acuggcaacuccucuua

SEQ ID NO: 1944876 - RNA, 17 nt, Human herpesvirus 4 [Epstein-Barr virus]
uugucacuuucuuugca

SEQ ID NO: 1944877 - RNA, 19 nt, Human herpesvirus 4 [Epstein-Barr virus]
uugccggccaccuuugcua

SEQ ID NO: 1944878 - RNA, 20 nt, Human herpesvirus 4 [Epstein-Barr virus]
uugcucucagcacuuugcca

SEQ ID NO: 1944879 - RNA, 15 nt, Human herpesvirus 4 [Epstein-Barr virus]
uugcucucguugcca

SEQ ID NO: 1944880 - RNA, 19 nt, Human herpesvirus 4 [Epstein-Barr virus]
uuccucauuggcuuugccc

SEQ ID NO: 1944881 - RNA, 15 nt, Human herpesvirus 4 [Epstein-Barr virus]
uggcucucuucgcca

SEQ ID NO: 1944882 - RNA, 19 nt, Human herpesvirus 4 [Epstein-Barr virus]
guggacucggccacacagu

SEQ ID NO: 1944883 - RNA, 17 nt, Human herpesvirus 4 [Epstein-Barr virus]
uacguguccauguacaa

SEQ ID NO: 1944884 - RNA, 15 nt, Human herpesvirus 4 [Epstein-Barr virus]
uaccgagauguacau

SEQ ID NO: 1944885 - RNA, 19 nt, Human herpesvirus 4 [Epstein-Barr virus]
uaggcacuggacacacaug

SEQ ID NO: 1944886 - RNA, 23 nt, Human herpesvirus 4 [Epstein-Barr virus]
ucuaccuggucaagagcuuccug

SEQ ID NO: 1944887 - RNA, 14 nt, Human herpesvirus 4 [Epstein-Barr virus]
ucuccaggcuccug

SEQ ID NO: 1944888 - RNA, 18 nt, Human herpesvirus 4 [Epstein-Barr virus]
ucugaaaacugccuccuc

SEQ ID NO: 1944889 - RNA, 22 nt, Human herpesvirus 4 [Epstein-Barr virus]
ucugccccucagccugcuccug

SEQ ID NO: 1944890 - RNA, 17 nt, Human herpesvirus 4 [Epstein-Barr virus]
ugccuggcgcuuugcua

SEQ ID NO: 1944891 - RNA, 12 nt, Human herpesvirus 4 [Epstein-Barr virus]
gcuccuuugccu

SEQ ID NO: 1944892 - RNA, 16 nt, Human herpesvirus 4 [Epstein-Barr virus]
gccugcuucacgccuc

SEQ ID NO: 1944893 - RNA, 17 nt, Human herpesvirus 4 [Epstein-Barr virus]
gccuccggccgccccgg

SEQ ID NO: 1944894 - RNA, 21 nt, Human herpesvirus 4 [Epstein-Barr virus]
ggaacacccccaccccaccga

SEQ ID NO: 1944895 - RNA, 15 nt, Human herpesvirus 4 [Epstein-Barr virus]
cugcacggcccucca

SEQ ID NO: 1944896 - RNA, 13 nt, Human herpesvirus 4 [Epstein-Barr virus]
cuuucuaugccug

SEQ ID NO: 1944897 - RNA, 19 nt, Human herpesvirus 4 [Epstein-Barr virus]
gacgggcucccucccccuc

SEQ ID NO: 1944898 - RNA, 15 nt, Human herpesvirus 4 [Epstein-Barr virus]
aggcccagcccccuc

SEQ ID NO: 1944899 - RNA, 20 nt, Human herpesvirus 4 [Epstein-Barr virus]
acagagccgugucuccugac

SEQ ID NO: 1944900 - RNA, 20 nt, Human herpesvirus 4 [Epstein-Barr virus]
acacuugugguucuccugau

SEQ ID NO: 1944901 - RNA, 13 nt, Human herpesvirus 4 [Epstein-Barr virus]
ccuccgccgccug

SEQ ID NO: 1944902 - RNA, 13 nt, Human herpesvirus 4 [Epstein-Barr virus]
ccucccgccccug

SEQ ID NO: 1944903 - RNA, 23 nt, Human herpesvirus 4 [Epstein-Barr virus]
cgaggcugagaacugacgcucca

SEQ ID NO: 1944904 - RNA, 15 nt, Human herpesvirus 4 [Epstein-Barr virus]
ccccgggcgccccca

SEQ ID NO: 1944905 - RNA, 22 nt, Human herpesvirus 4 [Epstein-Barr virus]
cucagucuuugcaauuugccua

SEQ ID NO: 1944906 - RNA, 14 nt, Human herpesvirus 4 [Epstein-Barr virus]
cucauaauggugcc

SEQ ID NO: 1944907 - RNA, 13 nt, Human herpesvirus 4 [Epstein-Barr virus]
gagcccccaccgc

SEQ ID NO: 1944908 - RNA, 13 nt, Human herpesvirus 4 [Epstein-Barr virus]
gagcgcccaccga

SEQ ID NO: 1944909 - RNA, 15 nt, Human herpesvirus 4 [Epstein-Barr virus]
gcgcgggucccccua

SEQ ID NO: 1944910 - RNA, 19 nt, Human herpesvirus 4 [Epstein-Barr virus]
uccuaggcacggccucgug

SEQ ID NO: 1944911 - RNA, 18 nt, Human herpesvirus 4 [Epstein-Barr virus]
ucgcccccucugccuccg

SEQ ID NO: 1944912 - RNA, 21 nt, Human herpesvirus 4 [Epstein-Barr virus]
uggaggggggcggcguggagc

SEQ ID NO: 1944913 - RNA, 14 nt, Human herpesvirus 4 [Epstein-Barr virus]
gccccggucccccc

SEQ ID NO: 1944914 - RNA, 18 nt, Human herpesvirus 4 [Epstein-Barr virus]
gccccgaaagcggcccag

SEQ ID NO: 1944915 - RNA, 19 nt, Human herpesvirus 4 [Epstein-Barr virus]
cgguggguggaacgcucca

SEQ ID NO: 1944916 - RNA, 20 nt, Human herpesvirus 4 [Epstein-Barr virus]
cggcgcuugcgucugccccc

SEQ ID NO: 1944917 - RNA, 20 nt, Human herpesvirus 4 [Epstein-Barr virus]
uacagcagcuggauguacag

SEQ ID NO: 1944918 - RNA, 13 nt, Human herpesvirus 4 [Epstein-Barr virus]
uaaccuaugccug

SEQ ID NO: 1944919 - RNA, 14 nt, Human herpesvirus 4 [Epstein-Barr virus]
ugcaguauguacag

SEQ ID NO: 1944920 - RNA, 14 nt, Human herpesvirus 4 [Epstein-Barr virus]
ugacauauguacaa

SEQ ID NO: 1944921 - RNA, 17 nt, Human herpesvirus 4 [Epstein-Barr virus]
ugcugccagagccucug

SEQ ID NO: 1944922 - RNA, 20 nt, Human herpesvirus 4 [Epstein-Barr virus]
ggucgugguuuucugccccu

SEQ ID NO: 1944923 - RNA, 20 nt, Human herpesvirus 4 [Epstein-Barr virus]
ggucgcccccucugccuccg

SEQ ID NO: 1944924 - RNA, 17 nt, Human herpesvirus 4 [Epstein-Barr virus]
gcguccucuaccugguc

SEQ ID NO: 1944925 - RNA, 17 nt, Human herpesvirus 4 [Epstein-Barr virus]
aacccaauucccgccuc

SEQ ID NO: 1944926 - RNA, 16 nt, Human herpesvirus 4 [Epstein-Barr virus]
aaccugauucccccug

SEQ ID NO: 1944927 - RNA, 18 nt, Human herpesvirus 4 [Epstein-Barr virus]
acaaaggaaacugcugac

SEQ ID NO: 1944928 - RNA, 22 nt, Human herpesvirus 4 [Epstein-Barr virus]
accccacggggugcucccccug

SEQ ID NO: 1944929 - RNA, 12 nt, Human herpesvirus 4 [Epstein-Barr virus]
acccucccccug

SEQ ID NO: 1944930 - RNA, 17 nt, Human herpesvirus 4 [Epstein-Barr virus]
aggcacggucgccccuc

SEQ ID NO: 1944931 - RNA, 20 nt, Human herpesvirus 4 [Epstein-Barr virus]
aguggccggggccguggagc

SEQ ID NO: 1944932 - RNA, 21 nt, Human herpesvirus 4 [Epstein-Barr virus]
cauccaucaacuucagcucca

SEQ ID NO: 1944933 - RNA, 21 nt, Human herpesvirus 4 [Epstein-Barr virus]
auuagauucacguuccucauc

SEQ ID NO: 1944934 - RNA, 15 nt, Human herpesvirus 4 [Epstein-Barr virus]
auaagaaacacgcug

SEQ ID NO: 1944935 - RNA, 21 nt, Human herpesvirus 4 [Epstein-Barr virus]
ggccuuggggguggugggcuc

SEQ ID NO: 1944936 - RNA, 14 nt, Human
aaaaacacaaaagu

SEQ ID NO: 1944937 - RNA, 11 nt, Human
aaaaacaaaag

SEQ ID NO: 1944938 - RNA, 12 nt, Human
aaaaacaaagag

SEQ ID NO: 1944939 - RNA, 15 nt, Human
aaaaacaaauaauau

SEQ ID NO: 1944940 - RNA, 11 nt, Human
aaaaacagcuu

SEQ ID NO: 1944941 - RNA, 12 nt, Human
aaaacacauuuu

SEQ ID NO: 1944942 - RNA, 17 nt, Human
aaaacaauaggaugggc

SEQ ID NO: 1944943 - RNA, 18 nt, Human
aaaacaauaggaugggcu

SEQ ID NO: 1944944 - RNA, 14 nt, Human
aaaaauuuguuuaa

SEQ ID NO: 1944945 - RNA, 16 nt, Human
aaaaauuuguuuaaag

SEQ ID NO: 1944946 - RNA, 21 nt, Human
aaaaauuuacuacaauaugua

SEQ ID NO: 1944947 - RNA, 13 nt, Human
aaaacaaauaaua

SEQ ID NO: 1944948 - RNA, 16 nt, Human
aaaacaaauaauaucu

SEQ ID NO: 1944949 - RNA, 13 nt, Human
aaaacaaaaggca

SEQ ID NO: 1944950 - RNA, 13 nt, Human
aaaacaaaaccaa

SEQ ID NO: 1944951 - RNA, 13 nt, Human
aaaaacugauuuu

SEQ ID NO: 1944952 - RNA, 14 nt, Human
aaaaacauggccuu

SEQ ID NO: 1944953 - RNA, 13 nt, Human
aaaaacauguaug

SEQ ID NO: 1944954 - RNA, 16 nt, Human
aaaaacauguaugugc

SEQ ID NO: 1944955 - RNA, 20 nt, Human
aaaaacauguaugugcauuu

SEQ ID NO: 1944956 - RNA, 19 nt, Human
aaaaacuuucuacucauuu

SEQ ID NO: 1944957 - RNA, 18 nt, Human
aaaaacuuucuacucauu

SEQ ID NO: 1944958 - RNA, 15 nt, Human
aaaaacugauuuuuu

SEQ ID NO: 1944959 - RNA, 19 nt, Human
aaaaauucaauaguaauau

SEQ ID NO: 1944960 - RNA, 17 nt, Human
aaaaauucaauaguaau

SEQ ID NO: 1944961 - RNA, 18 nt, Human
aaaaauucaauaguaaua

SEQ ID NO: 1944962 - RNA, 17 nt, Human
aaaaagauaccuuaaaa

SEQ ID NO: 1944963 - RNA, 14 nt, Human
aaaaagacagggcu

SEQ ID NO: 1944964 - RNA, 12 nt, Human
aaaaagaggcua

SEQ ID NO: 1944965 - RNA, 15 nt, Human
aggaaaaacugauuu

SEQ ID NO: 1944966 - RNA, 13 nt, Human
aggaaaaacugau

SEQ ID NO: 1944967 - RNA, 15 nt, Human
agcuuuucccuuuuu

SEQ ID NO: 1944968 - RNA, 16 nt, Human
agcuuuucccuucuuu

SEQ ID NO: 1944969 - RNA, 21 nt, Human
agcuuuuaugugaaacauguu

SEQ ID NO: 1944970 - RNA, 13 nt, Human
agcuuuucccuuc

SEQ ID NO: 1944971 - RNA, 14 nt, Human
agcuuuucauugcu

SEQ ID NO: 1944972 - RNA, 23 nt, Human
agcuucuguugcugccucaugcu

SEQ ID NO: 1944973 - RNA, 20 nt, Human
aggaaauggcuguggagugu

SEQ ID NO: 1944974 - RNA, 21 nt, Human
aggaaaugcugacccaugggc

SEQ ID NO: 1944975 - RNA, 22 nt, Human
aggaaaugcugacccaugggca

SEQ ID NO: 1944976 - RNA, 23 nt, Human
aggaaaugcugacccaugggcag

SEQ ID NO: 1944977 - RNA, 22 nt, Human
aggaacguaaucguguccccua

SEQ ID NO: 1944978 - RNA, 20 nt, Human
aggaaccuuccuuccugcuu

SEQ ID NO: 1944979 - RNA, 22 nt, Human
aggaaccuuccuuccugcuuga

SEQ ID NO: 1944980 - RNA, 13 nt, Human
aggaaccuguccu

SEQ ID NO: 1944981 - RNA, 14 nt, Human
aggaaccuuccuuc

SEQ ID NO: 1944982 - RNA, 19 nt, Human
aggaaccuuccuuccugcu

SEQ ID NO: 1944983 - RNA, 15 nt, Human
aggaaauccagggug

SEQ ID NO: 1944984 - RNA, 17 nt, Human
aggaaauccaggguggu

SEQ ID NO: 1944985 - RNA, 12 nt, Human
aggaaaaagaac

SEQ ID NO: 1944986 - RNA, 16 nt, Human
aggaaaaagaacuucc

SEQ ID NO: 1944987 - RNA, 13 nt, Human
aggaaaaauaugu

SEQ ID NO: 1944988 - RNA, 14 nt, Human
aggaaaaauaugug

SEQ ID NO: 1944989 - RNA, 15 nt, Human
aggaaaaauauguga

SEQ ID NO: 1944990 - RNA, 16 nt, Human
aggaaaaauaugugaa

SEQ ID NO: 1944991 - RNA, 17 nt, Human
aggaaaaauaugugaag

SEQ ID NO: 1944992 - RNA, 20 nt, Human
agcuucuguugcugccucau

SEQ ID NO: 1944993 - RNA, 21 nt, Human
agcuucuguugcugccucaug

SEQ ID NO: 1944994 - RNA, 22 nt, Human
agcuucuguugcugccucaugc

SEQ ID NO: 1944995 - RNA, 16 nt, Human
agcuucauacuucaug

SEQ ID NO: 1944996 - RNA, 13 nt, Human
agcuucacuucug

SEQ ID NO: 1944997 - RNA, 14 nt, Human
agcuucacuucuga

SEQ ID NO: 1944998 - RNA, 23 nt, Human
agcuucacuucugacucuucccc

SEQ ID NO: 1944999 - RNA, 13 nt, Human
agcuguaaggcau

SEQ ID NO: 1945000 - RNA, 17 nt, Human
agcuguaaggcaugaag

SEQ ID NO: 1945001 - RNA, 18 nt, Human
agcuguaaggcaugaagg

SEQ ID NO: 1945002 - RNA, 19 nt, Human
agcuguaaggcaugaagga

SEQ ID NO: 1945003 - RNA, 17 nt, Human
agcugggugucaagagg

SEQ ID NO: 1945004 - RNA, 22 nt, Human
agcugggugucaagagggucug

SEQ ID NO: 1945005 - RNA, 21 nt, Human
agcuggucccacucaguccau

SEQ ID NO: 1945006 - RNA, 15 nt, Human
agcugaauugagccu

SEQ ID NO: 1945007 - RNA, 20 nt, Human
agcugaauugagccuaaaaa

SEQ ID NO: 1945008 - RNA, 21 nt, Human
agcugaauugagccuaaaaau

SEQ ID NO: 1945009 - RNA, 20 nt, Human
aggauucacaccccaccugc

SEQ ID NO: 1945010 - RNA, 21 nt, Human
aggauucacaccccaccugcg

SEQ ID NO: 1945011 - RNA, 22 nt, Human
aggauucacaccccaccugcgc

SEQ ID NO: 1945012 - RNA, 22 nt, Human
aggauucucaccagcugugucc

SEQ ID NO: 1945013 - RNA, 18 nt, Human
aggauucucaccagcugu

SEQ ID NO: 1945014 - RNA, 20 nt, Human
aggauucucaccagcugugu

SEQ ID NO: 1945015 - RNA, 12 nt, Human
aggauucuuccu

SEQ ID NO: 1945016 - RNA, 16 nt, Human
aggauucuuccucccu

SEQ ID NO: 1945017 - RNA, 17 nt, Human
aggaggggauagagaga

SEQ ID NO: 1945018 - RNA, 20 nt, Human
aggagaggugauaaugaaug

SEQ ID NO: 1945019 - RNA, 17 nt, Human
aggauguugaaaaaguu

SEQ ID NO: 1945020 - RNA, 18 nt, Human
aggauucacaccccaccu

SEQ ID NO: 1945021 - RNA, 19 nt, Human
aggauucacaccccaccug

SEQ ID NO: 1945022 - RNA, 14 nt, Human
aggauguugaaaaa

SEQ ID NO: 1945023 - RNA, 20 nt, Human
aggauguucugggacacagu

SEQ ID NO: 1945024 - RNA, 14 nt, Human
aggcacugcugccc

SEQ ID NO: 1945025 - RNA, 16 nt, Human
aggcacugcugcccag

SEQ ID NO: 1945026 - RNA, 22 nt, Human
aggcacugcugcccagccucca

SEQ ID NO: 1945027 - RNA, 17 nt, Human
aggcagaaggaagcagg

SEQ ID NO: 1945028 - RNA, 16 nt, Human
aggaacugcugggcuu

SEQ ID NO: 1945029 - RNA, 15 nt, Human
aggaacuacugagga

SEQ ID NO: 1945030 - RNA, 14 nt, Human
aggaccagcccacg

SEQ ID NO: 1945031 - RNA, 18 nt, Human
aggaccagcccacgcuga

SEQ ID NO: 1945032 - RNA, 18 nt, Human
aggaccagcacacucccg

SEQ ID NO: 1945033 - RNA, 12 nt, Human
aggaccagccca

SEQ ID NO: 1945034 - RNA, 13 nt, Human
aggaccagcccac

SEQ ID NO: 1945035 - RNA, 20 nt, Human
aggaccccuccaugugggcu

SEQ ID NO: 1945036 - RNA, 18 nt, Human
aggagaggggcacagggu

SEQ ID NO: 1945037 - RNA, 16 nt, Human
aggagaggggcacagg

SEQ ID NO: 1945038 - RNA, 14 nt, Human
aggagaggggcaca

SEQ ID NO: 1945039 - RNA, 15 nt, Human
aggagagcuagcagc

SEQ ID NO: 1945040 - RNA, 20 nt, Human
aggaccccugcaguuccccu

SEQ ID NO: 1945041 - RNA, 15 nt, Human
aggagaacuugcugc

SEQ ID NO: 1945042 - RNA, 16 nt, Human
aggagaacuugcugcc

SEQ ID NO: 1945043 - RNA, 17 nt, Human
aggagaacuugcugccu

SEQ ID NO: 1945044 - RNA, 18 nt, Human
aggagaacuugcugccuc

SEQ ID NO: 1945045 - RNA, 19 nt, Human
aggagaacuugcugccucg

SEQ ID NO: 1945046 - RNA, 13 nt, Human
aggagaagaaaau

SEQ ID NO: 1945047 - RNA, 20 nt, Human
aggaccucaggugagaagca

SEQ ID NO: 1945048 - RNA, 14 nt, Human
aggaccucagguga

SEQ ID NO: 1945049 - RNA, 17 nt, Human
aggacccggaggggccu

SEQ ID NO: 1945050 - RNA, 18 nt, Human
aggcugcagccaggccac

SEQ ID NO: 1945051 - RNA, 14 nt, Human
aggcugagugcagg

SEQ ID NO: 1945052 - RNA, 15 nt, Human
aggcugagugcaggc

SEQ ID NO: 1945053 - RNA, 17 nt, Human
aggcugagugcaggccc

SEQ ID NO: 1945054 - RNA, 18 nt, Human
aggcugagugcaggccca

SEQ ID NO: 1945055 - RNA, 19 nt, Human
aggcugagugcaggcccac

SEQ ID NO: 1945056 - RNA, 20 nt, Human
aggcugagugcaggcccacc

SEQ ID NO: 1945057 - RNA, 21 nt, Human
aggcugagugcaggcccaccc

SEQ ID NO: 1945058 - RNA, 23 nt, Human
aggcugagugcaggcccacccug

SEQ ID NO: 1945059 - RNA, 24 nt, Human
aggcugagugcaggcccacccugc

SEQ ID NO: 1945060 - RNA, 20 nt, Human
aggcugaacuuguuuucugg

SEQ ID NO: 1945061 - RNA, 21 nt, Human
aggcugaacuuguuuucuggg

SEQ ID NO: 1945062 - RNA, 14 nt, Human
aggcucuucuccuu

SEQ ID NO: 1945063 - RNA, 21 nt, Human
aggcuauggggauagaugugu

SEQ ID NO: 1945064 - RNA, 22 nt, Human
aggcuauggggauagaugugug

SEQ ID NO: 1945065 - RNA, 19 nt, Human
aggcuauggggauagaugu

SEQ ID NO: 1945066 - RNA, 16 nt, Human
aggcuaugagugggau

SEQ ID NO: 1945067 - RNA, 23 nt, Human
aggcuagugugguguuuccuggc

SEQ ID NO: 1945068 - RNA, 20 nt, Human
agggacagaggggguggccu

SEQ ID NO: 1945069 - RNA, 13 nt, Human
agggacagagggg

SEQ ID NO: 1945070 - RNA, 12 nt, Human
agggacagaggg

SEQ ID NO: 1945071 - RNA, 17 nt, Human
agggacgcuacccggga

SEQ ID NO: 1945072 - RNA, 21 nt, Human
agggacgcuacccgggaaggg

SEQ ID NO: 1945073 - RNA, 18 nt, Human
aggcugccucucccauca

SEQ ID NO: 1945074 - RNA, 16 nt, Human
aggcugucuguuguau

SEQ ID NO: 1945075 - RNA, 14 nt, Human
aggggcagccugcc

SEQ ID NO: 1945076 - RNA, 18 nt, Human
aggggcagccugccuugc

SEQ ID NO: 1945077 - RNA, 12 nt, Human
aggggcccugca

SEQ ID NO: 1945078 - RNA, 13 nt, Human
aggggcagccugc

SEQ ID NO: 1945079 - RNA, 15 nt, Human
aggggcagaggaggc

SEQ ID NO: 1945080 - RNA, 15 nt, Human
aggggcacagggucu

SEQ ID NO: 1945081 - RNA, 17 nt, Human
aggggaugugugugugc

SEQ ID NO: 1945082 - RNA, 15 nt, Human
aggggauuacaguuc

SEQ ID NO: 1945083 - RNA, 21 nt, Human
aggggauagagagagaccacu

SEQ ID NO: 1945084 - RNA, 18 nt, Human
agggccuggccugagcug

SEQ ID NO: 1945085 - RNA, 16 nt, Human
agggcacagggccugg

SEQ ID NO: 1945086 - RNA, 17 nt, Human
agggcacagggccuggc

SEQ ID NO: 1945087 - RNA, 18 nt, Human
agggcacagggccuggcc

SEQ ID NO: 1945088 - RNA, 19 nt, Human
agggcgggaggauguucug

SEQ ID NO: 1945089 - RNA, 17 nt, Human
agggccuggccugagcu

SEQ ID NO: 1945090 - RNA, 16 nt, Human
agggccuggccugagc

SEQ ID NO: 1945091 - RNA, 13 nt, Human
agggcacagggcc

SEQ ID NO: 1945092 - RNA, 14 nt, Human
agggcacagggccu

SEQ ID NO: 1945093 - RNA, 15 nt, Human
agggcacagggccug

SEQ ID NO: 1945094 - RNA, 15 nt, Human
agggccuggccugag

SEQ ID NO: 1945095 - RNA, 22 nt, Human
agggcacagaaaauggaagaca

SEQ ID NO: 1945096 - RNA, 20 nt, Human
agggcacaccgggcacucag

SEQ ID NO: 1945097 - RNA, 21 nt, Human
agggcacaccgggcacucaga

SEQ ID NO: 1945098 - RNA, 17 nt, Human
agggcacaccgggcacu

SEQ ID NO: 1945099 - RNA, 16 nt, Human
agguggaagagggcug

SEQ ID NO: 1945100 - RNA, 15 nt, Human
agguggaaauaaacu

SEQ ID NO: 1945101 - RNA, 14 nt, Human
aggucgaggcagga

SEQ ID NO: 1945102 - RNA, 20 nt, Human
aggucgcuugggaauuuuau

SEQ ID NO: 1945103 - RNA, 14 nt, Human
agguccuuuagaaa

SEQ ID NO: 1945104 - RNA, 19 nt, Human
agguccugcucagcaguga

SEQ ID NO: 1945105 - RNA, 15 nt, Human
agguccuuuagaaac

SEQ ID NO: 1945106 - RNA, 16 nt, Human
aggugcugccauccag

SEQ ID NO: 1945107 - RNA, 17 nt, Human
aggugcugccauccagg

SEQ ID NO: 1945108 - RNA, 22 nt, Human
agguggcaucagugucuuucca

SEQ ID NO: 1945109 - RNA, 23 nt, Human
agguggcaucagugucuuuccac

SEQ ID NO: 1945110 - RNA, 17 nt, Human
agguggcaggugagcaa

SEQ ID NO: 1945111 - RNA, 15 nt, Human
agguuaauaaaguaa

SEQ ID NO: 1945112 - RNA, 14 nt, Human
agguuaauguucau

SEQ ID NO: 1945113 - RNA, 17 nt, Human
agguucaaagauauuuu

SEQ ID NO: 1945114 - RNA, 17 nt, Human
agguucaugcaaacuuu

SEQ ID NO: 1945115 - RNA, 13 nt, Human
agguucagcuugu

SEQ ID NO: 1945116 - RNA, 18 nt, Human
agguuccacagaggacac

SEQ ID NO: 1945117 - RNA, 17 nt, Human
agguaaggaauaccugu

SEQ ID NO: 1945118 - RNA, 17 nt, Human
agguaaucgaccugccu

SEQ ID NO: 1945119 - RNA, 18 nt, Human
agguaaucgaccugccuc

SEQ ID NO: 1945120 - RNA, 20 nt, Human
aggucccuaauaaagcugug

SEQ ID NO: 1945121 - RNA, 19 nt, Human
aggucccuaauaaagcugu

SEQ ID NO: 1945122 - RNA, 18 nt, Human
aggucccuaauaaagcug

SEQ ID NO: 1945123 - RNA, 17 nt, Human
aggucccuaauaaagcu

SEQ ID NO: 1945124 - RNA, 13 nt, Human
agauguaauuuug

SEQ ID NO: 1945125 - RNA, 21 nt, Human
agaugggagaaucacuugaac

SEQ ID NO: 1945126 - RNA, 14 nt, Human
agauguagaggaga

SEQ ID NO: 1945127 - RNA, 14 nt, Human
agauguaauuuugu

SEQ ID NO: 1945128 - RNA, 15 nt, Human
agauguaauuuugug

SEQ ID NO: 1945129 - RNA, 17 nt, Human
agauguaauuuugugua

SEQ ID NO: 1945130 - RNA, 19 nt, Human
agauguaauuuuguguaag

SEQ ID NO: 1945131 - RNA, 15 nt, Human
agauguacuauaaca

SEQ ID NO: 1945132 - RNA, 22 nt, Human
agauguacuauaacauagaauu

SEQ ID NO: 1945133 - RNA, 21 nt, Human
agcagccacauuccugaugcu

SEQ ID NO: 1945134 - RNA, 20 nt, Human
agcacuaaggugugcucuga

SEQ ID NO: 1945135 - RNA, 19 nt, Human
agcacuaaggugugcucug

SEQ ID NO: 1945136 - RNA, 12 nt, Human
agcagccagcca

SEQ ID NO: 1945137 - RNA, 21 nt, Human
agcagccagccaaacacacag

SEQ ID NO: 1945138 - RNA, 20 nt, Human
agcagucuuaugcuuccaga

SEQ ID NO: 1945139 - RNA, 22 nt, Human
agcagucuuaugcuuccagaaa

SEQ ID NO: 1945140 - RNA, 13 nt, Human
agcagucugccug

SEQ ID NO: 1945141 - RNA, 15 nt, Human
agcagucugccugga

SEQ ID NO: 1945142 - RNA, 19 nt, Human
agcagucuuaugcuuccag

SEQ ID NO: 1945143 - RNA, 16 nt, Human
agcagugagagcagau

SEQ ID NO: 1945144 - RNA, 15 nt, Human
agcagugauauucuu

SEQ ID NO: 1945145 - RNA, 19 nt, Human
agcagugauauucuuuguu

SEQ ID NO: 1945146 - RNA, 17 nt, Human
agccauucugacucaua

SEQ ID NO: 1945147 - RNA, 17 nt, Human
agcaugccaauuucucu

SEQ ID NO: 1945148 - RNA, 23 nt, Human
agccaaggccaaaggaagcacau

SEQ ID NO: 1945149 - RNA, 22 nt, Human
agccaaggccaaaggaagcaca

SEQ ID NO: 1945150 - RNA, 13 nt, Human
agccagaggucug

SEQ ID NO: 1945151 - RNA, 20 nt, Human
agccagaggagagaggaccc

SEQ ID NO: 1945152 - RNA, 20 nt, Human
agcaugauuuauacucauuu

SEQ ID NO: 1945153 - RNA, 23 nt, Human
agcaugaggcagcacgugcacaa

SEQ ID NO: 1945154 - RNA, 20 nt, Human
agcaugagagggaugaggca

SEQ ID NO: 1945155 - RNA, 12 nt, Human
agcaugccugga

SEQ ID NO: 1945156 - RNA, 14 nt, Human
agcaugcacaaauu

SEQ ID NO: 1945157 - RNA, 19 nt, Human
agccaaagcuaggccuggc

SEQ ID NO: 1945158 - RNA, 20 nt, Human
agccaaagcuaggccuggcc

SEQ ID NO: 1945159 - RNA, 23 nt, Human
agccaaagcuaggccuggccaga

SEQ ID NO: 1945160 - RNA, 16 nt, Human
agcaugaacagugcac

SEQ ID NO: 1945161 - RNA, 21 nt, Human
agcagugauauucuuuguuaa

SEQ ID NO: 1945162 - RNA, 16 nt, Human
agcaguugcugguaaa

SEQ ID NO: 1945163 - RNA, 17 nt, Human
agcaguugcugguaaaa

SEQ ID NO: 1945164 - RNA, 20 nt, Human
agcaguugcugguaaaauga

SEQ ID NO: 1945165 - RNA, 21 nt, Human
agcaguugcugguaaaaugaa

SEQ ID NO: 1945166 - RNA, 22 nt, Human
agcaguugcugguaaaaugaag

SEQ ID NO: 1945167 - RNA, 14 nt, Human
agcaguuucaauaa

SEQ ID NO: 1945168 - RNA, 23 nt, Human
agcaguugcugguaaaaugaaga

SEQ ID NO: 1945169 - RNA, 12 nt, Human
agcaguuucaau

SEQ ID NO: 1945170 - RNA, 13 nt, Human
agcaguuucaaua

SEQ ID NO: 1945171 - RNA, 15 nt, Human
agcccaaccucuucc

SEQ ID NO: 1945172 - RNA, 16 nt, Human
agcccaaccucuuccu

SEQ ID NO: 1945173 - RNA, 11 nt, Human
agcccaaccuc

SEQ ID NO: 1945174 - RNA, 11 nt, Human
agccccauccu

SEQ ID NO: 1945175 - RNA, 20 nt, Human
agccccaucccaaacccuuc

SEQ ID NO: 1945176 - RNA, 16 nt, Human
agccccagugcccaca

SEQ ID NO: 1945177 - RNA, 23 nt, Human
agccccauaauuuuuuuuuuccu

SEQ ID NO: 1945178 - RNA, 16 nt, Human
agcccuauuucuugau

SEQ ID NO: 1945179 - RNA, 15 nt, Human
agcccugagcuuucu

SEQ ID NO: 1945180 - RNA, 17 nt, Human
agcccugaggaggccuu

SEQ ID NO: 1945181 - RNA, 19 nt, Human
agccgagaucacgccacug

SEQ ID NO: 1945182 - RNA, 20 nt, Human
agccgagaucacgccacugc

SEQ ID NO: 1945183 - RNA, 21 nt, Human
agccccacucucagaggcccc

SEQ ID NO: 1945184 - RNA, 22 nt, Human
agccccacucucagaggcccca

SEQ ID NO: 1945185 - RNA, 14 nt, Human
agccccacucucag

SEQ ID NO: 1945186 - RNA, 15 nt, Human
agccccacucucaga

SEQ ID NO: 1945187 - RNA, 16 nt, Human
agccccacucucagag

SEQ ID NO: 1945188 - RNA, 17 nt, Human
agccccacucucagagg

SEQ ID NO: 1945189 - RNA, 19 nt, Human
agccccacucucagaggcc

SEQ ID NO: 1945190 - RNA, 20 nt, Human
agccucccaaagugcuggga

SEQ ID NO: 1945191 - RNA, 18 nt, Human
agccucccgaauagcugg

SEQ ID NO: 1945192 - RNA, 19 nt, Human
agccucccgaauagcuggg

SEQ ID NO: 1945193 - RNA, 20 nt, Human
agccucccgaauagcuggga

SEQ ID NO: 1945194 - RNA, 22 nt, Human
agccucccgaauagcugggacu

SEQ ID NO: 1945195 - RNA, 17 nt, Human
agccucccgaguagcug

SEQ ID NO: 1945196 - RNA, 22 nt, Human
agccucccgaguagcugggacu

SEQ ID NO: 1945197 - RNA, 22 nt, Human
agccgcuggggccaguuggucc

SEQ ID NO: 1945198 - RNA, 14 nt, Human
agccgcuggggcca

SEQ ID NO: 1945199 - RNA, 14 nt, Human
agcccugaguuccu

SEQ ID NO: 1945200 - RNA, 18 nt, Human
agcccugaggaggccuug

SEQ ID NO: 1945201 - RNA, 22 nt, Human
agcccugagguuugaaucugac

SEQ ID NO: 1945202 - RNA, 20 nt, Human
agccgagauugcaccacugc

SEQ ID NO: 1945203 - RNA, 19 nt, Human
agccgagauugcaccacug

SEQ ID NO: 1945204 - RNA, 21 nt, Human
agccgagaucacgccacugca

SEQ ID NO: 1945205 - RNA, 18 nt, Human
agccucccaaagugcugg

SEQ ID NO: 1945206 - RNA, 19 nt, Human
agccucccaaagugcuggg

SEQ ID NO: 1945207 - RNA, 17 nt, Human
agccguaaaaacugaag

SEQ ID NO: 1945208 - RNA, 20 nt, Human
agccguaaaaacugaaguuc

SEQ ID NO: 1945209 - RNA, 16 nt, Human
agccguaaaaacugaa

SEQ ID NO: 1945210 - RNA, 13 nt, Human
agaggagaggggc

SEQ ID NO: 1945211 - RNA, 12 nt, Human
agaggagcccug

SEQ ID NO: 1945212 - RNA, 13 nt, Human
agaggagcccugc

SEQ ID NO: 1945213 - RNA, 14 nt, Human
agaggagcccugcc

SEQ ID NO: 1945214 - RNA, 15 nt, Human
agaggagcccugccu

SEQ ID NO: 1945215 - RNA, 23 nt, Human
agaggagcccugccucuccgccc

SEQ ID NO: 1945216 - RNA, 16 nt, Human
agaggggaaaagagau

SEQ ID NO: 1945217 - RNA, 19 nt, Human
agaggauggcccaggguga

SEQ ID NO: 1945218 - RNA, 22 nt, Human
agaggauuggcucccaucuuuu

SEQ ID NO: 1945219 - RNA, 14 nt, Human
agaggauuuugcgu

SEQ ID NO: 1945220 - RNA, 22 nt, Human
agaggauuuugcgucagagaaa

SEQ ID NO: 1945221 - RNA, 16 nt, Human
agaggggaagagacuu

SEQ ID NO: 1945222 - RNA, 18 nt, Human
agaggggaaaagagauga

SEQ ID NO: 1945223 - RNA, 18 nt, Human
agaggggaaaagcugaac

SEQ ID NO: 1945224 - RNA, 19 nt, Human
agaggggaaaagcugaaca

SEQ ID NO: 1945225 - RNA, 22 nt, Human
agaggggaacagacuggaagca

SEQ ID NO: 1945226 - RNA, 18 nt, Human
agaggggagagcugaaca

SEQ ID NO: 1945227 - RNA, 13 nt, Human
agaggggaggcca

SEQ ID NO: 1945228 - RNA, 15 nt, Human
agaggggaggccaag

SEQ ID NO: 1945229 - RNA, 23 nt, Human
agaggguggugaccucugccuga

SEQ ID NO: 1945230 - RNA, 22 nt, Human
agauacuuggggggcugaggug

SEQ ID NO: 1945231 - RNA, 11 nt, Human
agauacuuugu

SEQ ID NO: 1945232 - RNA, 22 nt, Human
agauacuuggucacagccaggc

SEQ ID NO: 1945233 - RNA, 21 nt, Human
agauacuuggucacagccagg

SEQ ID NO: 1945234 - RNA, 12 nt, Human
agauacuuugua

SEQ ID NO: 1945235 - RNA, 13 nt, Human
agauacuuuguau

SEQ ID NO: 1945236 - RNA, 15 nt, Human
agauacuuuguauug

SEQ ID NO: 1945237 - RNA, 16 nt, Human
agauacuuuguauugu

SEQ ID NO: 1945238 - RNA, 13 nt, Human
agauagccaaggc

SEQ ID NO: 1945239 - RNA, 20 nt, Human
agauacuuuguauuguccua

SEQ ID NO: 1945240 - RNA, 22 nt, Human
agauacuuuguauuguccuauu

SEQ ID NO: 1945241 - RNA, 20 nt, Human
agaugaccccugcccagauc

SEQ ID NO: 1945242 - RNA, 23 nt, Human
agaugaccccugcccagaucagc

SEQ ID NO: 1945243 - RNA, 17 nt, Human
agaugagaacagauaaa

SEQ ID NO: 1945244 - RNA, 21 nt, Human
agaugagaacagauaaagauu

SEQ ID NO: 1945245 - RNA, 23 nt, Human
agaugagaggggagagcugaaca

SEQ ID NO: 1945246 - RNA, 23 nt, Human
agauggcugugccucugccuguc

SEQ ID NO: 1945247 - RNA, 14 nt, Human
agaugagcacuucu

SEQ ID NO: 1945248 - RNA, 19 nt, Human
agaugagcacuucuaaguu

SEQ ID NO: 1945249 - RNA, 23 nt, Human
agauaguccauaauguucugcua

SEQ ID NO: 1945250 - RNA, 20 nt, Human
agauaguccauaauguucug

SEQ ID NO: 1945251 - RNA, 21 nt, Human
agauaguccauaauguucugc

SEQ ID NO: 1945252 - RNA, 16 nt, Human
agauagccaaggccaa

SEQ ID NO: 1945253 - RNA, 15 nt, Human
agauagccaaggcca

SEQ ID NO: 1945254 - RNA, 21 nt, Human
agauaggucagugcaaauacu

SEQ ID NO: 1945255 - RNA, 21 nt, Human
agagaagagauugugguuuca

SEQ ID NO: 1945256 - RNA, 10 nt, Human
agagaagaga

SEQ ID NO: 1945257 - RNA, 13 nt, Human
agagaagagcccc

SEQ ID NO: 1945258 - RNA, 18 nt, Human
agagaaaguacuucucca

SEQ ID NO: 1945259 - RNA, 14 nt, Human
agagaagagcccca

SEQ ID NO: 1945260 - RNA, 15 nt, Human
agagaagagccccac

SEQ ID NO: 1945261 - RNA, 16 nt, Human
agagaagagccccacu

SEQ ID NO: 1945262 - RNA, 18 nt, Human
agagaagagccccacucu

SEQ ID NO: 1945263 - RNA, 21 nt, Human
agagaagagccccacucucag

SEQ ID NO: 1945264 - RNA, 21 nt, Human
agagaagauggauaugaccag

SEQ ID NO: 1945265 - RNA, 20 nt, Human
agagagcuucuguugcugcc

SEQ ID NO: 1945266 - RNA, 23 nt, Human
agagagcuucuguugcugccuca

SEQ ID NO: 1945267 - RNA, 16 nt, Human
agagagcuucuguugc

SEQ ID NO: 1945268 - RNA, 23 nt, Human
agagaggguggugaccucugccu

SEQ ID NO: 1945269 - RNA, 14 nt, Human
agagaguggcuccu

SEQ ID NO: 1945270 - RNA, 16 nt, Human
agagaguggcuccucc

SEQ ID NO: 1945271 - RNA, 13 nt, Human
agagcccugcucc

SEQ ID NO: 1945272 - RNA, 14 nt, Human
agagcccugcuccc

SEQ ID NO: 1945273 - RNA, 13 nt, Human
agagccccacucu

SEQ ID NO: 1945274 - RNA, 15 nt, Human
agagccccacucuca

SEQ ID NO: 1945275 - RNA, 16 nt, Human
agagccccacucucag

SEQ ID NO: 1945276 - RNA, 17 nt, Human
agagccccacucucaga

SEQ ID NO: 1945277 - RNA, 20 nt, Human
agagccccacucucagaggc

SEQ ID NO: 1945278 - RNA, 21 nt, Human
agagccccacucucagaggcc

SEQ ID NO: 1945279 - RNA, 22 nt, Human
agagccccacucucagaggccc

SEQ ID NO: 1945280 - RNA, 23 nt, Human
agagccccacucucagaggcccc

SEQ ID NO: 1945281 - RNA, 13 nt, Human
agagccuuaaaac

SEQ ID NO: 1945282 - RNA, 16 nt, Human
agagcccugcucccuc

SEQ ID NO: 1945283 - RNA, 18 nt, Human
agagcccugcucccuccg

SEQ ID NO: 1945284 - RNA, 14 nt, Human
agagccuuaaaaca

SEQ ID NO: 1945285 - RNA, 15 nt, Human
agagccuuaaaacau

SEQ ID NO: 1945286 - RNA, 16 nt, Human
agagccuuaaaacauc

SEQ ID NO: 1945287 - RNA, 23 nt, Human
agacugaguacguugugcauuug

SEQ ID NO: 1945288 - RNA, 11 nt, Human
agacugaucuc

SEQ ID NO: 1945289 - RNA, 13 nt, Human
agacaaugacuua

SEQ ID NO: 1945290 - RNA, 17 nt, Human
agacaaugacuuacugu

SEQ ID NO: 1945291 - RNA, 13 nt, Human
agacaaucuucug

SEQ ID NO: 1945292 - RNA, 14 nt, Human
agacaaucuucugu

SEQ ID NO: 1945293 - RNA, 19 nt, Human
agacaaugacuuacuguac

SEQ ID NO: 1945294 - RNA, 15 nt, Human
agacaauuuauuaug

SEQ ID NO: 1945295 - RNA, 21 nt, Human
agacaauuuauuauggcacau

SEQ ID NO: 1945296 - RNA, 15 nt, Human
agacaaucuucuguu

SEQ ID NO: 1945297 - RNA, 22 nt, Human
agaccaauuuuuugugugugaa

SEQ ID NO: 1945298 - RNA, 17 nt, Human
agacagcccgggcucug

SEQ ID NO: 1945299 - RNA, 16 nt, Human
agacagcccgggcucu

SEQ ID NO: 1945300 - RNA, 20 nt, Human
agacagcccgggcucugccu

SEQ ID NO: 1945301 - RNA, 18 nt, Human
agacagcccgggcucugc

SEQ ID NO: 1945302 - RNA, 21 nt, Human
agaccaucccugaaggccccg

SEQ ID NO: 1945303 - RNA, 18 nt, Human
agaccaucccugaaggcc

SEQ ID NO: 1945304 - RNA, 17 nt, Human
agaccaucccugaaggc

SEQ ID NO: 1945305 - RNA, 14 nt, Human
agaccaucccugaa

SEQ ID NO: 1945306 - RNA, 13 nt, Human
agaccaucccuga

SEQ ID NO: 1945307 - RNA, 18 nt, Human
agacgggggcagagaggg

SEQ ID NO: 1945308 - RNA, 19 nt, Human
agacggagucccaccuugg

SEQ ID NO: 1945309 - RNA, 18 nt, Human
agacgggaggccuggccu

SEQ ID NO: 1945310 - RNA, 21 nt, Human
agacuaagaucgguuaacaaa

SEQ ID NO: 1945311 - RNA, 22 nt, Human
agacuaagaucgguuaacaaau

SEQ ID NO: 1945312 - RNA, 15 nt, Human
agacuacuguucagc

SEQ ID NO: 1945313 - RNA, 22 nt, Human
agacuacuguucagcuuuuauu

SEQ ID NO: 1945314 - RNA, 14 nt, Human
aucaucuguaagcu

SEQ ID NO: 1945315 - RNA, 16 nt, Human
aucaucuguaagcugu

SEQ ID NO: 1945316 - RNA, 17 nt, Human
aucaucuguaagcuguu

SEQ ID NO: 1945317 - RNA, 23 nt, Human
aucagcugcuacuacuccuguag

SEQ ID NO: 1945318 - RNA, 13 nt, Human
aucagcugcuacu

SEQ ID NO: 1945319 - RNA, 12 nt, Human
aucagcugcuac

SEQ ID NO: 1945320 - RNA, 21 nt, Human
aucagccugggcaaugugaua

SEQ ID NO: 1945321 - RNA, 20 nt, Human
aucagccugggcaaugugau

SEQ ID NO: 1945322 - RNA, 11 nt, Human
aucagccuggg

SEQ ID NO: 1945323 - RNA, 20 nt, Human
aucagcccaaucccugaucc

SEQ ID NO: 1945324 - RNA, 12 nt, Human
aucaccugcccu

SEQ ID NO: 1945325 - RNA, 13 nt, Human
aucaccugcccug

SEQ ID NO: 1945326 - RNA, 22 nt, Human
auccucauacccacccccaccc

SEQ ID NO: 1945327 - RNA, 19 nt, Human
auccucauacccaccccca

SEQ ID NO: 1945328 - RNA, 18 nt, Human
auccucauacccaccccc

SEQ ID NO: 1945329 - RNA, 15 nt, Human
aucccuacuguaauu

SEQ ID NO: 1945330 - RNA, 14 nt, Human
aucccggcugcccu

SEQ ID NO: 1945331 - RNA, 18 nt, Human
auccacccaccucagccu

SEQ ID NO: 1945332 - RNA, 20 nt, Human
auccacccaccucagccucc

SEQ ID NO: 1945333 - RNA, 16 nt, Human
auccacccauguuauc

SEQ ID NO: 1945334 - RNA, 22 nt, Human
auccuccaggugcacaagcucc

SEQ ID NO: 1945335 - RNA, 19 nt, Human
auccuccaggugcacaagc

SEQ ID NO: 1945336 - RNA, 14 nt, Human
auccuccaggugca

SEQ ID NO: 1945337 - RNA, 13 nt, Human
auccuccaggugc

SEQ ID NO: 1945338 - RNA, 11 nt, Human
auccuccucag

SEQ ID NO: 1945339 - RNA, 23 nt, Human
auccucauacccacccccaccca

SEQ ID NO: 1945340 - RNA, 12 nt, Human
auccucccaggc

SEQ ID NO: 1945341 - RNA, 15 nt, Human
auccuccccuggacu

SEQ ID NO: 1945342 - RNA, 16 nt, Human
auccuccccuggacuc

SEQ ID NO: 1945343 - RNA, 22 nt, Human
auccuccccuggacucccgugu

SEQ ID NO: 1945344 - RNA, 13 nt, Human
aucgaugcagugc

SEQ ID NO: 1945345 - RNA, 12 nt, Human
auccuuuucugu

SEQ ID NO: 1945346 - RNA, 16 nt, Human
auccuuuucuguguuu

SEQ ID NO: 1945347 - RNA, 21 nt, Human
aucgagugccgcaucucacag

SEQ ID NO: 1945348 - RNA, 22 nt, Human
aucgagugccgcaucucacagc

SEQ ID NO: 1945349 - RNA, 14 nt, Human
auccuccucagauc

SEQ ID NO: 1945350 - RNA, 17 nt, Human
auccuuuuagucugcau

SEQ ID NO: 1945351 - RNA, 19 nt, Human
auccuuuuagucugcauau

SEQ ID NO: 1945352 - RNA, 20 nt, Human
aucgcacucuggcagcaccg

SEQ ID NO: 1945353 - RNA, 17 nt, Human
aucgcacucuggcagca

SEQ ID NO: 1945354 - RNA, 14 nt, Human
augagccuggcaag

SEQ ID NO: 1945355 - RNA, 13 nt, Human
augagccuggcaa

SEQ ID NO: 1945356 - RNA, 18 nt, Human
augacucuugacucuugc

SEQ ID NO: 1945357 - RNA, 14 nt, Human
augaccccugccca

SEQ ID NO: 1945358 - RNA, 12 nt, Human
augacccagugg

SEQ ID NO: 1945359 - RNA, 13 nt, Human
augacccccccag

SEQ ID NO: 1945360 - RNA, 16 nt, Human
augacccccccagcuu

SEQ ID NO: 1945361 - RNA, 21 nt, Human
augaagcuuuuaugugaaaca

SEQ ID NO: 1945362 - RNA, 20 nt, Human
augaagcuuuuaugugaaac

SEQ ID NO: 1945363 - RNA, 19 nt, Human
augaagcuuuuaugugaaa

SEQ ID NO: 1945364 - RNA, 18 nt, Human
augaagcuuuuaugugaa

SEQ ID NO: 1945365 - RNA, 19 nt, Human
augacucaggacauccccc

SEQ ID NO: 1945366 - RNA, 16 nt, Human
augacuccagaauuuc

SEQ ID NO: 1945367 - RNA, 12 nt, Human
augacuccagaa

SEQ ID NO: 1945368 - RNA, 17 nt, Human
augacuccagaauuucc

SEQ ID NO: 1945369 - RNA, 18 nt, Human
augaaaagcuuuguuugu

SEQ ID NO: 1945370 - RNA, 23 nt, Human
augaaaagcuuuguuuguucuug

SEQ ID NO: 1945371 - RNA, 15 nt, Human
augaaaauuguguua

SEQ ID NO: 1945372 - RNA, 17 nt, Human
augaaaaaauauauauc

SEQ ID NO: 1945373 - RNA, 14 nt, Human
augaaaaaauauau

SEQ ID NO: 1945374 - RNA, 22 nt, Human
augaaaaaauauauaucaaaua

SEQ ID NO: 1945375 - RNA, 17 nt, Human
aucuucuuuauaauucu

SEQ ID NO: 1945376 - RNA, 17 nt, Human
aucuugaagacuuuucu

SEQ ID NO: 1945377 - RNA, 22 nt, Human
aucucucgugauugauaagaac

SEQ ID NO: 1945378 - RNA, 17 nt, Human
aucucuauuauuggaaa

SEQ ID NO: 1945379 - RNA, 17 nt, Human
aucucuauuccccaccc

SEQ ID NO: 1945380 - RNA, 12 nt, Human
aucugcugucuu

SEQ ID NO: 1945381 - RNA, 13 nt, Human
aucugcugucuuu

SEQ ID NO: 1945382 - RNA, 21 nt, Human
aucugcugucuuuucuuugcc

SEQ ID NO: 1945383 - RNA, 22 nt, Human
aucugcugucuuuucuuugcca

SEQ ID NO: 1945384 - RNA, 16 nt, Human
aucugcugcagagcag

SEQ ID NO: 1945385 - RNA, 17 nt, Human
aucugcugcagagcagu

SEQ ID NO: 1945386 - RNA, 14 nt, Human
aucuuaucucagau

SEQ ID NO: 1945387 - RNA, 18 nt, Human
aucuuaucucagauauuu

SEQ ID NO: 1945388 - RNA, 19 nt, Human
aucuuaucucagauauuug

SEQ ID NO: 1945389 - RNA, 20 nt, Human
aucuuaucucagauauuugc

SEQ ID NO: 1945390 - RNA, 21 nt, Human
aucuuaucucagauauuugca

SEQ ID NO: 1945391 - RNA, 13 nt, Human
aucuuauuaaagu

SEQ ID NO: 1945392 - RNA, 19 nt, Human
aucuuccaacucaaacucu

SEQ ID NO: 1945393 - RNA, 23 nt, Human
aucuucaucugagagaggcuaaa

SEQ ID NO: 1945394 - RNA, 21 nt, Human
aucuggaauugguuuagccca

SEQ ID NO: 1945395 - RNA, 13 nt, Human
aucuggaagagcu

SEQ ID NO: 1945396 - RNA, 21 nt, Human
aucuggaagagcuaggcaggg

SEQ ID NO: 1945397 - RNA, 15 nt, Human
aucugggccagaauu

SEQ ID NO: 1945398 - RNA, 19 nt, Human
aucuggaccccaucuguga

SEQ ID NO: 1945399 - RNA, 21 nt, Human
aucuggaccccaucugugaau

SEQ ID NO: 1945400 - RNA, 22 nt, Human
aucuuauaauuuaaaauaugcu

SEQ ID NO: 1945401 - RNA, 17 nt, Human
aucugggccagaauuuc

SEQ ID NO: 1945402 - RNA, 16 nt, Human
augugggggucugugu

SEQ ID NO: 1945403 - RNA, 17 nt, Human
augugggggucugugug

SEQ ID NO: 1945404 - RNA, 18 nt, Human
augugggggucugugugu

SEQ ID NO: 1945405 - RNA, 19 nt, Human
auguggucguuagagacag

SEQ ID NO: 1945406 - RNA, 23 nt, Human
auguggucguuagagacagagcg

SEQ ID NO: 1945407 - RNA, 21 nt, Human
augugguuaauuuugcauauc

SEQ ID NO: 1945408 - RNA, 14 nt, Human
auguguaaguauuc

SEQ ID NO: 1945409 - RNA, 13 nt, Human
auuaaauucuugc

SEQ ID NO: 1945410 - RNA, 11 nt, Human
auuaaauuaug

SEQ ID NO: 1945411 - RNA, 16 nt, Human
auuaaaugcccagccc

SEQ ID NO: 1945412 - RNA, 15 nt, Human
auuaaaugcccagcc

SEQ ID NO: 1945413 - RNA, 14 nt, Human
auuaaaugcccagc

SEQ ID NO: 1945414 - RNA, 16 nt, Human
auuaaaguuucaaaaa

SEQ ID NO: 1945415 - RNA, 18 nt, Human
auuaaaguuucaaaaauc

SEQ ID NO: 1945416 - RNA, 19 nt, Human
auuaaaguuucaaaaaucu

SEQ ID NO: 1945417 - RNA, 20 nt, Human
auuaaaguuucaaaaaucug

SEQ ID NO: 1945418 - RNA, 21 nt, Human
auuaaaguuucaaaaaucuga

SEQ ID NO: 1945419 - RNA, 23 nt, Human
auuaaaguuucaaaaaucugaag

SEQ ID NO: 1945420 - RNA, 16 nt, Human
auguuuuaagaggcag

SEQ ID NO: 1945421 - RNA, 18 nt, Human
auguuuuaagaggcaggg

SEQ ID NO: 1945422 - RNA, 12 nt, Human
auuaaaguuuca

SEQ ID NO: 1945423 - RNA, 13 nt, Human
auuaaaguuucaa

SEQ ID NO: 1945424 - RNA, 14 nt, Human
auuaaaguuucaaa

SEQ ID NO: 1945425 - RNA, 15 nt, Human
auuaaaguuucaaaa

SEQ ID NO: 1945426 - RNA, 22 nt, Human
auguucugacccugcuucaaau

SEQ ID NO: 1945427 - RNA, 20 nt, Human
auguucuuaguggauguucu

SEQ ID NO: 1945428 - RNA, 15 nt, Human
auguucuuaauucuu

SEQ ID NO: 1945429 - RNA, 20 nt, Human
auguucuuucacccuuuucu

SEQ ID NO: 1945430 - RNA, 14 nt, Human
auguucuuccaguu

SEQ ID NO: 1945431 - RNA, 13 nt, Human
auguuucuuugau

SEQ ID NO: 1945432 - RNA, 21 nt, Human
auguuucuuugaucaugaaua

SEQ ID NO: 1945433 - RNA, 11 nt, Human
auguucuucca

SEQ ID NO: 1945434 - RNA, 13 nt, Human
auguucuuccagu

SEQ ID NO: 1945435 - RNA, 18 nt, Human
auguuucuuuguaaugaa

SEQ ID NO: 1945436 - RNA, 18 nt, Human
auguucucugaggacacu

SEQ ID NO: 1945437 - RNA, 19 nt, Human
augugucugccacauuaac

SEQ ID NO: 1945438 - RNA, 12 nt, Human
augugucuuuau

SEQ ID NO: 1945439 - RNA, 15 nt, Human
auguguccauuuccu

SEQ ID NO: 1945440 - RNA, 17 nt, Human
auguguccucagggagc

SEQ ID NO: 1945441 - RNA, 18 nt, Human
auguguccucagggagca

SEQ ID NO: 1945442 - RNA, 12 nt, Human
auguguauguga

SEQ ID NO: 1945443 - RNA, 19 nt, Human
auguguaugugaguauucu

SEQ ID NO: 1945444 - RNA, 19 nt, Human
auguguaauuuuucuguau

SEQ ID NO: 1945445 - RNA, 20 nt, Human
auguguaauuuuucuguaua

SEQ ID NO: 1945446 - RNA, 12 nt, Human
auguguaauuuu

SEQ ID NO: 1945447 - RNA, 15 nt, Human
auguguaauuuuucu

SEQ ID NO: 1945448 - RNA, 18 nt, Human
auguguaauuuuucugua

SEQ ID NO: 1945449 - RNA, 22 nt, Human
auguguaauuuuucuguauaga

SEQ ID NO: 1945450 - RNA, 15 nt, Human
augucacaggcaggu

SEQ ID NO: 1945451 - RNA, 14 nt, Human
augucacaggcagg

SEQ ID NO: 1945452 - RNA, 16 nt, Human
augucacaggcagguc

SEQ ID NO: 1945453 - RNA, 17 nt, Human
augucacaggcaggucc

SEQ ID NO: 1945454 - RNA, 16 nt, Human
augucaauaacaguau

SEQ ID NO: 1945455 - RNA, 13 nt, Human
augucagcaguug

SEQ ID NO: 1945456 - RNA, 16 nt, Human
augucagcaguugcug

SEQ ID NO: 1945457 - RNA, 19 nt, Human
augucaaauauuuagaugu

SEQ ID NO: 1945458 - RNA, 23 nt, Human
augucaaauauuuagauguaauu

SEQ ID NO: 1945459 - RNA, 14 nt, Human
augucaaaugugaa

SEQ ID NO: 1945460 - RNA, 17 nt, Human
auguacauguacugauu

SEQ ID NO: 1945461 - RNA, 23 nt, Human
auggugacuuuugaaaagaggug

SEQ ID NO: 1945462 - RNA, 16 nt, Human
auggugaacugucauu

SEQ ID NO: 1945463 - RNA, 18 nt, Human
auggucuuauauuuacaa

SEQ ID NO: 1945464 - RNA, 14 nt, Human
auggucuaauguuu

SEQ ID NO: 1945465 - RNA, 16 nt, Human
auggucuaauguuuaa

SEQ ID NO: 1945466 - RNA, 17 nt, Human
auguaagcucuacugag

SEQ ID NO: 1945467 - RNA, 16 nt, Human
auguaaguaaacgguc

SEQ ID NO: 1945468 - RNA, 13 nt, Human
auguaagguauau

SEQ ID NO: 1945469 - RNA, 22 nt, Human
auguaagguauaucauucuaaa

SEQ ID NO: 1945470 - RNA, 20 nt, Human
augucagcaguugcugguaa

SEQ ID NO: 1945471 - RNA, 21 nt, Human
augccuuuguacuuuagggaa

SEQ ID NO: 1945472 - RNA, 16 nt, Human
augaugugugaaaacu

SEQ ID NO: 1945473 - RNA, 15 nt, Human
augcaauccuuacaa

SEQ ID NO: 1945474 - RNA, 16 nt, Human
augcaauccuuacaaa

SEQ ID NO: 1945475 - RNA, 17 nt, Human
augcaauccuuacaaau

SEQ ID NO: 1945476 - RNA, 18 nt, Human
augcaauccuuacaaaug

SEQ ID NO: 1945477 - RNA, 19 nt, Human
augcaauccuuacaaauga

SEQ ID NO: 1945478 - RNA, 21 nt, Human
augcaauccuuacaaaugauu

SEQ ID NO: 1945479 - RNA, 23 nt, Human
augauguauguugaagccuuugu

SEQ ID NO: 1945480 - RNA, 18 nt, Human
augaugugccugcuucag

SEQ ID NO: 1945481 - RNA, 14 nt, Human
augaugugccugcu

SEQ ID NO: 1945482 - RNA, 17 nt, Human
augcacacauuuuuuaa

SEQ ID NO: 1945483 - RNA, 19 nt, Human
augcacacauuuuuuaaau

SEQ ID NO: 1945484 - RNA, 22 nt, Human
augcacacauuuuuuaaaugca

SEQ ID NO: 1945485 - RNA, 14 nt, Human
augcacagcuaaca

SEQ ID NO: 1945486 - RNA, 23 nt, Human
augcacacauuuuuuaaaugcac

SEQ ID NO: 1945487 - RNA, 21 nt, Human
augcacagcuaacauggaagu

SEQ ID NO: 1945488 - RNA, 17 nt, Human
augccugggcagaagga

SEQ ID NO: 1945489 - RNA, 17 nt, Human
augccuggugagcauua

SEQ ID NO: 1945490 - RNA, 23 nt, Human
augccuggauggggcugcaccgg

SEQ ID NO: 1945491 - RNA, 21 nt, Human
augccuggauggggcugcacc

SEQ ID NO: 1945492 - RNA, 15 nt, Human
augccugguggcagc

SEQ ID NO: 1945493 - RNA, 16 nt, Human
augccugguggcagcu

SEQ ID NO: 1945494 - RNA, 17 nt, Human
augccugguggcagcug

SEQ ID NO: 1945495 - RNA, 10 nt, Human
augcauuuga

SEQ ID NO: 1945496 - RNA, 12 nt, Human
augcauuugaaa

SEQ ID NO: 1945497 - RNA, 18 nt, Human
augcauuugaaaauuuug

SEQ ID NO: 1945498 - RNA, 23 nt, Human
augcaugaaguaauaugcacaca

SEQ ID NO: 1945499 - RNA, 20 nt, Human
augcaugaaguaauaugcac

SEQ ID NO: 1945500 - RNA, 20 nt, Human
augcaugauugcagaauugu

SEQ ID NO: 1945501 - RNA, 15 nt, Human
augcaugcuuuccau

SEQ ID NO: 1945502 - RNA, 16 nt, Human
augcaugcuuuccaua

SEQ ID NO: 1945503 - RNA, 17 nt, Human
augcaugcuuuccauau

SEQ ID NO: 1945504 - RNA, 19 nt, Human
augcaugcuuuccauauuu

SEQ ID NO: 1945505 - RNA, 20 nt, Human
augcaugcuuuccauauuuu

SEQ ID NO: 1945506 - RNA, 21 nt, Human
augcaugcuuuccauauuuuu

SEQ ID NO: 1945507 - RNA, 14 nt, Human
augcuucuuuaaaa

SEQ ID NO: 1945508 - RNA, 19 nt, Human
augcuugcauauauuucau

SEQ ID NO: 1945509 - RNA, 12 nt, Human
augcuucuuuaa

SEQ ID NO: 1945510 - RNA, 14 nt, Human
augcuuuucucaaa

SEQ ID NO: 1945511 - RNA, 15 nt, Human
augcuuugugaacaa

SEQ ID NO: 1945512 - RNA, 20 nt, Human
auggaaaugggcagagcaga

SEQ ID NO: 1945513 - RNA, 19 nt, Human
auggaaaugggcagagcag

SEQ ID NO: 1945514 - RNA, 13 nt, Human
auggaaauguuua

SEQ ID NO: 1945515 - RNA, 18 nt, Human
auggaaaugcaaacuggg

SEQ ID NO: 1945516 - RNA, 20 nt, Human
auggaucgauauuaauguau

SEQ ID NO: 1945517 - RNA, 16 nt, Human
auggaugaacugaaag

SEQ ID NO: 1945518 - RNA, 18 nt, Human
auggagcuauuuuaaacc

SEQ ID NO: 1945519 - RNA, 23 nt, Human
auggcugccaaugggagcucaug

SEQ ID NO: 1945520 - RNA, 17 nt, Human
auggcugcauaguauuc

SEQ ID NO: 1945521 - RNA, 15 nt, Human
augggaaugaauguc

SEQ ID NO: 1945522 - RNA, 21 nt, Human
augggaaugaaugucagugug

SEQ ID NO: 1945523 - RNA, 22 nt, Human
augggaauauaauauugucucu

SEQ ID NO: 1945524 - RNA, 20 nt, Human
aguccagaaacuguucccac

SEQ ID NO: 1945525 - RNA, 13 nt, Human
agugauccuccca

SEQ ID NO: 1945526 - RNA, 20 nt, Human
agugauauucuuuguuaauu

SEQ ID NO: 1945527 - RNA, 12 nt, Human
agugauauucuu

SEQ ID NO: 1945528 - RNA, 15 nt, Human
agugauauucuuugu

SEQ ID NO: 1945529 - RNA, 17 nt, Human
agugauauucuuuguua

SEQ ID NO: 1945530 - RNA, 18 nt, Human
agugauauucuuuguuaa

SEQ ID NO: 1945531 - RNA, 19 nt, Human
agugauauucuuuguuaau

SEQ ID NO: 1945532 - RNA, 15 nt, Human
agucauucagauaug

SEQ ID NO: 1945533 - RNA, 20 nt, Human
agucauucagauaugauuca

SEQ ID NO: 1945534 - RNA, 23 nt, Human
agucauucagauaugauucaaau

SEQ ID NO: 1945535 - RNA, 18 nt, Human
agucauuauguuaauauu

SEQ ID NO: 1945536 - RNA, 12 nt, Human
agucauuauguu

SEQ ID NO: 1945537 - RNA, 23 nt, Human
aguccaagggguccccuccagga

SEQ ID NO: 1945538 - RNA, 21 nt, Human
aguccaagggguccccuccag

SEQ ID NO: 1945539 - RNA, 22 nt, Human
aguccaagggguccccuccagg

SEQ ID NO: 1945540 - RNA, 20 nt, Human
agucaagugaaaaaggagga

SEQ ID NO: 1945541 - RNA, 19 nt, Human
agucaagacgaacauguag

SEQ ID NO: 1945542 - RNA, 16 nt, Human
agucaagugaaaaagg

SEQ ID NO: 1945543 - RNA, 18 nt, Human
agucaaggguaggguggg

SEQ ID NO: 1945544 - RNA, 20 nt, Human
aguuguaucagcacgugugg

SEQ ID NO: 1945545 - RNA, 23 nt, Human
aguuguaucagcacguguggccu

SEQ ID NO: 1945546 - RNA, 21 nt, Human
aguuguaggcgaaucauuugu

SEQ ID NO: 1945547 - RNA, 22 nt, Human
aguuguaggcgaaucauuuguu

SEQ ID NO: 1945548 - RNA, 18 nt, Human
aguuguaugaucugugcc

SEQ ID NO: 1945549 - RNA, 15 nt, Human
aguuguaugaucugu

SEQ ID NO: 1945550 - RNA, 17 nt, Human
aguuguaugaucugugc

SEQ ID NO: 1945551 - RNA, 15 nt, Human
aguugaauuuuacau

SEQ ID NO: 1945552 - RNA, 18 nt, Human
aguuguaccgcaauguga

SEQ ID NO: 1945553 - RNA, 19 nt, Human
aguuguaccgcaaugugac

SEQ ID NO: 1945554 - RNA, 13 nt, Human
aguuguacuuuaa

SEQ ID NO: 1945555 - RNA, 19 nt, Human
aguuguacuuuaaaaauuu

SEQ ID NO: 1945556 - RNA, 20 nt, Human
aguuguacuuuaaaaauuua

SEQ ID NO: 1945557 - RNA, 23 nt, Human
aguuguacuuuaaaaauuuacua

SEQ ID NO: 1945558 - RNA, 20 nt, Human
aguuacauauguauacaugu

SEQ ID NO: 1945559 - RNA, 21 nt, Human
aguuacauauguauacaugug

SEQ ID NO: 1945560 - RNA, 18 nt, Human
aguuacagacaaagcgug

SEQ ID NO: 1945561 - RNA, 16 nt, Human
aguuguuacauuuuua

SEQ ID NO: 1945562 - RNA, 13 nt, Human
aguuguuacauuu

SEQ ID NO: 1945563 - RNA, 15 nt, Human
aguuguuacauuuuu

SEQ ID NO: 1945564 - RNA, 13 nt, Human
agugugaauacug

SEQ ID NO: 1945565 - RNA, 14 nt, Human
agugugaauacugc

SEQ ID NO: 1945566 - RNA, 16 nt, Human
agugugaauacugcuu

SEQ ID NO: 1945567 - RNA, 23 nt, Human
agugugacaaggauugcuacugu

SEQ ID NO: 1945568 - RNA, 16 nt, Human
agugucuuuccacucc

SEQ ID NO: 1945569 - RNA, 18 nt, Human
agugauuaccagggacug

SEQ ID NO: 1945570 - RNA, 15 nt, Human
agugauuaccaggga

SEQ ID NO: 1945571 - RNA, 18 nt, Human
agugauucucaugccuca

SEQ ID NO: 1945572 - RNA, 19 nt, Human
agugauucucaugccucag

SEQ ID NO: 1945573 - RNA, 16 nt, Human
auaacagccgcuccag

SEQ ID NO: 1945574 - RNA, 17 nt, Human
auaacagccgcuccaga

SEQ ID NO: 1945575 - RNA, 19 nt, Human
auaacagggauugauuuua

SEQ ID NO: 1945576 - RNA, 20 nt, Human
auaacagggauugauuuuaa

SEQ ID NO: 1945577 - RNA, 21 nt, Human
auaacagggauugauuuuaaa

SEQ ID NO: 1945578 - RNA, 22 nt, Human
auaacagggauugauuuuaaaa

SEQ ID NO: 1945579 - RNA, 15 nt, Human
auaacaguaguguua

SEQ ID NO: 1945580 - RNA, 17 nt, Human
auaacacugugaagagc

SEQ ID NO: 1945581 - RNA, 16 nt, Human
auaacacugugaagag

SEQ ID NO: 1945582 - RNA, 15 nt, Human
auaaguggugugugu

SEQ ID NO: 1945583 - RNA, 16 nt, Human
auaaguauuuggaauu

SEQ ID NO: 1945584 - RNA, 14 nt, Human
auaaguauuuggaa

SEQ ID NO: 1945585 - RNA, 19 nt, Human
auaaguauuuaauucaugu

SEQ ID NO: 1945586 - RNA, 19 nt, Human
auaaugugaaacuggauua

SEQ ID NO: 1945587 - RNA, 21 nt, Human
auaaugugaaacuggauuaaa

SEQ ID NO: 1945588 - RNA, 20 nt, Human
auaauuaaccaagguagaau

SEQ ID NO: 1945589 - RNA, 22 nt, Human
auaaguguguguuuuucauaaa

SEQ ID NO: 1945590 - RNA, 19 nt, Human
auaaguguguguuuuucau

SEQ ID NO: 1945591 - RNA, 18 nt, Human
auaaugugaaacuggauu

SEQ ID NO: 1945592 - RNA, 17 nt, Human
auacuuaaauguuaugu

SEQ ID NO: 1945593 - RNA, 20 nt, Human
auacuuaaauguuauguaua

SEQ ID NO: 1945594 - RNA, 21 nt, Human
auacuuaaauguuauguauau

SEQ ID NO: 1945595 - RNA, 14 nt, Human
auaauuacuauguc

SEQ ID NO: 1945596 - RNA, 21 nt, Human
auaauuaaccaagguagaaug

SEQ ID NO: 1945597 - RNA, 22 nt, Human
auaauuacagugccuaaaauaa

SEQ ID NO: 1945598 - RNA, 14 nt, Human
auacacaaaaucaa

SEQ ID NO: 1945599 - RNA, 16 nt, Human
auacacaaaaucaaau

SEQ ID NO: 1945600 - RNA, 22 nt, Human
auacccccugcaaagcccagcu

SEQ ID NO: 1945601 - RNA, 18 nt, Human
auacacaaaaucaaauaa

SEQ ID NO: 1945602 - RNA, 12 nt, Human
auaccugucccc

SEQ ID NO: 1945603 - RNA, 13 nt, Human
auaccuguccccc

SEQ ID NO: 1945604 - RNA, 18 nt, Human
auauagcauuuaugguaa

SEQ ID NO: 1945605 - RNA, 20 nt, Human
auauagcauuuaugguaauc

SEQ ID NO: 1945606 - RNA, 23 nt, Human
auauacauuuuuagccuguguca

SEQ ID NO: 1945607 - RNA, 15 nt, Human
auauacauguuuaug

SEQ ID NO: 1945608 - RNA, 16 nt, Human
auauacauguuuaugu

SEQ ID NO: 1945609 - RNA, 18 nt, Human
auauacauguuuauguaa

SEQ ID NO: 1945610 - RNA, 21 nt, Human
auauacauguuuauguaaaca

SEQ ID NO: 1945611 - RNA, 16 nt, Human
auauaggaacuuaaau

SEQ ID NO: 1945612 - RNA, 21 nt, Human
auacuucaugaaauccugggu

SEQ ID NO: 1945613 - RNA, 16 nt, Human
auacuugaaaauuaac

SEQ ID NO: 1945614 - RNA, 15 nt, Human
auacuugaaaauuaa

SEQ ID NO: 1945615 - RNA, 15 nt, Human
auaguaugguggcug

SEQ ID NO: 1945616 - RNA, 15 nt, Human
auauaagugauugcu

SEQ ID NO: 1945617 - RNA, 16 nt, Human
auaguaugguggcugg

SEQ ID NO: 1945618 - RNA, 15 nt, Human
auauaaguguguguu

SEQ ID NO: 1945619 - RNA, 16 nt, Human
auauuuauaaaaauaa

SEQ ID NO: 1945620 - RNA, 18 nt, Human
auauuuaguguucauaaa

SEQ ID NO: 1945621 - RNA, 13 nt, Human
auauucaggaagc

SEQ ID NO: 1945622 - RNA, 22 nt, Human
auauuagacuucuguuuucaau

SEQ ID NO: 1945623 - RNA, 19 nt, Human
auauuagcgacaacagauu

SEQ ID NO: 1945624 - RNA, 22 nt, Human
auauuagcgacaacagauugga

SEQ ID NO: 1945625 - RNA, 16 nt, Human
auauucaggaagcuca

SEQ ID NO: 1945626 - RNA, 14 nt, Human
auauucaggaagcu

SEQ ID NO: 1945627 - RNA, 17 nt, Human
auauucaggaagcucag

SEQ ID NO: 1945628 - RNA, 22 nt, Human
auauuuagauguaauuuugugu

SEQ ID NO: 1945629 - RNA, 20 nt, Human
auauuuagauguaauuuugu

SEQ ID NO: 1945630 - RNA, 15 nt, Human
auauuuauuaaauuu

SEQ ID NO: 1945631 - RNA, 13 nt, Human
auauuuauuuuua

SEQ ID NO: 1945632 - RNA, 17 nt, Human
auauuucaaguacacug

SEQ ID NO: 1945633 - RNA, 18 nt, Human
auauuucaaguacacuga

SEQ ID NO: 1945634 - RNA, 20 nt, Human
auauuucagaaauacagaua

SEQ ID NO: 1945635 - RNA, 19 nt, Human
auauuucaaguacacugaa

SEQ ID NO: 1945636 - RNA, 12 nt, Human
auauuucagaaa

SEQ ID NO: 1945637 - RNA, 14 nt, Human
auauuucagaaaua

SEQ ID NO: 1945638 - RNA, 15 nt, Human
auauuucagaaauac

SEQ ID NO: 1945639 - RNA, 19 nt, Human
auaucccuuggacauuuua

SEQ ID NO: 1945640 - RNA, 18 nt, Human
auauccccuauuuaacag

SEQ ID NO: 1945641 - RNA, 17 nt, Human
auauccauagugacuuu

SEQ ID NO: 1945642 - RNA, 21 nt, Human
auauccacuuguccaugugaa

SEQ ID NO: 1945643 - RNA, 19 nt, Human
auaucaccaggacuguuac

SEQ ID NO: 1945644 - RNA, 15 nt, Human
auaucaauuuaaaaa

SEQ ID NO: 1945645 - RNA, 22 nt, Human
auaugccugggcagaaggaaga

SEQ ID NO: 1945646 - RNA, 18 nt, Human
auaugcauauauauaugu

SEQ ID NO: 1945647 - RNA, 19 nt, Human
auaugcauauauauaugug

SEQ ID NO: 1945648 - RNA, 22 nt, Human
auaugcauauauauaugugugu

SEQ ID NO: 1945649 - RNA, 14 nt, Human
auaugccugcucuu

SEQ ID NO: 1945650 - RNA, 15 nt, Human
auaugccugcucuuu

SEQ ID NO: 1945651 - RNA, 15 nt, Human
auaugcauauauaua

SEQ ID NO: 1945652 - RNA, 20 nt, Human
auauccucugcuuaaaaacu

SEQ ID NO: 1945653 - RNA, 19 nt, Human
auaugcuuauacacuuaca

SEQ ID NO: 1945654 - RNA, 16 nt, Human
auaugcuuauacacuu

SEQ ID NO: 1945655 - RNA, 14 nt, Human
auaugcuuauacac

SEQ ID NO: 1945656 - RNA, 13 nt, Human
auaugcuucuuua

SEQ ID NO: 1945657 - RNA, 15 nt, Human
auaugcuucuuuaaa

SEQ ID NO: 1945658 - RNA, 19 nt, Human
auaugcuuguaacuaaaau

SEQ ID NO: 1945659 - RNA, 15 nt, Human
auauuagacuucugu

SEQ ID NO: 1945660 - RNA, 16 nt, Human
auauuagacuucuguu

SEQ ID NO: 1945661 - RNA, 20 nt, Human
auauuagacuucuguuuuca

SEQ ID NO: 1945662 - RNA, 21 nt, Human
auauuagacuucuguuuucaa

SEQ ID NO: 1945663 - RNA, 20 nt, Human
accccucaacaccucugcac

SEQ ID NO: 1945664 - RNA, 14 nt, Human
accaucaugucugg

SEQ ID NO: 1945665 - RNA, 15 nt, Human
acccaagcuccaacc

SEQ ID NO: 1945666 - RNA, 22 nt, Human
accaucccugaaggccccgccc

SEQ ID NO: 1945667 - RNA, 21 nt, Human
accaucccugaaggccccgcc

SEQ ID NO: 1945668 - RNA, 18 nt, Human
accaucccugaaggcccc

SEQ ID NO: 1945669 - RNA, 16 nt, Human
accaucaugucuggcu

SEQ ID NO: 1945670 - RNA, 17 nt, Human
accaucaugucuggcua

SEQ ID NO: 1945671 - RNA, 16 nt, Human
acccaugcugcccugu

SEQ ID NO: 1945672 - RNA, 13 nt, Human
acccaugggcagg

SEQ ID NO: 1945673 - RNA, 14 nt, Human
acccaugggcagga

SEQ ID NO: 1945674 - RNA, 19 nt, Human
acccaugcugcccugugag

SEQ ID NO: 1945675 - RNA, 22 nt, Human
acccaugaaagaaaacuuuuau

SEQ ID NO: 1945676 - RNA, 18 nt, Human
acccaugcugcccuguga

SEQ ID NO: 1945677 - RNA, 17 nt, Human
acccaugcugcccugug

SEQ ID NO: 1945678 - RNA, 15 nt, Human
acccacaagaaauga

SEQ ID NO: 1945679 - RNA, 16 nt, Human
acccaugaaagaaaac

SEQ ID NO: 1945680 - RNA, 16 nt, Human
acccaagggccuggcc

SEQ ID NO: 1945681 - RNA, 13 nt, Human
acccaagggccug

SEQ ID NO: 1945682 - RNA, 15 nt, Human
accccggccaccugc

SEQ ID NO: 1945683 - RNA, 22 nt, Human
accccuaaagagauacuuugau

SEQ ID NO: 1945684 - RNA, 22 nt, Human
accccgcaagcaccauccccuc

SEQ ID NO: 1945685 - RNA, 18 nt, Human
accccgaccaccugccca

SEQ ID NO: 1945686 - RNA, 15 nt, Human
accaacugucacugu

SEQ ID NO: 1945687 - RNA, 17 nt, Human
acauuugguaauguuuu

SEQ ID NO: 1945688 - RNA, 19 nt, Human
acauuugguaauguuuuua

SEQ ID NO: 1945689 - RNA, 14 nt, Human
acauuugguaaugu

SEQ ID NO: 1945690 - RNA, 18 nt, Human
accagcagucugccugga

SEQ ID NO: 1945691 - RNA, 17 nt, Human
accagcagccuggaccc

SEQ ID NO: 1945692 - RNA, 14 nt, Human
accagcagccugga

SEQ ID NO: 1945693 - RNA, 13 nt, Human
accagcagccugg

SEQ ID NO: 1945694 - RNA, 15 nt, Human
accacguuucuaaag

SEQ ID NO: 1945695 - RNA, 19 nt, Human
accacguuucuaaaggcua

SEQ ID NO: 1945696 - RNA, 14 nt, Human
accacuacauucug

SEQ ID NO: 1945697 - RNA, 19 nt, Human
accaagccuggucagccca

SEQ ID NO: 1945698 - RNA, 20 nt, Human
accaagccuggucagcccaa

SEQ ID NO: 1945699 - RNA, 12 nt, Human
accaacuuucaa

SEQ ID NO: 1945700 - RNA, 13 nt, Human
accaacuuucaag

SEQ ID NO: 1945701 - RNA, 20 nt, Human
accaacugugaugucacuga

SEQ ID NO: 1945702 - RNA, 14 nt, Human
accaacuuucaaga

SEQ ID NO: 1945703 - RNA, 15 nt, Human
accaacuuucaagaa

SEQ ID NO: 1945704 - RNA, 20 nt, Human
accaacuuucaagaacuugu

SEQ ID NO: 1945705 - RNA, 20 nt, Human
accacgcccggcuaauuuuu

SEQ ID NO: 1945706 - RNA, 14 nt, Human
accacgcccggcua

SEQ ID NO: 1945707 - RNA, 13 nt, Human
acauguuacaaca

SEQ ID NO: 1945708 - RNA, 21 nt, Human
acauguuuuucuucucccuca

SEQ ID NO: 1945709 - RNA, 23 nt, Human
acaugcacagcuaacauggaagu

SEQ ID NO: 1945710 - RNA, 15 nt, Human
acaugcacacucaug

SEQ ID NO: 1945711 - RNA, 20 nt, Human
acaugcacagcuaacaugga

SEQ ID NO: 1945712 - RNA, 19 nt, Human
acaugcaaggucauuuuuu

SEQ ID NO: 1945713 - RNA, 14 nt, Human
acauguuuauguaa

SEQ ID NO: 1945714 - RNA, 15 nt, Human
acagguuugggaccc

SEQ ID NO: 1945715 - RNA, 18 nt, Human
acagguuugggaccccug

SEQ ID NO: 1945716 - RNA, 18 nt, Human
acagguuuuaaaagccuu

SEQ ID NO: 1945717 - RNA, 11 nt, Human
acauaaacauc

SEQ ID NO: 1945718 - RNA, 12 nt, Human
acauaaacauca

SEQ ID NO: 1945719 - RNA, 23 nt, Human
acauaaacaagaccacguuucua

SEQ ID NO: 1945720 - RNA, 20 nt, Human
acaucagcacgauuucuguu

SEQ ID NO: 1945721 - RNA, 21 nt, Human
acaucagcacgauuucuguuu

SEQ ID NO: 1945722 - RNA, 22 nt, Human
acaucagcacgauuucuguuua

SEQ ID NO: 1945723 - RNA, 19 nt, Human
acaucagcacgauuucugu

SEQ ID NO: 1945724 - RNA, 15 nt, Human
acauccacagucucc

SEQ ID NO: 1945725 - RNA, 19 nt, Human
acauccacagucuccccca

SEQ ID NO: 1945726 - RNA, 13 nt, Human
acauccacucucu

SEQ ID NO: 1945727 - RNA, 19 nt, Human
acauccacucucucuuguu

SEQ ID NO: 1945728 - RNA, 22 nt, Human
acauccacucucucuuguucuu

SEQ ID NO: 1945729 - RNA, 20 nt, Human
acaucccaccccauccucca

SEQ ID NO: 1945730 - RNA, 21 nt, Human
acaucccaccccauccuccag

SEQ ID NO: 1945731 - RNA, 22 nt, Human
acauccugucaucugagaauga

SEQ ID NO: 1945732 - RNA, 23 nt, Human
acauccugucaucugagaaugaa

SEQ ID NO: 1945733 - RNA, 12 nt, Human
acagcuccuucu

SEQ ID NO: 1945734 - RNA, 13 nt, Human
acagcuccuucug

SEQ ID NO: 1945735 - RNA, 14 nt, Human
acagcuccuucugu

SEQ ID NO: 1945736 - RNA, 23 nt, Human
acagcugccugggaucccucauc

SEQ ID NO: 1945737 - RNA, 14 nt, Human
acagcugccuggga

SEQ ID NO: 1945738 - RNA, 20 nt, Human
acagcucugcauacucauua

SEQ ID NO: 1945739 - RNA, 15 nt, Human
acagcuccuuuucca

SEQ ID NO: 1945740 - RNA, 20 nt, Human
acagcuccuuuuccagagca

SEQ ID NO: 1945741 - RNA, 21 nt, Human
acagcuccuuuuccagagcau

SEQ ID NO: 1945742 - RNA, 15 nt, Human
acagcuccuucuguc

SEQ ID NO: 1945743 - RNA, 15 nt, Human
acagguaccaguucu

SEQ ID NO: 1945744 - RNA, 17 nt, Human
acagguaccaguucuuu

SEQ ID NO: 1945745 - RNA, 14 nt, Human
acagguacuuuguc

SEQ ID NO: 1945746 - RNA, 23 nt, Human
acagggucucuagugcugugaaa

SEQ ID NO: 1945747 - RNA, 21 nt, Human
acagggucucuagugcuguga

SEQ ID NO: 1945748 - RNA, 19 nt, Human
acagggucucuagugcugu

SEQ ID NO: 1945749 - RNA, 15 nt, Human
acagguacuuugucu

SEQ ID NO: 1945750 - RNA, 20 nt, Human
acaggugugaaccaccacac

SEQ ID NO: 1945751 - RNA, 23 nt, Human
acaggugugaaccaccacaccca

SEQ ID NO: 1945752 - RNA, 22 nt, Human
acaggugugagccaccacgccc

SEQ ID NO: 1945753 - RNA, 21 nt, Human
acaggugugagccaccacgcc

SEQ ID NO: 1945754 - RNA, 15 nt, Human
acaggggcaggagga

SEQ ID NO: 1945755 - RNA, 16 nt, Human
acagggggccagaaca

SEQ ID NO: 1945756 - RNA, 21 nt, Human
acagggguuccuucugggcau

SEQ ID NO: 1945757 - RNA, 12 nt, Human
acagggguuccu

SEQ ID NO: 1945758 - RNA, 13 nt, Human
acagggguuccuu

SEQ ID NO: 1945759 - RNA, 16 nt, Human
acagggguuccuucug

SEQ ID NO: 1945760 - RNA, 19 nt, Human
acaggcaagcaccuccugc

SEQ ID NO: 1945761 - RNA, 21 nt, Human
acagcugcucaauaaaguaca

SEQ ID NO: 1945762 - RNA, 18 nt, Human
acaggcaagcaccuccug

SEQ ID NO: 1945763 - RNA, 15 nt, Human
acaggcaagcaccuc

SEQ ID NO: 1945764 - RNA, 16 nt, Human
acaggcaagcaccucc

SEQ ID NO: 1945765 - RNA, 15 nt, Human
acagccaugauucuu

SEQ ID NO: 1945766 - RNA, 20 nt, Human
acagccauaggcccuuucag

SEQ ID NO: 1945767 - RNA, 23 nt, Human
acagcauuuguguguuacaaugu

SEQ ID NO: 1945768 - RNA, 12 nt, Human
acagccacucag

SEQ ID NO: 1945769 - RNA, 19 nt, Human
acagccacggccaggccag

SEQ ID NO: 1945770 - RNA, 17 nt, Human
acagcauuuguguguua

SEQ ID NO: 1945771 - RNA, 20 nt, Human
acagccagaacucugugucc

SEQ ID NO: 1945772 - RNA, 14 nt, Human
acagccacucagaa

SEQ ID NO: 1945773 - RNA, 16 nt, Human
acagaagugacugaug

SEQ ID NO: 1945774 - RNA, 15 nt, Human
acagaguaaucuugu

SEQ ID NO: 1945775 - RNA, 22 nt, Human
acagaggggguggccucccaac

SEQ ID NO: 1945776 - RNA, 12 nt, Human
acagagucucac

SEQ ID NO: 1945777 - RNA, 14 nt, Human
acagagucucacug

SEQ ID NO: 1945778 - RNA, 17 nt, Human
acagagucucacuguug

SEQ ID NO: 1945779 - RNA, 19 nt, Human
acagagucucacuguugcc

SEQ ID NO: 1945780 - RNA, 20 nt, Human
acagcagucuuaugcuucca

SEQ ID NO: 1945781 - RNA, 22 nt, Human
acagcagucuuaugcuuccaga

SEQ ID NO: 1945782 - RNA, 15 nt, Human
acacugauccagccc

SEQ ID NO: 1945783 - RNA, 19 nt, Human
acacugagagccuuuuuga

SEQ ID NO: 1945784 - RNA, 17 nt, Human
acacugaagucaguucu

SEQ ID NO: 1945785 - RNA, 16 nt, Human
acacugaauuuuuaug

SEQ ID NO: 1945786 - RNA, 20 nt, Human
acacugaauuuuuaugugug

SEQ ID NO: 1945787 - RNA, 21 nt, Human
acacugaauuuuuauguguga

SEQ ID NO: 1945788 - RNA, 22 nt, Human
acacugaauuuuuaugugugau

SEQ ID NO: 1945789 - RNA, 21 nt, Human
acagaacacauaauucaggaa

SEQ ID NO: 1945790 - RNA, 18 nt, Human
acacuguccuauuauauu

SEQ ID NO: 1945791 - RNA, 16 nt, Human
acacugugacaucucu

SEQ ID NO: 1945792 - RNA, 21 nt, Human
acacugugacaucucuauucc

SEQ ID NO: 1945793 - RNA, 22 nt, Human
acacugugaagagcuggacucc

SEQ ID NO: 1945794 - RNA, 23 nt, Human
acagaaauugguaccuugcacac

SEQ ID NO: 1945795 - RNA, 15 nt, Human
acacugccugccuua

SEQ ID NO: 1945796 - RNA, 16 nt, Human
acacugccugccuuaa

SEQ ID NO: 1945797 - RNA, 20 nt, Human
acacugccugccuuaaguga

SEQ ID NO: 1945798 - RNA, 17 nt, Human
acaaugugacuuugaaa

SEQ ID NO: 1945799 - RNA, 20 nt, Human
acaaugugacuuugaaaaua

SEQ ID NO: 1945800 - RNA, 18 nt, Human
acacaaacgggcucagca

SEQ ID NO: 1945801 - RNA, 21 nt, Human
acaauuuucagauuugcacaa

SEQ ID NO: 1945802 - RNA, 22 nt, Human
acaauuuucagauuugcacaaa

SEQ ID NO: 1945803 - RNA, 13 nt, Human
acaauuuucagau

SEQ ID NO: 1945804 - RNA, 14 nt, Human
acaauuuucagauu

SEQ ID NO: 1945805 - RNA, 15 nt, Human
acaauuuucagauuu

SEQ ID NO: 1945806 - RNA, 16 nt, Human
acaauuuucagauuug

SEQ ID NO: 1945807 - RNA, 17 nt, Human
acaauuuucagauuugc

SEQ ID NO: 1945808 - RNA, 18 nt, Human
acaauuuucagauuugca

SEQ ID NO: 1945809 - RNA, 19 nt, Human
acaauuuucagauuugcac

SEQ ID NO: 1945810 - RNA, 20 nt, Human
acaauuuucagauuugcaca

SEQ ID NO: 1945811 - RNA, 16 nt, Human
acaauuuauuauggca

SEQ ID NO: 1945812 - RNA, 16 nt, Human
acaauuacuuuagaaa

SEQ ID NO: 1945813 - RNA, 13 nt, Human
acaauuucuuuug

SEQ ID NO: 1945814 - RNA, 16 nt, Human
acaauuucuuuugguu

SEQ ID NO: 1945815 - RNA, 13 nt, Human
acaauuucugugu

SEQ ID NO: 1945816 - RNA, 15 nt, Human
acaauuuauuauggc

SEQ ID NO: 1945817 - RNA, 13 nt, Human
acaauguuuacaa

SEQ ID NO: 1945818 - RNA, 16 nt, Human
acaauguuuuaacaag

SEQ ID NO: 1945819 - RNA, 15 nt, Human
acacggacacucaaa

SEQ ID NO: 1945820 - RNA, 18 nt, Human
acacuaaauguuaaagau

SEQ ID NO: 1945821 - RNA, 19 nt, Human
acacuaaauguuaaagaug

SEQ ID NO: 1945822 - RNA, 20 nt, Human
acacuaaauguuaaagaugu

SEQ ID NO: 1945823 - RNA, 21 nt, Human
acacuaaauguuaaagaugua

SEQ ID NO: 1945824 - RNA, 23 nt, Human
acacggagcggauugcaaagcaa

SEQ ID NO: 1945825 - RNA, 12 nt, Human
acacuaaauguu

SEQ ID NO: 1945826 - RNA, 13 nt, Human
acacuaaauguua

SEQ ID NO: 1945827 - RNA, 15 nt, Human
acacuaaauguuaaa

SEQ ID NO: 1945828 - RNA, 14 nt, Human
acacuaaccacgcu

SEQ ID NO: 1945829 - RNA, 15 nt, Human
acacuaaccacgcug

SEQ ID NO: 1945830 - RNA, 23 nt, Human
acacagaaggggacugccaccuc

SEQ ID NO: 1945831 - RNA, 20 nt, Human
acaccaaucuuacuuuguaa

SEQ ID NO: 1945832 - RNA, 22 nt, Human
acaccaaucuuacuuuguaaau

SEQ ID NO: 1945833 - RNA, 23 nt, Human
acaccaaucuuacuuuguaaauu

SEQ ID NO: 1945834 - RNA, 11 nt, Human
acacagcucug

SEQ ID NO: 1945835 - RNA, 12 nt, Human
acacagcucugu

SEQ ID NO: 1945836 - RNA, 14 nt, Human
acaccagacagaca

SEQ ID NO: 1945837 - RNA, 21 nt, Human
acaccacuacauucuguuaau

SEQ ID NO: 1945838 - RNA, 14 nt, Human
acaccacuacauuc

SEQ ID NO: 1945839 - RNA, 12 nt, Human
acaccagagccc

SEQ ID NO: 1945840 - RNA, 17 nt, Human
acacgcuccuuccucug

SEQ ID NO: 1945841 - RNA, 19 nt, Human
acacgcuccuuccucugag

SEQ ID NO: 1945842 - RNA, 23 nt, Human
acacgcugcucugccccagcuug

SEQ ID NO: 1945843 - RNA, 12 nt, Human
acacgcugccuu

SEQ ID NO: 1945844 - RNA, 17 nt, Human
acacgcugcucugcccc

SEQ ID NO: 1945845 - RNA, 18 nt, Human
acacgcugcucugcccca

SEQ ID NO: 1945846 - RNA, 22 nt, Human
acacgcugcucugccccagcuu

SEQ ID NO: 1945847 - RNA, 20 nt, Human
acaagucagucauucagaua

SEQ ID NO: 1945848 - RNA, 21 nt, Human
acaaguaugaauaaagacacc

SEQ ID NO: 1945849 - RNA, 23 nt, Human
acaaguaugaauaaagacaccua

SEQ ID NO: 1945850 - RNA, 16 nt, Human
acaagucccuguaauu

SEQ ID NO: 1945851 - RNA, 17 nt, Human
acaagucccuguaauug

SEQ ID NO: 1945852 - RNA, 16 nt, Human
acaaguaguucuguau

SEQ ID NO: 1945853 - RNA, 17 nt, Human
acaaguaguucuguauu

SEQ ID NO: 1945854 - RNA, 18 nt, Human
acaaguaguucuguauuu

SEQ ID NO: 1945855 - RNA, 19 nt, Human
acaaguaguucuguauuug

SEQ ID NO: 1945856 - RNA, 20 nt, Human
acaaguaguucuguauuuga

SEQ ID NO: 1945857 - RNA, 21 nt, Human
acaaguaguucuguauuugaa

SEQ ID NO: 1945858 - RNA, 22 nt, Human
acaaguaguucuguauuugaaa

SEQ ID NO: 1945859 - RNA, 23 nt, Human
acaaguaguucuguauuugaaag

SEQ ID NO: 1945860 - RNA, 15 nt, Human
acaaaauggaauacu

SEQ ID NO: 1945861 - RNA, 19 nt, Human
acaaaauggaauacucuua

SEQ ID NO: 1945862 - RNA, 16 nt, Human
aauuuugauaguggga

SEQ ID NO: 1945863 - RNA, 22 nt, Human
aauuuugaaaaguaauauuuau

SEQ ID NO: 1945864 - RNA, 12 nt, Human
aauuuucuuuca

SEQ ID NO: 1945865 - RNA, 13 nt, Human
aauuuugaaaagu

SEQ ID NO: 1945866 - RNA, 20 nt, Human
aauuuugaaaaguaauauuu

SEQ ID NO: 1945867 - RNA, 21 nt, Human
aauuuugaaaaguaauauuua

SEQ ID NO: 1945868 - RNA, 20 nt, Human
acaaaauggaauacucuuau

SEQ ID NO: 1945869 - RNA, 12 nt, Human
acaaaauguaac

SEQ ID NO: 1945870 - RNA, 13 nt, Human
acaaaauguaacu

SEQ ID NO: 1945871 - RNA, 20 nt, Human
acaaaauguaggguuauaau

SEQ ID NO: 1945872 - RNA, 14 nt, Human
acaaaauguaacug

SEQ ID NO: 1945873 - RNA, 16 nt, Human
acaaaauguaacuguu

SEQ ID NO: 1945874 - RNA, 17 nt, Human
acaaaauguaacuguua

SEQ ID NO: 1945875 - RNA, 20 nt, Human
acaaaauguaacuguuacca

SEQ ID NO: 1945876 - RNA, 23 nt, Human
acaaaauguaacuguuaccauug

SEQ ID NO: 1945877 - RNA, 15 nt, Human
acaaacgggcucagc

SEQ ID NO: 1945878 - RNA, 21 nt, Human
acaaaccuguuucugcagcca

SEQ ID NO: 1945879 - RNA, 20 nt, Human
acaaagagcguugaaguuga

SEQ ID NO: 1945880 - RNA, 18 nt, Human
acaacuaugauuuggaaa

SEQ ID NO: 1945881 - RNA, 13 nt, Human
acaaagacugagu

SEQ ID NO: 1945882 - RNA, 21 nt, Human
aauuuuauaaggacuuccuga

SEQ ID NO: 1945883 - RNA, 13 nt, Human
aauuuugaaaaac

SEQ ID NO: 1945884 - RNA, 20 nt, Human
aauuauaaacucauuuugcu

SEQ ID NO: 1945885 - RNA, 12 nt, Human
aauuauaaugua

SEQ ID NO: 1945886 - RNA, 13 nt, Human
aauuauaauguau

SEQ ID NO: 1945887 - RNA, 14 nt, Human
aauuauaauguauu

SEQ ID NO: 1945888 - RNA, 18 nt, Human
agaaauaaaguuucuguu

SEQ ID NO: 1945889 - RNA, 15 nt, Human
agaaauaaaguuucu

SEQ ID NO: 1945890 - RNA, 20 nt, Human
agaaaggaggggauagagag

SEQ ID NO: 1945891 - RNA, 23 nt, Human
agaaaggaggggauagagagaga

SEQ ID NO: 1945892 - RNA, 16 nt, Human
agaaaggaccugcaaa

SEQ ID NO: 1945893 - RNA, 17 nt, Human
acuuuagugcuacagaa

SEQ ID NO: 1945894 - RNA, 22 nt, Human
acuuucauauuuuaaacagagg

SEQ ID NO: 1945895 - RNA, 23 nt, Human
acuuuagggaaguacuuuuggca

SEQ ID NO: 1945896 - RNA, 17 nt, Human
acuuuccaauucuccuu

SEQ ID NO: 1945897 - RNA, 18 nt, Human
acuuuccaauucuccuuu

SEQ ID NO: 1945898 - RNA, 19 nt, Human
acuuuccaauucuccuuua

SEQ ID NO: 1945899 - RNA, 23 nt, Human
acuuuccuucauucaacccaccu

SEQ ID NO: 1945900 - RNA, 17 nt, Human
acuuucuacucauuuua

SEQ ID NO: 1945901 - RNA, 23 nt, Human
acuuuguucuggcucuuccaggc

SEQ ID NO: 1945902 - RNA, 19 nt, Human
acuuucuacucauuuuaau

SEQ ID NO: 1945903 - RNA, 14 nt, Human
acuuuuccuugcau

SEQ ID NO: 1945904 - RNA, 15 nt, Human
acuuuuccuugcaua

SEQ ID NO: 1945905 - RNA, 18 nt, Human
acuuuuccuugcauacaa

SEQ ID NO: 1945906 - RNA, 21 nt, Human
acuuuuccuugcauacaaaca

SEQ ID NO: 1945907 - RNA, 22 nt, Human
acuuuuccuugcauacaaacaa

SEQ ID NO: 1945908 - RNA, 23 nt, Human
acuuuucuaaacuaggcuccuuc

SEQ ID NO: 1945909 - RNA, 15 nt, Human
acuuuuauaaacuuu

SEQ ID NO: 1945910 - RNA, 19 nt, Human
acuuuuauaaacuuuaccu

SEQ ID NO: 1945911 - RNA, 22 nt, Human
acuuuuauaaacuuuaccuuuu

SEQ ID NO: 1945912 - RNA, 18 nt, Human
agaaaaguugaauuuuac

SEQ ID NO: 1945913 - RNA, 21 nt, Human
agaaaaguugaauuuuacaug

SEQ ID NO: 1945914 - RNA, 21 nt, Human
agaaaaggugauaaaaucaua

SEQ ID NO: 1945915 - RNA, 13 nt, Human
agaaaaggucuug

SEQ ID NO: 1945916 - RNA, 16 nt, Human
agaaaaggugauaaaa

SEQ ID NO: 1945917 - RNA, 16 nt, Human
agaaaauaaaaaaaag

SEQ ID NO: 1945918 - RNA, 17 nt, Human
agaaaauaaaaaaaaga

SEQ ID NO: 1945919 - RNA, 18 nt, Human
agaaaauaaaaaaaagaa

SEQ ID NO: 1945920 - RNA, 19 nt, Human
agaaaauaaaaaaaagaaa

SEQ ID NO: 1945921 - RNA, 20 nt, Human
agaaaauaaaaaaaagaaaa

SEQ ID NO: 1945922 - RNA, 21 nt, Human
agaaaauaaaaaaaagaaaaa

SEQ ID NO: 1945923 - RNA, 22 nt, Human
agaaaauaaaaaaaagaaaaaa

SEQ ID NO: 1945924 - RNA, 15 nt, Human
agaaacaaacaaaag

SEQ ID NO: 1945925 - RNA, 16 nt, Human
agaaaauguucuucca

SEQ ID NO: 1945926 - RNA, 23 nt, Human
agaaaauggacguguuaugacuc

SEQ ID NO: 1945927 - RNA, 22 nt, Human
agaaaauggacguguuaugacu

SEQ ID NO: 1945928 - RNA, 20 nt, Human
agaaaauggacguguuauga

SEQ ID NO: 1945929 - RNA, 15 nt, Human
agaaaauggacgugu

SEQ ID NO: 1945930 - RNA, 23 nt, Human
agaaaauggaagacagcucuuau

SEQ ID NO: 1945931 - RNA, 14 nt, Human
agaaaauauguauu

SEQ ID NO: 1945932 - RNA, 22 nt, Human
agaaaauaugucccagaaaugu

SEQ ID NO: 1945933 - RNA, 16 nt, Human
acugcauuuagggagu

SEQ ID NO: 1945934 - RNA, 14 nt, Human
acugccaaccucgc

SEQ ID NO: 1945935 - RNA, 18 nt, Human
acugccaaccucgcucca

SEQ ID NO: 1945936 - RNA, 14 nt, Human
acugcauuuaggga

SEQ ID NO: 1945937 - RNA, 19 nt, Human
acugcauuuagggaguauu

SEQ ID NO: 1945938 - RNA, 15 nt, Human
acugccacaaggaag

SEQ ID NO: 1945939 - RNA, 17 nt, Human
acugccacaaggaagaa

SEQ ID NO: 1945940 - RNA, 18 nt, Human
acugccacaaggaagaaa

SEQ ID NO: 1945941 - RNA, 20 nt, Human
acugccacaaggaagaaauu

SEQ ID NO: 1945942 - RNA, 19 nt, Human
acugccaacugaucuguua

SEQ ID NO: 1945943 - RNA, 17 nt, Human
acugccaacugaucugu

SEQ ID NO: 1945944 - RNA, 15 nt, Human
acugaagucaguucu

SEQ ID NO: 1945945 - RNA, 13 nt, Human
acugaaggccacu

SEQ ID NO: 1945946 - RNA, 21 nt, Human
acugaaggccacuugaguugg

SEQ ID NO: 1945947 - RNA, 16 nt, Human
acuggaagcacagcuu

SEQ ID NO: 1945948 - RNA, 15 nt, Human
acuggaagcacagcu

SEQ ID NO: 1945949 - RNA, 14 nt, Human
acuggaagcacagc

SEQ ID NO: 1945950 - RNA, 19 nt, Human
acugcccccucugcccugc

SEQ ID NO: 1945951 - RNA, 18 nt, Human
acugcccccucugcccug

SEQ ID NO: 1945952 - RNA, 11 nt, Human
acugccaccuc

SEQ ID NO: 1945953 - RNA, 12 nt, Human
acugccaccucc

SEQ ID NO: 1945954 - RNA, 13 nt, Human
acugccaccuccc

SEQ ID NO: 1945955 - RNA, 23 nt, Human
acugccaccuccccuugccagcu

SEQ ID NO: 1945956 - RNA, 20 nt, Human
acugcccccucugcccugcg

SEQ ID NO: 1945957 - RNA, 14 nt, Human
acuggagaaaaugg

SEQ ID NO: 1945958 - RNA, 21 nt, Human
acugucuaagauuaauagcau

SEQ ID NO: 1945959 - RNA, 17 nt, Human
acugucuagcacuuccu

SEQ ID NO: 1945960 - RNA, 18 nt, Human
acugucuagcacuuccuu

SEQ ID NO: 1945961 - RNA, 19 nt, Human
acugucuagcacuuccuug

SEQ ID NO: 1945962 - RNA, 21 nt, Human
acugucuagcacuuccuugcc

SEQ ID NO: 1945963 - RNA, 24 nt, Human
acugucuagcacuuccuugccagu

SEQ ID NO: 1945964 - RNA, 23 nt, Human
acugguggcccgacagccuggca

SEQ ID NO: 1945965 - RNA, 21 nt, Human
acugguggcccgacagccugg

SEQ ID NO: 1945966 - RNA, 22 nt, Human
acugguggcccgacagccuggc

SEQ ID NO: 1945967 - RNA, 20 nt, Human
acugguggcccgacagccug

SEQ ID NO: 1945968 - RNA, 16 nt, Human
acugugccaugugcca

SEQ ID NO: 1945969 - RNA, 13 nt, Human
acugugauuugaa

SEQ ID NO: 1945970 - RNA, 12 nt, Human
acugucugucug

SEQ ID NO: 1945971 - RNA, 12 nt, Human
acugucuucagu

SEQ ID NO: 1945972 - RNA, 20 nt, Human
acuuauuguagcauccugga

SEQ ID NO: 1945973 - RNA, 23 nt, Human
acuuauuguagcauccuggaaua

SEQ ID NO: 1945974 - RNA, 19 nt, Human
acuucacauauugauuucc

SEQ ID NO: 1945975 - RNA, 15 nt, Human
acuguuguauaaauu

SEQ ID NO: 1945976 - RNA, 19 nt, Human
acuguuguauaaauuuauu

SEQ ID NO: 1945977 - RNA, 16 nt, Human
acuguuuaagacacuu

SEQ ID NO: 1945978 - RNA, 14 nt, Human
acuguuuagaugaa

SEQ ID NO: 1945979 - RNA, 13 nt, Human
acuguuuagauuu

SEQ ID NO: 1945980 - RNA, 22 nt, Human
acuguuuguuccagaaucugua

SEQ ID NO: 1945981 - RNA, 13 nt, Human
acuguuucaaacu

SEQ ID NO: 1945982 - RNA, 19 nt, Human
acuguuuagauuugccaua

SEQ ID NO: 1945983 - RNA, 20 nt, Human
acuguuuagauuugccauag

SEQ ID NO: 1945984 - RNA, 21 nt, Human
acuuggucugugagaugcuag

SEQ ID NO: 1945985 - RNA, 20 nt, Human
acuuguaaaugugguaaaga

SEQ ID NO: 1945986 - RNA, 12 nt, Human
acuucuuucacu

SEQ ID NO: 1945987 - RNA, 18 nt, Human
acuuguaaaugugguaaa

SEQ ID NO: 1945988 - RNA, 19 nt, Human
acuuguaaaggaauuuaaa

SEQ ID NO: 1945989 - RNA, 20 nt, Human
acuuguaaaggaauuuaaaa

SEQ ID NO: 1945990 - RNA, 14 nt, Human
acuuggucugugag

SEQ ID NO: 1945991 - RNA, 15 nt, Human
acuuggucugugaga

SEQ ID NO: 1945992 - RNA, 18 nt, Human
acuuguaaaggaauuuaa

SEQ ID NO: 1945993 - RNA, 23 nt, Human
acuucacauauugauuuccguua

SEQ ID NO: 1945994 - RNA, 18 nt, Human
acuucugacucuucccca

SEQ ID NO: 1945995 - RNA, 16 nt, Human
acuucugacucuuccc

SEQ ID NO: 1945996 - RNA, 12 nt, Human
acuucugccaga

SEQ ID NO: 1945997 - RNA, 19 nt, Human
acuucugccagauguccua

SEQ ID NO: 1945998 - RNA, 22 nt, Human
acuucugccagcauaauacuug

SEQ ID NO: 1945999 - RNA, 18 nt, Human
acuucugccauauucugu

SEQ ID NO: 1946000 - RNA, 19 nt, Human
acuucugccauauucuguu

SEQ ID NO: 1946001 - RNA, 12 nt, Human
acuucuuucccu

SEQ ID NO: 1946002 - RNA, 17 nt, Human
acuucuuucccuuccuc

SEQ ID NO: 1946003 - RNA, 18 nt, Human
acuucuuucccuuccucc

SEQ ID NO: 1946004 - RNA, 19 nt, Human
acuucuuucccuuccucca

SEQ ID NO: 1946005 - RNA, 14 nt, Human
acuucuuugcaguu

SEQ ID NO: 1946006 - RNA, 21 nt, Human
acuucuuugcaguucccaucu

SEQ ID NO: 1946007 - RNA, 18 nt, Human
acucuacccucuuagaaa

SEQ ID NO: 1946008 - RNA, 13 nt, Human
acucuacccucuu

SEQ ID NO: 1946009 - RNA, 21 nt, Human
acucuacccucuuagaaaaac

SEQ ID NO: 1946010 - RNA, 16 nt, Human
acucuaccugcacacu

SEQ ID NO: 1946011 - RNA, 18 nt, Human
acucuuaaaacccaagug

SEQ ID NO: 1946012 - RNA, 11 nt, Human
acucuuaaaac

SEQ ID NO: 1946013 - RNA, 16 nt, Human
acucugugucaggugg

SEQ ID NO: 1946014 - RNA, 16 nt, Human
acucugggcuccagag

SEQ ID NO: 1946015 - RNA, 14 nt, Human
acucugggcuccag

SEQ ID NO: 1946016 - RNA, 22 nt, Human
acucugggaacuucuuugcagu

SEQ ID NO: 1946017 - RNA, 11 nt, Human
acucugggaac

SEQ ID NO: 1946018 - RNA, 16 nt, Human
acucuaucaaguauua

SEQ ID NO: 1946019 - RNA, 14 nt, Human
acucuaucaaguau

SEQ ID NO: 1946020 - RNA, 12 nt, Human
acucccuuucaa

SEQ ID NO: 1946021 - RNA, 13 nt, Human
acucccuuucaac

SEQ ID NO: 1946022 - RNA, 21 nt, Human
acucccgagacggcacugaga

SEQ ID NO: 1946023 - RNA, 22 nt, Human
acucccguguaggaaccugcac

SEQ ID NO: 1946024 - RNA, 14 nt, Human
acucagcaccacuc

SEQ ID NO: 1946025 - RNA, 17 nt, Human
acucagcaccacucaag

SEQ ID NO: 1946026 - RNA, 21 nt, Human
acucagcaccacucaagacca

SEQ ID NO: 1946027 - RNA, 22 nt, Human
acucagcaccacucaagaccaa

SEQ ID NO: 1946028 - RNA, 19 nt, Human
acucaaagcaaaagugcug

SEQ ID NO: 1946029 - RNA, 16 nt, Human
acucaaacucuuaaaa

SEQ ID NO: 1946030 - RNA, 17 nt, Human
acucaaacucuuaaaac

SEQ ID NO: 1946031 - RNA, 11 nt, Human
acuauaaugua

SEQ ID NO: 1946032 - RNA, 18 nt, Human
acucaaaagcugggcagg

SEQ ID NO: 1946033 - RNA, 19 nt, Human
acuauaacauagaauugca

SEQ ID NO: 1946034 - RNA, 23 nt, Human
acuauaacauagaauugcaaucu

SEQ ID NO: 1946035 - RNA, 17 nt, Human
acuccccagccagccug

SEQ ID NO: 1946036 - RNA, 21 nt, Human
acuccccagccagccuggcug

SEQ ID NO: 1946037 - RNA, 14 nt, Human
acucccccaggugg

SEQ ID NO: 1946038 - RNA, 19 nt, Human
acuccccgccguacaguuc

SEQ ID NO: 1946039 - RNA, 17 nt, Human
acuccccugcugggugu

SEQ ID NO: 1946040 - RNA, 13 nt, Human
acuccccugcugg

SEQ ID NO: 1946041 - RNA, 12 nt, Human
acuccccuccuu

SEQ ID NO: 1946042 - RNA, 22 nt, Human
acucagcucuuggcuccacugg

SEQ ID NO: 1946043 - RNA, 17 nt, Human
acucaggcccaaagccu

SEQ ID NO: 1946044 - RNA, 13 nt, Human
acucagucuuuaa

SEQ ID NO: 1946045 - RNA, 14 nt, Human
acucaguggggagg

SEQ ID NO: 1946046 - RNA, 15 nt, Human
acuaggaaggcacuu

SEQ ID NO: 1946047 - RNA, 16 nt, Human
acuaggguccugggga

SEQ ID NO: 1946048 - RNA, 15 nt, Human
acuaggguccugggg

SEQ ID NO: 1946049 - RNA, 14 nt, Human
acuagcuauggugu

SEQ ID NO: 1946050 - RNA, 21 nt, Human
acuagccaacggccccagcuu

SEQ ID NO: 1946051 - RNA, 23 nt, Human
acuagccaacggccccagcuucu

SEQ ID NO: 1946052 - RNA, 13 nt, Human
acgauuuaauuua

SEQ ID NO: 1946053 - RNA, 14 nt, Human
acgauuuaauuuau

SEQ ID NO: 1946054 - RNA, 12 nt, Human
acgauuucuguu

SEQ ID NO: 1946055 - RNA, 13 nt, Human
acgauuucuguuu

SEQ ID NO: 1946056 - RNA, 14 nt, Human
acgauuucuguuua

SEQ ID NO: 1946057 - RNA, 17 nt, Human
acgauuucuguuuagau

SEQ ID NO: 1946058 - RNA, 18 nt, Human
acgccacugcacuauagc

SEQ ID NO: 1946059 - RNA, 15 nt, Human
acuaaguuuuuaugg

SEQ ID NO: 1946060 - RNA, 22 nt, Human
acuaaguuuuuauggcuuuugu

SEQ ID NO: 1946061 - RNA, 18 nt, Human
acgcugugcugcccugcc

SEQ ID NO: 1946062 - RNA, 17 nt, Human
acgcugugcugcccugc

SEQ ID NO: 1946063 - RNA, 16 nt, Human
acgcugugcugcccug

SEQ ID NO: 1946064 - RNA, 15 nt, Human
acgcugugcugcccu

SEQ ID NO: 1946065 - RNA, 15 nt, Human
acguggcugcuucaa

SEQ ID NO: 1946066 - RNA, 14 nt, Human
acguggcugcuuca

SEQ ID NO: 1946067 - RNA, 13 nt, Human
acguggcugcuuc

SEQ ID NO: 1946068 - RNA, 19 nt, Human
acgugcacaaauucaugug

SEQ ID NO: 1946069 - RNA, 20 nt, Human
acuaagaggaaaguacauuu

SEQ ID NO: 1946070 - RNA, 21 nt, Human
acuaagaggaaaguacauuuu

SEQ ID NO: 1946071 - RNA, 11 nt, Human
acguggcugcu

SEQ ID NO: 1946072 - RNA, 17 nt, Human
acuaagaucgguuaaca

SEQ ID NO: 1946073 - RNA, 19 nt, Human
acuaagaucgguuaacaaa

SEQ ID NO: 1946074 - RNA, 20 nt, Human
acuaagaucgguuaacaaau

SEQ ID NO: 1946075 - RNA, 21 nt, Human
acuaagaucgguuaacaaaua

SEQ ID NO: 1946076 - RNA, 22 nt, Human
acuaagaucgguuaacaaauaa

SEQ ID NO: 1946077 - RNA, 21 nt, Human
accugcccaaccugcucuccu

SEQ ID NO: 1946078 - RNA, 13 nt, Human
accugcccaaccu

SEQ ID NO: 1946079 - RNA, 17 nt, Human
accucuuccuggccggu

SEQ ID NO: 1946080 - RNA, 23 nt, Human
accugccccucaacucuccucca

SEQ ID NO: 1946081 - RNA, 14 nt, Human
accugccccuccuc

SEQ ID NO: 1946082 - RNA, 18 nt, Human
accugccccuccucucug

SEQ ID NO: 1946083 - RNA, 18 nt, Human
accucugcacaagcugca

SEQ ID NO: 1946084 - RNA, 16 nt, Human
accucugcacaagcug

SEQ ID NO: 1946085 - RNA, 21 nt, Human
accucugcacaagcugcaccc

SEQ ID NO: 1946086 - RNA, 23 nt, Human
accuuucaauaggaaaaacugau

SEQ ID NO: 1946087 - RNA, 21 nt, Human
accuuucaauaggaaaaacug

SEQ ID NO: 1946088 - RNA, 17 nt, Human
accuuucaauaggaaaa

SEQ ID NO: 1946089 - RNA, 20 nt, Human
accugccccuccucucugcc

SEQ ID NO: 1946090 - RNA, 22 nt, Human
accugccccuccucucugcccu

SEQ ID NO: 1946091 - RNA, 15 nt, Human
accuguaaugacagg

SEQ ID NO: 1946092 - RNA, 20 nt, Human
accuguaaugacaggccugu

SEQ ID NO: 1946093 - RNA, 14 nt, Human
accuuggcucaagu

SEQ ID NO: 1946094 - RNA, 12 nt, Human
accuuggcugca

SEQ ID NO: 1946095 - RNA, 12 nt, Human
accuuggcucaa

SEQ ID NO: 1946096 - RNA, 16 nt, Human
accuuucaauaggaaa

SEQ ID NO: 1946097 - RNA, 12 nt, Human
accuuuauucug

SEQ ID NO: 1946098 - RNA, 13 nt, Human
accuuuauucugg

SEQ ID NO: 1946099 - RNA, 14 nt, Human
accuuggcugcagg

SEQ ID NO: 1946100 - RNA, 16 nt, Human
accuuguaauguaacu

SEQ ID NO: 1946101 - RNA, 17 nt, Human
accuuguaauguaacug

SEQ ID NO: 1946102 - RNA, 22 nt, Human
accuuguaauguaacugcucuu

SEQ ID NO: 1946103 - RNA, 18 nt, Human
accuugucauuuuggucu

SEQ ID NO: 1946104 - RNA, 13 nt, Human
aacuuugaccucu

SEQ ID NO: 1946105 - RNA, 11 nt, Human
aacuuugaaau

SEQ ID NO: 1946106 - RNA, 13 nt, Human
aacuuugaaauau

SEQ ID NO: 1946107 - RNA, 14 nt, Human
aacuuugaaauaua

SEQ ID NO: 1946108 - RNA, 21 nt, Human
aacuuucuuaauauuuuuaca

SEQ ID NO: 1946109 - RNA, 14 nt, Human
aacuuugaccucug

SEQ ID NO: 1946110 - RNA, 17 nt, Human
aacuuugaccucugcag

SEQ ID NO: 1946111 - RNA, 12 nt, Human
aacuuuuauaaa

SEQ ID NO: 1946112 - RNA, 15 nt, Human
aacuuuuauaaacuu

SEQ ID NO: 1946113 - RNA, 13 nt, Human
aacuuuguauagu

SEQ ID NO: 1946114 - RNA, 14 nt, Human
aacuuuguauaguu

SEQ ID NO: 1946115 - RNA, 15 nt, Human
aacuuuguauaguua

SEQ ID NO: 1946116 - RNA, 20 nt, Human
aacuuuguuaggccaaagac

SEQ ID NO: 1946117 - RNA, 20 nt, Human
aacuuuguauaguuauguaa

SEQ ID NO: 1946118 - RNA, 21 nt, Human
aacuuuguauaguuauguaaa

SEQ ID NO: 1946119 - RNA, 22 nt, Human
aacuuuguauaguuauguaaau

SEQ ID NO: 1946120 - RNA, 19 nt, Human
aacuuugaccucugcagca

SEQ ID NO: 1946121 - RNA, 20 nt, Human
aacuuugaccucugcagcaa

SEQ ID NO: 1946122 - RNA, 16 nt, Human
aacuuugaaauauaug

SEQ ID NO: 1946123 - RNA, 16 nt, Human
aacuuugagaucuaaa

SEQ ID NO: 1946124 - RNA, 16 nt, Human
aacuuuuauaaacuuu

SEQ ID NO: 1946125 - RNA, 19 nt, Human
aacuuuuauaaacuuuacc

SEQ ID NO: 1946126 - RNA, 16 nt, Human
aacuuuuuuuucuuuu

SEQ ID NO: 1946127 - RNA, 20 nt, Human
aagaaaaaaaaaaagaaaga

SEQ ID NO: 1946128 - RNA, 21 nt, Human
aagaaaaaaaaaaagaaagaa

SEQ ID NO: 1946129 - RNA, 17 nt, Human
aacuuuuuuuucuuuuu

SEQ ID NO: 1946130 - RNA, 18 nt, Human
aacuuuuuuuucuuuuuu

SEQ ID NO: 1946131 - RNA, 14 nt, Human
aagaaaucuauaga

SEQ ID NO: 1946132 - RNA, 16 nt, Human
aagaaaucuauagaaa

SEQ ID NO: 1946133 - RNA, 20 nt, Human
aagaaaucuauagaaagugu

SEQ ID NO: 1946134 - RNA, 12 nt, Human
aagaaaugaaga

SEQ ID NO: 1946135 - RNA, 13 nt, Human
aagaaaugaagag

SEQ ID NO: 1946136 - RNA, 13 nt, Human
aacuucacauauu

SEQ ID NO: 1946137 - RNA, 16 nt, Human
aacucaccugccccuc

SEQ ID NO: 1946138 - RNA, 15 nt, Human
aacucaccugccccu

SEQ ID NO: 1946139 - RNA, 15 nt, Human
aacucaccccagccc

SEQ ID NO: 1946140 - RNA, 12 nt, Human
aacucaccccag

SEQ ID NO: 1946141 - RNA, 23 nt, Human
aacugaacucugacaacagacuu

SEQ ID NO: 1946142 - RNA, 19 nt, Human
aacugaacucugacaacag

SEQ ID NO: 1946143 - RNA, 20 nt, Human
aacugaacucugacaacaga

SEQ ID NO: 1946144 - RNA, 16 nt, Human
aacugaacucugacaa

SEQ ID NO: 1946145 - RNA, 12 nt, Human
aacuuaguuuug

SEQ ID NO: 1946146 - RNA, 16 nt, Human
aacuuaguuuugcaua

SEQ ID NO: 1946147 - RNA, 15 nt, Human
aacuuauauuguaag

SEQ ID NO: 1946148 - RNA, 19 nt, Human
aacuuauauuguaagaaau

SEQ ID NO: 1946149 - RNA, 20 nt, Human
aacuuauauuguaagaaaua

SEQ ID NO: 1946150 - RNA, 21 nt, Human
aacuuauauuguaagaaauac

SEQ ID NO: 1946151 - RNA, 17 nt, Human
aacuuaaauaaugugaa

SEQ ID NO: 1946152 - RNA, 19 nt, Human
aacuuaaauaaugugaaac

SEQ ID NO: 1946153 - RNA, 14 nt, Human
aacugaccagccuc

SEQ ID NO: 1946154 - RNA, 19 nt, Human
aacugaccagccuccaugc

SEQ ID NO: 1946155 - RNA, 17 nt, Human
aacugauuuuuuuuucc

SEQ ID NO: 1946156 - RNA, 18 nt, Human
aacugauuaguaagucuu

SEQ ID NO: 1946157 - RNA, 13 nt, Human
aacugaucuguua

SEQ ID NO: 1946158 - RNA, 15 nt, Human
aacugaucuguuaua

SEQ ID NO: 1946159 - RNA, 19 nt, Human
aacugauuuuuuuuuccuu

SEQ ID NO: 1946160 - RNA, 14 nt, Human
aacccuggugacca

SEQ ID NO: 1946161 - RNA, 17 nt, Human
aacccugucaaacauua

SEQ ID NO: 1946162 - RNA, 19 nt, Human
aacccugucaaacauuagu

SEQ ID NO: 1946163 - RNA, 23 nt, Human
aacccugucaaacauuaguacuu

SEQ ID NO: 1946164 - RNA, 12 nt, Human
aaccagaucauu

SEQ ID NO: 1946165 - RNA, 14 nt, Human
aaccagaucauugu

SEQ ID NO: 1946166 - RNA, 11 nt, Human
aaccacugaau

SEQ ID NO: 1946167 - RNA, 13 nt, Human
aaccacugaaucu

SEQ ID NO: 1946168 - RNA, 17 nt, Human
aaccacugaaucuggac

SEQ ID NO: 1946169 - RNA, 21 nt, Human
aacauguaauuaaguacuaug

SEQ ID NO: 1946170 - RNA, 14 nt, Human
aacauguaauuaag

SEQ ID NO: 1946171 - RNA, 23 nt, Human
aacauguaauuaaguacuaugua

SEQ ID NO: 1946172 - RNA, 22 nt, Human
aaccacucuaucaaguauuaua

SEQ ID NO: 1946173 - RNA, 21 nt, Human
aaccagucuuucaacucauug

SEQ ID NO: 1946174 - RNA, 13 nt, Human
aacaugauuuggg

SEQ ID NO: 1946175 - RNA, 21 nt, Human
aacaucauagaaacugucuag

SEQ ID NO: 1946176 - RNA, 21 nt, Human
aacaucagguuaggcaguaua

SEQ ID NO: 1946177 - RNA, 22 nt, Human
aacaucagguuaggcaguauaa

SEQ ID NO: 1946178 - RNA, 13 nt, Human
aacaucauuccuu

SEQ ID NO: 1946179 - RNA, 14 nt, Human
aacaucauuccuuu

SEQ ID NO: 1946180 - RNA, 17 nt, Human
aacaugagguucucucu

SEQ ID NO: 1946181 - RNA, 13 nt, Human
aacagcucgacuu

SEQ ID NO: 1946182 - RNA, 19 nt, Human
aacaccuucuauagcauca

SEQ ID NO: 1946183 - RNA, 21 nt, Human
aacaaaaccaaaaguuauuaa

SEQ ID NO: 1946184 - RNA, 21 nt, Human
aacaaaagcgacccauucaga

SEQ ID NO: 1946185 - RNA, 11 nt, Human
aacaaaaggca

SEQ ID NO: 1946186 - RNA, 13 nt, Human
aacaaaauacauu

SEQ ID NO: 1946187 - RNA, 14 nt, Human
aacaaaauacauuc

SEQ ID NO: 1946188 - RNA, 17 nt, Human
aacaaaauacauucuuu

SEQ ID NO: 1946189 - RNA, 17 nt, Human
aacaaagaaauuaugug

SEQ ID NO: 1946190 - RNA, 15 nt, Human
aacaaagaaauuaug

SEQ ID NO: 1946191 - RNA, 18 nt, Human
aacaaaauacauucuuuu

SEQ ID NO: 1946192 - RNA, 21 nt, Human
aacaaacugcacaugauuuca

SEQ ID NO: 1946193 - RNA, 22 nt, Human
aacaaacugcacaugauuucac

SEQ ID NO: 1946194 - RNA, 24 nt, Human
aacaaacugcacaugauuucacaa

SEQ ID NO: 1946195 - RNA, 18 nt, Human
aaauugauguugaugcaa

SEQ ID NO: 1946196 - RNA, 12 nt, Human
aaauugauguug

SEQ ID NO: 1946197 - RNA, 13 nt, Human
aaauugauguuga

SEQ ID NO: 1946198 - RNA, 14 nt, Human
aaauugauguugau

SEQ ID NO: 1946199 - RNA, 15 nt, Human
aaauugauguugaug

SEQ ID NO: 1946200 - RNA, 18 nt, Human
aaauugcauuuccugaca

SEQ ID NO: 1946201 - RNA, 13 nt, Human
aaauugcuuuuga

SEQ ID NO: 1946202 - RNA, 23 nt, Human
aaauuggaguuggaguagaaugu

SEQ ID NO: 1946203 - RNA, 16 nt, Human
aacaccaaaaaauauc

SEQ ID NO: 1946204 - RNA, 17 nt, Human
aacaccaaaaaauaucu

SEQ ID NO: 1946205 - RNA, 15 nt, Human
aacaccugacagccc

SEQ ID NO: 1946206 - RNA, 18 nt, Human
aacaccugacagccccuc

SEQ ID NO: 1946207 - RNA, 19 nt, Human
aacacauuuuucuuaggga

SEQ ID NO: 1946208 - RNA, 22 nt, Human
aacaccaaaaaaauccagaaac

SEQ ID NO: 1946209 - RNA, 15 nt, Human
aacaccaaaaaauau

SEQ ID NO: 1946210 - RNA, 23 nt, Human
aacaagaauaaaggcagcuguug

SEQ ID NO: 1946211 - RNA, 22 nt, Human
aacaaagcauuugacuuucugu

SEQ ID NO: 1946212 - RNA, 14 nt, Human
aacaaagaccaauu

SEQ ID NO: 1946213 - RNA, 16 nt, Human
aacaaagaccaauuuu

SEQ ID NO: 1946214 - RNA, 21 nt, Human
aacaaagaccaauuuuuugug

SEQ ID NO: 1946215 - RNA, 15 nt, Human
aacaacuuuuuuuuc

SEQ ID NO: 1946216 - RNA, 13 nt, Human
aaaacacauuuuu

SEQ ID NO: 1946217 - RNA, 15 nt, Human
aaaacacauuuuucu

SEQ ID NO: 1946218 - RNA, 13 nt, Human
aaaauucagugga

SEQ ID NO: 1946219 - RNA, 18 nt, Human
aaacacuguucucugccc

SEQ ID NO: 1946220 - RNA, 17 nt, Human
aaacacucuugaaaaau

SEQ ID NO: 1946221 - RNA, 14 nt, Human
aaacacucuugaaa

SEQ ID NO: 1946222 - RNA, 13 nt, Human
aaacacucuugaa

SEQ ID NO: 1946223 - RNA, 12 nt, Human
aaaauugccuuu

SEQ ID NO: 1946224 - RNA, 22 nt, Human
aaaauugccuuucuguguuuau

SEQ ID NO: 1946225 - RNA, 22 nt, Human
aaaauugcuuuugagagaacau

SEQ ID NO: 1946226 - RNA, 22 nt, Human
aaacagacuuguauauucuauu

SEQ ID NO: 1946227 - RNA, 18 nt, Human
aaacacuucauugaaaau

SEQ ID NO: 1946228 - RNA, 23 nt, Human
aaacacuguuuguuccagaaucu

SEQ ID NO: 1946229 - RNA, 22 nt, Human
aaacacuguucucugcccucca

SEQ ID NO: 1946230 - RNA, 19 nt, Human
aaacacuguucucugcccu

SEQ ID NO: 1946231 - RNA, 17 nt, Human
aaacagauuuggaaaga

SEQ ID NO: 1946232 - RNA, 13 nt, Human
aaacagaggacca

SEQ ID NO: 1946233 - RNA, 16 nt, Human
aaacagaggaccagca

SEQ ID NO: 1946234 - RNA, 17 nt, Human
aaacagaguaaucuugu

SEQ ID NO: 1946235 - RNA, 18 nt, Human
aaacagaguaaucuuguu

SEQ ID NO: 1946236 - RNA, 14 nt, Human
aaacagaugcucug

SEQ ID NO: 1946237 - RNA, 13 nt, Human
aaagaaauuaugu

SEQ ID NO: 1946238 - RNA, 12 nt, Human
aaagaaauaauu

SEQ ID NO: 1946239 - RNA, 13 nt, Human
aaagaaauaauuu

SEQ ID NO: 1946240 - RNA, 15 nt, Human
aaagaaagaggaaaa

SEQ ID NO: 1946241 - RNA, 16 nt, Human
aaagaaagaggaaaag

SEQ ID NO: 1946242 - RNA, 22 nt, Human
aaagaaauuagggcucuaauuu

SEQ ID NO: 1946243 - RNA, 15 nt, Human
aaagaaauuaugugc

SEQ ID NO: 1946244 - RNA, 11 nt, Human
aaagaacaucc

SEQ ID NO: 1946245 - RNA, 11 nt, Human
aaagagguuuu

SEQ ID NO: 1946246 - RNA, 17 nt, Human
aaagauaccuuaaaauu

SEQ ID NO: 1946247 - RNA, 18 nt, Human
aaagauaccuuaaaauuu

SEQ ID NO: 1946248 - RNA, 19 nt, Human
aaagauaccuuaaaauuug

SEQ ID NO: 1946249 - RNA, 20 nt, Human
aaagauaccuuaaaauuuga

SEQ ID NO: 1946250 - RNA, 21 nt, Human
aaagauaccuuaaaauuugaa

SEQ ID NO: 1946251 - RNA, 22 nt, Human
aaagauaccuuaaaauuugaaa

SEQ ID NO: 1946252 - RNA, 12 nt, Human
aaagaguacucu

SEQ ID NO: 1946253 - RNA, 16 nt, Human
aaagauaccuuaaaau

SEQ ID NO: 1946254 - RNA, 17 nt, Human
aaagaguacucuuguuu

SEQ ID NO: 1946255 - RNA, 20 nt, Human
aaagaaaacuuguauuaugu

SEQ ID NO: 1946256 - RNA, 12 nt, Human
aaagaaaacuug

SEQ ID NO: 1946257 - RNA, 13 nt, Human
aaagaaaaauauu

SEQ ID NO: 1946258 - RNA, 20 nt, Human
aaacugccaguuuuguuucc

SEQ ID NO: 1946259 - RNA, 18 nt, Human
aaagaaaaauauuuaaug

SEQ ID NO: 1946260 - RNA, 14 nt, Human
aaagaaaacaaaac

SEQ ID NO: 1946261 - RNA, 12 nt, Human
aaagaaaauaaa

SEQ ID NO: 1946262 - RNA, 21 nt, Human
aaagaaaauaaaaaaaagaaa

SEQ ID NO: 1946263 - RNA, 10 nt, Human
aaagaaagaa

SEQ ID NO: 1946264 - RNA, 20 nt, Human
aaauaacaacuuuuuuuucu

SEQ ID NO: 1946265 - RNA, 11 nt, Human
aaagugcuggg

SEQ ID NO: 1946266 - RNA, 20 nt, Human
aaagugcugcagggcuuuaa

SEQ ID NO: 1946267 - RNA, 19 nt, Human
aaauaaaaggacugugauu

SEQ ID NO: 1946268 - RNA, 21 nt, Human
aaagugcugcagggcuuuaaa

SEQ ID NO: 1946269 - RNA, 22 nt, Human
aaagugcugcagggcuuuaaaa

SEQ ID NO: 1946270 - RNA, 14 nt, Human
aaagugcugggauu

SEQ ID NO: 1946271 - RNA, 17 nt, Human
aaauaaacgucuuaaau

SEQ ID NO: 1946272 - RNA, 13 nt, Human
aaauaaacuuucu

SEQ ID NO: 1946273 - RNA, 21 nt, Human
aaauaaacuuucuuaauauuu

SEQ ID NO: 1946274 - RNA, 22 nt, Human
aaauaaaauuaaagcugaaaac

SEQ ID NO: 1946275 - RNA, 12 nt, Human
aaauaacaauga

SEQ ID NO: 1946276 - RNA, 13 nt, Human
aaauaaaggaacc

SEQ ID NO: 1946277 - RNA, 22 nt, Human
aaagucucuggaauuugaaaca

SEQ ID NO: 1946278 - RNA, 20 nt, Human
aaagucucuggaauuugaaa

SEQ ID NO: 1946279 - RNA, 18 nt, Human
aaagucuguugauuaaag

SEQ ID NO: 1946280 - RNA, 19 nt, Human
aaagucuguugauuaaaga

SEQ ID NO: 1946281 - RNA, 20 nt, Human
aaagucuguugauuaaagau

SEQ ID NO: 1946282 - RNA, 20 nt, Human
aaagugaaaguccagaaacu

SEQ ID NO: 1946283 - RNA, 18 nt, Human
aaagucuugaauguugaa

SEQ ID NO: 1946284 - RNA, 13 nt, Human
aaagucuuuuaaa

SEQ ID NO: 1946285 - RNA, 14 nt, Human
aaagucuuuuaaaa

SEQ ID NO: 1946286 - RNA, 15 nt, Human
aaagucuuuuaaaaa

SEQ ID NO: 1946287 - RNA, 16 nt, Human
aaagucuuuuaaaaag

SEQ ID NO: 1946288 - RNA, 20 nt, Human
aaagucuuuuaaaaaguauu

SEQ ID NO: 1946289 - RNA, 21 nt, Human
aaagucuuuuaaaaaguauug

SEQ ID NO: 1946290 - RNA, 17 nt, Human
aaaggcuuauaaaacag

SEQ ID NO: 1946291 - RNA, 17 nt, Human
aaaggcuugcagaacuu

SEQ ID NO: 1946292 - RNA, 14 nt, Human
aaaggcuuauaaaa

SEQ ID NO: 1946293 - RNA, 16 nt, Human
aaagggacugagaaau

SEQ ID NO: 1946294 - RNA, 13 nt, Human
aaagggaaauuga

SEQ ID NO: 1946295 - RNA, 19 nt, Human
aaagucucuggaauuugaa

SEQ ID NO: 1946296 - RNA, 23 nt, Human
aaaucuuccuggucgaaaguuag

SEQ ID NO: 1946297 - RNA, 20 nt, Human
aaaucuuauuaaaguuucaa

SEQ ID NO: 1946298 - RNA, 21 nt, Human
aaaucuuauuaaaguuucaaa

SEQ ID NO: 1946299 - RNA, 22 nt, Human
aaaucuuauuaaaguuucaaaa

SEQ ID NO: 1946300 - RNA, 16 nt, Human
aaaucaaauguaaagu

SEQ ID NO: 1946301 - RNA, 22 nt, Human
aaaucaaauguaaaguuuaauu

SEQ ID NO: 1946302 - RNA, 22 nt, Human
aaauggacguguuaugacucca

SEQ ID NO: 1946303 - RNA, 21 nt, Human
aaauggacguguuaugacucc

SEQ ID NO: 1946304 - RNA, 20 nt, Human
aaauggacguguuaugacuc

SEQ ID NO: 1946305 - RNA, 14 nt, Human
aaauggaaacagag

SEQ ID NO: 1946306 - RNA, 18 nt, Human
aaaucuuuccauauccau

SEQ ID NO: 1946307 - RNA, 18 nt, Human
aaauggaagacagcucuu

SEQ ID NO: 1946308 - RNA, 16 nt, Human
aaauggaaaugggcag

SEQ ID NO: 1946309 - RNA, 14 nt, Human
aaauauaauugaca

SEQ ID NO: 1946310 - RNA, 20 nt, Human
aaauauuuuaauuuuuaaau

SEQ ID NO: 1946311 - RNA, 21 nt, Human
aaauauuuuaauuuuuaaaug

SEQ ID NO: 1946312 - RNA, 22 nt, Human
aaauauuuuaauuuuuaaaugc

SEQ ID NO: 1946313 - RNA, 23 nt, Human
aaauaguaggcaagauggcacag

SEQ ID NO: 1946314 - RNA, 13 nt, Human
aaauaguaggcaa

SEQ ID NO: 1946315 - RNA, 22 nt, Human
aaauaguaggcaagauggcaca

SEQ ID NO: 1946316 - RNA, 13 nt, Human
aaauaguaaaaau

SEQ ID NO: 1946317 - RNA, 16 nt, Human
aaauaguaaaaauaaa

SEQ ID NO: 1946318 - RNA, 17 nt, Human
aaauagacagcaugaga

SEQ ID NO: 1946319 - RNA, 15 nt, Human
aaauacuuaaauguu

SEQ ID NO: 1946320 - RNA, 16 nt, Human
aaauacuuaaauguua

SEQ ID NO: 1946321 - RNA, 18 nt, Human
aaauacuuaaauguuaug

SEQ ID NO: 1946322 - RNA, 19 nt, Human
aaauacuuaaauguuaugu

SEQ ID NO: 1946323 - RNA, 20 nt, Human
aaauacuuaaauguuaugua

SEQ ID NO: 1946324 - RNA, 19 nt, Human
aaauacuuaacuacuguuu

SEQ ID NO: 1946325 - RNA, 22 nt, Human
aaauacuguuuuuaacaacuau

SEQ ID NO: 1946326 - RNA, 13 nt, Human
aaauacuuaaaug

SEQ ID NO: 1946327 - RNA, 15 nt, Human
aaauacuguagauaa

SEQ ID NO: 1946328 - RNA, 16 nt, Human
aaauacuguagauaau

SEQ ID NO: 1946329 - RNA, 17 nt, Human
aaauacuguagauaauu

SEQ ID NO: 1946330 - RNA, 18 nt, Human
aaauacuguagauaauua

SEQ ID NO: 1946331 - RNA, 20 nt, Human
aaauacuguagauaauuaac

SEQ ID NO: 1946332 - RNA, 23 nt, Human
aaauacuguagauaauuaaccaa

SEQ ID NO: 1946333 - RNA, 11 nt, Human
aaauacuguag

SEQ ID NO: 1946334 - RNA, 14 nt, Human
aaauacuguagaua

SEQ ID NO: 1946335 - RNA, 18 nt, Human
aauuaguggcacuugcuu

SEQ ID NO: 1946336 - RNA, 18 nt, Human
aauuaaaacacaacaucu

SEQ ID NO: 1946337 - RNA, 14 nt, Human
aauguuuugcuuuu

SEQ ID NO: 1946338 - RNA, 13 nt, Human
aauguuuuguaaa

SEQ ID NO: 1946339 - RNA, 14 nt, Human
aauguuuuguaaac

SEQ ID NO: 1946340 - RNA, 15 nt, Human
aauguuuuguaaacu

SEQ ID NO: 1946341 - RNA, 17 nt, Human
aauguuuuguaaacuuu

SEQ ID NO: 1946342 - RNA, 18 nt, Human
aauguuuuguaaacuuug

SEQ ID NO: 1946343 - RNA, 19 nt, Human
aauguuuuguaaacuuuga

SEQ ID NO: 1946344 - RNA, 20 nt, Human
aauguuuuguaaacuuugaa

SEQ ID NO: 1946345 - RNA, 21 nt, Human
aauguuuuguaaacuuugaaa

SEQ ID NO: 1946346 - RNA, 22 nt, Human
aauguuuuguaaacuuugaaau

SEQ ID NO: 1946347 - RNA, 23 nt, Human
aauguuuuguaaacuuugaaaua

SEQ ID NO: 1946348 - RNA, 22 nt, Human
aauguuuuuaagaugaucaucu

SEQ ID NO: 1946349 - RNA, 18 nt, Human
aauguuugccucugccuc

SEQ ID NO: 1946350 - RNA, 16 nt, Human
aauguuuuaacaagaa

SEQ ID NO: 1946351 - RNA, 14 nt, Human
aauguuuucagcua

SEQ ID NO: 1946352 - RNA, 19 nt, Human
aauguuugccucugccucu

SEQ ID NO: 1946353 - RNA, 13 nt, Human
aauuaaagaaaua

SEQ ID NO: 1946354 - RNA, 12 nt, Human
aaugguaguuuc

SEQ ID NO: 1946355 - RNA, 13 nt, Human
aaugguaguuucu

SEQ ID NO: 1946356 - RNA, 14 nt, Human
aaugguaguuuuac

SEQ ID NO: 1946357 - RNA, 14 nt, Human
aaugguaguuucug

SEQ ID NO: 1946358 - RNA, 17 nt, Human
aaugguaguuucugugg

SEQ ID NO: 1946359 - RNA, 18 nt, Human
aaugguaguuucuguggu

SEQ ID NO: 1946360 - RNA, 20 nt, Human
aaugguaguuucugugguug

SEQ ID NO: 1946361 - RNA, 22 nt, Human
aaugguacaaaaccacagugua

SEQ ID NO: 1946362 - RNA, 20 nt, Human
aaugguacuccacauauuuc

SEQ ID NO: 1946363 - RNA, 13 nt, Human
aaugggcagagca

SEQ ID NO: 1946364 - RNA, 15 nt, Human
aaugggcagagcaga

SEQ ID NO: 1946365 - RNA, 16 nt, Human
aaugucaguaugugga

SEQ ID NO: 1946366 - RNA, 22 nt, Human
aaugucaguauguggaagugug

SEQ ID NO: 1946367 - RNA, 13 nt, Human
aaugucaguguga

SEQ ID NO: 1946368 - RNA, 16 nt, Human
aaugucagugugacug

SEQ ID NO: 1946369 - RNA, 15 nt, Human
aaugucagugugacu

SEQ ID NO: 1946370 - RNA, 22 nt, Human
aauggucuuucuaaugugugaa

SEQ ID NO: 1946371 - RNA, 22 nt, Human
aauggugaacugucauuacaga

SEQ ID NO: 1946372 - RNA, 12 nt, Human
aauggugauuuu

SEQ ID NO: 1946373 - RNA, 13 nt, Human
aauggugauuuua

SEQ ID NO: 1946374 - RNA, 15 nt, Human
aauggugauuuuaaa

SEQ ID NO: 1946375 - RNA, 21 nt, Human
aaugucagugugacugaucuc

SEQ ID NO: 1946376 - RNA, 17 nt, Human
aaugucagugugacuga

SEQ ID NO: 1946377 - RNA, 22 nt, Human
aaugucuaguuguaacaccaug

SEQ ID NO: 1946378 - RNA, 19 nt, Human
aaugucaguuguuauuuau

SEQ ID NO: 1946379 - RNA, 20 nt, Human
aaugucaguuguuauuuauu

SEQ ID NO: 1946380 - RNA, 22 nt, Human
aaugucaguuguuauuuauuga

SEQ ID NO: 1946381 - RNA, 20 nt, Human
aaugucucuuuaaugucaca

SEQ ID NO: 1946382 - RNA, 14 nt, Human
aauauguacauuuc

SEQ ID NO: 1946383 - RNA, 15 nt, Human
aauauguacauuucu

SEQ ID NO: 1946384 - RNA, 16 nt, Human
aauauguacauuucua

SEQ ID NO: 1946385 - RNA, 18 nt, Human
aauauguacauuucuaag

SEQ ID NO: 1946386 - RNA, 18 nt, Human
aauauggucuuuugguua

SEQ ID NO: 1946387 - RNA, 13 nt, Human
aauaugggagaaa

SEQ ID NO: 1946388 - RNA, 21 nt, Human
aauauguauucuguaaaagaa

SEQ ID NO: 1946389 - RNA, 16 nt, Human
aauauguauuaacacu

SEQ ID NO: 1946390 - RNA, 19 nt, Human
aauauguacauuucuaagu

SEQ ID NO: 1946391 - RNA, 21 nt, Human
aaucaacauggcuacuugcuu

SEQ ID NO: 1946392 - RNA, 16 nt, Human
aaucaacuaguauuug

SEQ ID NO: 1946393 - RNA, 14 nt, Human
aaucaagaaacaaa

SEQ ID NO: 1946394 - RNA, 12 nt, Human
aaucacaggcug

SEQ ID NO: 1946395 - RNA, 13 nt, Human
aaucacaggcugg

SEQ ID NO: 1946396 - RNA, 21 nt, Human
aaucacaggcugggcugggca

SEQ ID NO: 1946397 - RNA, 20 nt, Human
aauauaggaacuuaaauaau

SEQ ID NO: 1946398 - RNA, 21 nt, Human
aauauaggaacuuaaauaaug

SEQ ID NO: 1946399 - RNA, 17 nt, Human
aauauaauacacaaaau

SEQ ID NO: 1946400 - RNA, 18 nt, Human
aauauaggaacuuaaaua

SEQ ID NO: 1946401 - RNA, 13 nt, Human
aauauaauauugu

SEQ ID NO: 1946402 - RNA, 14 nt, Human
aauauaauauuguc

SEQ ID NO: 1946403 - RNA, 19 nt, Human
aaugaugccaugaggaaca

SEQ ID NO: 1946404 - RNA, 13 nt, Human
aaucuccaaaaua

SEQ ID NO: 1946405 - RNA, 14 nt, Human
aaucuccaaaauaa

SEQ ID NO: 1946406 - RNA, 18 nt, Human
aaucuccaaaauaaaacu

SEQ ID NO: 1946407 - RNA, 18 nt, Human
aauccaggguggugguga

SEQ ID NO: 1946408 - RNA, 16 nt, Human
aaugaaccacaucuug

SEQ ID NO: 1946409 - RNA, 14 nt, Human
aaugaacauuaaca

SEQ ID NO: 1946410 - RNA, 23 nt, Human
aaucuggaccccaucugugaaua

SEQ ID NO: 1946411 - RNA, 22 nt, Human
aaucuggaccccaucugugaau

SEQ ID NO: 1946412 - RNA, 17 nt, Human
aaugaaccacaucuugc

SEQ ID NO: 1946413 - RNA, 23 nt, Human
aaugaaccacaucuugcucugcu

SEQ ID NO: 1946414 - RNA, 21 nt, Human
aaucuggaccccaucugugaa

SEQ ID NO: 1946415 - RNA, 22 nt, Human
aaucugcuuuuuaaagaaugcu

SEQ ID NO: 1946416 - RNA, 23 nt, Human
aaucugcaaagcauguuuugcau

SEQ ID NO: 1946417 - RNA, 16 nt, Human
aaucugcaaagcaugu

SEQ ID NO: 1946418 - RNA, 19 nt, Human
aaucugcaaagcauguuuu

SEQ ID NO: 1946419 - RNA, 21 nt, Human
aaucugcaaagcauguuuugc

SEQ ID NO: 1946420 - RNA, 12 nt, Human
aaugaagauacu

SEQ ID NO: 1946421 - RNA, 20 nt, Human
aaugaagagcuguugauggg

SEQ ID NO: 1946422 - RNA, 17 nt, Human
aaugaagaauuuaaaga

SEQ ID NO: 1946423 - RNA, 18 nt, Human
aaugaagaauuuaaagaa

SEQ ID NO: 1946424 - RNA, 15 nt, Human
aaugaagaauucaga

SEQ ID NO: 1946425 - RNA, 13 nt, Human
aaugaagaauuua

SEQ ID NO: 1946426 - RNA, 14 nt, Human
aaugaagaauuuaa

SEQ ID NO: 1946427 - RNA, 15 nt, Human
aaugaagaauuuaaa

SEQ ID NO: 1946428 - RNA, 16 nt, Human
aaugaagaauuuaaag

SEQ ID NO: 1946429 - RNA, 17 nt, Human
aaugaagauacugaaau

SEQ ID NO: 1946430 - RNA, 21 nt, Human
aaugaugauccuaggcauuug

SEQ ID NO: 1946431 - RNA, 18 nt, Human
aaggcaaggcugucaauu

SEQ ID NO: 1946432 - RNA, 17 nt, Human
aaggcaaggcugucaau

SEQ ID NO: 1946433 - RNA, 13 nt, Human
aagcugggcaggu

SEQ ID NO: 1946434 - RNA, 15 nt, Human
aagcugggcagguug

SEQ ID NO: 1946435 - RNA, 14 nt, Human
aagcuggccugaga

SEQ ID NO: 1946436 - RNA, 18 nt, Human
aagcuggcuuacacuggc

SEQ ID NO: 1946437 - RNA, 18 nt, Human
aaggacauugcggacagc

SEQ ID NO: 1946438 - RNA, 11 nt, Human
aagcugggcag

SEQ ID NO: 1946439 - RNA, 13 nt, Human
aagcuggccugag

SEQ ID NO: 1946440 - RNA, 18 nt, Human
aaggacccggaggggccu

SEQ ID NO: 1946441 - RNA, 15 nt, Human
aaggacuaggguccu

SEQ ID NO: 1946442 - RNA, 21 nt, Human
aaggacccggaggggccuggc

SEQ ID NO: 1946443 - RNA, 18 nt, Human
aaggacuaggguccuggg

SEQ ID NO: 1946444 - RNA, 20 nt, Human
aaggacuaggguccugggga

SEQ ID NO: 1946445 - RNA, 12 nt, Human
aaggacugacug

SEQ ID NO: 1946446 - RNA, 19 nt, Human
aaggacugacugaggcagu

SEQ ID NO: 1946447 - RNA, 16 nt, Human
aaggauuuguguuuua

SEQ ID NO: 1946448 - RNA, 14 nt, Human
aaggcaaaaacaaa

SEQ ID NO: 1946449 - RNA, 12 nt, Human
aagcguggugga

SEQ ID NO: 1946450 - RNA, 23 nt, Human
aagcugccuccccucuccuuccu

SEQ ID NO: 1946451 - RNA, 22 nt, Human
aagcugcacccucaggcaggug

SEQ ID NO: 1946452 - RNA, 20 nt, Human
aagcugcacccucaggcagg

SEQ ID NO: 1946453 - RNA, 21 nt, Human
aagcugcacccucaggcaggu

SEQ ID NO: 1946454 - RNA, 17 nt, Human
aagcuaagguuuagaua

SEQ ID NO: 1946455 - RNA, 22 nt, Human
aagcuaacagcaguuucaggua

SEQ ID NO: 1946456 - RNA, 21 nt, Human
aagcuaacagcaguuucaggu

SEQ ID NO: 1946457 - RNA, 18 nt, Human
aagccauaauuguucuua

SEQ ID NO: 1946458 - RNA, 14 nt, Human
aagccaugagaaug

SEQ ID NO: 1946459 - RNA, 16 nt, Human
aagccaugagaauguu

SEQ ID NO: 1946460 - RNA, 22 nt, Human
aagaaauuaugugccagauuua

SEQ ID NO: 1946461 - RNA, 13 nt, Human
aagaaauuaacuu

SEQ ID NO: 1946462 - RNA, 21 nt, Human
aagaaauuagggcucuaauuu

SEQ ID NO: 1946463 - RNA, 13 nt, Human
aagaaauuaugug

SEQ ID NO: 1946464 - RNA, 20 nt, Human
aagauuguuuaucuagaugu

SEQ ID NO: 1946465 - RNA, 22 nt, Human
aagauuguuuaucuagauguaa

SEQ ID NO: 1946466 - RNA, 13 nt, Human
aagauuguuuauc

SEQ ID NO: 1946467 - RNA, 15 nt, Human
aagauuguuuaucua

SEQ ID NO: 1946468 - RNA, 19 nt, Human
aagauuguuuaucuagaug

SEQ ID NO: 1946469 - RNA, 17 nt, Human
aagauugugugguguuu

SEQ ID NO: 1946470 - RNA, 17 nt, Human
aagauugucauuaguga

SEQ ID NO: 1946471 - RNA, 18 nt, Human
aagcaggcuucuaugaaa

SEQ ID NO: 1946472 - RNA, 23 nt, Human
aagccagacucugccaaaaccaa

SEQ ID NO: 1946473 - RNA, 14 nt, Human
aagcagcucucccc

SEQ ID NO: 1946474 - RNA, 17 nt, Human
aagcagcucuccccuca

SEQ ID NO: 1946475 - RNA, 11 nt, Human
aagcaggaggc

SEQ ID NO: 1946476 - RNA, 23 nt, Human
aagcaggcgcaagggaggcccag

SEQ ID NO: 1946477 - RNA, 16 nt, Human
aagcagaauuggaaaa

SEQ ID NO: 1946478 - RNA, 19 nt, Human
aagcagaauuggaaaagac

SEQ ID NO: 1946479 - RNA, 14 nt, Human
aagcagaggaagga

SEQ ID NO: 1946480 - RNA, 21 nt, Human
aagcagaauuggaaaagacua

SEQ ID NO: 1946481 - RNA, 22 nt, Human
aagugcugggauuacaggugug

SEQ ID NO: 1946482 - RNA, 16 nt, Human
aauaaugugaaacugg

SEQ ID NO: 1946483 - RNA, 19 nt, Human
aauaauguaagacaaauau

SEQ ID NO: 1946484 - RNA, 12 nt, Human
aauaauguaaga

SEQ ID NO: 1946485 - RNA, 13 nt, Human
aauaaucauugga

SEQ ID NO: 1946486 - RNA, 20 nt, Human
aauaauaaagaauagcuuua

SEQ ID NO: 1946487 - RNA, 11 nt, Human
aauaaucaaga

SEQ ID NO: 1946488 - RNA, 13 nt, Human
aauaaucaagagc

SEQ ID NO: 1946489 - RNA, 15 nt, Human
aauaaucaagagccu

SEQ ID NO: 1946490 - RNA, 12 nt, Human
aauaauaaagaa

SEQ ID NO: 1946491 - RNA, 17 nt, Human
aauaauaaaaaauuuca

SEQ ID NO: 1946492 - RNA, 15 nt, Human
aauaaugagaaaugu

SEQ ID NO: 1946493 - RNA, 14 nt, Human
aauaauccugcaaa

SEQ ID NO: 1946494 - RNA, 19 nt, Human
aauaauccugcaaaguaca

SEQ ID NO: 1946495 - RNA, 14 nt, Human
aauaaucucauugg

SEQ ID NO: 1946496 - RNA, 21 nt, Human
aauaauccuaaacauaugaau

SEQ ID NO: 1946497 - RNA, 22 nt, Human
aaguuguaugaucugugccuuu

SEQ ID NO: 1946498 - RNA, 22 nt, Human
aaguuguaggcauaaagucagg

SEQ ID NO: 1946499 - RNA, 14 nt, Human
aagugguuuuaaua

SEQ ID NO: 1946500 - RNA, 17 nt, Human
aauaaacgucuuaaaua

SEQ ID NO: 1946501 - RNA, 16 nt, Human
aauaaacgucuuaaau

SEQ ID NO: 1946502 - RNA, 23 nt, Human
aauaaaauuaaagcugaaaacug

SEQ ID NO: 1946503 - RNA, 17 nt, Human
aauaagugccaggaugg

SEQ ID NO: 1946504 - RNA, 19 nt, Human
aauaaacuauuuguaaagu

SEQ ID NO: 1946505 - RNA, 18 nt, Human
aauaaacuggcagcucag

SEQ ID NO: 1946506 - RNA, 11 nt, Human
aaggugggagg

SEQ ID NO: 1946507 - RNA, 16 nt, Human
aagguuaauaaaguaa

SEQ ID NO: 1946508 - RNA, 15 nt, Human
aagguuaauaaagua

SEQ ID NO: 1946509 - RNA, 15 nt, Human
aagguguuugaaaau

SEQ ID NO: 1946510 - RNA, 20 nt, Human
aagguguuugaaaauaguuu

SEQ ID NO: 1946511 - RNA, 21 nt, Human
aagguguuugaaaauaguuua

SEQ ID NO: 1946512 - RNA, 20 nt, Human
aagguuaauguucaucaucc

SEQ ID NO: 1946513 - RNA, 16 nt, Human
aaguaucccuacugua

SEQ ID NO: 1946514 - RNA, 23 nt, Human
aaguccaggcuuuuuuaucaugu

SEQ ID NO: 1946515 - RNA, 15 nt, Human
aaguagaacuuugua

SEQ ID NO: 1946516 - RNA, 16 nt, Human
aaguagaacuuuguau

SEQ ID NO: 1946517 - RNA, 15 nt, Human
aaguacuuuuggcau

SEQ ID NO: 1946518 - RNA, 14 nt, Human
aaguacuuuuggca

SEQ ID NO: 1946519 - RNA, 11 nt, Human
aaguacuucuu

SEQ ID NO: 1946520 - RNA, 16 nt, Human
aagucuuagauguaua

SEQ ID NO: 1946521 - RNA, 19 nt, Human
aagucucuggaauuugaaa

SEQ ID NO: 1946522 - RNA, 23 nt, Human
cucguguuauuuuaaucucagaa

SEQ ID NO: 1946523 - RNA, 21 nt, Human
cucuaaaauauuuaugaagaa

SEQ ID NO: 1946524 - RNA, 11 nt, Human
cucuaaaauau

SEQ ID NO: 1946525 - RNA, 19 nt, Human
cucuaaaauauuuaugaag

SEQ ID NO: 1946526 - RNA, 18 nt, Human
cucguuggaagaggaaca

SEQ ID NO: 1946527 - RNA, 15 nt, Human
cucuaucaccaagga

SEQ ID NO: 1946528 - RNA, 15 nt, Human
cucuauccugggcuu

SEQ ID NO: 1946529 - RNA, 16 nt, Human
cucuauccugggcuuu

SEQ ID NO: 1946530 - RNA, 18 nt, Human
cucucacagacaggaccc

SEQ ID NO: 1946531 - RNA, 20 nt, Human
cucucacagacaggaccccu

SEQ ID NO: 1946532 - RNA, 19 nt, Human
cucucaaugcuguuugggu

SEQ ID NO: 1946533 - RNA, 13 nt, Human
cucucaauuuuug

SEQ ID NO: 1946534 - RNA, 14 nt, Human
cucucaauuuuugg

SEQ ID NO: 1946535 - RNA, 19 nt, Human
cucucaauuuuugguugaa

SEQ ID NO: 1946536 - RNA, 22 nt, Human
cucucaauuuuugguugaauaa

SEQ ID NO: 1946537 - RNA, 14 nt, Human
cucucacagacagg

SEQ ID NO: 1946538 - RNA, 17 nt, Human
cucucacagacaggacc

SEQ ID NO: 1946539 - RNA, 18 nt, Human
cucucaccuugguuccug

SEQ ID NO: 1946540 - RNA, 23 nt, Human
cucucaccuugguuccuggggca

SEQ ID NO: 1946541 - RNA, 19 nt, Human
cucucaggaaaugcugacc

SEQ ID NO: 1946542 - RNA, 20 nt, Human
cucucaggaaaugcugaccc

SEQ ID NO: 1946543 - RNA, 21 nt, Human
cucucaggaaaugcugaccca

SEQ ID NO: 1946544 - RNA, 13 nt, Human
cucgaacuggcug

SEQ ID NO: 1946545 - RNA, 14 nt, Human
cucgaacuggcugc

SEQ ID NO: 1946546 - RNA, 15 nt, Human
cucgaacuggcugca

SEQ ID NO: 1946547 - RNA, 23 nt, Human
cuccuggggguucuuucuuccuc

SEQ ID NO: 1946548 - RNA, 14 nt, Human
cuccuggggguucu

SEQ ID NO: 1946549 - RNA, 18 nt, Human
cuccuggggguucuuucu

SEQ ID NO: 1946550 - RNA, 20 nt, Human
cuccuggggguucuuucuuc

SEQ ID NO: 1946551 - RNA, 22 nt, Human
cuccuggggguucuuucuuccu

SEQ ID NO: 1946552 - RNA, 16 nt, Human
cuccuaaaaggcccag

SEQ ID NO: 1946553 - RNA, 12 nt, Human
cuccuacagccc

SEQ ID NO: 1946554 - RNA, 21 nt, Human
cuccucuccugacaauacugu

SEQ ID NO: 1946555 - RNA, 17 nt, Human
cuccuaaaaggcccaga

SEQ ID NO: 1946556 - RNA, 18 nt, Human
cuccuaaaaggcccagag

SEQ ID NO: 1946557 - RNA, 19 nt, Human
cuccuaaaaggcccagaga

SEQ ID NO: 1946558 - RNA, 13 nt, Human
cuccucucugccc

SEQ ID NO: 1946559 - RNA, 14 nt, Human
cuccucucugcccu

SEQ ID NO: 1946560 - RNA, 15 nt, Human
cuccucucugcccua

SEQ ID NO: 1946561 - RNA, 18 nt, Human
cuccucugcugcuggcug

SEQ ID NO: 1946562 - RNA, 16 nt, Human
cuccucugcugcuggc

SEQ ID NO: 1946563 - RNA, 19 nt, Human
cuccucucugcccuaaugc

SEQ ID NO: 1946564 - RNA, 18 nt, Human
cuccuggcccacugcauc

SEQ ID NO: 1946565 - RNA, 16 nt, Human
cuccuggcccacugca

SEQ ID NO: 1946566 - RNA, 14 nt, Human
cuccucuuccaggc

SEQ ID NO: 1946567 - RNA, 15 nt, Human
cuccuggacuccugc

SEQ ID NO: 1946568 - RNA, 18 nt, Human
cuccucuucaacugacca

SEQ ID NO: 1946569 - RNA, 23 nt, Human
cuccucuucaacugaccagccuc

SEQ ID NO: 1946570 - RNA, 20 nt, Human
cucccccagccccauccucu

SEQ ID NO: 1946571 - RNA, 15 nt, Human
cucccccagccccau

SEQ ID NO: 1946572 - RNA, 13 nt, Human
cucccccagccac

SEQ ID NO: 1946573 - RNA, 22 nt, Human
cucccccagccccauccucugu

SEQ ID NO: 1946574 - RNA, 14 nt, Human
cucccccagccacu

SEQ ID NO: 1946575 - RNA, 16 nt, Human
cucccccagccacucc

SEQ ID NO: 1946576 - RNA, 12 nt, Human
cucccccauccu

SEQ ID NO: 1946577 - RNA, 13 nt, Human
cucccccauccua

SEQ ID NO: 1946578 - RNA, 13 nt, Human
cucccccaucucu

SEQ ID NO: 1946579 - RNA, 10 nt, Human
cuccagggcu

SEQ ID NO: 1946580 - RNA, 21 nt, Human
cuccagggcucaacacuguga

SEQ ID NO: 1946581 - RNA, 15 nt, Human
cucccaccuuuaauc

SEQ ID NO: 1946582 - RNA, 23 nt, Human
cuccacuuggucugugagaugcu

SEQ ID NO: 1946583 - RNA, 19 nt, Human
cuccacuuucuagccagag

SEQ ID NO: 1946584 - RNA, 16 nt, Human
cuccacuuucuagcca

SEQ ID NO: 1946585 - RNA, 20 nt, Human
cuccacuuucuagccagagg

SEQ ID NO: 1946586 - RNA, 13 nt, Human
cucagucucccuc

SEQ ID NO: 1946587 - RNA, 15 nt, Human
cucagucucccuccc

SEQ ID NO: 1946588 - RNA, 16 nt, Human
cucagucucccucccu

SEQ ID NO: 1946589 - RNA, 17 nt, Human
cucagucucccucccuu

SEQ ID NO: 1946590 - RNA, 14 nt, Human
cucagucucacauu

SEQ ID NO: 1946591 - RNA, 21 nt, Human
cucaucuggaguucucaaaga

SEQ ID NO: 1946592 - RNA, 17 nt, Human
cucaucuggaguucuca

SEQ ID NO: 1946593 - RNA, 13 nt, Human
cuccacuuggucu

SEQ ID NO: 1946594 - RNA, 15 nt, Human
cuccacuuggucugu

SEQ ID NO: 1946595 - RNA, 16 nt, Human
cuccacuggauggagg

SEQ ID NO: 1946596 - RNA, 16 nt, Human
cuccacuuggucugug

SEQ ID NO: 1946597 - RNA, 17 nt, Human
cuccacuuggucuguga

SEQ ID NO: 1946598 - RNA, 21 nt, Human
cuccacuuggucugugagaug

SEQ ID NO: 1946599 - RNA, 22 nt, Human
cuccacuuggucugugagaugc

SEQ ID NO: 1946600 - RNA, 16 nt, Human
cuccaagcucccaggc

SEQ ID NO: 1946601 - RNA, 15 nt, Human
cuccaagcucccagg

SEQ ID NO: 1946602 - RNA, 14 nt, Human
cuccaagcucccag

SEQ ID NO: 1946603 - RNA, 13 nt, Human
cuccaagcuccca

SEQ ID NO: 1946604 - RNA, 13 nt, Human
cuccaagccagcg

SEQ ID NO: 1946605 - RNA, 13 nt, Human
cuccaagccagca

SEQ ID NO: 1946606 - RNA, 15 nt, Human
cuccaagccagcaag

SEQ ID NO: 1946607 - RNA, 23 nt, Human
cuccaagcccaguucagcuuggg

SEQ ID NO: 1946608 - RNA, 16 nt, Human
cuccaagccagcaagc

SEQ ID NO: 1946609 - RNA, 18 nt, Human
cuccaagcuccaucucca

SEQ ID NO: 1946610 - RNA, 19 nt, Human
cuccaagcuccaucuccac

SEQ ID NO: 1946611 - RNA, 14 nt, Human
cuccaagcuccauc

SEQ ID NO: 1946612 - RNA, 24 nt, Human
cuccaagcaggacauggacaagga

SEQ ID NO: 1946613 - RNA, 22 nt, Human
cuccaagcaggacauggacaag

SEQ ID NO: 1946614 - RNA, 14 nt, Human
cuccaagcaggaca

SEQ ID NO: 1946615 - RNA, 13 nt, Human
cuccaagcaggac

SEQ ID NO: 1946616 - RNA, 22 nt, Human
cuccaagaccuucuccuucacc

SEQ ID NO: 1946617 - RNA, 14 nt, Human
cuccaagaauuucu

SEQ ID NO: 1946618 - RNA, 15 nt, Human
cuccaagaccuucuc

SEQ ID NO: 1946619 - RNA, 21 nt, Human
cuccaagaccuucuccuucac

SEQ ID NO: 1946620 - RNA, 12 nt, Human
cucaugccucag

SEQ ID NO: 1946621 - RNA, 16 nt, Human
cucaugccucagccuc

SEQ ID NO: 1946622 - RNA, 15 nt, Human
cucauguucugcuuu

SEQ ID NO: 1946623 - RNA, 14 nt, Human
cucaugugauuuac

SEQ ID NO: 1946624 - RNA, 16 nt, Human
cucauguucugcuuuc

SEQ ID NO: 1946625 - RNA, 13 nt, Human
cuccaagaauuuc

SEQ ID NO: 1946626 - RNA, 12 nt, Human
cuccaacuccaa

SEQ ID NO: 1946627 - RNA, 18 nt, Human
cuccaacuccaacaucca

SEQ ID NO: 1946628 - RNA, 15 nt, Human
cugacaacagacuuc

SEQ ID NO: 1946629 - RNA, 18 nt, Human
cugacaacagacuucuga

SEQ ID NO: 1946630 - RNA, 19 nt, Human
cugacaacagacuucugaa

SEQ ID NO: 1946631 - RNA, 17 nt, Human
cugacaauacuguaugu

SEQ ID NO: 1946632 - RNA, 22 nt, Human
cugagacucgcgacaaugcaaa

SEQ ID NO: 1946633 - RNA, 17 nt, Human
cugagagcccagaaaag

SEQ ID NO: 1946634 - RNA, 11 nt, Human
cugagagcaaa

SEQ ID NO: 1946635 - RNA, 23 nt, Human
cugagagaggcuaaaauguuuuc

SEQ ID NO: 1946636 - RNA, 16 nt, Human
cugagagagcgcagcc

SEQ ID NO: 1946637 - RNA, 19 nt, Human
cugagagaggcuaaaaugu

SEQ ID NO: 1946638 - RNA, 20 nt, Human
cugagagaggcuaaaauguu

SEQ ID NO: 1946639 - RNA, 21 nt, Human
cugagagaggcuaaaauguuu

SEQ ID NO: 1946640 - RNA, 17 nt, Human
cugagaguagagucacu

SEQ ID NO: 1946641 - RNA, 15 nt, Human
cugagagucuagagg

SEQ ID NO: 1946642 - RNA, 14 nt, Human
cugagaggggaagc

SEQ ID NO: 1946643 - RNA, 12 nt, Human
cugagaggccac

SEQ ID NO: 1946644 - RNA, 14 nt, Human
cugagaggcugucu

SEQ ID NO: 1946645 - RNA, 21 nt, Human
cugagaggacuuuucuuugug

SEQ ID NO: 1946646 - RNA, 22 nt, Human
cugagaggacuuuucuuugugg

SEQ ID NO: 1946647 - RNA, 22 nt, Human
cugacccaugcugcccugugag

SEQ ID NO: 1946648 - RNA, 21 nt, Human
cugacccaugcugcccuguga

SEQ ID NO: 1946649 - RNA, 13 nt, Human
cugacccaugggc

SEQ ID NO: 1946650 - RNA, 17 nt, Human
cugacccaugggcagga

SEQ ID NO: 1946651 - RNA, 19 nt, Human
cugacccaugggcaggaga

SEQ ID NO: 1946652 - RNA, 21 nt, Human
cugagacucgcgacaaugcaa

SEQ ID NO: 1946653 - RNA, 23 nt, Human
cugagacagcccgggcucugccu

SEQ ID NO: 1946654 - RNA, 14 nt, Human
cugaguagcuggga

SEQ ID NO: 1946655 - RNA, 15 nt, Human
cugaguagcugggau

SEQ ID NO: 1946656 - RNA, 20 nt, Human
cugaguagcugggauuacag

SEQ ID NO: 1946657 - RNA, 17 nt, Human
cugaguagcucugccuu

SEQ ID NO: 1946658 - RNA, 18 nt, Human
cugaguagcucugccuuu

SEQ ID NO: 1946659 - RNA, 18 nt, Human
cugaguacguugugcauu

SEQ ID NO: 1946660 - RNA, 17 nt, Human
cugaguacguugugcau

SEQ ID NO: 1946661 - RNA, 19 nt, Human
cugaguacguugugcauuu

SEQ ID NO: 1946662 - RNA, 20 nt, Human
cugaguacguugugcauuug

SEQ ID NO: 1946663 - RNA, 12 nt, Human
cugaggugggag

SEQ ID NO: 1946664 - RNA, 21 nt, Human
cugaguacguugugcauuugg

SEQ ID NO: 1946665 - RNA, 22 nt, Human
cugaggacuuaaaauauuccug

SEQ ID NO: 1946666 - RNA, 19 nt, Human
cugaggacauggcuucuga

SEQ ID NO: 1946667 - RNA, 14 nt, Human
cugaggaccagcca

SEQ ID NO: 1946668 - RNA, 23 nt, Human
cugaggaggccuugggcucugcu

SEQ ID NO: 1946669 - RNA, 22 nt, Human
cugaggugaugaagacagcccg

SEQ ID NO: 1946670 - RNA, 15 nt, Human
cugagcuuucugcua

SEQ ID NO: 1946671 - RNA, 14 nt, Human
cugagcuuucugcu

SEQ ID NO: 1946672 - RNA, 21 nt, Human
cugagaugagaggggagagcu

SEQ ID NO: 1946673 - RNA, 20 nt, Human
cugagaugccuggugagcau

SEQ ID NO: 1946674 - RNA, 16 nt, Human
cugagaucucugcagg

SEQ ID NO: 1946675 - RNA, 17 nt, Human
cugagaucucugcagga

SEQ ID NO: 1946676 - RNA, 18 nt, Human
cugagaucucugcaggaa

SEQ ID NO: 1946677 - RNA, 21 nt, Human
cugagaucaaaacgguuuuac

SEQ ID NO: 1946678 - RNA, 23 nt, Human
cugaggacacuaaccacgcugga

SEQ ID NO: 1946679 - RNA, 23 nt, Human
cugaggacaagagaaaaaagcca

SEQ ID NO: 1946680 - RNA, 21 nt, Human
cugaggaauccagacccggcu

SEQ ID NO: 1946681 - RNA, 20 nt, Human
cugaggacacuaaccacgcu

SEQ ID NO: 1946682 - RNA, 17 nt, Human
cugaggaauccagaccc

SEQ ID NO: 1946683 - RNA, 20 nt, Human
cugaggaauccagacccggc

SEQ ID NO: 1946684 - RNA, 14 nt, Human
cugaggaauccaga

SEQ ID NO: 1946685 - RNA, 13 nt, Human
cucuucagcacaa

SEQ ID NO: 1946686 - RNA, 18 nt, Human
cucuuagcaaaaacaugu

SEQ ID NO: 1946687 - RNA, 14 nt, Human
cucuuauugcccac

SEQ ID NO: 1946688 - RNA, 15 nt, Human
cucuuauugcccacg

SEQ ID NO: 1946689 - RNA, 19 nt, Human
cucuuauugcccacgcugg

SEQ ID NO: 1946690 - RNA, 20 nt, Human
cucuuauugcccacgcugga

SEQ ID NO: 1946691 - RNA, 16 nt, Human
cucuuagcccaugcug

SEQ ID NO: 1946692 - RNA, 13 nt, Human
cucuuauugccca

SEQ ID NO: 1946693 - RNA, 18 nt, Human
cucuucagaucucuaacu

SEQ ID NO: 1946694 - RNA, 19 nt, Human
cucuucagaucucuaacuu

SEQ ID NO: 1946695 - RNA, 14 nt, Human
cucuucaaucucuu

SEQ ID NO: 1946696 - RNA, 20 nt, Human
cucuucaacugaccagccuc

SEQ ID NO: 1946697 - RNA, 16 nt, Human
cucuucaacugaccag

SEQ ID NO: 1946698 - RNA, 17 nt, Human
cucuucaacugaccagc

SEQ ID NO: 1946699 - RNA, 20 nt, Human
cucugcacuccccugcuggg

SEQ ID NO: 1946700 - RNA, 18 nt, Human
cucugcacuccccugcug

SEQ ID NO: 1946701 - RNA, 21 nt, Human
cucugcacuccccugcugggu

SEQ ID NO: 1946702 - RNA, 13 nt, Human
cucugcagcaaua

SEQ ID NO: 1946703 - RNA, 17 nt, Human
cucugcaggucccuaau

SEQ ID NO: 1946704 - RNA, 16 nt, Human
cucugcaggucccuaa

SEQ ID NO: 1946705 - RNA, 15 nt, Human
cucugcaggucccua

SEQ ID NO: 1946706 - RNA, 14 nt, Human
cucugcaggucccu

SEQ ID NO: 1946707 - RNA, 13 nt, Human
cucugcuccucuc

SEQ ID NO: 1946708 - RNA, 18 nt, Human
cucugcuccucuccccag

SEQ ID NO: 1946709 - RNA, 20 nt, Human
cucugcuccucuccccagca

SEQ ID NO: 1946710 - RNA, 14 nt, Human
cucugguccauaga

SEQ ID NO: 1946711 - RNA, 16 nt, Human
cucugcucccccuuuu

SEQ ID NO: 1946712 - RNA, 13 nt, Human
cucugcucuugca

SEQ ID NO: 1946713 - RNA, 12 nt, Human
cucugcuccccc

SEQ ID NO: 1946714 - RNA, 13 nt, Human
cucugcucccccu

SEQ ID NO: 1946715 - RNA, 13 nt, Human
cucugcugacaga

SEQ ID NO: 1946716 - RNA, 14 nt, Human
cucugcugacagac

SEQ ID NO: 1946717 - RNA, 16 nt, Human
cucugcugacagacac

SEQ ID NO: 1946718 - RNA, 12 nt, Human
cucuguccaggc

SEQ ID NO: 1946719 - RNA, 17 nt, Human
cucugguacaauuucuu

SEQ ID NO: 1946720 - RNA, 20 nt, Human
cucugguacaauuucuuuug

SEQ ID NO: 1946721 - RNA, 22 nt, Human
cucugguacaauuucuuuuggu

SEQ ID NO: 1946722 - RNA, 14 nt, Human
cucugguaucuaau

SEQ ID NO: 1946723 - RNA, 19 nt, Human
cucugguaucuaauucuuu

SEQ ID NO: 1946724 - RNA, 21 nt, Human
cucugguaucuaauucuuuaa

SEQ ID NO: 1946725 - RNA, 16 nt, Human
cucuggugcugcagua

SEQ ID NO: 1946726 - RNA, 23 nt, Human
cucuugagccuugaacuuugacc

SEQ ID NO: 1946727 - RNA, 18 nt, Human
cucuugagccuugaacuu

SEQ ID NO: 1946728 - RNA, 16 nt, Human
cucuugagccuugaac

SEQ ID NO: 1946729 - RNA, 17 nt, Human
cucuugagccuugaacu

SEQ ID NO: 1946730 - RNA, 11 nt, Human
cucuuuuccua

SEQ ID NO: 1946731 - RNA, 21 nt, Human
cucuugaugccuggcggggug

SEQ ID NO: 1946732 - RNA, 16 nt, Human
cucuugaugccuggcg

SEQ ID NO: 1946733 - RNA, 15 nt, Human
cucuugaugccuggc

SEQ ID NO: 1946734 - RNA, 13 nt, Human
cucuugaugccug

SEQ ID NO: 1946735 - RNA, 20 nt, Human
cugaaaccuaguacugcccc

SEQ ID NO: 1946736 - RNA, 15 nt, Human
cugaaaauugccuuu

SEQ ID NO: 1946737 - RNA, 19 nt, Human
cugaaaauugccuuucugu

SEQ ID NO: 1946738 - RNA, 20 nt, Human
cugaaaauugccuuucugug

SEQ ID NO: 1946739 - RNA, 22 nt, Human
cugaaaauugaugggauuuggu

SEQ ID NO: 1946740 - RNA, 22 nt, Human
cugaagcuaucguaaaauuaag

SEQ ID NO: 1946741 - RNA, 21 nt, Human
cugaagcuaucguaaaauuaa

SEQ ID NO: 1946742 - RNA, 23 nt, Human
cugaaggacauugcggacagcca

SEQ ID NO: 1946743 - RNA, 21 nt, Human
cugaaggccccgcccaggcuu

SEQ ID NO: 1946744 - RNA, 17 nt, Human
cugaaggcuggguucug

SEQ ID NO: 1946745 - RNA, 19 nt, Human
cugaaggccccgcccaggc

SEQ ID NO: 1946746 - RNA, 13 nt, Human
cugaaggaggcca

SEQ ID NO: 1946747 - RNA, 15 nt, Human
cugaaggaggccacc

SEQ ID NO: 1946748 - RNA, 23 nt, Human
cugacaacacucauugaccugag

SEQ ID NO: 1946749 - RNA, 22 nt, Human
cugacaacacucauugaccuga

SEQ ID NO: 1946750 - RNA, 16 nt, Human
cugaauuuuuaugugu

SEQ ID NO: 1946751 - RNA, 18 nt, Human
cugaauuuuuauguguga

SEQ ID NO: 1946752 - RNA, 20 nt, Human
cugaauuuuuaugugugauu

SEQ ID NO: 1946753 - RNA, 15 nt, Human
cuagccagaggagag

SEQ ID NO: 1946754 - RNA, 13 nt, Human
cuagccagaggag

SEQ ID NO: 1946755 - RNA, 19 nt, Human
cuagccaccgccuccuaca

SEQ ID NO: 1946756 - RNA, 12 nt, Human
cuagccagagga

SEQ ID NO: 1946757 - RNA, 23 nt, Human
cuaguuguuugauucagacagcu

SEQ ID NO: 1946758 - RNA, 22 nt, Human
cuaguuguuugauucagacagc

SEQ ID NO: 1946759 - RNA, 13 nt, Human
cuaguuugauuaa

SEQ ID NO: 1946760 - RNA, 15 nt, Human
cuaguuugauuaaau

SEQ ID NO: 1946761 - RNA, 22 nt, Human
cuaguuugauuaaauucuugca

SEQ ID NO: 1946762 - RNA, 21 nt, Human
cuaguuugauuaaauucuugc

SEQ ID NO: 1946763 - RNA, 15 nt, Human
cuaucucccccagcc

SEQ ID NO: 1946764 - RNA, 14 nt, Human
cuaucuaaauguug

SEQ ID NO: 1946765 - RNA, 17 nt, Human
cuaucguaaaauuaaga

SEQ ID NO: 1946766 - RNA, 18 nt, Human
cuaucguaaaauuaagaa

SEQ ID NO: 1946767 - RNA, 18 nt, Human
cuaucaugucaaacguga

SEQ ID NO: 1946768 - RNA, 17 nt, Human
cucaaaaaaagaaaaag

SEQ ID NO: 1946769 - RNA, 18 nt, Human
cucaaaagcugggcaggu

SEQ ID NO: 1946770 - RNA, 17 nt, Human
cuaucucccccagcccc

SEQ ID NO: 1946771 - RNA, 16 nt, Human
cuaucucccccagccc

SEQ ID NO: 1946772 - RNA, 18 nt, Human
cuaucucccccagcccca

SEQ ID NO: 1946773 - RNA, 14 nt, Human
cucaaugcuguuug

SEQ ID NO: 1946774 - RNA, 13 nt, Human
cucaaugcacuga

SEQ ID NO: 1946775 - RNA, 15 nt, Human
cucaaugcacugaca

SEQ ID NO: 1946776 - RNA, 11 nt, Human
cucacaaaaga

SEQ ID NO: 1946777 - RNA, 12 nt, Human
cucaauuuuugg

SEQ ID NO: 1946778 - RNA, 21 nt, Human
cucaauuuuugguugaauaaa

SEQ ID NO: 1946779 - RNA, 14 nt, Human
cucaauuucucuau

SEQ ID NO: 1946780 - RNA, 17 nt, Human
cucaaugcuguuugggu

SEQ ID NO: 1946781 - RNA, 12 nt, Human
cucaauuucaau

SEQ ID NO: 1946782 - RNA, 14 nt, Human
cucaauaaaguaca

SEQ ID NO: 1946783 - RNA, 20 nt, Human
cucaaacucuugaccucagg

SEQ ID NO: 1946784 - RNA, 12 nt, Human
cucaaaccccug

SEQ ID NO: 1946785 - RNA, 16 nt, Human
cucaaaccccugaccu

SEQ ID NO: 1946786 - RNA, 13 nt, Human
cuaauucuuuaau

SEQ ID NO: 1946787 - RNA, 15 nt, Human
cuaauucuuuaauga

SEQ ID NO: 1946788 - RNA, 12 nt, Human
cuaauucuuugc

SEQ ID NO: 1946789 - RNA, 14 nt, Human
cuaauucuuugcaa

SEQ ID NO: 1946790 - RNA, 15 nt, Human
cuaauucuuugcaaa

SEQ ID NO: 1946791 - RNA, 16 nt, Human
cuaauucuuugcaaaa

SEQ ID NO: 1946792 - RNA, 17 nt, Human
cuaauucuuugcaaaaa

SEQ ID NO: 1946793 - RNA, 18 nt, Human
cuaauucuuugcaaaaau

SEQ ID NO: 1946794 - RNA, 21 nt, Human
cuaauucuuugaccuguuggg

SEQ ID NO: 1946795 - RNA, 22 nt, Human
cuaauucuuugaccuguuggga

SEQ ID NO: 1946796 - RNA, 15 nt, Human
cuaauucuaugccug

SEQ ID NO: 1946797 - RNA, 23 nt, Human
cuaaguuuuuauggcuuuugugc

SEQ ID NO: 1946798 - RNA, 21 nt, Human
cuaagugguacuaacuuuccu

SEQ ID NO: 1946799 - RNA, 17 nt, Human
cuaaguaaaucucuucu

SEQ ID NO: 1946800 - RNA, 20 nt, Human
cuaaguuuuuauggcuuuug

SEQ ID NO: 1946801 - RNA, 23 nt, Human
cuaagugauccucccaccucagc

SEQ ID NO: 1946802 - RNA, 11 nt, Human
cgugugugugu

SEQ ID NO: 1946803 - RNA, 19 nt, Human
cuacaguccucccaucuca

SEQ ID NO: 1946804 - RNA, 22 nt, Human
cuacaguugaaaaacagcugag

SEQ ID NO: 1946805 - RNA, 21 nt, Human
cuacaguugaaaaacagcuga

SEQ ID NO: 1946806 - RNA, 19 nt, Human
cuacaguugaaaaacagcu

SEQ ID NO: 1946807 - RNA, 20 nt, Human
cuacaguccucccaucucac

SEQ ID NO: 1946808 - RNA, 20 nt, Human
cuacaugagguacugagagu

SEQ ID NO: 1946809 - RNA, 18 nt, Human
cuacaugagguacugaga

SEQ ID NO: 1946810 - RNA, 12 nt, Human
cuacauauugaa

SEQ ID NO: 1946811 - RNA, 14 nt, Human
cuacauauugaaua

SEQ ID NO: 1946812 - RNA, 17 nt, Human
cuaccuuuguauucucu

SEQ ID NO: 1946813 - RNA, 23 nt, Human
cuacgaguaauugcauuugcuuu

SEQ ID NO: 1946814 - RNA, 17 nt, Human
cuacguuaccaggcagg

SEQ ID NO: 1946815 - RNA, 21 nt, Human
cuacguuuacucacagccagc

SEQ ID NO: 1946816 - RNA, 12 nt, Human
cuagaacucccu

SEQ ID NO: 1946817 - RNA, 13 nt, Human
cuagaacucccuu

SEQ ID NO: 1946818 - RNA, 22 nt, Human
cuagaagauuuugaaauuuuua

SEQ ID NO: 1946819 - RNA, 22 nt, Human
cuagaaguaacuggugauauau

SEQ ID NO: 1946820 - RNA, 23 nt, Human
cuagaauuugauaugugaacagu

SEQ ID NO: 1946821 - RNA, 12 nt, Human
cuagacacacaa

SEQ ID NO: 1946822 - RNA, 12 nt, Human
cuagaauuuuaa

SEQ ID NO: 1946823 - RNA, 14 nt, Human
cuagaauuuuaagc

SEQ ID NO: 1946824 - RNA, 15 nt, Human
cuagaauuuuaagcc

SEQ ID NO: 1946825 - RNA, 16 nt, Human
cuagaauuuuaagccu

SEQ ID NO: 1946826 - RNA, 21 nt, Human
cuagcauacguacacauuuua

SEQ ID NO: 1946827 - RNA, 23 nt, Human
cuagcauacguacacauuuuauu

SEQ ID NO: 1946828 - RNA, 17 nt, Human
cuagacacacaaagcag

SEQ ID NO: 1946829 - RNA, 15 nt, Human
cuagcauauaugugu

SEQ ID NO: 1946830 - RNA, 13 nt, Human
cuagacacacaaa

SEQ ID NO: 1946831 - RNA, 14 nt, Human
cuagacacacaaag

SEQ ID NO: 1946832 - RNA, 16 nt, Human
ccuugccgucuaccug

SEQ ID NO: 1946833 - RNA, 19 nt, Human
ccuuuaaucagguccugcu

SEQ ID NO: 1946834 - RNA, 20 nt, Human
ccuuuaaucagguccugcuc

SEQ ID NO: 1946835 - RNA, 21 nt, Human
ccuuuaaucagguccugcuca

SEQ ID NO: 1946836 - RNA, 21 nt, Human
ccuuucaauaggaaaaacuga

SEQ ID NO: 1946837 - RNA, 17 nt, Human
ccuuuacuugucuuucu

SEQ ID NO: 1946838 - RNA, 18 nt, Human
ccuuuacuugucuuucug

SEQ ID NO: 1946839 - RNA, 15 nt, Human
ccuuucacaaccuuc

SEQ ID NO: 1946840 - RNA, 15 nt, Human
ccuuucacuucuuuc

SEQ ID NO: 1946841 - RNA, 17 nt, Human
ccuuucacuucuuuccc

SEQ ID NO: 1946842 - RNA, 18 nt, Human
ccuuucacuucuuucccu

SEQ ID NO: 1946843 - RNA, 22 nt, Human
ccuuucacuucuuucccuuccu

SEQ ID NO: 1946844 - RNA, 16 nt, Human
ccuuucagcaggcagc

SEQ ID NO: 1946845 - RNA, 17 nt, Human
ccuuuugagugccuuac

SEQ ID NO: 1946846 - RNA, 15 nt, Human
ccuuuugagugccuu

SEQ ID NO: 1946847 - RNA, 17 nt, Human
ccuuucagcaggcagcc

SEQ ID NO: 1946848 - RNA, 19 nt, Human
ccuuucauuugcuaucucu

SEQ ID NO: 1946849 - RNA, 15 nt, Human
ccuuucauuuugcuu

SEQ ID NO: 1946850 - RNA, 16 nt, Human
cgaauuuuaaaagaug

SEQ ID NO: 1946851 - RNA, 21 nt, Human
ccuuuuuuagaguugauacua

SEQ ID NO: 1946852 - RNA, 13 nt, Human
ccuuuuugcuuga

SEQ ID NO: 1946853 - RNA, 12 nt, Human
ccuuuuuauuua

SEQ ID NO: 1946854 - RNA, 13 nt, Human
ccuuuuuauuuau

SEQ ID NO: 1946855 - RNA, 16 nt, Human
ccuuuuuauuuauaug

SEQ ID NO: 1946856 - RNA, 18 nt, Human
ccuuuuuauuuauaugua

SEQ ID NO: 1946857 - RNA, 20 nt, Human
ccuuuuuauuuauauguaug

SEQ ID NO: 1946858 - RNA, 22 nt, Human
ccuuuuuauuuauauguaugug

SEQ ID NO: 1946859 - RNA, 12 nt, Human
cgacaaugcaaa

SEQ ID NO: 1946860 - RNA, 14 nt, Human
cgacaaaucugucu

SEQ ID NO: 1946861 - RNA, 15 nt, Human
cgacaaaucugucug

SEQ ID NO: 1946862 - RNA, 16 nt, Human
cgacaaaucugucugc

SEQ ID NO: 1946863 - RNA, 17 nt, Human
cgacaacagauuggauu

SEQ ID NO: 1946864 - RNA, 20 nt, Human
cgacaacagauuggauuuua

SEQ ID NO: 1946865 - RNA, 13 nt, Human
cgacaaugcaaac

SEQ ID NO: 1946866 - RNA, 18 nt, Human
cgacacggucucggauca

SEQ ID NO: 1946867 - RNA, 16 nt, Human
cgacaagcacagucag

SEQ ID NO: 1946868 - RNA, 20 nt, Human
cgacacgugggcuccccucu

SEQ ID NO: 1946869 - RNA, 11 nt, Human
cgacagagcag

SEQ ID NO: 1946870 - RNA, 18 nt, Human
cgacagagcaguugagag

SEQ ID NO: 1946871 - RNA, 12 nt, Human
cgacagccuggc

SEQ ID NO: 1946872 - RNA, 13 nt, Human
cgacagccuggca

SEQ ID NO: 1946873 - RNA, 14 nt, Human
cgacagccuggcac

SEQ ID NO: 1946874 - RNA, 17 nt, Human
cgacugcccggcagggu

SEQ ID NO: 1946875 - RNA, 15 nt, Human
cgacuagacacacaa

SEQ ID NO: 1946876 - RNA, 16 nt, Human
cgacuagacacacaaa

SEQ ID NO: 1946877 - RNA, 17 nt, Human
cgacuagacacacaaag

SEQ ID NO: 1946878 - RNA, 20 nt, Human
cgacuagacacacaaagcag

SEQ ID NO: 1946879 - RNA, 20 nt, Human
cgacccuugccgucuaccug

SEQ ID NO: 1946880 - RNA, 19 nt, Human
cgacccuugccgucuaccu

SEQ ID NO: 1946881 - RNA, 19 nt, Human
cgccuggcugcagccugcg

SEQ ID NO: 1946882 - RNA, 22 nt, Human
cgccuccaaccccucgcccagu

SEQ ID NO: 1946883 - RNA, 13 nt, Human
cgccucugcauuc

SEQ ID NO: 1946884 - RNA, 19 nt, Human
cgccuccaaccccucgccc

SEQ ID NO: 1946885 - RNA, 21 nt, Human
cgccuccaaccccucgcccag

SEQ ID NO: 1946886 - RNA, 17 nt, Human
cgagucauccagaaugu

SEQ ID NO: 1946887 - RNA, 16 nt, Human
cgauaguuuacugaga

SEQ ID NO: 1946888 - RNA, 19 nt, Human
cgaucacaaaugacuuuau

SEQ ID NO: 1946889 - RNA, 21 nt, Human
cgaucacaaaugacuuuauua

SEQ ID NO: 1946890 - RNA, 14 nt, Human
cgaucacaaaugac

SEQ ID NO: 1946891 - RNA, 15 nt, Human
cgaucacaaaugacu

SEQ ID NO: 1946892 - RNA, 17 nt, Human
cgaucacaaaugacuuu

SEQ ID NO: 1946893 - RNA, 18 nt, Human
cgaucacaaaugacuuua

SEQ ID NO: 1946894 - RNA, 14 nt, Human
cgauagugguggug

SEQ ID NO: 1946895 - RNA, 13 nt, Human
cgcaggcuggccc

SEQ ID NO: 1946896 - RNA, 16 nt, Human
cgcaggccucccugcc

SEQ ID NO: 1946897 - RNA, 18 nt, Human
cgcaggccucccugccag

SEQ ID NO: 1946898 - RNA, 19 nt, Human
cgcaggccucccugccagu

SEQ ID NO: 1946899 - RNA, 22 nt, Human
cgcaggauucuuccucccuccc

SEQ ID NO: 1946900 - RNA, 16 nt, Human
cgguuuuacugcagcu

SEQ ID NO: 1946901 - RNA, 16 nt, Human
cguaaaaacugaaguu

SEQ ID NO: 1946902 - RNA, 14 nt, Human
cgguuaacaaauaa

SEQ ID NO: 1946903 - RNA, 19 nt, Human
cgguuaacaaauaacaacu

SEQ ID NO: 1946904 - RNA, 23 nt, Human
cgguguuuaagacauuuuuggaa

SEQ ID NO: 1946905 - RNA, 22 nt, Human
cgguuuaucgcccuggcaggca

SEQ ID NO: 1946906 - RNA, 14 nt, Human
cguaaaauuaagaa

SEQ ID NO: 1946907 - RNA, 17 nt, Human
cguaaaaacugaaguuc

SEQ ID NO: 1946908 - RNA, 16 nt, Human
cgugaguccuggcaug

SEQ ID NO: 1946909 - RNA, 17 nt, Human
cgugaggccagagacac

SEQ ID NO: 1946910 - RNA, 17 nt, Human
cgugaguccuggcaugg

SEQ ID NO: 1946911 - RNA, 20 nt, Human
cguguaaccauggacccaau

SEQ ID NO: 1946912 - RNA, 17 nt, Human
cguguaggaaccugcac

SEQ ID NO: 1946913 - RNA, 12 nt, Human
cgugugcugugu

SEQ ID NO: 1946914 - RNA, 14 nt, Human
cgugugcuguguuu

SEQ ID NO: 1946915 - RNA, 21 nt, Human
cgugguugggaacacagcauu

SEQ ID NO: 1946916 - RNA, 22 nt, Human
cgugaucaaagccacacucugg

SEQ ID NO: 1946917 - RNA, 14 nt, Human
cgugcacacaccag

SEQ ID NO: 1946918 - RNA, 23 nt, Human
cgccuggugaugcgcaguugcug

SEQ ID NO: 1946919 - RNA, 13 nt, Human
cgcugauguucac

SEQ ID NO: 1946920 - RNA, 13 nt, Human
cggaggaccaggg

SEQ ID NO: 1946921 - RNA, 16 nt, Human
cggagucccaccuugg

SEQ ID NO: 1946922 - RNA, 15 nt, Human
cggaggaccagggcu

SEQ ID NO: 1946923 - RNA, 18 nt, Human
cggagucccaccuuggcu

SEQ ID NO: 1946924 - RNA, 20 nt, Human
cggagucccaccuuggcugc

SEQ ID NO: 1946925 - RNA, 15 nt, Human
cggcucacugcagcc

SEQ ID NO: 1946926 - RNA, 14 nt, Human
cggcucacugcagc

SEQ ID NO: 1946927 - RNA, 16 nt, Human
cggcucacugcagccu

SEQ ID NO: 1946928 - RNA, 17 nt, Human
cggcucacugcagccuc

SEQ ID NO: 1946929 - RNA, 12 nt, Human
cggcuccaggcu

SEQ ID NO: 1946930 - RNA, 13 nt, Human
cggcuccaggcuc

SEQ ID NO: 1946931 - RNA, 14 nt, Human
cggcuccaggcucc

SEQ ID NO: 1946932 - RNA, 15 nt, Human
cggcuccaggcuccu

SEQ ID NO: 1946933 - RNA, 16 nt, Human
cggcuccaggcuccuu

SEQ ID NO: 1946934 - RNA, 12 nt, Human
cgggccacagag

SEQ ID NO: 1946935 - RNA, 14 nt, Human
cgggccacagagaa

SEQ ID NO: 1946936 - RNA, 20 nt, Human
cggcuccaguccccagaacu

SEQ ID NO: 1946937 - RNA, 19 nt, Human
cggcuccaguccccagaac

SEQ ID NO: 1946938 - RNA, 14 nt, Human
cggggacagcuccu

SEQ ID NO: 1946939 - RNA, 17 nt, Human
cgggcucugccucccau

SEQ ID NO: 1946940 - RNA, 20 nt, Human
cggugugggggccccgucuc

SEQ ID NO: 1946941 - RNA, 23 nt, Human
cggugugggggccccgucucagg

SEQ ID NO: 1946942 - RNA, 13 nt, Human
cggugugggggcc

SEQ ID NO: 1946943 - RNA, 18 nt, Human
cgguguggagaagcggcu

SEQ ID NO: 1946944 - RNA, 15 nt, Human
cggggacagcuccuu

SEQ ID NO: 1946945 - RNA, 13 nt, Human
cgguguggagaag

SEQ ID NO: 1946946 - RNA, 16 nt, Human
cgggcucugccuccca

SEQ ID NO: 1946947 - RNA, 14 nt, Human
cgggcucugccucc

SEQ ID NO: 1946948 - RNA, 15 nt, Human
cgggcucagcaaaag

SEQ ID NO: 1946949 - RNA, 11 nt, Human
cgggcucagca

SEQ ID NO: 1946950 - RNA, 17 nt, Human
cgggccacagagaaagu

SEQ ID NO: 1946951 - RNA, 15 nt, Human
cccucagagugcaag

SEQ ID NO: 1946952 - RNA, 13 nt, Human
cccucagagccac

SEQ ID NO: 1946953 - RNA, 21 nt, Human
cccucagaaggucuguuuuga

SEQ ID NO: 1946954 - RNA, 20 nt, Human
cccucagaaaaugaguaaca

SEQ ID NO: 1946955 - RNA, 12 nt, Human
ccccuugccagc

SEQ ID NO: 1946956 - RNA, 17 nt, Human
ccccuucugacccaugc

SEQ ID NO: 1946957 - RNA, 12 nt, Human
cccgggaagggg

SEQ ID NO: 1946958 - RNA, 22 nt, Human
cccuauccuacuuccccuuccu

SEQ ID NO: 1946959 - RNA, 12 nt, Human
cccgggaagcaa

SEQ ID NO: 1946960 - RNA, 15 nt, Human
cccgggaagcaaaug

SEQ ID NO: 1946961 - RNA, 14 nt, Human
ccccuugccagcug

SEQ ID NO: 1946962 - RNA, 12 nt, Human
cccggcugcgga

SEQ ID NO: 1946963 - RNA, 12 nt, Human
cccggcugcccu

SEQ ID NO: 1946964 - RNA, 13 nt, Human
cccggcugcccuu

SEQ ID NO: 1946965 - RNA, 18 nt, Human
ccccaugaggaaggaaca

SEQ ID NO: 1946966 - RNA, 13 nt, Human
ccccaucugugaa

SEQ ID NO: 1946967 - RNA, 14 nt, Human
ccccaucugugaau

SEQ ID NO: 1946968 - RNA, 15 nt, Human
ccccaugaggaagga

SEQ ID NO: 1946969 - RNA, 15 nt, Human
ccccauucugccugc

SEQ ID NO: 1946970 - RNA, 13 nt, Human
ccccauucugccu

SEQ ID NO: 1946971 - RNA, 14 nt, Human
ccccauucugccug

SEQ ID NO: 1946972 - RNA, 18 nt, Human
ccccugcacuccagccug

SEQ ID NO: 1946973 - RNA, 16 nt, Human
ccccugcaaagcccag

SEQ ID NO: 1946974 - RNA, 17 nt, Human
ccccugcaaagcccagc

SEQ ID NO: 1946975 - RNA, 15 nt, Human
ccccugagcccacug

SEQ ID NO: 1946976 - RNA, 15 nt, Human
ccccugcaaagccca

SEQ ID NO: 1946977 - RNA, 11 nt, Human
ccccugagccc

SEQ ID NO: 1946978 - RNA, 12 nt, Human
ccccugagccca

SEQ ID NO: 1946979 - RNA, 13 nt, Human
ccccugagcccac

SEQ ID NO: 1946980 - RNA, 14 nt, Human
ccccugagcccacu

SEQ ID NO: 1946981 - RNA, 19 nt, Human
ccccuuccuguguccaugu

SEQ ID NO: 1946982 - RNA, 19 nt, Human
ccccuucgcuccugugucu

SEQ ID NO: 1946983 - RNA, 14 nt, Human
ccccuuccugggca

SEQ ID NO: 1946984 - RNA, 14 nt, Human
ccccuucgcuccug

SEQ ID NO: 1946985 - RNA, 20 nt, Human
ccccugcaguuccccuggaa

SEQ ID NO: 1946986 - RNA, 15 nt, Human
ccccuucgcuccugu

SEQ ID NO: 1946987 - RNA, 17 nt, Human
ccccuucgcuccugugu

SEQ ID NO: 1946988 - RNA, 13 nt, Human
cccaguuguauuu

SEQ ID NO: 1946989 - RNA, 22 nt, Human
cccauaauuuuuuuuuuccuuu

SEQ ID NO: 1946990 - RNA, 23 nt, Human
cccauaauuuuuuuuuuccuuuu

SEQ ID NO: 1946991 - RNA, 16 nt, Human
cccauacaaauaagca

SEQ ID NO: 1946992 - RNA, 12 nt, Human
cccauuuagaau

SEQ ID NO: 1946993 - RNA, 22 nt, Human
cccauuuagaauggugauuuua

SEQ ID NO: 1946994 - RNA, 21 nt, Human
ccccagauugcaacaggcugg

SEQ ID NO: 1946995 - RNA, 22 nt, Human
ccccagauugcaacaggcuggg

SEQ ID NO: 1946996 - RNA, 23 nt, Human
ccccagauugcaacaggcugggc

SEQ ID NO: 1946997 - RNA, 17 nt, Human
ccccagcaagugagagc

SEQ ID NO: 1946998 - RNA, 21 nt, Human
ccccauccucuguacagagcc

SEQ ID NO: 1946999 - RNA, 19 nt, Human
ccccauccucuguacagag

SEQ ID NO: 1947000 - RNA, 22 nt, Human
ccccauccucuguacagagccc

SEQ ID NO: 1947001 - RNA, 12 nt, Human
ccccaucuguga

SEQ ID NO: 1947002 - RNA, 19 nt, Human
ccccagcaagugagagcug

SEQ ID NO: 1947003 - RNA, 20 nt, Human
ccccagcaagugagagcugg

SEQ ID NO: 1947004 - RNA, 17 nt, Human
ccccauccucuguacag

SEQ ID NO: 1947005 - RNA, 20 nt, Human
cccauucugccugcccaggc

SEQ ID NO: 1947006 - RNA, 21 nt, Human
cccauucugccugcccaggcc

SEQ ID NO: 1947007 - RNA, 22 nt, Human
cccauucugccugcccaggccc

SEQ ID NO: 1947008 - RNA, 12 nt, Human
cccagcagccag

SEQ ID NO: 1947009 - RNA, 14 nt, Human
cccagcagccagcc

SEQ ID NO: 1947010 - RNA, 15 nt, Human
cccagcagccagcca

SEQ ID NO: 1947011 - RNA, 17 nt, Human
cccagcccacuucugcc

SEQ ID NO: 1947012 - RNA, 14 nt, Human
cccagcccacuucu

SEQ ID NO: 1947013 - RNA, 16 nt, Human
cccagcccaccccaug

SEQ ID NO: 1947014 - RNA, 21 nt, Human
cccaggcuggcgugcaguggu

SEQ ID NO: 1947015 - RNA, 20 nt, Human
cccaggcuuagucacugaga

SEQ ID NO: 1947016 - RNA, 15 nt, Human
cccaggcuuagucac

SEQ ID NO: 1947017 - RNA, 22 nt, Human
cccaggaaaggcuccaggagca

SEQ ID NO: 1947018 - RNA, 21 nt, Human
cccaggaaaggcuccaggagc

SEQ ID NO: 1947019 - RNA, 23 nt, Human
cccaggaaaggcuccaggagcag

SEQ ID NO: 1947020 - RNA, 19 nt, Human
cccaggaaaggcuccagga

SEQ ID NO: 1947021 - RNA, 22 nt, Human
cccagcuuaaaggggcuagagu

SEQ ID NO: 1947022 - RNA, 21 nt, Human
cccagcugugcucuggacagg

SEQ ID NO: 1947023 - RNA, 23 nt, Human
cccagcugugcucuggacaggca

SEQ ID NO: 1947024 - RNA, 11 nt, Human
ccauccccucc

SEQ ID NO: 1947025 - RNA, 22 nt, Human
ccauccccuguagagugggagc

SEQ ID NO: 1947026 - RNA, 16 nt, Human
ccauccccuguagagu

SEQ ID NO: 1947027 - RNA, 14 nt, Human
ccaugagccucagc

SEQ ID NO: 1947028 - RNA, 18 nt, Human
ccaugagccucagcaucc

SEQ ID NO: 1947029 - RNA, 13 nt, Human
ccaugaguccccu

SEQ ID NO: 1947030 - RNA, 19 nt, Human
ccaugagccucagcauccu

SEQ ID NO: 1947031 - RNA, 15 nt, Human
ccaugaguccccugu

SEQ ID NO: 1947032 - RNA, 14 nt, Human
ccaugaguccccug

SEQ ID NO: 1947033 - RNA, 16 nt, Human
ccaugaguccccuguu

SEQ ID NO: 1947034 - RNA, 13 nt, Human
ccaugggccuccu

SEQ ID NO: 1947035 - RNA, 12 nt, Human
ccaucccagccc

SEQ ID NO: 1947036 - RNA, 23 nt, Human
ccaucccaaacccuucagugcca

SEQ ID NO: 1947037 - RNA, 20 nt, Human
ccauaauuuuuuuuuuccuu

SEQ ID NO: 1947038 - RNA, 19 nt, Human
ccauaagcaacaauuuuca

SEQ ID NO: 1947039 - RNA, 18 nt, Human
ccauacacacgcugccuu

SEQ ID NO: 1947040 - RNA, 20 nt, Human
ccauacacacgcugccuucg

SEQ ID NO: 1947041 - RNA, 20 nt, Human
ccauaagcaacaauuuucag

SEQ ID NO: 1947042 - RNA, 12 nt, Human
ccauacacacgc

SEQ ID NO: 1947043 - RNA, 14 nt, Human
ccauacacacgcug

SEQ ID NO: 1947044 - RNA, 14 nt, Human
ccaugggccuccug

SEQ ID NO: 1947045 - RNA, 15 nt, Human
ccaugggccuccugu

SEQ ID NO: 1947046 - RNA, 14 nt, Human
ccaugggcaggaga

SEQ ID NO: 1947047 - RNA, 15 nt, Human
ccauugaacucugag

SEQ ID NO: 1947048 - RNA, 20 nt, Human
ccauuuaauggggaggacaa

SEQ ID NO: 1947049 - RNA, 16 nt, Human
ccauuuacugcauucu

SEQ ID NO: 1947050 - RNA, 23 nt, Human
ccauuuacugcauucuucugauc

SEQ ID NO: 1947051 - RNA, 22 nt, Human
ccauugagaccgugaagauacu

SEQ ID NO: 1947052 - RNA, 15 nt, Human
ccauuuccccagggc

SEQ ID NO: 1947053 - RNA, 16 nt, Human
ccauuuccccagggca

SEQ ID NO: 1947054 - RNA, 13 nt, Human
ccauuuagaaugg

SEQ ID NO: 1947055 - RNA, 22 nt, Human
ccauuuagaauggugauuuuaa

SEQ ID NO: 1947056 - RNA, 17 nt, Human
ccauuuccccagggcac

SEQ ID NO: 1947057 - RNA, 13 nt, Human
ccauuuccuuaug

SEQ ID NO: 1947058 - RNA, 17 nt, Human
ccauuuccuuaugcugu

SEQ ID NO: 1947059 - RNA, 22 nt, Human
ccagggggccagucccugaggc

SEQ ID NO: 1947060 - RNA, 21 nt, Human
ccagucaccccggccaccugc

SEQ ID NO: 1947061 - RNA, 20 nt, Human
ccagucaccccggccaccug

SEQ ID NO: 1947062 - RNA, 13 nt, Human
ccagucaccccgg

SEQ ID NO: 1947063 - RNA, 12 nt, Human
ccagucaccccg

SEQ ID NO: 1947064 - RNA, 14 nt, Human
ccagucccccugcc

SEQ ID NO: 1947065 - RNA, 15 nt, Human
ccaguccccagaacu

SEQ ID NO: 1947066 - RNA, 16 nt, Human
ccaguccccagaacuc

SEQ ID NO: 1947067 - RNA, 21 nt, Human
ccaguccccagaacucugccu

SEQ ID NO: 1947068 - RNA, 13 nt, Human
ccagucccagcag

SEQ ID NO: 1947069 - RNA, 14 nt, Human
ccagucccagcagc

SEQ ID NO: 1947070 - RNA, 15 nt, Human
ccagucccagcagcc

SEQ ID NO: 1947071 - RNA, 17 nt, Human
ccagucccagcagccag

SEQ ID NO: 1947072 - RNA, 18 nt, Human
ccagucccagcagccagc

SEQ ID NO: 1947073 - RNA, 20 nt, Human
ccagucccagcagccagcca

SEQ ID NO: 1947074 - RNA, 22 nt, Human
ccaggcugggagagccuuccag

SEQ ID NO: 1947075 - RNA, 16 nt, Human
ccaggggccuuugggu

SEQ ID NO: 1947076 - RNA, 23 nt, Human
ccaggggccuuugggugcuguuu

SEQ ID NO: 1947077 - RNA, 21 nt, Human
ccaggcugggagagccuucca

SEQ ID NO: 1947078 - RNA, 18 nt, Human
ccaggcugggagagccuu

SEQ ID NO: 1947079 - RNA, 17 nt, Human
ccaggcugggagagccu

SEQ ID NO: 1947080 - RNA, 15 nt, Human
ccaggcugggagagc

SEQ ID NO: 1947081 - RNA, 14 nt, Human
ccaggcugggagag

SEQ ID NO: 1947082 - RNA, 13 nt, Human
ccaggcugggaga

SEQ ID NO: 1947083 - RNA, 17 nt, Human
ccaggcaacuugggaac

SEQ ID NO: 1947084 - RNA, 23 nt, Human
ccaggagucccacuccaagccag

SEQ ID NO: 1947085 - RNA, 22 nt, Human
ccaggauguacaaggacagccc

SEQ ID NO: 1947086 - RNA, 19 nt, Human
ccaggagucccacuccaag

SEQ ID NO: 1947087 - RNA, 17 nt, Human
ccaggagggagcagagg

SEQ ID NO: 1947088 - RNA, 21 nt, Human
ccacucucucuuguucuuacu

SEQ ID NO: 1947089 - RNA, 22 nt, Human
ccacucucucuuguucuuacuu

SEQ ID NO: 1947090 - RNA, 11 nt, Human
ccacucuggau

SEQ ID NO: 1947091 - RNA, 18 nt, Human
ccacucuggauucagccu

SEQ ID NO: 1947092 - RNA, 19 nt, Human
ccacucuggauucagccuu

SEQ ID NO: 1947093 - RNA, 20 nt, Human
ccacucuggauucagccuuc

SEQ ID NO: 1947094 - RNA, 21 nt, Human
ccacucuggauucagccuucu

SEQ ID NO: 1947095 - RNA, 19 nt, Human
ccagcagagcaccuuagac

SEQ ID NO: 1947096 - RNA, 23 nt, Human
ccagcagagcaccuuagacaguc

SEQ ID NO: 1947097 - RNA, 23 nt, Human
ccaggaaaggcuccaggagcagc

SEQ ID NO: 1947098 - RNA, 22 nt, Human
ccaggaaaggcuccaggagcag

SEQ ID NO: 1947099 - RNA, 21 nt, Human
ccaggaaaggcuccaggagca

SEQ ID NO: 1947100 - RNA, 18 nt, Human
ccagcuugaaaccuucac

SEQ ID NO: 1947101 - RNA, 13 nt, Human
ccagcuuccagca

SEQ ID NO: 1947102 - RNA, 20 nt, Human
ccagcuucacuucugacucu

SEQ ID NO: 1947103 - RNA, 14 nt, Human
ccagcuuccagcag

SEQ ID NO: 1947104 - RNA, 15 nt, Human
ccagcuuccagcagg

SEQ ID NO: 1947105 - RNA, 14 nt, Human
ccagcuucacuucu

SEQ ID NO: 1947106 - RNA, 15 nt, Human
ccagcuucacuucug

SEQ ID NO: 1947107 - RNA, 16 nt, Human
ccagcuucacuucuga

SEQ ID NO: 1947108 - RNA, 19 nt, Human
ccagcuucacuucugacuc

SEQ ID NO: 1947109 - RNA, 16 nt, Human
ccagcuuaucucaggg

SEQ ID NO: 1947110 - RNA, 16 nt, Human
ccagcuuccagcagga

SEQ ID NO: 1947111 - RNA, 17 nt, Human
ccagcuuccagcaggag

SEQ ID NO: 1947112 - RNA, 21 nt, Human
ccagccccuggaugcagccuc

SEQ ID NO: 1947113 - RNA, 10 nt, Human
ccagccccuu

SEQ ID NO: 1947114 - RNA, 14 nt, Human
ccagcagccuggac

SEQ ID NO: 1947115 - RNA, 15 nt, Human
ccagcagccuggacc

SEQ ID NO: 1947116 - RNA, 20 nt, Human
ccagcagccuggacccugug

SEQ ID NO: 1947117 - RNA, 19 nt, Human
ccagcagccuggacccugu

SEQ ID NO: 1947118 - RNA, 23 nt, Human
cccugucucaaaaaaagaaaaag

SEQ ID NO: 1947119 - RNA, 20 nt, Human
cccugucucaaaaaaagaaa

SEQ ID NO: 1947120 - RNA, 13 nt, Human
cccugucuaauga

SEQ ID NO: 1947121 - RNA, 16 nt, Human
cccugucuaaugaaac

SEQ ID NO: 1947122 - RNA, 17 nt, Human
cccugugauggggcccu

SEQ ID NO: 1947123 - RNA, 19 nt, Human
cccugugauggggcccugc

SEQ ID NO: 1947124 - RNA, 18 nt, Human
cccugugauggggcccug

SEQ ID NO: 1947125 - RNA, 20 nt, Human
cccugugauggggcccugcc

SEQ ID NO: 1947126 - RNA, 13 nt, Human
cccuucgcuccug

SEQ ID NO: 1947127 - RNA, 13 nt, Human
ccggccccugcug

SEQ ID NO: 1947128 - RNA, 11 nt, Human
ccgcaguguuu

SEQ ID NO: 1947129 - RNA, 16 nt, Human
ccgcaguguuugugug

SEQ ID NO: 1947130 - RNA, 19 nt, Human
ccgcaucagcugcucagau

SEQ ID NO: 1947131 - RNA, 14 nt, Human
ccgcaucucacagc

SEQ ID NO: 1947132 - RNA, 22 nt, Human
cccuucucuccagccccuggau

SEQ ID NO: 1947133 - RNA, 21 nt, Human
cccuucucuccagccccugga

SEQ ID NO: 1947134 - RNA, 14 nt, Human
cccuucgcuccugu

SEQ ID NO: 1947135 - RNA, 15 nt, Human
cccuucgcuccugug

SEQ ID NO: 1947136 - RNA, 14 nt, Human
ccggccccugcugg

SEQ ID NO: 1947137 - RNA, 13 nt, Human
ccucagcuucccc

SEQ ID NO: 1947138 - RNA, 11 nt, Human
ccucaggacca

SEQ ID NO: 1947139 - RNA, 13 nt, Human
ccucaggaccagg

SEQ ID NO: 1947140 - RNA, 15 nt, Human
ccucagcuuccccag

SEQ ID NO: 1947141 - RNA, 18 nt, Human
ccucagcuuccccaguag

SEQ ID NO: 1947142 - RNA, 21 nt, Human
ccucagcuuccccaguagcug

SEQ ID NO: 1947143 - RNA, 14 nt, Human
ccucaaagaggcag

SEQ ID NO: 1947144 - RNA, 14 nt, Human
ccucaaaacaaagg

SEQ ID NO: 1947145 - RNA, 13 nt, Human
ccucccaucucac

SEQ ID NO: 1947146 - RNA, 16 nt, Human
ccucccaucucacaca

SEQ ID NO: 1947147 - RNA, 23 nt, Human
ccuccccaaggcccccugccugc

SEQ ID NO: 1947148 - RNA, 22 nt, Human
ccuccccaaggcccccugccug

SEQ ID NO: 1947149 - RNA, 20 nt, Human
ccuccccaaggcccccugcc

SEQ ID NO: 1947150 - RNA, 21 nt, Human
ccuccccaaggcccccugccu

SEQ ID NO: 1947151 - RNA, 16 nt, Human
ccuccaaccccucgcc

SEQ ID NO: 1947152 - RNA, 20 nt, Human
ccuccaaccccucgcccagu

SEQ ID NO: 1947153 - RNA, 23 nt, Human
ccucauuuuugaauacaggcaua

SEQ ID NO: 1947154 - RNA, 15 nt, Human
ccucccaccucagcc

SEQ ID NO: 1947155 - RNA, 17 nt, Human
ccucccaccucagccuc

SEQ ID NO: 1947156 - RNA, 21 nt, Human
ccuggccucugcacuccccug

SEQ ID NO: 1947157 - RNA, 20 nt, Human
ccuggccucugcacuccccu

SEQ ID NO: 1947158 - RNA, 22 nt, Human
ccuggccuagcauacguacaca

SEQ ID NO: 1947159 - RNA, 23 nt, Human
ccuggccggugugggggccccgu

SEQ ID NO: 1947160 - RNA, 21 nt, Human
ccuggccggugugggggcccc

SEQ ID NO: 1947161 - RNA, 22 nt, Human
ccuggccggugugggggccccg

SEQ ID NO: 1947162 - RNA, 22 nt, Human
ccuggccucugcacuccccugc

SEQ ID NO: 1947163 - RNA, 20 nt, Human
ccugggccccaguuguauuu

SEQ ID NO: 1947164 - RNA, 18 nt, Human
ccuggccggugugggggc

SEQ ID NO: 1947165 - RNA, 13 nt, Human
ccugucugcucca

SEQ ID NO: 1947166 - RNA, 14 nt, Human
ccugucugcuccag

SEQ ID NO: 1947167 - RNA, 15 nt, Human
ccugucugcuccagc

SEQ ID NO: 1947168 - RNA, 18 nt, Human
ccugucugcuccagcucu

SEQ ID NO: 1947169 - RNA, 19 nt, Human
ccugucugugaagagcaag

SEQ ID NO: 1947170 - RNA, 14 nt, Human
ccugucuucugcuu

SEQ ID NO: 1947171 - RNA, 15 nt, Human
ccugucuucugcuuu

SEQ ID NO: 1947172 - RNA, 16 nt, Human
ccugucuucugcuuug

SEQ ID NO: 1947173 - RNA, 17 nt, Human
ccugucuucugcuuugu

SEQ ID NO: 1947174 - RNA, 13 nt, Human
ccugucuucugcu

SEQ ID NO: 1947175 - RNA, 21 nt, Human
ccugucuucugcuuuguugug

SEQ ID NO: 1947176 - RNA, 19 nt, Human
ccugucugaauguaccugu

SEQ ID NO: 1947177 - RNA, 22 nt, Human
ccugucuaaugaaaccuguguc

SEQ ID NO: 1947178 - RNA, 15 nt, Human
ccugucuaaugaaac

SEQ ID NO: 1947179 - RNA, 16 nt, Human
ccugugaacugaacuc

SEQ ID NO: 1947180 - RNA, 17 nt, Human
ccugugaacugaacucu

SEQ ID NO: 1947181 - RNA, 21 nt, Human
ccugugaagaaaggaccugca

SEQ ID NO: 1947182 - RNA, 19 nt, Human
ccugggccuggcucccuca

SEQ ID NO: 1947183 - RNA, 15 nt, Human
ccugggccuggcucc

SEQ ID NO: 1947184 - RNA, 16 nt, Human
ccugggccuggcuccc

SEQ ID NO: 1947185 - RNA, 12 nt, Human
ccugggccuggc

SEQ ID NO: 1947186 - RNA, 13 nt, Human
ccugggccuggcu

SEQ ID NO: 1947187 - RNA, 14 nt, Human
ccugggccuggcuc

SEQ ID NO: 1947188 - RNA, 12 nt, Human
ccuggggcaucc

SEQ ID NO: 1947189 - RNA, 17 nt, Human
ccuggggcauccauggg

SEQ ID NO: 1947190 - RNA, 18 nt, Human
ccuggggcauccaugggg

SEQ ID NO: 1947191 - RNA, 21 nt, Human
ccuggggcauccauggggucu

SEQ ID NO: 1947192 - RNA, 21 nt, Human
ccugguggcagugggagcugc

SEQ ID NO: 1947193 - RNA, 15 nt, Human
ccugggggcuggagc

SEQ ID NO: 1947194 - RNA, 15 nt, Human
ccugguuuccugccc

SEQ ID NO: 1947195 - RNA, 13 nt, Human
ccugguuuccugc

SEQ ID NO: 1947196 - RNA, 14 nt, Human
ccugguuuccugcc

SEQ ID NO: 1947197 - RNA, 16 nt, Human
ccugguuguguguccc

SEQ ID NO: 1947198 - RNA, 17 nt, Human
ccuguccugccuaaggc

SEQ ID NO: 1947199 - RNA, 15 nt, Human
ccuguaaucacagcu

SEQ ID NO: 1947200 - RNA, 19 nt, Human
ccuguccugccuaaggcug

SEQ ID NO: 1947201 - RNA, 11 nt, Human
ccucuuucccu

SEQ ID NO: 1947202 - RNA, 13 nt, Human
ccucuuucccucc

SEQ ID NO: 1947203 - RNA, 16 nt, Human
ccucuuucccucccuu

SEQ ID NO: 1947204 - RNA, 11 nt, Human
ccucuuucagu

SEQ ID NO: 1947205 - RNA, 21 nt, Human
ccugaguagcugggauuacag

SEQ ID NO: 1947206 - RNA, 16 nt, Human
ccugcacuugcagacu

SEQ ID NO: 1947207 - RNA, 17 nt, Human
ccugcacuugcagacuc

SEQ ID NO: 1947208 - RNA, 18 nt, Human
ccugcacuugcagacucu

SEQ ID NO: 1947209 - RNA, 19 nt, Human
ccugcacuugcagacucua

SEQ ID NO: 1947210 - RNA, 20 nt, Human
ccugcccaccuggccucugc

SEQ ID NO: 1947211 - RNA, 14 nt, Human
ccugcccaccuggc

SEQ ID NO: 1947212 - RNA, 13 nt, Human
ccugcccaccugg

SEQ ID NO: 1947213 - RNA, 12 nt, Human
ccugcccaccug

SEQ ID NO: 1947214 - RNA, 13 nt, Human
ccugcccaggccc

SEQ ID NO: 1947215 - RNA, 14 nt, Human
ccugcccagaucag

SEQ ID NO: 1947216 - RNA, 19 nt, Human
ccugcccagaucagccaga

SEQ ID NO: 1947217 - RNA, 22 nt, Human
ccugcccagaucagccagaagc

SEQ ID NO: 1947218 - RNA, 18 nt, Human
ccugcccagcccccuggu

SEQ ID NO: 1947219 - RNA, 14 nt, Human
ccugccccagcgcu

SEQ ID NO: 1947220 - RNA, 17 nt, Human
ccugccccagggcuccc

SEQ ID NO: 1947221 - RNA, 12 nt, Human
ccugccccagcg

SEQ ID NO: 1947222 - RNA, 13 nt, Human
ccugccccagcgc

SEQ ID NO: 1947223 - RNA, 20 nt, Human
ccugcugcaguugccaguca

SEQ ID NO: 1947224 - RNA, 21 nt, Human
ccugcugcaguugccagucac

SEQ ID NO: 1947225 - RNA, 19 nt, Human
ccugcugcaguugccaguc

SEQ ID NO: 1947226 - RNA, 17 nt, Human
ccugcugcaguugccag

SEQ ID NO: 1947227 - RNA, 21 nt, Human
ccugccucgaacuggcugcaa

SEQ ID NO: 1947228 - RNA, 23 nt, Human
ccugccucgaacuggcugcaaag

SEQ ID NO: 1947229 - RNA, 19 nt, Human
ccugccucgaacuggcugc

SEQ ID NO: 1947230 - RNA, 14 nt, Human
ccacuccuccuagc

SEQ ID NO: 1947231 - RNA, 11 nt, Human
ccacucucaga

SEQ ID NO: 1947232 - RNA, 13 nt, Human
ccacucucagagg

SEQ ID NO: 1947233 - RNA, 15 nt, Human
ccacucucagaggcc

SEQ ID NO: 1947234 - RNA, 16 nt, Human
ccacucucagaggccc

SEQ ID NO: 1947235 - RNA, 17 nt, Human
ccacucucagaggcccc

SEQ ID NO: 1947236 - RNA, 18 nt, Human
ccacucucagaggcccca

SEQ ID NO: 1947237 - RNA, 17 nt, Human
ccacucccugcaaccug

SEQ ID NO: 1947238 - RNA, 14 nt, Human
ccaccaucaagcca

SEQ ID NO: 1947239 - RNA, 13 nt, Human
ccaccaucaagcc

SEQ ID NO: 1947240 - RNA, 20 nt, Human
ccaccacaguccccagagug

SEQ ID NO: 1947241 - RNA, 21 nt, Human
ccaccacacugauccagcccu

SEQ ID NO: 1947242 - RNA, 17 nt, Human
ccaccacacccagccca

SEQ ID NO: 1947243 - RNA, 14 nt, Human
ccacagcuccuuuu

SEQ ID NO: 1947244 - RNA, 15 nt, Human
ccacagcuccuuuuc

SEQ ID NO: 1947245 - RNA, 16 nt, Human
ccacagcuccuuuucc

SEQ ID NO: 1947246 - RNA, 15 nt, Human
ccaccaucaagccac

SEQ ID NO: 1947247 - RNA, 15 nt, Human
ccacccugugcagaa

SEQ ID NO: 1947248 - RNA, 15 nt, Human
ccacccuuguuccag

SEQ ID NO: 1947249 - RNA, 22 nt, Human
ccacagcaacgaucacaaauga

SEQ ID NO: 1947250 - RNA, 19 nt, Human
ccacgcccccacuggugac

SEQ ID NO: 1947251 - RNA, 18 nt, Human
ccacgcccccacugguga

SEQ ID NO: 1947252 - RNA, 13 nt, Human
ccacgcccggcua

SEQ ID NO: 1947253 - RNA, 17 nt, Human
ccacgcccccacuggug

SEQ ID NO: 1947254 - RNA, 16 nt, Human
ccacgcccccacuggu

SEQ ID NO: 1947255 - RNA, 22 nt, Human
ccaccgcagacaggaccaggga

SEQ ID NO: 1947256 - RNA, 18 nt, Human
ccaccgaagccgccugug

SEQ ID NO: 1947257 - RNA, 12 nt, Human
ccacccuuucua

SEQ ID NO: 1947258 - RNA, 13 nt, Human
ccaccgcagacag

SEQ ID NO: 1947259 - RNA, 13 nt, Human
ccaccgccuccua

SEQ ID NO: 1947260 - RNA, 17 nt, Human
ccaccgcccagagaccc

SEQ ID NO: 1947261 - RNA, 13 nt, Human
ccaccgcccagag

SEQ ID NO: 1947262 - RNA, 17 nt, Human
ccaccgccuccuacagc

SEQ ID NO: 1947263 - RNA, 21 nt, Human
ccaccuuugaagaaguaagga

SEQ ID NO: 1947264 - RNA, 20 nt, Human
cauuuguguugaagagguuu

SEQ ID NO: 1947265 - RNA, 20 nt, Human
cauuuuuuauauauaugcau

SEQ ID NO: 1947266 - RNA, 22 nt, Human
cauuuuuuauggcugcauagua

SEQ ID NO: 1947267 - RNA, 16 nt, Human
cauuuuuuccuguuug

SEQ ID NO: 1947268 - RNA, 14 nt, Human
cauuuuuugaaaug

SEQ ID NO: 1947269 - RNA, 20 nt, Human
cauuuuuugaaaugcugaaa

SEQ ID NO: 1947270 - RNA, 16 nt, Human
cauuuguguugaagag

SEQ ID NO: 1947271 - RNA, 21 nt, Human
ccaaaacucuccucugcugcu

SEQ ID NO: 1947272 - RNA, 11 nt, Human
ccaaaagaaaa

SEQ ID NO: 1947273 - RNA, 12 nt, Human
ccaaaagaaaaa

SEQ ID NO: 1947274 - RNA, 20 nt, Human
ccaaaacucuccucugcugc

SEQ ID NO: 1947275 - RNA, 22 nt, Human
cauuuuuuuuaagaaaaaggau

SEQ ID NO: 1947276 - RNA, 19 nt, Human
ccaaugugaacagcggcug

SEQ ID NO: 1947277 - RNA, 17 nt, Human
ccaaugggagcucaugg

SEQ ID NO: 1947278 - RNA, 17 nt, Human
ccaaauguucaucaaug

SEQ ID NO: 1947279 - RNA, 14 nt, Human
ccaacucaccccag

SEQ ID NO: 1947280 - RNA, 23 nt, Human
ccaaauggaaaugggcagagcag

SEQ ID NO: 1947281 - RNA, 19 nt, Human
ccaaauggauuccuguuuc

SEQ ID NO: 1947282 - RNA, 14 nt, Human
ccaaaugguacaaa

SEQ ID NO: 1947283 - RNA, 15 nt, Human
ccaacugaucuguua

SEQ ID NO: 1947284 - RNA, 19 nt, Human
ccaaaugugugcccagcuu

SEQ ID NO: 1947285 - RNA, 20 nt, Human
ccaaaugugugcccagcuua

SEQ ID NO: 1947286 - RNA, 18 nt, Human
ccaacucaccccagcccc

SEQ ID NO: 1947287 - RNA, 17 nt, Human
ccaacucaccccagccc

SEQ ID NO: 1947288 - RNA, 16 nt, Human
ccaacucaccccagcc

SEQ ID NO: 1947289 - RNA, 23 nt, Human
ccaagcugccuccccucuccuuc

SEQ ID NO: 1947290 - RNA, 18 nt, Human
ccaagcucugcuccucuc

SEQ ID NO: 1947291 - RNA, 12 nt, Human
ccaagcucugcu

SEQ ID NO: 1947292 - RNA, 17 nt, Human
ccaagcucugcuccucu

SEQ ID NO: 1947293 - RNA, 13 nt, Human
ccaagcucugcuc

SEQ ID NO: 1947294 - RNA, 14 nt, Human
ccaaugcacuuugu

SEQ ID NO: 1947295 - RNA, 15 nt, Human
ccaaugauggucacc

SEQ ID NO: 1947296 - RNA, 21 nt, Human
ccaaugagacucuagggucca

SEQ ID NO: 1947297 - RNA, 23 nt, Human
ccaaugagacucuaggguccagu

SEQ ID NO: 1947298 - RNA, 17 nt, Human
ccaauauuuaccagacc

SEQ ID NO: 1947299 - RNA, 22 nt, Human
ccaaucaguagcuuaagaaaaa

SEQ ID NO: 1947300 - RNA, 12 nt, Human
caucuggagagc

SEQ ID NO: 1947301 - RNA, 14 nt, Human
caucugugaauaag

SEQ ID NO: 1947302 - RNA, 22 nt, Human
caucuggaagagcuaggcaggg

SEQ ID NO: 1947303 - RNA, 12 nt, Human
caucugcugucu

SEQ ID NO: 1947304 - RNA, 14 nt, Human
caucugcugucuuu

SEQ ID NO: 1947305 - RNA, 21 nt, Human
caucugcugucuuuucuuugc

SEQ ID NO: 1947306 - RNA, 12 nt, Human
cauccuggaaua

SEQ ID NO: 1947307 - RNA, 22 nt, Human
cauccuggcacccggccccugc

SEQ ID NO: 1947308 - RNA, 21 nt, Human
cauccccuguagagugggagc

SEQ ID NO: 1947309 - RNA, 15 nt, Human
caucacuuaaaacac

SEQ ID NO: 1947310 - RNA, 14 nt, Human
caucacuucccuac

SEQ ID NO: 1947311 - RNA, 12 nt, Human
caucacuucccu

SEQ ID NO: 1947312 - RNA, 15 nt, Human
cauccuggcacccgg

SEQ ID NO: 1947313 - RNA, 15 nt, Human
cauauuacaauauuu

SEQ ID NO: 1947314 - RNA, 16 nt, Human
cauauuacaauauuug

SEQ ID NO: 1947315 - RNA, 17 nt, Human
cauauuacaauauuugu

SEQ ID NO: 1947316 - RNA, 21 nt, Human
cauauuaaguaagucucaagg

SEQ ID NO: 1947317 - RNA, 16 nt, Human
cauauuaccacagaca

SEQ ID NO: 1947318 - RNA, 19 nt, Human
cauauuacaauauuugugu

SEQ ID NO: 1947319 - RNA, 22 nt, Human
cauauuacaauauuugugugcu

SEQ ID NO: 1947320 - RNA, 17 nt, Human
cauauucuguuggccag

SEQ ID NO: 1947321 - RNA, 18 nt, Human
cauauucuguuggccagu

SEQ ID NO: 1947322 - RNA, 19 nt, Human
caguggugguuuucuguuc

SEQ ID NO: 1947323 - RNA, 20 nt, Human
caguggugguuuucuguucu

SEQ ID NO: 1947324 - RNA, 21 nt, Human
caguggugguuuucuguucuu

SEQ ID NO: 1947325 - RNA, 22 nt, Human
caguggugguuuucuguucuuu

SEQ ID NO: 1947326 - RNA, 15 nt, Human
cauaugcuucuuuaa

SEQ ID NO: 1947327 - RNA, 14 nt, Human
caucacuggcaugg

SEQ ID NO: 1947328 - RNA, 13 nt, Human
caucacuuaaaac

SEQ ID NO: 1947329 - RNA, 14 nt, Human
caucacuuaaaaca

SEQ ID NO: 1947330 - RNA, 14 nt, Human
caugcuacacacug

SEQ ID NO: 1947331 - RNA, 20 nt, Human
caugcuacacacugcauguu

SEQ ID NO: 1947332 - RNA, 23 nt, Human
caugcuacacacugcauguuugu

SEQ ID NO: 1947333 - RNA, 22 nt, Human
caugauuucacaaauauuaaaa

SEQ ID NO: 1947334 - RNA, 18 nt, Human
caugauuucacaaauauu

SEQ ID NO: 1947335 - RNA, 19 nt, Human
caugauuucacaaauauua

SEQ ID NO: 1947336 - RNA, 12 nt, Human
caugauuucaca

SEQ ID NO: 1947337 - RNA, 14 nt, Human
caugauuucacaaa

SEQ ID NO: 1947338 - RNA, 15 nt, Human
caugauuucacaaau

SEQ ID NO: 1947339 - RNA, 16 nt, Human
caugauuucacaaaua

SEQ ID NO: 1947340 - RNA, 17 nt, Human
caugauuucacaaauau

SEQ ID NO: 1947341 - RNA, 13 nt, Human
caugauguuuucc

SEQ ID NO: 1947342 - RNA, 17 nt, Human
caugggaaugaauguca

SEQ ID NO: 1947343 - RNA, 16 nt, Human
caugggaaugaauguc

SEQ ID NO: 1947344 - RNA, 15 nt, Human
caugggaaugaaugu

SEQ ID NO: 1947345 - RNA, 14 nt, Human
caugggaaugaaug

SEQ ID NO: 1947346 - RNA, 17 nt, Human
cauggcucccccuccac

SEQ ID NO: 1947347 - RNA, 17 nt, Human
cauggcugccaauggga

SEQ ID NO: 1947348 - RNA, 18 nt, Human
cauggcuacuugcuuuga

SEQ ID NO: 1947349 - RNA, 16 nt, Human
cauguuggccaggcug

SEQ ID NO: 1947350 - RNA, 14 nt, Human
cauguuggccaggc

SEQ ID NO: 1947351 - RNA, 15 nt, Human
cauguuggccaggcu

SEQ ID NO: 1947352 - RNA, 16 nt, Human
caugucccuaccgagu

SEQ ID NO: 1947353 - RNA, 22 nt, Human
caugucccuaccgagucucuuc

SEQ ID NO: 1947354 - RNA, 14 nt, Human
caugucaaacguga

SEQ ID NO: 1947355 - RNA, 19 nt, Human
caugucaaacgugaaaaug

SEQ ID NO: 1947356 - RNA, 23 nt, Human
caugucccuaccgagucucuucu

SEQ ID NO: 1947357 - RNA, 14 nt, Human
cauguccuguguca

SEQ ID NO: 1947358 - RNA, 14 nt, Human
cauuaguuuugaag

SEQ ID NO: 1947359 - RNA, 15 nt, Human
cauuaguuuugaaga

SEQ ID NO: 1947360 - RNA, 16 nt, Human
cauuaguuuugaagau

SEQ ID NO: 1947361 - RNA, 18 nt, Human
cauuauaaucaccagggc

SEQ ID NO: 1947362 - RNA, 23 nt, Human
cauucgggccccaccugcagcuc

SEQ ID NO: 1947363 - RNA, 17 nt, Human
cauucguacauaauacu

SEQ ID NO: 1947364 - RNA, 19 nt, Human
cauucguacauaauacuga

SEQ ID NO: 1947365 - RNA, 16 nt, Human
cauucuccaccugcca

SEQ ID NO: 1947366 - RNA, 14 nt, Human
cauucuccaccugc

SEQ ID NO: 1947367 - RNA, 13 nt, Human
cauucuccaccug

SEQ ID NO: 1947368 - RNA, 20 nt, Human
cagccgagauagccaaggcc

SEQ ID NO: 1947369 - RNA, 19 nt, Human
cagccgagauagccaaggc

SEQ ID NO: 1947370 - RNA, 17 nt, Human
cagccucugaaaaccaa

SEQ ID NO: 1947371 - RNA, 19 nt, Human
cagccugcuaauuccccag

SEQ ID NO: 1947372 - RNA, 13 nt, Human
cagccucugggcc

SEQ ID NO: 1947373 - RNA, 21 nt, Human
cagccucugggcccacauccg

SEQ ID NO: 1947374 - RNA, 15 nt, Human
cagccugcuccagcu

SEQ ID NO: 1947375 - RNA, 12 nt, Human
cagccugcucca

SEQ ID NO: 1947376 - RNA, 18 nt, Human
cagcggggacagcuccuu

SEQ ID NO: 1947377 - RNA, 19 nt, Human
cagcggggacagcuccuuc

SEQ ID NO: 1947378 - RNA, 21 nt, Human
cagcggggacagcuccuucug

SEQ ID NO: 1947379 - RNA, 18 nt, Human
caggaaaagcugcugaca

SEQ ID NO: 1947380 - RNA, 15 nt, Human
caggaaaagcugcug

SEQ ID NO: 1947381 - RNA, 16 nt, Human
caggaaaagcugcuga

SEQ ID NO: 1947382 - RNA, 15 nt, Human
cagcucccuucuguu

SEQ ID NO: 1947383 - RNA, 17 nt, Human
cagcucccuucuguuga

SEQ ID NO: 1947384 - RNA, 22 nt, Human
cagcuccggcguguguucagug

SEQ ID NO: 1947385 - RNA, 12 nt, Human
cagcucccuucu

SEQ ID NO: 1947386 - RNA, 13 nt, Human
cagcucccuucug

SEQ ID NO: 1947387 - RNA, 14 nt, Human
cagcucccuucugu

SEQ ID NO: 1947388 - RNA, 20 nt, Human
cagcucccgcuccgggcucc

SEQ ID NO: 1947389 - RNA, 23 nt, Human
cagcucccgcuccgggcuccgac

SEQ ID NO: 1947390 - RNA, 21 nt, Human
cagcucccucaaagaggcagu

SEQ ID NO: 1947391 - RNA, 14 nt, Human
cagcucccccagcu

SEQ ID NO: 1947392 - RNA, 15 nt, Human
cagcucccccagcuc

SEQ ID NO: 1947393 - RNA, 16 nt, Human
cagcucccccagcucc

SEQ ID NO: 1947394 - RNA, 14 nt, Human
cagcugccugggau

SEQ ID NO: 1947395 - RNA, 13 nt, Human
cagcugccuggga

SEQ ID NO: 1947396 - RNA, 12 nt, Human
cagcugccuggg

SEQ ID NO: 1947397 - RNA, 12 nt, Human
cagcugccugca

SEQ ID NO: 1947398 - RNA, 19 nt, Human
cagcugagggugagugggu

SEQ ID NO: 1947399 - RNA, 14 nt, Human
cagcuguugucucu

SEQ ID NO: 1947400 - RNA, 17 nt, Human
cagcuguugucucuucu

SEQ ID NO: 1947401 - RNA, 19 nt, Human
cagcuguugucucuucucc

SEQ ID NO: 1947402 - RNA, 21 nt, Human
cagcuguugucucuucuccuu

SEQ ID NO: 1947403 - RNA, 23 nt, Human
cagcuguugacucuaguacugug

SEQ ID NO: 1947404 - RNA, 14 nt, Human
cagcuguugacucu

SEQ ID NO: 1947405 - RNA, 19 nt, Human
cagcuguugacucuaguac

SEQ ID NO: 1947406 - RNA, 22 nt, Human
cagcuguugucucuucuccuua

SEQ ID NO: 1947407 - RNA, 23 nt, Human
cagcuguuucuagaguuccuacc

SEQ ID NO: 1947408 - RNA, 24 nt, Human
cagcuguuucuagaguuccuacca

SEQ ID NO: 1947409 - RNA, 24 nt, Human
cagcugugcucuggacaggcaugu

SEQ ID NO: 1947410 - RNA, 19 nt, Human
cagcugugcucuggacagg

SEQ ID NO: 1947411 - RNA, 20 nt, Human
cagcugugcucuggacaggc

SEQ ID NO: 1947412 - RNA, 19 nt, Human
cagauucuuuccugaggcu

SEQ ID NO: 1947413 - RNA, 18 nt, Human
cagauucuuuccugaggc

SEQ ID NO: 1947414 - RNA, 17 nt, Human
cagauucuuuccugagg

SEQ ID NO: 1947415 - RNA, 15 nt, Human
cagauucuuuccuga

SEQ ID NO: 1947416 - RNA, 17 nt, Human
cagagguugcagugagc

SEQ ID NO: 1947417 - RNA, 16 nt, Human
cagagguugcagugag

SEQ ID NO: 1947418 - RNA, 15 nt, Human
cagagguccacaaca

SEQ ID NO: 1947419 - RNA, 20 nt, Human
cagagguccacaacacacag

SEQ ID NO: 1947420 - RNA, 21 nt, Human
cagaguaauccaagcaaaugu

SEQ ID NO: 1947421 - RNA, 19 nt, Human
cagaucaagggccuaucuu

SEQ ID NO: 1947422 - RNA, 23 nt, Human
cagaggggguggccucccaacuc

SEQ ID NO: 1947423 - RNA, 22 nt, Human
cagaggggguggccucccaacu

SEQ ID NO: 1947424 - RNA, 13 nt, Human
cagaucagccaga

SEQ ID NO: 1947425 - RNA, 15 nt, Human
cagaucagccagaag

SEQ ID NO: 1947426 - RNA, 23 nt, Human
cagaucauuaucagccugugcca

SEQ ID NO: 1947427 - RNA, 19 nt, Human
cagauccccaagccuggca

SEQ ID NO: 1947428 - RNA, 15 nt, Human
cagauccccaagccu

SEQ ID NO: 1947429 - RNA, 16 nt, Human
cagcacgauuucuguu

SEQ ID NO: 1947430 - RNA, 18 nt, Human
cagcacgauuucuguuua

SEQ ID NO: 1947431 - RNA, 19 nt, Human
cagcacgauuucuguuuag

SEQ ID NO: 1947432 - RNA, 20 nt, Human
cagcacgauuucuguuuaga

SEQ ID NO: 1947433 - RNA, 22 nt, Human
cagauucuuuccugaggcuggg

SEQ ID NO: 1947434 - RNA, 20 nt, Human
cagauucuuuccugaggcug

SEQ ID NO: 1947435 - RNA, 17 nt, Human
cagauugcaacaggcug

SEQ ID NO: 1947436 - RNA, 12 nt, Human
cagauucuuuua

SEQ ID NO: 1947437 - RNA, 18 nt, Human
cagauucuuuuaugugau

SEQ ID NO: 1947438 - RNA, 17 nt, Human
cagcauagaaguaacuu

SEQ ID NO: 1947439 - RNA, 12 nt, Human
cagcauaaagaa

SEQ ID NO: 1947440 - RNA, 21 nt, Human
cagcaguuuucuuuuaauuuu

SEQ ID NO: 1947441 - RNA, 20 nt, Human
cagcaguugcugguaaaaug

SEQ ID NO: 1947442 - RNA, 21 nt, Human
cagcaguugcugguaaaauga

SEQ ID NO: 1947443 - RNA, 22 nt, Human
cagcaguugcugguaaaaugaa

SEQ ID NO: 1947444 - RNA, 23 nt, Human
cagcaguugcugguaaaaugaag

SEQ ID NO: 1947445 - RNA, 13 nt, Human
cagcauaauacuu

SEQ ID NO: 1947446 - RNA, 16 nt, Human
cagcagugagagcaga

SEQ ID NO: 1947447 - RNA, 17 nt, Human
cagcaguugcugguaaa

SEQ ID NO: 1947448 - RNA, 20 nt, Human
cagcaucauggagguuugaa

SEQ ID NO: 1947449 - RNA, 13 nt, Human
cagccagccuggc

SEQ ID NO: 1947450 - RNA, 22 nt, Human
cagccagggaaagacuggcaag

SEQ ID NO: 1947451 - RNA, 23 nt, Human
cagccagggaaagacuggcaaga

SEQ ID NO: 1947452 - RNA, 14 nt, Human
cagccagccuggcu

SEQ ID NO: 1947453 - RNA, 15 nt, Human
cagccagccuggcug

SEQ ID NO: 1947454 - RNA, 16 nt, Human
cagccagccuggcugg

SEQ ID NO: 1947455 - RNA, 14 nt, Human
cagugggccuggcc

SEQ ID NO: 1947456 - RNA, 15 nt, Human
cagugggccuggcca

SEQ ID NO: 1947457 - RNA, 21 nt, Human
cagugggccuggccagcaggu

SEQ ID NO: 1947458 - RNA, 14 nt, Human
caguggggaaugaa

SEQ ID NO: 1947459 - RNA, 20 nt, Human
caguggugcgaucuggguuc

SEQ ID NO: 1947460 - RNA, 20 nt, Human
caguggggccugaggcuccu

SEQ ID NO: 1947461 - RNA, 21 nt, Human
caguggggccugaggcuccuu

SEQ ID NO: 1947462 - RNA, 20 nt, Human
caguggggaggggcuguggg

SEQ ID NO: 1947463 - RNA, 18 nt, Human
caguggugguuuucuguu

SEQ ID NO: 1947464 - RNA, 21 nt, Human
caguggugcgaucuggguuca

SEQ ID NO: 1947465 - RNA, 17 nt, Human
cagugcaugcugucccu

SEQ ID NO: 1947466 - RNA, 16 nt, Human
cagugcaugcuguccc

SEQ ID NO: 1947467 - RNA, 13 nt, Human
cagugcccacagg

SEQ ID NO: 1947468 - RNA, 15 nt, Human
cagugcccacaggau

SEQ ID NO: 1947469 - RNA, 17 nt, Human
cagugcccacaggauca

SEQ ID NO: 1947470 - RNA, 20 nt, Human
cagugggagcugccuguuca

SEQ ID NO: 1947471 - RNA, 23 nt, Human
cagugggagcugccuguucagcu

SEQ ID NO: 1947472 - RNA, 14 nt, Human
cagugcaugcuguc

SEQ ID NO: 1947473 - RNA, 13 nt, Human
cagugcaugcugu

SEQ ID NO: 1947474 - RNA, 15 nt, Human
cagugcaucucagcc

SEQ ID NO: 1947475 - RNA, 16 nt, Human
cagugcaucucagccc

SEQ ID NO: 1947476 - RNA, 17 nt, Human
cagugcaucucagccca

SEQ ID NO: 1947477 - RNA, 18 nt, Human
cagugcaucucagcccac

SEQ ID NO: 1947478 - RNA, 15 nt, Human
cagucuggaaugcag

SEQ ID NO: 1947479 - RNA, 17 nt, Human
cagucuggaaugcagug

SEQ ID NO: 1947480 - RNA, 12 nt, Human
cagugcaucuca

SEQ ID NO: 1947481 - RNA, 14 nt, Human
cagucaauuacaug

SEQ ID NO: 1947482 - RNA, 17 nt, Human
caguaaacuuagaguuu

SEQ ID NO: 1947483 - RNA, 13 nt, Human
caguaaaccuguc

SEQ ID NO: 1947484 - RNA, 16 nt, Human
caguaaaccugucuga

SEQ ID NO: 1947485 - RNA, 15 nt, Human
cagucacauuccaag

SEQ ID NO: 1947486 - RNA, 16 nt, Human
cagucacaaauuucuc

SEQ ID NO: 1947487 - RNA, 21 nt, Human
caggugauccacccaccucag

SEQ ID NO: 1947488 - RNA, 20 nt, Human
caggugcacaagcuccaagc

SEQ ID NO: 1947489 - RNA, 19 nt, Human
caggugcacaagcuccaag

SEQ ID NO: 1947490 - RNA, 18 nt, Human
caggugcacaagcuccaa

SEQ ID NO: 1947491 - RNA, 17 nt, Human
caggugcacaagcucca

SEQ ID NO: 1947492 - RNA, 23 nt, Human
caggugaucugcugcagagcagu

SEQ ID NO: 1947493 - RNA, 15 nt, Human
caggugcacaagcuc

SEQ ID NO: 1947494 - RNA, 22 nt, Human
caggugauccacccaccucagc

SEQ ID NO: 1947495 - RNA, 23 nt, Human
caggugauccacccaccucagcc

SEQ ID NO: 1947496 - RNA, 16 nt, Human
cagguuuuccugaaga

SEQ ID NO: 1947497 - RNA, 17 nt, Human
cagguuuuaaaagccuu

SEQ ID NO: 1947498 - RNA, 12 nt, Human
cagguuuuccug

SEQ ID NO: 1947499 - RNA, 14 nt, Human
cagguuuaagcugu

SEQ ID NO: 1947500 - RNA, 23 nt, Human
caguaaagaacaucccuccuggg

SEQ ID NO: 1947501 - RNA, 12 nt, Human
caguaaacacug

SEQ ID NO: 1947502 - RNA, 14 nt, Human
caguaaacacugug

SEQ ID NO: 1947503 - RNA, 15 nt, Human
caguaaacacugugu

SEQ ID NO: 1947504 - RNA, 21 nt, Human
caguaaacacuguguauuguu

SEQ ID NO: 1947505 - RNA, 14 nt, Human
cagguuuugcacuc

SEQ ID NO: 1947506 - RNA, 21 nt, Human
cagguuggugggggccucggu

SEQ ID NO: 1947507 - RNA, 22 nt, Human
cagguugucugaagucacugca

SEQ ID NO: 1947508 - RNA, 23 nt, Human
cagguugucugaagucacugcac

SEQ ID NO: 1947509 - RNA, 21 nt, Human
caggugcacaagcuccaagcu

SEQ ID NO: 1947510 - RNA, 22 nt, Human
caggugcacaagcuccaagcuc

SEQ ID NO: 1947511 - RNA, 14 nt, Human
caggugcccgccac

SEQ ID NO: 1947512 - RNA, 18 nt, Human
caggugcccgccaccaca

SEQ ID NO: 1947513 - RNA, 15 nt, Human
caggccacuugauga

SEQ ID NO: 1947514 - RNA, 18 nt, Human
caggcagauacaggaaaa

SEQ ID NO: 1947515 - RNA, 13 nt, Human
caggccagaggga

SEQ ID NO: 1947516 - RNA, 15 nt, Human
caggccagagggagu

SEQ ID NO: 1947517 - RNA, 18 nt, Human
caggcacaggcagggcag

SEQ ID NO: 1947518 - RNA, 19 nt, Human
caggcacaggcagggcagg

SEQ ID NO: 1947519 - RNA, 14 nt, Human
caggcagagcccag

SEQ ID NO: 1947520 - RNA, 12 nt, Human
caggcacaggca

SEQ ID NO: 1947521 - RNA, 13 nt, Human
caggcacaggcag

SEQ ID NO: 1947522 - RNA, 14 nt, Human
caggcacaggcagg

SEQ ID NO: 1947523 - RNA, 15 nt, Human
caggcacaggcaggg

SEQ ID NO: 1947524 - RNA, 16 nt, Human
caggcacaggcagggc

SEQ ID NO: 1947525 - RNA, 17 nt, Human
caggcacaggcagggca

SEQ ID NO: 1947526 - RNA, 23 nt, Human
caggccagcugcuugggcuucau

SEQ ID NO: 1947527 - RNA, 21 nt, Human
caggccagcugcuugggcuuc

SEQ ID NO: 1947528 - RNA, 19 nt, Human
caggccagcugcuugggcu

SEQ ID NO: 1947529 - RNA, 17 nt, Human
caggccagcugcuuggg

SEQ ID NO: 1947530 - RNA, 18 nt, Human
caggccaggcccucugcc

SEQ ID NO: 1947531 - RNA, 17 nt, Human
caggccaggcccucugc

SEQ ID NO: 1947532 - RNA, 19 nt, Human
caggccaggcccucugccc

SEQ ID NO: 1947533 - RNA, 20 nt, Human
caggccaggcccucugccca

SEQ ID NO: 1947534 - RNA, 16 nt, Human
caggccagagggagug

SEQ ID NO: 1947535 - RNA, 21 nt, Human
caggcugggcuucaguggcag

SEQ ID NO: 1947536 - RNA, 22 nt, Human
caggcugggcuucaguggcagc

SEQ ID NO: 1947537 - RNA, 14 nt, Human
caggcugggagagc

SEQ ID NO: 1947538 - RNA, 12 nt, Human
caggcugggaga

SEQ ID NO: 1947539 - RNA, 15 nt, Human
caggcugggagagcc

SEQ ID NO: 1947540 - RNA, 20 nt, Human
caggcugggcuucaguggca

SEQ ID NO: 1947541 - RNA, 18 nt, Human
cagggauaacaaagaacc

SEQ ID NO: 1947542 - RNA, 16 nt, Human
cagggaugguguucaa

SEQ ID NO: 1947543 - RNA, 21 nt, Human
cagggcucagcggggacagcu

SEQ ID NO: 1947544 - RNA, 23 nt, Human
cagggcucagcggggacagcucc

SEQ ID NO: 1947545 - RNA, 19 nt, Human
caggggaaaaucagccugc

SEQ ID NO: 1947546 - RNA, 20 nt, Human
caggggaaaaucagccugcu

SEQ ID NO: 1947547 - RNA, 18 nt, Human
cagggcugaggccucuca

SEQ ID NO: 1947548 - RNA, 16 nt, Human
cagggcugaggccucu

SEQ ID NO: 1947549 - RNA, 14 nt, Human
caggggaaccugcc

SEQ ID NO: 1947550 - RNA, 15 nt, Human
caggggaaccugcca

SEQ ID NO: 1947551 - RNA, 16 nt, Human
caggggaaccugccau

SEQ ID NO: 1947552 - RNA, 16 nt, Human
caggggacacccagaa

SEQ ID NO: 1947553 - RNA, 18 nt, Human
caggggacacccagaaac

SEQ ID NO: 1947554 - RNA, 15 nt, Human
cagaacacauaauuc

SEQ ID NO: 1947555 - RNA, 14 nt, Human
cagaaguuuaaaua

SEQ ID NO: 1947556 - RNA, 13 nt, Human
cagaagugacuga

SEQ ID NO: 1947557 - RNA, 16 nt, Human
cagaaguccagagucu

SEQ ID NO: 1947558 - RNA, 17 nt, Human
cagaaauguguuaucac

SEQ ID NO: 1947559 - RNA, 14 nt, Human
cagaaauucuguuu

SEQ ID NO: 1947560 - RNA, 17 nt, Human
cagaaauucuguuuuua

SEQ ID NO: 1947561 - RNA, 18 nt, Human
cagaaauucuguuuuuaa

SEQ ID NO: 1947562 - RNA, 19 nt, Human
cagaaauucuguuuuuaaa

SEQ ID NO: 1947563 - RNA, 20 nt, Human
cagaaauucuguuuuuaaaa

SEQ ID NO: 1947564 - RNA, 22 nt, Human
cagaaauucuguuuuuaaaaau

SEQ ID NO: 1947565 - RNA, 23 nt, Human
cagaaauugguaccuugcacaca

SEQ ID NO: 1947566 - RNA, 11 nt, Human
cagaaauuggu

SEQ ID NO: 1947567 - RNA, 15 nt, Human
cagaaauugguaccu

SEQ ID NO: 1947568 - RNA, 17 nt, Human
cagaaauugguaccuug

SEQ ID NO: 1947569 - RNA, 19 nt, Human
cagaaauugguaccuugca

SEQ ID NO: 1947570 - RNA, 20 nt, Human
cagaaauugguaccuugcac

SEQ ID NO: 1947571 - RNA, 21 nt, Human
cagaaauugguaccuugcaca

SEQ ID NO: 1947572 - RNA, 15 nt, Human
cagaauacugaugga

SEQ ID NO: 1947573 - RNA, 22 nt, Human
cagaauauuagugaccucagcu

SEQ ID NO: 1947574 - RNA, 21 nt, Human
cagaauaaacuggcagcucag

SEQ ID NO: 1947575 - RNA, 21 nt, Human
cagaaguuucugccgcagccc

SEQ ID NO: 1947576 - RNA, 20 nt, Human
cagaaguuucugccgcagcc

SEQ ID NO: 1947577 - RNA, 22 nt, Human
cagaaguuucugccgcagcccu

SEQ ID NO: 1947578 - RNA, 16 nt, Human
cagaaguuuaaauauu

SEQ ID NO: 1947579 - RNA, 22 nt, Human
cagaaguuuaaauauuaagcau

SEQ ID NO: 1947580 - RNA, 14 nt, Human
cacuuuccaaguca

SEQ ID NO: 1947581 - RNA, 13 nt, Human
cacuuuauugcca

SEQ ID NO: 1947582 - RNA, 20 nt, Human
cacuuuauugccaaaaccca

SEQ ID NO: 1947583 - RNA, 22 nt, Human
cacugggcuuggggaccagagc

SEQ ID NO: 1947584 - RNA, 15 nt, Human
cacuggggauugggc

SEQ ID NO: 1947585 - RNA, 16 nt, Human
cacuggggauugggcc

SEQ ID NO: 1947586 - RNA, 17 nt, Human
cacuggggauugggccc

SEQ ID NO: 1947587 - RNA, 18 nt, Human
cacuggggauugggcccc

SEQ ID NO: 1947588 - RNA, 23 nt, Human
cacugggcuuggggaccagagcu

SEQ ID NO: 1947589 - RNA, 23 nt, Human
cacuggggauugggccccugcca

SEQ ID NO: 1947590 - RNA, 17 nt, Human
cacuggugacaugucuu

SEQ ID NO: 1947591 - RNA, 14 nt, Human
cacuguugcccagg

SEQ ID NO: 1947592 - RNA, 22 nt, Human
cacugguggcccgacagccugg

SEQ ID NO: 1947593 - RNA, 13 nt, Human
cacugguggcccg

SEQ ID NO: 1947594 - RNA, 21 nt, Human
cacugguggcccgacagccug

SEQ ID NO: 1947595 - RNA, 15 nt, Human
cacuguugcccaggc

SEQ ID NO: 1947596 - RNA, 16 nt, Human
cacuguugcccaggcu

SEQ ID NO: 1947597 - RNA, 21 nt, Human
cacuugugacuuuugcuuuaa

SEQ ID NO: 1947598 - RNA, 21 nt, Human
cacuugucggcuccagucccc

SEQ ID NO: 1947599 - RNA, 13 nt, Human
cacuugugacuuu

SEQ ID NO: 1947600 - RNA, 14 nt, Human
cacuugugacuuuu

SEQ ID NO: 1947601 - RNA, 17 nt, Human
cacuugugacuuuugcu

SEQ ID NO: 1947602 - RNA, 18 nt, Human
cacuugugacuuuugcuu

SEQ ID NO: 1947603 - RNA, 20 nt, Human
cacuugugacuuuugcuuua

SEQ ID NO: 1947604 - RNA, 16 nt, Human
cacuuguccaugugaa

SEQ ID NO: 1947605 - RNA, 17 nt, Human
cacuugucggcuccagu

SEQ ID NO: 1947606 - RNA, 17 nt, Human
cacuuggucugugagau

SEQ ID NO: 1947607 - RNA, 20 nt, Human
cacuuggucugugagaugcu

SEQ ID NO: 1947608 - RNA, 20 nt, Human
cacuuagaaauugcauuucc

SEQ ID NO: 1947609 - RNA, 19 nt, Human
cacuguuucaaacuuuacu

SEQ ID NO: 1947610 - RNA, 23 nt, Human
cacuguuuagauuugccauagag

SEQ ID NO: 1947611 - RNA, 15 nt, Human
cacuguuuagauuug

SEQ ID NO: 1947612 - RNA, 20 nt, Human
cacuguuuagauuugccaua

SEQ ID NO: 1947613 - RNA, 17 nt, Human
cacuguugcccaggcug

SEQ ID NO: 1947614 - RNA, 17 nt, Human
cacuggugccaugucag

SEQ ID NO: 1947615 - RNA, 12 nt, Human
cacuguuuagau

SEQ ID NO: 1947616 - RNA, 17 nt, Human
cacuuagaaauugcauu

SEQ ID NO: 1947617 - RNA, 19 nt, Human
cacuuagaaauugcauuuc

SEQ ID NO: 1947618 - RNA, 17 nt, Human
cacucuuggagccugca

SEQ ID NO: 1947619 - RNA, 19 nt, Human
cacucuuggagccugcaga

SEQ ID NO: 1947620 - RNA, 20 nt, Human
cacugaaccugggaaagaga

SEQ ID NO: 1947621 - RNA, 14 nt, Human
cacucuuggagccu

SEQ ID NO: 1947622 - RNA, 15 nt, Human
cacucuuggagccug

SEQ ID NO: 1947623 - RNA, 16 nt, Human
cacucuuggagccugc

SEQ ID NO: 1947624 - RNA, 17 nt, Human
cacucuugaaaaaugca

SEQ ID NO: 1947625 - RNA, 22 nt, Human
cacucuuagcccaugcuguuuu

SEQ ID NO: 1947626 - RNA, 20 nt, Human
cacuccccgccguacaguuc

SEQ ID NO: 1947627 - RNA, 17 nt, Human
cacucuuauugcccacg

SEQ ID NO: 1947628 - RNA, 18 nt, Human
cacucuuauugcccacgc

SEQ ID NO: 1947629 - RNA, 19 nt, Human
cacucuuauugcccacgcu

SEQ ID NO: 1947630 - RNA, 12 nt, Human
cacucccagcau

SEQ ID NO: 1947631 - RNA, 14 nt, Human
cacuccccagccag

SEQ ID NO: 1947632 - RNA, 16 nt, Human
cacuccccagccagcc

SEQ ID NO: 1947633 - RNA, 21 nt, Human
cacuccccagccagccuggcu

SEQ ID NO: 1947634 - RNA, 22 nt, Human
cacuccccagccagccuggcug

SEQ ID NO: 1947635 - RNA, 14 nt, Human
cacggccaggccag

SEQ ID NO: 1947636 - RNA, 15 nt, Human
cacggccaggccaga

SEQ ID NO: 1947637 - RNA, 16 nt, Human
cacggccaggccagag

SEQ ID NO: 1947638 - RNA, 22 nt, Human
cacggagcggauugcaaagcaa

SEQ ID NO: 1947639 - RNA, 20 nt, Human
cacggagggugacgggggug

SEQ ID NO: 1947640 - RNA, 23 nt, Human
cacuacggaauaguuggcuagga

SEQ ID NO: 1947641 - RNA, 13 nt, Human
cacuaccuggcug

SEQ ID NO: 1947642 - RNA, 21 nt, Human
caccuacaugagguacugaga

SEQ ID NO: 1947643 - RNA, 20 nt, Human
caccuaccaccacgcccggc

SEQ ID NO: 1947644 - RNA, 16 nt, Human
caccugccagggacag

SEQ ID NO: 1947645 - RNA, 14 nt, Human
caccugccagggac

SEQ ID NO: 1947646 - RNA, 13 nt, Human
caccugccaggga

SEQ ID NO: 1947647 - RNA, 17 nt, Human
caccugccagggacaga

SEQ ID NO: 1947648 - RNA, 19 nt, Human
caccuugacagggcacacc

SEQ ID NO: 1947649 - RNA, 13 nt, Human
caccuuggcucaa

SEQ ID NO: 1947650 - RNA, 15 nt, Human
caccuuuguccccac

SEQ ID NO: 1947651 - RNA, 14 nt, Human
caccuuugucccca

SEQ ID NO: 1947652 - RNA, 17 nt, Human
caccuuuguccccaccg

SEQ ID NO: 1947653 - RNA, 14 nt, Human
caccuuugaagaag

SEQ ID NO: 1947654 - RNA, 14 nt, Human
caccuuuauucugg

SEQ ID NO: 1947655 - RNA, 14 nt, Human
caccuugguuccug

SEQ ID NO: 1947656 - RNA, 22 nt, Human
caccuugguuccuggggcaucc

SEQ ID NO: 1947657 - RNA, 16 nt, Human
cacagcuaacauggaa

SEQ ID NO: 1947658 - RNA, 15 nt, Human
cacagcuaacaugga

SEQ ID NO: 1947659 - RNA, 22 nt, Human
cacagacccugcccugugggcc

SEQ ID NO: 1947660 - RNA, 21 nt, Human
cacagacccugcccugugggc

SEQ ID NO: 1947661 - RNA, 20 nt, Human
cacagacccugcccuguggg

SEQ ID NO: 1947662 - RNA, 19 nt, Human
cacagacccugcccugugg

SEQ ID NO: 1947663 - RNA, 17 nt, Human
cacagacaggaccccug

SEQ ID NO: 1947664 - RNA, 22 nt, Human
cacagacaggaccccugcaguu

SEQ ID NO: 1947665 - RNA, 10 nt, Human
cacagacagg

SEQ ID NO: 1947666 - RNA, 13 nt, Human
cacagacaggacc

SEQ ID NO: 1947667 - RNA, 14 nt, Human
cacagacaggaccc

SEQ ID NO: 1947668 - RNA, 15 nt, Human
cacagacaggacccc

SEQ ID NO: 1947669 - RNA, 19 nt, Human
cacagaaggggacugccac

SEQ ID NO: 1947670 - RNA, 22 nt, Human
cacagaaggggacugccaccuc

SEQ ID NO: 1947671 - RNA, 23 nt, Human
cacagaaggggacugccaccucc

SEQ ID NO: 1947672 - RNA, 18 nt, Human
cacagaaggggacugcca

SEQ ID NO: 1947673 - RNA, 13 nt, Human
cacaggucaggcu

SEQ ID NO: 1947674 - RNA, 14 nt, Human
cacaggucaggcua

SEQ ID NO: 1947675 - RNA, 19 nt, Human
cacagggccuggcccaugu

SEQ ID NO: 1947676 - RNA, 17 nt, Human
cacagggccuggcccau

SEQ ID NO: 1947677 - RNA, 18 nt, Human
cacagggccuggcccaug

SEQ ID NO: 1947678 - RNA, 13 nt, Human
cacagggccuggc

SEQ ID NO: 1947679 - RNA, 14 nt, Human
cacagggccuggcc

SEQ ID NO: 1947680 - RNA, 15 nt, Human
cacagggccuggccc

SEQ ID NO: 1947681 - RNA, 16 nt, Human
cacagggccuggccca

SEQ ID NO: 1947682 - RNA, 17 nt, Human
cacagggcaugaaauga

SEQ ID NO: 1947683 - RNA, 22 nt, Human
cacagcuaacauggaaguacua

SEQ ID NO: 1947684 - RNA, 22 nt, Human
cacagcguuaugugucugccac

SEQ ID NO: 1947685 - RNA, 13 nt, Human
cacagcucccuuc

SEQ ID NO: 1947686 - RNA, 20 nt, Human
cacagcucuguccugggagu

SEQ ID NO: 1947687 - RNA, 23 nt, Human
cacagcucuguccugggagugag

SEQ ID NO: 1947688 - RNA, 10 nt, Human
cacagcucuu

SEQ ID NO: 1947689 - RNA, 16 nt, Human
cacagcucccuucugu

SEQ ID NO: 1947690 - RNA, 17 nt, Human
cacagcucccuucuguu

SEQ ID NO: 1947691 - RNA, 16 nt, Human
cacaguauuacuucug

SEQ ID NO: 1947692 - RNA, 18 nt, Human
cacaguauuacuucugcu

SEQ ID NO: 1947693 - RNA, 19 nt, Human
cacaguauuacuucugcua

SEQ ID NO: 1947694 - RNA, 16 nt, Human
caccaggccccccugu

SEQ ID NO: 1947695 - RNA, 14 nt, Human
caccagcugugucc

SEQ ID NO: 1947696 - RNA, 16 nt, Human
cacccagcccacuucu

SEQ ID NO: 1947697 - RNA, 17 nt, Human
cacccagcccacuucug

SEQ ID NO: 1947698 - RNA, 17 nt, Human
caccaggccccccuguc

SEQ ID NO: 1947699 - RNA, 12 nt, Human
caccagcagccu

SEQ ID NO: 1947700 - RNA, 14 nt, Human
caccagcagccugg

SEQ ID NO: 1947701 - RNA, 23 nt, Human
caccaacauacucccaucuguga

SEQ ID NO: 1947702 - RNA, 19 nt, Human
caccaaaaaaauccagaaa

SEQ ID NO: 1947703 - RNA, 20 nt, Human
caccaaaaaaauccagaaac

SEQ ID NO: 1947704 - RNA, 12 nt, Human
caccaaaaaaua

SEQ ID NO: 1947705 - RNA, 13 nt, Human
caccaaaaaauau

SEQ ID NO: 1947706 - RNA, 14 nt, Human
caccaaaaaauauc

SEQ ID NO: 1947707 - RNA, 17 nt, Human
caccaaaaaauaucuag

SEQ ID NO: 1947708 - RNA, 15 nt, Human
caccagcagccugga

SEQ ID NO: 1947709 - RNA, 21 nt, Human
caccagcccuuagcagggaaa

SEQ ID NO: 1947710 - RNA, 24 nt, Human
cacccaggagccccgaggccuucu

SEQ ID NO: 1947711 - RNA, 19 nt, Human
cacccagcccacuucugcc

SEQ ID NO: 1947712 - RNA, 20 nt, Human
cacccaggagccccgaggcc

SEQ ID NO: 1947713 - RNA, 23 nt, Human
cacccaggagccccgaggccuuc

SEQ ID NO: 1947714 - RNA, 21 nt, Human
caccaacauacucccaucugu

SEQ ID NO: 1947715 - RNA, 20 nt, Human
caccaacauacucccaucug

SEQ ID NO: 1947716 - RNA, 17 nt, Human
caccaacauacucccau

SEQ ID NO: 1947717 - RNA, 13 nt, Human
cacauuuuucuua

SEQ ID NO: 1947718 - RNA, 14 nt, Human
cacauuuuucuuag

SEQ ID NO: 1947719 - RNA, 17 nt, Human
cacauuuuuuaaaugca

SEQ ID NO: 1947720 - RNA, 21 nt, Human
cacauuuuuuaaaugcaccug

SEQ ID NO: 1947721 - RNA, 15 nt, Human
cacauuuuauuuuau

SEQ ID NO: 1947722 - RNA, 19 nt, Human
cacauuuuaaaaaauuugu

SEQ ID NO: 1947723 - RNA, 17 nt, Human
cacauuuuuauaccugu

SEQ ID NO: 1947724 - RNA, 21 nt, Human
cacauuuuuauaccuguuuaa

SEQ ID NO: 1947725 - RNA, 23 nt, Human
cacauuuuuauaccuguuuaaau

SEQ ID NO: 1947726 - RNA, 21 nt, Human
cacauuuucuuaauccagucu

SEQ ID NO: 1947727 - RNA, 18 nt, Human
cacauuugguaauguuuu

SEQ ID NO: 1947728 - RNA, 20 nt, Human
cacauuugguaauguuuuua

SEQ ID NO: 1947729 - RNA, 21 nt, Human
cacauuucuuuuuaaaaaaag

SEQ ID NO: 1947730 - RNA, 18 nt, Human
cacauuucucaacaaggc

SEQ ID NO: 1947731 - RNA, 13 nt, Human
cacauuucuuuuu

SEQ ID NO: 1947732 - RNA, 19 nt, Human
cacaucuugcucugcugac

SEQ ID NO: 1947733 - RNA, 18 nt, Human
cacaucuugcucugcuga

SEQ ID NO: 1947734 - RNA, 20 nt, Human
cacaucagcacgauuucugu

SEQ ID NO: 1947735 - RNA, 21 nt, Human
cacaucagcacgauuucuguu

SEQ ID NO: 1947736 - RNA, 22 nt, Human
cacaucagcacgauuucuguuu

SEQ ID NO: 1947737 - RNA, 19 nt, Human
cacauccggggccagcucc

SEQ ID NO: 1947738 - RNA, 20 nt, Human
cacauccggggccagcuccg

SEQ ID NO: 1947739 - RNA, 19 nt, Human
cacauccuugacuuuuuag

SEQ ID NO: 1947740 - RNA, 21 nt, Human
cacauccuugacuuuuuagau

SEQ ID NO: 1947741 - RNA, 16 nt, Human
cacaucuugcucugcu

SEQ ID NO: 1947742 - RNA, 17 nt, Human
cacaucuugcucugcug

SEQ ID NO: 1947743 - RNA, 17 nt, Human
caaguagacuacuguuc

SEQ ID NO: 1947744 - RNA, 16 nt, Human
caaguagaccaugguc

SEQ ID NO: 1947745 - RNA, 16 nt, Human
caaguacaguacuuug

SEQ ID NO: 1947746 - RNA, 15 nt, Human
caaguacacugagag

SEQ ID NO: 1947747 - RNA, 13 nt, Human
caaguuuugugaa

SEQ ID NO: 1947748 - RNA, 14 nt, Human
caaguuuugugaaa

SEQ ID NO: 1947749 - RNA, 16 nt, Human
caaguuuugugaaauu

SEQ ID NO: 1947750 - RNA, 17 nt, Human
caaguuuugugaaauuu

SEQ ID NO: 1947751 - RNA, 18 nt, Human
caaguuuugugaaauuuu

SEQ ID NO: 1947752 - RNA, 19 nt, Human
caaguuuugugaaauuuuu

SEQ ID NO: 1947753 - RNA, 20 nt, Human
caaguuuugugaaauuuuuc

SEQ ID NO: 1947754 - RNA, 21 nt, Human
caaguuuugugaaauuuuuca

SEQ ID NO: 1947755 - RNA, 22 nt, Human
caaguuuugugaaauuuuucau

SEQ ID NO: 1947756 - RNA, 19 nt, Human
caaguugagcuaugacuua

SEQ ID NO: 1947757 - RNA, 18 nt, Human
caacccccagcucccgcu

SEQ ID NO: 1947758 - RNA, 13 nt, Human
caaguaguucugu

SEQ ID NO: 1947759 - RNA, 12 nt, Human
caaguauuauaa

SEQ ID NO: 1947760 - RNA, 22 nt, Human
caaguauuauaaacaagaauga

SEQ ID NO: 1947761 - RNA, 22 nt, Human
caaugcugugcccuaaagugua

SEQ ID NO: 1947762 - RNA, 17 nt, Human
caauucuccugccucag

SEQ ID NO: 1947763 - RNA, 19 nt, Human
caauucuccugccucagcc

SEQ ID NO: 1947764 - RNA, 13 nt, Human
caauucuccuuua

SEQ ID NO: 1947765 - RNA, 22 nt, Human
caaugcuggcuguuggcugggg

SEQ ID NO: 1947766 - RNA, 23 nt, Human
caaugcuggcuguuggcuggggg

SEQ ID NO: 1947767 - RNA, 16 nt, Human
cacaagacccuugugg

SEQ ID NO: 1947768 - RNA, 14 nt, Human
cacaagacccuugu

SEQ ID NO: 1947769 - RNA, 12 nt, Human
caauuuaaaaaa

SEQ ID NO: 1947770 - RNA, 17 nt, Human
caauuuaaaauauagau

SEQ ID NO: 1947771 - RNA, 14 nt, Human
cacaagccuucggc

SEQ ID NO: 1947772 - RNA, 20 nt, Human
caacaccuuguuucccucuc

SEQ ID NO: 1947773 - RNA, 22 nt, Human
caacaccucugcacaagcugca

SEQ ID NO: 1947774 - RNA, 13 nt, Human
caacacaaagauu

SEQ ID NO: 1947775 - RNA, 21 nt, Human
caaaguacacuguuucaaacu

SEQ ID NO: 1947776 - RNA, 16 nt, Human
caaaguacacuguuuc

SEQ ID NO: 1947777 - RNA, 20 nt, Human
caaaguacacuguuucaaac

SEQ ID NO: 1947778 - RNA, 14 nt, Human
caaagaugcagccg

SEQ ID NO: 1947779 - RNA, 13 nt, Human
caaagaugcagcc

SEQ ID NO: 1947780 - RNA, 16 nt, Human
caaagucaagccacau

SEQ ID NO: 1947781 - RNA, 17 nt, Human
caaaucagcugcuacua

SEQ ID NO: 1947782 - RNA, 20 nt, Human
caaauccuugugggaaaaga

SEQ ID NO: 1947783 - RNA, 14 nt, Human
caaauccaggaccc

SEQ ID NO: 1947784 - RNA, 22 nt, Human
caaauccagccugcugccugcu

SEQ ID NO: 1947785 - RNA, 20 nt, Human
caaauccaggacccugccag

SEQ ID NO: 1947786 - RNA, 17 nt, Human
caaauccaggacccugc

SEQ ID NO: 1947787 - RNA, 18 nt, Human
caaauccaggacccugcc

SEQ ID NO: 1947788 - RNA, 22 nt, Human
caaaugagggucuugguuccag

SEQ ID NO: 1947789 - RNA, 18 nt, Human
caaaucugcaaagcaugu

SEQ ID NO: 1947790 - RNA, 20 nt, Human
caaaucugcaaagcauguuu

SEQ ID NO: 1947791 - RNA, 21 nt, Human
caaaucugcuuuuuaaagaau

SEQ ID NO: 1947792 - RNA, 13 nt, Human
caaaugcagcuuu

SEQ ID NO: 1947793 - RNA, 22 nt, Human
caaaugauugcuuuuaaaauuu

SEQ ID NO: 1947794 - RNA, 23 nt, Human
caaaugauugcuuuuaaaauuuu

SEQ ID NO: 1947795 - RNA, 17 nt, Human
caaaugaugugccugcu

SEQ ID NO: 1947796 - RNA, 20 nt, Human
caaaugaugugccugcuuca

SEQ ID NO: 1947797 - RNA, 21 nt, Human
caaaugaugugccugcuucag

SEQ ID NO: 1947798 - RNA, 12 nt, Human
caaaugauugcu

SEQ ID NO: 1947799 - RNA, 14 nt, Human
caaaugauugcuuu

SEQ ID NO: 1947800 - RNA, 15 nt, Human
caaaugauugcuuuu

SEQ ID NO: 1947801 - RNA, 17 nt, Human
caaaugauugcuuuuaa

SEQ ID NO: 1947802 - RNA, 18 nt, Human
caaaugauugcuuuuaaa

SEQ ID NO: 1947803 - RNA, 19 nt, Human
caaaugauugcuuuuaaaa

SEQ ID NO: 1947804 - RNA, 20 nt, Human
caaaugauugcuuuuaaaau

SEQ ID NO: 1947805 - RNA, 21 nt, Human
caaaugauugcuuuuaaaauu

SEQ ID NO: 1947806 - RNA, 23 nt, Human
caacaauuuucagauuugcacaa

SEQ ID NO: 1947807 - RNA, 20 nt, Human
caacaauuuagaaggaaaac

SEQ ID NO: 1947808 - RNA, 12 nt, Human
caacaauuuuca

SEQ ID NO: 1947809 - RNA, 13 nt, Human
caacaauuuucag

SEQ ID NO: 1947810 - RNA, 15 nt, Human
caacaauuuucagau

SEQ ID NO: 1947811 - RNA, 18 nt, Human
caacaauuuucagauuug

SEQ ID NO: 1947812 - RNA, 19 nt, Human
caacaauuuucagauuugc

SEQ ID NO: 1947813 - RNA, 23 nt, Human
caacaaaccuguuucugcagcca

SEQ ID NO: 1947814 - RNA, 21 nt, Human
caacaaacugcacaugauuuc

SEQ ID NO: 1947815 - RNA, 22 nt, Human
caacaaacugcacaugauuuca

SEQ ID NO: 1947816 - RNA, 13 nt, Human
caacaaaauacau

SEQ ID NO: 1947817 - RNA, 14 nt, Human
caacaaaauacauu

SEQ ID NO: 1947818 - RNA, 16 nt, Human
caacaaacugcacaug

SEQ ID NO: 1947819 - RNA, 17 nt, Human
caacaaacugcacauga

SEQ ID NO: 1947820 - RNA, 12 nt, Human
caacaaaauaca

SEQ ID NO: 1947821 - RNA, 18 nt, Human
caaccacugcgaccacaa

SEQ ID NO: 1947822 - RNA, 23 nt, Human
caagaauuucuaggacugaauua

SEQ ID NO: 1947823 - RNA, 13 nt, Human
caagacacaguga

SEQ ID NO: 1947824 - RNA, 22 nt, Human
caagaauaaaggcagcuguugu

SEQ ID NO: 1947825 - RNA, 16 nt, Human
caagacaacauuguaa

SEQ ID NO: 1947826 - RNA, 19 nt, Human
caagacccuugugguccca

SEQ ID NO: 1947827 - RNA, 18 nt, Human
caagacccuugugguccc

SEQ ID NO: 1947828 - RNA, 22 nt, Human
caagacccuuguggucccaccc

SEQ ID NO: 1947829 - RNA, 15 nt, Human
caacucaccccagcc

SEQ ID NO: 1947830 - RNA, 13 nt, Human
caacucaccccag

SEQ ID NO: 1947831 - RNA, 16 nt, Human
caacucaccccagccc

SEQ ID NO: 1947832 - RNA, 15 nt, Human
caacccccagcuccc

SEQ ID NO: 1947833 - RNA, 16 nt, Human
caacccccagcucccg

SEQ ID NO: 1947834 - RNA, 19 nt, Human
caagaauaaaggcagcugu

SEQ ID NO: 1947835 - RNA, 21 nt, Human
caagaauaaaggcagcuguug

SEQ ID NO: 1947836 - RNA, 21 nt, Human
caagaaguucuuugauucugu

SEQ ID NO: 1947837 - RNA, 15 nt, Human
caagaaguuuaagga

SEQ ID NO: 1947838 - RNA, 15 nt, Human
caagaauaaaggcag

SEQ ID NO: 1947839 - RNA, 17 nt, Human
caagaauaaaggcagcu

SEQ ID NO: 1947840 - RNA, 18 nt, Human
caagaauaaaggcagcug

SEQ ID NO: 1947841 - RNA, 21 nt, Human
caaccacguugggacagggag

SEQ ID NO: 1947842 - RNA, 19 nt, Human
caacccaaauguucaucaa

SEQ ID NO: 1947843 - RNA, 14 nt, Human
caaccauuccccau

SEQ ID NO: 1947844 - RNA, 13 nt, Human
caaccauuuaucu

SEQ ID NO: 1947845 - RNA, 16 nt, Human
caaccauuuaucuuga

SEQ ID NO: 1947846 - RNA, 17 nt, Human
caaccauuuaucuugaa

SEQ ID NO: 1947847 - RNA, 22 nt, Human
caaccauuuaucuugaaggaaa

SEQ ID NO: 1947848 - RNA, 14 nt, Human
caaccauuugaaac

SEQ ID NO: 1947849 - RNA, 15 nt, Human
caacccccagccugc

SEQ ID NO: 1947850 - RNA, 16 nt, Human
caacccccagccugcu

SEQ ID NO: 1947851 - RNA, 17 nt, Human
caacccccagccugcua

SEQ ID NO: 1947852 - RNA, 18 nt, Human
caacuaugauuuggaaaa

SEQ ID NO: 1947853 - RNA, 19 nt, Human
caacuaugauuuggaaaau

SEQ ID NO: 1947854 - RNA, 22 nt, Human
caacuaugauuuggaaaauaaa

SEQ ID NO: 1947855 - RNA, 17 nt, Human
caacuaugauuuggaaa

SEQ ID NO: 1947856 - RNA, 14 nt, Human
caacccccagcucc

SEQ ID NO: 1947857 - RNA, 15 nt, Human
caaaccaccagaagc

SEQ ID NO: 1947858 - RNA, 16 nt, Human
caaaccaccagaagcc

SEQ ID NO: 1947859 - RNA, 20 nt, Human
caaaccaccagaagcccaga

SEQ ID NO: 1947860 - RNA, 22 nt, Human
caaaccaccagaagcccagaau

SEQ ID NO: 1947861 - RNA, 13 nt, Human
caaaaguggucag

SEQ ID NO: 1947862 - RNA, 15 nt, Human
caaaagcugggcagg

SEQ ID NO: 1947863 - RNA, 14 nt, Human
caaaagcugcucag

SEQ ID NO: 1947864 - RNA, 21 nt, Human
caaaagcugaacacauuucuu

SEQ ID NO: 1947865 - RNA, 14 nt, Human
caaaaguagaacuu

SEQ ID NO: 1947866 - RNA, 18 nt, Human
caaaaguagaacuuugua

SEQ ID NO: 1947867 - RNA, 19 nt, Human
caaaaguagaacuuuguau

SEQ ID NO: 1947868 - RNA, 20 nt, Human
caaaaguagaacuuuguaua

SEQ ID NO: 1947869 - RNA, 21 nt, Human
caaaaguagaacuuuguauag

SEQ ID NO: 1947870 - RNA, 22 nt, Human
caaaaguagaacuuuguauagu

SEQ ID NO: 1947871 - RNA, 13 nt, Human
auuuuuaagugcu

SEQ ID NO: 1947872 - RNA, 16 nt, Human
auuuuuacaguuauag

SEQ ID NO: 1947873 - RNA, 16 nt, Human
auuuuuuuuuccuuca

SEQ ID NO: 1947874 - RNA, 13 nt, Human
auuuuuuuuuccu

SEQ ID NO: 1947875 - RNA, 12 nt, Human
auuuuuuuuucc

SEQ ID NO: 1947876 - RNA, 12 nt, Human
caaaagcugcuc

SEQ ID NO: 1947877 - RNA, 20 nt, Human
caaaagcugaacacauuucu

SEQ ID NO: 1947878 - RNA, 16 nt, Human
caaaagcugaacacau

SEQ ID NO: 1947879 - RNA, 22 nt, Human
caaaaaaaguuguaugaucugu

SEQ ID NO: 1947880 - RNA, 12 nt, Human
caaaaaaaguug

SEQ ID NO: 1947881 - RNA, 13 nt, Human
caaaaaaaguugu

SEQ ID NO: 1947882 - RNA, 14 nt, Human
caaaaaaaguugua

SEQ ID NO: 1947883 - RNA, 15 nt, Human
caaaaaaaguuguau

SEQ ID NO: 1947884 - RNA, 16 nt, Human
caaaaaaaguuguaug

SEQ ID NO: 1947885 - RNA, 18 nt, Human
caaaaaaaguuguaugau

SEQ ID NO: 1947886 - RNA, 21 nt, Human
caaaaaaaguuguaugaucug

SEQ ID NO: 1947887 - RNA, 17 nt, Human
auuuuuuuuuccuucag

SEQ ID NO: 1947888 - RNA, 19 nt, Human
auuuuuaaaugcaguuaca

SEQ ID NO: 1947889 - RNA, 20 nt, Human
auuuuuaaaugcaguuacaa

SEQ ID NO: 1947890 - RNA, 11 nt, Human
auuuuuaaaug

SEQ ID NO: 1947891 - RNA, 13 nt, Human
auuuguuugaacu

SEQ ID NO: 1947892 - RNA, 20 nt, Human
auuuuauaaggacuuccuga

SEQ ID NO: 1947893 - RNA, 15 nt, Human
auuuuauaaauguau

SEQ ID NO: 1947894 - RNA, 18 nt, Human
auuuuauaaggacuuccu

SEQ ID NO: 1947895 - RNA, 20 nt, Human
auuuguuugaacugauaaag

SEQ ID NO: 1947896 - RNA, 18 nt, Human
auuuguuucuuucucuga

SEQ ID NO: 1947897 - RNA, 20 nt, Human
auuuguuucuuucucugagg

SEQ ID NO: 1947898 - RNA, 14 nt, Human
auuuguuugaacug

SEQ ID NO: 1947899 - RNA, 16 nt, Human
auuuguuugaacugau

SEQ ID NO: 1947900 - RNA, 18 nt, Human
auuuugauccaagcuggu

SEQ ID NO: 1947901 - RNA, 14 nt, Human
auuuugauaguggg

SEQ ID NO: 1947902 - RNA, 14 nt, Human
auuccaaacauggu

SEQ ID NO: 1947903 - RNA, 16 nt, Human
auucauuuucucuuua

SEQ ID NO: 1947904 - RNA, 15 nt, Human
auucauuuucucuuu

SEQ ID NO: 1947905 - RNA, 19 nt, Human
auucauauuuacuucuuau

SEQ ID NO: 1947906 - RNA, 18 nt, Human
auucauauuuacuucuua

SEQ ID NO: 1947907 - RNA, 22 nt, Human
auucauauuuguacuuucuguu

SEQ ID NO: 1947908 - RNA, 23 nt, Human
auucauauuuguacuuucuguua

SEQ ID NO: 1947909 - RNA, 15 nt, Human
auucauauuuguacu

SEQ ID NO: 1947910 - RNA, 17 nt, Human
auucauauuuguacuuu

SEQ ID NO: 1947911 - RNA, 19 nt, Human
auucauauuuguacuuucu

SEQ ID NO: 1947912 - RNA, 21 nt, Human
auucauauuuguacuuucugu

SEQ ID NO: 1947913 - RNA, 20 nt, Human
auucauauuuacuucuuaua

SEQ ID NO: 1947914 - RNA, 12 nt, Human
auucauauuugu

SEQ ID NO: 1947915 - RNA, 13 nt, Human
auucauauuugua

SEQ ID NO: 1947916 - RNA, 15 nt, Human
auuauguguguuuua

SEQ ID NO: 1947917 - RNA, 21 nt, Human
auuauguguguuuuaaaauga

SEQ ID NO: 1947918 - RNA, 20 nt, Human
auuauguguguuuuaaaaug

SEQ ID NO: 1947919 - RNA, 20 nt, Human
auuaaauucuugcaaaguau

SEQ ID NO: 1947920 - RNA, 14 nt, Human
auuaaauucuugca

SEQ ID NO: 1947921 - RNA, 18 nt, Human
auuaaauucuugcaaagu

SEQ ID NO: 1947922 - RNA, 18 nt, Human
auucacaagacccaaaag

SEQ ID NO: 1947923 - RNA, 12 nt, Human
auucaagaacau

SEQ ID NO: 1947924 - RNA, 16 nt, Human
auucaacuuuccaaau

SEQ ID NO: 1947925 - RNA, 21 nt, Human
auucaacuuuccaaauaaaag

SEQ ID NO: 1947926 - RNA, 22 nt, Human
auugagccuaaaaauaaagcac

SEQ ID NO: 1947927 - RNA, 17 nt, Human
auugauccagaaagaaa

SEQ ID NO: 1947928 - RNA, 16 nt, Human
auugauccagaaagaa

SEQ ID NO: 1947929 - RNA, 17 nt, Human
auugagagagaugugua

SEQ ID NO: 1947930 - RNA, 19 nt, Human
auugagagagauguguaau

SEQ ID NO: 1947931 - RNA, 21 nt, Human
auugagaccgugaagauacuu

SEQ ID NO: 1947932 - RNA, 22 nt, Human
auugagaccgugaagauacuuu

SEQ ID NO: 1947933 - RNA, 23 nt, Human
auugagaccgugaagauacuuug

SEQ ID NO: 1947934 - RNA, 17 nt, Human
auugagaccgugaagau

SEQ ID NO: 1947935 - RNA, 20 nt, Human
auugagaccgugaagauacu

SEQ ID NO: 1947936 - RNA, 17 nt, Human
auugagccuaaaaauaa

SEQ ID NO: 1947937 - RNA, 21 nt, Human
auugagccuaaaaauaaagca

SEQ ID NO: 1947938 - RNA, 15 nt, Human
auugagccuaaaaau

SEQ ID NO: 1947939 - RNA, 20 nt, Human
auugagagagauguguaauu

SEQ ID NO: 1947940 - RNA, 21 nt, Human
auugagagagauguguaauuu

SEQ ID NO: 1947941 - RNA, 19 nt, Human
auucuuugaccuguuggga

SEQ ID NO: 1947942 - RNA, 14 nt, Human
auucuuucuccuuu

SEQ ID NO: 1947943 - RNA, 22 nt, Human
auucuuuccugaggcugggcuc

SEQ ID NO: 1947944 - RNA, 17 nt, Human
auucuuuccugaggcug

SEQ ID NO: 1947945 - RNA, 22 nt, Human
auuccugacgagauaagcaguu

SEQ ID NO: 1947946 - RNA, 13 nt, Human
auuccugaacagg

SEQ ID NO: 1947947 - RNA, 21 nt, Human
auuccugaugcuucuucagag

SEQ ID NO: 1947948 - RNA, 19 nt, Human
auucucuccuguaccucuu

SEQ ID NO: 1947949 - RNA, 21 nt, Human
auucucuccuguaccucuuga

SEQ ID NO: 1947950 - RNA, 16 nt, Human
auucucuccuguaccu

SEQ ID NO: 1947951 - RNA, 13 nt, Human
auucugagagcug

SEQ ID NO: 1947952 - RNA, 14 nt, Human
auucugagagcugu

SEQ ID NO: 1947953 - RNA, 18 nt, Human
auucugaccuuaaaugca

SEQ ID NO: 1947954 - RNA, 17 nt, Human
auucuugccaaauauaa

SEQ ID NO: 1947955 - RNA, 18 nt, Human
auucugaggcccugccca

SEQ ID NO: 1947956 - RNA, 15 nt, Human
auucugaggcccugc

SEQ ID NO: 1947957 - RNA, 17 nt, Human
auucugaggcccugccc

SEQ ID NO: 1947958 - RNA, 18 nt, Human
auuguaagcguauggcuu

SEQ ID NO: 1947959 - RNA, 19 nt, Human
auuguaagcguauggcuuu

SEQ ID NO: 1947960 - RNA, 16 nt, Human
auuguuccagagacaa

SEQ ID NO: 1947961 - RNA, 19 nt, Human
auuguucuuaguuugcagu

SEQ ID NO: 1947962 - RNA, 14 nt, Human
auuguucuuuucaa

SEQ ID NO: 1947963 - RNA, 13 nt, Human
auuguuuagauuu

SEQ ID NO: 1947964 - RNA, 16 nt, Human
auuguuuagauuuugu

SEQ ID NO: 1947965 - RNA, 16 nt, Human
auuguuuaucuagaug

SEQ ID NO: 1947966 - RNA, 17 nt, Human
auuguuuaucuagaugu

SEQ ID NO: 1947967 - RNA, 19 nt, Human
auuguuuaucuagauguaa

SEQ ID NO: 1947968 - RNA, 20 nt, Human
auuguuuaucuagauguaaa

SEQ ID NO: 1947969 - RNA, 21 nt, Human
auuguuuaucuagauguaaau

SEQ ID NO: 1947970 - RNA, 22 nt, Human
auuguuuaucuagauguaaauu

SEQ ID NO: 1947971 - RNA, 13 nt, Human
auuguaaaagcau

SEQ ID NO: 1947972 - RNA, 18 nt, Human
auugaugggauuugguca

SEQ ID NO: 1947973 - RNA, 13 nt, Human
auuguaaaauggu

SEQ ID NO: 1947974 - RNA, 19 nt, Human
auuguaaaagcauuuugua

SEQ ID NO: 1947975 - RNA, 20 nt, Human
auuguaaaagcauuuuguaa

SEQ ID NO: 1947976 - RNA, 21 nt, Human
auuguaaaagcauuuuguaau

SEQ ID NO: 1947977 - RNA, 23 nt, Human
auuguaaaagcauuuuguaauaa

SEQ ID NO: 1947978 - RNA, 22 nt, Human
auugauccagaaagaaaacuug

SEQ ID NO: 1947979 - RNA, 19 nt, Human
auugauccagaaagaaaac

SEQ ID NO: 1947980 - RNA, 18 nt, Human
auugauccagaaagaaaa

SEQ ID NO: 1947981 - RNA, 15 nt, Human
auuguaaggaaugau

SEQ ID NO: 1947982 - RNA, 17 nt, Human
auuguaagcguauggcu

SEQ ID NO: 1947983 - RNA, 18 nt, Human
auuguaagcaugcacaaa

SEQ ID NO: 1947984 - RNA, 16 nt, Human
auuguaaggaaugauu

SEQ ID NO: 1947985 - RNA, 15 nt, Human
auuucucauguugaa

SEQ ID NO: 1947986 - RNA, 12 nt, Human
auuucuguuuag

SEQ ID NO: 1947987 - RNA, 20 nt, Human
auuucuccugcguguucuca

SEQ ID NO: 1947988 - RNA, 10 nt, Human
auuucuccuu

SEQ ID NO: 1947989 - RNA, 11 nt, Human
auuucuccuuu

SEQ ID NO: 1947990 - RNA, 14 nt, Human
auuucuguuuagau

SEQ ID NO: 1947991 - RNA, 16 nt, Human
auuucuguuuagauaa

SEQ ID NO: 1947992 - RNA, 13 nt, Human
auuucuguucagc

SEQ ID NO: 1947993 - RNA, 17 nt, Human
auuuaauggggaggaca

SEQ ID NO: 1947994 - RNA, 12 nt, Human
auuuaauguuga

SEQ ID NO: 1947995 - RNA, 14 nt, Human
auuuaauguugaac

SEQ ID NO: 1947996 - RNA, 15 nt, Human
auuuaauguugaaca

SEQ ID NO: 1947997 - RNA, 19 nt, Human
auuuaauguugaacaaaau

SEQ ID NO: 1947998 - RNA, 14 nt, Human
auuuaaugaaagac

SEQ ID NO: 1947999 - RNA, 15 nt, Human
auuuauauuuauuga

SEQ ID NO: 1948000 - RNA, 16 nt, Human
auuuauauuuauugac

SEQ ID NO: 1948001 - RNA, 20 nt, Human
auuuauauuuauugacucuu

SEQ ID NO: 1948002 - RNA, 22 nt, Human
auuuauauuuauugacucuuga

SEQ ID NO: 1948003 - RNA, 21 nt, Human
auuucaagcuuauuuuggaga

SEQ ID NO: 1948004 - RNA, 22 nt, Human
auuucaagcuuauuuuggagag

SEQ ID NO: 1948005 - RNA, 12 nt, Human
auuucaagcuua

SEQ ID NO: 1948006 - RNA, 14 nt, Human
auuucaagcuuauu

SEQ ID NO: 1948007 - RNA, 19 nt, Human
auuucagagagaaucaaga

SEQ ID NO: 1948008 - RNA, 22 nt, Human
auuucaaucccacguacuuaua

SEQ ID NO: 1948009 - RNA, 17 nt, Human
auuucaaguacacugaa

SEQ ID NO: 1948010 - RNA, 19 nt, Human
auuucauccuuucacuucu

SEQ ID NO: 1948011 - RNA, 20 nt, Human
auuucauccuuucacuucuu

SEQ ID NO: 1948012 - RNA, 22 nt, Human
auuucauccuuucacuucuuuc

SEQ ID NO: 1948013 - RNA, 17 nt, Human
auuucaucagaacagcu

SEQ ID NO: 1948014 - RNA, 19 nt, Human
auuucaucagaacagcugu

SEQ ID NO: 1948015 - RNA, 18 nt, Human
auuucaucauauuauaca

SEQ ID NO: 1948016 - RNA, 20 nt, Human
auuucaucauauuauacaga

SEQ ID NO: 1948017 - RNA, 14 nt, Human
auuucauccagaag

SEQ ID NO: 1948018 - RNA, 24 nt, Human
cugcccugugaguacuacaguccu

SEQ ID NO: 1948019 - RNA, 21 nt, Human
cugcccugguuuccugcccug

SEQ ID NO: 1948020 - RNA, 23 nt, Human
cugcccuggugcugccacacuuc

SEQ ID NO: 1948021 - RNA, 17 nt, Human
cugcccugguuuccugc

SEQ ID NO: 1948022 - RNA, 18 nt, Human
cugcccugguuuccugcc

SEQ ID NO: 1948023 - RNA, 19 nt, Human
cugcccugguuuccugccc

SEQ ID NO: 1948024 - RNA, 12 nt, Human
cugcccuggugc

SEQ ID NO: 1948025 - RNA, 13 nt, Human
cugcccuggugcu

SEQ ID NO: 1948026 - RNA, 14 nt, Human
cugcccuggugcug

SEQ ID NO: 1948027 - RNA, 15 nt, Human
cugcccuggugcugc

SEQ ID NO: 1948028 - RNA, 23 nt, Human
cugcccuuaccugccaggaagcc

SEQ ID NO: 1948029 - RNA, 22 nt, Human
cugcccuuaccugccaggaagc

SEQ ID NO: 1948030 - RNA, 19 nt, Human
cugcccuuaccugccagga

SEQ ID NO: 1948031 - RNA, 20 nt, Human
cugcccugguuuccugcccu

SEQ ID NO: 1948032 - RNA, 12 nt, Human
cugcccuguggg

SEQ ID NO: 1948033 - RNA, 11 nt, Human
cugcccugugg

SEQ ID NO: 1948034 - RNA, 20 nt, Human
cugcugagacugcugaguga

SEQ ID NO: 1948035 - RNA, 18 nt, Human
cugcugagccgcagagaa

SEQ ID NO: 1948036 - RNA, 13 nt, Human
cugcugagccgca

SEQ ID NO: 1948037 - RNA, 14 nt, Human
cugcugagccgcag

SEQ ID NO: 1948038 - RNA, 15 nt, Human
cugcugagccgcaga

SEQ ID NO: 1948039 - RNA, 15 nt, Human
cugcuacugccaacc

SEQ ID NO: 1948040 - RNA, 17 nt, Human
cugcuacugccaaccuc

SEQ ID NO: 1948041 - RNA, 12 nt, Human
cugcuacugcca

SEQ ID NO: 1948042 - RNA, 20 nt, Human
cugccuguucagcuccagcu

SEQ ID NO: 1948043 - RNA, 23 nt, Human
cugccuguucagcuccagcucac

SEQ ID NO: 1948044 - RNA, 15 nt, Human
cugccuguucccauu

SEQ ID NO: 1948045 - RNA, 19 nt, Human
cugccuguucccauucuug

SEQ ID NO: 1948046 - RNA, 18 nt, Human
cugcugaaggcucgagca

SEQ ID NO: 1948047 - RNA, 23 nt, Human
cugcugaaggcucgagcaugccu

SEQ ID NO: 1948048 - RNA, 24 nt, Human
cugcugaaggcucgagcaugccug

SEQ ID NO: 1948049 - RNA, 17 nt, Human
cugcuaucaaagagguu

SEQ ID NO: 1948050 - RNA, 19 nt, Human
cugcuauuuuccuguucua

SEQ ID NO: 1948051 - RNA, 20 nt, Human
cugccucggauccccuuccu

SEQ ID NO: 1948052 - RNA, 19 nt, Human
cugccucgaacuggcugca

SEQ ID NO: 1948053 - RNA, 20 nt, Human
cugccucgaacuggcugcaa

SEQ ID NO: 1948054 - RNA, 21 nt, Human
cugccuccuuugugaggaagc

SEQ ID NO: 1948055 - RNA, 17 nt, Human
cugccuccuuugugagg

SEQ ID NO: 1948056 - RNA, 23 nt, Human
cugccuccuuugugaggaagccg

SEQ ID NO: 1948057 - RNA, 14 nt, Human
cugccucgaacugg

SEQ ID NO: 1948058 - RNA, 14 nt, Human
cugccuccuuugug

SEQ ID NO: 1948059 - RNA, 19 nt, Human
cugccuccuugauauuugu

SEQ ID NO: 1948060 - RNA, 15 nt, Human
cuggcagcaccgccu

SEQ ID NO: 1948061 - RNA, 22 nt, Human
cuggcagaguugaagacagagc

SEQ ID NO: 1948062 - RNA, 23 nt, Human
cuggcagccccuguucuggcaga

SEQ ID NO: 1948063 - RNA, 13 nt, Human
cuggcagccgugc

SEQ ID NO: 1948064 - RNA, 19 nt, Human
cuggcagcaccgccucuuc

SEQ ID NO: 1948065 - RNA, 20 nt, Human
cuggcagcaccgccucuucc

SEQ ID NO: 1948066 - RNA, 13 nt, Human
cuggcagcccgca

SEQ ID NO: 1948067 - RNA, 18 nt, Human
cuggcagcccgcaucagc

SEQ ID NO: 1948068 - RNA, 21 nt, Human
cuggcagaguugaagacagag

SEQ ID NO: 1948069 - RNA, 20 nt, Human
cuggcagaguugaagacaga

SEQ ID NO: 1948070 - RNA, 15 nt, Human
cuggcucuuccaggc

SEQ ID NO: 1948071 - RNA, 14 nt, Human
cuggcucuuccagg

SEQ ID NO: 1948072 - RNA, 13 nt, Human
cuggcucuuccag

SEQ ID NO: 1948073 - RNA, 21 nt, Human
cuggcucccucacucucagga

SEQ ID NO: 1948074 - RNA, 18 nt, Human
cuggcucccucacucuca

SEQ ID NO: 1948075 - RNA, 20 nt, Human
cuggcucccucacucucagg

SEQ ID NO: 1948076 - RNA, 17 nt, Human
cugggacuacaggcacc

SEQ ID NO: 1948077 - RNA, 21 nt, Human
cugggacuacaggcacccacc

SEQ ID NO: 1948078 - RNA, 17 nt, Human
cugggacuacaggugug

SEQ ID NO: 1948079 - RNA, 19 nt, Human
cuggcagcucagagagggu

SEQ ID NO: 1948080 - RNA, 17 nt, Human
cuggcagcucagagagg

SEQ ID NO: 1948081 - RNA, 16 nt, Human
cuggcagcucagagag

SEQ ID NO: 1948082 - RNA, 17 nt, Human
cuggcagccgugccuuc

SEQ ID NO: 1948083 - RNA, 18 nt, Human
cuggcagccgugccuuca

SEQ ID NO: 1948084 - RNA, 23 nt, Human
cuggcccuaugcuuccggccucc

SEQ ID NO: 1948085 - RNA, 19 nt, Human
cuggcagcccgcaucagcu

SEQ ID NO: 1948086 - RNA, 15 nt, Human
cuggcccucucugaa

SEQ ID NO: 1948087 - RNA, 16 nt, Human
cuggcccucucugaag

SEQ ID NO: 1948088 - RNA, 22 nt, Human
cuggcucccacaggcccuuccu

SEQ ID NO: 1948089 - RNA, 13 nt, Human
cuggcucccucac

SEQ ID NO: 1948090 - RNA, 14 nt, Human
cuggcucccucacu

SEQ ID NO: 1948091 - RNA, 19 nt, Human
cuggcucccacaggcccuu

SEQ ID NO: 1948092 - RNA, 18 nt, Human
cuggcucccacaggcccu

SEQ ID NO: 1948093 - RNA, 15 nt, Human
cuggaugcagccuca

SEQ ID NO: 1948094 - RNA, 18 nt, Human
cuggaugcagccucacag

SEQ ID NO: 1948095 - RNA, 17 nt, Human
cuggaugcagccucaca

SEQ ID NO: 1948096 - RNA, 16 nt, Human
cuggaugcagccucac

SEQ ID NO: 1948097 - RNA, 19 nt, Human
cuggauccaucaggccacu

SEQ ID NO: 1948098 - RNA, 20 nt, Human
cuggaucuccauucucucag

SEQ ID NO: 1948099 - RNA, 20 nt, Human
cugcuucaaggauccugagc

SEQ ID NO: 1948100 - RNA, 19 nt, Human
cugcuucaaggauccugag

SEQ ID NO: 1948101 - RNA, 16 nt, Human
cugcuucaaggauccu

SEQ ID NO: 1948102 - RNA, 14 nt, Human
cugcuucaaggauc

SEQ ID NO: 1948103 - RNA, 14 nt, Human
cugcuuccagugag

SEQ ID NO: 1948104 - RNA, 23 nt, Human
cugcuucagccucccgaguagcu

SEQ ID NO: 1948105 - RNA, 16 nt, Human
cuggaaaccugucuga

SEQ ID NO: 1948106 - RNA, 21 nt, Human
cuggagaaaauggacguguua

SEQ ID NO: 1948107 - RNA, 22 nt, Human
cuggacuccucuguccaggcac

SEQ ID NO: 1948108 - RNA, 23 nt, Human
cuggacuccucuguccaggcacu

SEQ ID NO: 1948109 - RNA, 23 nt, Human
cuggacucuaaagucuguugauu

SEQ ID NO: 1948110 - RNA, 20 nt, Human
cuggacuccucuguccaggc

SEQ ID NO: 1948111 - RNA, 14 nt, Human
cuggagaacuagag

SEQ ID NO: 1948112 - RNA, 15 nt, Human
cuggagaacuagaga

SEQ ID NO: 1948113 - RNA, 17 nt, Human
cuggauccaucaggcca

SEQ ID NO: 1948114 - RNA, 23 nt, Human
cuggaaauacuagauuugggaga

SEQ ID NO: 1948115 - RNA, 15 nt, Human
cugucguuaaaaaca

SEQ ID NO: 1948116 - RNA, 22 nt, Human
cugucuaaugaaaccugugucu

SEQ ID NO: 1948117 - RNA, 19 nt, Human
cugucauugcuucuucuga

SEQ ID NO: 1948118 - RNA, 14 nt, Human
cugucauuugagca

SEQ ID NO: 1948119 - RNA, 13 nt, Human
cuguccugggagu

SEQ ID NO: 1948120 - RNA, 14 nt, Human
cuguccugggagug

SEQ ID NO: 1948121 - RNA, 20 nt, Human
cuguccugggagugagcugg

SEQ ID NO: 1948122 - RNA, 14 nt, Human
cugucauugcuucu

SEQ ID NO: 1948123 - RNA, 16 nt, Human
cugucauugcuucuuc

SEQ ID NO: 1948124 - RNA, 18 nt, Human
cugucauugcuucuucug

SEQ ID NO: 1948125 - RNA, 20 nt, Human
cugucagggcaguacaaugu

SEQ ID NO: 1948126 - RNA, 18 nt, Human
cuguaggaagguuaaugu

SEQ ID NO: 1948127 - RNA, 12 nt, Human
cugucaggaggc

SEQ ID NO: 1948128 - RNA, 15 nt, Human
cugucaggaggcaga

SEQ ID NO: 1948129 - RNA, 15 nt, Human
cuguagagugggagc

SEQ ID NO: 1948130 - RNA, 16 nt, Human
cuguagauaauuaacc

SEQ ID NO: 1948131 - RNA, 17 nt, Human
cuguagauaauuaacca

SEQ ID NO: 1948132 - RNA, 20 nt, Human
cuguacuugcucuugaugcc

SEQ ID NO: 1948133 - RNA, 19 nt, Human
cuguacuugcucuugaugc

SEQ ID NO: 1948134 - RNA, 16 nt, Human
cuguacuugcucuuga

SEQ ID NO: 1948135 - RNA, 21 nt, Human
cuggucucgaacuccugaccu

SEQ ID NO: 1948136 - RNA, 18 nt, Human
cuggucuuauuuguaaag

SEQ ID NO: 1948137 - RNA, 22 nt, Human
cuggugaccuuccaagagccug

SEQ ID NO: 1948138 - RNA, 23 nt, Human
cuggugaccuuccaagagccuga

SEQ ID NO: 1948139 - RNA, 12 nt, Human
cuguuggccagu

SEQ ID NO: 1948140 - RNA, 14 nt, Human
cuguugcugauuuu

SEQ ID NO: 1948141 - RNA, 15 nt, Human
cuguugcugauuuua

SEQ ID NO: 1948142 - RNA, 16 nt, Human
cuguugcugauuuuau

SEQ ID NO: 1948143 - RNA, 21 nt, Human
cuguugcugauuuuauucuug

SEQ ID NO: 1948144 - RNA, 22 nt, Human
cuguugcugauuuuauucuuga

SEQ ID NO: 1948145 - RNA, 15 nt, Human
cuguuggccagugug

SEQ ID NO: 1948146 - RNA, 14 nt, Human
cuguugucucuucu

SEQ ID NO: 1948147 - RNA, 15 nt, Human
cuguugucucuucuc

SEQ ID NO: 1948148 - RNA, 17 nt, Human
cuguugucucuucuccu

SEQ ID NO: 1948149 - RNA, 18 nt, Human
cuguugucucuucuccuu

SEQ ID NO: 1948150 - RNA, 13 nt, Human
cuuaaauaaugug

SEQ ID NO: 1948151 - RNA, 14 nt, Human
cuuaaauaauguga

SEQ ID NO: 1948152 - RNA, 16 nt, Human
cuuaaauaaugugaaa

SEQ ID NO: 1948153 - RNA, 19 nt, Human
cuuaaauaaugugaaacug

SEQ ID NO: 1948154 - RNA, 13 nt, Human
cuuaaaaaugguu

SEQ ID NO: 1948155 - RNA, 20 nt, Human
cuuaaaaaugguuuaaaugg

SEQ ID NO: 1948156 - RNA, 12 nt, Human
cuuaaaaauggu

SEQ ID NO: 1948157 - RNA, 18 nt, Human
cuuaaaagaggaaaauga

SEQ ID NO: 1948158 - RNA, 23 nt, Human
cuuaaaauaaaacacuguuuccc

SEQ ID NO: 1948159 - RNA, 13 nt, Human
cugugaacugaac

SEQ ID NO: 1948160 - RNA, 15 nt, Human
cugugaacugaacuc

SEQ ID NO: 1948161 - RNA, 16 nt, Human
cugugaacugaacucu

SEQ ID NO: 1948162 - RNA, 17 nt, Human
cugugaauccagugaaa

SEQ ID NO: 1948163 - RNA, 23 nt, Human
cugugagaugcuagaacucccuu

SEQ ID NO: 1948164 - RNA, 17 nt, Human
cugugcucuggacaggc

SEQ ID NO: 1948165 - RNA, 15 nt, Human
cugugcucuggacag

SEQ ID NO: 1948166 - RNA, 18 nt, Human
cuguucagcugguugagg

SEQ ID NO: 1948167 - RNA, 12 nt, Human
cuguucagcugg

SEQ ID NO: 1948168 - RNA, 16 nt, Human
cuguucagcuccagcu

SEQ ID NO: 1948169 - RNA, 18 nt, Human
cuguucagcuccagcuca

SEQ ID NO: 1948170 - RNA, 19 nt, Human
cuguucagcuccagcucac

SEQ ID NO: 1948171 - RNA, 22 nt, Human
cuguucagcuccagcucaccag

SEQ ID NO: 1948172 - RNA, 15 nt, Human
cuguucagcuccagc

SEQ ID NO: 1948173 - RNA, 13 nt, Human
cuguucacucuac

SEQ ID NO: 1948174 - RNA, 19 nt, Human
cuguuaucccugccugguc

SEQ ID NO: 1948175 - RNA, 19 nt, Human
cuguuaucauuuuuuccug

SEQ ID NO: 1948176 - RNA, 20 nt, Human
cuguuaucauuuuuuccugu

SEQ ID NO: 1948177 - RNA, 21 nt, Human
cuguuaucauuuuuuccuguu

SEQ ID NO: 1948178 - RNA, 18 nt, Human
cuguuauagguccuuuag

SEQ ID NO: 1948179 - RNA, 21 nt, Human
cuguuauagguccuuuagaaa

SEQ ID NO: 1948180 - RNA, 17 nt, Human
cuguuacugucuucagu

SEQ ID NO: 1948181 - RNA, 19 nt, Human
cugugucaguuuauguuuu

SEQ ID NO: 1948182 - RNA, 20 nt, Human
cugugucaguuuauguuuug

SEQ ID NO: 1948183 - RNA, 22 nt, Human
cugugucagguggggcagcuug

SEQ ID NO: 1948184 - RNA, 15 nt, Human
cugugucaguuuaug

SEQ ID NO: 1948185 - RNA, 16 nt, Human
cugugucaguuuaugu

SEQ ID NO: 1948186 - RNA, 12 nt, Human
cuguguauauuu

SEQ ID NO: 1948187 - RNA, 15 nt, Human
cuguguauauuugau

SEQ ID NO: 1948188 - RNA, 16 nt, Human
cuguguauauuugauu

SEQ ID NO: 1948189 - RNA, 18 nt, Human
cuguguauauuugauuua

SEQ ID NO: 1948190 - RNA, 20 nt, Human
cuguguauauuugauuuauu

SEQ ID NO: 1948191 - RNA, 22 nt, Human
cuguguauauuugauuuauuaa

SEQ ID NO: 1948192 - RNA, 18 nt, Human
cugugcucuggacaggca

SEQ ID NO: 1948193 - RNA, 19 nt, Human
cugugcucuggacaggcau

SEQ ID NO: 1948194 - RNA, 22 nt, Human
cuuuuauuccugcccugcuguu

SEQ ID NO: 1948195 - RNA, 19 nt, Human
cuuuuaugugaaacauguu

SEQ ID NO: 1948196 - RNA, 18 nt, Human
cuuuuaugugaaacaugu

SEQ ID NO: 1948197 - RNA, 14 nt, Human
gaaaauuuuaaaaa

SEQ ID NO: 1948198 - RNA, 18 nt, Human
gaaaauuuugauguuuua

SEQ ID NO: 1948199 - RNA, 23 nt, Human
gaaacaaacaaaagcugaacaca

SEQ ID NO: 1948200 - RNA, 13 nt, Human
gaaaagagacagg

SEQ ID NO: 1948201 - RNA, 17 nt, Human
gaaaagagacaggcagg

SEQ ID NO: 1948202 - RNA, 19 nt, Human
gaaaacugcaacuuguaaa

SEQ ID NO: 1948203 - RNA, 13 nt, Human
gaaaacucuauuu

SEQ ID NO: 1948204 - RNA, 17 nt, Human
gaaaagcagcucucccc

SEQ ID NO: 1948205 - RNA, 14 nt, Human
gaaaagcagcucuc

SEQ ID NO: 1948206 - RNA, 18 nt, Human
gaaaagagacaggcaggu

SEQ ID NO: 1948207 - RNA, 18 nt, Human
gaaaagcggacaucagcu

SEQ ID NO: 1948208 - RNA, 18 nt, Human
gaaaauuaggauuucaug

SEQ ID NO: 1948209 - RNA, 22 nt, Human
gaaaauuaggauuucaugauuu

SEQ ID NO: 1948210 - RNA, 20 nt, Human
gaaaagcggacaucagcugg

SEQ ID NO: 1948211 - RNA, 14 nt, Human
gaaaauuaacauga

SEQ ID NO: 1948212 - RNA, 14 nt, Human
cuuuugcuuuaauu

SEQ ID NO: 1948213 - RNA, 18 nt, Human
cuuuugcuuuaauuccau

SEQ ID NO: 1948214 - RNA, 22 nt, Human
cuuuugcucgaugcagacaggg

SEQ ID NO: 1948215 - RNA, 18 nt, Human
cuuuugccguuauuaaaa

SEQ ID NO: 1948216 - RNA, 15 nt, Human
cuuuuggucugugug

SEQ ID NO: 1948217 - RNA, 16 nt, Human
cuuuuggucuguguga

SEQ ID NO: 1948218 - RNA, 14 nt, Human
cuuuugucccagaa

SEQ ID NO: 1948219 - RNA, 17 nt, Human
cuuuugucuaugggacu

SEQ ID NO: 1948220 - RNA, 19 nt, Human
cuuuuguagaagucacauu

SEQ ID NO: 1948221 - RNA, 21 nt, Human
cuuuuuuuuuuuuuuugacaa

SEQ ID NO: 1948222 - RNA, 17 nt, Human
gaaaaaaaaaaagaaag

SEQ ID NO: 1948223 - RNA, 18 nt, Human
gaaaaaaaaaaugcugaa

SEQ ID NO: 1948224 - RNA, 19 nt, Human
gaaaaaaaaaaugcugaac

SEQ ID NO: 1948225 - RNA, 20 nt, Human
gaaaaaaaaaaugcugaaca

SEQ ID NO: 1948226 - RNA, 19 nt, Human
gaaaaaaaaaaagaaagaa

SEQ ID NO: 1948227 - RNA, 12 nt, Human
gaaaaaaaaaga

SEQ ID NO: 1948228 - RNA, 13 nt, Human
gaaaaaaaaagaa

SEQ ID NO: 1948229 - RNA, 19 nt, Human
gaaaaaauauuuuccugcc

SEQ ID NO: 1948230 - RNA, 14 nt, Human
gaaaaaauauauau

SEQ ID NO: 1948231 - RNA, 15 nt, Human
gaaaaaaaaagaaaa

SEQ ID NO: 1948232 - RNA, 16 nt, Human
gaaaaaaaaagaaaaa

SEQ ID NO: 1948233 - RNA, 17 nt, Human
gaaaaaaaaagaaaaaa

SEQ ID NO: 1948234 - RNA, 18 nt, Human
gaaaaaaaaagaaaaaag

SEQ ID NO: 1948235 - RNA, 14 nt, Human
cuuuuguguuccaa

SEQ ID NO: 1948236 - RNA, 14 nt, Human
cuuuugugcauuau

SEQ ID NO: 1948237 - RNA, 18 nt, Human
cuuuugugcauuaucuag

SEQ ID NO: 1948238 - RNA, 22 nt, Human
cuuuuuuuugacagcuuccugu

SEQ ID NO: 1948239 - RNA, 23 nt, Human
cuuuuuuuugacagcuuccuguc

SEQ ID NO: 1948240 - RNA, 13 nt, Human
cuuuuuuugaaac

SEQ ID NO: 1948241 - RNA, 18 nt, Human
cuuuuguuacucuuggga

SEQ ID NO: 1948242 - RNA, 20 nt, Human
cuuuuguuacucuugggaca

SEQ ID NO: 1948243 - RNA, 21 nt, Human
gaacaaggcaaggcugucaau

SEQ ID NO: 1948244 - RNA, 22 nt, Human
gaacaagucccuguaauuguug

SEQ ID NO: 1948245 - RNA, 18 nt, Human
gaacaaggcaaggcuguc

SEQ ID NO: 1948246 - RNA, 17 nt, Human
gaacaaggcaaggcugu

SEQ ID NO: 1948247 - RNA, 15 nt, Human
gaacaaggcaaggcu

SEQ ID NO: 1948248 - RNA, 14 nt, Human
gaacaaggcaaggc

SEQ ID NO: 1948249 - RNA, 22 nt, Human
gaaacuguucccaccugcugga

SEQ ID NO: 1948250 - RNA, 21 nt, Human
gaaacuguucccaccugcugg

SEQ ID NO: 1948251 - RNA, 20 nt, Human
gaaacuguucccaccugcug

SEQ ID NO: 1948252 - RNA, 22 nt, Human
gaaacugucuagcacuuccuug

SEQ ID NO: 1948253 - RNA, 11 nt, Human
gaaacuuggau

SEQ ID NO: 1948254 - RNA, 16 nt, Human
gaaagaacuaucuuca

SEQ ID NO: 1948255 - RNA, 16 nt, Human
gaaacuuguucuucca

SEQ ID NO: 1948256 - RNA, 22 nt, Human
gaaacuuguucuuccaaagcag

SEQ ID NO: 1948257 - RNA, 17 nt, Human
gaaagaacuaucuucau

SEQ ID NO: 1948258 - RNA, 20 nt, Human
gaaagaacuaucuucaucug

SEQ ID NO: 1948259 - RNA, 21 nt, Human
gaaagaacuaucuucaucuga

SEQ ID NO: 1948260 - RNA, 15 nt, Human
gaaagaauguaaagc

SEQ ID NO: 1948261 - RNA, 14 nt, Human
gaaagaauguaaag

SEQ ID NO: 1948262 - RNA, 18 nt, Human
gaaagaaguggggacaga

SEQ ID NO: 1948263 - RNA, 18 nt, Human
gaaagacuaucuaaaugu

SEQ ID NO: 1948264 - RNA, 18 nt, Human
gaaaggcuccaggagcag

SEQ ID NO: 1948265 - RNA, 17 nt, Human
gaaaggcuccaggagca

SEQ ID NO: 1948266 - RNA, 19 nt, Human
gaaaggcuccaggagcagc

SEQ ID NO: 1948267 - RNA, 19 nt, Human
gaaaguaaauaaaaggacu

SEQ ID NO: 1948268 - RNA, 13 nt, Human
gaaaguacauuuu

SEQ ID NO: 1948269 - RNA, 20 nt, Human
gaaaguacauuuuuugaaau

SEQ ID NO: 1948270 - RNA, 22 nt, Human
gaaaguacuucuccacccugcu

SEQ ID NO: 1948271 - RNA, 13 nt, Human
gaaauauuuuaau

SEQ ID NO: 1948272 - RNA, 21 nt, Human
gaaaguacuucuccacccugc

SEQ ID NO: 1948273 - RNA, 22 nt, Human
gaaauauuuuaauuuuuaaaug

SEQ ID NO: 1948274 - RNA, 23 nt, Human
gaaauauuuuaauuuuuaaaugc

SEQ ID NO: 1948275 - RNA, 12 nt, Human
gaaaucaaagug

SEQ ID NO: 1948276 - RNA, 14 nt, Human
gaaaucaaagugcu

SEQ ID NO: 1948277 - RNA, 16 nt, Human
gaaaucaaagugcuau

SEQ ID NO: 1948278 - RNA, 18 nt, Human
gaaaugaaagcagggacu

SEQ ID NO: 1948279 - RNA, 14 nt, Human
gaaaugaacacaaa

SEQ ID NO: 1948280 - RNA, 15 nt, Human
gaaaugaacacaaau

SEQ ID NO: 1948281 - RNA, 18 nt, Human
gaaauuuuuauuaaauua

SEQ ID NO: 1948282 - RNA, 17 nt, Human
gaaaugaacacaaauua

SEQ ID NO: 1948283 - RNA, 13 nt, Human
gaaaugaagagcu

SEQ ID NO: 1948284 - RNA, 18 nt, Human
gaaaugaagagcuguuga

SEQ ID NO: 1948285 - RNA, 17 nt, Human
gaaaugaaagcagggac

SEQ ID NO: 1948286 - RNA, 17 nt, Human
gaaaucaccgaaaacgu

SEQ ID NO: 1948287 - RNA, 17 nt, Human
gaaaucaaagugcuauu

SEQ ID NO: 1948288 - RNA, 16 nt, Human
gaaaucaaauguaaag

SEQ ID NO: 1948289 - RNA, 17 nt, Human
gaaaucaaauguaaagu

SEQ ID NO: 1948290 - RNA, 23 nt, Human
gaaaucaauaauuuguggugauu

SEQ ID NO: 1948291 - RNA, 17 nt, Human
gaacaaauuuacagaga

SEQ ID NO: 1948292 - RNA, 18 nt, Human
gaacaaauuuacagagac

SEQ ID NO: 1948293 - RNA, 19 nt, Human
gaaauuuuuauuaaauuau

SEQ ID NO: 1948294 - RNA, 12 nt, Human
gaaauuuuucau

SEQ ID NO: 1948295 - RNA, 23 nt, Human
gaacaaauuuacagagacagaaa

SEQ ID NO: 1948296 - RNA, 19 nt, Human
gaaauuuuucauauuuuaa

SEQ ID NO: 1948297 - RNA, 13 nt, Human
gaaauuuuucaua

SEQ ID NO: 1948298 - RNA, 15 nt, Human
gaaauuuuucauauu

SEQ ID NO: 1948299 - RNA, 16 nt, Human
gaaauuuuucauauuu

SEQ ID NO: 1948300 - RNA, 17 nt, Human
gaaauuuuucauauuuu

SEQ ID NO: 1948301 - RNA, 15 nt, Human
gaacaacauauacaa

SEQ ID NO: 1948302 - RNA, 18 nt, Human
cuucccacaaagaauaua

SEQ ID NO: 1948303 - RNA, 15 nt, Human
cuuccauuucugccu

SEQ ID NO: 1948304 - RNA, 16 nt, Human
cuuccauuucugccuu

SEQ ID NO: 1948305 - RNA, 20 nt, Human
cuuccauuucugccuuuugu

SEQ ID NO: 1948306 - RNA, 20 nt, Human
cuucccaaaugugugcccag

SEQ ID NO: 1948307 - RNA, 23 nt, Human
cuucccaaaugugugcccagcuu

SEQ ID NO: 1948308 - RNA, 17 nt, Human
cuucccaacuugccuuu

SEQ ID NO: 1948309 - RNA, 20 nt, Human
cuuacauuagcaguuugcuu

SEQ ID NO: 1948310 - RNA, 21 nt, Human
cuuccaucugauuccagcaca

SEQ ID NO: 1948311 - RNA, 14 nt, Human
cuuacaggugauua

SEQ ID NO: 1948312 - RNA, 15 nt, Human
cuuaaauauagcagu

SEQ ID NO: 1948313 - RNA, 17 nt, Human
cuuacauaaacaucagg

SEQ ID NO: 1948314 - RNA, 19 nt, Human
cuuacauaaacaucagguu

SEQ ID NO: 1948315 - RNA, 18 nt, Human
cuuccucccucccucuuu

SEQ ID NO: 1948316 - RNA, 14 nt, Human
cuuccucccucccu

SEQ ID NO: 1948317 - RNA, 13 nt, Human
cuuccucccuccc

SEQ ID NO: 1948318 - RNA, 12 nt, Human
cuuccucccucc

SEQ ID NO: 1948319 - RNA, 16 nt, Human
cuuccucuccacugcc

SEQ ID NO: 1948320 - RNA, 17 nt, Human
cuuccucuccacugccu

SEQ ID NO: 1948321 - RNA, 19 nt, Human
cuuccucuccacugccuuc

SEQ ID NO: 1948322 - RNA, 21 nt, Human
cuuccucuccacugccuucga

SEQ ID NO: 1948323 - RNA, 11 nt, Human
cuuccucugcu

SEQ ID NO: 1948324 - RNA, 12 nt, Human
cuuccucugcug

SEQ ID NO: 1948325 - RNA, 13 nt, Human
cuuccucugcuga

SEQ ID NO: 1948326 - RNA, 14 nt, Human
cuuccucugcuaaa

SEQ ID NO: 1948327 - RNA, 16 nt, Human
cuuccucugcuaaauu

SEQ ID NO: 1948328 - RNA, 12 nt, Human
cuuccucugcuc

SEQ ID NO: 1948329 - RNA, 13 nt, Human
cuuccucugcucc

SEQ ID NO: 1948330 - RNA, 14 nt, Human
cuuccucugcuccc

SEQ ID NO: 1948331 - RNA, 15 nt, Human
cuuccucugcucccc

SEQ ID NO: 1948332 - RNA, 14 nt, Human
cuuccucuugaccc

SEQ ID NO: 1948333 - RNA, 15 nt, Human
cuuccucuugacccu

SEQ ID NO: 1948334 - RNA, 18 nt, Human
cuuccucuugacccugca

SEQ ID NO: 1948335 - RNA, 19 nt, Human
cuuccucuugacccugcac

SEQ ID NO: 1948336 - RNA, 20 nt, Human
cuuccucuugacccugcacc

SEQ ID NO: 1948337 - RNA, 21 nt, Human
cuuccucuugacccugcaccc

SEQ ID NO: 1948338 - RNA, 22 nt, Human
cuuccucuugacccugcacccu

SEQ ID NO: 1948339 - RNA, 17 nt, Human
cuucuaccucuuggcug

SEQ ID NO: 1948340 - RNA, 16 nt, Human
cuucuauagcaucacu

SEQ ID NO: 1948341 - RNA, 18 nt, Human
cuucuauagcaucacuua

SEQ ID NO: 1948342 - RNA, 17 nt, Human
cuucuaugaaagacuca

SEQ ID NO: 1948343 - RNA, 16 nt, Human
cuucuauuuauuuauu

SEQ ID NO: 1948344 - RNA, 22 nt, Human
cuucuauuuauuuauuuauuca

SEQ ID NO: 1948345 - RNA, 12 nt, Human
cuucucugccca

SEQ ID NO: 1948346 - RNA, 22 nt, Human
cuucugaacuuggcgcugcccc

SEQ ID NO: 1948347 - RNA, 15 nt, Human
cuucugacccaugcu

SEQ ID NO: 1948348 - RNA, 19 nt, Human
cuucugaacuuggcgcugc

SEQ ID NO: 1948349 - RNA, 19 nt, Human
cuucucugcccagcuuuuc

SEQ ID NO: 1948350 - RNA, 22 nt, Human
cuucuugaauggcaauguuuug

SEQ ID NO: 1948351 - RNA, 13 nt, Human
cuucuucugucca

SEQ ID NO: 1948352 - RNA, 19 nt, Human
cuucuucuguccaagcaga

SEQ ID NO: 1948353 - RNA, 21 nt, Human
cuucuucuguccaagcagauu

SEQ ID NO: 1948354 - RNA, 13 nt, Human
cuucuugaaaucc

SEQ ID NO: 1948355 - RNA, 16 nt, Human
cuucuuauacauuuga

SEQ ID NO: 1948356 - RNA, 13 nt, Human
cuucuuauacauu

SEQ ID NO: 1948357 - RNA, 17 nt, Human
cuucugacccaugcugc

SEQ ID NO: 1948358 - RNA, 16 nt, Human
cuucugacccaugcug

SEQ ID NO: 1948359 - RNA, 18 nt, Human
cuucugacccaugcugcc

SEQ ID NO: 1948360 - RNA, 23 nt, Human
cuucugaacuuggcgcugccccu

SEQ ID NO: 1948361 - RNA, 18 nt, Human
cuuucaauaggaaaaacu

SEQ ID NO: 1948362 - RNA, 17 nt, Human
cuuucaauaggaaaaac

SEQ ID NO: 1948363 - RNA, 21 nt, Human
cuuuaaugauaugcuuguaac

SEQ ID NO: 1948364 - RNA, 22 nt, Human
cuuuaaugauaugcuuguaacu

SEQ ID NO: 1948365 - RNA, 16 nt, Human
cuuuaaugauaugcuu

SEQ ID NO: 1948366 - RNA, 22 nt, Human
cuugucuuuggacccugaggcc

SEQ ID NO: 1948367 - RNA, 21 nt, Human
cuugucuuuggacccugaggc

SEQ ID NO: 1948368 - RNA, 18 nt, Human
cuuuaacuuaguuuugca

SEQ ID NO: 1948369 - RNA, 15 nt, Human
cuuuaagaacuaaaa

SEQ ID NO: 1948370 - RNA, 15 nt, Human
cuugugaaaauaauu

SEQ ID NO: 1948371 - RNA, 16 nt, Human
cuugugaaaauaauug

SEQ ID NO: 1948372 - RNA, 19 nt, Human
cuugucuuccuauuucaga

SEQ ID NO: 1948373 - RNA, 21 nt, Human
cuugucuuccuauuucagaag

SEQ ID NO: 1948374 - RNA, 15 nt, Human
cuuucaauaggaaaa

SEQ ID NO: 1948375 - RNA, 14 nt, Human
cuuucaauaggaaa

SEQ ID NO: 1948376 - RNA, 18 nt, Human
cuugugaaaauaauugac

SEQ ID NO: 1948377 - RNA, 22 nt, Human
cuuuaaugucacaggcaggucc

SEQ ID NO: 1948378 - RNA, 17 nt, Human
cuuuaaugucacaggca

SEQ ID NO: 1948379 - RNA, 18 nt, Human
cuuuaaugucacaggcag

SEQ ID NO: 1948380 - RNA, 19 nt, Human
cuuuaaugucacaggcagg

SEQ ID NO: 1948381 - RNA, 20 nt, Human
cuuuaaugucacaggcaggu

SEQ ID NO: 1948382 - RNA, 15 nt, Human
cuugguccugcugca

SEQ ID NO: 1948383 - RNA, 20 nt, Human
cuugguccugcugcaguugc

SEQ ID NO: 1948384 - RNA, 18 nt, Human
cuugguccugcugcaguu

SEQ ID NO: 1948385 - RNA, 17 nt, Human
cuugguccugcugcagu

SEQ ID NO: 1948386 - RNA, 16 nt, Human
cuugguccugcugcag

SEQ ID NO: 1948387 - RNA, 17 nt, Human
cuugguuccagccugcc

SEQ ID NO: 1948388 - RNA, 19 nt, Human
cuugguuccagccugccac

SEQ ID NO: 1948389 - RNA, 16 nt, Human
cuugguucccauuugc

SEQ ID NO: 1948390 - RNA, 20 nt, Human
cuugguuccagccugccacu

SEQ ID NO: 1948391 - RNA, 20 nt, Human
cuugguucccauuugcuccu

SEQ ID NO: 1948392 - RNA, 23 nt, Human
cuuggucucagugucaaugcagc

SEQ ID NO: 1948393 - RNA, 22 nt, Human
cuugguccugcugcaguugcca

SEQ ID NO: 1948394 - RNA, 13 nt, Human
cuugguuccuggg

SEQ ID NO: 1948395 - RNA, 19 nt, Human
cuugguuccuggggcaucc

SEQ ID NO: 1948396 - RNA, 15 nt, Human
cuugguuccuggggc

SEQ ID NO: 1948397 - RNA, 16 nt, Human
cuugguuccuggggca

SEQ ID NO: 1948398 - RNA, 17 nt, Human
cuugguuccuggggcau

SEQ ID NO: 1948399 - RNA, 18 nt, Human
cuugguuccuggggcauc

SEQ ID NO: 1948400 - RNA, 20 nt, Human
cuugucuuuggacccugagg

SEQ ID NO: 1948401 - RNA, 17 nt, Human
cuugucuuccuauuuca

SEQ ID NO: 1948402 - RNA, 21 nt, Human
cuugucuguagcgucuguaua

SEQ ID NO: 1948403 - RNA, 13 nt, Human
cuugucuguagau

SEQ ID NO: 1948404 - RNA, 15 nt, Human
cuugauguguuaucu

SEQ ID NO: 1948405 - RNA, 15 nt, Human
cuugauggauuuuca

SEQ ID NO: 1948406 - RNA, 21 nt, Human
cuugccgcgucgcccucccag

SEQ ID NO: 1948407 - RNA, 18 nt, Human
cuugccgcgucgcccucc

SEQ ID NO: 1948408 - RNA, 18 nt, Human
cuugccgucuaccugagg

SEQ ID NO: 1948409 - RNA, 23 nt, Human
cuugccgcgucgcccucccaggc

SEQ ID NO: 1948410 - RNA, 19 nt, Human
cuugccgucuaccugaggg

SEQ ID NO: 1948411 - RNA, 12 nt, Human
cuugauuggaag

SEQ ID NO: 1948412 - RNA, 13 nt, Human
cuugauuggaagg

SEQ ID NO: 1948413 - RNA, 17 nt, Human
cuugauucccuuguuau

SEQ ID NO: 1948414 - RNA, 22 nt, Human
cuugauucguagauuuaauaac

SEQ ID NO: 1948415 - RNA, 19 nt, Human
cuugauucauaaugacuua

SEQ ID NO: 1948416 - RNA, 15 nt, Human
cuuggauuguccccg

SEQ ID NO: 1948417 - RNA, 20 nt, Human
cuugccucagcuuccccagu

SEQ ID NO: 1948418 - RNA, 20 nt, Human
cuuggauuguccccgacccu

SEQ ID NO: 1948419 - RNA, 18 nt, Human
cuuggauuguccccgacc

SEQ ID NO: 1948420 - RNA, 22 nt, Human
cuuggauuguccccgacccuug

SEQ ID NO: 1948421 - RNA, 22 nt, Human
cuuggcgcugccccuggcagcc

SEQ ID NO: 1948422 - RNA, 21 nt, Human
cuuggcgcugccccuggcagc

SEQ ID NO: 1948423 - RNA, 23 nt, Human
cuuggcgcugccccuggcagccc

SEQ ID NO: 1948424 - RNA, 15 nt, Human
cuuggcccuuuccuu

SEQ ID NO: 1948425 - RNA, 20 nt, Human
cuuggcccuuuccuuccaga

SEQ ID NO: 1948426 - RNA, 13 nt, Human
cuuggcccuggca

SEQ ID NO: 1948427 - RNA, 16 nt, Human
cuuggcccuggcagcc

SEQ ID NO: 1948428 - RNA, 14 nt, Human
cuuggcccuuuccu

SEQ ID NO: 1948429 - RNA, 15 nt, Human
cuuggcccagggggc

SEQ ID NO: 1948430 - RNA, 18 nt, Human
cuuggcccagggggcuuc

SEQ ID NO: 1948431 - RNA, 21 nt, Human
cuuggcccagggggcuuccug

SEQ ID NO: 1948432 - RNA, 22 nt, Human
cuuggcccagggggcuuccuga

SEQ ID NO: 1948433 - RNA, 23 nt, Human
cuuggcccagggggcuuccugag

SEQ ID NO: 1948434 - RNA, 20 nt, Human
gcaaccuucgccaccugggu

SEQ ID NO: 1948435 - RNA, 20 nt, Human
gcaaccuccgccucuugggu

SEQ ID NO: 1948436 - RNA, 15 nt, Human
gcaaccaaacuccca

SEQ ID NO: 1948437 - RNA, 14 nt, Human
gcaaccauuugaaa

SEQ ID NO: 1948438 - RNA, 18 nt, Human
gcaaccauauagaaagcu

SEQ ID NO: 1948439 - RNA, 14 nt, Human
gcaacccccagccu

SEQ ID NO: 1948440 - RNA, 15 nt, Human
gcaacccccagccug

SEQ ID NO: 1948441 - RNA, 16 nt, Human
gcaacccccagccugc

SEQ ID NO: 1948442 - RNA, 19 nt, Human
gcaaccuccgccucuuggg

SEQ ID NO: 1948443 - RNA, 18 nt, Human
gcaaccaccaccaaccac

SEQ ID NO: 1948444 - RNA, 16 nt, Human
gcaaccaccaccaacc

SEQ ID NO: 1948445 - RNA, 13 nt, Human
gcaaccaccacca

SEQ ID NO: 1948446 - RNA, 15 nt, Human
gcaaccaaaaagaaa

SEQ ID NO: 1948447 - RNA, 16 nt, Human
gcaacaggcugggcuu

SEQ ID NO: 1948448 - RNA, 19 nt, Human
gcaacaggcugggcuucag

SEQ ID NO: 1948449 - RNA, 23 nt, Human
gcaaaagugcugcagggcuuuaa

SEQ ID NO: 1948450 - RNA, 15 nt, Human
gcaaaaucaagagau

SEQ ID NO: 1948451 - RNA, 18 nt, Human
gcaaaauacaugaugauu

SEQ ID NO: 1948452 - RNA, 21 nt, Human
gcaaaauacaugaugauuuca

SEQ ID NO: 1948453 - RNA, 14 nt, Human
gcaacaggcugggc

SEQ ID NO: 1948454 - RNA, 15 nt, Human
gcaacaggcugggcu

SEQ ID NO: 1948455 - RNA, 13 nt, Human
gcaacaggcuggg

SEQ ID NO: 1948456 - RNA, 13 nt, Human
gcaaaauuccuga

SEQ ID NO: 1948457 - RNA, 16 nt, Human
gcaagugagagcuggg

SEQ ID NO: 1948458 - RNA, 15 nt, Human
gcaagugagagcugg

SEQ ID NO: 1948459 - RNA, 12 nt, Human
gauucuucugcu

SEQ ID NO: 1948460 - RNA, 13 nt, Human
gauucuucugcuu

SEQ ID NO: 1948461 - RNA, 15 nt, Human
gauucuucugcuuca

SEQ ID NO: 1948462 - RNA, 19 nt, Human
gauuuaacagaaauguaca

SEQ ID NO: 1948463 - RNA, 17 nt, Human
gauuuaacagaaaugua

SEQ ID NO: 1948464 - RNA, 18 nt, Human
gauuuaacagaaauguac

SEQ ID NO: 1948465 - RNA, 16 nt, Human
gauuuaacagaaaugu

SEQ ID NO: 1948466 - RNA, 20 nt, Human
gauucuucugcuucagccuc

SEQ ID NO: 1948467 - RNA, 21 nt, Human
gauuuuuuuuuccuucagugc

SEQ ID NO: 1948468 - RNA, 19 nt, Human
gauuucacaaauauuaaaa

SEQ ID NO: 1948469 - RNA, 13 nt, Human
gauuucacaaaua

SEQ ID NO: 1948470 - RNA, 14 nt, Human
gauuucacaaauau

SEQ ID NO: 1948471 - RNA, 15 nt, Human
gauuucacaaauauu

SEQ ID NO: 1948472 - RNA, 14 nt, Human
gcaaaaaggcagga

SEQ ID NO: 1948473 - RNA, 22 nt, Human
gcaaaaaaucuuaauacuguua

SEQ ID NO: 1948474 - RNA, 12 nt, Human
gcaaaaaaucuu

SEQ ID NO: 1948475 - RNA, 22 nt, Human
gcaaaagaugcuucucacugcc

SEQ ID NO: 1948476 - RNA, 17 nt, Human
gcaaaagaugcuucuca

SEQ ID NO: 1948477 - RNA, 15 nt, Human
gcaaaaacauguaug

SEQ ID NO: 1948478 - RNA, 22 nt, Human
gcaaaaacauguaugugcauuu

SEQ ID NO: 1948479 - RNA, 18 nt, Human
gauuuuuuuuuccuucag

SEQ ID NO: 1948480 - RNA, 17 nt, Human
gauuuuuuuuuccuuca

SEQ ID NO: 1948481 - RNA, 12 nt, Human
gauuucacucuc

SEQ ID NO: 1948482 - RNA, 16 nt, Human
gauuuuuuuuuccuuc

SEQ ID NO: 1948483 - RNA, 11 nt, Human
gauuucacucu

SEQ ID NO: 1948484 - RNA, 18 nt, Human
gauuuauuucaucauauu

SEQ ID NO: 1948485 - RNA, 22 nt, Human
gauuuauuucaucauauuauac

SEQ ID NO: 1948486 - RNA, 16 nt, Human
gauuuaauuugaaaua

SEQ ID NO: 1948487 - RNA, 20 nt, Human
gauuuauuaacuuaauaauc

SEQ ID NO: 1948488 - RNA, 20 nt, Human
gauggaauuuuuuuguacga

SEQ ID NO: 1948489 - RNA, 13 nt, Human
gauggaauuuuuu

SEQ ID NO: 1948490 - RNA, 13 nt, Human
gauggaaugaugg

SEQ ID NO: 1948491 - RNA, 16 nt, Human
gauacaguuacucaga

SEQ ID NO: 1948492 - RNA, 19 nt, Human
gauacaguuacucagaauu

SEQ ID NO: 1948493 - RNA, 23 nt, Human
gauacaguuacucagaauucucu

SEQ ID NO: 1948494 - RNA, 17 nt, Human
gauacugccucccccag

SEQ ID NO: 1948495 - RNA, 12 nt, Human
gauacugaaaua

SEQ ID NO: 1948496 - RNA, 13 nt, Human
gauacugccuccc

SEQ ID NO: 1948497 - RNA, 17 nt, Human
gauacuguaucaugaca

SEQ ID NO: 1948498 - RNA, 21 nt, Human
gauacuguaucaugacaaaga

SEQ ID NO: 1948499 - RNA, 22 nt, Human
gaucaaaccccgaccaccugcc

SEQ ID NO: 1948500 - RNA, 23 nt, Human
gaucaaaagguuaauaaaguaau

SEQ ID NO: 1948501 - RNA, 14 nt, Human
gaucaaaaaggcuu

SEQ ID NO: 1948502 - RNA, 20 nt, Human
gaucaaaaaggcuuauaaaa

SEQ ID NO: 1948503 - RNA, 23 nt, Human
gaucaaaaaggcuuauaaaacag

SEQ ID NO: 1948504 - RNA, 20 nt, Human
gaucaaaagguuaauaaagu

SEQ ID NO: 1948505 - RNA, 17 nt, Human
gauauuuuuuucuuuuc

SEQ ID NO: 1948506 - RNA, 15 nt, Human
gauauuuugcuuugu

SEQ ID NO: 1948507 - RNA, 21 nt, Human
gauauuuucaacgcagcccug

SEQ ID NO: 1948508 - RNA, 22 nt, Human
gauauuuucaacgcagcccugc

SEQ ID NO: 1948509 - RNA, 23 nt, Human
gauauuuucaacgcagcccugcu

SEQ ID NO: 1948510 - RNA, 20 nt, Human
gauauuuguauuuauucuuu

SEQ ID NO: 1948511 - RNA, 20 nt, Human
gauauuuuauuuugaaaugg

SEQ ID NO: 1948512 - RNA, 19 nt, Human
gauauuuucaacgcagccc

SEQ ID NO: 1948513 - RNA, 11 nt, Human
gauauuucaga

SEQ ID NO: 1948514 - RNA, 16 nt, Human
gauauuucagaaauac

SEQ ID NO: 1948515 - RNA, 17 nt, Human
gauauuucagaaauaca

SEQ ID NO: 1948516 - RNA, 18 nt, Human
gauacuuugauauuuuca

SEQ ID NO: 1948517 - RNA, 22 nt, Human
gauacuuggucacagccaggcg

SEQ ID NO: 1948518 - RNA, 16 nt, Human
gauacuuuguauuguc

SEQ ID NO: 1948519 - RNA, 19 nt, Human
gauacuuuguauuguccua

SEQ ID NO: 1948520 - RNA, 23 nt, Human
gauacuuuguauuguccuauuag

SEQ ID NO: 1948521 - RNA, 22 nt, Human
gauccacccaccucagccuccc

SEQ ID NO: 1948522 - RNA, 20 nt, Human
gauccacccaccucagccuc

SEQ ID NO: 1948523 - RNA, 21 nt, Human
gauccacccaccucagccucc

SEQ ID NO: 1948524 - RNA, 21 nt, Human
gauccaagcuggucccacuca

SEQ ID NO: 1948525 - RNA, 18 nt, Human
gauccacccaccucagcc

SEQ ID NO: 1948526 - RNA, 19 nt, Human
gauccacccaccucagccu

SEQ ID NO: 1948527 - RNA, 12 nt, Human
gauccaagcugg

SEQ ID NO: 1948528 - RNA, 16 nt, Human
gauccaagcugguccc

SEQ ID NO: 1948529 - RNA, 17 nt, Human
gauccaagcugguccca

SEQ ID NO: 1948530 - RNA, 19 nt, Human
gauccaagcuggucccacu

SEQ ID NO: 1948531 - RNA, 14 nt, Human
gaugauccuaggca

SEQ ID NO: 1948532 - RNA, 13 nt, Human
gaugauccuaggc

SEQ ID NO: 1948533 - RNA, 22 nt, Human
gaugauuggaggggggaggugg

SEQ ID NO: 1948534 - RNA, 19 nt, Human
gaugauugaagaaacagcu

SEQ ID NO: 1948535 - RNA, 12 nt, Human
gaugauuucaga

SEQ ID NO: 1948536 - RNA, 20 nt, Human
gaugcuucuucagagacucc

SEQ ID NO: 1948537 - RNA, 17 nt, Human
gaugcuucuucagagac

SEQ ID NO: 1948538 - RNA, 21 nt, Human
gaugcuucuucagagacuccu

SEQ ID NO: 1948539 - RNA, 17 nt, Human
gaucugcugcagagcag

SEQ ID NO: 1948540 - RNA, 18 nt, Human
gaucugcugcagagcagu

SEQ ID NO: 1948541 - RNA, 16 nt, Human
gaucugcugcagagca

SEQ ID NO: 1948542 - RNA, 23 nt, Human
gauccagcccugaguuccuagcc

SEQ ID NO: 1948543 - RNA, 15 nt, Human
gaucccaguagaaaa

SEQ ID NO: 1948544 - RNA, 15 nt, Human
gaucucuaacuucac

SEQ ID NO: 1948545 - RNA, 12 nt, Human
gaucucugcagg

SEQ ID NO: 1948546 - RNA, 18 nt, Human
gaucucuugagccuggga

SEQ ID NO: 1948547 - RNA, 23 nt, Human
gaucucugcaggaaauggcugug

SEQ ID NO: 1948548 - RNA, 17 nt, Human
gaucugaugcaagcaag

SEQ ID NO: 1948549 - RNA, 19 nt, Human
gaucucuugagccugggag

SEQ ID NO: 1948550 - RNA, 18 nt, Human
gcaagugagagcugggug

SEQ ID NO: 1948551 - RNA, 19 nt, Human
gcaagugagagcugggugu

SEQ ID NO: 1948552 - RNA, 20 nt, Human
gcacucagaagacacugaug

SEQ ID NO: 1948553 - RNA, 15 nt, Human
gcacuccagccuggg

SEQ ID NO: 1948554 - RNA, 14 nt, Human
gcacuccagccugg

SEQ ID NO: 1948555 - RNA, 14 nt, Human
gcacuccccugcug

SEQ ID NO: 1948556 - RNA, 13 nt, Human
gcacuccccugcu

SEQ ID NO: 1948557 - RNA, 19 nt, Human
gcacuuuguucuggcucuu

SEQ ID NO: 1948558 - RNA, 18 nt, Human
gcacuuuguucuggcucu

SEQ ID NO: 1948559 - RNA, 15 nt, Human
gcacuccccugcugg

SEQ ID NO: 1948560 - RNA, 12 nt, Human
gcacuccccugc

SEQ ID NO: 1948561 - RNA, 22 nt, Human
gcacuuuguucuggcucuucca

SEQ ID NO: 1948562 - RNA, 23 nt, Human
gcacuuuucuaaacuaggcuccu

SEQ ID NO: 1948563 - RNA, 16 nt, Human
gcacuuuuuaaaaaac

SEQ ID NO: 1948564 - RNA, 22 nt, Human
gcacuuuuucuuaaucauuuuu

SEQ ID NO: 1948565 - RNA, 20 nt, Human
gcagaaagcaaaauuauguu

SEQ ID NO: 1948566 - RNA, 12 nt, Human
gcagaacaguga

SEQ ID NO: 1948567 - RNA, 13 nt, Human
gcagaacagugau

SEQ ID NO: 1948568 - RNA, 14 nt, Human
gcagagggcacaga

SEQ ID NO: 1948569 - RNA, 17 nt, Human
gcagcauaaagaauuug

SEQ ID NO: 1948570 - RNA, 23 nt, Human
gcagcauauucaggaagcucagg

SEQ ID NO: 1948571 - RNA, 19 nt, Human
gcagcauauucaggaagcu

SEQ ID NO: 1948572 - RNA, 18 nt, Human
gcagcauauucaggaagc

SEQ ID NO: 1948573 - RNA, 17 nt, Human
gcagcauauucaggaag

SEQ ID NO: 1948574 - RNA, 20 nt, Human
gcagaggaaagcaaaggaga

SEQ ID NO: 1948575 - RNA, 18 nt, Human
gcagaggaaagcaaagga

SEQ ID NO: 1948576 - RNA, 14 nt, Human
gcagaggaaagcaa

SEQ ID NO: 1948577 - RNA, 13 nt, Human
gcagaggaaagca

SEQ ID NO: 1948578 - RNA, 19 nt, Human
gcagaggagaacuugcugc

SEQ ID NO: 1948579 - RNA, 21 nt, Human
gcagaggagaacuugcugccu

SEQ ID NO: 1948580 - RNA, 22 nt, Human
gcagaggagaacuugcugccuc

SEQ ID NO: 1948581 - RNA, 21 nt, Human
gcagaggaaagcaaaggagau

SEQ ID NO: 1948582 - RNA, 17 nt, Human
gcagagcugcgggcugg

SEQ ID NO: 1948583 - RNA, 19 nt, Human
gcagagcugcgggcugggu

SEQ ID NO: 1948584 - RNA, 19 nt, Human
gcagaacugcagucacugc

SEQ ID NO: 1948585 - RNA, 18 nt, Human
gcagaacagugauuacca

SEQ ID NO: 1948586 - RNA, 22 nt, Human
gcagaacagugauuaccaggga

SEQ ID NO: 1948587 - RNA, 20 nt, Human
gcagcuccuuccuagccuug

SEQ ID NO: 1948588 - RNA, 12 nt, Human
gcagcucccuca

SEQ ID NO: 1948589 - RNA, 18 nt, Human
gcagcccaccccucaaca

SEQ ID NO: 1948590 - RNA, 15 nt, Human
gcagccacauuccug

SEQ ID NO: 1948591 - RNA, 21 nt, Human
gcagccagccaaacacacaga

SEQ ID NO: 1948592 - RNA, 20 nt, Human
gcagccaggccacuggcccc

SEQ ID NO: 1948593 - RNA, 18 nt, Human
gcauacguacacauuuua

SEQ ID NO: 1948594 - RNA, 13 nt, Human
gcaguuguuaagu

SEQ ID NO: 1948595 - RNA, 23 nt, Human
gcaguugcugguaaaaugaagaa

SEQ ID NO: 1948596 - RNA, 15 nt, Human
gcauacguacacauu

SEQ ID NO: 1948597 - RNA, 16 nt, Human
gcauacguacacauuu

SEQ ID NO: 1948598 - RNA, 17 nt, Human
gcauacguacacauuuu

SEQ ID NO: 1948599 - RNA, 16 nt, Human
gcaguugcccagccuc

SEQ ID NO: 1948600 - RNA, 23 nt, Human
gcaguugcccagccucuuucccu

SEQ ID NO: 1948601 - RNA, 18 nt, Human
gcaguugcugguaaaaug

SEQ ID NO: 1948602 - RNA, 19 nt, Human
gcaguugcugguaaaauga

SEQ ID NO: 1948603 - RNA, 17 nt, Human
gcagugauauucuuugu

SEQ ID NO: 1948604 - RNA, 18 nt, Human
gcagugauauucuuuguu

SEQ ID NO: 1948605 - RNA, 14 nt, Human
gcagugagagcaga

SEQ ID NO: 1948606 - RNA, 17 nt, Human
gcagucuuaugcuucca

SEQ ID NO: 1948607 - RNA, 18 nt, Human
gcagucuuaugcuuccag

SEQ ID NO: 1948608 - RNA, 19 nt, Human
gcagucuuaugcuuccaga

SEQ ID NO: 1948609 - RNA, 21 nt, Human
gcagucuuaugcuuccagaaa

SEQ ID NO: 1948610 - RNA, 22 nt, Human
gcagucuuaugcuuccagaaac

SEQ ID NO: 1948611 - RNA, 12 nt, Human
gcagucugccug

SEQ ID NO: 1948612 - RNA, 14 nt, Human
gcagucugccugga

SEQ ID NO: 1948613 - RNA, 12 nt, Human
gcagcugaaauu

SEQ ID NO: 1948614 - RNA, 18 nt, Human
gcagcugaaauugaaaag

SEQ ID NO: 1948615 - RNA, 12 nt, Human
gcagcucucccc

SEQ ID NO: 1948616 - RNA, 12 nt, Human
gcagcucuuccu

SEQ ID NO: 1948617 - RNA, 13 nt, Human
gcagcucuuccug

SEQ ID NO: 1948618 - RNA, 14 nt, Human
gcagcucuuccugg

SEQ ID NO: 1948619 - RNA, 23 nt, Human
gcagcucuuccuggacaggccag

SEQ ID NO: 1948620 - RNA, 17 nt, Human
gcauccaguaucuugaa

SEQ ID NO: 1948621 - RNA, 14 nt, Human
gcauccaguaucuu

SEQ ID NO: 1948622 - RNA, 18 nt, Human
gcauccaguaucuugaag

SEQ ID NO: 1948623 - RNA, 11 nt, Human
gcauccauggg

SEQ ID NO: 1948624 - RNA, 12 nt, Human
gcauccaugggg

SEQ ID NO: 1948625 - RNA, 21 nt, Human
gcauccauggggucucucaca

SEQ ID NO: 1948626 - RNA, 22 nt, Human
gcauccauggggucucucacag

SEQ ID NO: 1948627 - RNA, 23 nt, Human
gcauccauggggucucucacaga

SEQ ID NO: 1948628 - RNA, 16 nt, Human
gcauccgaccagguug

SEQ ID NO: 1948629 - RNA, 14 nt, Human
gcauccgaccaggu

SEQ ID NO: 1948630 - RNA, 15 nt, Human
gcauugugggaaggg

SEQ ID NO: 1948631 - RNA, 13 nt, Human
gcauugugggaag

SEQ ID NO: 1948632 - RNA, 21 nt, Human
gcaugugaugagaggaaauca

SEQ ID NO: 1948633 - RNA, 18 nt, Human
gcaugugaugagaggaaa

SEQ ID NO: 1948634 - RNA, 19 nt, Human
gcaugugaugagaggaaau

SEQ ID NO: 1948635 - RNA, 22 nt, Human
gcauguaaaagccuaggucuau

SEQ ID NO: 1948636 - RNA, 18 nt, Human
gcauugugggaaggggag

SEQ ID NO: 1948637 - RNA, 16 nt, Human
gcauugugggaagggg

SEQ ID NO: 1948638 - RNA, 16 nt, Human
gcauuuaaaagauaca

SEQ ID NO: 1948639 - RNA, 17 nt, Human
gcauuuaaaagauacag

SEQ ID NO: 1948640 - RNA, 18 nt, Human
gcauuuaaaagauacagu

SEQ ID NO: 1948641 - RNA, 22 nt, Human
gcauuuaaaagauacaguuacu

SEQ ID NO: 1948642 - RNA, 15 nt, Human
gcauuuacuuugugu

SEQ ID NO: 1948643 - RNA, 20 nt, Human
gcauggugguugggacccag

SEQ ID NO: 1948644 - RNA, 22 nt, Human
gcauggugguugggacccagug

SEQ ID NO: 1948645 - RNA, 13 nt, Human
gcauggugguugg

SEQ ID NO: 1948646 - RNA, 22 nt, Human
gcaugguccauucucaagggac

SEQ ID NO: 1948647 - RNA, 15 nt, Human
gcaugguccauucuc

SEQ ID NO: 1948648 - RNA, 21 nt, Human
gcauggcugccaaugggagcu

SEQ ID NO: 1948649 - RNA, 14 nt, Human
gcauccuggcaccc

SEQ ID NO: 1948650 - RNA, 13 nt, Human
gcauccuggcacc

SEQ ID NO: 1948651 - RNA, 17 nt, Human
gcauccuccgccucccg

SEQ ID NO: 1948652 - RNA, 20 nt, Human
gcaucuagcaugucgucaaa

SEQ ID NO: 1948653 - RNA, 21 nt, Human
gacacagcucuucuccaggcu

SEQ ID NO: 1948654 - RNA, 14 nt, Human
gacaaauaguaggc

SEQ ID NO: 1948655 - RNA, 15 nt, Human
gacaaauaguaggca

SEQ ID NO: 1948656 - RNA, 17 nt, Human
gacaaauaguaggcaag

SEQ ID NO: 1948657 - RNA, 21 nt, Human
gacaaauaguaggcaagaugg

SEQ ID NO: 1948658 - RNA, 15 nt, Human
gacaaagucaagcca

SEQ ID NO: 1948659 - RNA, 12 nt, Human
gacacagcucuu

SEQ ID NO: 1948660 - RNA, 19 nt, Human
gacacagcucuucuccagg

SEQ ID NO: 1948661 - RNA, 20 nt, Human
gacacagcucuucuccaggc

SEQ ID NO: 1948662 - RNA, 14 nt, Human
gaauuaugaaacuu

SEQ ID NO: 1948663 - RNA, 14 nt, Human
gaauuacuaacuuc

SEQ ID NO: 1948664 - RNA, 15 nt, Human
gaauuacuaacuucu

SEQ ID NO: 1948665 - RNA, 16 nt, Human
gaauuacuaacuucua

SEQ ID NO: 1948666 - RNA, 18 nt, Human
gaauuacuaacuucuaaa

SEQ ID NO: 1948667 - RNA, 23 nt, Human
gaauuacuaacuucuaaaacugu

SEQ ID NO: 1948668 - RNA, 13 nt, Human
gaauuauuuuaaa

SEQ ID NO: 1948669 - RNA, 16 nt, Human
gaauuauuuuaaaaga

SEQ ID NO: 1948670 - RNA, 18 nt, Human
gaauuauuuuaaaagaua

SEQ ID NO: 1948671 - RNA, 14 nt, Human
gacaaaaagcuacu

SEQ ID NO: 1948672 - RNA, 13 nt, Human
gaauuuuuuugua

SEQ ID NO: 1948673 - RNA, 17 nt, Human
gacaaacugccaguuuu

SEQ ID NO: 1948674 - RNA, 20 nt, Human
gacaaacugccaguuuuguu

SEQ ID NO: 1948675 - RNA, 15 nt, Human
gaaugaauggcuaag

SEQ ID NO: 1948676 - RNA, 20 nt, Human
gaaugaauggcuaagcaaaa

SEQ ID NO: 1948677 - RNA, 16 nt, Human
gaaugaguuucuuaga

SEQ ID NO: 1948678 - RNA, 18 nt, Human
gaaugaguuucuuagacu

SEQ ID NO: 1948679 - RNA, 14 nt, Human
gaaugaguuucuua

SEQ ID NO: 1948680 - RNA, 14 nt, Human
gaaugauuaauuaa

SEQ ID NO: 1948681 - RNA, 14 nt, Human
gaaugaugccauga

SEQ ID NO: 1948682 - RNA, 20 nt, Human
gaaugaugauccuaggcauu

SEQ ID NO: 1948683 - RNA, 15 nt, Human
gaauguuugccucug

SEQ ID NO: 1948684 - RNA, 19 nt, Human
gaaugcacaaacagaggcc

SEQ ID NO: 1948685 - RNA, 16 nt, Human
gaauguuugccucugc

SEQ ID NO: 1948686 - RNA, 17 nt, Human
gaauguuugccucugcc

SEQ ID NO: 1948687 - RNA, 18 nt, Human
gaaugcacaaacagaggc

SEQ ID NO: 1948688 - RNA, 21 nt, Human
gaaugaugguuuccaauuuca

SEQ ID NO: 1948689 - RNA, 23 nt, Human
gaauuacaauuacuccuuuuauu

SEQ ID NO: 1948690 - RNA, 14 nt, Human
gaauuaacacauga

SEQ ID NO: 1948691 - RNA, 15 nt, Human
gaauuaacacaugau

SEQ ID NO: 1948692 - RNA, 17 nt, Human
gaauguuuucaaauguu

SEQ ID NO: 1948693 - RNA, 17 nt, Human
gaauguuuuagcacagc

SEQ ID NO: 1948694 - RNA, 20 nt, Human
gaauguuuuagcacagcguu

SEQ ID NO: 1948695 - RNA, 18 nt, Human
gaauguuugccucugccu

SEQ ID NO: 1948696 - RNA, 19 nt, Human
gaauguuugccucugccuc

SEQ ID NO: 1948697 - RNA, 14 nt, Human
gaaugaauggcuaa

SEQ ID NO: 1948698 - RNA, 24 nt, Human
gaauauugcugauggugcaaugac

SEQ ID NO: 1948699 - RNA, 19 nt, Human
gaauauugccauuaugcuu

SEQ ID NO: 1948700 - RNA, 23 nt, Human
gaauauugcugauggugcaauga

SEQ ID NO: 1948701 - RNA, 22 nt, Human
gaauauugcugauggugcaaug

SEQ ID NO: 1948702 - RNA, 15 nt, Human
gaauauauaaccagu

SEQ ID NO: 1948703 - RNA, 17 nt, Human
gaauauagauuaaauca

SEQ ID NO: 1948704 - RNA, 22 nt, Human
gaauaucuccgucaacucauau

SEQ ID NO: 1948705 - RNA, 20 nt, Human
gaauaugaaagucuuauuaa

SEQ ID NO: 1948706 - RNA, 17 nt, Human
gaauaugggagaaauag

SEQ ID NO: 1948707 - RNA, 19 nt, Human
gaauaugauuaaaaauauc

SEQ ID NO: 1948708 - RNA, 21 nt, Human
gaauaugauuaaaaauaucaa

SEQ ID NO: 1948709 - RNA, 13 nt, Human
gaauauugcugau

SEQ ID NO: 1948710 - RNA, 12 nt, Human
gaauauugcuga

SEQ ID NO: 1948711 - RNA, 11 nt, Human
gaauauugcug

SEQ ID NO: 1948712 - RNA, 18 nt, Human
gaauaugggagaaauagu

SEQ ID NO: 1948713 - RNA, 17 nt, Human
gacauugcggacagcca

SEQ ID NO: 1948714 - RNA, 23 nt, Human
gacauugcggacagccacggcca

SEQ ID NO: 1948715 - RNA, 16 nt, Human
gacauuuuaugucuuu

SEQ ID NO: 1948716 - RNA, 20 nt, Human
gacauuuuaugucuuucuug

SEQ ID NO: 1948717 - RNA, 17 nt, Human
gacauuugucauuuuca

SEQ ID NO: 1948718 - RNA, 19 nt, Human
gacauuugucauuuucauu

SEQ ID NO: 1948719 - RNA, 20 nt, Human
gacauuugucauuuucauua

SEQ ID NO: 1948720 - RNA, 13 nt, Human
gacauuuguuugg

SEQ ID NO: 1948721 - RNA, 12 nt, Human
gacauuugucau

SEQ ID NO: 1948722 - RNA, 15 nt, Human
gacauuugucauuuu

SEQ ID NO: 1948723 - RNA, 16 nt, Human
gacauuugucauuuuc

SEQ ID NO: 1948724 - RNA, 20 nt, Human
gacagucccugccaauggac

SEQ ID NO: 1948725 - RNA, 16 nt, Human
gacagucccugccaau

SEQ ID NO: 1948726 - RNA, 15 nt, Human
gacagucccugccaa

SEQ ID NO: 1948727 - RNA, 14 nt, Human
gacagucccugcca

SEQ ID NO: 1948728 - RNA, 11 nt, Human
gacagcucuua

SEQ ID NO: 1948729 - RNA, 12 nt, Human
gacagucccugc

SEQ ID NO: 1948730 - RNA, 10 nt, Human
gacagcucuu

SEQ ID NO: 1948731 - RNA, 15 nt, Human
gacagccccucccuc

SEQ ID NO: 1948732 - RNA, 17 nt, Human
gacagccccucccuccu

SEQ ID NO: 1948733 - RNA, 19 nt, Human
gacagcccgauccuccccu

SEQ ID NO: 1948734 - RNA, 24 nt, Human
gacagcccgauccuccccuggacu

SEQ ID NO: 1948735 - RNA, 12 nt, Human
gacagcucugca

SEQ ID NO: 1948736 - RNA, 19 nt, Human
gacagcuccuucuguccua

SEQ ID NO: 1948737 - RNA, 14 nt, Human
gacagcccgggcuc

SEQ ID NO: 1948738 - RNA, 16 nt, Human
gacagcccgggcucug

SEQ ID NO: 1948739 - RNA, 16 nt, Human
gacagcuccuucuguc

SEQ ID NO: 1948740 - RNA, 17 nt, Human
gacagcuccuucugucc

SEQ ID NO: 1948741 - RNA, 18 nt, Human
gacagcuccuucuguccu

SEQ ID NO: 1948742 - RNA, 20 nt, Human
gacacuggugccaugucagc

SEQ ID NO: 1948743 - RNA, 20 nt, Human
gacacuuccgucacauccca

SEQ ID NO: 1948744 - RNA, 14 nt, Human
gacgcucucuggcc

SEQ ID NO: 1948745 - RNA, 23 nt, Human
gacgcuacccgggaagggggcug

SEQ ID NO: 1948746 - RNA, 22 nt, Human
gacgcuacccgggaagggggcu

SEQ ID NO: 1948747 - RNA, 17 nt, Human
gacgcugugcugcccug

SEQ ID NO: 1948748 - RNA, 16 nt, Human
gacgcugugcugcccu

SEQ ID NO: 1948749 - RNA, 18 nt, Human
gacgcugugcugcccugc

SEQ ID NO: 1948750 - RNA, 15 nt, Human
gacgcugugcugccc

SEQ ID NO: 1948751 - RNA, 21 nt, Human
gacgccaucccagccccaaug

SEQ ID NO: 1948752 - RNA, 15 nt, Human
gacgccaucccagcc

SEQ ID NO: 1948753 - RNA, 19 nt, Human
gacgccaucccagccccaa

SEQ ID NO: 1948754 - RNA, 13 nt, Human
gacgccaucccag

SEQ ID NO: 1948755 - RNA, 12 nt, Human
gacgccauccca

SEQ ID NO: 1948756 - RNA, 13 nt, Human
gaccucugccuga

SEQ ID NO: 1948757 - RNA, 16 nt, Human
gaccucugcagcaaua

SEQ ID NO: 1948758 - RNA, 18 nt, Human
gaccucugcagcaauaaa

SEQ ID NO: 1948759 - RNA, 22 nt, Human
gaccucugcagcaauaaagcag

SEQ ID NO: 1948760 - RNA, 18 nt, Human
gacccggaggggccuggc

SEQ ID NO: 1948761 - RNA, 19 nt, Human
gacccggaggggccuggca

SEQ ID NO: 1948762 - RNA, 20 nt, Human
gacccggaggggccuggcag

SEQ ID NO: 1948763 - RNA, 16 nt, Human
gaccccugagcuugca

SEQ ID NO: 1948764 - RNA, 17 nt, Human
gacccggaggggccugg

SEQ ID NO: 1948765 - RNA, 12 nt, Human
gaccccugccca

SEQ ID NO: 1948766 - RNA, 23 nt, Human
gaccccugcccagaucagccaga

SEQ ID NO: 1948767 - RNA, 20 nt, Human
gaccccugcaguuccccugg

SEQ ID NO: 1948768 - RNA, 20 nt, Human
gacccugaaaugugugugau

SEQ ID NO: 1948769 - RNA, 13 nt, Human
gacccugaaaugu

SEQ ID NO: 1948770 - RNA, 14 nt, Human
gacccugaaaugug

SEQ ID NO: 1948771 - RNA, 15 nt, Human
gacccugaaaugugu

SEQ ID NO: 1948772 - RNA, 16 nt, Human
gacccugaaaugugug

SEQ ID NO: 1948773 - RNA, 14 nt, Human
gaccucaggccugg

SEQ ID NO: 1948774 - RNA, 11 nt, Human
gacccuccaag

SEQ ID NO: 1948775 - RNA, 13 nt, Human
gacccuccaaggc

SEQ ID NO: 1948776 - RNA, 20 nt, Human
gacccuccaaggccaggccu

SEQ ID NO: 1948777 - RNA, 15 nt, Human
gacccuccaaggcca

SEQ ID NO: 1948778 - RNA, 19 nt, Human
gaccucaggugagaagcag

SEQ ID NO: 1948779 - RNA, 18 nt, Human
gaccucaggugagaagca

SEQ ID NO: 1948780 - RNA, 19 nt, Human
gaccucaggccugggggcu

SEQ ID NO: 1948781 - RNA, 22 nt, Human
gaccucagguaaucgaccugcc

SEQ ID NO: 1948782 - RNA, 23 nt, Human
gaccucagguaaucgaccugccu

SEQ ID NO: 1948783 - RNA, 21 nt, Human
gaccucaggugagaagcagag

SEQ ID NO: 1948784 - RNA, 19 nt, Human
gaccucaggugauccaccc

SEQ ID NO: 1948785 - RNA, 20 nt, Human
gaccucaggugauccaccca

SEQ ID NO: 1948786 - RNA, 21 nt, Human
gaccucaggugauccacccac

SEQ ID NO: 1948787 - RNA, 14 nt, Human
gagcaucaggccag

SEQ ID NO: 1948788 - RNA, 17 nt, Human
gagcaguaucaugaagc

SEQ ID NO: 1948789 - RNA, 16 nt, Human
gagcaguaucaugaag

SEQ ID NO: 1948790 - RNA, 13 nt, Human
gagcaucaggcca

SEQ ID NO: 1948791 - RNA, 16 nt, Human
gagcaucaggccaggc

SEQ ID NO: 1948792 - RNA, 15 nt, Human
gagcaucaggccagg

SEQ ID NO: 1948793 - RNA, 13 nt, Human
gagcaugccugga

SEQ ID NO: 1948794 - RNA, 21 nt, Human
gagcaugccuggauggggcug

SEQ ID NO: 1948795 - RNA, 18 nt, Human
gagcccauuuggagggcc

SEQ ID NO: 1948796 - RNA, 20 nt, Human
gagcccugggaggcucugga

SEQ ID NO: 1948797 - RNA, 19 nt, Human
gagcccugggaggcucugg

SEQ ID NO: 1948798 - RNA, 18 nt, Human
gagcccugggaggcucug

SEQ ID NO: 1948799 - RNA, 16 nt, Human
gagcccugggaggcuc

SEQ ID NO: 1948800 - RNA, 22 nt, Human
gagcccugccucuccgccccug

SEQ ID NO: 1948801 - RNA, 18 nt, Human
gagcccugccucuccgcc

SEQ ID NO: 1948802 - RNA, 12 nt, Human
gagcccugggag

SEQ ID NO: 1948803 - RNA, 13 nt, Human
gagccccgaggcc

SEQ ID NO: 1948804 - RNA, 14 nt, Human
gagccccgaggccu

SEQ ID NO: 1948805 - RNA, 17 nt, Human
gagccccgaggccuucu

SEQ ID NO: 1948806 - RNA, 19 nt, Human
gagcuggcuccagccugga

SEQ ID NO: 1948807 - RNA, 18 nt, Human
gagcuguugaugggauga

SEQ ID NO: 1948808 - RNA, 14 nt, Human
gagcuggcuccagc

SEQ ID NO: 1948809 - RNA, 13 nt, Human
gagcccugguggc

SEQ ID NO: 1948810 - RNA, 14 nt, Human
gagcccugguggca

SEQ ID NO: 1948811 - RNA, 14 nt, Human
gagcccugcucccu

SEQ ID NO: 1948812 - RNA, 21 nt, Human
gagggccugcaagggagugag

SEQ ID NO: 1948813 - RNA, 17 nt, Human
gagggccugcaagggag

SEQ ID NO: 1948814 - RNA, 14 nt, Human
gagggccugcaagg

SEQ ID NO: 1948815 - RNA, 14 nt, Human
gaggggagccagga

SEQ ID NO: 1948816 - RNA, 17 nt, Human
gaggggagccaggaggg

SEQ ID NO: 1948817 - RNA, 20 nt, Human
gaggggagacuuugauguca

SEQ ID NO: 1948818 - RNA, 17 nt, Human
gaggggauggggcuggg

SEQ ID NO: 1948819 - RNA, 21 nt, Human
gaggggaugugugugugcaga

SEQ ID NO: 1948820 - RNA, 23 nt, Human
gaggggaugugugugugcagagc

SEQ ID NO: 1948821 - RNA, 12 nt, Human
gagggccugggc

SEQ ID NO: 1948822 - RNA, 18 nt, Human
gaggcugagaugggagaa

SEQ ID NO: 1948823 - RNA, 20 nt, Human
gaggcucuggagcccacugu

SEQ ID NO: 1948824 - RNA, 17 nt, Human
gaggcuccacuuggucu

SEQ ID NO: 1948825 - RNA, 19 nt, Human
gaggccaagaguggcccca

SEQ ID NO: 1948826 - RNA, 20 nt, Human
gaggccaagaguggccccac

SEQ ID NO: 1948827 - RNA, 21 nt, Human
gaggccaagaguggccccacc

SEQ ID NO: 1948828 - RNA, 22 nt, Human
gaggccaagaguggccccaccu

SEQ ID NO: 1948829 - RNA, 15 nt, Human
gaggcuccacuuggu

SEQ ID NO: 1948830 - RNA, 21 nt, Human
gaggcauuuguuugaacugau

SEQ ID NO: 1948831 - RNA, 17 nt, Human
gaggccaaacaggcccu

SEQ ID NO: 1948832 - RNA, 18 nt, Human
gaggccaaacaggcccuc

SEQ ID NO: 1948833 - RNA, 16 nt, Human
gaggccaagaguggcc

SEQ ID NO: 1948834 - RNA, 17 nt, Human
gaggccaagaguggccc

SEQ ID NO: 1948835 - RNA, 21 nt, Human
gaggcaugugaugagaggaaa

SEQ ID NO: 1948836 - RNA, 20 nt, Human
gaggcaugugaugagaggaa

SEQ ID NO: 1948837 - RNA, 22 nt, Human
gaggcaugugaugagaggaaau

SEQ ID NO: 1948838 - RNA, 19 nt, Human
gaggcauuuguuugaacug

SEQ ID NO: 1948839 - RNA, 16 nt, Human
gaggacauggcuucug

SEQ ID NO: 1948840 - RNA, 22 nt, Human
gaggacaguauuuguggggagg

SEQ ID NO: 1948841 - RNA, 21 nt, Human
gaggacgcucucuggccuucg

SEQ ID NO: 1948842 - RNA, 20 nt, Human
gaggacgcucucuggccuuc

SEQ ID NO: 1948843 - RNA, 13 nt, Human
gaggaccagcaca

SEQ ID NO: 1948844 - RNA, 14 nt, Human
gaggaccagcacac

SEQ ID NO: 1948845 - RNA, 13 nt, Human
gaggaccagggcu

SEQ ID NO: 1948846 - RNA, 16 nt, Human
gaggacuuuucuuugu

SEQ ID NO: 1948847 - RNA, 20 nt, Human
gaggacuuuucuuuguggcu

SEQ ID NO: 1948848 - RNA, 23 nt, Human
gaggacuuuucuuuguggcuucc

SEQ ID NO: 1948849 - RNA, 22 nt, Human
gaggcagggucucacucugucg

SEQ ID NO: 1948850 - RNA, 17 nt, Human
gaggcaucgcaauguaa

SEQ ID NO: 1948851 - RNA, 19 nt, Human
gaggcagggucucacucug

SEQ ID NO: 1948852 - RNA, 20 nt, Human
gaggcagggucucacucugu

SEQ ID NO: 1948853 - RNA, 18 nt, Human
gaggcagggucucacucu

SEQ ID NO: 1948854 - RNA, 15 nt, Human
gaggagagaggaccc

SEQ ID NO: 1948855 - RNA, 14 nt, Human
gaggagagaggacc

SEQ ID NO: 1948856 - RNA, 12 nt, Human
gaggagagagga

SEQ ID NO: 1948857 - RNA, 12 nt, Human
gaggagaaacug

SEQ ID NO: 1948858 - RNA, 14 nt, Human
gaggagaaacugga

SEQ ID NO: 1948859 - RNA, 18 nt, Human
gaggagaacuugcugccu

SEQ ID NO: 1948860 - RNA, 14 nt, Human
gaggagaagaaaau

SEQ ID NO: 1948861 - RNA, 16 nt, Human
gaggagaacuugcugc

SEQ ID NO: 1948862 - RNA, 21 nt, Human
gagauugugccccugcacucc

SEQ ID NO: 1948863 - RNA, 14 nt, Human
gagauuggaaggaa

SEQ ID NO: 1948864 - RNA, 23 nt, Human
gagauugcuguguguugccuggg

SEQ ID NO: 1948865 - RNA, 20 nt, Human
gagaugcuagaacucccuuu

SEQ ID NO: 1948866 - RNA, 16 nt, Human
gagaugcuagaacucc

SEQ ID NO: 1948867 - RNA, 15 nt, Human
gagauuauguucuuu

SEQ ID NO: 1948868 - RNA, 20 nt, Human
gagauguguaauuuuucugu

SEQ ID NO: 1948869 - RNA, 17 nt, Human
gagauguguaauuuuuc

SEQ ID NO: 1948870 - RNA, 16 nt, Human
gagagccuuccagggg

SEQ ID NO: 1948871 - RNA, 15 nt, Human
gagagccuuccaggg

SEQ ID NO: 1948872 - RNA, 14 nt, Human
gagacuccugcagg

SEQ ID NO: 1948873 - RNA, 13 nt, Human
gagacuccugcag

SEQ ID NO: 1948874 - RNA, 20 nt, Human
gagagccuuccagggguggg

SEQ ID NO: 1948875 - RNA, 18 nt, Human
gagagccuuccaggggug

SEQ ID NO: 1948876 - RNA, 21 nt, Human
gagagcuagcagcagggaggg

SEQ ID NO: 1948877 - RNA, 15 nt, Human
gagagcuagcagcag

SEQ ID NO: 1948878 - RNA, 13 nt, Human
gagagcugggugu

SEQ ID NO: 1948879 - RNA, 23 nt, Human
gagagcuauggacagcauugcca

SEQ ID NO: 1948880 - RNA, 13 nt, Human
gagaggccgggac

SEQ ID NO: 1948881 - RNA, 13 nt, Human
gagaggcuguggu

SEQ ID NO: 1948882 - RNA, 21 nt, Human
gagaggcugugguuuggggga

SEQ ID NO: 1948883 - RNA, 16 nt, Human
gagaggcuaaaauguu

SEQ ID NO: 1948884 - RNA, 20 nt, Human
gagaggcuaaaauguuuuca

SEQ ID NO: 1948885 - RNA, 21 nt, Human
gagaggcuaaaauguuuucag

SEQ ID NO: 1948886 - RNA, 22 nt, Human
gagaggcuaaaauguuuucagc

SEQ ID NO: 1948887 - RNA, 15 nt, Human
gagaggagcccugcc

SEQ ID NO: 1948888 - RNA, 15 nt, Human
gagaggacccccuga

SEQ ID NO: 1948889 - RNA, 12 nt, Human
gagaggaaauca

SEQ ID NO: 1948890 - RNA, 22 nt, Human
gagagcuucuguugcugccuca

SEQ ID NO: 1948891 - RNA, 20 nt, Human
gagagcugggugucaagagg

SEQ ID NO: 1948892 - RNA, 17 nt, Human
gagaaaaccccuuccca

SEQ ID NO: 1948893 - RNA, 22 nt, Human
gacuuuucaaguauuuaagccu

SEQ ID NO: 1948894 - RNA, 20 nt, Human
gacuuuuccaacccucauca

SEQ ID NO: 1948895 - RNA, 19 nt, Human
gacuuuuccaacccucauc

SEQ ID NO: 1948896 - RNA, 14 nt, Human
gacuuuuccaaccc

SEQ ID NO: 1948897 - RNA, 18 nt, Human
gacuuuuauuuccaguga

SEQ ID NO: 1948898 - RNA, 14 nt, Human
gacuuuucaaguau

SEQ ID NO: 1948899 - RNA, 19 nt, Human
gacuuuucaaguauuuaag

SEQ ID NO: 1948900 - RNA, 21 nt, Human
gagaagggcagaguuacuuga

SEQ ID NO: 1948901 - RNA, 15 nt, Human
gagaaucacaggcug

SEQ ID NO: 1948902 - RNA, 14 nt, Human
gagaaucacaggcu

SEQ ID NO: 1948903 - RNA, 15 nt, Human
gagaaugaaagggcc

SEQ ID NO: 1948904 - RNA, 23 nt, Human
gagaaugaaagggcccagagagg

SEQ ID NO: 1948905 - RNA, 13 nt, Human
gagaaugaacaaa

SEQ ID NO: 1948906 - RNA, 17 nt, Human
gagaaucucaacauguc

SEQ ID NO: 1948907 - RNA, 11 nt, Human
gagaaugaaca

SEQ ID NO: 1948908 - RNA, 17 nt, Human
gagaaugaacaaagacc

SEQ ID NO: 1948909 - RNA, 20 nt, Human
gagaccgugaagauacuuug

SEQ ID NO: 1948910 - RNA, 22 nt, Human
gagaccgugaagauacuuugua

SEQ ID NO: 1948911 - RNA, 14 nt, Human
gagacggaguccca

SEQ ID NO: 1948912 - RNA, 16 nt, Human
gagacggagucccacc

SEQ ID NO: 1948913 - RNA, 19 nt, Human
gagacggagucccaccuug

SEQ ID NO: 1948914 - RNA, 18 nt, Human
gagacgggggcagagagg

SEQ ID NO: 1948915 - RNA, 17 nt, Human
gcccaggagaaugcugc

SEQ ID NO: 1948916 - RNA, 11 nt, Human
gcccaggcagg

SEQ ID NO: 1948917 - RNA, 16 nt, Human
gcccaggauauauuuu

SEQ ID NO: 1948918 - RNA, 18 nt, Human
gcccaggauauauuuuau

SEQ ID NO: 1948919 - RNA, 11 nt, Human
gcccaggcccc

SEQ ID NO: 1948920 - RNA, 12 nt, Human
gcccaggccccu

SEQ ID NO: 1948921 - RNA, 20 nt, Human
gcccaggccccugccacccu

SEQ ID NO: 1948922 - RNA, 21 nt, Human
gcccaggccccugccacccug

SEQ ID NO: 1948923 - RNA, 22 nt, Human
gcccaggccccugccacccugg

SEQ ID NO: 1948924 - RNA, 11 nt, Human
gcccacuggcc

SEQ ID NO: 1948925 - RNA, 22 nt, Human
gcccacuguacuugcucuugau

SEQ ID NO: 1948926 - RNA, 20 nt, Human
gcccacuguacuugcucuug

SEQ ID NO: 1948927 - RNA, 15 nt, Human
gcccacuguacuugc

SEQ ID NO: 1948928 - RNA, 23 nt, Human
gcccacgcuggagugcagugagc

SEQ ID NO: 1948929 - RNA, 15 nt, Human
gccauugcuuaccuu

SEQ ID NO: 1948930 - RNA, 19 nt, Human
gcccacgcuggagugcagu

SEQ ID NO: 1948931 - RNA, 21 nt, Human
gcccacgcuggagugcaguga

SEQ ID NO: 1948932 - RNA, 23 nt, Human
gcccaggaaaggcuccaggagca

SEQ ID NO: 1948933 - RNA, 22 nt, Human
gcccaggaaaggcuccaggagc

SEQ ID NO: 1948934 - RNA, 24 nt, Human
gcccaggaaaggcuccaggagcag

SEQ ID NO: 1948935 - RNA, 16 nt, Human
gcccacuucccugggu

SEQ ID NO: 1948936 - RNA, 11 nt, Human
gcccacuuccc

SEQ ID NO: 1948937 - RNA, 15 nt, Human
gcccacuucccuggg

SEQ ID NO: 1948938 - RNA, 13 nt, Human
gcccacuucugcc

SEQ ID NO: 1948939 - RNA, 16 nt, Human
gcccacugugcguggg

SEQ ID NO: 1948940 - RNA, 23 nt, Human
gcccacugugcguggggcucccg

SEQ ID NO: 1948941 - RNA, 21 nt, Human
gcccacgcccccacuggugac

SEQ ID NO: 1948942 - RNA, 17 nt, Human
gcccacgcccccacugg

SEQ ID NO: 1948943 - RNA, 16 nt, Human
gcccacgcccccacug

SEQ ID NO: 1948944 - RNA, 15 nt, Human
gcccacgcccccacu

SEQ ID NO: 1948945 - RNA, 17 nt, Human
gccauugacuucuuccc

SEQ ID NO: 1948946 - RNA, 18 nt, Human
gcauuuagggaguauucu

SEQ ID NO: 1948947 - RNA, 19 nt, Human
gcauuuagggaguauucua

SEQ ID NO: 1948948 - RNA, 19 nt, Human
gcauuuaggccaugggaca

SEQ ID NO: 1948949 - RNA, 18 nt, Human
gcauuuacuuuguguuca

SEQ ID NO: 1948950 - RNA, 20 nt, Human
gccccaaaacucuccucugc

SEQ ID NO: 1948951 - RNA, 11 nt, Human
gccccaaaagg

SEQ ID NO: 1948952 - RNA, 21 nt, Human
gccccaaaacucuccucugcu

SEQ ID NO: 1948953 - RNA, 22 nt, Human
gccccaaauugucaccugcuuc

SEQ ID NO: 1948954 - RNA, 18 nt, Human
gcccccagcuuccagcag

SEQ ID NO: 1948955 - RNA, 19 nt, Human
gcccccagcuuccagcagg

SEQ ID NO: 1948956 - RNA, 12 nt, Human
gcccccagcuuc

SEQ ID NO: 1948957 - RNA, 15 nt, Human
gcccccucugcccug

SEQ ID NO: 1948958 - RNA, 16 nt, Human
gcccccucugcccugc

SEQ ID NO: 1948959 - RNA, 17 nt, Human
gcccccucuucccuggu

SEQ ID NO: 1948960 - RNA, 17 nt, Human
gcccccucugcccugcg

SEQ ID NO: 1948961 - RNA, 12 nt, Human
gccccugcuggu

SEQ ID NO: 1948962 - RNA, 15 nt, Human
gccccuggcagcccc

SEQ ID NO: 1948963 - RNA, 12 nt, Human
gccccuggcagc

SEQ ID NO: 1948964 - RNA, 15 nt, Human
gccccugcugguuca

SEQ ID NO: 1948965 - RNA, 16 nt, Human
gccccugcugguucag

SEQ ID NO: 1948966 - RNA, 22 nt, Human
gccucauguccacugguucuuc

SEQ ID NO: 1948967 - RNA, 19 nt, Human
gccucaugucaaauauuua

SEQ ID NO: 1948968 - RNA, 19 nt, Human
gccucaugcuaagacucag

SEQ ID NO: 1948969 - RNA, 13 nt, Human
gccuccauccuga

SEQ ID NO: 1948970 - RNA, 14 nt, Human
gccuccauccugag

SEQ ID NO: 1948971 - RNA, 15 nt, Human
gccuccauccugagg

SEQ ID NO: 1948972 - RNA, 19 nt, Human
gccuccugaguagcuggga

SEQ ID NO: 1948973 - RNA, 14 nt, Human
gccucugggacugg

SEQ ID NO: 1948974 - RNA, 16 nt, Human
gccucgaacuggcugc

SEQ ID NO: 1948975 - RNA, 22 nt, Human
gccuccuuugugaggaagccgc

SEQ ID NO: 1948976 - RNA, 13 nt, Human
gccucgaacuggc

SEQ ID NO: 1948977 - RNA, 17 nt, Human
gccuacaggagugagca

SEQ ID NO: 1948978 - RNA, 12 nt, Human
gccuagcauacg

SEQ ID NO: 1948979 - RNA, 19 nt, Human
gccuagcauacguacacau

SEQ ID NO: 1948980 - RNA, 17 nt, Human
gccccuggcagccccug

SEQ ID NO: 1948981 - RNA, 16 nt, Human
gccccuggcagccccu

SEQ ID NO: 1948982 - RNA, 21 nt, Human
gccccugcugguucaggguug

SEQ ID NO: 1948983 - RNA, 16 nt, Human
gccuacaggagugagc

SEQ ID NO: 1948984 - RNA, 22 nt, Human
gccggcaauaaaagcccaggag

SEQ ID NO: 1948985 - RNA, 23 nt, Human
gccggcaauaaaagcccaggagc

SEQ ID NO: 1948986 - RNA, 18 nt, Human
gccggcaauaaaagccca

SEQ ID NO: 1948987 - RNA, 19 nt, Human
gccggcaauaaaagcccag

SEQ ID NO: 1948988 - RNA, 20 nt, Human
gccggcaauaaaagcccagg

SEQ ID NO: 1948989 - RNA, 21 nt, Human
gccggcaauaaaagcccagga

SEQ ID NO: 1948990 - RNA, 12 nt, Human
gccgcuccagag

SEQ ID NO: 1948991 - RNA, 13 nt, Human
gccgcuccagagu

SEQ ID NO: 1948992 - RNA, 16 nt, Human
gccgcuccagagucag

SEQ ID NO: 1948993 - RNA, 22 nt, Human
gccggacacccgacuccagucc

SEQ ID NO: 1948994 - RNA, 14 nt, Human
gcccuuccucucca

SEQ ID NO: 1948995 - RNA, 15 nt, Human
gcccuuccucuccac

SEQ ID NO: 1948996 - RNA, 13 nt, Human
gccgcuagguaga

SEQ ID NO: 1948997 - RNA, 23 nt, Human
gccgcuagguagagucugagggc

SEQ ID NO: 1948998 - RNA, 11 nt, Human
gccgcuccaga

SEQ ID NO: 1948999 - RNA, 22 nt, Human
gcccuuccaugucgccucugca

SEQ ID NO: 1949000 - RNA, 12 nt, Human
gcccuuccucuc

SEQ ID NO: 1949001 - RNA, 12 nt, Human
gcccuuccaugu

SEQ ID NO: 1949002 - RNA, 21 nt, Human
gcccuuccaugucgccucugc

SEQ ID NO: 1949003 - RNA, 22 nt, Human
gcccuuaccugccaggaagcca

SEQ ID NO: 1949004 - RNA, 21 nt, Human
gcccuuaccugccaggaagcc

SEQ ID NO: 1949005 - RNA, 17 nt, Human
gcccugugggcccccaa

SEQ ID NO: 1949006 - RNA, 16 nt, Human
gcccugugggccccca

SEQ ID NO: 1949007 - RNA, 19 nt, Human
gcccuuagcagggaaacag

SEQ ID NO: 1949008 - RNA, 23 nt, Human
gcccuuaccugccaggaagccag

SEQ ID NO: 1949009 - RNA, 21 nt, Human
gcccugugggcccccaaaugg

SEQ ID NO: 1949010 - RNA, 15 nt, Human
gcccugcccaccugg

SEQ ID NO: 1949011 - RNA, 14 nt, Human
gcccugcccaccug

SEQ ID NO: 1949012 - RNA, 20 nt, Human
gcccugcgggucacaggagg

SEQ ID NO: 1949013 - RNA, 20 nt, Human
gcucagggccuggcucaggu

SEQ ID NO: 1949014 - RNA, 19 nt, Human
gcucagggccuggcucagg

SEQ ID NO: 1949015 - RNA, 18 nt, Human
gcucagggccuggcucag

SEQ ID NO: 1949016 - RNA, 13 nt, Human
gcucaggaguuug

SEQ ID NO: 1949017 - RNA, 23 nt, Human
gcucaggagcccugggaggcucu

SEQ ID NO: 1949018 - RNA, 22 nt, Human
gcucaggagcccugggaggcuc

SEQ ID NO: 1949019 - RNA, 21 nt, Human
gcucacugcuaagaauauuug

SEQ ID NO: 1949020 - RNA, 17 nt, Human
gcucacuguggugucug

SEQ ID NO: 1949021 - RNA, 18 nt, Human
gcucacuguggugucugu

SEQ ID NO: 1949022 - RNA, 19 nt, Human
gcucacuguggugucugug

SEQ ID NO: 1949023 - RNA, 16 nt, Human
gcucagagcaguguuu

SEQ ID NO: 1949024 - RNA, 15 nt, Human
gcucagaaccacagc

SEQ ID NO: 1949025 - RNA, 17 nt, Human
gcucagaaccacagcaa

SEQ ID NO: 1949026 - RNA, 21 nt, Human
gcuaggaauuguguuuauaau

SEQ ID NO: 1949027 - RNA, 18 nt, Human
gcuaggaauauagauuaa

SEQ ID NO: 1949028 - RNA, 16 nt, Human
gcuaggaaugaaaucu

SEQ ID NO: 1949029 - RNA, 22 nt, Human
gcuaggaccccuccaugugggc

SEQ ID NO: 1949030 - RNA, 20 nt, Human
gcuaggaccccuccaugugg

SEQ ID NO: 1949031 - RNA, 18 nt, Human
gcuauucaguaauaacuc

SEQ ID NO: 1949032 - RNA, 23 nt, Human
gcuauuacgaaguucaagaucaa

SEQ ID NO: 1949033 - RNA, 19 nt, Human
gcuaguugaauacuugaac

SEQ ID NO: 1949034 - RNA, 22 nt, Human
gcuaguugaauacuugaaccau

SEQ ID NO: 1949035 - RNA, 14 nt, Human
gcuaguugggcuuc

SEQ ID NO: 1949036 - RNA, 16 nt, Human
gcuaguugggcuuccu

SEQ ID NO: 1949037 - RNA, 19 nt, Human
gcuaguguucuuucucuuu

SEQ ID NO: 1949038 - RNA, 13 nt, Human
gcuaguugaauac

SEQ ID NO: 1949039 - RNA, 15 nt, Human
gcuaguugaauacuu

SEQ ID NO: 1949040 - RNA, 16 nt, Human
gcuaguugaauacuug

SEQ ID NO: 1949041 - RNA, 18 nt, Human
gcuaguugaauacuugaa

SEQ ID NO: 1949042 - RNA, 18 nt, Human
gcuaagugauccucccac

SEQ ID NO: 1949043 - RNA, 22 nt, Human
gcuaagugauccucccaccuca

SEQ ID NO: 1949044 - RNA, 18 nt, Human
gcuaaguaaaucucuucu

SEQ ID NO: 1949045 - RNA, 19 nt, Human
gcuaaguaaaucucuucug

SEQ ID NO: 1949046 - RNA, 15 nt, Human
gcgcaggcuggcccu

SEQ ID NO: 1949047 - RNA, 16 nt, Human
gcgcaggcuggcccug

SEQ ID NO: 1949048 - RNA, 17 nt, Human
gcgcagcauccgaccag

SEQ ID NO: 1949049 - RNA, 21 nt, Human
gcgcagcauauucaggaagcu

SEQ ID NO: 1949050 - RNA, 14 nt, Human
gcgcaggcuggccc

SEQ ID NO: 1949051 - RNA, 23 nt, Human
gcgauucuucugcuucagccucc

SEQ ID NO: 1949052 - RNA, 22 nt, Human
gccuugaccauucuccaccugc

SEQ ID NO: 1949053 - RNA, 16 nt, Human
gccuugaccauucucc

SEQ ID NO: 1949054 - RNA, 23 nt, Human
gccuugaacuuugaccucugcag

SEQ ID NO: 1949055 - RNA, 23 nt, Human
gccuugaccauucuccaccugcc

SEQ ID NO: 1949056 - RNA, 20 nt, Human
gccuugauucccuuguuauu

SEQ ID NO: 1949057 - RNA, 22 nt, Human
gcgauucuucugcuucagccuc

SEQ ID NO: 1949058 - RNA, 15 nt, Human
gccuucuuuuucugg

SEQ ID NO: 1949059 - RNA, 16 nt, Human
gccuucuuuuucugga

SEQ ID NO: 1949060 - RNA, 17 nt, Human
gccuucuuuuucuggac

SEQ ID NO: 1949061 - RNA, 14 nt, Human
gccuugaacuuuga

SEQ ID NO: 1949062 - RNA, 19 nt, Human
gccuucgguacccaccaca

SEQ ID NO: 1949063 - RNA, 18 nt, Human
gccuucgguacccaccac

SEQ ID NO: 1949064 - RNA, 15 nt, Human
gccuucucugaagga

SEQ ID NO: 1949065 - RNA, 16 nt, Human
gccuucucugaaggac

SEQ ID NO: 1949066 - RNA, 15 nt, Human
gccuguucagcucca

SEQ ID NO: 1949067 - RNA, 14 nt, Human
gccuguucagcucc

SEQ ID NO: 1949068 - RNA, 16 nt, Human
gccuguucagcuccag

SEQ ID NO: 1949069 - RNA, 17 nt, Human
gccuguucagcuccagc

SEQ ID NO: 1949070 - RNA, 19 nt, Human
gccugugccucugggacug

SEQ ID NO: 1949071 - RNA, 15 nt, Human
gccugggcaauaaag

SEQ ID NO: 1949072 - RNA, 22 nt, Human
gccugggcaauaaagugagacc

SEQ ID NO: 1949073 - RNA, 11 nt, Human
gccugggcaga

SEQ ID NO: 1949074 - RNA, 23 nt, Human
gccugggaucccucauccucaua

SEQ ID NO: 1949075 - RNA, 12 nt, Human
gccuggcucccu

SEQ ID NO: 1949076 - RNA, 16 nt, Human
gccuggcucccucacu

SEQ ID NO: 1949077 - RNA, 19 nt, Human
gccuggcucccucacucuc

SEQ ID NO: 1949078 - RNA, 21 nt, Human
gccuggcucccucacucucag

SEQ ID NO: 1949079 - RNA, 22 nt, Human
gccuggcucccucacucucagg

SEQ ID NO: 1949080 - RNA, 23 nt, Human
gccuggcucccucacucucagga

SEQ ID NO: 1949081 - RNA, 16 nt, Human
gcggccuuuggcuuca

SEQ ID NO: 1949082 - RNA, 18 nt, Human
gcggcucaagcccaggag

SEQ ID NO: 1949083 - RNA, 15 nt, Human
gcggcuggacuugga

SEQ ID NO: 1949084 - RNA, 16 nt, Human
gcggcuggacuuggag

SEQ ID NO: 1949085 - RNA, 15 nt, Human
gcggcuggcagccca

SEQ ID NO: 1949086 - RNA, 19 nt, Human
gcgggaauggcagcugcca

SEQ ID NO: 1949087 - RNA, 15 nt, Human
gcguguucucagagg

SEQ ID NO: 1949088 - RNA, 17 nt, Human
gcguucaccagugaccu

SEQ ID NO: 1949089 - RNA, 17 nt, Human
gcuguaucccaugagcc

SEQ ID NO: 1949090 - RNA, 19 nt, Human
gcuguaucccaugagccuc

SEQ ID NO: 1949091 - RNA, 14 nt, Human
gcugugcugcccug

SEQ ID NO: 1949092 - RNA, 18 nt, Human
gcugugcucuggacaggc

SEQ ID NO: 1949093 - RNA, 15 nt, Human
gcugugcucuggaca

SEQ ID NO: 1949094 - RNA, 16 nt, Human
gcugugcucuggacag

SEQ ID NO: 1949095 - RNA, 16 nt, Human
gcugugccucugccug

SEQ ID NO: 1949096 - RNA, 14 nt, Human
gcugugccucugcc

SEQ ID NO: 1949097 - RNA, 15 nt, Human
gcugugccucugccu

SEQ ID NO: 1949098 - RNA, 13 nt, Human
gcugugcucugga

SEQ ID NO: 1949099 - RNA, 16 nt, Human
gcugugcugcccugcc

SEQ ID NO: 1949100 - RNA, 15 nt, Human
gcugugcugcccugc

SEQ ID NO: 1949101 - RNA, 17 nt, Human
gcugugcugcccugccc

SEQ ID NO: 1949102 - RNA, 15 nt, Human
gcuguuggcuggggg

SEQ ID NO: 1949103 - RNA, 16 nt, Human
gcuguuggcugggggc

SEQ ID NO: 1949104 - RNA, 20 nt, Human
gcuguuggcugggggccuca

SEQ ID NO: 1949105 - RNA, 17 nt, Human
gcuguugucucuucucc

SEQ ID NO: 1949106 - RNA, 16 nt, Human
gcuguugucucuucuc

SEQ ID NO: 1949107 - RNA, 21 nt, Human
gcuggguucuacccaggugcu

SEQ ID NO: 1949108 - RNA, 20 nt, Human
gcuggguucuacccaggugc

SEQ ID NO: 1949109 - RNA, 14 nt, Human
gcugguaaaaugaa

SEQ ID NO: 1949110 - RNA, 16 nt, Human
gcugguaaaaugaaga

SEQ ID NO: 1949111 - RNA, 18 nt, Human
gcugguaaaaugaagaau

SEQ ID NO: 1949112 - RNA, 23 nt, Human
gcugguaaaaugaagaauuuaaa

SEQ ID NO: 1949113 - RNA, 17 nt, Human
gcuggguucuacccagg

SEQ ID NO: 1949114 - RNA, 18 nt, Human
gcuggguucuacccaggu

SEQ ID NO: 1949115 - RNA, 23 nt, Human
gcugggguggggaccucaggccu

SEQ ID NO: 1949116 - RNA, 22 nt, Human
gcugggguggggaccucaggcc

SEQ ID NO: 1949117 - RNA, 19 nt, Human
gcugggguggggaccucag

SEQ ID NO: 1949118 - RNA, 17 nt, Human
gcugggguggggaccuc

SEQ ID NO: 1949119 - RNA, 20 nt, Human
gcugggccccugccucucug

SEQ ID NO: 1949120 - RNA, 18 nt, Human
gcugggccccugccucuc

SEQ ID NO: 1949121 - RNA, 14 nt, Human
gcugggccccugcc

SEQ ID NO: 1949122 - RNA, 13 nt, Human
gcugggccccugc

SEQ ID NO: 1949123 - RNA, 12 nt, Human
gcugggccccug

SEQ ID NO: 1949124 - RNA, 20 nt, Human
gcugggcccacccaagcagg

SEQ ID NO: 1949125 - RNA, 20 nt, Human
gcugggaauaagugccagga

SEQ ID NO: 1949126 - RNA, 14 nt, Human
gcugggcagguugg

SEQ ID NO: 1949127 - RNA, 20 nt, Human
gcuggcuguuggcugggggc

SEQ ID NO: 1949128 - RNA, 23 nt, Human
gcuggcuguuggcugggggccuc

SEQ ID NO: 1949129 - RNA, 12 nt, Human
gcugcugaaggc

SEQ ID NO: 1949130 - RNA, 13 nt, Human
gcuggacuuggag

SEQ ID NO: 1949131 - RNA, 14 nt, Human
gcuggcgugcagug

SEQ ID NO: 1949132 - RNA, 15 nt, Human
gcuggagaggagccc

SEQ ID NO: 1949133 - RNA, 14 nt, Human
gcuggagaaaaaua

SEQ ID NO: 1949134 - RNA, 15 nt, Human
gcuggcgugcagugg

SEQ ID NO: 1949135 - RNA, 18 nt, Human
gcuggcgugcaguggugc

SEQ ID NO: 1949136 - RNA, 16 nt, Human
gcuggagaggagcccu

SEQ ID NO: 1949137 - RNA, 17 nt, Human
gcuggagaggagcccug

SEQ ID NO: 1949138 - RNA, 18 nt, Human
gcuggagaggagcccugc

SEQ ID NO: 1949139 - RNA, 18 nt, Human
gcuggcuguuggcugggg

SEQ ID NO: 1949140 - RNA, 19 nt, Human
gcuggcuguuggcuggggg

SEQ ID NO: 1949141 - RNA, 14 nt, Human
gcuggcugccuuag

SEQ ID NO: 1949142 - RNA, 20 nt, Human
gcuggcugccuuagaaccuu

SEQ ID NO: 1949143 - RNA, 11 nt, Human
gcuggcugccu

SEQ ID NO: 1949144 - RNA, 14 nt, Human
gcugaggugggagg

SEQ ID NO: 1949145 - RNA, 23 nt, Human
gcugagggugagugggugaauaa

SEQ ID NO: 1949146 - RNA, 16 nt, Human
gcugagaggagagaga

SEQ ID NO: 1949147 - RNA, 13 nt, Human
gcugcaccggcug

SEQ ID NO: 1949148 - RNA, 19 nt, Human
gcugcacccucaggcaggu

SEQ ID NO: 1949149 - RNA, 18 nt, Human
gcugcacccucaggcagg

SEQ ID NO: 1949150 - RNA, 15 nt, Human
gcugcagccaggcca

SEQ ID NO: 1949151 - RNA, 20 nt, Human
gcugcagauaaguggccuug

SEQ ID NO: 1949152 - RNA, 22 nt, Human
gcugcagauacuacugaccaga

SEQ ID NO: 1949153 - RNA, 23 nt, Human
gcugcagccaggccacuggcccc

SEQ ID NO: 1949154 - RNA, 19 nt, Human
gcugccccuggcagccccu

SEQ ID NO: 1949155 - RNA, 18 nt, Human
gcugccccuggcagcccc

SEQ ID NO: 1949156 - RNA, 20 nt, Human
gcugccccuggcagccccug

SEQ ID NO: 1949157 - RNA, 17 nt, Human
gcugccuaggauucaca

SEQ ID NO: 1949158 - RNA, 21 nt, Human
gcugccugggaucccucaucc

SEQ ID NO: 1949159 - RNA, 17 nt, Human
gcugccuguucagcucc

SEQ ID NO: 1949160 - RNA, 23 nt, Human
gcugcucuugaacuccugaccuc

SEQ ID NO: 1949161 - RNA, 12 nt, Human
gcugccuguuca

SEQ ID NO: 1949162 - RNA, 13 nt, Human
gcugccuguucag

SEQ ID NO: 1949163 - RNA, 20 nt, Human
gcugccugggaucccucauc

SEQ ID NO: 1949164 - RNA, 16 nt, Human
gcugccugaaaaucaa

SEQ ID NO: 1949165 - RNA, 16 nt, Human
gcugccucucccauca

SEQ ID NO: 1949166 - RNA, 22 nt, Human
gcugccucggauccccuuccua

SEQ ID NO: 1949167 - RNA, 19 nt, Human
gcugccucggauccccuuc

SEQ ID NO: 1949168 - RNA, 20 nt, Human
gcugccucggauccccuucc

SEQ ID NO: 1949169 - RNA, 21 nt, Human
gcugccucggauccccuuccu

SEQ ID NO: 1949170 - RNA, 21 nt, Human
gcugccuccccucuccuuccu

SEQ ID NO: 1949171 - RNA, 13 nt, Human
gcugccucaugcu

SEQ ID NO: 1949172 - RNA, 23 nt, Human
ggaaaucaccgaaaacguggcug

SEQ ID NO: 1949173 - RNA, 16 nt, Human
ggaaauccaggguggu

SEQ ID NO: 1949174 - RNA, 21 nt, Human
ggaagccagcaggcucucagg

SEQ ID NO: 1949175 - RNA, 23 nt, Human
ggaagccagcaggcucucaggcc

SEQ ID NO: 1949176 - RNA, 22 nt, Human
ggaagccagcaggcucucaggc

SEQ ID NO: 1949177 - RNA, 18 nt, Human
ggaagccgcuggggccag

SEQ ID NO: 1949178 - RNA, 21 nt, Human
ggacauccugucaucugagaa

SEQ ID NO: 1949179 - RNA, 20 nt, Human
ggacauccccugcuggccgg

SEQ ID NO: 1949180 - RNA, 14 nt, Human
ggacauggacaagg

SEQ ID NO: 1949181 - RNA, 13 nt, Human
ggacauggacaag

SEQ ID NO: 1949182 - RNA, 20 nt, Human
ggacauccccccgccaaaag

SEQ ID NO: 1949183 - RNA, 14 nt, Human
ggacaucagcuggu

SEQ ID NO: 1949184 - RNA, 14 nt, Human
ggacauccccugcu

SEQ ID NO: 1949185 - RNA, 22 nt, Human
ggacaguggagugcaaaaggcu

SEQ ID NO: 1949186 - RNA, 19 nt, Human
ggacaguauuuguggggag

SEQ ID NO: 1949187 - RNA, 15 nt, Human
ggacagggguuccuu

SEQ ID NO: 1949188 - RNA, 17 nt, Human
ggacaggggcaggagga

SEQ ID NO: 1949189 - RNA, 18 nt, Human
ggacaguauuugugggga

SEQ ID NO: 1949190 - RNA, 15 nt, Human
ggacagggcauggcc

SEQ ID NO: 1949191 - RNA, 22 nt, Human
ggacagggcauggccagguggc

SEQ ID NO: 1949192 - RNA, 17 nt, Human
ggacagggaggugaccc

SEQ ID NO: 1949193 - RNA, 23 nt, Human
ggacacccugugauggggcccug

SEQ ID NO: 1949194 - RNA, 13 nt, Human
ggacacccuguga

SEQ ID NO: 1949195 - RNA, 17 nt, Human
ggaagcucagggccugg

SEQ ID NO: 1949196 - RNA, 16 nt, Human
ggaagcucagggccug

SEQ ID NO: 1949197 - RNA, 15 nt, Human
ggaauaccugucccc

SEQ ID NO: 1949198 - RNA, 21 nt, Human
ggaagcucagggccuggcuca

SEQ ID NO: 1949199 - RNA, 22 nt, Human
ggaagcucagggccuggcucag

SEQ ID NO: 1949200 - RNA, 19 nt, Human
ggaauacucuuauaucuau

SEQ ID NO: 1949201 - RNA, 19 nt, Human
ggaauaccugucccccuga

SEQ ID NO: 1949202 - RNA, 16 nt, Human
ggaauaccuguccccc

SEQ ID NO: 1949203 - RNA, 16 nt, Human
ggaauauauaaccagu

SEQ ID NO: 1949204 - RNA, 17 nt, Human
ggaauaugggagaaaua

SEQ ID NO: 1949205 - RNA, 15 nt, Human
ggaauauuauauuug

SEQ ID NO: 1949206 - RNA, 19 nt, Human
ggaauauuauauuuggaug

SEQ ID NO: 1949207 - RNA, 12 nt, Human
ggacacagcucu

SEQ ID NO: 1949208 - RNA, 19 nt, Human
ggaaugaaugucaguguga

SEQ ID NO: 1949209 - RNA, 18 nt, Human
ggaaugaagcaaugcuuc

SEQ ID NO: 1949210 - RNA, 21 nt, Human
ggaauauuauauuuggaugca

SEQ ID NO: 1949211 - RNA, 12 nt, Human
ggacacccugug

SEQ ID NO: 1949212 - RNA, 13 nt, Human
ggacacagcucuu

SEQ ID NO: 1949213 - RNA, 14 nt, Human
gcuuuggaaguuuu

SEQ ID NO: 1949214 - RNA, 16 nt, Human
gcuuugccaugugcuu

SEQ ID NO: 1949215 - RNA, 21 nt, Human
gcuuggggaccagagcugcca

SEQ ID NO: 1949216 - RNA, 20 nt, Human
gcuuggggaccagagcugcc

SEQ ID NO: 1949217 - RNA, 18 nt, Human
gcuuggggaccagagcug

SEQ ID NO: 1949218 - RNA, 17 nt, Human
gcuuggggaccagagcu

SEQ ID NO: 1949219 - RNA, 22 nt, Human
gcuuggggaccagagcugccac

SEQ ID NO: 1949220 - RNA, 13 nt, Human
gcuuuccugugcc

SEQ ID NO: 1949221 - RNA, 13 nt, Human
gcuuucuacccag

SEQ ID NO: 1949222 - RNA, 14 nt, Human
gcuuuccugugcca

SEQ ID NO: 1949223 - RNA, 17 nt, Human
gcuuuccugugccaggu

SEQ ID NO: 1949224 - RNA, 18 nt, Human
gcuuuccugugccaggug

SEQ ID NO: 1949225 - RNA, 18 nt, Human
gcuuuccuguuucucagu

SEQ ID NO: 1949226 - RNA, 19 nt, Human
gcuuucuacccagcgagcc

SEQ ID NO: 1949227 - RNA, 22 nt, Human
gcuuucuacccagcgagcccug

SEQ ID NO: 1949228 - RNA, 13 nt, Human
gcuuugcacuuuu

SEQ ID NO: 1949229 - RNA, 23 nt, Human
gcuuucuacccagcgagcccugg

SEQ ID NO: 1949230 - RNA, 16 nt, Human
gcuuggggaccagagc

SEQ ID NO: 1949231 - RNA, 23 nt, Human
gcuugggcuucauccuccucaga

SEQ ID NO: 1949232 - RNA, 19 nt, Human
gcuugaccgugaggccaga

SEQ ID NO: 1949233 - RNA, 18 nt, Human
gcuugaccgugaggccag

SEQ ID NO: 1949234 - RNA, 17 nt, Human
gcuugaccgugaggcca

SEQ ID NO: 1949235 - RNA, 23 nt, Human
gcuucuucagagacuccugcagg

SEQ ID NO: 1949236 - RNA, 16 nt, Human
gcuugaccgugaggcc

SEQ ID NO: 1949237 - RNA, 21 nt, Human
gcuucuucagagacuccugca

SEQ ID NO: 1949238 - RNA, 19 nt, Human
gcuucuucagagacuccug

SEQ ID NO: 1949239 - RNA, 17 nt, Human
gcuuaacuucacauauu

SEQ ID NO: 1949240 - RNA, 17 nt, Human
gcuguuuggguuuccaa

SEQ ID NO: 1949241 - RNA, 12 nt, Human
gcuuaagaaaaa

SEQ ID NO: 1949242 - RNA, 13 nt, Human
gcuuaagaaaaaa

SEQ ID NO: 1949243 - RNA, 16 nt, Human
gcuucuucagagacuc

SEQ ID NO: 1949244 - RNA, 19 nt, Human
gcuguuuaucccuuaagaa

SEQ ID NO: 1949245 - RNA, 16 nt, Human
gcuuaacuucacauau

SEQ ID NO: 1949246 - RNA, 17 nt, Human
gcuuuucuuucuaccaa

SEQ ID NO: 1949247 - RNA, 15 nt, Human
gcuuuuccugggaca

SEQ ID NO: 1949248 - RNA, 22 nt, Human
gcuuuuccucaaagggagagag

SEQ ID NO: 1949249 - RNA, 21 nt, Human
gcuuuucccuuuuuuuaagua

SEQ ID NO: 1949250 - RNA, 20 nt, Human
gcuuuucccuuuuuuuaagu

SEQ ID NO: 1949251 - RNA, 14 nt, Human
ggaaagaggcucug

SEQ ID NO: 1949252 - RNA, 20 nt, Human
ggaaagacuuuuccaacccu

SEQ ID NO: 1949253 - RNA, 21 nt, Human
ggaaacuugauuugagauuuu

SEQ ID NO: 1949254 - RNA, 17 nt, Human
ggaaagaguaggaagac

SEQ ID NO: 1949255 - RNA, 16 nt, Human
ggaaagaguaggaaga

SEQ ID NO: 1949256 - RNA, 19 nt, Human
ggaaagcaaaggagauugg

SEQ ID NO: 1949257 - RNA, 14 nt, Human
ggaaagcauuuaaa

SEQ ID NO: 1949258 - RNA, 12 nt, Human
ggaaagcacaga

SEQ ID NO: 1949259 - RNA, 14 nt, Human
ggaaagcacagagg

SEQ ID NO: 1949260 - RNA, 21 nt, Human
ggaaagcacagaggccuccug

SEQ ID NO: 1949261 - RNA, 21 nt, Human
ggaaacuaggugcauauuuau

SEQ ID NO: 1949262 - RNA, 15 nt, Human
ggaaacccagcucug

SEQ ID NO: 1949263 - RNA, 13 nt, Human
ggaaacagaggcu

SEQ ID NO: 1949264 - RNA, 20 nt, Human
ggaaacagcuaaugggacac

SEQ ID NO: 1949265 - RNA, 14 nt, Human
gcuuuuguuuugcu

SEQ ID NO: 1949266 - RNA, 15 nt, Human
gcuuuuuaauauuga

SEQ ID NO: 1949267 - RNA, 13 nt, Human
gcuuuugugcauu

SEQ ID NO: 1949268 - RNA, 19 nt, Human
gcuuuugugcauuaucuag

SEQ ID NO: 1949269 - RNA, 16 nt, Human
ggaaaaaauaacaaug

SEQ ID NO: 1949270 - RNA, 20 nt, Human
gcuuuuuuugaaacuuugag

SEQ ID NO: 1949271 - RNA, 16 nt, Human
gcuuuuguuuugcuuu

SEQ ID NO: 1949272 - RNA, 21 nt, Human
gcuuuuuuugaaacuuugaga

SEQ ID NO: 1949273 - RNA, 20 nt, Human
gcuuuuuuuuuuuaauuuug

SEQ ID NO: 1949274 - RNA, 13 nt, Human
ggcucacugcagc

SEQ ID NO: 1949275 - RNA, 14 nt, Human
ggcucacugcagcc

SEQ ID NO: 1949276 - RNA, 15 nt, Human
ggcucacugcagccu

SEQ ID NO: 1949277 - RNA, 14 nt, Human
ggcugacugggcca

SEQ ID NO: 1949278 - RNA, 16 nt, Human
ggcugacugggccagg

SEQ ID NO: 1949279 - RNA, 12 nt, Human
ggcugcccuggu

SEQ ID NO: 1949280 - RNA, 10 nt, Human
ggcugcccuu

SEQ ID NO: 1949281 - RNA, 11 nt, Human
ggcugcccuuu

SEQ ID NO: 1949282 - RNA, 14 nt, Human
ggcugcccuuucug

SEQ ID NO: 1949283 - RNA, 18 nt, Human
ggcugcccuuucugggca

SEQ ID NO: 1949284 - RNA, 20 nt, Human
ggcucuugaacugagcuugg

SEQ ID NO: 1949285 - RNA, 18 nt, Human
ggcucuugaacugagcuu

SEQ ID NO: 1949286 - RNA, 19 nt, Human
ggcucuugaacugagcuug

SEQ ID NO: 1949287 - RNA, 12 nt, Human
ggcucuacacau

SEQ ID NO: 1949288 - RNA, 14 nt, Human
ggcucuacacauau

SEQ ID NO: 1949289 - RNA, 18 nt, Human
ggcucuuccaggcuggga

SEQ ID NO: 1949290 - RNA, 17 nt, Human
ggcucuuccaggcuggg

SEQ ID NO: 1949291 - RNA, 15 nt, Human
ggcucuuccaggcug

SEQ ID NO: 1949292 - RNA, 13 nt, Human
ggcucuaauuucc

SEQ ID NO: 1949293 - RNA, 14 nt, Human
ggcucuuccaggcu

SEQ ID NO: 1949294 - RNA, 13 nt, Human
ggcucccuuccca

SEQ ID NO: 1949295 - RNA, 21 nt, Human
ggcucccgccuccaaccccuc

SEQ ID NO: 1949296 - RNA, 15 nt, Human
ggcucccgccuccaa

SEQ ID NO: 1949297 - RNA, 17 nt, Human
ggcucccgccuccaacc

SEQ ID NO: 1949298 - RNA, 20 nt, Human
ggcucccgccuccaaccccu

SEQ ID NO: 1949299 - RNA, 18 nt, Human
ggcucccucacucucagg

SEQ ID NO: 1949300 - RNA, 19 nt, Human
ggcucccucacucucagga

SEQ ID NO: 1949301 - RNA, 22 nt, Human
ggcucccguguaucuggacacu

SEQ ID NO: 1949302 - RNA, 15 nt, Human
ggcucccucacucuc

SEQ ID NO: 1949303 - RNA, 16 nt, Human
ggcucccucacucuca

SEQ ID NO: 1949304 - RNA, 17 nt, Human
ggcucccucacucucag

SEQ ID NO: 1949305 - RNA, 15 nt, Human
ggcuggccuggcccc

SEQ ID NO: 1949306 - RNA, 14 nt, Human
ggcuggccuggccc

SEQ ID NO: 1949307 - RNA, 13 nt, Human
ggcuggccuggcc

SEQ ID NO: 1949308 - RNA, 17 nt, Human
ggcuggcccugcccugg

SEQ ID NO: 1949309 - RNA, 11 nt, Human
aaaaaaagaca

SEQ ID NO: 1949310 - RNA, 11 nt, Human
aaaaaaagaaa

SEQ ID NO: 1949311 - RNA, 10 nt, Human
aaaaaaagaa

SEQ ID NO: 1949312 - RNA, 9 nt, Human
aaaaaaaga

SEQ ID NO: 1949313 - RNA, 12 nt, Human
aaaaaaacucuu

SEQ ID NO: 1949314 - RNA, 11 nt, Human
aaaaaacucuu

SEQ ID NO: 1949315 - RNA, 9 nt, Human
aaaaaagaa

SEQ ID NO: 1949316 - RNA, 14 nt, Human
aaaaagcaguucuu

SEQ ID NO: 1949317 - RNA, 22 nt, Human
aaaaaacugcugacuguuuucu

SEQ ID NO: 1949318 - RNA, 13 nt, Human
aaaaaaaugcuga

SEQ ID NO: 1949319 - RNA, 12 nt, Human
aaaaaaaguugu

SEQ ID NO: 1949320 - RNA, 14 nt, Human
aaaaaggaggaaga

SEQ ID NO: 1949321 - RNA, 12 nt, Human
aaaaaggcagga

SEQ ID NO: 1949322 - RNA, 21 nt, Human
aaaaaggaugcacagaguugu

SEQ ID NO: 1949323 - RNA, 23 nt, Human
aaaaaguuguaugaucugugccu

SEQ ID NO: 1949324 - RNA, 21 nt, Human
aaaaaguuguaugaucugugc

SEQ ID NO: 1949325 - RNA, 14 nt, Human
aaaaauaaaaaaca

SEQ ID NO: 1949326 - RNA, 22 nt, Human
ggcuggguucuacccaggugcu

SEQ ID NO: 1949327 - RNA, 14 nt, Human
ggcuggguuggagg

SEQ ID NO: 1949328 - RNA, 13 nt, Human
aaaaauacaaaaa

SEQ ID NO: 1949329 - RNA, 20 nt, Human
aaaaaggcuuauaaaacaga

SEQ ID NO: 1949330 - RNA, 17 nt, Human
ggccucccacagacuca

SEQ ID NO: 1949331 - RNA, 19 nt, Human
ggccccugccucucugcag

SEQ ID NO: 1949332 - RNA, 18 nt, Human
ggccccugccucucugca

SEQ ID NO: 1949333 - RNA, 17 nt, Human
ggccccugccucucugc

SEQ ID NO: 1949334 - RNA, 13 nt, Human
ggccccugccucu

SEQ ID NO: 1949335 - RNA, 21 nt, Human
ggccccugccucucugcaggu

SEQ ID NO: 1949336 - RNA, 22 nt, Human
ggccagagggagugacagaggc

SEQ ID NO: 1949337 - RNA, 15 nt, Human
ggccagaugcaccag

SEQ ID NO: 1949338 - RNA, 16 nt, Human
ggccagaugcaccagc

SEQ ID NO: 1949339 - RNA, 22 nt, Human
ggccucccaacucaccccagcc

SEQ ID NO: 1949340 - RNA, 20 nt, Human
ggccucccaacucaccccag

SEQ ID NO: 1949341 - RNA, 16 nt, Human
ggccucccacagacuc

SEQ ID NO: 1949342 - RNA, 14 nt, Human
ggccucccacagac

SEQ ID NO: 1949343 - RNA, 23 nt, Human
ggccucccaacucaccccagccc

SEQ ID NO: 1949344 - RNA, 19 nt, Human
ggccucccaacucacccca

SEQ ID NO: 1949345 - RNA, 18 nt, Human
ggccucccaacucacccc

SEQ ID NO: 1949346 - RNA, 17 nt, Human
ggccucccaacucaccc

SEQ ID NO: 1949347 - RNA, 13 nt, Human
ggccucagugcca

SEQ ID NO: 1949348 - RNA, 16 nt, Human
ggccgcgggggcaggg

SEQ ID NO: 1949349 - RNA, 22 nt, Human
ggccgccggcaauaaaagccca

SEQ ID NO: 1949350 - RNA, 23 nt, Human
ggccgccggcaauaaaagcccag

SEQ ID NO: 1949351 - RNA, 16 nt, Human
ggccugcaagggagug

SEQ ID NO: 1949352 - RNA, 11 nt, Human
ggccugccugu

SEQ ID NO: 1949353 - RNA, 16 nt, Human
ggccuggccagaugca

SEQ ID NO: 1949354 - RNA, 17 nt, Human
ggccuucagggagugag

SEQ ID NO: 1949355 - RNA, 12 nt, Human
ggccuggccaga

SEQ ID NO: 1949356 - RNA, 15 nt, Human
ggccuggccagaugc

SEQ ID NO: 1949357 - RNA, 14 nt, Human
ggccuggcagccgu

SEQ ID NO: 1949358 - RNA, 15 nt, Human
ggccuggcagccgug

SEQ ID NO: 1949359 - RNA, 16 nt, Human
ggcuagagguucaaag

SEQ ID NO: 1949360 - RNA, 15 nt, Human
ggcuacuugcuuuga

SEQ ID NO: 1949361 - RNA, 14 nt, Human
ggcuaccuuuguau

SEQ ID NO: 1949362 - RNA, 13 nt, Human
ggcuaccuuugua

SEQ ID NO: 1949363 - RNA, 17 nt, Human
ggcuacccgugagcccu

SEQ ID NO: 1949364 - RNA, 22 nt, Human
ggcuacaccuuagccugcccuc

SEQ ID NO: 1949365 - RNA, 23 nt, Human
ggcuacaccuuagccugcccucc

SEQ ID NO: 1949366 - RNA, 16 nt, Human
ggcuaauguacugcau

SEQ ID NO: 1949367 - RNA, 20 nt, Human
ggcuaagugauccucccacc

SEQ ID NO: 1949368 - RNA, 18 nt, Human
ggcuaauuuuuguuuugu

SEQ ID NO: 1949369 - RNA, 18 nt, Human
ggccuucggccuccaucc

SEQ ID NO: 1949370 - RNA, 22 nt, Human
ggccuucggccuccauccugag

SEQ ID NO: 1949371 - RNA, 16 nt, Human
ggccuucggccuccau

SEQ ID NO: 1949372 - RNA, 18 nt, Human
ggcgaggacgacuucugc

SEQ ID NO: 1949373 - RNA, 14 nt, Human
ggcgugagaccugc

SEQ ID NO: 1949374 - RNA, 16 nt, Human
ggcgugagaccugccc

SEQ ID NO: 1949375 - RNA, 17 nt, Human
ggcgugagaccugcccc

SEQ ID NO: 1949376 - RNA, 18 nt, Human
ggcgugagaccugccccu

SEQ ID NO: 1949377 - RNA, 18 nt, Human
ggcuaaaauguuuucagc

SEQ ID NO: 1949378 - RNA, 20 nt, Human
ggcuaagcuucacuguaaaa

SEQ ID NO: 1949379 - RNA, 18 nt, Human
ggcacaccgggcacucag

SEQ ID NO: 1949380 - RNA, 16 nt, Human
ggcacaccuccuccca

SEQ ID NO: 1949381 - RNA, 17 nt, Human
ggcacaccuccucccac

SEQ ID NO: 1949382 - RNA, 20 nt, Human
ggcacaccuccucccacugc

SEQ ID NO: 1949383 - RNA, 21 nt, Human
ggcacaccuccucccacugcc

SEQ ID NO: 1949384 - RNA, 22 nt, Human
ggcacaccuccucccacugccc

SEQ ID NO: 1949385 - RNA, 16 nt, Human
ggcacugcuuccagug

SEQ ID NO: 1949386 - RNA, 11 nt, Human
ggcacugcucu

SEQ ID NO: 1949387 - RNA, 18 nt, Human
ggcacacgcugcucugcc

SEQ ID NO: 1949388 - RNA, 20 nt, Human
ggcacacgcugcucugcccc

SEQ ID NO: 1949389 - RNA, 21 nt, Human
ggcacacgcugcucugcccca

SEQ ID NO: 1949390 - RNA, 22 nt, Human
ggcacacgcugcucugccccag

SEQ ID NO: 1949391 - RNA, 18 nt, Human
ggcacaucagcacgauuu

SEQ ID NO: 1949392 - RNA, 11 nt, Human
ggcaaaaacaa

SEQ ID NO: 1949393 - RNA, 13 nt, Human
ggcaaaaacaaag

SEQ ID NO: 1949394 - RNA, 15 nt, Human
ggcaaaaaggcagga

SEQ ID NO: 1949395 - RNA, 13 nt, Human
ggcagccaggcca

SEQ ID NO: 1949396 - RNA, 20 nt, Human
ggcacugcuuccagugaggc

SEQ ID NO: 1949397 - RNA, 22 nt, Human
ggcacugcuuccagugaggcuc

SEQ ID NO: 1949398 - RNA, 22 nt, Human
ggcagccccauucugccugccc

SEQ ID NO: 1949399 - RNA, 23 nt, Human
ggcagccucugggcccacauccg

SEQ ID NO: 1949400 - RNA, 16 nt, Human
ggcagccucuucaaaa

SEQ ID NO: 1949401 - RNA, 13 nt, Human
ggcagccugagag

SEQ ID NO: 1949402 - RNA, 14 nt, Human
ggcagccugagagu

SEQ ID NO: 1949403 - RNA, 19 nt, Human
ggcagccugccuugcccac

SEQ ID NO: 1949404 - RNA, 23 nt, Human
ggcagccugccuugcccacuccu

SEQ ID NO: 1949405 - RNA, 16 nt, Human
ggcagccccauucugc

SEQ ID NO: 1949406 - RNA, 20 nt, Human
ggcagccccauucugccugc

SEQ ID NO: 1949407 - RNA, 21 nt, Human
ggcagccccauucugccugcc

SEQ ID NO: 1949408 - RNA, 10 nt, Human
ggcagggagg

SEQ ID NO: 1949409 - RNA, 17 nt, Human
ggcagggagggccuggg

SEQ ID NO: 1949410 - RNA, 18 nt, Human
ggcagggagggccugggc

SEQ ID NO: 1949411 - RNA, 19 nt, Human
ggcagggagggccugggcc

SEQ ID NO: 1949412 - RNA, 20 nt, Human
ggcagggagggccugggccc

SEQ ID NO: 1949413 - RNA, 16 nt, Human
ggcagggacagggccg

SEQ ID NO: 1949414 - RNA, 14 nt, Human
ggcagggcacaggg

SEQ ID NO: 1949415 - RNA, 15 nt, Human
ggcagggcacagggc

SEQ ID NO: 1949416 - RNA, 16 nt, Human
ggcagggcacagggcc

SEQ ID NO: 1949417 - RNA, 17 nt, Human
ggcagggcacagggccu

SEQ ID NO: 1949418 - RNA, 19 nt, Human
ggcaggggcccugcagcuc

SEQ ID NO: 1949419 - RNA, 20 nt, Human
ggcaggggcccugcagcucu

SEQ ID NO: 1949420 - RNA, 21 nt, Human
ggcaggggcccugcagcucuc

SEQ ID NO: 1949421 - RNA, 15 nt, Human
ggcagggcaggacca

SEQ ID NO: 1949422 - RNA, 16 nt, Human
ggcagggcaggaccag

SEQ ID NO: 1949423 - RNA, 18 nt, Human
ggcagggcacagggccug

SEQ ID NO: 1949424 - RNA, 19 nt, Human
ggcagggcacagggccugg

SEQ ID NO: 1949425 - RNA, 22 nt, Human
ggcagggcacagggccuggccc

SEQ ID NO: 1949426 - RNA, 23 nt, Human
ggcagggcacagggccuggccca

SEQ ID NO: 1949427 - RNA, 19 nt, Human
ggcaggggaggccaucugg

SEQ ID NO: 1949428 - RNA, 20 nt, Human
ggcaggggaggccaucugga

SEQ ID NO: 1949429 - RNA, 18 nt, Human
ggcaggaggaucacuuga

SEQ ID NO: 1949430 - RNA, 14 nt, Human
ggcauuugcugaau

SEQ ID NO: 1949431 - RNA, 15 nt, Human
ggcauuugcaauaaa

SEQ ID NO: 1949432 - RNA, 20 nt, Human
ggcaucgcaauguaagacuc

SEQ ID NO: 1949433 - RNA, 12 nt, Human
ggcaucauucca

SEQ ID NO: 1949434 - RNA, 15 nt, Human
ggcauccacuucaca

SEQ ID NO: 1949435 - RNA, 19 nt, Human
ggccaaaggaagcacaugc

SEQ ID NO: 1949436 - RNA, 17 nt, Human
ggcauuuguuucuuucu

SEQ ID NO: 1949437 - RNA, 23 nt, Human
ggcauuuguuucuuucucugagg

SEQ ID NO: 1949438 - RNA, 23 nt, Human
ggccaagagguuuggcuccugcc

SEQ ID NO: 1949439 - RNA, 14 nt, Human
ggccaagaguggcc

SEQ ID NO: 1949440 - RNA, 17 nt, Human
ggccaagaguggcccca

SEQ ID NO: 1949441 - RNA, 19 nt, Human
ggccaagaguggccccacc

SEQ ID NO: 1949442 - RNA, 16 nt, Human
ggccaaaggaagcaca

SEQ ID NO: 1949443 - RNA, 14 nt, Human
ggccaaaggaagca

SEQ ID NO: 1949444 - RNA, 17 nt, Human
ggcauuuguuugaacug

SEQ ID NO: 1949445 - RNA, 13 nt, Human
ggccaaaggaagc

SEQ ID NO: 1949446 - RNA, 17 nt, Human
ggccagagacacaagcc

SEQ ID NO: 1949447 - RNA, 20 nt, Human
ggccaagaguggccccaccu

SEQ ID NO: 1949448 - RNA, 21 nt, Human
ggccaagaguggccccaccug

SEQ ID NO: 1949449 - RNA, 22 nt, Human
ggccaagaguggccccaccugg

SEQ ID NO: 1949450 - RNA, 17 nt, Human
ggccagagggagugaca

SEQ ID NO: 1949451 - RNA, 19 nt, Human
ggccagagggagugacaga

SEQ ID NO: 1949452 - RNA, 18 nt, Human
ggccagagacacaagccu

SEQ ID NO: 1949453 - RNA, 14 nt, Human
ggagguggcauccc

SEQ ID NO: 1949454 - RNA, 23 nt, Human
ggaggugggauccuccaggugca

SEQ ID NO: 1949455 - RNA, 22 nt, Human
ggaggugggauccuccaggugc

SEQ ID NO: 1949456 - RNA, 21 nt, Human
ggagggugacgggggugaacu

SEQ ID NO: 1949457 - RNA, 22 nt, Human
ggagguaaggaauaccuguccc

SEQ ID NO: 1949458 - RNA, 14 nt, Human
ggaggggggaggug

SEQ ID NO: 1949459 - RNA, 13 nt, Human
ggaggggggaggu

SEQ ID NO: 1949460 - RNA, 13 nt, Human
ggagggggcaaag

SEQ ID NO: 1949461 - RNA, 15 nt, Human
ggaggcucuggagcc

SEQ ID NO: 1949462 - RNA, 15 nt, Human
ggaggcuccaggcag

SEQ ID NO: 1949463 - RNA, 16 nt, Human
ggaggcuccaggcagc

SEQ ID NO: 1949464 - RNA, 15 nt, Human
ggaguggccacagaa

SEQ ID NO: 1949465 - RNA, 22 nt, Human
ggagugggcccaaugcacuuug

SEQ ID NO: 1949466 - RNA, 12 nt, Human
ggagugggccca

SEQ ID NO: 1949467 - RNA, 16 nt, Human
ggaguggccacagaaa

SEQ ID NO: 1949468 - RNA, 17 nt, Human
ggagugggucuggagga

SEQ ID NO: 1949469 - RNA, 22 nt, Human
ggaguguguaauuuaaaauugu

SEQ ID NO: 1949470 - RNA, 11 nt, Human
ggaguguguaa

SEQ ID NO: 1949471 - RNA, 14 nt, Human
ggaugaaaaaauaa

SEQ ID NO: 1949472 - RNA, 13 nt, Human
ggauuguccccga

SEQ ID NO: 1949473 - RNA, 14 nt, Human
ggauuguaguccca

SEQ ID NO: 1949474 - RNA, 22 nt, Human
ggauuuaacagaaauguacagc

SEQ ID NO: 1949475 - RNA, 16 nt, Human
ggauuuaacagaaaug

SEQ ID NO: 1949476 - RNA, 17 nt, Human
ggauuuaacagaaaugu

SEQ ID NO: 1949477 - RNA, 20 nt, Human
ggauuguccccgacccuugc

SEQ ID NO: 1949478 - RNA, 16 nt, Human
ggauuguccccgaccc

SEQ ID NO: 1949479 - RNA, 15 nt, Human
ggaugguguucaaaa

SEQ ID NO: 1949480 - RNA, 23 nt, Human
ggauugugccuaauguguuugag

SEQ ID NO: 1949481 - RNA, 12 nt, Human
ggauuuaacaga

SEQ ID NO: 1949482 - RNA, 23 nt, Human
ggauccugagccagauuucacuc

SEQ ID NO: 1949483 - RNA, 20 nt, Human
ggauccugagccagauuuca

SEQ ID NO: 1949484 - RNA, 19 nt, Human
ggauccugagccagauuuc

SEQ ID NO: 1949485 - RNA, 18 nt, Human
ggauccugagccagauuu

SEQ ID NO: 1949486 - RNA, 16 nt, Human
ggauccugagccagau

SEQ ID NO: 1949487 - RNA, 15 nt, Human
ggauccugagccaga

SEQ ID NO: 1949488 - RNA, 16 nt, Human
ggaguucaucuugaau

SEQ ID NO: 1949489 - RNA, 19 nt, Human
ggaguucauucauauuaca

SEQ ID NO: 1949490 - RNA, 20 nt, Human
ggaguucauucauauuacaa

SEQ ID NO: 1949491 - RNA, 20 nt, Human
ggauccugcacugacucugg

SEQ ID NO: 1949492 - RNA, 18 nt, Human
ggaucucuugagccuggg

SEQ ID NO: 1949493 - RNA, 21 nt, Human
aaagugggcccucauacacaa

SEQ ID NO: 1949494 - RNA, 14 nt, Human
aaaguguauuuuuu

SEQ ID NO: 1949495 - RNA, 21 nt, Human
aaaguguauuuuuuuacuaau

SEQ ID NO: 1949496 - RNA, 19 nt, Human
aaaguacacuguuucaaac

SEQ ID NO: 1949497 - RNA, 15 nt, Human
aaaguagaacuuugu

SEQ ID NO: 1949498 - RNA, 18 nt, Human
aaaguacacuguuucaaa

SEQ ID NO: 1949499 - RNA, 15 nt, Human
aaaguaauauuuauu

SEQ ID NO: 1949500 - RNA, 18 nt, Human
aaaguaauauuuauuaaa

SEQ ID NO: 1949501 - RNA, 22 nt, Human
aaaguagaagucuuagauguau

SEQ ID NO: 1949502 - RNA, 20 nt, Human
aaaguagaagucuuagaugu

SEQ ID NO: 1949503 - RNA, 21 nt, Human
aaaguaucccuacuguaauuu

SEQ ID NO: 1949504 - RNA, 16 nt, Human
aaaguagaacuuugua

SEQ ID NO: 1949505 - RNA, 17 nt, Human
aaaguagaacuuuguau

SEQ ID NO: 1949506 - RNA, 18 nt, Human
aaaguagaacuuuguaua

SEQ ID NO: 1949507 - RNA, 21 nt, Human
aaaguagaacuuuguauaguu

SEQ ID NO: 1949508 - RNA, 23 nt, Human
aaaguagaacuuuguauaguuau

SEQ ID NO: 1949509 - RNA, 15 nt, Human
gguuucagaaaugug

SEQ ID NO: 1949510 - RNA, 18 nt, Human
gguuuccaacaauucagc

SEQ ID NO: 1949511 - RNA, 12 nt, Human
gguuuccugccc

SEQ ID NO: 1949512 - RNA, 20 nt, Human
gguuuccaacaauucagcau

SEQ ID NO: 1949513 - RNA, 13 nt, Human
gguuuccugcccu

SEQ ID NO: 1949514 - RNA, 15 nt, Human
gguuuccugcccugg

SEQ ID NO: 1949515 - RNA, 16 nt, Human
gguuucuaaagcugcc

SEQ ID NO: 1949516 - RNA, 16 nt, Human
gguuuccugcccuggg

SEQ ID NO: 1949517 - RNA, 19 nt, Human
gguuuccugcccugggagg

SEQ ID NO: 1949518 - RNA, 22 nt, Human
gguuucuaaagcugccagccga

SEQ ID NO: 1949519 - RNA, 14 nt, Human
gguuugggaccccu

SEQ ID NO: 1949520 - RNA, 17 nt, Human
gguuuucacauuggaaa

SEQ ID NO: 1949521 - RNA, 11 nt, Human
gguuuuaugau

SEQ ID NO: 1949522 - RNA, 17 nt, Human
gguuuuauuuauuucuu

SEQ ID NO: 1949523 - RNA, 22 nt, Human
gguuuguuuagaagaagugugu

SEQ ID NO: 1949524 - RNA, 12 nt, Human
gguuuuaaaaua

SEQ ID NO: 1949525 - RNA, 20 nt, Human
gguuuuaaaauacuguagau

SEQ ID NO: 1949526 - RNA, 20 nt, Human
gguuuguaaauuaacuuuua

SEQ ID NO: 1949527 - RNA, 19 nt, Human
gguuugguuuuguuuuuug

SEQ ID NO: 1949528 - RNA, 12 nt, Human
gguguggagaag

SEQ ID NO: 1949529 - RNA, 15 nt, Human
ggugggggggcagag

SEQ ID NO: 1949530 - RNA, 19 nt, Human
ggugggggggcagagcccu

SEQ ID NO: 1949531 - RNA, 23 nt, Human
gguguggagaagcggcuggcagc

SEQ ID NO: 1949532 - RNA, 14 nt, Human
gguguggagaagcg

SEQ ID NO: 1949533 - RNA, 16 nt, Human
gguggggggcuucaua

SEQ ID NO: 1949534 - RNA, 18 nt, Human
gguggggggcuucauaca

SEQ ID NO: 1949535 - RNA, 13 nt, Human
ggugggggccucg

SEQ ID NO: 1949536 - RNA, 22 nt, Human
ggugggcuugucauagccagug

SEQ ID NO: 1949537 - RNA, 23 nt, Human
gguguuccgaaaccaaagaagaa

SEQ ID NO: 1949538 - RNA, 13 nt, Human
ggugugggggaag

SEQ ID NO: 1949539 - RNA, 11 nt, Human
gguguggggga

SEQ ID NO: 1949540 - RNA, 23 nt, Human
ggugugggggccccgucucaggu

SEQ ID NO: 1949541 - RNA, 15 nt, Human
ggugugggggccccg

SEQ ID NO: 1949542 - RNA, 17 nt, Human
gguguuuccuggcacug

SEQ ID NO: 1949543 - RNA, 19 nt, Human
gguguuuccuggcacugcu

SEQ ID NO: 1949544 - RNA, 15 nt, Human
gguuccagccugcca

SEQ ID NO: 1949545 - RNA, 16 nt, Human
gguuccagccugccac

SEQ ID NO: 1949546 - RNA, 13 nt, Human
gguguuugaaaau

SEQ ID NO: 1949547 - RNA, 14 nt, Human
gguguuugaaaaua

SEQ ID NO: 1949548 - RNA, 14 nt, Human
gguuccagccugcc

SEQ ID NO: 1949549 - RNA, 20 nt, Human
gguguuugaaaauaguuuau

SEQ ID NO: 1949550 - RNA, 17 nt, Human
gguucccauuugcuccu

SEQ ID NO: 1949551 - RNA, 16 nt, Human
gguuccuucugggcau

SEQ ID NO: 1949552 - RNA, 23 nt, Human
gguucccuuugacgccaucccag

SEQ ID NO: 1949553 - RNA, 22 nt, Human
gguucccuuuuuuggcugcuga

SEQ ID NO: 1949554 - RNA, 20 nt, Human
ggugggaggaucucuugagc

SEQ ID NO: 1949555 - RNA, 17 nt, Human
ggugggacacccuguga

SEQ ID NO: 1949556 - RNA, 16 nt, Human
ggugggacacccugug

SEQ ID NO: 1949557 - RNA, 13 nt, Human
ggugggacacccu

SEQ ID NO: 1949558 - RNA, 19 nt, Human
gguggggaccucaggccug

SEQ ID NO: 1949559 - RNA, 21 nt, Human
aaaguaaaaacaaagaaauua

SEQ ID NO: 1949560 - RNA, 15 nt, Human
aaaguaaaagcagca

SEQ ID NO: 1949561 - RNA, 19 nt, Human
aaaguaaaagcagcauaaa

SEQ ID NO: 1949562 - RNA, 18 nt, Human
gguggcuggguuggaggg

SEQ ID NO: 1949563 - RNA, 12 nt, Human
gguggcuggguu

SEQ ID NO: 1949564 - RNA, 14 nt, Human
aaaggugauaaaau

SEQ ID NO: 1949565 - RNA, 17 nt, Human
aaaggugauaaaaucau

SEQ ID NO: 1949566 - RNA, 18 nt, Human
aaaggugauaaaaucaua

SEQ ID NO: 1949567 - RNA, 13 nt, Human
aaaggugauaaaa

SEQ ID NO: 1949568 - RNA, 16 nt, Human
aaagguucuuugugua

SEQ ID NO: 1949569 - RNA, 13 nt, Human
aaaggugugcugu

SEQ ID NO: 1949570 - RNA, 18 nt, Human
aaagguucaugcaaacuu

SEQ ID NO: 1949571 - RNA, 20 nt, Human
aaagggcccagagagggugg

SEQ ID NO: 1949572 - RNA, 14 nt, Human
aaagcuguucuucc

SEQ ID NO: 1949573 - RNA, 16 nt, Human
aaagcuguucuuccug

SEQ ID NO: 1949574 - RNA, 17 nt, Human
aaagcuguucuuccugg

SEQ ID NO: 1949575 - RNA, 12 nt, Human
aaacuuuaugcu

SEQ ID NO: 1949576 - RNA, 19 nt, Human
aaacuuuaugcuaagugaa

SEQ ID NO: 1949577 - RNA, 20 nt, Human
ggugcugcuaauucuuugca

SEQ ID NO: 1949578 - RNA, 22 nt, Human
ggugcugcuaauucuuugcaaa

SEQ ID NO: 1949579 - RNA, 16 nt, Human
aaagcagaacagugau

SEQ ID NO: 1949580 - RNA, 20 nt, Human
gguggcaccagcagccugga

SEQ ID NO: 1949581 - RNA, 14 nt, Human
gguggcaccagcag

SEQ ID NO: 1949582 - RNA, 14 nt, Human
gguggagaaaggag

SEQ ID NO: 1949583 - RNA, 13 nt, Human
aaagcuguucuuc

SEQ ID NO: 1949584 - RNA, 14 nt, Human
aaagcuguguggca

SEQ ID NO: 1949585 - RNA, 22 nt, Human
aaagcugccagccgagauagcc

SEQ ID NO: 1949586 - RNA, 13 nt, Human
aaagcugccagcc

SEQ ID NO: 1949587 - RNA, 12 nt, Human
aaagcugccagc

SEQ ID NO: 1949588 - RNA, 17 nt, Human
aaagcuaggccuggcca

SEQ ID NO: 1949589 - RNA, 19 nt, Human
aaagcuagaacacugccaa

SEQ ID NO: 1949590 - RNA, 23 nt, Human
aaagcugaacacauuucuuuuua

SEQ ID NO: 1949591 - RNA, 16 nt, Human
aaagcagugcaugcug

SEQ ID NO: 1949592 - RNA, 13 nt, Human
aaagcagugcaug

SEQ ID NO: 1949593 - RNA, 14 nt, Human
aaagcuaggccugg

SEQ ID NO: 1949594 - RNA, 16 nt, Human
aaagcuaggccuggcc

SEQ ID NO: 1949595 - RNA, 21 nt, Human
aaauaucuaguaauauauuua

SEQ ID NO: 1949596 - RNA, 23 nt, Human
aaauaucuguaagaguguuuaua

SEQ ID NO: 1949597 - RNA, 23 nt, Human
aaauaucugaaaauguaugugua

SEQ ID NO: 1949598 - RNA, 22 nt, Human
aaauaucugaaaauguaugugu

SEQ ID NO: 1949599 - RNA, 21 nt, Human
aaauaucugaaaauguaugug

SEQ ID NO: 1949600 - RNA, 19 nt, Human
aaauaucugaaaauguaug

SEQ ID NO: 1949601 - RNA, 18 nt, Human
aaauaucugaaaauguau

SEQ ID NO: 1949602 - RNA, 17 nt, Human
aaauaucugaaaaugua

SEQ ID NO: 1949603 - RNA, 14 nt, Human
aaauaucugaaaau

SEQ ID NO: 1949604 - RNA, 12 nt, Human
aaauaucugaaa

SEQ ID NO: 1949605 - RNA, 13 nt, Human
aaauaugcacuaa

SEQ ID NO: 1949606 - RNA, 16 nt, Human
aaauaugcacuaaguc

SEQ ID NO: 1949607 - RNA, 19 nt, Human
aaauaugcacuaagucucu

SEQ ID NO: 1949608 - RNA, 21 nt, Human
aaauaugcacuaagucucuuu

SEQ ID NO: 1949609 - RNA, 19 nt, Human
aaauauggucuuuugguua

SEQ ID NO: 1949610 - RNA, 12 nt, Human
aaauauguauua

SEQ ID NO: 1949611 - RNA, 13 nt, Human
aaauauguauuaa

SEQ ID NO: 1949612 - RNA, 18 nt, Human
aaauaugucccagaaaug

SEQ ID NO: 1949613 - RNA, 12 nt, Human
aaauaugugaag

SEQ ID NO: 1949614 - RNA, 15 nt, Human
aaauaugugaaggac

SEQ ID NO: 1949615 - RNA, 20 nt, Human
aaauaugugaaggaccuuca

SEQ ID NO: 1949616 - RNA, 23 nt, Human
aaaucagccugcuccagcuguuc

SEQ ID NO: 1949617 - RNA, 21 nt, Human
aaaucagccugcuccagcugu

SEQ ID NO: 1949618 - RNA, 19 nt, Human
aaaucagccugcuccagcu

SEQ ID NO: 1949619 - RNA, 21 nt, Human
aaauauugaaaggcaaacauu

SEQ ID NO: 1949620 - RNA, 23 nt, Human
aaauauucuucuauaaaugaauc

SEQ ID NO: 1949621 - RNA, 19 nt, Human
aaauauuaagaaagacuau

SEQ ID NO: 1949622 - RNA, 12 nt, Human
aaauauuaaaaa

SEQ ID NO: 1949623 - RNA, 14 nt, Human
aaauauuaaaaagu

SEQ ID NO: 1949624 - RNA, 17 nt, Human
aaauauuaaaaagucuu

SEQ ID NO: 1949625 - RNA, 20 nt, Human
aaauauuccugcauuuguga

SEQ ID NO: 1949626 - RNA, 22 nt, Human
aaauauuaaaaagucuuuuaaa

SEQ ID NO: 1949627 - RNA, 20 nt, Human
aaauacgugggcauucaaau

SEQ ID NO: 1949628 - RNA, 21 nt, Human
aaauacgugggcauucaaaug

SEQ ID NO: 1949629 - RNA, 15 nt, Human
aaauaccauuauuau

SEQ ID NO: 1949630 - RNA, 17 nt, Human
aaauaccauuauuauca

SEQ ID NO: 1949631 - RNA, 15 nt, Human
aaauauaggaacuua

SEQ ID NO: 1949632 - RNA, 20 nt, Human
aaauaccagccaguaaaugg

SEQ ID NO: 1949633 - RNA, 21 nt, Human
aaauaccagccaguaaauggg

SEQ ID NO: 1949634 - RNA, 22 nt, Human
guacaaugugacuuugaaaaua

SEQ ID NO: 1949635 - RNA, 19 nt, Human
aaauaccagccaguaaaug

SEQ ID NO: 1949636 - RNA, 16 nt, Human
guacacacacauacac

SEQ ID NO: 1949637 - RNA, 21 nt, Human
guacaaugacuuuauugcauc

SEQ ID NO: 1949638 - RNA, 20 nt, Human
guacaaugacuuuauugcau

SEQ ID NO: 1949639 - RNA, 14 nt, Human
aaauauauaucaaa

SEQ ID NO: 1949640 - RNA, 18 nt, Human
aaauauaugcuaagucuu

SEQ ID NO: 1949641 - RNA, 20 nt, Human
aaauauauggucuaauguuu

SEQ ID NO: 1949642 - RNA, 21 nt, Human
aaauauauggucuaauguuua

SEQ ID NO: 1949643 - RNA, 22 nt, Human
aaauauauggucuaauguuuaa

SEQ ID NO: 1949644 - RNA, 22 nt, Human
aaauauauuuuaagacgaaaca

SEQ ID NO: 1949645 - RNA, 16 nt, Human
aaauauauuuuaagac

SEQ ID NO: 1949646 - RNA, 12 nt, Human
aaauaucaaauu

SEQ ID NO: 1949647 - RNA, 13 nt, Human
aaauaucaaauua

SEQ ID NO: 1949648 - RNA, 16 nt, Human
aaauaucaaauuaauu

SEQ ID NO: 1949649 - RNA, 20 nt, Human
aaauaucaaauuaauugugu

SEQ ID NO: 1949650 - RNA, 19 nt, Human
aaauaucuaguaauauauu

SEQ ID NO: 1949651 - RNA, 20 nt, Human
aaauaucuaguaauauauuu

SEQ ID NO: 1949652 - RNA, 22 nt, Human
aaauaucccuuggacauuuuau

SEQ ID NO: 1949653 - RNA, 23 nt, Human
aaauaucccuuggacauuuuaug

SEQ ID NO: 1949654 - RNA, 21 nt, Human
aaauaucauauaaauauugag

SEQ ID NO: 1949655 - RNA, 23 nt, Human
aaauaucaaauuaauugugugaa

SEQ ID NO: 1949656 - RNA, 19 nt, Human
guaacaggaaaauuuuaaa

SEQ ID NO: 1949657 - RNA, 16 nt, Human
guaacaagccacccca

SEQ ID NO: 1949658 - RNA, 20 nt, Human
guaacaggaaaauuuuaaaa

SEQ ID NO: 1949659 - RNA, 17 nt, Human
guaacauucuauuucaa

SEQ ID NO: 1949660 - RNA, 11 nt, Human
guaaacacugu

SEQ ID NO: 1949661 - RNA, 13 nt, Human
guaaaccuuuuau

SEQ ID NO: 1949662 - RNA, 13 nt, Human
guaaaauuuuagg

SEQ ID NO: 1949663 - RNA, 13 nt, Human
aaauaauucuuuu

SEQ ID NO: 1949664 - RNA, 14 nt, Human
aaauaauucuuuuu

SEQ ID NO: 1949665 - RNA, 18 nt, Human
aaauaauucuuuuuuauu

SEQ ID NO: 1949666 - RNA, 19 nt, Human
aaauaauucuuuuuuauua

SEQ ID NO: 1949667 - RNA, 21 nt, Human
aaauaauucuuuuuuauuaau

SEQ ID NO: 1949668 - RNA, 22 nt, Human
aaaguguauuuuuuuacuaaua

SEQ ID NO: 1949669 - RNA, 20 nt, Human
aaaguguucuguuacaaaau

SEQ ID NO: 1949670 - RNA, 22 nt, Human
aaauaaugugaaacuggauuaa

SEQ ID NO: 1949671 - RNA, 14 nt, Human
aaauaaugugaaac

SEQ ID NO: 1949672 - RNA, 22 nt, Human
aaaguuaacaggcaaacauuuu

SEQ ID NO: 1949673 - RNA, 20 nt, Human
aaaguuaaacgugaugugcu

SEQ ID NO: 1949674 - RNA, 13 nt, Human
guaacuaaaauaa

SEQ ID NO: 1949675 - RNA, 15 nt, Human
guaacuaaaauaauu

SEQ ID NO: 1949676 - RNA, 20 nt, Human
guaacuaaaauaauuuugua

SEQ ID NO: 1949677 - RNA, 22 nt, Human
guaacuaaaauaauuuuguaau

SEQ ID NO: 1949678 - RNA, 18 nt, Human
guaacgugugcuguguuu

SEQ ID NO: 1949679 - RNA, 14 nt, Human
guaacuauguuuua

SEQ ID NO: 1949680 - RNA, 12 nt, Human
guaauaauaaag

SEQ ID NO: 1949681 - RNA, 16 nt, Human
guaauaauaaagaaua

SEQ ID NO: 1949682 - RNA, 18 nt, Human
guaauaagggaaaaauca

SEQ ID NO: 1949683 - RNA, 19 nt, Human
guaauaagggaaaaaucaa

SEQ ID NO: 1949684 - RNA, 13 nt, Human
guaauauuuauua

SEQ ID NO: 1949685 - RNA, 14 nt, Human
guaauauuuauuaa

SEQ ID NO: 1949686 - RNA, 15 nt, Human
guaauauuuauuaaa

SEQ ID NO: 1949687 - RNA, 16 nt, Human
guaauauuuauuaaau

SEQ ID NO: 1949688 - RNA, 17 nt, Human
guaauauuuauuaaauu

SEQ ID NO: 1949689 - RNA, 18 nt, Human
guaauauuuauuaaauuu

SEQ ID NO: 1949690 - RNA, 21 nt, Human
guaauauuuauuaaauuuuuu

SEQ ID NO: 1949691 - RNA, 21 nt, Human
guaauuuuuuuaucgucacug

SEQ ID NO: 1949692 - RNA, 22 nt, Human
guacaaaaaauucagugaugug

SEQ ID NO: 1949693 - RNA, 22 nt, Human
guacaaccuguucugcuuuccu

SEQ ID NO: 1949694 - RNA, 17 nt, Human
guacaaguaguucugua

SEQ ID NO: 1949695 - RNA, 21 nt, Human
guacaaguaguucuguauuug

SEQ ID NO: 1949696 - RNA, 22 nt, Human
guacaaguaguucuguauuuga

SEQ ID NO: 1949697 - RNA, 15 nt, Human
guacaagaucucagg

SEQ ID NO: 1949698 - RNA, 13 nt, Human
guacaaguaguuc

SEQ ID NO: 1949699 - RNA, 14 nt, Human
guacaaguaguucu

SEQ ID NO: 1949700 - RNA, 15 nt, Human
guacaaguaguucug

SEQ ID NO: 1949701 - RNA, 16 nt, Human
guacaaguaguucugu

SEQ ID NO: 1949702 - RNA, 15 nt, Human
guaauuugugauaca

SEQ ID NO: 1949703 - RNA, 17 nt, Human
guaaucgaccugccucg

SEQ ID NO: 1949704 - RNA, 17 nt, Human
guaauuugugauacaau

SEQ ID NO: 1949705 - RNA, 20 nt, Human
guaauuugugauacaaugcu

SEQ ID NO: 1949706 - RNA, 15 nt, Human
guaaucgaccugccu

SEQ ID NO: 1949707 - RNA, 23 nt, Human
guaauccuagcacuuugggaggc

SEQ ID NO: 1949708 - RNA, 15 nt, Human
guaaucauauuagac

SEQ ID NO: 1949709 - RNA, 12 nt, Human
guaaucauauua

SEQ ID NO: 1949710 - RNA, 20 nt, Human
aaacuguucccaccugcugg

SEQ ID NO: 1949711 - RNA, 19 nt, Human
aaacuguuaauaguucagg

SEQ ID NO: 1949712 - RNA, 21 nt, Human
aaacuguucccaccugcugga

SEQ ID NO: 1949713 - RNA, 16 nt, Human
aaacguguauguuuuu

SEQ ID NO: 1949714 - RNA, 18 nt, Human
aaacguguauguuuuuca

SEQ ID NO: 1949715 - RNA, 20 nt, Human
aaacguguauguuuuucagu

SEQ ID NO: 1949716 - RNA, 21 nt, Human
aaacguggcugcuucaaggau

SEQ ID NO: 1949717 - RNA, 18 nt, Human
gggugggacacccuguga

SEQ ID NO: 1949718 - RNA, 15 nt, Human
gggugggacacccug

SEQ ID NO: 1949719 - RNA, 18 nt, Human
ggguggcgcuagaggcca

SEQ ID NO: 1949720 - RNA, 19 nt, Human
aaacuuaaucuaaauggaa

SEQ ID NO: 1949721 - RNA, 20 nt, Human
aaacuuagcaucuaauuuca

SEQ ID NO: 1949722 - RNA, 15 nt, Human
gggugguggugauag

SEQ ID NO: 1949723 - RNA, 23 nt, Human
ggguuuugccauguuggccaggc

SEQ ID NO: 1949724 - RNA, 10 nt, Human
ggguuuuucu

SEQ ID NO: 1949725 - RNA, 12 nt, Human
ggguuuucucuc

SEQ ID NO: 1949726 - RNA, 12 nt, Human
ggguuuucuuaa

SEQ ID NO: 1949727 - RNA, 20 nt, Human
ggguuuugccauguuggcca

SEQ ID NO: 1949728 - RNA, 22 nt, Human
gguaaaucagacuaugaaguuu

SEQ ID NO: 1949729 - RNA, 13 nt, Human
gguaacaggcaga

SEQ ID NO: 1949730 - RNA, 12 nt, Human
gguaaaaugaag

SEQ ID NO: 1949731 - RNA, 13 nt, Human
gguaaaaugaaga

SEQ ID NO: 1949732 - RNA, 14 nt, Human
gguaaaaugaagaa

SEQ ID NO: 1949733 - RNA, 20 nt, Human
gguaaaaugaagaauuuaaa

SEQ ID NO: 1949734 - RNA, 13 nt, Human
gguaaaauuuugu

SEQ ID NO: 1949735 - RNA, 18 nt, Human
gguaggaacugcugggcu

SEQ ID NO: 1949736 - RNA, 21 nt, Human
gguaggaauauuauauuugga

SEQ ID NO: 1949737 - RNA, 14 nt, Human
gguagggcucugac

SEQ ID NO: 1949738 - RNA, 20 nt, Human
gguaaggaauaccugucccc

SEQ ID NO: 1949739 - RNA, 16 nt, Human
gguaggaacugcuggg

SEQ ID NO: 1949740 - RNA, 12 nt, Human
gguaagaaaaag

SEQ ID NO: 1949741 - RNA, 21 nt, Human
gguaagaaaaagcaaaaggca

SEQ ID NO: 1949742 - RNA, 20 nt, Human
gguaggguaagugagagagg

SEQ ID NO: 1949743 - RNA, 11 nt, Human
gguaggguggg

SEQ ID NO: 1949744 - RNA, 23 nt, Human
gguagggugggccuucagggagu

SEQ ID NO: 1949745 - RNA, 14 nt, Human
gguaucaggugcug

SEQ ID NO: 1949746 - RNA, 19 nt, Human
gguauauccuuuucugugu

SEQ ID NO: 1949747 - RNA, 21 nt, Human
gguauauccuuuucuguguuu

SEQ ID NO: 1949748 - RNA, 17 nt, Human
gguauaucauucuaaag

SEQ ID NO: 1949749 - RNA, 19 nt, Human
gguauaauugugugauauu

SEQ ID NO: 1949750 - RNA, 22 nt, Human
gguccaggccuacuccugucuu

SEQ ID NO: 1949751 - RNA, 20 nt, Human
gguccaggccuacuccuguc

SEQ ID NO: 1949752 - RNA, 22 nt, Human
gguccagccucguuggaagagg

SEQ ID NO: 1949753 - RNA, 22 nt, Human
aaacuugauguguuaucucuua

SEQ ID NO: 1949754 - RNA, 19 nt, Human
gguaucaggugcugccauc

SEQ ID NO: 1949755 - RNA, 17 nt, Human
gguaucuaauucuuuaa

SEQ ID NO: 1949756 - RNA, 20 nt, Human
gguaucuaauucuuuaauga

SEQ ID NO: 1949757 - RNA, 14 nt, Human
ggucagugcaaaua

SEQ ID NO: 1949758 - RNA, 22 nt, Human
ggucauauguuugcuuguauuu

SEQ ID NO: 1949759 - RNA, 15 nt, Human
ggggcccugccuccu

SEQ ID NO: 1949760 - RNA, 17 nt, Human
gggggaucacagccucu

SEQ ID NO: 1949761 - RNA, 11 nt, Human
gggggcuggga

SEQ ID NO: 1949762 - RNA, 16 nt, Human
gggggcucagcaaggc

SEQ ID NO: 1949763 - RNA, 19 nt, Human
gggggcucagcaaggccac

SEQ ID NO: 1949764 - RNA, 20 nt, Human
gggggcucagcaaggccacc

SEQ ID NO: 1949765 - RNA, 22 nt, Human
gggggcuucauacacaugagau

SEQ ID NO: 1949766 - RNA, 15 nt, Human
gggggcugggcagag

SEQ ID NO: 1949767 - RNA, 13 nt, Human
ggggguggccucc

SEQ ID NO: 1949768 - RNA, 22 nt, Human
ggggucacucaauucugcagua

SEQ ID NO: 1949769 - RNA, 22 nt, Human
ggggucaggccgggcagagcac

SEQ ID NO: 1949770 - RNA, 21 nt, Human
ggggucacucuggcagcucag

SEQ ID NO: 1949771 - RNA, 13 nt, Human
ggggaccagagcu

SEQ ID NO: 1949772 - RNA, 12 nt, Human
ggggaccagagc

SEQ ID NO: 1949773 - RNA, 14 nt, Human
aaaaugucaaaagu

SEQ ID NO: 1949774 - RNA, 15 nt, Human
aaaaugucaaaagua

SEQ ID NO: 1949775 - RNA, 21 nt, Human
aaaaugucaaaaguagaacuu

SEQ ID NO: 1949776 - RNA, 22 nt, Human
aaaaugucaaaaguagaacuuu

SEQ ID NO: 1949777 - RNA, 23 nt, Human
aaaaugucaaaaguagaacuuug

SEQ ID NO: 1949778 - RNA, 23 nt, Human
aaaauguccaguaagaucacugu

SEQ ID NO: 1949779 - RNA, 18 nt, Human
aaaauguaacuguuacca

SEQ ID NO: 1949780 - RNA, 12 nt, Human
aaaauguaacug

SEQ ID NO: 1949781 - RNA, 13 nt, Human
aaaauguaacugu

SEQ ID NO: 1949782 - RNA, 15 nt, Human
aaaauguaacuguua

SEQ ID NO: 1949783 - RNA, 16 nt, Human
aaaauguaacuguuac

SEQ ID NO: 1949784 - RNA, 18 nt, Human
aaaauguauguguaagua

SEQ ID NO: 1949785 - RNA, 16 nt, Human
ggggccccgucucagg

SEQ ID NO: 1949786 - RNA, 20 nt, Human
ggggccccgucucaggucug

SEQ ID NO: 1949787 - RNA, 14 nt, Human
ggggaccagagcug

SEQ ID NO: 1949788 - RNA, 15 nt, Human
aaaccaccagaagcc

SEQ ID NO: 1949789 - RNA, 18 nt, Human
aaaccaccagaagcccag

SEQ ID NO: 1949790 - RNA, 15 nt, Human
aaaccaaaaacugaa

SEQ ID NO: 1949791 - RNA, 19 nt, Human
aaacauuuucucuuagaaa

SEQ ID NO: 1949792 - RNA, 20 nt, Human
aaacauuuucucuuagaaaa

SEQ ID NO: 1949793 - RNA, 19 nt, Human
aaaccaccagaagcccaga

SEQ ID NO: 1949794 - RNA, 17 nt, Human
aaaccaggcuuucuaga

SEQ ID NO: 1949795 - RNA, 18 nt, Human
aaacgacaaaucugucug

SEQ ID NO: 1949796 - RNA, 19 nt, Human
aaacgacaaaucugucugc

SEQ ID NO: 1949797 - RNA, 22 nt, Human
aaaccugugucucugagaguag

SEQ ID NO: 1949798 - RNA, 12 nt, Human
aaaccugugaag

SEQ ID NO: 1949799 - RNA, 21 nt, Human
aaaccaggcuuucuagaaaga

SEQ ID NO: 1949800 - RNA, 18 nt, Human
aaaccugggauuauauau

SEQ ID NO: 1949801 - RNA, 12 nt, Human
aaaccugucuga

SEQ ID NO: 1949802 - RNA, 17 nt, Human
aaaccuucacuuaggaa

SEQ ID NO: 1949803 - RNA, 18 nt, Human
gggguccccuccaggagu

SEQ ID NO: 1949804 - RNA, 20 nt, Human
gggucacucuggcagcucag

SEQ ID NO: 1949805 - RNA, 14 nt, Human
gggucacucuggca

SEQ ID NO: 1949806 - RNA, 21 nt, Human
gggucaucuguaccucugccu

SEQ ID NO: 1949807 - RNA, 19 nt, Human
gggucagguugacaggagg

SEQ ID NO: 1949808 - RNA, 20 nt, Human
gggucagguugacaggaggu

SEQ ID NO: 1949809 - RNA, 18 nt, Human
gggucauucauggccugg

SEQ ID NO: 1949810 - RNA, 22 nt, Human
gggucacucuggcagcucagag

SEQ ID NO: 1949811 - RNA, 18 nt, Human
gggucagguugacaggag

SEQ ID NO: 1949812 - RNA, 19 nt, Human
aaacauuuugucauauaag

SEQ ID NO: 1949813 - RNA, 14 nt, Human
aaaaggaugcacag

SEQ ID NO: 1949814 - RNA, 15 nt, Human
aaaaggaugcacaga

SEQ ID NO: 1949815 - RNA, 19 nt, Human
aaaaggaugcacagaguug

SEQ ID NO: 1949816 - RNA, 22 nt, Human
aaaaggaugcacagaguuguua

SEQ ID NO: 1949817 - RNA, 13 nt, Human
aaaaggaugcaca

SEQ ID NO: 1949818 - RNA, 22 nt, Human
aaaaggagccaauuuaaagaaa

SEQ ID NO: 1949819 - RNA, 21 nt, Human
aaaaggaagguaguucaagaa

SEQ ID NO: 1949820 - RNA, 16 nt, Human
aaaagguuaauaaagu

SEQ ID NO: 1949821 - RNA, 11 nt, Human
aaaaggcccag

SEQ ID NO: 1949822 - RNA, 18 nt, Human
aaaaggugauaaaaucau

SEQ ID NO: 1949823 - RNA, 17 nt, Human
aaaagguuaauaaagua

SEQ ID NO: 1949824 - RNA, 11 nt, Human
aaaaggcagga

SEQ ID NO: 1949825 - RNA, 22 nt, Human
aaaauaagaaaagauguagauu

SEQ ID NO: 1949826 - RNA, 18 nt, Human
aaaauaaccuugcagaag

SEQ ID NO: 1949827 - RNA, 12 nt, Human
aaaauaacugua

SEQ ID NO: 1949828 - RNA, 13 nt, Human
aaaauaacuguaa

SEQ ID NO: 1949829 - RNA, 14 nt, Human
aaaauaacuguaau

SEQ ID NO: 1949830 - RNA, 15 nt, Human
aaaauaacuguaauu

SEQ ID NO: 1949831 - RNA, 12 nt, Human
aaaauaagaaaa

SEQ ID NO: 1949832 - RNA, 14 nt, Human
aaaauaagaaaaga

SEQ ID NO: 1949833 - RNA, 15 nt, Human
aaaauaagaaaagau

SEQ ID NO: 1949834 - RNA, 13 nt, Human
aaaauaccaagga

SEQ ID NO: 1949835 - RNA, 12 nt, Human
aaaauacauucu

SEQ ID NO: 1949836 - RNA, 13 nt, Human
aaaauaauuuugu

SEQ ID NO: 1949837 - RNA, 14 nt, Human
aaaauaauuuugua

SEQ ID NO: 1949838 - RNA, 19 nt, Human
aaaaucucucauuugugug

SEQ ID NO: 1949839 - RNA, 13 nt, Human
aaaaucugaagau

SEQ ID NO: 1949840 - RNA, 14 nt, Human
aaaaucugaagauu

SEQ ID NO: 1949841 - RNA, 15 nt, Human
aaaaucugaagauug

SEQ ID NO: 1949842 - RNA, 16 nt, Human
aaaaucugaagauugu

SEQ ID NO: 1949843 - RNA, 18 nt, Human
aaaaucugaagauuguuu

SEQ ID NO: 1949844 - RNA, 22 nt, Human
aaaaucugaagauuguuuaucu

SEQ ID NO: 1949845 - RNA, 12 nt, Human
aaaaugagaaau

SEQ ID NO: 1949846 - RNA, 11 nt, Human
aaaaugagaaa

SEQ ID NO: 1949847 - RNA, 16 nt, Human
aaaaugcaugauugca

SEQ ID NO: 1949848 - RNA, 16 nt, Human
aaaaugcauguaauca

SEQ ID NO: 1949849 - RNA, 16 nt, Human
aaaaugcaaaaaaucu

SEQ ID NO: 1949850 - RNA, 17 nt, Human
aaaaugcaaaaaaucuu

SEQ ID NO: 1949851 - RNA, 23 nt, Human
aaaaugcuguauuagucacagag

SEQ ID NO: 1949852 - RNA, 21 nt, Human
aaaaugcuguauuagucacag

SEQ ID NO: 1949853 - RNA, 20 nt, Human
aaaauggaagacagcucuua

SEQ ID NO: 1949854 - RNA, 14 nt, Human
aaaauauuuaaagg

SEQ ID NO: 1949855 - RNA, 12 nt, Human
aaaauaugcacu

SEQ ID NO: 1949856 - RNA, 14 nt, Human
aaaauaugcacuaa

SEQ ID NO: 1949857 - RNA, 14 nt, Human
aaaauauuuaugaa

SEQ ID NO: 1949858 - RNA, 15 nt, Human
aaaauauuuaugaag

SEQ ID NO: 1949859 - RNA, 17 nt, Human
aaaauauuuaugaagaa

SEQ ID NO: 1949860 - RNA, 14 nt, Human
aaaauauuuaaugu

SEQ ID NO: 1949861 - RNA, 20 nt, Human
aaaauauuuaugaagaaaau

SEQ ID NO: 1949862 - RNA, 16 nt, Human
aaaauauuuuccugcc

SEQ ID NO: 1949863 - RNA, 11 nt, Human
aaaauacugua

SEQ ID NO: 1949864 - RNA, 15 nt, Human
aaaauacuguagaua

SEQ ID NO: 1949865 - RNA, 14 nt, Human
aaaauacuuaaaug

SEQ ID NO: 1949866 - RNA, 15 nt, Human
aaaauacuuaaaugu

SEQ ID NO: 1949867 - RNA, 20 nt, Human
aaaauacuuaaauguuaugu

SEQ ID NO: 1949868 - RNA, 12 nt, Human
aaaauacuucuu

SEQ ID NO: 1949869 - RNA, 19 nt, Human
aaaauaucuaguaauauau

SEQ ID NO: 1949870 - RNA, 13 nt, Human
aaaauaucaaauu

SEQ ID NO: 1949871 - RNA, 22 nt, Human
aaaauaugaccacacuccagcu

SEQ ID NO: 1949872 - RNA, 15 nt, Human
aaaauauuccugcau

SEQ ID NO: 1949873 - RNA, 19 nt, Human
gggcugcaccggcuggccu

SEQ ID NO: 1949874 - RNA, 17 nt, Human
gggcugcaccggcuggc

SEQ ID NO: 1949875 - RNA, 19 nt, Human
gggcucccgccuccaaccc

SEQ ID NO: 1949876 - RNA, 13 nt, Human
gggcucccgccuc

SEQ ID NO: 1949877 - RNA, 18 nt, Human
gggcucccgccuccaacc

SEQ ID NO: 1949878 - RNA, 12 nt, Human
gggcuccccucu

SEQ ID NO: 1949879 - RNA, 13 nt, Human
gggcuccccucuu

SEQ ID NO: 1949880 - RNA, 16 nt, Human
gggcuccccucuuccu

SEQ ID NO: 1949881 - RNA, 18 nt, Human
gggcuccccucuuccucu

SEQ ID NO: 1949882 - RNA, 13 nt, Human
gggcuccagacac

SEQ ID NO: 1949883 - RNA, 10 nt, Human
gggcuccaga

SEQ ID NO: 1949884 - RNA, 21 nt, Human
gggcucagcggggacagcucc

SEQ ID NO: 1949885 - RNA, 21 nt, Human
gggcucagcaaggccaccucu

SEQ ID NO: 1949886 - RNA, 15 nt, Human
gggcuaguugggcuu

SEQ ID NO: 1949887 - RNA, 20 nt, Human
gggcuaggaaauccagggug

SEQ ID NO: 1949888 - RNA, 22 nt, Human
gggcucagcaaaagaugcuucu

SEQ ID NO: 1949889 - RNA, 18 nt, Human
gggcuaguugggcuuccu

SEQ ID NO: 1949890 - RNA, 17 nt, Human
gggcucagcggggacag

SEQ ID NO: 1949891 - RNA, 19 nt, Human
gggcucagcggggacagcu

SEQ ID NO: 1949892 - RNA, 13 nt, Human
gggcucagcaagg

SEQ ID NO: 1949893 - RNA, 15 nt, Human
gggcucagcaaggcc

SEQ ID NO: 1949894 - RNA, 16 nt, Human
gggcucagcaaggcca

SEQ ID NO: 1949895 - RNA, 17 nt, Human
gggcucagcaaggccac

SEQ ID NO: 1949896 - RNA, 18 nt, Human
gggcucagcaaggccacc

SEQ ID NO: 1949897 - RNA, 19 nt, Human
gggcucagcaaggccaccu

SEQ ID NO: 1949898 - RNA, 20 nt, Human
gggcucagcaaggccaccuc

SEQ ID NO: 1949899 - RNA, 15 nt, Human
gggcugggcagagga

SEQ ID NO: 1949900 - RNA, 12 nt, Human
gggcugggcaga

SEQ ID NO: 1949901 - RNA, 21 nt, Human
gggcugcaccggcuggccugg

SEQ ID NO: 1949902 - RNA, 20 nt, Human
gggcugcaccggcuggccug

SEQ ID NO: 1949903 - RNA, 14 nt, Human
aaaaugggagaucu

SEQ ID NO: 1949904 - RNA, 16 nt, Human
aaaaugguuuaaaugg

SEQ ID NO: 1949905 - RNA, 18 nt, Human
aaaaugguuuaaaugguc

SEQ ID NO: 1949906 - RNA, 17 nt, Human
gggcuggguucuaccca

SEQ ID NO: 1949907 - RNA, 22 nt, Human
gggcugggcccacccaagcagg

SEQ ID NO: 1949908 - RNA, 19 nt, Human
gggcugggggaugggccug

SEQ ID NO: 1949909 - RNA, 21 nt, Human
gggcugggggaugggccugag

SEQ ID NO: 1949910 - RNA, 15 nt, Human
gggccucagugccac

SEQ ID NO: 1949911 - RNA, 13 nt, Human
gggccucagugcc

SEQ ID NO: 1949912 - RNA, 14 nt, Human
gggccucagugcca

SEQ ID NO: 1949913 - RNA, 22 nt, Human
gggccucgguguggagaagcgg

SEQ ID NO: 1949914 - RNA, 18 nt, Human
gggccucuuaugggcugg

SEQ ID NO: 1949915 - RNA, 21 nt, Human
gggcggugagaggggaacaga

SEQ ID NO: 1949916 - RNA, 18 nt, Human
gggcgugagaccugcccc

SEQ ID NO: 1949917 - RNA, 19 nt, Human
gggcgugagaccugccccu

SEQ ID NO: 1949918 - RNA, 15 nt, Human
gggcgugguggugag

SEQ ID NO: 1949919 - RNA, 14 nt, Human
gggccaggagccuc

SEQ ID NO: 1949920 - RNA, 13 nt, Human
gggccaggagccu

SEQ ID NO: 1949921 - RNA, 12 nt, Human
gggccaggagcc

SEQ ID NO: 1949922 - RNA, 14 nt, Human
gggccgccuguccu

SEQ ID NO: 1949923 - RNA, 19 nt, Human
gggccauugaacucugaga

SEQ ID NO: 1949924 - RNA, 17 nt, Human
uuuugugcauuaucuag

SEQ ID NO: 1949925 - RNA, 20 nt, Human
uuuugugcauuaucuagaua

SEQ ID NO: 1949926 - RNA, 21 nt, Human
uuuugugaugucccaacuugu

SEQ ID NO: 1949927 - RNA, 13 nt, Human
uuuugcucuaaaa

SEQ ID NO: 1949928 - RNA, 15 nt, Human
uuuugcucuaaaaua

SEQ ID NO: 1949929 - RNA, 16 nt, Human
uuuugcucuaaaauau

SEQ ID NO: 1949930 - RNA, 22 nt, Human
uuuugcucuaaaauauuuauga

SEQ ID NO: 1949931 - RNA, 22 nt, Human
uuuugcuaaguaaaucucuucu

SEQ ID NO: 1949932 - RNA, 21 nt, Human
uuuuguuccacaaguuaaaua

SEQ ID NO: 1949933 - RNA, 15 nt, Human
uuuuguuccacaagu

SEQ ID NO: 1949934 - RNA, 24 nt, Human
uuuuguucauuucauccuuucacu

SEQ ID NO: 1949935 - RNA, 23 nt, Human
uuuuuauacauaaacaagaccac

SEQ ID NO: 1949936 - RNA, 20 nt, Human
uuuuuagaugugcugcuuug

SEQ ID NO: 1949937 - RNA, 12 nt, Human
uuuuuauggcuu

SEQ ID NO: 1949938 - RNA, 20 nt, Human
uuuuuaucgucacugcuuaa

SEQ ID NO: 1949939 - RNA, 12 nt, Human
uuuuuaucaugu

SEQ ID NO: 1949940 - RNA, 11 nt, Human
uuuuuacuaau

SEQ ID NO: 1949941 - RNA, 22 nt, Human
uuuuuagacagagucucacugu

SEQ ID NO: 1949942 - RNA, 12 nt, Human
uuuuuagaauuu

SEQ ID NO: 1949943 - RNA, 16 nt, Human
uuuugagcccuuguuu

SEQ ID NO: 1949944 - RNA, 22 nt, Human
auuaagcaugacagaaaauaug

SEQ ID NO: 1949945 - RNA, 17 nt, Human
uuuugagugccuuacac

SEQ ID NO: 1949946 - RNA, 17 nt, Human
uuuugauccaagcuggu

SEQ ID NO: 1949947 - RNA, 19 nt, Human
uuuugauagcauuguaagc

SEQ ID NO: 1949948 - RNA, 23 nt, Human
uuuugagucuuuuuuuuuuaagu

SEQ ID NO: 1949949 - RNA, 13 nt, Human
auuaagauuauaa

SEQ ID NO: 1949950 - RNA, 19 nt, Human
auuaaagaaauaauuuuau

SEQ ID NO: 1949951 - RNA, 16 nt, Human
auuaaagaaauaauuu

SEQ ID NO: 1949952 - RNA, 20 nt, Human
auuaagcaugacagaaaaua

SEQ ID NO: 1949953 - RNA, 15 nt, Human
auuaagauuauaauu

SEQ ID NO: 1949954 - RNA, 16 nt, Human
auuaagauuauaauug

SEQ ID NO: 1949955 - RNA, 17 nt, Human
auuaagauuauaauugu

SEQ ID NO: 1949956 - RNA, 18 nt, Human
auuaagauuauaauuguu

SEQ ID NO: 1949957 - RNA, 14 nt, Human
uuuugaucucacau

SEQ ID NO: 1949958 - RNA, 16 nt, Human
uuuugauguaaagaug

SEQ ID NO: 1949959 - RNA, 18 nt, Human
uuuugauguaaagauguu

SEQ ID NO: 1949960 - RNA, 17 nt, Human
uuuugcaagguaaaauu

SEQ ID NO: 1949961 - RNA, 18 nt, Human
uuuugcaagguaaaauuu

SEQ ID NO: 1949962 - RNA, 21 nt, Human
uuuugcaagguaaaauuuuag

SEQ ID NO: 1949963 - RNA, 21 nt, Human
uuuugcauaguucuagugcag

SEQ ID NO: 1949964 - RNA, 13 nt, Human
uuuugcaggagca

SEQ ID NO: 1949965 - RNA, 23 nt, Human
uuuugccauguuggccaggcugg

SEQ ID NO: 1949966 - RNA, 13 nt, Human
uuuugccagccca

SEQ ID NO: 1949967 - RNA, 21 nt, Human
auuacaguggggaaugaagau

SEQ ID NO: 1949968 - RNA, 18 nt, Human
auuaauagcauucgaaga

SEQ ID NO: 1949969 - RNA, 16 nt, Human
auuaaguacuauguau

SEQ ID NO: 1949970 - RNA, 14 nt, Human
auuaaguacuaugu

SEQ ID NO: 1949971 - RNA, 15 nt, Human
uuuuuauuaaucacu

SEQ ID NO: 1949972 - RNA, 19 nt, Human
uuuuuauuaaucacugugu

SEQ ID NO: 1949973 - RNA, 21 nt, Human
uuuuuauuaaucacuguguau

SEQ ID NO: 1949974 - RNA, 20 nt, Human
uuuuuauggcuuuugugcau

SEQ ID NO: 1949975 - RNA, 21 nt, Human
uuuuuauggcuuuugugcauu

SEQ ID NO: 1949976 - RNA, 22 nt, Human
uuuuuauggcuuuugugcauua

SEQ ID NO: 1949977 - RNA, 12 nt, Human
uuuuuaugugug

SEQ ID NO: 1949978 - RNA, 19 nt, Human
uuuuuguagagccaggguc

SEQ ID NO: 1949979 - RNA, 20 nt, Human
uuuuuguagagccagggucu

SEQ ID NO: 1949980 - RNA, 19 nt, Human
uuuuugugaaaagcuccau

SEQ ID NO: 1949981 - RNA, 18 nt, Human
auuacguacuaaggauac

SEQ ID NO: 1949982 - RNA, 22 nt, Human
auuacgaaguucaagaucaaaa

SEQ ID NO: 1949983 - RNA, 17 nt, Human
auuacgaaguucaagau

SEQ ID NO: 1949984 - RNA, 12 nt, Human
auuacuaacuuc

SEQ ID NO: 1949985 - RNA, 14 nt, Human
auuacuaacuucua

SEQ ID NO: 1949986 - RNA, 15 nt, Human
auuacuaacuucuaa

SEQ ID NO: 1949987 - RNA, 16 nt, Human
auuacuaacuucuaaa

SEQ ID NO: 1949988 - RNA, 21 nt, Human
auuacuaacuucuaaaacugu

SEQ ID NO: 1949989 - RNA, 22 nt, Human
auuacuaacuucuaaaacugua

SEQ ID NO: 1949990 - RNA, 21 nt, Human
auuacuagacugccacaagga

SEQ ID NO: 1949991 - RNA, 14 nt, Human
auuacuagaguugg

SEQ ID NO: 1949992 - RNA, 13 nt, Human
auuagucccuggc

SEQ ID NO: 1949993 - RNA, 21 nt, Human
auuaguacuuuauagaagaau

SEQ ID NO: 1949994 - RNA, 18 nt, Human
auuaguacuuuauagaag

SEQ ID NO: 1949995 - RNA, 22 nt, Human
auguggaagugugggucugugu

SEQ ID NO: 1949996 - RNA, 23 nt, Human
auguggaagugugggucugugug

SEQ ID NO: 1949997 - RNA, 15 nt, Human
auguggaaguguggg

SEQ ID NO: 1949998 - RNA, 16 nt, Human
auguggaagugugggu

SEQ ID NO: 1949999 - RNA, 13 nt, Human
auguggaagugug

SEQ ID NO: 1950000 - RNA, 20 nt, Human
auguggaguucaucuugaau

SEQ ID NO: 1950001 - RNA, 16 nt, Human
auguggacuuaggaag

SEQ ID NO: 1950002 - RNA, 17 nt, Human
auguggacuuaggaagg

SEQ ID NO: 1950003 - RNA, 19 nt, Human
auguggagucagccucgca

SEQ ID NO: 1950004 - RNA, 24 nt, Human
auguggaguucaucuugaauugua

SEQ ID NO: 1950005 - RNA, 18 nt, Human
auguguguguguugugug

SEQ ID NO: 1950006 - RNA, 23 nt, Human
auguguguuuuaaaaugagaaau

SEQ ID NO: 1950007 - RNA, 10 nt, Human
augugugugu

SEQ ID NO: 1950008 - RNA, 12 nt, Human
augugugugugc

SEQ ID NO: 1950009 - RNA, 18 nt, Human
augugugugaugugacau

SEQ ID NO: 1950010 - RNA, 19 nt, Human
augugugugaugugacauu

SEQ ID NO: 1950011 - RNA, 20 nt, Human
augugugugaugugacauuu

SEQ ID NO: 1950012 - RNA, 20 nt, Human
auggggcccugccuccuuug

SEQ ID NO: 1950013 - RNA, 21 nt, Human
auggggaggcaaguguggggg

SEQ ID NO: 1950014 - RNA, 14 nt, Human
uuuuaauaaacacu

SEQ ID NO: 1950015 - RNA, 13 nt, Human
uuuuaaguuugca

SEQ ID NO: 1950016 - RNA, 15 nt, Human
uuuuaaguuugcacu

SEQ ID NO: 1950017 - RNA, 16 nt, Human
uuuuaaguuugcacuc

SEQ ID NO: 1950018 - RNA, 14 nt, Human
augugccuaaauaa

SEQ ID NO: 1950019 - RNA, 18 nt, Human
augugccuaaauaaguua

SEQ ID NO: 1950020 - RNA, 15 nt, Human
augugccugcuucag

SEQ ID NO: 1950021 - RNA, 23 nt, Human
augugccugcuucagccucccac

SEQ ID NO: 1950022 - RNA, 22 nt, Human
augugccagguuuuuggucuga

SEQ ID NO: 1950023 - RNA, 20 nt, Human
auguugcccuguugcugccu

SEQ ID NO: 1950024 - RNA, 20 nt, Human
auguugcccaggcaggucuu

SEQ ID NO: 1950025 - RNA, 22 nt, Human
uuuuacuuuuuuuuuauuuuau

SEQ ID NO: 1950026 - RNA, 18 nt, Human
uuuuagaaacaauaugga

SEQ ID NO: 1950027 - RNA, 18 nt, Human
uuuuagaauuuugugaaa

SEQ ID NO: 1950028 - RNA, 18 nt, Human
auguucaucaaugaauga

SEQ ID NO: 1950029 - RNA, 18 nt, Human
auguugcauagaauaaaa

SEQ ID NO: 1950030 - RNA, 17 nt, Human
auguugcauagaauaaa

SEQ ID NO: 1950031 - RNA, 17 nt, Human
auguugcccaggcaggu

SEQ ID NO: 1950032 - RNA, 22 nt, Human
auguugccaaaaugguggccug

SEQ ID NO: 1950033 - RNA, 12 nt, Human
auguugcccagg

SEQ ID NO: 1950034 - RNA, 15 nt, Human
auguugcauagaaua

SEQ ID NO: 1950035 - RNA, 16 nt, Human
auguugccaaaauggu

SEQ ID NO: 1950036 - RNA, 13 nt, Human
auguuaauauuuc

SEQ ID NO: 1950037 - RNA, 13 nt, Human
auguuaauauuuu

SEQ ID NO: 1950038 - RNA, 22 nt, Human
auguuaauauuuuagguguaaa

SEQ ID NO: 1950039 - RNA, 19 nt, Human
auguuaauugauagaauaa

SEQ ID NO: 1950040 - RNA, 12 nt, Human
auguguuuagaa

SEQ ID NO: 1950041 - RNA, 11 nt, Human
auguguuuaga

SEQ ID NO: 1950042 - RNA, 19 nt, Human
auguguugccacuuuccaa

SEQ ID NO: 1950043 - RNA, 13 nt, Human
auguguugccacu

SEQ ID NO: 1950044 - RNA, 17 nt, Human
uuuucaugcuuuaucaa

SEQ ID NO: 1950045 - RNA, 14 nt, Human
uuuucauugcugug

SEQ ID NO: 1950046 - RNA, 13 nt, Human
uuuucauuuuaca

SEQ ID NO: 1950047 - RNA, 15 nt, Human
uuuucauauuuuaau

SEQ ID NO: 1950048 - RNA, 16 nt, Human
uuuucauauuuuaauu

SEQ ID NO: 1950049 - RNA, 19 nt, Human
uuuucauauuuuaauuuca

SEQ ID NO: 1950050 - RNA, 22 nt, Human
uuuucauauuuuaauuucaagc

SEQ ID NO: 1950051 - RNA, 20 nt, Human
uuuucauuuaggugaggaag

SEQ ID NO: 1950052 - RNA, 16 nt, Human
uuuucaugcuuuauca

SEQ ID NO: 1950053 - RNA, 18 nt, Human
uuuucugauauguuugua

SEQ ID NO: 1950054 - RNA, 16 nt, Human
uuuucuggacucugga

SEQ ID NO: 1950055 - RNA, 20 nt, Human
uuuucuggacucuggacuuu

SEQ ID NO: 1950056 - RNA, 22 nt, Human
uuuucuggacucuggacuuucu

SEQ ID NO: 1950057 - RNA, 14 nt, Human
uuuucugaaguugu

SEQ ID NO: 1950058 - RNA, 15 nt, Human
uuuucugaaucuucu

SEQ ID NO: 1950059 - RNA, 16 nt, Human
uuuucugaaucuucug

SEQ ID NO: 1950060 - RNA, 17 nt, Human
uuuucugaaucuucuga

SEQ ID NO: 1950061 - RNA, 13 nt, Human
uuuuauuaugcau

SEQ ID NO: 1950062 - RNA, 14 nt, Human
uuuuauuuauaugu

SEQ ID NO: 1950063 - RNA, 16 nt, Human
uuuuauuuauauguau

SEQ ID NO: 1950064 - RNA, 15 nt, Human
uuuuaggcaaguuuu

SEQ ID NO: 1950065 - RNA, 17 nt, Human
uuuuagguuuaucuuuu

SEQ ID NO: 1950066 - RNA, 11 nt, Human
uuuuauuuuau

SEQ ID NO: 1950067 - RNA, 14 nt, Human
uuuuauuucuccuu

SEQ ID NO: 1950068 - RNA, 16 nt, Human
uuuuauuucuccuuuu

SEQ ID NO: 1950069 - RNA, 18 nt, Human
uuuuauuucuccuuuugu

SEQ ID NO: 1950070 - RNA, 16 nt, Human
uuuuauuuucuaaagu

SEQ ID NO: 1950071 - RNA, 15 nt, Human
uuuucaguucaaagu

SEQ ID NO: 1950072 - RNA, 23 nt, Human
uuuucaguucaaagucaugaugu

SEQ ID NO: 1950073 - RNA, 24 nt, Human
uuuucaguucaaagucaugauguu

SEQ ID NO: 1950074 - RNA, 16 nt, Human
uuuucauaagauauuu

SEQ ID NO: 1950075 - RNA, 17 nt, Human
uuuucauaagauauuuu

SEQ ID NO: 1950076 - RNA, 19 nt, Human
uuuucauaagauauuuuau

SEQ ID NO: 1950077 - RNA, 21 nt, Human
auuaaaaccugggauuauaua

SEQ ID NO: 1950078 - RNA, 23 nt, Human
auuaaaagaaaauaaaaaaaaga

SEQ ID NO: 1950079 - RNA, 15 nt, Human
auuaaaaaucucaaa

SEQ ID NO: 1950080 - RNA, 19 nt, Human
auuaaaaaucucaaauuuc

SEQ ID NO: 1950081 - RNA, 15 nt, Human
auguuuuguaaacuu

SEQ ID NO: 1950082 - RNA, 16 nt, Human
auguuuuguaaacuuu

SEQ ID NO: 1950083 - RNA, 17 nt, Human
auguuuuguaaacuuug

SEQ ID NO: 1950084 - RNA, 18 nt, Human
auguuuuguaaacuuuga

SEQ ID NO: 1950085 - RNA, 20 nt, Human
auguuuuguaaacuuugaaa

SEQ ID NO: 1950086 - RNA, 21 nt, Human
auguuuuguaaacuuugaaau

SEQ ID NO: 1950087 - RNA, 20 nt, Human
auuaaaaaucucaaauuucu

SEQ ID NO: 1950088 - RNA, 22 nt, Human
auuaaaaaucucaaauuucuaa

SEQ ID NO: 1950089 - RNA, 23 nt, Human
auuaaaacacaacaucuuuuucu

SEQ ID NO: 1950090 - RNA, 12 nt, Human
auguuuuuaaaa

SEQ ID NO: 1950091 - RNA, 17 nt, Human
auguuuaguaaucauau

SEQ ID NO: 1950092 - RNA, 18 nt, Human
auguuguuuuguacagau

SEQ ID NO: 1950093 - RNA, 19 nt, Human
auguuguuuuguacagaug

SEQ ID NO: 1950094 - RNA, 21 nt, Human
auguuguuuuguacagaugug

SEQ ID NO: 1950095 - RNA, 12 nt, Human
auguuuaaaaca

SEQ ID NO: 1950096 - RNA, 14 nt, Human
auguuuaaaacacc

SEQ ID NO: 1950097 - RNA, 16 nt, Human
auguuuaaaacaccuu

SEQ ID NO: 1950098 - RNA, 21 nt, Human
auguuuaaaacaccuucuaua

SEQ ID NO: 1950099 - RNA, 15 nt, Human
auguuguuuuguaca

SEQ ID NO: 1950100 - RNA, 17 nt, Human
auguuguuuuguacaga

SEQ ID NO: 1950101 - RNA, 12 nt, Human
auguuuauguaa

SEQ ID NO: 1950102 - RNA, 13 nt, Human
auguuuauguaaa

SEQ ID NO: 1950103 - RNA, 22 nt, Human
auguuuaaaacaccuucuauag

SEQ ID NO: 1950104 - RNA, 23 nt, Human
auguuuauguaaacaaaucuuuc

SEQ ID NO: 1950105 - RNA, 21 nt, Human
auguuuauguaaacaaaucuu

SEQ ID NO: 1950106 - RNA, 23 nt, Human
auguuuugcauguaaaagccuag

SEQ ID NO: 1950107 - RNA, 17 nt, Human
auguuuugguccacuuu

SEQ ID NO: 1950108 - RNA, 22 nt, Human
auguuuugguccacuuuuccag

SEQ ID NO: 1950109 - RNA, 23 nt, Human
auguuuugguccacuuuuccagu

SEQ ID NO: 1950110 - RNA, 20 nt, Human
auucagauaugauucaaaug

SEQ ID NO: 1950111 - RNA, 12 nt, Human
auugaaaucuuu

SEQ ID NO: 1950112 - RNA, 20 nt, Human
auuauauacuuguuguuuaa

SEQ ID NO: 1950113 - RNA, 14 nt, Human
auucaggaagcuca

SEQ ID NO: 1950114 - RNA, 17 nt, Human
auucagaguugaugguu

SEQ ID NO: 1950115 - RNA, 19 nt, Human
auucaggaagcucagggcc

SEQ ID NO: 1950116 - RNA, 17 nt, Human
auucaggaagcucaggg

SEQ ID NO: 1950117 - RNA, 18 nt, Human
auucagauaugauucaaa

SEQ ID NO: 1950118 - RNA, 20 nt, Human
auucaggaagcucagggccu

SEQ ID NO: 1950119 - RNA, 19 nt, Human
auucaguaauaacucuacc

SEQ ID NO: 1950120 - RNA, 15 nt, Human
auucaguaauaacuc

SEQ ID NO: 1950121 - RNA, 20 nt, Human
auuccagucaggcucucugg

SEQ ID NO: 1950122 - RNA, 15 nt, Human
auuccauauuagaaa

SEQ ID NO: 1950123 - RNA, 19 nt, Human
auuccauauuagaaaacuu

SEQ ID NO: 1950124 - RNA, 20 nt, Human
auuccauauuagaaaacuuu

SEQ ID NO: 1950125 - RNA, 21 nt, Human
auuccauauuagaaaacuuug

SEQ ID NO: 1950126 - RNA, 22 nt, Human
auuccauauuagaaaacuuugu

SEQ ID NO: 1950127 - RNA, 23 nt, Human
auuccauauuagaaaacuuuguu

SEQ ID NO: 1950128 - RNA, 16 nt, Human
auucccaagcucugcu

SEQ ID NO: 1950129 - RNA, 14 nt, Human
auucccaagcucug

SEQ ID NO: 1950130 - RNA, 15 nt, Human
auucccaagcucugc

SEQ ID NO: 1950131 - RNA, 17 nt, Human
auucccucgucuuuccc

SEQ ID NO: 1950132 - RNA, 18 nt, Human
auucccucgucuuuccca

SEQ ID NO: 1950133 - RNA, 16 nt, Human
auucuccuuguguuac

SEQ ID NO: 1950134 - RNA, 20 nt, Human
auucuccugccucagccucc

SEQ ID NO: 1950135 - RNA, 19 nt, Human
auucuccugccucagccuc

SEQ ID NO: 1950136 - RNA, 15 nt, Human
auucuccugccucag

SEQ ID NO: 1950137 - RNA, 17 nt, Human
auucuccugccucagcc

SEQ ID NO: 1950138 - RNA, 17 nt, Human
auucucccgggacucug

SEQ ID NO: 1950139 - RNA, 18 nt, Human
auucucccgggacucugc

SEQ ID NO: 1950140 - RNA, 23 nt, Human
auucucccgggacucugcauauu

SEQ ID NO: 1950141 - RNA, 21 nt, Human
auucuccaccugccagggaca

SEQ ID NO: 1950142 - RNA, 14 nt, Human
auucucaguuuuuc

SEQ ID NO: 1950143 - RNA, 18 nt, Human
auucucaguuuuucuuaa

SEQ ID NO: 1950144 - RNA, 11 nt, Human
auucuccugcc

SEQ ID NO: 1950145 - RNA, 12 nt, Human
auucuccugccu

SEQ ID NO: 1950146 - RNA, 14 nt, Human
auucuccugccuca

SEQ ID NO: 1950147 - RNA, 13 nt, Human
auucuccugccuc

SEQ ID NO: 1950148 - RNA, 12 nt, Human
auucuauuucaa

SEQ ID NO: 1950149 - RNA, 21 nt, Human
auucuauuucaacuucaggaa

SEQ ID NO: 1950150 - RNA, 13 nt, Human
auucuauuuuaca

SEQ ID NO: 1950151 - RNA, 21 nt, Human
auucucaagggacguccucca

SEQ ID NO: 1950152 - RNA, 20 nt, Human
auucuccaccugccagggac

SEQ ID NO: 1950153 - RNA, 19 nt, Human
auucuccaccugccaggga

SEQ ID NO: 1950154 - RNA, 14 nt, Human
auucucaugccuca

SEQ ID NO: 1950155 - RNA, 15 nt, Human
auucucaugccucag

SEQ ID NO: 1950156 - RNA, 13 nt, Human
auucucaguuuuu

SEQ ID NO: 1950157 - RNA, 17 nt, Human
auucuauggagcuauuu

SEQ ID NO: 1950158 - RNA, 15 nt, Human
auucuauguuaauau

SEQ ID NO: 1950159 - RNA, 18 nt, Human
auucuauguuaauauuuu

SEQ ID NO: 1950160 - RNA, 12 nt, Human
auucuaaagaua

SEQ ID NO: 1950161 - RNA, 14 nt, Human
auuuauucugcuca

SEQ ID NO: 1950162 - RNA, 15 nt, Human
auuuagaaauauaau

SEQ ID NO: 1950163 - RNA, 11 nt, Human
auuuagaaugg

SEQ ID NO: 1950164 - RNA, 17 nt, Human
auuuagaauggugauuu

SEQ ID NO: 1950165 - RNA, 21 nt, Human
auuuagaauggugauuuuaaa

SEQ ID NO: 1950166 - RNA, 16 nt, Human
auuuacuucuuauaca

SEQ ID NO: 1950167 - RNA, 14 nt, Human
auuuacuucuuaua

SEQ ID NO: 1950168 - RNA, 21 nt, Human
auuuacugcuagucuuaagaa

SEQ ID NO: 1950169 - RNA, 17 nt, Human
auuuacuucuuauacau

SEQ ID NO: 1950170 - RNA, 19 nt, Human
auuuaaaaagcccaaccuc

SEQ ID NO: 1950171 - RNA, 20 nt, Human
auuuaaaaacaaaaggcaau

SEQ ID NO: 1950172 - RNA, 15 nt, Human
auuuaaaaagcccaa

SEQ ID NO: 1950173 - RNA, 16 nt, Human
auuuaaaaagcccaac

SEQ ID NO: 1950174 - RNA, 18 nt, Human
auuuaaaaagcccaaccu

SEQ ID NO: 1950175 - RNA, 14 nt, Human
auuuaacagaaaug

SEQ ID NO: 1950176 - RNA, 17 nt, Human
auuuacugcauucuucu

SEQ ID NO: 1950177 - RNA, 21 nt, Human
auuuacugcauucuucugauc

SEQ ID NO: 1950178 - RNA, 12 nt, Human
auuuaacagaaa

SEQ ID NO: 1950179 - RNA, 16 nt, Human
auuuagaugcauauua

SEQ ID NO: 1950180 - RNA, 18 nt, Human
auuuaguauuuuguuuca

SEQ ID NO: 1950181 - RNA, 20 nt, Human
auuuaguaucuuuuuauuca

SEQ ID NO: 1950182 - RNA, 13 nt, Human
auuuaguguucau

SEQ ID NO: 1950183 - RNA, 22 nt, Human
auuuauaaaaauaaaaaacacu

SEQ ID NO: 1950184 - RNA, 17 nt, Human
auuuauaaaaauaaaaa

SEQ ID NO: 1950185 - RNA, 14 nt, Human
auuuauuaaauuuu

SEQ ID NO: 1950186 - RNA, 21 nt, Human
auuuauuaaauuuuuuuguau

SEQ ID NO: 1950187 - RNA, 24 nt, Human
auuuauuaaauuuuuuuguaugaa

SEQ ID NO: 1950188 - RNA, 22 nt, Human
auuuauuaacugcucaguguuu

SEQ ID NO: 1950189 - RNA, 13 nt, Human
auuuauuaacuua

SEQ ID NO: 1950190 - RNA, 14 nt, Human
auuuauuaacuuaa

SEQ ID NO: 1950191 - RNA, 16 nt, Human
auuuauuaacuuaaua

SEQ ID NO: 1950192 - RNA, 20 nt, Human
auuuauuaagguuacagauu

SEQ ID NO: 1950193 - RNA, 17 nt, Human
auuuauuaacuuaauaa

SEQ ID NO: 1950194 - RNA, 20 nt, Human
auuuauuaacuuaauaauca

SEQ ID NO: 1950195 - RNA, 21 nt, Human
auuuauuaacuuaauaaucaa

SEQ ID NO: 1950196 - RNA, 23 nt, Human
auuuauuaacuuaauaaucaaga

SEQ ID NO: 1950197 - RNA, 17 nt, Human
auuuauuuacugcuagu

SEQ ID NO: 1950198 - RNA, 14 nt, Human
auuuauuuauucau

SEQ ID NO: 1950199 - RNA, 14 nt, Human
auuuauucauuagu

SEQ ID NO: 1950200 - RNA, 13 nt, Human
auuuauucugcuc

SEQ ID NO: 1950201 - RNA, 14 nt, Human
auuuauucuaauua

SEQ ID NO: 1950202 - RNA, 16 nt, Human
auuucccuuuagcugu

SEQ ID NO: 1950203 - RNA, 20 nt, Human
auuucccuuuagcuguguua

SEQ ID NO: 1950204 - RNA, 21 nt, Human
auuucccuuuagcuguguuau

SEQ ID NO: 1950205 - RNA, 22 nt, Human
auuucccuuuagcuguguuauu

SEQ ID NO: 1950206 - RNA, 17 nt, Human
auuuccccuaaucuuuu

SEQ ID NO: 1950207 - RNA, 15 nt, Human
auuuccguuaaaaua

SEQ ID NO: 1950208 - RNA, 16 nt, Human
auuuccguuaaaauac

SEQ ID NO: 1950209 - RNA, 18 nt, Human
auuuccguaauucuuauu

SEQ ID NO: 1950210 - RNA, 23 nt, Human
auuucccuuuagcuguguuauua

SEQ ID NO: 1950211 - RNA, 14 nt, Human
auuuccguaauucu

SEQ ID NO: 1950212 - RNA, 16 nt, Human
auuuccguaauucuua

SEQ ID NO: 1950213 - RNA, 22 nt, Human
auuugaacauguggcuugaauu

SEQ ID NO: 1950214 - RNA, 20 nt, Human
auuugaaagugccuuugcag

SEQ ID NO: 1950215 - RNA, 22 nt, Human
auuugaaagugccuuugcagcu

SEQ ID NO: 1950216 - RNA, 18 nt, Human
auuugaaaaugauaaaag

SEQ ID NO: 1950217 - RNA, 17 nt, Human
auuugaaagugccuuug

SEQ ID NO: 1950218 - RNA, 14 nt, Human
auuugaaaauuuug

SEQ ID NO: 1950219 - RNA, 17 nt, Human
auuugaaaacagaaauu

SEQ ID NO: 1950220 - RNA, 19 nt, Human
auuugaaaacagaaauugg

SEQ ID NO: 1950221 - RNA, 20 nt, Human
auuugaaaacagaaauuggu

SEQ ID NO: 1950222 - RNA, 15 nt, Human
auuuccccagggcac

SEQ ID NO: 1950223 - RNA, 14 nt, Human
auuuccccagggca

SEQ ID NO: 1950224 - RNA, 17 nt, Human
auuucccccuuucuucc

SEQ ID NO: 1950225 - RNA, 14 nt, Human
auuucccccuuucu

SEQ ID NO: 1950226 - RNA, 18 nt, Human
auuucccccuuucuuccu

SEQ ID NO: 1950227 - RNA, 19 nt, Human
auuucccccuuucuuccuc

SEQ ID NO: 1950228 - RNA, 20 nt, Human
auuucccccuuucuuccuca

SEQ ID NO: 1950229 - RNA, 16 nt, Human
auuuccccuaaucuuu

SEQ ID NO: 1950230 - RNA, 20 nt, Human
auuuccagugaaaucaguua

SEQ ID NO: 1950231 - RNA, 17 nt, Human
auuuccagccaaagccu

SEQ ID NO: 1950232 - RNA, 22 nt, Human
auuucauuugugccagaaugcu

SEQ ID NO: 1950233 - RNA, 16 nt, Human
auuucaaacggccuca

SEQ ID NO: 1950234 - RNA, 21 nt, Human
auuucauucgggccccaccug

SEQ ID NO: 1950235 - RNA, 15 nt, Human
auugggccccugcca

SEQ ID NO: 1950236 - RNA, 16 nt, Human
auugggccccugccag

SEQ ID NO: 1950237 - RNA, 21 nt, Human
auuggguggggggcuucauac

SEQ ID NO: 1950238 - RNA, 22 nt, Human
auuggguggggggcuucauaca

SEQ ID NO: 1950239 - RNA, 20 nt, Human
auuggguggggggcuucaua

SEQ ID NO: 1950240 - RNA, 18 nt, Human
auugacccacaagaaaug

SEQ ID NO: 1950241 - RNA, 17 nt, Human
auugacaggcgaaagaa

SEQ ID NO: 1950242 - RNA, 18 nt, Human
auugaaagaauguaaagc

SEQ ID NO: 1950243 - RNA, 20 nt, Human
auugaaagaauguaaagcaa

SEQ ID NO: 1950244 - RNA, 13 nt, Human
auugaaagaaugu

SEQ ID NO: 1950245 - RNA, 14 nt, Human
auugaaagaaugua

SEQ ID NO: 1950246 - RNA, 17 nt, Human
auugaaagaauguaaag

SEQ ID NO: 1950247 - RNA, 20 nt, Human
auugaaaauuauuaaucaga

SEQ ID NO: 1950248 - RNA, 22 nt, Human
auugaaaauuauuaaucagaag

SEQ ID NO: 1950249 - RNA, 21 nt, Human
auugaaaaguuauuucccuuu

SEQ ID NO: 1950250 - RNA, 16 nt, Human
auucuuuuugaaaugu

SEQ ID NO: 1950251 - RNA, 23 nt, Human
auucuuauuccauauuagaaaac

SEQ ID NO: 1950252 - RNA, 18 nt, Human
auucuuauuuaaugaaag

SEQ ID NO: 1950253 - RNA, 14 nt, Human
auucuuauuuaaug

SEQ ID NO: 1950254 - RNA, 13 nt, Human
auucuuauuccau

SEQ ID NO: 1950255 - RNA, 21 nt, Human
auucuuauuccauauuagaaa

SEQ ID NO: 1950256 - RNA, 22 nt, Human
auucuuauuccauauuagaaaa

SEQ ID NO: 1950257 - RNA, 13 nt, Human
auucuuauuacua

SEQ ID NO: 1950258 - RNA, 13 nt, Human
auucuuauuuaau

SEQ ID NO: 1950259 - RNA, 18 nt, Human
auucuuuucugaaguugu

SEQ ID NO: 1950260 - RNA, 15 nt, Human
auucuuugcaaaaau

SEQ ID NO: 1950261 - RNA, 21 nt, Human
auucuuugcacuuuuucuuaa

SEQ ID NO: 1950262 - RNA, 17 nt, Human
auucuuuguuaauuugg

SEQ ID NO: 1950263 - RNA, 13 nt, Human
auucuucuccacu

SEQ ID NO: 1950264 - RNA, 22 nt, Human
auucuuccucccucccucuuuc

SEQ ID NO: 1950265 - RNA, 19 nt, Human
auucuguuuuuaaaaauua

SEQ ID NO: 1950266 - RNA, 23 nt, Human
auucugucuucauccccucagaa

SEQ ID NO: 1950267 - RNA, 24 nt, Human
auucugucucuggauuauauuaug

SEQ ID NO: 1950268 - RNA, 19 nt, Human
auucugggaauguauagua

SEQ ID NO: 1950269 - RNA, 16 nt, Human
auucugggaauguaua

SEQ ID NO: 1950270 - RNA, 17 nt, Human
auucugggaauguauag

SEQ ID NO: 1950271 - RNA, 22 nt, Human
auucugggaauguauaguauuu

SEQ ID NO: 1950272 - RNA, 15 nt, Human
auucugggaauguau

SEQ ID NO: 1950273 - RNA, 14 nt, Human
auucugauuucuuu

SEQ ID NO: 1950274 - RNA, 20 nt, Human
auucugauuucuuuucacca

SEQ ID NO: 1950275 - RNA, 14 nt, Human
auugugucucuugg

SEQ ID NO: 1950276 - RNA, 18 nt, Human
auugugucucuugguccu

SEQ ID NO: 1950277 - RNA, 12 nt, Human
auugguguugac

SEQ ID NO: 1950278 - RNA, 19 nt, Human
auugguguaagguacuuuc

SEQ ID NO: 1950279 - RNA, 18 nt, Human
auuggucuaucuacuggc

SEQ ID NO: 1950280 - RNA, 17 nt, Human
auuggugaguuaggaac

SEQ ID NO: 1950281 - RNA, 13 nt, Human
auuguauucagag

SEQ ID NO: 1950282 - RNA, 20 nt, Human
auuguccccgacccuugccg

SEQ ID NO: 1950283 - RNA, 19 nt, Human
auuguccccgacccuugcc

SEQ ID NO: 1950284 - RNA, 17 nt, Human
auuguccccgacccuug

SEQ ID NO: 1950285 - RNA, 13 nt, Human
auuguccagagcu

SEQ ID NO: 1950286 - RNA, 19 nt, Human
auuguccagagcugcuucc

SEQ ID NO: 1950287 - RNA, 23 nt, Human
auuguccagagcugcuuccccgu

SEQ ID NO: 1950288 - RNA, 13 nt, Human
auugugauguguc

SEQ ID NO: 1950289 - RNA, 14 nt, Human
auugugaugugucc

SEQ ID NO: 1950290 - RNA, 15 nt, Human
auugugauguguccu

SEQ ID NO: 1950291 - RNA, 17 nt, Human
auugugaauaaugauuu

SEQ ID NO: 1950292 - RNA, 14 nt, Human
auuuucaaugugau

SEQ ID NO: 1950293 - RNA, 18 nt, Human
auuuucaacgcagcccug

SEQ ID NO: 1950294 - RNA, 20 nt, Human
auuuucaacgcagcccugcu

SEQ ID NO: 1950295 - RNA, 20 nt, Human
auuuucaagacugaauucca

SEQ ID NO: 1950296 - RNA, 21 nt, Human
auuuuauuuuuuucugaauua

SEQ ID NO: 1950297 - RNA, 18 nt, Human
auuuuauuuuuagaauuu

SEQ ID NO: 1950298 - RNA, 23 nt, Human
auuuuagcaaagcggguuauaau

SEQ ID NO: 1950299 - RNA, 11 nt, Human
auuuuauucuu

SEQ ID NO: 1950300 - RNA, 12 nt, Human
auuuuauucuug

SEQ ID NO: 1950301 - RNA, 13 nt, Human
auuuuauucuuga

SEQ ID NO: 1950302 - RNA, 14 nt, Human
auuuuauucuugau

SEQ ID NO: 1950303 - RNA, 15 nt, Human
auuuuauucuugauc

SEQ ID NO: 1950304 - RNA, 15 nt, Human
auuuuauuuuuagaa

SEQ ID NO: 1950305 - RNA, 19 nt, Human
auuuuccaucuaaaaauau

SEQ ID NO: 1950306 - RNA, 15 nt, Human
auuuuccaucuaaaa

SEQ ID NO: 1950307 - RNA, 18 nt, Human
auuuuccaucuaaaaaua

SEQ ID NO: 1950308 - RNA, 13 nt, Human
auuuucauuagca

SEQ ID NO: 1950309 - RNA, 14 nt, Human
auuuucauuagcaa

SEQ ID NO: 1950310 - RNA, 15 nt, Human
auuuucauuagcaaa

SEQ ID NO: 1950311 - RNA, 16 nt, Human
auuuucauuagcaaaa

SEQ ID NO: 1950312 - RNA, 14 nt, Human
auuuucauuuuaca

SEQ ID NO: 1950313 - RNA, 17 nt, Human
auuuucauuuuacaguu

SEQ ID NO: 1950314 - RNA, 17 nt, Human
auuuucauuagcaaaaa

SEQ ID NO: 1950315 - RNA, 22 nt, Human
auuuucauuagcaaaaaaaguu

SEQ ID NO: 1950316 - RNA, 22 nt, Human
auuuucaguuauuauauuuaca

SEQ ID NO: 1950317 - RNA, 13 nt, Human
auuuucagauuca

SEQ ID NO: 1950318 - RNA, 12 nt, Human
auuuucagauuu

SEQ ID NO: 1950319 - RNA, 13 nt, Human
auuuucagauuug

SEQ ID NO: 1950320 - RNA, 20 nt, Human
auuuucagauuugcacaaaa

SEQ ID NO: 1950321 - RNA, 18 nt, Human
auuuucagauuugcacaa

SEQ ID NO: 1950322 - RNA, 19 nt, Human
auuuucagauuugcacaaa

SEQ ID NO: 1950323 - RNA, 14 nt, Human
auuuucagauuugc

SEQ ID NO: 1950324 - RNA, 15 nt, Human
auuuucagauuugca

SEQ ID NO: 1950325 - RNA, 16 nt, Human
auuuucagauuugcac

SEQ ID NO: 1950326 - RNA, 17 nt, Human
auuuucagauuugcaca

SEQ ID NO: 1950327 - RNA, 14 nt, Human
auuugugauacaau

SEQ ID NO: 1950328 - RNA, 23 nt, Human
auuugugaagguggaaauaaacu

SEQ ID NO: 1950329 - RNA, 23 nt, Human
auuugaagguagaauguuuucaa

SEQ ID NO: 1950330 - RNA, 18 nt, Human
auuugaagguagaauguu

SEQ ID NO: 1950331 - RNA, 17 nt, Human
auuuuaccuuugacaaa

SEQ ID NO: 1950332 - RNA, 16 nt, Human
auuuuacauaaauuua

SEQ ID NO: 1950333 - RNA, 17 nt, Human
auuuuacauaaauuuag

SEQ ID NO: 1950334 - RNA, 13 nt, Human
auuuuacauaaau

SEQ ID NO: 1950335 - RNA, 15 nt, Human
auuuuaauucaguug

SEQ ID NO: 1950336 - RNA, 16 nt, Human
auuuuaauguaauuga

SEQ ID NO: 1950337 - RNA, 15 nt, Human
auuuuaaacagagga

SEQ ID NO: 1950338 - RNA, 15 nt, Human
uugggcagagaggcu

SEQ ID NO: 1950339 - RNA, 19 nt, Human
uuggggaagaacgaagcca

SEQ ID NO: 1950340 - RNA, 17 nt, Human
uugggguacccacugcu

SEQ ID NO: 1950341 - RNA, 12 nt, Human
uugggcucccaa

SEQ ID NO: 1950342 - RNA, 13 nt, Human
uugggcucugcug

SEQ ID NO: 1950343 - RNA, 20 nt, Human
augaaccacaucuugcucug

SEQ ID NO: 1950344 - RNA, 13 nt, Human
augaaccacaucu

SEQ ID NO: 1950345 - RNA, 12 nt, Human
augaacagacuu

SEQ ID NO: 1950346 - RNA, 13 nt, Human
augaacagugcac

SEQ ID NO: 1950347 - RNA, 16 nt, Human
augaacauacaaaugc

SEQ ID NO: 1950348 - RNA, 15 nt, Human
augaacauguuuuag

SEQ ID NO: 1950349 - RNA, 19 nt, Human
uugguuuuuauuucuccuu

SEQ ID NO: 1950350 - RNA, 17 nt, Human
uuguaacuaaaauaauu

SEQ ID NO: 1950351 - RNA, 18 nt, Human
uuguaacuaaaauaauuu

SEQ ID NO: 1950352 - RNA, 21 nt, Human
uuguaacuaaaauaauuuugu

SEQ ID NO: 1950353 - RNA, 13 nt, Human
uuguaaaaaugua

SEQ ID NO: 1950354 - RNA, 14 nt, Human
uuguaaggaaugau

SEQ ID NO: 1950355 - RNA, 22 nt, Human
uuguaagcaugcacaaauucug

SEQ ID NO: 1950356 - RNA, 13 nt, Human
uuguaagaaauac

SEQ ID NO: 1950357 - RNA, 14 nt, Human
uuguaagaaauacu

SEQ ID NO: 1950358 - RNA, 22 nt, Human
uuguaacuaaaauaauuuugua

SEQ ID NO: 1950359 - RNA, 23 nt, Human
uuguaacuaaaauaauuuuguaa

SEQ ID NO: 1950360 - RNA, 22 nt, Human
uuguaacuauguuuaaaguaau

SEQ ID NO: 1950361 - RNA, 21 nt, Human
uuguaacuguuuagaugaaug

SEQ ID NO: 1950362 - RNA, 22 nt, Human
uuguaacuguuuagaugaaugu

SEQ ID NO: 1950363 - RNA, 11 nt, Human
uuguaagaaau

SEQ ID NO: 1950364 - RNA, 21 nt, Human
uugguuccaagucuuugcuau

SEQ ID NO: 1950365 - RNA, 22 nt, Human
uugguuccaagucuuugcuauu

SEQ ID NO: 1950366 - RNA, 18 nt, Human
uugguucauuuucagauu

SEQ ID NO: 1950367 - RNA, 19 nt, Human
uugguuaggcauuguggga

SEQ ID NO: 1950368 - RNA, 20 nt, Human
uugguuauagugcaauauau

SEQ ID NO: 1950369 - RNA, 23 nt, Human
uugguuauagugcaauauauuuu

SEQ ID NO: 1950370 - RNA, 13 nt, Human
uugguucaaaugu

SEQ ID NO: 1950371 - RNA, 15 nt, Human
uugguucaaaugugu

SEQ ID NO: 1950372 - RNA, 22 nt, Human
uugggguacccacugcucuggu

SEQ ID NO: 1950373 - RNA, 20 nt, Human
uuguaaggaaugauuaauua

SEQ ID NO: 1950374 - RNA, 16 nt, Human
uuguaagcguauggcu

SEQ ID NO: 1950375 - RNA, 17 nt, Human
uuguaagcguauggcuu

SEQ ID NO: 1950376 - RNA, 18 nt, Human
uuguaagcguauggcuuu

SEQ ID NO: 1950377 - RNA, 22 nt, Human
uuguaagcguauggcuuuauuu

SEQ ID NO: 1950378 - RNA, 13 nt, Human
uuguaaugaaaac

SEQ ID NO: 1950379 - RNA, 13 nt, Human
uuguaauguaacu

SEQ ID NO: 1950380 - RNA, 14 nt, Human
uuguaauguaacug

SEQ ID NO: 1950381 - RNA, 12 nt, Human
uuguaauguugu

SEQ ID NO: 1950382 - RNA, 19 nt, Human
uuguaauguugugaauaau

SEQ ID NO: 1950383 - RNA, 21 nt, Human
uuguaauguugugaauaauua

SEQ ID NO: 1950384 - RNA, 23 nt, Human
uuguaauguugugaauaauuaca

SEQ ID NO: 1950385 - RNA, 15 nt, Human
uuguaauguaacugc

SEQ ID NO: 1950386 - RNA, 20 nt, Human
uuguaauguaacugcucuug

SEQ ID NO: 1950387 - RNA, 21 nt, Human
uuguaauuaauaauagauugu

SEQ ID NO: 1950388 - RNA, 15 nt, Human
uuguaguucuuuaaa

SEQ ID NO: 1950389 - RNA, 12 nt, Human
uuguauaaauuu

SEQ ID NO: 1950390 - RNA, 19 nt, Human
uuguauaaauuuauuuacu

SEQ ID NO: 1950391 - RNA, 17 nt, Human
uuguaguucuuuaaacu

SEQ ID NO: 1950392 - RNA, 23 nt, Human
uuguauaaauuuauuuacugcua

SEQ ID NO: 1950393 - RNA, 22 nt, Human
uuguauaguuauguaaauaauu

SEQ ID NO: 1950394 - RNA, 16 nt, Human
augacaaauguuucua

SEQ ID NO: 1950395 - RNA, 16 nt, Human
augacaaaauucuuuc

SEQ ID NO: 1950396 - RNA, 13 nt, Human
augacaaauguuu

SEQ ID NO: 1950397 - RNA, 15 nt, Human
augacaaauguuucu

SEQ ID NO: 1950398 - RNA, 19 nt, Human
augacacgaauauugcuga

SEQ ID NO: 1950399 - RNA, 20 nt, Human
augacacgaauauugcugau

SEQ ID NO: 1950400 - RNA, 15 nt, Human
augacaggccugucc

SEQ ID NO: 1950401 - RNA, 23 nt, Human
augacagaaaauauguauuaaca

SEQ ID NO: 1950402 - RNA, 14 nt, Human
augacagaaaauau

SEQ ID NO: 1950403 - RNA, 18 nt, Human
augacagaaaauauguau

SEQ ID NO: 1950404 - RNA, 19 nt, Human
augacagaaaauauguauu

SEQ ID NO: 1950405 - RNA, 20 nt, Human
augacagaaaauauguauua

SEQ ID NO: 1950406 - RNA, 16 nt, Human
uugcuuuuaaaaucca

SEQ ID NO: 1950407 - RNA, 12 nt, Human
uugcuuuaauuu

SEQ ID NO: 1950408 - RNA, 21 nt, Human
uugcuuuaauuccaugaaugu

SEQ ID NO: 1950409 - RNA, 18 nt, Human
uugcuuuuaaaauuuuaa

SEQ ID NO: 1950410 - RNA, 15 nt, Human
uugcuuuuaaaauuu

SEQ ID NO: 1950411 - RNA, 17 nt, Human
uuggaaagaguaggaag

SEQ ID NO: 1950412 - RNA, 19 nt, Human
uuggaaacacuaaauguua

SEQ ID NO: 1950413 - RNA, 20 nt, Human
uuggaaacacuaaauguuaa

SEQ ID NO: 1950414 - RNA, 21 nt, Human
uuggaaacacuaaauguuaaa

SEQ ID NO: 1950415 - RNA, 14 nt, Human
uugcuuuugagaga

SEQ ID NO: 1950416 - RNA, 15 nt, Human
uugcuuuugagagaa

SEQ ID NO: 1950417 - RNA, 19 nt, Human
uugcugauggugcaaugac

SEQ ID NO: 1950418 - RNA, 18 nt, Human
uugcugauggugcaauga

SEQ ID NO: 1950419 - RNA, 17 nt, Human
uugcugauggugcaaug

SEQ ID NO: 1950420 - RNA, 20 nt, Human
uugcugaccccacuuggacu

SEQ ID NO: 1950421 - RNA, 12 nt, Human
uugcugacuuag

SEQ ID NO: 1950422 - RNA, 14 nt, Human
uugcugacuuagaa

SEQ ID NO: 1950423 - RNA, 15 nt, Human
uugcugacuuagaau

SEQ ID NO: 1950424 - RNA, 17 nt, Human
uugcugaacauuggaga

SEQ ID NO: 1950425 - RNA, 18 nt, Human
uugcugaacauuggagaa

SEQ ID NO: 1950426 - RNA, 19 nt, Human
uugcugaauacagaggcaa

SEQ ID NO: 1950427 - RNA, 14 nt, Human
uugcuccccuuccc

SEQ ID NO: 1950428 - RNA, 16 nt, Human
uugcuccccuuccccu

SEQ ID NO: 1950429 - RNA, 17 nt, Human
uugcuccccuuccccuu

SEQ ID NO: 1950430 - RNA, 20 nt, Human
uugcuccccuuccccuuccu

SEQ ID NO: 1950431 - RNA, 21 nt, Human
uugcuccccuuccccuuccuu

SEQ ID NO: 1950432 - RNA, 22 nt, Human
uugcuccccuuccccuuccuuc

SEQ ID NO: 1950433 - RNA, 20 nt, Human
uugcuaugagcuggggaugu

SEQ ID NO: 1950434 - RNA, 14 nt, Human
uugcuaucucuauu

SEQ ID NO: 1950435 - RNA, 13 nt, Human
uugcuaucauugu

SEQ ID NO: 1950436 - RNA, 20 nt, Human
uugcuaagugaggaugaaaa

SEQ ID NO: 1950437 - RNA, 17 nt, Human
uugcuaaguaaaucucu

SEQ ID NO: 1950438 - RNA, 19 nt, Human
uugcuaaguaaaucucuuc

SEQ ID NO: 1950439 - RNA, 21 nt, Human
uugcuaaguaaaucucuucug

SEQ ID NO: 1950440 - RNA, 22 nt, Human
uugcuaaguaaaucucuucugu

SEQ ID NO: 1950441 - RNA, 23 nt, Human
uugcuaccacggccuccuuuccg

SEQ ID NO: 1950442 - RNA, 23 nt, Human
uuggaaagaguaggaagacuuug

SEQ ID NO: 1950443 - RNA, 18 nt, Human
uuggaaagaguaggaaga

SEQ ID NO: 1950444 - RNA, 21 nt, Human
uuggcuagagguucaaagaua

SEQ ID NO: 1950445 - RNA, 22 nt, Human
uuggcuagagguucaaagauau

SEQ ID NO: 1950446 - RNA, 22 nt, Human
uuggcuaggaccccuccaugug

SEQ ID NO: 1950447 - RNA, 15 nt, Human
uuggcugcugaaggc

SEQ ID NO: 1950448 - RNA, 11 nt, Human
uuggcugcuga

SEQ ID NO: 1950449 - RNA, 23 nt, Human
uuggcuauuagagaucaaccccu

SEQ ID NO: 1950450 - RNA, 14 nt, Human
uuggcugcagggag

SEQ ID NO: 1950451 - RNA, 22 nt, Human
uuggcgcugccccuggcagccc

SEQ ID NO: 1950452 - RNA, 17 nt, Human
aucuuuccauauccaua

SEQ ID NO: 1950453 - RNA, 14 nt, Human
augaaaugagguca

SEQ ID NO: 1950454 - RNA, 14 nt, Human
augaaaugaacaca

SEQ ID NO: 1950455 - RNA, 16 nt, Human
augaaaugaacacaaa

SEQ ID NO: 1950456 - RNA, 19 nt, Human
augaaagauggcugugccu

SEQ ID NO: 1950457 - RNA, 20 nt, Human
augaaagauggcugugccuc

SEQ ID NO: 1950458 - RNA, 23 nt, Human
augaaagauggcugugccucugc

SEQ ID NO: 1950459 - RNA, 20 nt, Human
augaaagacuguacaaagua

SEQ ID NO: 1950460 - RNA, 10 nt, Human
uugugugugg

SEQ ID NO: 1950461 - RNA, 13 nt, Human
uugugugugggag

SEQ ID NO: 1950462 - RNA, 16 nt, Human
uuguguguccccuugc

SEQ ID NO: 1950463 - RNA, 16 nt, Human
uugugugugggagugu

SEQ ID NO: 1950464 - RNA, 22 nt, Human
uugugaaggcaggggaauguau

SEQ ID NO: 1950465 - RNA, 23 nt, Human
uugugaagugaaggauuuguguu

SEQ ID NO: 1950466 - RNA, 16 nt, Human
uugugaauaaugauuu

SEQ ID NO: 1950467 - RNA, 18 nt, Human
uugugaagguggaaauaa

SEQ ID NO: 1950468 - RNA, 17 nt, Human
uugugaagguggaaaua

SEQ ID NO: 1950469 - RNA, 19 nt, Human
uugugaacaagucccugua

SEQ ID NO: 1950470 - RNA, 14 nt, Human
uugucggcuccagu

SEQ ID NO: 1950471 - RNA, 20 nt, Human
uugucggcuccaguccccag

SEQ ID NO: 1950472 - RNA, 14 nt, Human
uugugaaauuuuuc

SEQ ID NO: 1950473 - RNA, 15 nt, Human
uugugaaauuuuuca

SEQ ID NO: 1950474 - RNA, 17 nt, Human
uugugaaauuuuucaua

SEQ ID NO: 1950475 - RNA, 19 nt, Human
uugugaaauuuuucauauu

SEQ ID NO: 1950476 - RNA, 21 nt, Human
uugugaaauuuuucauauuuu

SEQ ID NO: 1950477 - RNA, 23 nt, Human
uugugaaauuuuucauauuuuaa

SEQ ID NO: 1950478 - RNA, 14 nt, Human
augaucuucuuuau

SEQ ID NO: 1950479 - RNA, 15 nt, Human
augauccuaaugaau

SEQ ID NO: 1950480 - RNA, 16 nt, Human
augauccuaggcauuu

SEQ ID NO: 1950481 - RNA, 23 nt, Human
augaucacggcucacugcagccu

SEQ ID NO: 1950482 - RNA, 18 nt, Human
augaucacggcucacugc

SEQ ID NO: 1950483 - RNA, 19 nt, Human
augaucacggcucacugca

SEQ ID NO: 1950484 - RNA, 15 nt, Human
augaucacggcucac

SEQ ID NO: 1950485 - RNA, 14 nt, Human
uuguugcacugaag

SEQ ID NO: 1950486 - RNA, 15 nt, Human
uuguugcacugaagu

SEQ ID NO: 1950487 - RNA, 17 nt, Human
uuguugcacugaaguuu

SEQ ID NO: 1950488 - RNA, 20 nt, Human
uuguugcacugaaguuugau

SEQ ID NO: 1950489 - RNA, 15 nt, Human
uuguugauucucucc

SEQ ID NO: 1950490 - RNA, 17 nt, Human
uuguugauucucuccau

SEQ ID NO: 1950491 - RNA, 22 nt, Human
augcaaaccaucauugaaaucu

SEQ ID NO: 1950492 - RNA, 21 nt, Human
augcaaaccaucauugaaauc

SEQ ID NO: 1950493 - RNA, 20 nt, Human
augcaaaccaucauugaaau

SEQ ID NO: 1950494 - RNA, 19 nt, Human
augcaaaccaucauugaaa

SEQ ID NO: 1950495 - RNA, 18 nt, Human
augcaaaccaucauugaa

SEQ ID NO: 1950496 - RNA, 16 nt, Human
augcaaaccaucauug

SEQ ID NO: 1950497 - RNA, 18 nt, Human
augaucuucuuuauaauu

SEQ ID NO: 1950498 - RNA, 15 nt, Human
augaucuucuuuaua

SEQ ID NO: 1950499 - RNA, 14 nt, Human
augcaaggucauuu

SEQ ID NO: 1950500 - RNA, 16 nt, Human
augcaaggucauuuuu

SEQ ID NO: 1950501 - RNA, 22 nt, Human
augcaaacuuuauuuuguguuu

SEQ ID NO: 1950502 - RNA, 15 nt, Human
augaucugugccuuu

SEQ ID NO: 1950503 - RNA, 19 nt, Human
augaucugugccuuuuuua

SEQ ID NO: 1950504 - RNA, 23 nt, Human
augaucugugccuuuuuuauauc

SEQ ID NO: 1950505 - RNA, 16 nt, Human
augcaccuggaauaua

SEQ ID NO: 1950506 - RNA, 14 nt, Human
augcaccuggaaua

SEQ ID NO: 1950507 - RNA, 16 nt, Human
augcaaguauucucau

SEQ ID NO: 1950508 - RNA, 22 nt, Human
augcaaggucauuuuuuuuaag

SEQ ID NO: 1950509 - RNA, 19 nt, Human
augcaccuggaauauauaa

SEQ ID NO: 1950510 - RNA, 16 nt, Human
augcaaguuuuuuuuc

SEQ ID NO: 1950511 - RNA, 13 nt, Human
uuguuuuguacag

SEQ ID NO: 1950512 - RNA, 14 nt, Human
uuguuuuguugcac

SEQ ID NO: 1950513 - RNA, 21 nt, Human
uuguuuuguugcacugaaguu

SEQ ID NO: 1950514 - RNA, 18 nt, Human
uuguuuuuuuuuuccacu

SEQ ID NO: 1950515 - RNA, 15 nt, Human
uuguuuuuguauauu

SEQ ID NO: 1950516 - RNA, 12 nt, Human
uuguuuuuugaa

SEQ ID NO: 1950517 - RNA, 14 nt, Human
uuguuuuuugaagu

SEQ ID NO: 1950518 - RNA, 16 nt, Human
uuguuuuuugaagugu

SEQ ID NO: 1950519 - RNA, 13 nt, Human
uuguuuuucugau

SEQ ID NO: 1950520 - RNA, 12 nt, Human
uuguuuuucugc

SEQ ID NO: 1950521 - RNA, 18 nt, Human
uuguuuuucugcuuuaga

SEQ ID NO: 1950522 - RNA, 15 nt, Human
uuguuuuuguaaaga

SEQ ID NO: 1950523 - RNA, 13 nt, Human
uuguuuuuguaua

SEQ ID NO: 1950524 - RNA, 19 nt, Human
uuguuuuuaaguuugcacu

SEQ ID NO: 1950525 - RNA, 17 nt, Human
uuuaaaaaauuaaucug

SEQ ID NO: 1950526 - RNA, 18 nt, Human
uuuaaacuucuuaacugg

SEQ ID NO: 1950527 - RNA, 17 nt, Human
uuuaaagaaaaaaaugu

SEQ ID NO: 1950528 - RNA, 18 nt, Human
uuuaaagaaaaaaauguc

SEQ ID NO: 1950529 - RNA, 19 nt, Human
uuguuuuuuuuuuccacuu

SEQ ID NO: 1950530 - RNA, 17 nt, Human
uuguuuuuugaaguguu

SEQ ID NO: 1950531 - RNA, 12 nt, Human
uuguuuuuugag

SEQ ID NO: 1950532 - RNA, 13 nt, Human
uuguuuuuugagu

SEQ ID NO: 1950533 - RNA, 17 nt, Human
augagccucagcauccu

SEQ ID NO: 1950534 - RNA, 18 nt, Human
augagccucagcauccug

SEQ ID NO: 1950535 - RNA, 13 nt, Human
augagugagaaua

SEQ ID NO: 1950536 - RNA, 15 nt, Human
augauaaaacacaaa

SEQ ID NO: 1950537 - RNA, 18 nt, Human
uugucacacacuuuggcu

SEQ ID NO: 1950538 - RNA, 19 nt, Human
uugucaccugcuucucugc

SEQ ID NO: 1950539 - RNA, 15 nt, Human
uugucaccugcuucu

SEQ ID NO: 1950540 - RNA, 23 nt, Human
augagugugauccaguuuuucau

SEQ ID NO: 1950541 - RNA, 17 nt, Human
uugucacugagaagaug

SEQ ID NO: 1950542 - RNA, 14 nt, Human
uugucacugcuuca

SEQ ID NO: 1950543 - RNA, 13 nt, Human
uugucauuuucau

SEQ ID NO: 1950544 - RNA, 14 nt, Human
uugucauuuucauu

SEQ ID NO: 1950545 - RNA, 19 nt, Human
uugucauuuucauuagcaa

SEQ ID NO: 1950546 - RNA, 20 nt, Human
uugucauuuucauuagcaaa

SEQ ID NO: 1950547 - RNA, 18 nt, Human
uugucccuggcuuccuua

SEQ ID NO: 1950548 - RNA, 19 nt, Human
uugucccuggcuuccuuac

SEQ ID NO: 1950549 - RNA, 18 nt, Human
uugucccugaagagaagg

SEQ ID NO: 1950550 - RNA, 16 nt, Human
uuguccuauuaguguu

SEQ ID NO: 1950551 - RNA, 15 nt, Human
uuguccgguuuacuu

SEQ ID NO: 1950552 - RNA, 17 nt, Human
uuguccgguuuacuuua

SEQ ID NO: 1950553 - RNA, 21 nt, Human
uuguccgguuuacuuuaacuu

SEQ ID NO: 1950554 - RNA, 13 nt, Human
uugugaaauuauu

SEQ ID NO: 1950555 - RNA, 15 nt, Human
uuguccuuugauucc

SEQ ID NO: 1950556 - RNA, 16 nt, Human
uuguccuccugcugcc

SEQ ID NO: 1950557 - RNA, 17 nt, Human
uuguccuccugcugcca

SEQ ID NO: 1950558 - RNA, 19 nt, Human
uuguccuccugcugccagu

SEQ ID NO: 1950559 - RNA, 17 nt, Human
uuguccuauuaguguua

SEQ ID NO: 1950560 - RNA, 19 nt, Human
uuguccuauuaguguuaua

SEQ ID NO: 1950561 - RNA, 20 nt, Human
uuguccuauuaguguuauau

SEQ ID NO: 1950562 - RNA, 13 nt, Human
uuguccuccugcu

SEQ ID NO: 1950563 - RNA, 15 nt, Human
uuguccuccugcugc

SEQ ID NO: 1950564 - RNA, 21 nt, Human
augagcaucaggccaggcccu

SEQ ID NO: 1950565 - RNA, 20 nt, Human
augagcaucaggccaggccc

SEQ ID NO: 1950566 - RNA, 19 nt, Human
augagcaucaggccaggcc

SEQ ID NO: 1950567 - RNA, 18 nt, Human
augagcaucaggccaggc

SEQ ID NO: 1950568 - RNA, 17 nt, Human
augagcaucaggccagg

SEQ ID NO: 1950569 - RNA, 16 nt, Human
augagcaucaggccag

SEQ ID NO: 1950570 - RNA, 15 nt, Human
augagcaucaggcca

SEQ ID NO: 1950571 - RNA, 22 nt, Human
augagcaucaggccaggcccuc

SEQ ID NO: 1950572 - RNA, 17 nt, Human
augagcaauaucugcua

SEQ ID NO: 1950573 - RNA, 13 nt, Human
augagcacuucua

SEQ ID NO: 1950574 - RNA, 14 nt, Human
augagcacuucuaa

SEQ ID NO: 1950575 - RNA, 12 nt, Human
augagccucagc

SEQ ID NO: 1950576 - RNA, 15 nt, Human
augagccucagcauc

SEQ ID NO: 1950577 - RNA, 16 nt, Human
augagccucagcaucc

SEQ ID NO: 1950578 - RNA, 13 nt, Human
augagaggaaauc

SEQ ID NO: 1950579 - RNA, 12 nt, Human
augagaggaaau

SEQ ID NO: 1950580 - RNA, 15 nt, Human
augagaggaaaucac

SEQ ID NO: 1950581 - RNA, 14 nt, Human
augagaggaaauca

SEQ ID NO: 1950582 - RNA, 16 nt, Human
augagaggaaaucacc

SEQ ID NO: 1950583 - RNA, 20 nt, Human
augagaggggagagcugaac

SEQ ID NO: 1950584 - RNA, 21 nt, Human
uuucuaggacugaauuaugaa

SEQ ID NO: 1950585 - RNA, 17 nt, Human
uuucuaggacugaauua

SEQ ID NO: 1950586 - RNA, 22 nt, Human
uuucuaggacugaauuaugaaa

SEQ ID NO: 1950587 - RNA, 20 nt, Human
uuucuaggccuacaugcuuu

SEQ ID NO: 1950588 - RNA, 14 nt, Human
uuucuaguuauuua

SEQ ID NO: 1950589 - RNA, 15 nt, Human
uuucuaguuauuuau

SEQ ID NO: 1950590 - RNA, 18 nt, Human
uuucuauaauuuuacaag

SEQ ID NO: 1950591 - RNA, 15 nt, Human
uuucuaugacacaug

SEQ ID NO: 1950592 - RNA, 21 nt, Human
uuucuaugacacaugcaaggu

SEQ ID NO: 1950593 - RNA, 14 nt, Human
uuucuauuuucucu

SEQ ID NO: 1950594 - RNA, 16 nt, Human
uuucuauuuucucuga

SEQ ID NO: 1950595 - RNA, 22 nt, Human
uuucucaaagccccauuaacug

SEQ ID NO: 1950596 - RNA, 16 nt, Human
uuucugccgcagcccu

SEQ ID NO: 1950597 - RNA, 14 nt, Human
uuucugccgcagcc

SEQ ID NO: 1950598 - RNA, 22 nt, Human
uuucucauuugccaauaauaau

SEQ ID NO: 1950599 - RNA, 13 nt, Human
uuucucauguuga

SEQ ID NO: 1950600 - RNA, 15 nt, Human
uuucucauguugaaa

SEQ ID NO: 1950601 - RNA, 23 nt, Human
augggcuggguucuacccaggug

SEQ ID NO: 1950602 - RNA, 16 nt, Human
uuugaaauauggucuu

SEQ ID NO: 1950603 - RNA, 13 nt, Human
uuugaaauauaug

SEQ ID NO: 1950604 - RNA, 21 nt, Human
uuugaaauauauggucuaaug

SEQ ID NO: 1950605 - RNA, 22 nt, Human
uuugaaauauauggucuaaugu

SEQ ID NO: 1950606 - RNA, 13 nt, Human
auggggcccugcc

SEQ ID NO: 1950607 - RNA, 14 nt, Human
auggggcccugccu

SEQ ID NO: 1950608 - RNA, 13 nt, Human
auggggaggacaa

SEQ ID NO: 1950609 - RNA, 17 nt, Human
auggggaggacaaaaug

SEQ ID NO: 1950610 - RNA, 17 nt, Human
auggggaggcaagugug

SEQ ID NO: 1950611 - RNA, 23 nt, Human
uuugaaacauugcuuuuaaaacu

SEQ ID NO: 1950612 - RNA, 22 nt, Human
uuugaaaccccuguaggccuca

SEQ ID NO: 1950613 - RNA, 15 nt, Human
uuugaaacauugcuu

SEQ ID NO: 1950614 - RNA, 18 nt, Human
uuugaaacauugcuuuua

SEQ ID NO: 1950615 - RNA, 21 nt, Human
uuugaaacaugcuuguguuuc

SEQ ID NO: 1950616 - RNA, 12 nt, Human
uuugaaacauug

SEQ ID NO: 1950617 - RNA, 13 nt, Human
uuugaaacauugc

SEQ ID NO: 1950618 - RNA, 14 nt, Human
uuugaaagugccuu

SEQ ID NO: 1950619 - RNA, 18 nt, Human
uuugaaagugccuuugca

SEQ ID NO: 1950620 - RNA, 21 nt, Human
uuugaaagugccuuugcagcu

SEQ ID NO: 1950621 - RNA, 23 nt, Human
uuugaaagugccuuugcagcuca

SEQ ID NO: 1950622 - RNA, 19 nt, Human
uuugaaacacuuugcauaa

SEQ ID NO: 1950623 - RNA, 17 nt, Human
uuugaaacacuuugcau

SEQ ID NO: 1950624 - RNA, 15 nt, Human
uuugaaaauaguuua

SEQ ID NO: 1950625 - RNA, 18 nt, Human
uuugaaaauaguuuauuu

SEQ ID NO: 1950626 - RNA, 11 nt, Human
uuugaaaagua

SEQ ID NO: 1950627 - RNA, 12 nt, Human
uuugaaaaguaa

SEQ ID NO: 1950628 - RNA, 14 nt, Human
uuugaaaaguaaua

SEQ ID NO: 1950629 - RNA, 17 nt, Human
uuugaaaaguaauauuu

SEQ ID NO: 1950630 - RNA, 22 nt, Human
uuugaaaaguaauauuuauuaa

SEQ ID NO: 1950631 - RNA, 11 nt, Human
uuugaaaauag

SEQ ID NO: 1950632 - RNA, 18 nt, Human
uuugaaaauaguuauuca

SEQ ID NO: 1950633 - RNA, 20 nt, Human
uuugaaaauaguuauucagu

SEQ ID NO: 1950634 - RNA, 14 nt, Human
uuugaaaauaguuu

SEQ ID NO: 1950635 - RNA, 13 nt, Human
uuucuuuguggcu

SEQ ID NO: 1950636 - RNA, 17 nt, Human
uuucugcuuuagacuug

SEQ ID NO: 1950637 - RNA, 19 nt, Human
uuucugcuuuagacuugaa

SEQ ID NO: 1950638 - RNA, 20 nt, Human
uuucugcuuuagacuugaaa

SEQ ID NO: 1950639 - RNA, 16 nt, Human
uuucugccuuuuguuc

SEQ ID NO: 1950640 - RNA, 17 nt, Human
uuucuggacucuggacu

SEQ ID NO: 1950641 - RNA, 18 nt, Human
uuucuggacucuggacuu

SEQ ID NO: 1950642 - RNA, 18 nt, Human
auggccucuucagaucuc

SEQ ID NO: 1950643 - RNA, 19 nt, Human
auggacaugaucuucuuua

SEQ ID NO: 1950644 - RNA, 23 nt, Human
auggaccaugcugucuggcacag

SEQ ID NO: 1950645 - RNA, 21 nt, Human
auggacccaauauuuaccaga

SEQ ID NO: 1950646 - RNA, 15 nt, Human
augggacuggccucu

SEQ ID NO: 1950647 - RNA, 12 nt, Human
augggagccggg

SEQ ID NO: 1950648 - RNA, 13 nt, Human
augggagcucaug

SEQ ID NO: 1950649 - RNA, 18 nt, Human
augggcaacccccagccu

SEQ ID NO: 1950650 - RNA, 15 nt, Human
augggagccgggcaa

SEQ ID NO: 1950651 - RNA, 19 nt, Human
augggcaacccccagccug

SEQ ID NO: 1950652 - RNA, 21 nt, Human
augggcaacccccagccugcu

SEQ ID NO: 1950653 - RNA, 14 nt, Human
augggcagagcaga

SEQ ID NO: 1950654 - RNA, 13 nt, Human
augggcagagcag

SEQ ID NO: 1950655 - RNA, 15 nt, Human
augggcagagcagag

SEQ ID NO: 1950656 - RNA, 15 nt, Human
augggccuccugugu

SEQ ID NO: 1950657 - RNA, 12 nt, Human
augggcaggaga

SEQ ID NO: 1950658 - RNA, 13 nt, Human
augggcaggagac

SEQ ID NO: 1950659 - RNA, 20 nt, Human
augggcagucauuuugcaga

SEQ ID NO: 1950660 - RNA, 15 nt, Human
augggcaguuucagu

SEQ ID NO: 1950661 - RNA, 14 nt, Human
uuucguuuguuugu

SEQ ID NO: 1950662 - RNA, 13 nt, Human
uuucguggcuuca

SEQ ID NO: 1950663 - RNA, 22 nt, Human
uuucgauucguuaagagagcaa

SEQ ID NO: 1950664 - RNA, 22 nt, Human
uuucgcaggauucuuccucccu

SEQ ID NO: 1950665 - RNA, 18 nt, Human
uuucgcaggauucuuccu

SEQ ID NO: 1950666 - RNA, 15 nt, Human
uuucgauguuuuuga

SEQ ID NO: 1950667 - RNA, 15 nt, Human
uuucgacuugcauuu

SEQ ID NO: 1950668 - RNA, 19 nt, Human
uuucgacuugcauuuuugc

SEQ ID NO: 1950669 - RNA, 17 nt, Human
uuuccuuuaauaugaaa

SEQ ID NO: 1950670 - RNA, 20 nt, Human
uuuccuugaggggagccagg

SEQ ID NO: 1950671 - RNA, 16 nt, Human
uuuccuugcauacaaa

SEQ ID NO: 1950672 - RNA, 19 nt, Human
uuuccuugcauacaaacaa

SEQ ID NO: 1950673 - RNA, 21 nt, Human
uuuccuuuuaaaacacuucca

SEQ ID NO: 1950674 - RNA, 15 nt, Human
uuuccuucagugccu

SEQ ID NO: 1950675 - RNA, 12 nt, Human
uuuccuucagug

SEQ ID NO: 1950676 - RNA, 16 nt, Human
uuuccuuacauaaaca

SEQ ID NO: 1950677 - RNA, 17 nt, Human
uuuccuuacauaaacau

SEQ ID NO: 1950678 - RNA, 11 nt, Human
uuuccuucagu

SEQ ID NO: 1950679 - RNA, 15 nt, Human
uuuccuguuugggaa

SEQ ID NO: 1950680 - RNA, 17 nt, Human
augggccuccugugugu

SEQ ID NO: 1950681 - RNA, 12 nt, Human
uuuccugugucu

SEQ ID NO: 1950682 - RNA, 21 nt, Human
uuuccuucauucaacccaccu

SEQ ID NO: 1950683 - RNA, 22 nt, Human
uuuccuucagugccuuauggaa

SEQ ID NO: 1950684 - RNA, 21 nt, Human
uuuccuucagugccuuaugga

SEQ ID NO: 1950685 - RNA, 18 nt, Human
uuuccuucagugccuuau

SEQ ID NO: 1950686 - RNA, 23 nt, Human
uuuccuucauucaacccaccugc

SEQ ID NO: 1950687 - RNA, 18 nt, Human
uuuccuuacauaaacauc

SEQ ID NO: 1950688 - RNA, 11 nt, Human
uuuccuucccu

SEQ ID NO: 1950689 - RNA, 16 nt, Human
uuuaaagcuuccauug

SEQ ID NO: 1950690 - RNA, 17 nt, Human
uuuaaaggcccuaucug

SEQ ID NO: 1950691 - RNA, 18 nt, Human
uuuaaagaaacaugguuu

SEQ ID NO: 1950692 - RNA, 20 nt, Human
uuuaaagaaaaaaaugucaa

SEQ ID NO: 1950693 - RNA, 15 nt, Human
augcgcaguugcugu

SEQ ID NO: 1950694 - RNA, 23 nt, Human
augcgcaggcuggcccugcccug

SEQ ID NO: 1950695 - RNA, 13 nt, Human
augcuaagugaaa

SEQ ID NO: 1950696 - RNA, 17 nt, Human
uuuaccuugucauuuug

SEQ ID NO: 1950697 - RNA, 21 nt, Human
uuuaccuuuuuuauacauaaa

SEQ ID NO: 1950698 - RNA, 14 nt, Human
uuuacuaauagaca

SEQ ID NO: 1950699 - RNA, 17 nt, Human
uuuacuaauagacaauu

SEQ ID NO: 1950700 - RNA, 18 nt, Human
uuuacuaauagacaauuu

SEQ ID NO: 1950701 - RNA, 14 nt, Human
uuuaccuuuuuuau

SEQ ID NO: 1950702 - RNA, 19 nt, Human
uuuaccuuuuuuauacaua

SEQ ID NO: 1950703 - RNA, 20 nt, Human
uuuaccuuuuuuauacauaa

SEQ ID NO: 1950704 - RNA, 17 nt, Human
augcuacacacugcaug

SEQ ID NO: 1950705 - RNA, 17 nt, Human
augcuaaucuugugaaa

SEQ ID NO: 1950706 - RNA, 18 nt, Human
augcuacacacugcaugu

SEQ ID NO: 1950707 - RNA, 15 nt, Human
uuuagauaauacacc

SEQ ID NO: 1950708 - RNA, 17 nt, Human
uuuagaugaaugucagu

SEQ ID NO: 1950709 - RNA, 18 nt, Human
uuuagaguugauacuaca

SEQ ID NO: 1950710 - RNA, 13 nt, Human
uuuagauaauaca

SEQ ID NO: 1950711 - RNA, 19 nt, Human
uuuacuacaauauguacau

SEQ ID NO: 1950712 - RNA, 21 nt, Human
uuuacuacaauauguacauuu

SEQ ID NO: 1950713 - RNA, 13 nt, Human
uuuagccuguguc

SEQ ID NO: 1950714 - RNA, 22 nt, Human
uuuagccugugucauugcccca

SEQ ID NO: 1950715 - RNA, 14 nt, Human
uuuaggugaaaaua

SEQ ID NO: 1950716 - RNA, 15 nt, Human
uuuaugugaaacaug

SEQ ID NO: 1950717 - RNA, 14 nt, Human
uuuaugugaaacau

SEQ ID NO: 1950718 - RNA, 19 nt, Human
uuuauuaaaugcccagccc

SEQ ID NO: 1950719 - RNA, 12 nt, Human
uuuauuaaauuu

SEQ ID NO: 1950720 - RNA, 13 nt, Human
uuuauuaaauuuu

SEQ ID NO: 1950721 - RNA, 23 nt, Human
uuuauuaaauuuuuuuguaugaa

SEQ ID NO: 1950722 - RNA, 17 nt, Human
uuuauuaacuuaauaau

SEQ ID NO: 1950723 - RNA, 14 nt, Human
uuuauaucuuggca

SEQ ID NO: 1950724 - RNA, 21 nt, Human
uuuauaucuuggcagguagga

SEQ ID NO: 1950725 - RNA, 15 nt, Human
uuuauauauauaucu

SEQ ID NO: 1950726 - RNA, 14 nt, Human
uuuauauauaugca

SEQ ID NO: 1950727 - RNA, 13 nt, Human
uuuauauccauuu

SEQ ID NO: 1950728 - RNA, 16 nt, Human
uuuauauccauuuuua

SEQ ID NO: 1950729 - RNA, 21 nt, Human
uuuauaucuccuuuguauucu

SEQ ID NO: 1950730 - RNA, 15 nt, Human
uuucacccuucuacu

SEQ ID NO: 1950731 - RNA, 14 nt, Human
uuucacucuccuug

SEQ ID NO: 1950732 - RNA, 17 nt, Human
uuuauuuuuuucugaau

SEQ ID NO: 1950733 - RNA, 16 nt, Human
uuuauuuuuugggaaa

SEQ ID NO: 1950734 - RNA, 13 nt, Human
uuuauuuuuuggu

SEQ ID NO: 1950735 - RNA, 23 nt, Human
uuucaaaaacaccccccccccac

SEQ ID NO: 1950736 - RNA, 21 nt, Human
uuuauuuuuuuuaauuguauu

SEQ ID NO: 1950737 - RNA, 12 nt, Human
uuucauaaagca

SEQ ID NO: 1950738 - RNA, 13 nt, Human
uuucacugucugu

SEQ ID NO: 1950739 - RNA, 15 nt, Human
uuucacugucugucu

SEQ ID NO: 1950740 - RNA, 14 nt, Human
uuucacuucuuucc

SEQ ID NO: 1950741 - RNA, 16 nt, Human
uuucacuucuuucccu

SEQ ID NO: 1950742 - RNA, 23 nt, Human
uuucacuucuuucccuuccucca

SEQ ID NO: 1950743 - RNA, 15 nt, Human
uuucacucuccuugg

SEQ ID NO: 1950744 - RNA, 24 nt, Human
uuucacucuuauugcccacgcugg

SEQ ID NO: 1950745 - RNA, 24 nt, Human
uuucacugcuggcugccuuagaac

SEQ ID NO: 1950746 - RNA, 12 nt, Human
uuucacucacau

SEQ ID NO: 1950747 - RNA, 23 nt, Human
uuucacuggccacaguuguuuga

SEQ ID NO: 1950748 - RNA, 18 nt, Human
uuuccagguucugaaaga

SEQ ID NO: 1950749 - RNA, 12 nt, Human
uuuccaguauuu

SEQ ID NO: 1950750 - RNA, 15 nt, Human
uuuccaguauuuuag

SEQ ID NO: 1950751 - RNA, 16 nt, Human
uuuccaguauuuuagu

SEQ ID NO: 1950752 - RNA, 17 nt, Human
uuuccaguauuuuagug

SEQ ID NO: 1950753 - RNA, 21 nt, Human
uuuccauauuuuuuuccuuac

SEQ ID NO: 1950754 - RNA, 11 nt, Human
uuucccacccu

SEQ ID NO: 1950755 - RNA, 21 nt, Human
uuuccauauccauagugacuu

SEQ ID NO: 1950756 - RNA, 17 nt, Human
uuuccauauuuuuacaa

SEQ ID NO: 1950757 - RNA, 19 nt, Human
uuuccauauuuuuuuccuu

SEQ ID NO: 1950758 - RNA, 15 nt, Human
uuucauaagauauuu

SEQ ID NO: 1950759 - RNA, 18 nt, Human
uuucauaagauauuuuau

SEQ ID NO: 1950760 - RNA, 19 nt, Human
uuucauaagauauuuuauu

SEQ ID NO: 1950761 - RNA, 21 nt, Human
uuucauauaggaauagaaaca

SEQ ID NO: 1950762 - RNA, 19 nt, Human
uuuccagguuuaagcuguu

SEQ ID NO: 1950763 - RNA, 23 nt, Human
uuucauauaggaauagaaacaug

SEQ ID NO: 1950764 - RNA, 17 nt, Human
augcugugccccuggcc

SEQ ID NO: 1950765 - RNA, 18 nt, Human
augcugugccccuggccu

SEQ ID NO: 1950766 - RNA, 13 nt, Human
augcugugccccu

SEQ ID NO: 1950767 - RNA, 14 nt, Human
augcugugccccug

SEQ ID NO: 1950768 - RNA, 23 nt, Human
augcugucuuucuugcucccuga

SEQ ID NO: 1950769 - RNA, 22 nt, Human
augcugucuggcacagccugca

SEQ ID NO: 1950770 - RNA, 18 nt, Human
augcugucuuucuugcuc

SEQ ID NO: 1950771 - RNA, 20 nt, Human
augcugucuuucuugcuccc

SEQ ID NO: 1950772 - RNA, 21 nt, Human
augcugucuuucuugcucccu

SEQ ID NO: 1950773 - RNA, 19 nt, Human
augcugugcccuaaagugu

SEQ ID NO: 1950774 - RNA, 14 nt, Human
augcuguauauguu

SEQ ID NO: 1950775 - RNA, 16 nt, Human
augcugucuggcacag

SEQ ID NO: 1950776 - RNA, 17 nt, Human
augcugucuggcacagc

SEQ ID NO: 1950777 - RNA, 19 nt, Human
augcugucuggcacagccu

SEQ ID NO: 1950778 - RNA, 15 nt, Human
augcugggcucccgu

SEQ ID NO: 1950779 - RNA, 22 nt, Human
augcuggcuguuggcugggggc

SEQ ID NO: 1950780 - RNA, 20 nt, Human
uuuauuaacuuaauaaucaa

SEQ ID NO: 1950781 - RNA, 15 nt, Human
auggaauaacaugua

SEQ ID NO: 1950782 - RNA, 14 nt, Human
auggaauaacaugu

SEQ ID NO: 1950783 - RNA, 13 nt, Human
uuuauuuuuuggg

SEQ ID NO: 1950784 - RNA, 18 nt, Human
uuuauuuugaaauggaaa

SEQ ID NO: 1950785 - RNA, 17 nt, Human
auggaacacucugagac

SEQ ID NO: 1950786 - RNA, 18 nt, Human
auggaacacucugagacu

SEQ ID NO: 1950787 - RNA, 21 nt, Human
auggaaguacuauaauuuacc

SEQ ID NO: 1950788 - RNA, 14 nt, Human
uucaggguuggccc

SEQ ID NO: 1950789 - RNA, 22 nt, Human
uucagcuaggaacaaaucuucc

SEQ ID NO: 1950790 - RNA, 14 nt, Human
uucagcuaggaaca

SEQ ID NO: 1950791 - RNA, 20 nt, Human
uucagcuaggaacaaaucuu

SEQ ID NO: 1950792 - RNA, 16 nt, Human
uucaggguuggccccu

SEQ ID NO: 1950793 - RNA, 17 nt, Human
uucaggguuggccccug

SEQ ID NO: 1950794 - RNA, 19 nt, Human
uucaggguuggccccugcc

SEQ ID NO: 1950795 - RNA, 22 nt, Human
uucaggguuggccccugcccgg

SEQ ID NO: 1950796 - RNA, 15 nt, Human
uucagguaacaggca

SEQ ID NO: 1950797 - RNA, 16 nt, Human
uucagguaacaggcag

SEQ ID NO: 1950798 - RNA, 21 nt, Human
uucagcaucugaccucuaccu

SEQ ID NO: 1950799 - RNA, 13 nt, Human
uucagccuucuuu

SEQ ID NO: 1950800 - RNA, 20 nt, Human
uucagccuucuuuuucugga

SEQ ID NO: 1950801 - RNA, 21 nt, Human
uucagccuucuuuuucuggac

SEQ ID NO: 1950802 - RNA, 16 nt, Human
uucagcguuuugcaag

SEQ ID NO: 1950803 - RNA, 12 nt, Human
uucagcaucuga

SEQ ID NO: 1950804 - RNA, 13 nt, Human
uucagcaucugac

SEQ ID NO: 1950805 - RNA, 12 nt, Human
uucagcaggcag

SEQ ID NO: 1950806 - RNA, 13 nt, Human
uucagcaggcagc

SEQ ID NO: 1950807 - RNA, 16 nt, Human
uucagauuugccuuau

SEQ ID NO: 1950808 - RNA, 17 nt, Human
uucagauuucucuuuga

SEQ ID NO: 1950809 - RNA, 19 nt, Human
uucagauuucucuuugaaa

SEQ ID NO: 1950810 - RNA, 15 nt, Human
uucagauuugcacaa

SEQ ID NO: 1950811 - RNA, 16 nt, Human
uucagauuugcacaaa

SEQ ID NO: 1950812 - RNA, 17 nt, Human
uucagauuugcacaaaa

SEQ ID NO: 1950813 - RNA, 18 nt, Human
uucagauuugcacaaaaa

SEQ ID NO: 1950814 - RNA, 19 nt, Human
uucagauuugcacaaaaag

SEQ ID NO: 1950815 - RNA, 19 nt, Human
uucagauaugauucaaaug

SEQ ID NO: 1950816 - RNA, 15 nt, Human
uucagauuucucuuu

SEQ ID NO: 1950817 - RNA, 16 nt, Human
uucagauaugauucaa

SEQ ID NO: 1950818 - RNA, 17 nt, Human
uucagauaugauucaaa

SEQ ID NO: 1950819 - RNA, 18 nt, Human
uucagauaugauucaaau

SEQ ID NO: 1950820 - RNA, 16 nt, Human
uucagaaauguguuau

SEQ ID NO: 1950821 - RNA, 11 nt, Human
uucagaaaaaa

SEQ ID NO: 1950822 - RNA, 22 nt, Human
uucagaaaacugagcugcaauc

SEQ ID NO: 1950823 - RNA, 19 nt, Human
uucacuucugacucuuccc

SEQ ID NO: 1950824 - RNA, 13 nt, Human
uucacuucuuucc

SEQ ID NO: 1950825 - RNA, 15 nt, Human
uucacuucuuucccu

SEQ ID NO: 1950826 - RNA, 16 nt, Human
uucacuucuuucccuu

SEQ ID NO: 1950827 - RNA, 22 nt, Human
uucacuucuuucccuuccucca

SEQ ID NO: 1950828 - RNA, 15 nt, Human
uucagugaugugccu

SEQ ID NO: 1950829 - RNA, 23 nt, Human
uucagugcauuaucuacuugugu

SEQ ID NO: 1950830 - RNA, 22 nt, Human
uucauauuuuaaacagaggaua

SEQ ID NO: 1950831 - RNA, 17 nt, Human
uucauauuuuaauuuca

SEQ ID NO: 1950832 - RNA, 18 nt, Human
uucauauuuuaauuucaa

SEQ ID NO: 1950833 - RNA, 20 nt, Human
uucauauuuuaauuucaagc

SEQ ID NO: 1950834 - RNA, 22 nt, Human
uucauauuuuaauuucaagcuu

SEQ ID NO: 1950835 - RNA, 17 nt, Human
uucauauuuuucaaaau

SEQ ID NO: 1950836 - RNA, 19 nt, Human
uucauauuuuucaaaauag

SEQ ID NO: 1950837 - RNA, 17 nt, Human
uucagguaacaggcaga

SEQ ID NO: 1950838 - RNA, 14 nt, Human
uucagguagaggug

SEQ ID NO: 1950839 - RNA, 20 nt, Human
uucagguagaggugcaugcc

SEQ ID NO: 1950840 - RNA, 14 nt, Human
uucaguaagccgug

SEQ ID NO: 1950841 - RNA, 9 nt, Human
auauauuuc

SEQ ID NO: 1950842 - RNA, 15 nt, Human
auauauuuuaagacg

SEQ ID NO: 1950843 - RNA, 21 nt, Human
auauauguuuuaagaggcagg

SEQ ID NO: 1950844 - RNA, 22 nt, Human
auauauguuuuaagaggcaggg

SEQ ID NO: 1950845 - RNA, 17 nt, Human
auauauguuuuugaagg

SEQ ID NO: 1950846 - RNA, 15 nt, Human
uucaucaaugaauga

SEQ ID NO: 1950847 - RNA, 16 nt, Human
uucaucagaacagcug

SEQ ID NO: 1950848 - RNA, 22 nt, Human
uucaucagaacagcuguugacu

SEQ ID NO: 1950849 - RNA, 18 nt, Human
uucaucagggaggaaagu

SEQ ID NO: 1950850 - RNA, 13 nt, Human
auauaugcuaagu

SEQ ID NO: 1950851 - RNA, 16 nt, Human
auauauggucuaaugu

SEQ ID NO: 1950852 - RNA, 18 nt, Human
auauauggucuaauguuu

SEQ ID NO: 1950853 - RNA, 13 nt, Human
auauaugcauaua

SEQ ID NO: 1950854 - RNA, 19 nt, Human
uucaucauauuauacagac

SEQ ID NO: 1950855 - RNA, 16 nt, Human
auauaugcauauauau

SEQ ID NO: 1950856 - RNA, 20 nt, Human
auauaugcauauauauaugu

SEQ ID NO: 1950857 - RNA, 11 nt, Human
uuccaguauuu

SEQ ID NO: 1950858 - RNA, 12 nt, Human
uuccaguauuuu

SEQ ID NO: 1950859 - RNA, 14 nt, Human
uuccaggggaaccu

SEQ ID NO: 1950860 - RNA, 15 nt, Human
uuccaggggaaccug

SEQ ID NO: 1950861 - RNA, 17 nt, Human
uuccaggggaaccugcc

SEQ ID NO: 1950862 - RNA, 18 nt, Human
uuccaggggaaccugcca

SEQ ID NO: 1950863 - RNA, 17 nt, Human
uuccagguuuaagcugu

SEQ ID NO: 1950864 - RNA, 18 nt, Human
uuccagguuuaagcuguu

SEQ ID NO: 1950865 - RNA, 17 nt, Human
uuccaggcugggagagc

SEQ ID NO: 1950866 - RNA, 15 nt, Human
uuccaggcugggaga

SEQ ID NO: 1950867 - RNA, 13 nt, Human
uuccaggcuggga

SEQ ID NO: 1950868 - RNA, 18 nt, Human
uuccaccaucaagccacc

SEQ ID NO: 1950869 - RNA, 13 nt, Human
uuccaccugcucu

SEQ ID NO: 1950870 - RNA, 15 nt, Human
uuccaccugcucugc

SEQ ID NO: 1950871 - RNA, 16 nt, Human
uuccaccugcucugcu

SEQ ID NO: 1950872 - RNA, 15 nt, Human
uuccaccuucccaug

SEQ ID NO: 1950873 - RNA, 17 nt, Human
uuccaccugcucugcug

SEQ ID NO: 1950874 - RNA, 21 nt, Human
uuccacaagagcccaggccuc

SEQ ID NO: 1950875 - RNA, 14 nt, Human
uuccacagaggaca

SEQ ID NO: 1950876 - RNA, 13 nt, Human
uuccacagaggac

SEQ ID NO: 1950877 - RNA, 22 nt, Human
uuccacagaggacacagagaag

SEQ ID NO: 1950878 - RNA, 20 nt, Human
uucauuagcaaaaaaaguug

SEQ ID NO: 1950879 - RNA, 21 nt, Human
uucauuagcaaaaaaaguugu

SEQ ID NO: 1950880 - RNA, 14 nt, Human
uucauuaguuuuga

SEQ ID NO: 1950881 - RNA, 22 nt, Human
uucauuagcaaaaaaaguugua

SEQ ID NO: 1950882 - RNA, 19 nt, Human
uucauuaguuuugaagauu

SEQ ID NO: 1950883 - RNA, 19 nt, Human
uucauucuuuuugaaaugu

SEQ ID NO: 1950884 - RNA, 22 nt, Human
uuccaauuuacauacucugcuu

SEQ ID NO: 1950885 - RNA, 13 nt, Human
uuccaauuuuccu

SEQ ID NO: 1950886 - RNA, 14 nt, Human
uuccaauuuuccuu

SEQ ID NO: 1950887 - RNA, 19 nt, Human
uucauugguacugccuuaa

SEQ ID NO: 1950888 - RNA, 22 nt, Human
uucauugguacugccuuaaaga

SEQ ID NO: 1950889 - RNA, 13 nt, Human
uucauugcuguga

SEQ ID NO: 1950890 - RNA, 20 nt, Human
uucaugcuguucaugaaaga

SEQ ID NO: 1950891 - RNA, 23 nt, Human
auauguguguguguguguugcuu

SEQ ID NO: 1950892 - RNA, 14 nt, Human
uucaugcuuuauca

SEQ ID NO: 1950893 - RNA, 22 nt, Human
uucaugcuguucaugaaagauu

SEQ ID NO: 1950894 - RNA, 15 nt, Human
auauguauacaugug

SEQ ID NO: 1950895 - RNA, 14 nt, Human
auaugggagaaaua

SEQ ID NO: 1950896 - RNA, 15 nt, Human
auaugggagaaauag

SEQ ID NO: 1950897 - RNA, 23 nt, Human
auauguaccuaacgaaguauccu

SEQ ID NO: 1950898 - RNA, 21 nt, Human
auauguggaguucaucuugaa

SEQ ID NO: 1950899 - RNA, 20 nt, Human
auauguggaguucaucuuga

SEQ ID NO: 1950900 - RNA, 23 nt, Human
auaugaccaaauaucaccaggac

SEQ ID NO: 1950901 - RNA, 19 nt, Human
auaugaacauacaaaugca

SEQ ID NO: 1950902 - RNA, 14 nt, Human
auaugacaaauguu

SEQ ID NO: 1950903 - RNA, 16 nt, Human
auaugacaaauguuuc

SEQ ID NO: 1950904 - RNA, 17 nt, Human
auaugacaaauguuucu

SEQ ID NO: 1950905 - RNA, 18 nt, Human
auaugacaaauguuucua

SEQ ID NO: 1950906 - RNA, 17 nt, Human
auaugaacauacaaaug

SEQ ID NO: 1950907 - RNA, 18 nt, Human
auaugaacauacaaaugc

SEQ ID NO: 1950908 - RNA, 20 nt, Human
auaugaaagucuuauuaaaa

SEQ ID NO: 1950909 - RNA, 16 nt, Human
auaugaacauacaaau

SEQ ID NO: 1950910 - RNA, 11 nt, Human
auauauuuuag

SEQ ID NO: 1950911 - RNA, 18 nt, Human
auauauuuuauuuuuaga

SEQ ID NO: 1950912 - RNA, 22 nt, Human
auauauuuuauuuuuagaauuu

SEQ ID NO: 1950913 - RNA, 13 nt, Human
auauauuuuguau

SEQ ID NO: 1950914 - RNA, 14 nt, Human
auauauuuuguaug

SEQ ID NO: 1950915 - RNA, 16 nt, Human
auauauuuuguaugca

SEQ ID NO: 1950916 - RNA, 17 nt, Human
auauauuuuguaugcaa

SEQ ID NO: 1950917 - RNA, 19 nt, Human
auauauuuuguaugcaagc

SEQ ID NO: 1950918 - RNA, 20 nt, Human
auauauuuuguaugcaagca

SEQ ID NO: 1950919 - RNA, 22 nt, Human
auauauuuuguaugcaagcagu

SEQ ID NO: 1950920 - RNA, 23 nt, Human
auauauuuuguaugcaagcaguu

SEQ ID NO: 1950921 - RNA, 21 nt, Human
uuccuaaauauauuuuaagac

SEQ ID NO: 1950922 - RNA, 13 nt, Human
uuccucugagccu

SEQ ID NO: 1950923 - RNA, 19 nt, Human
uuccucuccacugccuucg

SEQ ID NO: 1950924 - RNA, 16 nt, Human
uuccucuccacugccu

SEQ ID NO: 1950925 - RNA, 18 nt, Human
uuccucuccacugccuuc

SEQ ID NO: 1950926 - RNA, 12 nt, Human
uuccugaacagg

SEQ ID NO: 1950927 - RNA, 19 nt, Human
uuccuggcacugcuuccag

SEQ ID NO: 1950928 - RNA, 22 nt, Human
uuccucuuuuuauuuaguuccu

SEQ ID NO: 1950929 - RNA, 22 nt, Human
uuccuggcacugcuuccaguga

SEQ ID NO: 1950930 - RNA, 20 nt, Human
uuccuggcacugcuuccagu

SEQ ID NO: 1950931 - RNA, 17 nt, Human
uuccuguugucaagaau

SEQ ID NO: 1950932 - RNA, 13 nt, Human
uuccuguuucaag

SEQ ID NO: 1950933 - RNA, 17 nt, Human
uuccuguuugggaagag

SEQ ID NO: 1950934 - RNA, 23 nt, Human
auauuugauuuauuaacuuaaua

SEQ ID NO: 1950935 - RNA, 14 nt, Human
auauuuggaauaaa

SEQ ID NO: 1950936 - RNA, 12 nt, Human
auauuugauuua

SEQ ID NO: 1950937 - RNA, 14 nt, Human
auauuugauuuauu

SEQ ID NO: 1950938 - RNA, 15 nt, Human
auauuugauuuauua

SEQ ID NO: 1950939 - RNA, 16 nt, Human
auauuugauuuauuaa

SEQ ID NO: 1950940 - RNA, 18 nt, Human
auauuugauuuauuaacu

SEQ ID NO: 1950941 - RNA, 21 nt, Human
auauuugaauguaugcuucau

SEQ ID NO: 1950942 - RNA, 23 nt, Human
auauuuggaauaaaaauuccaga

SEQ ID NO: 1950943 - RNA, 17 nt, Human
auauuuggaugcagagu

SEQ ID NO: 1950944 - RNA, 20 nt, Human
auauuuggaugcagaguuca

SEQ ID NO: 1950945 - RNA, 14 nt, Human
uucccgcucagccc

SEQ ID NO: 1950946 - RNA, 15 nt, Human
uucccgcucagcccu

SEQ ID NO: 1950947 - RNA, 12 nt, Human
uucccgcucagc

SEQ ID NO: 1950948 - RNA, 19 nt, Human
uucccgccgcccagcccac

SEQ ID NO: 1950949 - RNA, 15 nt, Human
uucccuuuuuuuaag

SEQ ID NO: 1950950 - RNA, 20 nt, Human
uuccgaaaccaaagaagaaa

SEQ ID NO: 1950951 - RNA, 18 nt, Human
uuccgcauucuuuguaca

SEQ ID NO: 1950952 - RNA, 15 nt, Human
auauuuuucuuaaaa

SEQ ID NO: 1950953 - RNA, 17 nt, Human
auauuuuucuuaaaaag

SEQ ID NO: 1950954 - RNA, 18 nt, Human
auauuuuucuuaaaaagu

SEQ ID NO: 1950955 - RNA, 19 nt, Human
auauuuuucuuaaaaagua

SEQ ID NO: 1950956 - RNA, 17 nt, Human
uuccuuacauaaacauc

SEQ ID NO: 1950957 - RNA, 13 nt, Human
auauuuuucuuaa

SEQ ID NO: 1950958 - RNA, 14 nt, Human
auauuuuucuuaaa

SEQ ID NO: 1950959 - RNA, 13 nt, Human
uuccuuacauaaa

SEQ ID NO: 1950960 - RNA, 16 nt, Human
uuccuuacauaaacau

SEQ ID NO: 1950961 - RNA, 17 nt, Human
uuccuguuuguugaagg

SEQ ID NO: 1950962 - RNA, 21 nt, Human
aucaacugcaucaagauguga

SEQ ID NO: 1950963 - RNA, 13 nt, Human
aucaacucauguu

SEQ ID NO: 1950964 - RNA, 12 nt, Human
aucaacuaaagu

SEQ ID NO: 1950965 - RNA, 18 nt, Human
aucaacuaaaguuguacu

SEQ ID NO: 1950966 - RNA, 20 nt, Human
aucaacuaaaguuguacuuu

SEQ ID NO: 1950967 - RNA, 21 nt, Human
aucaacuaaaguuguacuuua

SEQ ID NO: 1950968 - RNA, 22 nt, Human
aucaacuaaaguuguacuuuaa

SEQ ID NO: 1950969 - RNA, 15 nt, Human
aucaacuaguauuug

SEQ ID NO: 1950970 - RNA, 18 nt, Human
aucacucagagcagucug

SEQ ID NO: 1950971 - RNA, 14 nt, Human
aucacucagagcag

SEQ ID NO: 1950972 - RNA, 15 nt, Human
aucacgccacugcac

SEQ ID NO: 1950973 - RNA, 17 nt, Human
aucacgccacugcacua

SEQ ID NO: 1950974 - RNA, 19 nt, Human
aucaaguagacuacuguuc

SEQ ID NO: 1950975 - RNA, 17 nt, Human
aucaaguagacuacugu

SEQ ID NO: 1950976 - RNA, 18 nt, Human
aucaaguagacuacuguu

SEQ ID NO: 1950977 - RNA, 13 nt, Human
aucaauuuaaaaa

SEQ ID NO: 1950978 - RNA, 18 nt, Human
auauguugcuauaauaaa

SEQ ID NO: 1950979 - RNA, 20 nt, Human
auauguugcuauaauaaaga

SEQ ID NO: 1950980 - RNA, 12 nt, Human
auauuaaaaagu

SEQ ID NO: 1950981 - RNA, 13 nt, Human
auauuaaaaaguc

SEQ ID NO: 1950982 - RNA, 15 nt, Human
auauuaaaaagucuu

SEQ ID NO: 1950983 - RNA, 16 nt, Human
auauuaaaaagucuuu

SEQ ID NO: 1950984 - RNA, 17 nt, Human
auauuaaaaagucuuuu

SEQ ID NO: 1950985 - RNA, 19 nt, Human
auauuaaaaagucuuuuaa

SEQ ID NO: 1950986 - RNA, 20 nt, Human
auauuaaaaagucuuuuaaa

SEQ ID NO: 1950987 - RNA, 15 nt, Human
auauuacaauauuug

SEQ ID NO: 1950988 - RNA, 17 nt, Human
auauuacaauauuugug

SEQ ID NO: 1950989 - RNA, 13 nt, Human
auauuacaauauu

SEQ ID NO: 1950990 - RNA, 17 nt, Human
auauuaccacagacaua

SEQ ID NO: 1950991 - RNA, 22 nt, Human
auauuaagaaagacuaucuaaa

SEQ ID NO: 1950992 - RNA, 17 nt, Human
auauuaagaaagacuau

SEQ ID NO: 1950993 - RNA, 15 nt, Human
auauuaagaaagacu

SEQ ID NO: 1950994 - RNA, 16 nt, Human
auauuaagaaagacua

SEQ ID NO: 1950995 - RNA, 19 nt, Human
uucccaggaaagaagcauu

SEQ ID NO: 1950996 - RNA, 16 nt, Human
uuccagugaggcucug

SEQ ID NO: 1950997 - RNA, 15 nt, Human
uuccagugaggcucu

SEQ ID NO: 1950998 - RNA, 22 nt, Human
uuccagucgggggaacugaggc

SEQ ID NO: 1950999 - RNA, 14 nt, Human
uuccaguauuuuag

SEQ ID NO: 1951000 - RNA, 22 nt, Human
uuccagucaggcucucugggcu

SEQ ID NO: 1951001 - RNA, 22 nt, Human
uuccagugaaaucaguuacucu

SEQ ID NO: 1951002 - RNA, 17 nt, Human
auauguuauuuuaaaca

SEQ ID NO: 1951003 - RNA, 16 nt, Human
auauguucugacauaa

SEQ ID NO: 1951004 - RNA, 21 nt, Human
auauugaggagcacugaaagu

SEQ ID NO: 1951005 - RNA, 22 nt, Human
auauugcugauggugcaaugac

SEQ ID NO: 1951006 - RNA, 17 nt, Human
auauugguuuuaugaug

SEQ ID NO: 1951007 - RNA, 18 nt, Human
auauugguuuuaugauga

SEQ ID NO: 1951008 - RNA, 12 nt, Human
auauuguaagaa

SEQ ID NO: 1951009 - RNA, 21 nt, Human
auauugguauauccuuuucug

SEQ ID NO: 1951010 - RNA, 12 nt, Human
auauugguuuua

SEQ ID NO: 1951011 - RNA, 13 nt, Human
auauugguuuuau

SEQ ID NO: 1951012 - RNA, 15 nt, Human
auauugguuuuauga

SEQ ID NO: 1951013 - RNA, 19 nt, Human
auauugguuuuaugaugac

SEQ ID NO: 1951014 - RNA, 13 nt, Human
auauuguaagaaa

SEQ ID NO: 1951015 - RNA, 14 nt, Human
auauuguaagaaau

SEQ ID NO: 1951016 - RNA, 15 nt, Human
auauuguaagaaaua

SEQ ID NO: 1951017 - RNA, 16 nt, Human
auauuguaagaaauac

SEQ ID NO: 1951018 - RNA, 18 nt, Human
auauucucacagcuccaa

SEQ ID NO: 1951019 - RNA, 14 nt, Human
auauucuauuuuac

SEQ ID NO: 1951020 - RNA, 16 nt, Human
auauucuauuuuacaa

SEQ ID NO: 1951021 - RNA, 19 nt, Human
auauucuaguaauaaagac

SEQ ID NO: 1951022 - RNA, 13 nt, Human
auauucuauuuua

SEQ ID NO: 1951023 - RNA, 21 nt, Human
auauucuaguaauaaagacuc

SEQ ID NO: 1951024 - RNA, 21 nt, Human
auauuccugcauuugugaaau

SEQ ID NO: 1951025 - RNA, 15 nt, Human
auauugauaugcuua

SEQ ID NO: 1951026 - RNA, 21 nt, Human
auauugacaaguuuaaaggcu

SEQ ID NO: 1951027 - RNA, 17 nt, Human
auauuguuuucagugua

SEQ ID NO: 1951028 - RNA, 13 nt, Human
auauuguuuucag

SEQ ID NO: 1951029 - RNA, 20 nt, Human
auauugucucuuuuuuaagu

SEQ ID NO: 1951030 - RNA, 13 nt, Human
auauuuacaaaug

SEQ ID NO: 1951031 - RNA, 15 nt, Human
auauuuaauguugaa

SEQ ID NO: 1951032 - RNA, 16 nt, Human
auauuuaauguugaac

SEQ ID NO: 1951033 - RNA, 20 nt, Human
auauuuaauguugaacaaaa

SEQ ID NO: 1951034 - RNA, 21 nt, Human
auauuuaauguugaacaaaau

SEQ ID NO: 1951035 - RNA, 22 nt, Human
auauuuaauguugaacaaaaua

SEQ ID NO: 1951036 - RNA, 22 nt, Human
auauuuacaacacuuuaauggg

SEQ ID NO: 1951037 - RNA, 13 nt, Human
auauuuacaaccu

SEQ ID NO: 1951038 - RNA, 12 nt, Human
auauuuaaaggg

SEQ ID NO: 1951039 - RNA, 13 nt, Human
auauuuaaagucu

SEQ ID NO: 1951040 - RNA, 14 nt, Human
auauuuaaagggaa

SEQ ID NO: 1951041 - RNA, 19 nt, Human
auauuuaaagggaaauuga

SEQ ID NO: 1951042 - RNA, 15 nt, Human
auccuggaguucugg

SEQ ID NO: 1951043 - RNA, 17 nt, Human
auccuggcacccggccc

SEQ ID NO: 1951044 - RNA, 19 nt, Human
auccuggcacccggccccu

SEQ ID NO: 1951045 - RNA, 20 nt, Human
auccuggcacccggccccug

SEQ ID NO: 1951046 - RNA, 21 nt, Human
auccuggcacccggccccugc

SEQ ID NO: 1951047 - RNA, 22 nt, Human
auccuggcacccggccccugcu

SEQ ID NO: 1951048 - RNA, 23 nt, Human
auccuggcacccggccccugcug

SEQ ID NO: 1951049 - RNA, 21 nt, Human
auccugggcuuuuguuuugcu

SEQ ID NO: 1951050 - RNA, 22 nt, Human
auccugggcuuuuguuuugcuu

SEQ ID NO: 1951051 - RNA, 17 nt, Human
aucguaaaauuaagaaa

SEQ ID NO: 1951052 - RNA, 15 nt, Human
aucgguuaacaaaua

SEQ ID NO: 1951053 - RNA, 16 nt, Human
aucgguuaacaaauaa

SEQ ID NO: 1951054 - RNA, 23 nt, Human
aucgguuaacaaauaacaacuuu

SEQ ID NO: 1951055 - RNA, 14 nt, Human
aucguaaaauuaag

SEQ ID NO: 1951056 - RNA, 13 nt, Human
aucguaaaauuaa

SEQ ID NO: 1951057 - RNA, 12 nt, Human
aucguaaaauua

SEQ ID NO: 1951058 - RNA, 21 nt, Human
aucggggagguuuucuccccc

SEQ ID NO: 1951059 - RNA, 12 nt, Human
auccuuacaaau

SEQ ID NO: 1951060 - RNA, 14 nt, Human
auccuuacaaauga

SEQ ID NO: 1951061 - RNA, 16 nt, Human
auccugucaucugaga

SEQ ID NO: 1951062 - RNA, 17 nt, Human
auccugucaucugagaa

SEQ ID NO: 1951063 - RNA, 18 nt, Human
auccugucaucugagaau

SEQ ID NO: 1951064 - RNA, 20 nt, Human
auccugucaucugagaauga

SEQ ID NO: 1951065 - RNA, 16 nt, Human
auccugcaauuccacu

SEQ ID NO: 1951066 - RNA, 15 nt, Human
auccugcacugacuc

SEQ ID NO: 1951067 - RNA, 16 nt, Human
auccugcacugacucu

SEQ ID NO: 1951068 - RNA, 17 nt, Human
auccugcacugacucug

SEQ ID NO: 1951069 - RNA, 22 nt, Human
auccugaggcuccacuuggucu

SEQ ID NO: 1951070 - RNA, 13 nt, Human
auccugccccuga

SEQ ID NO: 1951071 - RNA, 18 nt, Human
auccugcacugacucugg

SEQ ID NO: 1951072 - RNA, 19 nt, Human
auccugcacugacucugga

SEQ ID NO: 1951073 - RNA, 11 nt, Human
auccugaggcu

SEQ ID NO: 1951074 - RNA, 13 nt, Human
auccugaggcucc

SEQ ID NO: 1951075 - RNA, 16 nt, Human
auccugaggcuccacu

SEQ ID NO: 1951076 - RNA, 18 nt, Human
auccugaggcuccacuug

SEQ ID NO: 1951077 - RNA, 21 nt, Human
auccugagccagauuucacuc

SEQ ID NO: 1951078 - RNA, 17 nt, Human
auccugagccagauuuc

SEQ ID NO: 1951079 - RNA, 15 nt, Human
auccugagccagauu

SEQ ID NO: 1951080 - RNA, 14 nt, Human
auccugagccagau

SEQ ID NO: 1951081 - RNA, 13 nt, Human
auccugagccaga

SEQ ID NO: 1951082 - RNA, 12 nt, Human
auccugagccag

SEQ ID NO: 1951083 - RNA, 11 nt, Human
auccugagcca

SEQ ID NO: 1951084 - RNA, 17 nt, Human
auccucuuugagugaag

SEQ ID NO: 1951085 - RNA, 20 nt, Human
auccucuguacagagcccac

SEQ ID NO: 1951086 - RNA, 18 nt, Human
auccucuguacagagccc

SEQ ID NO: 1951087 - RNA, 20 nt, Human
uucuuuugccguuauuaaaa

SEQ ID NO: 1951088 - RNA, 15 nt, Human
uucuuugccaucucu

SEQ ID NO: 1951089 - RNA, 18 nt, Human
uucuuugccaucucugcu

SEQ ID NO: 1951090 - RNA, 19 nt, Human
uucuuugccaucucugcuc

SEQ ID NO: 1951091 - RNA, 21 nt, Human
uucuuugccaucucugcucca

SEQ ID NO: 1951092 - RNA, 16 nt, Human
aucguauucaccuuca

SEQ ID NO: 1951093 - RNA, 18 nt, Human
aucgucacugcuuaacuu

SEQ ID NO: 1951094 - RNA, 14 nt, Human
aucgucacugcuua

SEQ ID NO: 1951095 - RNA, 14 nt, Human
aucgugacaacacu

SEQ ID NO: 1951096 - RNA, 15 nt, Human
aucgugacaacacuu

SEQ ID NO: 1951097 - RNA, 19 nt, Human
aucuaaauggaaccacucu

SEQ ID NO: 1951098 - RNA, 18 nt, Human
aucuaaaaauauacaugu

SEQ ID NO: 1951099 - RNA, 23 nt, Human
aucuaaaaauauacauguuuaug

SEQ ID NO: 1951100 - RNA, 13 nt, Human
aucuaaaaauaua

SEQ ID NO: 1951101 - RNA, 14 nt, Human
aucuaaaaauauac

SEQ ID NO: 1951102 - RNA, 16 nt, Human
aucuaaaaauauacau

SEQ ID NO: 1951103 - RNA, 17 nt, Human
aucuaaaaauauacaug

SEQ ID NO: 1951104 - RNA, 15 nt, Human
aucuaaacugccccc

SEQ ID NO: 1951105 - RNA, 15 nt, Human
aucuaaauguugaaa

SEQ ID NO: 1951106 - RNA, 16 nt, Human
uugaaggaaaaauuca

SEQ ID NO: 1951107 - RNA, 14 nt, Human
uugaagguuuuuga

SEQ ID NO: 1951108 - RNA, 16 nt, Human
uugaagguuuuugaua

SEQ ID NO: 1951109 - RNA, 15 nt, Human
uugaagguagaaugu

SEQ ID NO: 1951110 - RNA, 16 nt, Human
uugaagguagaauguu

SEQ ID NO: 1951111 - RNA, 19 nt, Human
uugaagguagaauguuuuc

SEQ ID NO: 1951112 - RNA, 15 nt, Human
uugaagucaugcucc

SEQ ID NO: 1951113 - RNA, 23 nt, Human
uugaauagggcuaggaauauaga

SEQ ID NO: 1951114 - RNA, 23 nt, Human
uugaaguugacucugcucuugca

SEQ ID NO: 1951115 - RNA, 20 nt, Human
uugaagugagaaaaugaaca

SEQ ID NO: 1951116 - RNA, 14 nt, Human
uugaauaugauuaa

SEQ ID NO: 1951117 - RNA, 15 nt, Human
uugaauaugauuaaa

SEQ ID NO: 1951118 - RNA, 23 nt, Human
uugaauaugauuaaaaauaucaa

SEQ ID NO: 1951119 - RNA, 17 nt, Human
uugacacuuaaaaaugg

SEQ ID NO: 1951120 - RNA, 22 nt, Human
uugauaagggacugauguuugu

SEQ ID NO: 1951121 - RNA, 18 nt, Human
uugauaacaauguuuuaa

SEQ ID NO: 1951122 - RNA, 22 nt, Human
uugauaaauaguguuauugaga

SEQ ID NO: 1951123 - RNA, 13 nt, Human
uugauaaauagug

SEQ ID NO: 1951124 - RNA, 15 nt, Human
uugauaaauaguguu

SEQ ID NO: 1951125 - RNA, 21 nt, Human
uugauaagggacugauguuug

SEQ ID NO: 1951126 - RNA, 20 nt, Human
uugauaagggacugauguuu

SEQ ID NO: 1951127 - RNA, 22 nt, Human
uugauaacagggauugauuuua

SEQ ID NO: 1951128 - RNA, 16 nt, Human
uugaggucuguucuuu

SEQ ID NO: 1951129 - RNA, 15 nt, Human
uugaggucuguucuu

SEQ ID NO: 1951130 - RNA, 12 nt, Human
uugauaaaguaa

SEQ ID NO: 1951131 - RNA, 19 nt, Human
uugacacuuaaaaaugguu

SEQ ID NO: 1951132 - RNA, 19 nt, Human
uugacagggcacaccgggc

SEQ ID NO: 1951133 - RNA, 19 nt, Human
uugaccauucuccaccugc

SEQ ID NO: 1951134 - RNA, 18 nt, Human
uugaccauucuccaccug

SEQ ID NO: 1951135 - RNA, 21 nt, Human
uugagaacuaccuggauuugu

SEQ ID NO: 1951136 - RNA, 24 nt, Human
uugaccauucuccaccugccaggg

SEQ ID NO: 1951137 - RNA, 22 nt, Human
uugagagagauguguaauuuuu

SEQ ID NO: 1951138 - RNA, 23 nt, Human
uugagagagauguguaauuuuuc

SEQ ID NO: 1951139 - RNA, 14 nt, Human
uugagagagaugug

SEQ ID NO: 1951140 - RNA, 15 nt, Human
uugagagagaugugu

SEQ ID NO: 1951141 - RNA, 18 nt, Human
uugagagagauguguaau

SEQ ID NO: 1951142 - RNA, 21 nt, Human
uugagagagauguguaauuuu

SEQ ID NO: 1951143 - RNA, 13 nt, Human
uugagagagaugu

SEQ ID NO: 1951144 - RNA, 12 nt, Human
aucacugaaaua

SEQ ID NO: 1951145 - RNA, 17 nt, Human
aucacuguuuagauuug

SEQ ID NO: 1951146 - RNA, 18 nt, Human
aucacuguuuagauuugc

SEQ ID NO: 1951147 - RNA, 18 nt, Human
aucacuuaaaacacguuu

SEQ ID NO: 1951148 - RNA, 14 nt, Human
aucacuuaaaacac

SEQ ID NO: 1951149 - RNA, 15 nt, Human
aucacuuaaaacacg

SEQ ID NO: 1951150 - RNA, 22 nt, Human
aucacuguuuagauuugccaua

SEQ ID NO: 1951151 - RNA, 12 nt, Human
aucacuuaaaac

SEQ ID NO: 1951152 - RNA, 13 nt, Human
aucacuuaaaaca

SEQ ID NO: 1951153 - RNA, 17 nt, Human
aucaggugcugccaucc

SEQ ID NO: 1951154 - RNA, 19 nt, Human
aucaggugcugccauccag

SEQ ID NO: 1951155 - RNA, 23 nt, Human
aucacuugaacccgggaggcaga

SEQ ID NO: 1951156 - RNA, 15 nt, Human
aucaggugcugccau

SEQ ID NO: 1951157 - RNA, 19 nt, Human
aucagucugauucccaagc

SEQ ID NO: 1951158 - RNA, 17 nt, Human
aucagugcccuccagga

SEQ ID NO: 1951159 - RNA, 13 nt, Human
aucagugcccucc

SEQ ID NO: 1951160 - RNA, 15 nt, Human
aucagugcccuccag

SEQ ID NO: 1951161 - RNA, 20 nt, Human
aucauuaucagccugugcca

SEQ ID NO: 1951162 - RNA, 14 nt, Human
aucauucuaaagau

SEQ ID NO: 1951163 - RNA, 15 nt, Human
aucauucuaaagaua

SEQ ID NO: 1951164 - RNA, 16 nt, Human
aucauuaggugugacu

SEQ ID NO: 1951165 - RNA, 21 nt, Human
aucauccacugugccaugugc

SEQ ID NO: 1951166 - RNA, 23 nt, Human
aucauccacugugccaugugcca

SEQ ID NO: 1951167 - RNA, 15 nt, Human
aucauaaaacuugau

SEQ ID NO: 1951168 - RNA, 13 nt, Human
aucauauaaauau

SEQ ID NO: 1951169 - RNA, 19 nt, Human
aucauaguuuuauuuauau

SEQ ID NO: 1951170 - RNA, 23 nt, Human
aucauaguuuuauuuauauuuau

SEQ ID NO: 1951171 - RNA, 14 nt, Human
aucauaguuuuauu

SEQ ID NO: 1951172 - RNA, 16 nt, Human
aucauaguuuuauuua

SEQ ID NO: 1951173 - RNA, 17 nt, Human
aucauaguuuuauuuau

SEQ ID NO: 1951174 - RNA, 19 nt, Human
uucugcagccacuauuguu

SEQ ID NO: 1951175 - RNA, 16 nt, Human
uucugaaucuucugaa

SEQ ID NO: 1951176 - RNA, 13 nt, Human
uucugaaguuaua

SEQ ID NO: 1951177 - RNA, 15 nt, Human
uucugaaguuauauu

SEQ ID NO: 1951178 - RNA, 17 nt, Human
uucugaaguuauauuuc

SEQ ID NO: 1951179 - RNA, 18 nt, Human
uucugaaguuauauuucc

SEQ ID NO: 1951180 - RNA, 19 nt, Human
uucugaaguuauauuuccu

SEQ ID NO: 1951181 - RNA, 20 nt, Human
uucugaaguuauauuuccua

SEQ ID NO: 1951182 - RNA, 22 nt, Human
uucugaaguuauauuuccuaua

SEQ ID NO: 1951183 - RNA, 18 nt, Human
uucuccuuucacaaccuu

SEQ ID NO: 1951184 - RNA, 22 nt, Human
uucuccuuucacaaccuucugu

SEQ ID NO: 1951185 - RNA, 21 nt, Human
uucucuaguuugauuaaauuc

SEQ ID NO: 1951186 - RNA, 19 nt, Human
aucauugugaaauuauuca

SEQ ID NO: 1951187 - RNA, 23 nt, Human
aucauuguccagagcugcuuccc

SEQ ID NO: 1951188 - RNA, 18 nt, Human
aucauuguucuuuucaau

SEQ ID NO: 1951189 - RNA, 19 nt, Human
aucauuguuggacauuugg

SEQ ID NO: 1951190 - RNA, 15 nt, Human
aucauugugaaauua

SEQ ID NO: 1951191 - RNA, 13 nt, Human
aucauugugaaau

SEQ ID NO: 1951192 - RNA, 13 nt, Human
aucauugaaaucu

SEQ ID NO: 1951193 - RNA, 17 nt, Human
aucauucuaaagauaga

SEQ ID NO: 1951194 - RNA, 14 nt, Human
aucauuguccagag

SEQ ID NO: 1951195 - RNA, 16 nt, Human
aucauuguccagagcu

SEQ ID NO: 1951196 - RNA, 12 nt, Human
aucauugaaauc

SEQ ID NO: 1951197 - RNA, 13 nt, Human
uucuccccuucca

SEQ ID NO: 1951198 - RNA, 18 nt, Human
uucuccccuuccauuucu

SEQ ID NO: 1951199 - RNA, 22 nt, Human
uucuccccuuccauuucugccu

SEQ ID NO: 1951200 - RNA, 17 nt, Human
uucucccgggacucugc

SEQ ID NO: 1951201 - RNA, 17 nt, Human
uucuccuuucacaaccu

SEQ ID NO: 1951202 - RNA, 20 nt, Human
auccauggggcugauuguau

SEQ ID NO: 1951203 - RNA, 18 nt, Human
auccauggggucucucac

SEQ ID NO: 1951204 - RNA, 11 nt, Human
aucccagcccc

SEQ ID NO: 1951205 - RNA, 16 nt, Human
aucccaugagccucag

SEQ ID NO: 1951206 - RNA, 17 nt, Human
aucccugaaggccccgc

SEQ ID NO: 1951207 - RNA, 22 nt, Human
aucccugaaggccccgcccagg

SEQ ID NO: 1951208 - RNA, 17 nt, Human
aucccaugagccucagc

SEQ ID NO: 1951209 - RNA, 18 nt, Human
aucccaugagccucagca

SEQ ID NO: 1951210 - RNA, 14 nt, Human
auccaguaucuuga

SEQ ID NO: 1951211 - RNA, 15 nt, Human
auccaguaucuugaa

SEQ ID NO: 1951212 - RNA, 17 nt, Human
auccagguucagcuugu

SEQ ID NO: 1951213 - RNA, 20 nt, Human
auccacagucucccccaccc

SEQ ID NO: 1951214 - RNA, 19 nt, Human
auccaaaguccccauucag

SEQ ID NO: 1951215 - RNA, 13 nt, Human
auccaaauauugu

SEQ ID NO: 1951216 - RNA, 15 nt, Human
uucugccugcccagg

SEQ ID NO: 1951217 - RNA, 16 nt, Human
uucugccugcccaggc

SEQ ID NO: 1951218 - RNA, 16 nt, Human
auccaagcaaauguga

SEQ ID NO: 1951219 - RNA, 22 nt, Human
aucccugauaaauauucacacu

SEQ ID NO: 1951220 - RNA, 15 nt, Human
aucccugaucccuuc

SEQ ID NO: 1951221 - RNA, 13 nt, Human
uucuguuuagaua

SEQ ID NO: 1951222 - RNA, 18 nt, Human
uucuguuuagauaauaca

SEQ ID NO: 1951223 - RNA, 12 nt, Human
uucuguuuucaa

SEQ ID NO: 1951224 - RNA, 13 nt, Human
uucuguuuucaau

SEQ ID NO: 1951225 - RNA, 23 nt, Human
uucuuaaccagaucauugugaaa

SEQ ID NO: 1951226 - RNA, 22 nt, Human
uucuuaaccagaucauugugaa

SEQ ID NO: 1951227 - RNA, 14 nt, Human
uucuguuuucaauc

SEQ ID NO: 1951228 - RNA, 16 nt, Human
uucuuaccgacaagca

SEQ ID NO: 1951229 - RNA, 17 nt, Human
uucuuucuggcuaugca

SEQ ID NO: 1951230 - RNA, 20 nt, Human
uucuuucuggcuaugcauuu

SEQ ID NO: 1951231 - RNA, 12 nt, Human
uucuuucuggcu

SEQ ID NO: 1951232 - RNA, 22 nt, Human
uucuugcgauaguuuacugaga

SEQ ID NO: 1951233 - RNA, 15 nt, Human
uucuuugaauuuuca

SEQ ID NO: 1951234 - RNA, 16 nt, Human
uucuuugaauuuucau

SEQ ID NO: 1951235 - RNA, 17 nt, Human
uucuuugaauuuucauu

SEQ ID NO: 1951236 - RNA, 18 nt, Human
uucuuugaauuuucauuu

SEQ ID NO: 1951237 - RNA, 22 nt, Human
uucuuugaauuuucauuuuaca

SEQ ID NO: 1951238 - RNA, 15 nt, Human
uucuuugaucaugaa

SEQ ID NO: 1951239 - RNA, 16 nt, Human
uucuuugaucaugaau

SEQ ID NO: 1951240 - RNA, 17 nt, Human
uucuuugaucaugaaua

SEQ ID NO: 1951241 - RNA, 22 nt, Human
uucuuugaucaugaauaacuga

SEQ ID NO: 1951242 - RNA, 14 nt, Human
uucuuugauucugu

SEQ ID NO: 1951243 - RNA, 15 nt, Human
uucuuugcaaaaauc

SEQ ID NO: 1951244 - RNA, 16 nt, Human
uucuuugcaaaaaucc

SEQ ID NO: 1951245 - RNA, 19 nt, Human
uucuuugcacuuuuucuua

SEQ ID NO: 1951246 - RNA, 17 nt, Human
uucuucucccccauccu

SEQ ID NO: 1951247 - RNA, 11 nt, Human
uucuucucccu

SEQ ID NO: 1951248 - RNA, 22 nt, Human
uucuucuccacuuucuagccag

SEQ ID NO: 1951249 - RNA, 18 nt, Human
uucuuagacuuuuccaau

SEQ ID NO: 1951250 - RNA, 16 nt, Human
ugggaaaggggaaguu

SEQ ID NO: 1951251 - RNA, 17 nt, Human
uggcuucccgcucagcc

SEQ ID NO: 1951252 - RNA, 15 nt, Human
uggcuucccgcucag

SEQ ID NO: 1951253 - RNA, 16 nt, Human
uggcuucccgcucagc

SEQ ID NO: 1951254 - RNA, 23 nt, Human
uggcuucccaaaugugugcccag

SEQ ID NO: 1951255 - RNA, 15 nt, Human
ugggaaguuaaaggg

SEQ ID NO: 1951256 - RNA, 23 nt, Human
ugggaaguuaaagggaagaaaac

SEQ ID NO: 1951257 - RNA, 17 nt, Human
ugggaagagcuuagaaa

SEQ ID NO: 1951258 - RNA, 20 nt, Human
ugggaagagcuuagaaacug

SEQ ID NO: 1951259 - RNA, 13 nt, Human
ugggaacuagacu

SEQ ID NO: 1951260 - RNA, 23 nt, Human
uggcuucacggaagagccuugcg

SEQ ID NO: 1951261 - RNA, 22 nt, Human
uggcuucacggaagagccuugc

SEQ ID NO: 1951262 - RNA, 13 nt, Human
uggcuuacacugg

SEQ ID NO: 1951263 - RNA, 11 nt, Human
uggcuuaauuc

SEQ ID NO: 1951264 - RNA, 19 nt, Human
uggcuuaaaaaaaacucuu

SEQ ID NO: 1951265 - RNA, 14 nt, Human
uggcugugucuccc

SEQ ID NO: 1951266 - RNA, 13 nt, Human
uggcuguuggcug

SEQ ID NO: 1951267 - RNA, 15 nt, Human
uggcuguuggcuggg

SEQ ID NO: 1951268 - RNA, 17 nt, Human
uggcuuaaaacaacacu

SEQ ID NO: 1951269 - RNA, 22 nt, Human
uggcugccuugugaaggaauua

SEQ ID NO: 1951270 - RNA, 22 nt, Human
uggcugcggggcgggcacaccu

SEQ ID NO: 1951271 - RNA, 20 nt, Human
uggcugccaaugggagcuca

SEQ ID NO: 1951272 - RNA, 18 nt, Human
uggcugccaaugggagcu

SEQ ID NO: 1951273 - RNA, 15 nt, Human
uggcugcagggaguc

SEQ ID NO: 1951274 - RNA, 19 nt, Human
uggcugaguagcucugccu

SEQ ID NO: 1951275 - RNA, 13 nt, Human
uggcugcagggag

SEQ ID NO: 1951276 - RNA, 14 nt, Human
uggcugcagggagu

SEQ ID NO: 1951277 - RNA, 16 nt, Human
uggcucuugaacugag

SEQ ID NO: 1951278 - RNA, 22 nt, Human
uggcucuugaacugagcuugga

SEQ ID NO: 1951279 - RNA, 12 nt, Human
uggcugcaaagg

SEQ ID NO: 1951280 - RNA, 21 nt, Human
uggcucuuccaggcugggaga

SEQ ID NO: 1951281 - RNA, 20 nt, Human
uggcucuuccaggcugggag

SEQ ID NO: 1951282 - RNA, 19 nt, Human
uggcucuuccaggcuggga

SEQ ID NO: 1951283 - RNA, 18 nt, Human
uggcucaaguccucuuuu

SEQ ID NO: 1951284 - RNA, 15 nt, Human
uggcuaugcauuuga

SEQ ID NO: 1951285 - RNA, 17 nt, Human
uggcuaugcauuugaaa

SEQ ID NO: 1951286 - RNA, 14 nt, Human
uggcuaugcauuug

SEQ ID NO: 1951287 - RNA, 16 nt, Human
uggcuaugagggccuu

SEQ ID NO: 1951288 - RNA, 19 nt, Human
uggcuaugcauuugaaaau

SEQ ID NO: 1951289 - RNA, 22 nt, Human
uggcuauuagagaucaaccccu

SEQ ID NO: 1951290 - RNA, 19 nt, Human
aggcugggacgcucugcug

SEQ ID NO: 1951291 - RNA, 18 nt, Human
aggcugggacgcucugcu

SEQ ID NO: 1951292 - RNA, 14 nt, Human
aggcugggagagcc

SEQ ID NO: 1951293 - RNA, 22 nt, Human
uggcuagagguucaaagauauu

SEQ ID NO: 1951294 - RNA, 18 nt, Human
aggcuggcgugcaguggu

SEQ ID NO: 1951295 - RNA, 20 nt, Human
aggcuggcgugcaguggugc

SEQ ID NO: 1951296 - RNA, 20 nt, Human
aggcucucaggccagcugcu

SEQ ID NO: 1951297 - RNA, 19 nt, Human
aggcucucaggccagcugc

SEQ ID NO: 1951298 - RNA, 18 nt, Human
aggcucucaggccagcug

SEQ ID NO: 1951299 - RNA, 16 nt, Human
aggcucucaggccagc

SEQ ID NO: 1951300 - RNA, 15 nt, Human
aggcucucaggccag

SEQ ID NO: 1951301 - RNA, 14 nt, Human
aggcucucaggcca

SEQ ID NO: 1951302 - RNA, 12 nt, Human
aggcucucaggc

SEQ ID NO: 1951303 - RNA, 11 nt, Human
aggcucucagg

SEQ ID NO: 1951304 - RNA, 15 nt, Human
aggcucugcccuugg

SEQ ID NO: 1951305 - RNA, 14 nt, Human
aggcucugcccuug

SEQ ID NO: 1951306 - RNA, 13 nt, Human
aggcucugcccuu

SEQ ID NO: 1951307 - RNA, 12 nt, Human
aggcucugcccu

SEQ ID NO: 1951308 - RNA, 11 nt, Human
aggcucugccc

SEQ ID NO: 1951309 - RNA, 21 nt, Human
aggcucucaggccagcugcuu

SEQ ID NO: 1951310 - RNA, 15 nt, Human
aggcucucugggcug

SEQ ID NO: 1951311 - RNA, 19 nt, Human
aggcucgagcaugccugga

SEQ ID NO: 1951312 - RNA, 18 nt, Human
aggcucgagcaugccugg

SEQ ID NO: 1951313 - RNA, 17 nt, Human
aggcucgagcaugccug

SEQ ID NO: 1951314 - RNA, 15 nt, Human
aggcucgagcaugcc

SEQ ID NO: 1951315 - RNA, 20 nt, Human
aggcucucaacaggggagag

SEQ ID NO: 1951316 - RNA, 21 nt, Human
aggcucgagcaugccuggaug

SEQ ID NO: 1951317 - RNA, 20 nt, Human
aggcuccuucaacaaggcuu

SEQ ID NO: 1951318 - RNA, 12 nt, Human
aggcucgagcau

SEQ ID NO: 1951319 - RNA, 19 nt, Human
aggcuccuuuagcgcccag

SEQ ID NO: 1951320 - RNA, 20 nt, Human
aggcuccugccaccacgccc

SEQ ID NO: 1951321 - RNA, 13 nt, Human
aggcuccugcccc

SEQ ID NO: 1951322 - RNA, 22 nt, Human
aggcuccuuaggguuuucucuc

SEQ ID NO: 1951323 - RNA, 23 nt, Human
aggcuccuuaggguuuucucucu

SEQ ID NO: 1951324 - RNA, 14 nt, Human
aggcuccugccacc

SEQ ID NO: 1951325 - RNA, 15 nt, Human
aggcugcuuuccaaa

SEQ ID NO: 1951326 - RNA, 17 nt, Human
aggcugcuuuccaaagc

SEQ ID NO: 1951327 - RNA, 18 nt, Human
aggcugcuuuccaaagcc

SEQ ID NO: 1951328 - RNA, 19 nt, Human
aggcugcuuuccaaagcca

SEQ ID NO: 1951329 - RNA, 21 nt, Human
aggcugcuuuccaaagccaau

SEQ ID NO: 1951330 - RNA, 13 nt, Human
aggcugcuuucca

SEQ ID NO: 1951331 - RNA, 14 nt, Human
aggcugcuuuccaa

SEQ ID NO: 1951332 - RNA, 23 nt, Human
aggcugcucuugaacuccugacc

SEQ ID NO: 1951333 - RNA, 16 nt, Human
aggcucugcccuuggu

SEQ ID NO: 1951334 - RNA, 13 nt, Human
aggcucuggagcc

SEQ ID NO: 1951335 - RNA, 15 nt, Human
aggcucuggagccca

SEQ ID NO: 1951336 - RNA, 14 nt, Human
aggcucuggagccc

SEQ ID NO: 1951337 - RNA, 19 nt, Human
aggcucuggagcccacugu

SEQ ID NO: 1951338 - RNA, 18 nt, Human
aggcucuggagcccacug

SEQ ID NO: 1951339 - RNA, 13 nt, Human
aggcuggcgugca

SEQ ID NO: 1951340 - RNA, 17 nt, Human
aggcuggcgugcagugg

SEQ ID NO: 1951341 - RNA, 19 nt, Human
aggcuggcccugcccuggu

SEQ ID NO: 1951342 - RNA, 15 nt, Human
aggcuggcccugccc

SEQ ID NO: 1951343 - RNA, 16 nt, Human
aggcuggcccugcccu

SEQ ID NO: 1951344 - RNA, 17 nt, Human
aggcuggcccugcccug

SEQ ID NO: 1951345 - RNA, 18 nt, Human
aggcuggcccugcccugg

SEQ ID NO: 1951346 - RNA, 12 nt, Human
aggcuggcccug

SEQ ID NO: 1951347 - RNA, 14 nt, Human
aggcuggcccugcc

SEQ ID NO: 1951348 - RNA, 17 nt, Human
aggcuggaguuggggca

SEQ ID NO: 1951349 - RNA, 19 nt, Human
aggccaaguacacugagag

SEQ ID NO: 1951350 - RNA, 23 nt, Human
aggccaaguccgcagaagcccug

SEQ ID NO: 1951351 - RNA, 15 nt, Human
aggccacaagacccu

SEQ ID NO: 1951352 - RNA, 16 nt, Human
aggccaaucagaagcu

SEQ ID NO: 1951353 - RNA, 20 nt, Human
aggccaaucagaagcuaaca

SEQ ID NO: 1951354 - RNA, 16 nt, Human
uggagucauuucugau

SEQ ID NO: 1951355 - RNA, 17 nt, Human
uggagucauuucugauu

SEQ ID NO: 1951356 - RNA, 22 nt, Human
uggaguccaggacaggagaugc

SEQ ID NO: 1951357 - RNA, 19 nt, Human
uggagucagacagaugugg

SEQ ID NO: 1951358 - RNA, 14 nt, Human
uggagucagccucg

SEQ ID NO: 1951359 - RNA, 20 nt, Human
uggaguucaucuugaauugu

SEQ ID NO: 1951360 - RNA, 15 nt, Human
uggaugccugguggc

SEQ ID NO: 1951361 - RNA, 17 nt, Human
uggaguucaucuugaau

SEQ ID NO: 1951362 - RNA, 16 nt, Human
uggaguucaucuugaa

SEQ ID NO: 1951363 - RNA, 17 nt, Human
uggaguucauucauauu

SEQ ID NO: 1951364 - RNA, 18 nt, Human
uggaguucauucauauua

SEQ ID NO: 1951365 - RNA, 20 nt, Human
uggaguucauucauauuaca

SEQ ID NO: 1951366 - RNA, 20 nt, Human
uggaugccugguggcagcug

SEQ ID NO: 1951367 - RNA, 18 nt, Human
uggaugccugguggcagc

SEQ ID NO: 1951368 - RNA, 19 nt, Human
uggaugccugguggcagcu

SEQ ID NO: 1951369 - RNA, 18 nt, Human
aggccaaggugggaggau

SEQ ID NO: 1951370 - RNA, 20 nt, Human
aggccaaaggaagcacaugc

SEQ ID NO: 1951371 - RNA, 23 nt, Human
aggccaaaggaagcacaugccuc

SEQ ID NO: 1951372 - RNA, 15 nt, Human
aggccaaaggaagca

SEQ ID NO: 1951373 - RNA, 15 nt, Human
aggccaaagacaaau

SEQ ID NO: 1951374 - RNA, 17 nt, Human
aggccaaagacaaauag

SEQ ID NO: 1951375 - RNA, 18 nt, Human
aggccaaagacaaauagu

SEQ ID NO: 1951376 - RNA, 19 nt, Human
aggccaaagacaaauagua

SEQ ID NO: 1951377 - RNA, 14 nt, Human
aggccaaaggaagc

SEQ ID NO: 1951378 - RNA, 20 nt, Human
aggccaaacucaccugcccc

SEQ ID NO: 1951379 - RNA, 13 nt, Human
aggccaaagacaa

SEQ ID NO: 1951380 - RNA, 18 nt, Human
aggcauuuguuugaacug

SEQ ID NO: 1951381 - RNA, 21 nt, Human
aggcauuuucccccuuggcuc

SEQ ID NO: 1951382 - RNA, 16 nt, Human
aggccaaacucaccug

SEQ ID NO: 1951383 - RNA, 17 nt, Human
aggccaaacaggcccuc

SEQ ID NO: 1951384 - RNA, 22 nt, Human
uggaccuuuccugaggaagagg

SEQ ID NO: 1951385 - RNA, 18 nt, Human
uggacgagaaaacaauaa

SEQ ID NO: 1951386 - RNA, 12 nt, Human
uggcagccccug

SEQ ID NO: 1951387 - RNA, 16 nt, Human
uggcagccgugccuuc

SEQ ID NO: 1951388 - RNA, 17 nt, Human
uggcagcccgcaucagc

SEQ ID NO: 1951389 - RNA, 20 nt, Human
uggcagcccgcaucagcugc

SEQ ID NO: 1951390 - RNA, 20 nt, Human
aggccacaagacccuugugg

SEQ ID NO: 1951391 - RNA, 15 nt, Human
uggcagccucuucaa

SEQ ID NO: 1951392 - RNA, 16 nt, Human
uggcagccucuucaaa

SEQ ID NO: 1951393 - RNA, 23 nt, Human
uggcagccgugccuucagcucua

SEQ ID NO: 1951394 - RNA, 12 nt, Human
aggccagagaca

SEQ ID NO: 1951395 - RNA, 20 nt, Human
aggccacauccacagucucc

SEQ ID NO: 1951396 - RNA, 13 nt, Human
uggcagccuuggc

SEQ ID NO: 1951397 - RNA, 24 nt, Human
aggccacauuacuagaguuggcau

SEQ ID NO: 1951398 - RNA, 15 nt, Human
aggccacccugugca

SEQ ID NO: 1951399 - RNA, 20 nt, Human
aggccacccugugcagaagg

SEQ ID NO: 1951400 - RNA, 22 nt, Human
aggccacccugugcagaaggga

SEQ ID NO: 1951401 - RNA, 18 nt, Human
uggcaccagcagccugga

SEQ ID NO: 1951402 - RNA, 20 nt, Human
uggcacaucagcacgauuuc

SEQ ID NO: 1951403 - RNA, 22 nt, Human
uggauuaaacuuaaucuaaaug

SEQ ID NO: 1951404 - RNA, 12 nt, Human
uggauguucuga

SEQ ID NO: 1951405 - RNA, 22 nt, Human
uggcagaguugaagacagagcu

SEQ ID NO: 1951406 - RNA, 21 nt, Human
uggcagaguugaagacagagc

SEQ ID NO: 1951407 - RNA, 16 nt, Human
uggcacccggccccug

SEQ ID NO: 1951408 - RNA, 15 nt, Human
uggcacccggccccu

SEQ ID NO: 1951409 - RNA, 21 nt, Human
uggcacaucagcacgauuucu

SEQ ID NO: 1951410 - RNA, 14 nt, Human
uggccaguggcugg

SEQ ID NO: 1951411 - RNA, 15 nt, Human
uggccaguggcugga

SEQ ID NO: 1951412 - RNA, 16 nt, Human
uggccaguggcuggau

SEQ ID NO: 1951413 - RNA, 23 nt, Human
uggccaguggcuggaucugugag

SEQ ID NO: 1951414 - RNA, 21 nt, Human
uggccccugcccggcugcgga

SEQ ID NO: 1951415 - RNA, 18 nt, Human
uggcccgacagccuggca

SEQ ID NO: 1951416 - RNA, 19 nt, Human
uggcccgacagccuggcac

SEQ ID NO: 1951417 - RNA, 14 nt, Human
uggcccgacagccu

SEQ ID NO: 1951418 - RNA, 15 nt, Human
uggcccgacagccug

SEQ ID NO: 1951419 - RNA, 16 nt, Human
uggcccgacagccugg

SEQ ID NO: 1951420 - RNA, 17 nt, Human
uggcccgacagccuggc

SEQ ID NO: 1951421 - RNA, 15 nt, Human
uggccgggagccuga

SEQ ID NO: 1951422 - RNA, 16 nt, Human
uggccggacacccgac

SEQ ID NO: 1951423 - RNA, 23 nt, Human
aggccugggggcugggcagagga

SEQ ID NO: 1951424 - RNA, 12 nt, Human
uggccuggcccc

SEQ ID NO: 1951425 - RNA, 22 nt, Human
aggccuggccagaugcaccagc

SEQ ID NO: 1951426 - RNA, 23 nt, Human
aggccuggccagaugcaccagcc

SEQ ID NO: 1951427 - RNA, 15 nt, Human
aggccuggccagaug

SEQ ID NO: 1951428 - RNA, 16 nt, Human
aggccuggccagaugc

SEQ ID NO: 1951429 - RNA, 17 nt, Human
aggccuggccagaugca

SEQ ID NO: 1951430 - RNA, 21 nt, Human
aggccuggccagaugcaccag

SEQ ID NO: 1951431 - RNA, 18 nt, Human
uggccucugcacuccccu

SEQ ID NO: 1951432 - RNA, 17 nt, Human
uggccucugcacucccc

SEQ ID NO: 1951433 - RNA, 15 nt, Human
uggccucugcacucc

SEQ ID NO: 1951434 - RNA, 14 nt, Human
uggccucugcacuc

SEQ ID NO: 1951435 - RNA, 20 nt, Human
aggccugcuuugucuccucu

SEQ ID NO: 1951436 - RNA, 19 nt, Human
aggccugcuuugucuccuc

SEQ ID NO: 1951437 - RNA, 13 nt, Human
aggccugccuguu

SEQ ID NO: 1951438 - RNA, 15 nt, Human
uggcaugggaaugaa

SEQ ID NO: 1951439 - RNA, 12 nt, Human
uggcaugggaau

SEQ ID NO: 1951440 - RNA, 20 nt, Human
uggccaggcuggucucgaac

SEQ ID NO: 1951441 - RNA, 15 nt, Human
uggccaggcuggucu

SEQ ID NO: 1951442 - RNA, 17 nt, Human
uggccaggcuggucuca

SEQ ID NO: 1951443 - RNA, 14 nt, Human
aggcccucugccca

SEQ ID NO: 1951444 - RNA, 13 nt, Human
aggcccucugccc

SEQ ID NO: 1951445 - RNA, 15 nt, Human
aggcccucugcccac

SEQ ID NO: 1951446 - RNA, 12 nt, Human
aggcccaaagcc

SEQ ID NO: 1951447 - RNA, 13 nt, Human
aggcccaaagccu

SEQ ID NO: 1951448 - RNA, 15 nt, Human
aggcccaaagccucg

SEQ ID NO: 1951449 - RNA, 14 nt, Human
aggccucccugcca

SEQ ID NO: 1951450 - RNA, 15 nt, Human
aggccucccugccag

SEQ ID NO: 1951451 - RNA, 16 nt, Human
aggccucccugccagu

SEQ ID NO: 1951452 - RNA, 18 nt, Human
aggccucugccucacaac

SEQ ID NO: 1951453 - RNA, 21 nt, Human
aggccucucauuccagaggaa

SEQ ID NO: 1951454 - RNA, 22 nt, Human
aggccuccuguggccugccagu

SEQ ID NO: 1951455 - RNA, 23 nt, Human
aggccuccuguggccugccaguc

SEQ ID NO: 1951456 - RNA, 21 nt, Human
aggccuccuguggccugccag

SEQ ID NO: 1951457 - RNA, 17 nt, Human
aggccucccugccagua

SEQ ID NO: 1951458 - RNA, 15 nt, Human
ugcugucuggcacag

SEQ ID NO: 1951459 - RNA, 19 nt, Human
ugcugucuggcacagccug

SEQ ID NO: 1951460 - RNA, 18 nt, Human
ugcugucagucuugaccu

SEQ ID NO: 1951461 - RNA, 13 nt, Human
ugcugucauugcu

SEQ ID NO: 1951462 - RNA, 14 nt, Human
ugcugucauugcuu

SEQ ID NO: 1951463 - RNA, 20 nt, Human
ugcugucauugcuucuucug

SEQ ID NO: 1951464 - RNA, 21 nt, Human
ugcugucauugcuucuucuga

SEQ ID NO: 1951465 - RNA, 24 nt, Human
ugcugucauugcuucuucugaggc

SEQ ID NO: 1951466 - RNA, 13 nt, Human
ugcuggagcucug

SEQ ID NO: 1951467 - RNA, 14 nt, Human
ugcuggagcucugc

SEQ ID NO: 1951468 - RNA, 15 nt, Human
ugcugcccugugagu

SEQ ID NO: 1951469 - RNA, 20 nt, Human
aggaauuuuauuuuuuucug

SEQ ID NO: 1951470 - RNA, 14 nt, Human
ugcugcccugugag

SEQ ID NO: 1951471 - RNA, 13 nt, Human
ugcugcccuguga

SEQ ID NO: 1951472 - RNA, 12 nt, Human
ugcugcccugug

SEQ ID NO: 1951473 - RNA, 16 nt, Human
ugcuggcugguuagag

SEQ ID NO: 1951474 - RNA, 18 nt, Human
ugcuggcuguuggcuggg

SEQ ID NO: 1951475 - RNA, 15 nt, Human
ugcuggcugccuuag

SEQ ID NO: 1951476 - RNA, 14 nt, Human
ugcuggcugccuua

SEQ ID NO: 1951477 - RNA, 21 nt, Human
ugcuggcugccuuagaaccuu

SEQ ID NO: 1951478 - RNA, 14 nt, Human
aggacauggcuucu

SEQ ID NO: 1951479 - RNA, 15 nt, Human
aggacauggcuucug

SEQ ID NO: 1951480 - RNA, 21 nt, Human
aggacauggcuucugaaccug

SEQ ID NO: 1951481 - RNA, 20 nt, Human
aggacauccccccgccaaaa

SEQ ID NO: 1951482 - RNA, 22 nt, Human
aggacagggaggugaccccagg

SEQ ID NO: 1951483 - RNA, 16 nt, Human
aggacaggagaugcug

SEQ ID NO: 1951484 - RNA, 20 nt, Human
aggacaggaaaguggcaccu

SEQ ID NO: 1951485 - RNA, 22 nt, Human
aggacaggaaaguggcaccugu

SEQ ID NO: 1951486 - RNA, 11 nt, Human
ugcuucauaca

SEQ ID NO: 1951487 - RNA, 14 nt, Human
ugcuucauacaggg

SEQ ID NO: 1951488 - RNA, 15 nt, Human
ugcuucauacaggga

SEQ ID NO: 1951489 - RNA, 16 nt, Human
ugcuucauacagggau

SEQ ID NO: 1951490 - RNA, 14 nt, Human
ugcuucaucccuuu

SEQ ID NO: 1951491 - RNA, 12 nt, Human
aggacacucccg

SEQ ID NO: 1951492 - RNA, 23 nt, Human
aggacacuaaccacgcuggaccu

SEQ ID NO: 1951493 - RNA, 19 nt, Human
aggacacuaaccacgcugg

SEQ ID NO: 1951494 - RNA, 19 nt, Human
ugcuucaaggauccugagc

SEQ ID NO: 1951495 - RNA, 18 nt, Human
ugcuucaaggauccugag

SEQ ID NO: 1951496 - RNA, 16 nt, Human
ugcuucaaggauccug

SEQ ID NO: 1951497 - RNA, 19 nt, Human
ugcuuauguuguuuuguac

SEQ ID NO: 1951498 - RNA, 12 nt, Human
ugcuuauguugu

SEQ ID NO: 1951499 - RNA, 13 nt, Human
ugcuucagccucc

SEQ ID NO: 1951500 - RNA, 14 nt, Human
ugcuucagccuccc

SEQ ID NO: 1951501 - RNA, 12 nt, Human
ugcuucaaggau

SEQ ID NO: 1951502 - RNA, 17 nt, Human
ugcugugaagcuggaac

SEQ ID NO: 1951503 - RNA, 14 nt, Human
ugcugugaaaaaaa

SEQ ID NO: 1951504 - RNA, 22 nt, Human
ugcugugaaaaaaaaaaugcug

SEQ ID NO: 1951505 - RNA, 18 nt, Human
ugcugugaagcuggaacu

SEQ ID NO: 1951506 - RNA, 13 nt, Human
ugcugucuuucuu

SEQ ID NO: 1951507 - RNA, 21 nt, Human
ugcugucuuucuugcucccug

SEQ ID NO: 1951508 - RNA, 14 nt, Human
ugcugucuuuucuu

SEQ ID NO: 1951509 - RNA, 22 nt, Human
ugcugucuuuucuuugccaucu

SEQ ID NO: 1951510 - RNA, 23 nt, Human
ugcugucuuuucuuugccaucuc

SEQ ID NO: 1951511 - RNA, 12 nt, Human
ugcugugaaaaa

SEQ ID NO: 1951512 - RNA, 13 nt, Human
ugcugugaaaaaa

SEQ ID NO: 1951513 - RNA, 13 nt, Human
ugcuuauacacuu

SEQ ID NO: 1951514 - RNA, 17 nt, Human
ugcuuauauuguuuuca

SEQ ID NO: 1951515 - RNA, 21 nt, Human
ugcucugcugacagacacagg

SEQ ID NO: 1951516 - RNA, 22 nt, Human
ugcucugcugacagacacaggc

SEQ ID NO: 1951517 - RNA, 13 nt, Human
ugcucccugacug

SEQ ID NO: 1951518 - RNA, 14 nt, Human
ugcucccugacugg

SEQ ID NO: 1951519 - RNA, 21 nt, Human
ugcucccugacugggggcaga

SEQ ID NO: 1951520 - RNA, 21 nt, Human
ugcucccuccgggucuuccua

SEQ ID NO: 1951521 - RNA, 15 nt, Human
ugcucugcugaugac

SEQ ID NO: 1951522 - RNA, 15 nt, Human
ugcugacccaugggc

SEQ ID NO: 1951523 - RNA, 16 nt, Human
ugcugacccaugggca

SEQ ID NO: 1951524 - RNA, 18 nt, Human
ugcugacccaugggcagg

SEQ ID NO: 1951525 - RNA, 19 nt, Human
ugcugacccaugggcagga

SEQ ID NO: 1951526 - RNA, 21 nt, Human
ugcugacccaugggcaggaga

SEQ ID NO: 1951527 - RNA, 23 nt, Human
ugcugacccaugggcaggagacu

SEQ ID NO: 1951528 - RNA, 14 nt, Human
ugcugagucugaag

SEQ ID NO: 1951529 - RNA, 15 nt, Human
ugcugagucugaagg

SEQ ID NO: 1951530 - RNA, 12 nt, Human
ugcuccagcucu

SEQ ID NO: 1951531 - RNA, 13 nt, Human
ugcuccagcucug

SEQ ID NO: 1951532 - RNA, 17 nt, Human
ugcuccagcucuggcau

SEQ ID NO: 1951533 - RNA, 19 nt, Human
ugcuccagcucuggcaugg

SEQ ID NO: 1951534 - RNA, 19 nt, Human
ugcuccagcuguucagcug

SEQ ID NO: 1951535 - RNA, 16 nt, Human
ugcuccagcuguucag

SEQ ID NO: 1951536 - RNA, 22 nt, Human
ugcuauuguagagccagagguc

SEQ ID NO: 1951537 - RNA, 16 nt, Human
ugcuauugugaauagu

SEQ ID NO: 1951538 - RNA, 19 nt, Human
agcugggacuacaggcacc

SEQ ID NO: 1951539 - RNA, 16 nt, Human
agcugggacuacaggc

SEQ ID NO: 1951540 - RNA, 18 nt, Human
agcugggacuacaggcac

SEQ ID NO: 1951541 - RNA, 19 nt, Human
aggaagacuucaucccucu

SEQ ID NO: 1951542 - RNA, 13 nt, Human
aggaagacuucau

SEQ ID NO: 1951543 - RNA, 23 nt, Human
ugcugagucugaaggcuggguuc

SEQ ID NO: 1951544 - RNA, 22 nt, Human
ugcugagucugaaggcuggguu

SEQ ID NO: 1951545 - RNA, 21 nt, Human
ugcugagucugaaggcugggu

SEQ ID NO: 1951546 - RNA, 18 nt, Human
ugcugagucugaaggcug

SEQ ID NO: 1951547 - RNA, 17 nt, Human
ugcugagucugaaggcu

SEQ ID NO: 1951548 - RNA, 16 nt, Human
ugcugagucugaaggc

SEQ ID NO: 1951549 - RNA, 24 nt, Human
aggaagcacaugccucucucaggc

SEQ ID NO: 1951550 - RNA, 23 nt, Human
aggaagcacaugccucucucagg

SEQ ID NO: 1951551 - RNA, 14 nt, Human
aggaagacuuugga

SEQ ID NO: 1951552 - RNA, 13 nt, Human
aggaagacuuugg

SEQ ID NO: 1951553 - RNA, 15 nt, Human
aggaagccagcaggc

SEQ ID NO: 1951554 - RNA, 14 nt, Human
aggaagccagcagg

SEQ ID NO: 1951555 - RNA, 18 nt, Human
aggaagccagcaggcucu

SEQ ID NO: 1951556 - RNA, 17 nt, Human
aggaagccagcaggcuc

SEQ ID NO: 1951557 - RNA, 18 nt, Human
aggaaggaaacccagcuc

SEQ ID NO: 1951558 - RNA, 15 nt, Human
aggaaggagaggaga

SEQ ID NO: 1951559 - RNA, 19 nt, Human
aggaaggaaacccagcucu

SEQ ID NO: 1951560 - RNA, 23 nt, Human
aggaauuguguuuauaauuuuaa

SEQ ID NO: 1951561 - RNA, 23 nt, Human
aggaauugacccacaagaaauga

SEQ ID NO: 1951562 - RNA, 11 nt, Human
aggaauuuaaa

SEQ ID NO: 1951563 - RNA, 14 nt, Human
aggaggcaggaccu

SEQ ID NO: 1951564 - RNA, 11 nt, Human
aggaggccacc

SEQ ID NO: 1951565 - RNA, 13 nt, Human
aggaggccaccuc

SEQ ID NO: 1951566 - RNA, 21 nt, Human
aggaggcugggacgcucugcu

SEQ ID NO: 1951567 - RNA, 22 nt, Human
aggaggcugggacgcucugcug

SEQ ID NO: 1951568 - RNA, 19 nt, Human
aggagggacagucucacca

SEQ ID NO: 1951569 - RNA, 18 nt, Human
uggaaauuaagaagaaac

SEQ ID NO: 1951570 - RNA, 20 nt, Human
uggaaauuaagaagaaacua

SEQ ID NO: 1951571 - RNA, 23 nt, Human
uggaaaugggcagagcagagacc

SEQ ID NO: 1951572 - RNA, 20 nt, Human
uggaaauauuaagaaagacu

SEQ ID NO: 1951573 - RNA, 16 nt, Human
aggauccugagccaga

SEQ ID NO: 1951574 - RNA, 15 nt, Human
aggauccugagccag

SEQ ID NO: 1951575 - RNA, 21 nt, Human
aggauacaaaagcaugugaga

SEQ ID NO: 1951576 - RNA, 14 nt, Human
aggagggaggggga

SEQ ID NO: 1951577 - RNA, 21 nt, Human
aggagggagcaucagugcccu

SEQ ID NO: 1951578 - RNA, 22 nt, Human
aggaucucuugagccugggagg

SEQ ID NO: 1951579 - RNA, 21 nt, Human
aggaucucuugagccugggag

SEQ ID NO: 1951580 - RNA, 18 nt, Human
aggauccugagccagauu

SEQ ID NO: 1951581 - RNA, 17 nt, Human
aggauccugagccagau

SEQ ID NO: 1951582 - RNA, 17 nt, Human
aggaugaucuaggaaga

SEQ ID NO: 1951583 - RNA, 16 nt, Human
aggaugaucuaggaag

SEQ ID NO: 1951584 - RNA, 14 nt, Human
uggaccauuuuccu

SEQ ID NO: 1951585 - RNA, 22 nt, Human
uggaccaugcugucuggcacag

SEQ ID NO: 1951586 - RNA, 15 nt, Human
uggaccauuuuccug

SEQ ID NO: 1951587 - RNA, 15 nt, Human
uggacacagcucuuc

SEQ ID NO: 1951588 - RNA, 16 nt, Human
uggacacagcucuucu

SEQ ID NO: 1951589 - RNA, 18 nt, Human
uggacacagcucuucucc

SEQ ID NO: 1951590 - RNA, 13 nt, Human
uggacccugaggc

SEQ ID NO: 1951591 - RNA, 12 nt, Human
uggacccugagg

SEQ ID NO: 1951592 - RNA, 14 nt, Human
uggacccugaggcc

SEQ ID NO: 1951593 - RNA, 18 nt, Human
uggacccugaaaugugug

SEQ ID NO: 1951594 - RNA, 22 nt, Human
uggaauuggguggggggcuuca

SEQ ID NO: 1951595 - RNA, 17 nt, Human
aggcaacucaucuuagg

SEQ ID NO: 1951596 - RNA, 14 nt, Human
aggaugcccaaaga

SEQ ID NO: 1951597 - RNA, 20 nt, Human
aggaugaucuaggaagacuu

SEQ ID NO: 1951598 - RNA, 19 nt, Human
aggaugcccaaagaugcag

SEQ ID NO: 1951599 - RNA, 15 nt, Human
aggcaaaaaaggaug

SEQ ID NO: 1951600 - RNA, 15 nt, Human
aggcaaaaacaaaga

SEQ ID NO: 1951601 - RNA, 19 nt, Human
aggauuuugauccaagcug

SEQ ID NO: 1951602 - RNA, 17 nt, Human
aggaugccccguccccc

SEQ ID NO: 1951603 - RNA, 19 nt, Human
aggagcccugggaggcucu

SEQ ID NO: 1951604 - RNA, 15 nt, Human
aggagcccugccucu

SEQ ID NO: 1951605 - RNA, 17 nt, Human
aggagcccugccucucc

SEQ ID NO: 1951606 - RNA, 14 nt, Human
aggagccugcccag

SEQ ID NO: 1951607 - RNA, 14 nt, Human
aggagcgcucccuu

SEQ ID NO: 1951608 - RNA, 22 nt, Human
aggagcgcucccuugaccugcu

SEQ ID NO: 1951609 - RNA, 16 nt, Human
ugcuugggcuucaucc

SEQ ID NO: 1951610 - RNA, 12 nt, Human
ugcuugggcuuc

SEQ ID NO: 1951611 - RNA, 13 nt, Human
ugcuuggcccagg

SEQ ID NO: 1951612 - RNA, 14 nt, Human
ugcuuggcccaggg

SEQ ID NO: 1951613 - RNA, 15 nt, Human
ugcuuggcccagggg

SEQ ID NO: 1951614 - RNA, 21 nt, Human
ugcuuggaggaaggaaaccca

SEQ ID NO: 1951615 - RNA, 15 nt, Human
uggaaauauuaagaa

SEQ ID NO: 1951616 - RNA, 15 nt, Human
uggaaauacuagauu

SEQ ID NO: 1951617 - RNA, 19 nt, Human
ugcuugggcuucauccucc

SEQ ID NO: 1951618 - RNA, 17 nt, Human
ugcuuugggcugcccug

SEQ ID NO: 1951619 - RNA, 18 nt, Human
ugcuuugggcugcccugg

SEQ ID NO: 1951620 - RNA, 19 nt, Human
ugcuuugggcugcccuggu

SEQ ID NO: 1951621 - RNA, 20 nt, Human
ugcuuugggcugcccuggug

SEQ ID NO: 1951622 - RNA, 21 nt, Human
ugcuuugggcugcccuggugc

SEQ ID NO: 1951623 - RNA, 19 nt, Human
ugcuuuuaaggaaaggcaa

SEQ ID NO: 1951624 - RNA, 19 nt, Human
ugcuuuuaaaauuuuaagc

SEQ ID NO: 1951625 - RNA, 19 nt, Human
ugcuuuggucacuuuuaga

SEQ ID NO: 1951626 - RNA, 21 nt, Human
ugcuuuggucacuuuuagaug

SEQ ID NO: 1951627 - RNA, 12 nt, Human
ugcuuugucucc

SEQ ID NO: 1951628 - RNA, 13 nt, Human
ugcuuuuaaaacu

SEQ ID NO: 1951629 - RNA, 14 nt, Human
ugcuuuuaaaacua

SEQ ID NO: 1951630 - RNA, 17 nt, Human
ugcuuuuaaaacuacuu

SEQ ID NO: 1951631 - RNA, 13 nt, Human
ugcuuuuaaaauu

SEQ ID NO: 1951632 - RNA, 17 nt, Human
ugcuuuuaaaauuuuaa

SEQ ID NO: 1951633 - RNA, 14 nt, Human
aggagcagccacau

SEQ ID NO: 1951634 - RNA, 19 nt, Human
aggagcaguaucaugaagc

SEQ ID NO: 1951635 - RNA, 18 nt, Human
aggagcauauguccuaga

SEQ ID NO: 1951636 - RNA, 18 nt, Human
aggagcccugggaggcuc

SEQ ID NO: 1951637 - RNA, 11 nt, Human
aggagcccugc

SEQ ID NO: 1951638 - RNA, 13 nt, Human
aggagcccugccu

SEQ ID NO: 1951639 - RNA, 14 nt, Human
aggagcccugccuc

SEQ ID NO: 1951640 - RNA, 22 nt, Human
aggagccccgaggccuucucug

SEQ ID NO: 1951641 - RNA, 17 nt, Human
aggagauuggaaggaac

SEQ ID NO: 1951642 - RNA, 23 nt, Human
aggacuuuucuuuguggcuuccu

SEQ ID NO: 1951643 - RNA, 11 nt, Human
aggagaaacug

SEQ ID NO: 1951644 - RNA, 19 nt, Human
aggacugaauuaugaaacu

SEQ ID NO: 1951645 - RNA, 20 nt, Human
aggacugaauuaugaaacuu

SEQ ID NO: 1951646 - RNA, 19 nt, Human
aggacucugccuccucuuc

SEQ ID NO: 1951647 - RNA, 22 nt, Human
aggacauugauuugauuuuuau

SEQ ID NO: 1951648 - RNA, 19 nt, Human
aggacauugcggacagcca

SEQ ID NO: 1951649 - RNA, 23 nt, Human
aggacauugcggacagccacggc

SEQ ID NO: 1951650 - RNA, 15 nt, Human
aggacauugcggaca

SEQ ID NO: 1951651 - RNA, 17 nt, Human
aggacauugcggacagc

SEQ ID NO: 1951652 - RNA, 18 nt, Human
aggacauugcggacagcc

SEQ ID NO: 1951653 - RNA, 22 nt, Human
aggacuguuacucaaugugugc

SEQ ID NO: 1951654 - RNA, 18 nt, Human
aggacugacugaggcagu

SEQ ID NO: 1951655 - RNA, 22 nt, Human
aggacugacugaggcaguuuga

SEQ ID NO: 1951656 - RNA, 15 nt, Human
aggacugacugaggc

SEQ ID NO: 1951657 - RNA, 16 nt, Human
aggacugacugaggca

SEQ ID NO: 1951658 - RNA, 17 nt, Human
aggacugacugaggcag

SEQ ID NO: 1951659 - RNA, 17 nt, Human
agcuaucguaaaauuaa

SEQ ID NO: 1951660 - RNA, 15 nt, Human
agcuaguugaauacu

SEQ ID NO: 1951661 - RNA, 16 nt, Human
agcuaguugaauacuu

SEQ ID NO: 1951662 - RNA, 17 nt, Human
agcuaguugaauacuug

SEQ ID NO: 1951663 - RNA, 18 nt, Human
agcuaguugaauacuuga

SEQ ID NO: 1951664 - RNA, 16 nt, Human
agcuacaucuacuuaa

SEQ ID NO: 1951665 - RNA, 21 nt, Human
agcuaggccuggccagaugca

SEQ ID NO: 1951666 - RNA, 14 nt, Human
agcuagucaacagu

SEQ ID NO: 1951667 - RNA, 13 nt, Human
agcgugagccacu

SEQ ID NO: 1951668 - RNA, 19 nt, Human
agcgugaagccagggcccg

SEQ ID NO: 1951669 - RNA, 13 nt, Human
agcucagggccug

SEQ ID NO: 1951670 - RNA, 12 nt, Human
agcucagggccu

SEQ ID NO: 1951671 - RNA, 19 nt, Human
agcuauucaguaauaacuc

SEQ ID NO: 1951672 - RNA, 19 nt, Human
agcucagggccuggcucag

SEQ ID NO: 1951673 - RNA, 14 nt, Human
agcucagggccugg

SEQ ID NO: 1951674 - RNA, 20 nt, Human
agcucagggccuggcucagg

SEQ ID NO: 1951675 - RNA, 16 nt, Human
agcuccaagcucccag

SEQ ID NO: 1951676 - RNA, 18 nt, Human
agcuccaagaauuucuag

SEQ ID NO: 1951677 - RNA, 15 nt, Human
agcuccaagcuccca

SEQ ID NO: 1951678 - RNA, 15 nt, Human
agcuccaagaauuuc

SEQ ID NO: 1951679 - RNA, 17 nt, Human
agcucaggugucccugc

SEQ ID NO: 1951680 - RNA, 17 nt, Human
ugcccagccccuucuga

SEQ ID NO: 1951681 - RNA, 16 nt, Human
ugcccagccccuucug

SEQ ID NO: 1951682 - RNA, 12 nt, Human
ugcccagccccu

SEQ ID NO: 1951683 - RNA, 13 nt, Human
ugcccagccccuu

SEQ ID NO: 1951684 - RNA, 15 nt, Human
ugccauuuuucaaaa

SEQ ID NO: 1951685 - RNA, 20 nt, Human
ugcccaaagaugcagccggu

SEQ ID NO: 1951686 - RNA, 17 nt, Human
ugcccaaagaugcagcc

SEQ ID NO: 1951687 - RNA, 23 nt, Human
ugcccagcuuuucauugcuguga

SEQ ID NO: 1951688 - RNA, 19 nt, Human
ugcccagcuuuucauugcu

SEQ ID NO: 1951689 - RNA, 20 nt, Human
ugcccagcuuuucauugcug

SEQ ID NO: 1951690 - RNA, 15 nt, Human
ugcccaggccccugc

SEQ ID NO: 1951691 - RNA, 17 nt, Human
ugcccaggccccugcca

SEQ ID NO: 1951692 - RNA, 18 nt, Human
ugcccaggccccugccac

SEQ ID NO: 1951693 - RNA, 23 nt, Human
ugccccccaugaggaaggaacag

SEQ ID NO: 1951694 - RNA, 22 nt, Human
ugcccccaauaguagucucugu

SEQ ID NO: 1951695 - RNA, 23 nt, Human
ugccccgaacauguuuuucuucu

SEQ ID NO: 1951696 - RNA, 20 nt, Human
ugcccuaaaguguauuuuuu

SEQ ID NO: 1951697 - RNA, 14 nt, Human
ugcccccucugccc

SEQ ID NO: 1951698 - RNA, 15 nt, Human
ugcccccucugcccu

SEQ ID NO: 1951699 - RNA, 16 nt, Human
ugcccccucugcccug

SEQ ID NO: 1951700 - RNA, 17 nt, Human
ugcccccucugcccugc

SEQ ID NO: 1951701 - RNA, 18 nt, Human
ugcccccucugcccugcg

SEQ ID NO: 1951702 - RNA, 22 nt, Human
ugccagcucuuccuagcuggag

SEQ ID NO: 1951703 - RNA, 23 nt, Human
ugccagcucuuccuagcuggaga

SEQ ID NO: 1951704 - RNA, 15 nt, Human
ugccagcugcugagc

SEQ ID NO: 1951705 - RNA, 16 nt, Human
ugccagcugcugagcc

SEQ ID NO: 1951706 - RNA, 17 nt, Human
ugccagcugcugagccg

SEQ ID NO: 1951707 - RNA, 15 nt, Human
ugccagcucuuccua

SEQ ID NO: 1951708 - RNA, 18 nt, Human
ugccagcucuuccuagcu

SEQ ID NO: 1951709 - RNA, 20 nt, Human
ugccagcucuuccuagcugg

SEQ ID NO: 1951710 - RNA, 17 nt, Human
ugccagccacugugaua

SEQ ID NO: 1951711 - RNA, 21 nt, Human
ugccagauguccuaaugguga

SEQ ID NO: 1951712 - RNA, 20 nt, Human
ugcauuugaggucuguucuu

SEQ ID NO: 1951713 - RNA, 21 nt, Human
ugcauuugaggucuguucuuu

SEQ ID NO: 1951714 - RNA, 13 nt, Human
ugccacugccucu

SEQ ID NO: 1951715 - RNA, 17 nt, Human
ugccacugccucuuccu

SEQ ID NO: 1951716 - RNA, 21 nt, Human
ugcauuuagggaguauucuaa

SEQ ID NO: 1951717 - RNA, 12 nt, Human
ugcauuucagaa

SEQ ID NO: 1951718 - RNA, 17 nt, Human
ugcauuucagaaagccu

SEQ ID NO: 1951719 - RNA, 20 nt, Human
ugccacugccucuuccuccc

SEQ ID NO: 1951720 - RNA, 18 nt, Human
ugccacugccucuuccuc

SEQ ID NO: 1951721 - RNA, 19 nt, Human
ugccacugccucuuccucc

SEQ ID NO: 1951722 - RNA, 18 nt, Human
ugccagcuuaucucaggg

SEQ ID NO: 1951723 - RNA, 14 nt, Human
ugccaggaaccugu

SEQ ID NO: 1951724 - RNA, 19 nt, Human
ugccagcugcugagccgca

SEQ ID NO: 1951725 - RNA, 20 nt, Human
ugccagcugcugagccgcag

SEQ ID NO: 1951726 - RNA, 20 nt, Human
ugccagucccccugccccag

SEQ ID NO: 1951727 - RNA, 21 nt, Human
ugccaggaaccuguccuaagg

SEQ ID NO: 1951728 - RNA, 22 nt, Human
ugccaggaaccuguccuaagga

SEQ ID NO: 1951729 - RNA, 13 nt, Human
agcggcuggcagc

SEQ ID NO: 1951730 - RNA, 22 nt, Human
agcggggacagcuccuucuguc

SEQ ID NO: 1951731 - RNA, 17 nt, Human
agcguagugcagcaggg

SEQ ID NO: 1951732 - RNA, 20 nt, Human
agcguagugcagcagggcag

SEQ ID NO: 1951733 - RNA, 16 nt, Human
agcguauggcuuuauu

SEQ ID NO: 1951734 - RNA, 21 nt, Human
agcggcuggacuuggagguag

SEQ ID NO: 1951735 - RNA, 20 nt, Human
agcgggaauggcagcugcca

SEQ ID NO: 1951736 - RNA, 23 nt, Human
agcggcuggcagcccaccccuca

SEQ ID NO: 1951737 - RNA, 19 nt, Human
agcggggacagcuccuucu

SEQ ID NO: 1951738 - RNA, 20 nt, Human
agcggggacagcuccuucug

SEQ ID NO: 1951739 - RNA, 22 nt, Human
agccuugaccauucuccaccug

SEQ ID NO: 1951740 - RNA, 16 nt, Human
agccuugaacuuugac

SEQ ID NO: 1951741 - RNA, 22 nt, Human
agccuugaacuuugaccucugc

SEQ ID NO: 1951742 - RNA, 21 nt, Human
agccuugauucccuuguuauu

SEQ ID NO: 1951743 - RNA, 23 nt, Human
agccuugaccauucuccaccugc

SEQ ID NO: 1951744 - RNA, 22 nt, Human
agcgauucuucugcuucagccu

SEQ ID NO: 1951745 - RNA, 15 nt, Human
agccuugaacuuuga

SEQ ID NO: 1951746 - RNA, 18 nt, Human
agccuuccagggguggga

SEQ ID NO: 1951747 - RNA, 18 nt, Human
ugcagcucuuccuggaca

SEQ ID NO: 1951748 - RNA, 15 nt, Human
ugcagcugaaauuga

SEQ ID NO: 1951749 - RNA, 18 nt, Human
ugcagcugaaauugaaaa

SEQ ID NO: 1951750 - RNA, 19 nt, Human
ugcagcugaaauugaaaag

SEQ ID NO: 1951751 - RNA, 21 nt, Human
ugcagcugaaauugaaaaguu

SEQ ID NO: 1951752 - RNA, 22 nt, Human
ugcagcugaaauugaaaaguua

SEQ ID NO: 1951753 - RNA, 18 nt, Human
ugcagcucagaaccacag

SEQ ID NO: 1951754 - RNA, 19 nt, Human
ugcagcucagaaccacagc

SEQ ID NO: 1951755 - RNA, 20 nt, Human
ugcagcucagaaccacagca

SEQ ID NO: 1951756 - RNA, 14 nt, Human
ugcagcucuuccug

SEQ ID NO: 1951757 - RNA, 15 nt, Human
ugcagcucuuccugg

SEQ ID NO: 1951758 - RNA, 16 nt, Human
ugcagcucuuccugga

SEQ ID NO: 1951759 - RNA, 15 nt, Human
agcgcacagcugcuc

SEQ ID NO: 1951760 - RNA, 21 nt, Human
agcgcagccgccuucacagca

SEQ ID NO: 1951761 - RNA, 13 nt, Human
agcgcacagcugc

SEQ ID NO: 1951762 - RNA, 14 nt, Human
agcgcacagcugcu

SEQ ID NO: 1951763 - RNA, 19 nt, Human
agcggacaucagcugguca

SEQ ID NO: 1951764 - RNA, 19 nt, Human
ugcauuugaggucuguucu

SEQ ID NO: 1951765 - RNA, 18 nt, Human
ugcauuugaggucuguuc

SEQ ID NO: 1951766 - RNA, 19 nt, Human
ugcauuuagggaguauucu

SEQ ID NO: 1951767 - RNA, 20 nt, Human
ugcauuuaaaagauacaguu

SEQ ID NO: 1951768 - RNA, 23 nt, Human
ugccucucugcaggucccuaaua

SEQ ID NO: 1951769 - RNA, 15 nt, Human
ugccucucugcaggu

SEQ ID NO: 1951770 - RNA, 14 nt, Human
ugccucugacacac

SEQ ID NO: 1951771 - RNA, 16 nt, Human
ugccucugacacacag

SEQ ID NO: 1951772 - RNA, 21 nt, Human
ugccucucugcaggucccuaa

SEQ ID NO: 1951773 - RNA, 11 nt, Human
ugccucugccu

SEQ ID NO: 1951774 - RNA, 17 nt, Human
ugccucugauguauuuu

SEQ ID NO: 1951775 - RNA, 19 nt, Human
ugccucugauguauuuugu

SEQ ID NO: 1951776 - RNA, 12 nt, Human
ugccucugccuc

SEQ ID NO: 1951777 - RNA, 17 nt, Human
ugccugcccaggccccu

SEQ ID NO: 1951778 - RNA, 18 nt, Human
ugccugcccaggccccug

SEQ ID NO: 1951779 - RNA, 19 nt, Human
ugccugcccaggccccugc

SEQ ID NO: 1951780 - RNA, 22 nt, Human
ugccucugauguauuuugugag

SEQ ID NO: 1951781 - RNA, 11 nt, Human
ugccugccuua

SEQ ID NO: 1951782 - RNA, 19 nt, Human
ugccugccuuaagugagga

SEQ ID NO: 1951783 - RNA, 11 nt, Human
ugccugcucuu

SEQ ID NO: 1951784 - RNA, 12 nt, Human
ugccugcucuuu

SEQ ID NO: 1951785 - RNA, 23 nt, Human
ugccugcucuuuggccugaugac

SEQ ID NO: 1951786 - RNA, 14 nt, Human
agcugccugugccu

SEQ ID NO: 1951787 - RNA, 17 nt, Human
agcugcuuuuuuugaaa

SEQ ID NO: 1951788 - RNA, 22 nt, Human
agcugcuuuuuuugaaacuuug

SEQ ID NO: 1951789 - RNA, 23 nt, Human
agcugcuuuuuuugaaacuuuga

SEQ ID NO: 1951790 - RNA, 22 nt, Human
agcuggagaggagcccugccuc

SEQ ID NO: 1951791 - RNA, 23 nt, Human
agcuggagaggagcccugccucu

SEQ ID NO: 1951792 - RNA, 21 nt, Human
agcuggagaggagcccugccu

SEQ ID NO: 1951793 - RNA, 23 nt, Human
agcugcuuuugucuaugggacuc

SEQ ID NO: 1951794 - RNA, 24 nt, Human
agcugcuuuugucuaugggacuca

SEQ ID NO: 1951795 - RNA, 13 nt, Human
agcugccuguuca

SEQ ID NO: 1951796 - RNA, 22 nt, Human
agcugcuuuugucuaugggacu

SEQ ID NO: 1951797 - RNA, 12 nt, Human
ugccugcuucag

SEQ ID NO: 1951798 - RNA, 21 nt, Human
ugccugcuucagccucccaca

SEQ ID NO: 1951799 - RNA, 22 nt, Human
ugcccuuaccugccaggaagcc

SEQ ID NO: 1951800 - RNA, 18 nt, Human
ugcccugugggcccccaa

SEQ ID NO: 1951801 - RNA, 15 nt, Human
ugcccugugggcccc

SEQ ID NO: 1951802 - RNA, 15 nt, Human
agcucuucuccaggc

SEQ ID NO: 1951803 - RNA, 20 nt, Human
agcucuuccuggacaggcca

SEQ ID NO: 1951804 - RNA, 22 nt, Human
agcucuuccuggacaggccagg

SEQ ID NO: 1951805 - RNA, 14 nt, Human
agcucuuccuagcu

SEQ ID NO: 1951806 - RNA, 12 nt, Human
agcucuuccugg

SEQ ID NO: 1951807 - RNA, 16 nt, Human
agcucuucuccaggcu

SEQ ID NO: 1951808 - RNA, 17 nt, Human
agcucuucuccaggcug

SEQ ID NO: 1951809 - RNA, 23 nt, Human
ugcccugugaguacuacaguccu

SEQ ID NO: 1951810 - RNA, 15 nt, Human
ugccucaccccuugc

SEQ ID NO: 1951811 - RNA, 22 nt, Human
ugccgccgcuagguagagucug

SEQ ID NO: 1951812 - RNA, 16 nt, Human
ugccgcaucucacagc

SEQ ID NO: 1951813 - RNA, 18 nt, Human
ugccgccgcuagguagag

SEQ ID NO: 1951814 - RNA, 20 nt, Human
ugccgcagcccugcagaggg

SEQ ID NO: 1951815 - RNA, 19 nt, Human
ugcccuuaccugccaggaa

SEQ ID NO: 1951816 - RNA, 17 nt, Human
ugccucucucaggccaa

SEQ ID NO: 1951817 - RNA, 12 nt, Human
ugccucucugca

SEQ ID NO: 1951818 - RNA, 11 nt, Human
ugccucucugc

SEQ ID NO: 1951819 - RNA, 15 nt, Human
ugccucagccucccg

SEQ ID NO: 1951820 - RNA, 15 nt, Human
ugccucagccuccug

SEQ ID NO: 1951821 - RNA, 18 nt, Human
ugccucaggaggcaggac

SEQ ID NO: 1951822 - RNA, 15 nt, Human
ugccucagcuucccc

SEQ ID NO: 1951823 - RNA, 17 nt, Human
ugccucagcuuccccag

SEQ ID NO: 1951824 - RNA, 18 nt, Human
ugccucagcuuccccagu

SEQ ID NO: 1951825 - RNA, 21 nt, Human
ugccucaggaggcaggaccuu

SEQ ID NO: 1951826 - RNA, 22 nt, Human
ugccucccaucacccgcuaaga

SEQ ID NO: 1951827 - RNA, 19 nt, Human
agcuccaagcucccaggca

SEQ ID NO: 1951828 - RNA, 18 nt, Human
agcuccaagcucccaggc

SEQ ID NO: 1951829 - RNA, 17 nt, Human
agcuccaagcucccagg

SEQ ID NO: 1951830 - RNA, 13 nt, Human
agcuccagcucac

SEQ ID NO: 1951831 - RNA, 17 nt, Human
agcuccagcucaccagc

SEQ ID NO: 1951832 - RNA, 21 nt, Human
agcuccaccccgcaagcacca

SEQ ID NO: 1951833 - RNA, 23 nt, Human
ugcccuaaugcgcaggcuggccc

SEQ ID NO: 1951834 - RNA, 20 nt, Human
ugcccuaaugcgcaggcugg

SEQ ID NO: 1951835 - RNA, 23 nt, Human
agcucugcccauccugccccuga

SEQ ID NO: 1951836 - RNA, 21 nt, Human
agcucugcagagcaggaaaca

SEQ ID NO: 1951837 - RNA, 23 nt, Human
agcucugaguuccggcaccagua

SEQ ID NO: 1951838 - RNA, 21 nt, Human
agcuccagcucaccagcccca

SEQ ID NO: 1951839 - RNA, 18 nt, Human
agcuccagcucaccagcc

SEQ ID NO: 1951840 - RNA, 19 nt, Human
agcuccagcucaccagccc

SEQ ID NO: 1951841 - RNA, 21 nt, Human
agcuccaucuccacuccagau

SEQ ID NO: 1951842 - RNA, 17 nt, Human
agcucccacuucugcca

SEQ ID NO: 1951843 - RNA, 18 nt, Human
agcucccacuucugccag

SEQ ID NO: 1951844 - RNA, 19 nt, Human
agcucccacuucugccaga

SEQ ID NO: 1951845 - RNA, 22 nt, Human
agcuccuucuguccuacucugu

SEQ ID NO: 1951846 - RNA, 23 nt, Human
agcuccuucuguccuacucugug

SEQ ID NO: 1951847 - RNA, 20 nt, Human
agcuccccccaccuccccca

SEQ ID NO: 1951848 - RNA, 14 nt, Human
agcucccccagcuc

SEQ ID NO: 1951849 - RNA, 15 nt, Human
agcucccccagcucc

SEQ ID NO: 1951850 - RNA, 16 nt, Human
agcucccccagcuccc

SEQ ID NO: 1951851 - RNA, 14 nt, Human
agcuccccccaccu

SEQ ID NO: 1951852 - RNA, 15 nt, Human
agcuccccccaccuc

SEQ ID NO: 1951853 - RNA, 21 nt, Human
ugcacacaccagagcccaccu

SEQ ID NO: 1951854 - RNA, 17 nt, Human
ugcacacaccagagccc

SEQ ID NO: 1951855 - RNA, 18 nt, Human
ugcacacaccagagccca

SEQ ID NO: 1951856 - RNA, 14 nt, Human
agcccugguggcag

SEQ ID NO: 1951857 - RNA, 15 nt, Human
agcccugguggcagu

SEQ ID NO: 1951858 - RNA, 16 nt, Human
agcccugguggcagug

SEQ ID NO: 1951859 - RNA, 19 nt, Human
agcccugcuuugggcugcc

SEQ ID NO: 1951860 - RNA, 20 nt, Human
agcccugcuuugggcugccc

SEQ ID NO: 1951861 - RNA, 17 nt, Human
agcccugcuuugggcug

SEQ ID NO: 1951862 - RNA, 12 nt, Human
agcccugcuccc

SEQ ID NO: 1951863 - RNA, 13 nt, Human
agcccugcucccu

SEQ ID NO: 1951864 - RNA, 14 nt, Human
agcccugcucccuc

SEQ ID NO: 1951865 - RNA, 11 nt, Human
agcccugcucc

SEQ ID NO: 1951866 - RNA, 21 nt, Human
agcccgauccuccccuggacu

SEQ ID NO: 1951867 - RNA, 14 nt, Human
agcccgcaucagcu

SEQ ID NO: 1951868 - RNA, 15 nt, Human
agcccgcaucagcug

SEQ ID NO: 1951869 - RNA, 14 nt, Human
agcccccucuuccc

SEQ ID NO: 1951870 - RNA, 15 nt, Human
agcccccucuucccu

SEQ ID NO: 1951871 - RNA, 23 nt, Human
agccccauucugccugcccaggc

SEQ ID NO: 1951872 - RNA, 21 nt, Human
agcccauuuggagggccuggg

SEQ ID NO: 1951873 - RNA, 22 nt, Human
agcccauuugggcagagaggcu

SEQ ID NO: 1951874 - RNA, 23 nt, Human
agcccauuugggcagagaggcug

SEQ ID NO: 1951875 - RNA, 22 nt, Human
agcccccagcuuccagcaggag

SEQ ID NO: 1951876 - RNA, 21 nt, Human
agcccaggccuccuacagcuu

SEQ ID NO: 1951877 - RNA, 22 nt, Human
agcccaggagucccacuccaag

SEQ ID NO: 1951878 - RNA, 20 nt, Human
agcccaggagucccacucca

SEQ ID NO: 1951879 - RNA, 18 nt, Human
agcccaggauauauuuua

SEQ ID NO: 1951880 - RNA, 21 nt, Human
agcccauguggagucagccuc

SEQ ID NO: 1951881 - RNA, 17 nt, Human
agccccaaaacucuccu

SEQ ID NO: 1951882 - RNA, 16 nt, Human
agccccaaaacucucc

SEQ ID NO: 1951883 - RNA, 17 nt, Human
agcccauuuggagggcc

SEQ ID NO: 1951884 - RNA, 19 nt, Human
agcccauuuggagggccug

SEQ ID NO: 1951885 - RNA, 20 nt, Human
agcccauuuggagggccugg

SEQ ID NO: 1951886 - RNA, 20 nt, Human
agccccauucugccugccca

SEQ ID NO: 1951887 - RNA, 18 nt, Human
agccccaaaacucuccuc

SEQ ID NO: 1951888 - RNA, 21 nt, Human
agccccauucugccugcccag

SEQ ID NO: 1951889 - RNA, 22 nt, Human
agccccauucugccugcccagg

SEQ ID NO: 1951890 - RNA, 16 nt, Human
agcccaggagcccauu

SEQ ID NO: 1951891 - RNA, 12 nt, Human
agcccaggagcc

SEQ ID NO: 1951892 - RNA, 14 nt, Human
agcccaggagccca

SEQ ID NO: 1951893 - RNA, 15 nt, Human
agcccaggagcccau

SEQ ID NO: 1951894 - RNA, 12 nt, Human
agcccaggaggg

SEQ ID NO: 1951895 - RNA, 19 nt, Human
agcccaggagggagcagag

SEQ ID NO: 1951896 - RNA, 20 nt, Human
agcccaggagggagcagagg

SEQ ID NO: 1951897 - RNA, 21 nt, Human
ugcaaaccaucauugaaaucu

SEQ ID NO: 1951898 - RNA, 15 nt, Human
ugauuugucacugcu

SEQ ID NO: 1951899 - RNA, 13 nt, Human
ugauuuuaaaaug

SEQ ID NO: 1951900 - RNA, 14 nt, Human
ugauuuuaaaaugu

SEQ ID NO: 1951901 - RNA, 17 nt, Human
ugauuuuaaaauguaca

SEQ ID NO: 1951902 - RNA, 20 nt, Human
ugauuuuaaaauguacaugu

SEQ ID NO: 1951903 - RNA, 22 nt, Human
ugauuuuaaaauguacauguau

SEQ ID NO: 1951904 - RNA, 19 nt, Human
ugcaaacugggcuggaaga

SEQ ID NO: 1951905 - RNA, 15 nt, Human
ugcaaguauucucau

SEQ ID NO: 1951906 - RNA, 14 nt, Human
ugcaaguauucuca

SEQ ID NO: 1951907 - RNA, 18 nt, Human
agccucacaguccuuacc

SEQ ID NO: 1951908 - RNA, 20 nt, Human
agccucacccggugaccucu

SEQ ID NO: 1951909 - RNA, 21 nt, Human
agccucacgcuccuuucugau

SEQ ID NO: 1951910 - RNA, 23 nt, Human
agccucacgcuccuuucugaucu

SEQ ID NO: 1951911 - RNA, 17 nt, Human
agccucacaguccuuac

SEQ ID NO: 1951912 - RNA, 20 nt, Human
agccucaaccuccugggcua

SEQ ID NO: 1951913 - RNA, 19 nt, Human
agccucaaccuccugggcu

SEQ ID NO: 1951914 - RNA, 18 nt, Human
agccgagaucacgccacu

SEQ ID NO: 1951915 - RNA, 22 nt, Human
agccucagucucccucccuugg

SEQ ID NO: 1951916 - RNA, 13 nt, Human
agccucagucucc

SEQ ID NO: 1951917 - RNA, 16 nt, Human
agccucagucucccuc

SEQ ID NO: 1951918 - RNA, 19 nt, Human
agccucagucucccucccu

SEQ ID NO: 1951919 - RNA, 20 nt, Human
agccucagucucccucccuu

SEQ ID NO: 1951920 - RNA, 13 nt, Human
agccucugggccc

SEQ ID NO: 1951921 - RNA, 20 nt, Human
ugcagccucaaccuccuggg

SEQ ID NO: 1951922 - RNA, 21 nt, Human
ugcagccucaaccuccugggc

SEQ ID NO: 1951923 - RNA, 22 nt, Human
ugcagccucaaccuccugggcu

SEQ ID NO: 1951924 - RNA, 23 nt, Human
ugcagccucaaccuccugggcua

SEQ ID NO: 1951925 - RNA, 15 nt, Human
ugcagcucagaacca

SEQ ID NO: 1951926 - RNA, 23 nt, Human
agccucugaaaaccaauguucuc

SEQ ID NO: 1951927 - RNA, 17 nt, Human
agccuccaugcugccuc

SEQ ID NO: 1951928 - RNA, 23 nt, Human
agccuccacuuuggaucaggaaa

SEQ ID NO: 1951929 - RNA, 21 nt, Human
agccuccaagcuccaucucca

SEQ ID NO: 1951930 - RNA, 14 nt, Human
agccuccaauuuuu

SEQ ID NO: 1951931 - RNA, 18 nt, Human
ugcagacucuacagaggc

SEQ ID NO: 1951932 - RNA, 16 nt, Human
ugcagacucuacagag

SEQ ID NO: 1951933 - RNA, 17 nt, Human
ugcagacucuacagagg

SEQ ID NO: 1951934 - RNA, 16 nt, Human
agcccuuagcagggaa

SEQ ID NO: 1951935 - RNA, 22 nt, Human
agcccuugcccaugcugggcuc

SEQ ID NO: 1951936 - RNA, 21 nt, Human
agcccuuagcagggaaacagc

SEQ ID NO: 1951937 - RNA, 20 nt, Human
agccgagauagccaaggcca

SEQ ID NO: 1951938 - RNA, 21 nt, Human
agccgagauagccaaggccaa

SEQ ID NO: 1951939 - RNA, 17 nt, Human
agccgagaucacgccac

SEQ ID NO: 1951940 - RNA, 11 nt, Human
ugcacacauuu

SEQ ID NO: 1951941 - RNA, 12 nt, Human
ugcacacauuuu

SEQ ID NO: 1951942 - RNA, 13 nt, Human
ugcacacauuuuu

SEQ ID NO: 1951943 - RNA, 15 nt, Human
ugcacacauuuuuua

SEQ ID NO: 1951944 - RNA, 17 nt, Human
ugcacuccccugcuggg

SEQ ID NO: 1951945 - RNA, 16 nt, Human
ugcacuccccugcugg

SEQ ID NO: 1951946 - RNA, 19 nt, Human
ugcacuccccugcugggug

SEQ ID NO: 1951947 - RNA, 14 nt, Human
ugcagaacucccaa

SEQ ID NO: 1951948 - RNA, 15 nt, Human
ugcagaacucccaag

SEQ ID NO: 1951949 - RNA, 14 nt, Human
ugcagaagacagua

SEQ ID NO: 1951950 - RNA, 15 nt, Human
ugcagaagacaguau

SEQ ID NO: 1951951 - RNA, 22 nt, Human
ugcagacaggcaagcaccuccu

SEQ ID NO: 1951952 - RNA, 14 nt, Human
ugcagacccucaga

SEQ ID NO: 1951953 - RNA, 22 nt, Human
ugcagacagggggccagaacac

SEQ ID NO: 1951954 - RNA, 21 nt, Human
ugcagacagggggccagaaca

SEQ ID NO: 1951955 - RNA, 21 nt, Human
ugcagaacuugaagccugcuc

SEQ ID NO: 1951956 - RNA, 22 nt, Human
ugcagaacuugaagccugcucc

SEQ ID NO: 1951957 - RNA, 23 nt, Human
ugcagaacuugaagccugcuccu

SEQ ID NO: 1951958 - RNA, 14 nt, Human
agccaugagaaugu

SEQ ID NO: 1951959 - RNA, 16 nt, Human
agcccacuguacuugc

SEQ ID NO: 1951960 - RNA, 14 nt, Human
agcccacuguacuu

SEQ ID NO: 1951961 - RNA, 17 nt, Human
agcccagagucccccca

SEQ ID NO: 1951962 - RNA, 20 nt, Human
agcccagaguccccccacuc

SEQ ID NO: 1951963 - RNA, 13 nt, Human
agcccacuucugc

SEQ ID NO: 1951964 - RNA, 14 nt, Human
agcccacuucugcc

SEQ ID NO: 1951965 - RNA, 15 nt, Human
agcccacuucugcca

SEQ ID NO: 1951966 - RNA, 21 nt, Human
agccagggaaagacuggcaag

SEQ ID NO: 1951967 - RNA, 16 nt, Human
agccagggaaagacug

SEQ ID NO: 1951968 - RNA, 22 nt, Human
agccagcgggaauggcagcugc

SEQ ID NO: 1951969 - RNA, 19 nt, Human
agccagggcccgggaagca

SEQ ID NO: 1951970 - RNA, 21 nt, Human
agccagggcccgggaagcaaa

SEQ ID NO: 1951971 - RNA, 13 nt, Human
agccaguaaaugg

SEQ ID NO: 1951972 - RNA, 18 nt, Human
agccagguuccacagagg

SEQ ID NO: 1951973 - RNA, 22 nt, Human
agccaguaaaugggggugcauu

SEQ ID NO: 1951974 - RNA, 21 nt, Human
agccaguaaaugggggugcau

SEQ ID NO: 1951975 - RNA, 19 nt, Human
ugauucccuuguuauucaa

SEQ ID NO: 1951976 - RNA, 20 nt, Human
ugauucccuuguuauucaac

SEQ ID NO: 1951977 - RNA, 18 nt, Human
ugauucccuuguuauuca

SEQ ID NO: 1951978 - RNA, 22 nt, Human
ugauucccaagcucugcuccuc

SEQ ID NO: 1951979 - RNA, 23 nt, Human
ugauucccaagcucugcuccucu

SEQ ID NO: 1951980 - RNA, 13 nt, Human
ugauucucaugcc

SEQ ID NO: 1951981 - RNA, 14 nt, Human
ugauucucaugccu

SEQ ID NO: 1951982 - RNA, 15 nt, Human
ugauucucaugccuc

SEQ ID NO: 1951983 - RNA, 13 nt, Human
ugauucuccugcc

SEQ ID NO: 1951984 - RNA, 16 nt, Human
ugauucucaugccuca

SEQ ID NO: 1951985 - RNA, 16 nt, Human
ugauucauaaugacuu

SEQ ID NO: 1951986 - RNA, 18 nt, Human
agcccaggaaaggcucca

SEQ ID NO: 1951987 - RNA, 21 nt, Human
agcccagcuuggcccuuuccu

SEQ ID NO: 1951988 - RNA, 23 nt, Human
agcccagcuuggcccuuuccuuc

SEQ ID NO: 1951989 - RNA, 21 nt, Human
agcccagcuuuuccugggaca

SEQ ID NO: 1951990 - RNA, 21 nt, Human
ugauucauaaugacuuaagca

SEQ ID NO: 1951991 - RNA, 14 nt, Human
agcccaggaaaggc

SEQ ID NO: 1951992 - RNA, 23 nt, Human
agcccagcuugaaaccuucacuu

SEQ ID NO: 1951993 - RNA, 23 nt, Human
ugauuucuaguuauuuauucugg

SEQ ID NO: 1951994 - RNA, 23 nt, Human
ugauuuguacagauucuuuauua

SEQ ID NO: 1951995 - RNA, 18 nt, Human
ugauuuggggauucagau

SEQ ID NO: 1951996 - RNA, 21 nt, Human
ugauuuggggauucagauuuc

SEQ ID NO: 1951997 - RNA, 22 nt, Human
ugauuuggggauucagauuucu

SEQ ID NO: 1951998 - RNA, 17 nt, Human
ugauuuggggauauuuu

SEQ ID NO: 1951999 - RNA, 23 nt, Human
ugauuucuuuucaccauucguac

SEQ ID NO: 1952000 - RNA, 17 nt, Human
ugauuucagcucacugc

SEQ ID NO: 1952001 - RNA, 22 nt, Human
ugauuuccguuaaaauaccagc

SEQ ID NO: 1952002 - RNA, 18 nt, Human
ugauuuccguuaaaauac

SEQ ID NO: 1952003 - RNA, 14 nt, Human
ugaugggauuuggu

SEQ ID NO: 1952004 - RNA, 19 nt, Human
ugaugggaugauugaagaa

SEQ ID NO: 1952005 - RNA, 20 nt, Human
ugaugggaugauugaagaaa

SEQ ID NO: 1952006 - RNA, 21 nt, Human
ugaugggaugauugaagaaac

SEQ ID NO: 1952007 - RNA, 19 nt, Human
ugauggggcccugccuccu

SEQ ID NO: 1952008 - RNA, 16 nt, Human
ugauggggcccugccu

SEQ ID NO: 1952009 - RNA, 15 nt, Human
ugauggggcccugcc

SEQ ID NO: 1952010 - RNA, 14 nt, Human
ugauggggcccugc

SEQ ID NO: 1952011 - RNA, 23 nt, Human
ugaugcuucuucagagacuccug

SEQ ID NO: 1952012 - RNA, 20 nt, Human
ugauggaauuuuuuuguacg

SEQ ID NO: 1952013 - RNA, 16 nt, Human
ugaugagaggaaauca

SEQ ID NO: 1952014 - RNA, 15 nt, Human
ugaugagaggaaauc

SEQ ID NO: 1952015 - RNA, 14 nt, Human
ugaugagaggaaau

SEQ ID NO: 1952016 - RNA, 13 nt, Human
ugaugagaggaaa

SEQ ID NO: 1952017 - RNA, 16 nt, Human
ugauccuaguuccacc

SEQ ID NO: 1952018 - RNA, 15 nt, Human
ugauccucccaccuc

SEQ ID NO: 1952019 - RNA, 22 nt, Human
ugauccuaaugaaugcauaaaa

SEQ ID NO: 1952020 - RNA, 22 nt, Human
ugauccucccaccucagccucc

SEQ ID NO: 1952021 - RNA, 16 nt, Human
ugauccucccaccuca

SEQ ID NO: 1952022 - RNA, 21 nt, Human
ugauccucccaccucagccuc

SEQ ID NO: 1952023 - RNA, 22 nt, Human
ugaugacuaugcuuugcuauca

SEQ ID NO: 1952024 - RNA, 21 nt, Human
ugaugacguacaaguaguucu

SEQ ID NO: 1952025 - RNA, 22 nt, Human
ugaugacguacaaguaguucug

SEQ ID NO: 1952026 - RNA, 18 nt, Human
ugaugacccccccagcuu

SEQ ID NO: 1952027 - RNA, 19 nt, Human
ugaugacguacaaguaguu

SEQ ID NO: 1952028 - RNA, 16 nt, Human
ugaugaccaauuuuaa

SEQ ID NO: 1952029 - RNA, 18 nt, Human
ugaugaccaauuuuaacu

SEQ ID NO: 1952030 - RNA, 19 nt, Human
ugauuaaccacuucagcug

SEQ ID NO: 1952031 - RNA, 20 nt, Human
ugauuaaauucuugcaaagu

SEQ ID NO: 1952032 - RNA, 17 nt, Human
ugauggugaugaaaugu

SEQ ID NO: 1952033 - RNA, 13 nt, Human
ugauggugcaaug

SEQ ID NO: 1952034 - RNA, 15 nt, Human
ugauggugaugaaau

SEQ ID NO: 1952035 - RNA, 16 nt, Human
ugauggugaugaaaug

SEQ ID NO: 1952036 - RNA, 15 nt, Human
ugauggugcaaugac

SEQ ID NO: 1952037 - RNA, 19 nt, Human
ugauuaaauucuugcaaag

SEQ ID NO: 1952038 - RNA, 15 nt, Human
agccacgguguucug

SEQ ID NO: 1952039 - RNA, 17 nt, Human
ugauuaauggaaauguu

SEQ ID NO: 1952040 - RNA, 16 nt, Human
agccacugcaccgggc

SEQ ID NO: 1952041 - RNA, 23 nt, Human
agccacuccccagccagccuggc

SEQ ID NO: 1952042 - RNA, 17 nt, Human
agccacuccccagccag

SEQ ID NO: 1952043 - RNA, 22 nt, Human
agccacuccccagccagccugg

SEQ ID NO: 1952044 - RNA, 11 nt, Human
agccacucccc

SEQ ID NO: 1952045 - RNA, 13 nt, Human
agccacuccccag

SEQ ID NO: 1952046 - RNA, 14 nt, Human
agccacuccccagc

SEQ ID NO: 1952047 - RNA, 20 nt, Human
agccacugcaccgggccaca

SEQ ID NO: 1952048 - RNA, 18 nt, Human
agccacugcaccgggcca

SEQ ID NO: 1952049 - RNA, 19 nt, Human
agccacugcaccgggccac

SEQ ID NO: 1952050 - RNA, 11 nt, Human
agccagaggag

SEQ ID NO: 1952051 - RNA, 10 nt, Human
agccagagga

SEQ ID NO: 1952052 - RNA, 14 nt, Human
agccagcaucggaa

SEQ ID NO: 1952053 - RNA, 22 nt, Human
agccagccaaacacacagaagg

SEQ ID NO: 1952054 - RNA, 23 nt, Human
agccagccaaacacacagaaggg

SEQ ID NO: 1952055 - RNA, 15 nt, Human
agccagccuggcugg

SEQ ID NO: 1952056 - RNA, 17 nt, Human
agccagccuggcuggga

SEQ ID NO: 1952057 - RNA, 22 nt, Human
agccagccuggcugggacuggg

SEQ ID NO: 1952058 - RNA, 17 nt, Human
uuaaaccgccaaggcug

SEQ ID NO: 1952059 - RNA, 16 nt, Human
uuaaaauauuccugca

SEQ ID NO: 1952060 - RNA, 19 nt, Human
uuaaaauauuccugcauuu

SEQ ID NO: 1952061 - RNA, 16 nt, Human
uuaaaauaugcacuaa

SEQ ID NO: 1952062 - RNA, 19 nt, Human
uuaaaauaugcacuaaguc

SEQ ID NO: 1952063 - RNA, 12 nt, Human
uuaaaauauaau

SEQ ID NO: 1952064 - RNA, 15 nt, Human
uuaaaaauuuacuac

SEQ ID NO: 1952065 - RNA, 23 nt, Human
uuaaaaauuuacuacaauaugua

SEQ ID NO: 1952066 - RNA, 22 nt, Human
uuaaaauauagauguguuuuau

SEQ ID NO: 1952067 - RNA, 14 nt, Human
uuaaaauaugcacu

SEQ ID NO: 1952068 - RNA, 15 nt, Human
uuaaaauaugcacua

SEQ ID NO: 1952069 - RNA, 15 nt, Human
uuaaauaaaucauaa

SEQ ID NO: 1952070 - RNA, 13 nt, Human
uuaaauaaaucau

SEQ ID NO: 1952071 - RNA, 20 nt, Human
uuaaauaaugugaaacugga

SEQ ID NO: 1952072 - RNA, 21 nt, Human
uuaaauaaugugaaacuggau

SEQ ID NO: 1952073 - RNA, 19 nt, Human
uuaaauaaugugaaacugg

SEQ ID NO: 1952074 - RNA, 22 nt, Human
uuaaauaaugugaaacuggauu

SEQ ID NO: 1952075 - RNA, 18 nt, Human
uuaaaaaguggaaaaaua

SEQ ID NO: 1952076 - RNA, 17 nt, Human
uuaaaaagucuuuuaaa

SEQ ID NO: 1952077 - RNA, 23 nt, Human
uuaaaaagucuuuuaaaaaguau

SEQ ID NO: 1952078 - RNA, 22 nt, Human
uuaaaaaacuuucuacucauuu

SEQ ID NO: 1952079 - RNA, 16 nt, Human
uuaaaaagucuuuuaa

SEQ ID NO: 1952080 - RNA, 13 nt, Human
uuaaaaaguguuu

SEQ ID NO: 1952081 - RNA, 15 nt, Human
uuaaaaauaaagcaa

SEQ ID NO: 1952082 - RNA, 20 nt, Human
uuaaaaaugguuuaaauggu

SEQ ID NO: 1952083 - RNA, 13 nt, Human
uuaaaaauaucaa

SEQ ID NO: 1952084 - RNA, 18 nt, Human
uuaaaaauaucaaauuaa

SEQ ID NO: 1952085 - RNA, 19 nt, Human
uuaaaaauaucaaauuaau

SEQ ID NO: 1952086 - RNA, 17 nt, Human
uuaaaacaacacucaca

SEQ ID NO: 1952087 - RNA, 20 nt, Human
aguugccagucaccccggcc

SEQ ID NO: 1952088 - RNA, 22 nt, Human
aguugcauagguuuaauaauuu

SEQ ID NO: 1952089 - RNA, 20 nt, Human
aguuuucccuugaggaaaca

SEQ ID NO: 1952090 - RNA, 18 nt, Human
aguuuucccuugaggaaa

SEQ ID NO: 1952091 - RNA, 14 nt, Human
aguuuucaugugcu

SEQ ID NO: 1952092 - RNA, 22 nt, Human
aguuuucaugugcucagaauua

SEQ ID NO: 1952093 - RNA, 21 nt, Human
aguuuuauuuucuaaaguacu

SEQ ID NO: 1952094 - RNA, 13 nt, Human
aguuuuauuuucu

SEQ ID NO: 1952095 - RNA, 20 nt, Human
aguuuuauuuucuaaaguac

SEQ ID NO: 1952096 - RNA, 22 nt, Human
aguuuucacucuuauugcccac

SEQ ID NO: 1952097 - RNA, 14 nt, Human
aguuuuauuuauau

SEQ ID NO: 1952098 - RNA, 15 nt, Human
aguuuuauuuauauu

SEQ ID NO: 1952099 - RNA, 17 nt, Human
aguuuuauuuauauuua

SEQ ID NO: 1952100 - RNA, 18 nt, Human
aguuuuauuuauauuuau

SEQ ID NO: 1952101 - RNA, 19 nt, Human
aguuuuauuuauauuuauu

SEQ ID NO: 1952102 - RNA, 20 nt, Human
aguuuuauuuauauuuauug

SEQ ID NO: 1952103 - RNA, 22 nt, Human
aguuuuauuuauauuuauugac

SEQ ID NO: 1952104 - RNA, 23 nt, Human
aguuuuauuuauauuuauugacu

SEQ ID NO: 1952105 - RNA, 15 nt, Human
aguuucaauaaaguu

SEQ ID NO: 1952106 - RNA, 16 nt, Human
aguuucaauaaaguuu

SEQ ID NO: 1952107 - RNA, 17 nt, Human
aguuucaauaaaguuug

SEQ ID NO: 1952108 - RNA, 18 nt, Human
aguuucaauaaaguuuga

SEQ ID NO: 1952109 - RNA, 21 nt, Human
aguuucaauaaaguuugaucu

SEQ ID NO: 1952110 - RNA, 23 nt, Human
aguuucaauaaaguuugaucuuc

SEQ ID NO: 1952111 - RNA, 14 nt, Human
aguuucaaaaaucu

SEQ ID NO: 1952112 - RNA, 23 nt, Human
aguuuauuuuaaaacaauaggau

SEQ ID NO: 1952113 - RNA, 16 nt, Human
aguuuauuuuaaaaca

SEQ ID NO: 1952114 - RNA, 15 nt, Human
aguuucaaaaaucug

SEQ ID NO: 1952115 - RNA, 16 nt, Human
aguuucaaaaaucuga

SEQ ID NO: 1952116 - RNA, 18 nt, Human
aguuucaaaaaucugaag

SEQ ID NO: 1952117 - RNA, 21 nt, Human
aguuucaaaaaucugaagauu

SEQ ID NO: 1952118 - RNA, 22 nt, Human
aguuucaaaaaucugaagauug

SEQ ID NO: 1952119 - RNA, 23 nt, Human
aguuucaaaaaucugaagauugu

SEQ ID NO: 1952120 - RNA, 14 nt, Human
aguuucaacaugaa

SEQ ID NO: 1952121 - RNA, 13 nt, Human
uuaaauucuugca

SEQ ID NO: 1952122 - RNA, 16 nt, Human
uuaaauucuugcaaag

SEQ ID NO: 1952123 - RNA, 15 nt, Human
aguuucuccaagcag

SEQ ID NO: 1952124 - RNA, 13 nt, Human
aguuucuccaagc

SEQ ID NO: 1952125 - RNA, 21 nt, Human
aguuucuccaagcaggacaug

SEQ ID NO: 1952126 - RNA, 16 nt, Human
aguuucucagcuccca

SEQ ID NO: 1952127 - RNA, 16 nt, Human
aguuucguuuucaaaa

SEQ ID NO: 1952128 - RNA, 15 nt, Human
aguuucucagcuccc

SEQ ID NO: 1952129 - RNA, 15 nt, Human
aguuucguuuucaaa

SEQ ID NO: 1952130 - RNA, 12 nt, Human
aguucucuccuu

SEQ ID NO: 1952131 - RNA, 13 nt, Human
aguucucuccuuc

SEQ ID NO: 1952132 - RNA, 20 nt, Human
aguucucuucacucaaggau

SEQ ID NO: 1952133 - RNA, 16 nt, Human
aguucucuccuucuuc

SEQ ID NO: 1952134 - RNA, 15 nt, Human
uguuuucucuugaga

SEQ ID NO: 1952135 - RNA, 17 nt, Human
uguuuucaguguacaug

SEQ ID NO: 1952136 - RNA, 15 nt, Human
uguuuucaguguaca

SEQ ID NO: 1952137 - RNA, 13 nt, Human
uguuuucaaaugu

SEQ ID NO: 1952138 - RNA, 14 nt, Human
uguuuucaaauguu

SEQ ID NO: 1952139 - RNA, 22 nt, Human
uguuuucaaucucguauagaag

SEQ ID NO: 1952140 - RNA, 13 nt, Human
uguuuucaaaugg

SEQ ID NO: 1952141 - RNA, 14 nt, Human
uguuuucaaaugga

SEQ ID NO: 1952142 - RNA, 16 nt, Human
uguuuuagcacagcgu

SEQ ID NO: 1952143 - RNA, 15 nt, Human
uguuugcaucugaaa

SEQ ID NO: 1952144 - RNA, 14 nt, Human
uguuugccucugcc

SEQ ID NO: 1952145 - RNA, 16 nt, Human
uguuugccucugccuc

SEQ ID NO: 1952146 - RNA, 17 nt, Human
uguuguccgguuuacuu

SEQ ID NO: 1952147 - RNA, 14 nt, Human
uguugucagcugaa

SEQ ID NO: 1952148 - RNA, 19 nt, Human
uguuuggggaugagaaagg

SEQ ID NO: 1952149 - RNA, 20 nt, Human
uguuugggaagagcuuagaa

SEQ ID NO: 1952150 - RNA, 15 nt, Human
uguuuggggaugaga

SEQ ID NO: 1952151 - RNA, 12 nt, Human
uguuugcucccc

SEQ ID NO: 1952152 - RNA, 23 nt, Human
uguuugcuccccuuccccuuccu

SEQ ID NO: 1952153 - RNA, 18 nt, Human
aguugauucagcucugca

SEQ ID NO: 1952154 - RNA, 17 nt, Human
aguugauucagcucugc

SEQ ID NO: 1952155 - RNA, 15 nt, Human
aguugauucagcucu

SEQ ID NO: 1952156 - RNA, 14 nt, Human
aguugauucagcuc

SEQ ID NO: 1952157 - RNA, 23 nt, Human
aguugauucagcucugcaagaau

SEQ ID NO: 1952158 - RNA, 19 nt, Human
aguugcaacuuuguauaaa

SEQ ID NO: 1952159 - RNA, 14 nt, Human
aguugaucucccca

SEQ ID NO: 1952160 - RNA, 13 nt, Human
aguugauucagcu

SEQ ID NO: 1952161 - RNA, 23 nt, Human
aguugauagcacagacccugccc

SEQ ID NO: 1952162 - RNA, 22 nt, Human
aguugauagcacagacccugcc

SEQ ID NO: 1952163 - RNA, 21 nt, Human
aguugauagcacagacccugc

SEQ ID NO: 1952164 - RNA, 20 nt, Human
aguugauagcacagacccug

SEQ ID NO: 1952165 - RNA, 19 nt, Human
aguugauagcacagacccu

SEQ ID NO: 1952166 - RNA, 15 nt, Human
aguugauagcacaga

SEQ ID NO: 1952167 - RNA, 15 nt, Human
aguucuuuaaacugu

SEQ ID NO: 1952168 - RNA, 19 nt, Human
aguucuuuccauaauaaaa

SEQ ID NO: 1952169 - RNA, 16 nt, Human
aguucuuugauucugu

SEQ ID NO: 1952170 - RNA, 18 nt, Human
aguucuuugauucuguaa

SEQ ID NO: 1952171 - RNA, 14 nt, Human
aguugauagcacag

SEQ ID NO: 1952172 - RNA, 13 nt, Human
aguucuguauuug

SEQ ID NO: 1952173 - RNA, 14 nt, Human
aguucuguauuuga

SEQ ID NO: 1952174 - RNA, 15 nt, Human
aguucuguauuugaa

SEQ ID NO: 1952175 - RNA, 16 nt, Human
aguucuguauuugaaa

SEQ ID NO: 1952176 - RNA, 17 nt, Human
aguucuguauuugaaag

SEQ ID NO: 1952177 - RNA, 18 nt, Human
aguucuguauuugaaagu

SEQ ID NO: 1952178 - RNA, 20 nt, Human
aguucuguauuugaaagugc

SEQ ID NO: 1952179 - RNA, 21 nt, Human
aguucuguauuugaaagugcc

SEQ ID NO: 1952180 - RNA, 22 nt, Human
aguucuguauuugaaagugccu

SEQ ID NO: 1952181 - RNA, 23 nt, Human
aguucuguauuugaaagugccuu

SEQ ID NO: 1952182 - RNA, 11 nt, Human
aguucugugac

SEQ ID NO: 1952183 - RNA, 19 nt, Human
aguucugugacuaggaaaa

SEQ ID NO: 1952184 - RNA, 21 nt, Human
aguucugugacuaggaaaaaa

SEQ ID NO: 1952185 - RNA, 20 nt, Human
agugggggaguggccacaga

SEQ ID NO: 1952186 - RNA, 19 nt, Human
agugggggaguggccacag

SEQ ID NO: 1952187 - RNA, 18 nt, Human
agugggugaauaauacag

SEQ ID NO: 1952188 - RNA, 13 nt, Human
agugggugaauaa

SEQ ID NO: 1952189 - RNA, 18 nt, Human
agugggggaucacagccu

SEQ ID NO: 1952190 - RNA, 12 nt, Human
aguggcagggca

SEQ ID NO: 1952191 - RNA, 13 nt, Human
aguggcagggcac

SEQ ID NO: 1952192 - RNA, 15 nt, Human
aguggcagggcacag

SEQ ID NO: 1952193 - RNA, 16 nt, Human
aguggcagggcacagg

SEQ ID NO: 1952194 - RNA, 17 nt, Human
aguggcagggcacaggg

SEQ ID NO: 1952195 - RNA, 20 nt, Human
aguggcagggcacagggccu

SEQ ID NO: 1952196 - RNA, 22 nt, Human
aguggcagggcacagggccugg

SEQ ID NO: 1952197 - RNA, 14 nt, Human
aguggcagcugcuu

SEQ ID NO: 1952198 - RNA, 20 nt, Human
aguggcagcugcuuuugucu

SEQ ID NO: 1952199 - RNA, 12 nt, Human
aguggcagcugc

SEQ ID NO: 1952200 - RNA, 13 nt, Human
aguggcagcugcu

SEQ ID NO: 1952201 - RNA, 11 nt, Human
aguggcagcug

SEQ ID NO: 1952202 - RNA, 22 nt, Human
aguguacauggaauaacaugua

SEQ ID NO: 1952203 - RNA, 21 nt, Human
aguguacauggaauaacaugu

SEQ ID NO: 1952204 - RNA, 16 nt, Human
agugguuuuaauaaaa

SEQ ID NO: 1952205 - RNA, 13 nt, Human
agugguugaauau

SEQ ID NO: 1952206 - RNA, 14 nt, Human
agugguugaauaug

SEQ ID NO: 1952207 - RNA, 15 nt, Human
agugguugaauauga

SEQ ID NO: 1952208 - RNA, 18 nt, Human
agugguugaauaugauua

SEQ ID NO: 1952209 - RNA, 19 nt, Human
agugggugaauaauacagu

SEQ ID NO: 1952210 - RNA, 21 nt, Human
agugguuccuaauccucuagg

SEQ ID NO: 1952211 - RNA, 16 nt, Human
aguggugcgaucuggg

SEQ ID NO: 1952212 - RNA, 19 nt, Human
uguucuugguuuguaaauu

SEQ ID NO: 1952213 - RNA, 16 nt, Human
uguucuuggcaauaaa

SEQ ID NO: 1952214 - RNA, 17 nt, Human
uguucuuggcaauaaau

SEQ ID NO: 1952215 - RNA, 20 nt, Human
uguucuuggcaauaaauuuu

SEQ ID NO: 1952216 - RNA, 22 nt, Human
uguucuuggcaauaaauuuuga

SEQ ID NO: 1952217 - RNA, 23 nt, Human
uguucuuggcaauaaauuuugaa

SEQ ID NO: 1952218 - RNA, 13 nt, Human
uguucuuuccaaa

SEQ ID NO: 1952219 - RNA, 14 nt, Human
uguucuuuccaaag

SEQ ID NO: 1952220 - RNA, 17 nt, Human
uguucuugguuuguaaa

SEQ ID NO: 1952221 - RNA, 18 nt, Human
uguucuugguuuguaaau

SEQ ID NO: 1952222 - RNA, 14 nt, Human
uguucuuaauucuu

SEQ ID NO: 1952223 - RNA, 16 nt, Human
uguucuuaauucuuag

SEQ ID NO: 1952224 - RNA, 14 nt, Human
uguucugggacaca

SEQ ID NO: 1952225 - RNA, 15 nt, Human
uguucugggacacag

SEQ ID NO: 1952226 - RNA, 12 nt, Human
uguucugggaca

SEQ ID NO: 1952227 - RNA, 13 nt, Human
uguucugggacac

SEQ ID NO: 1952228 - RNA, 18 nt, Human
aguguaccauuaaaauau

SEQ ID NO: 1952229 - RNA, 19 nt, Human
aguguaccauuaaaauaug

SEQ ID NO: 1952230 - RNA, 21 nt, Human
aguguaccauuaaaauaugca

SEQ ID NO: 1952231 - RNA, 20 nt, Human
aguguagauuccauuuacug

SEQ ID NO: 1952232 - RNA, 23 nt, Human
aguguacauggaauaacauguaa

SEQ ID NO: 1952233 - RNA, 12 nt, Human
aguguaccauua

SEQ ID NO: 1952234 - RNA, 13 nt, Human
uguuaugagccag

SEQ ID NO: 1952235 - RNA, 15 nt, Human
uguuauguauauggu

SEQ ID NO: 1952236 - RNA, 19 nt, Human
uguuauuuuaaucucagaa

SEQ ID NO: 1952237 - RNA, 21 nt, Human
uguucaaaggagcaagaacuu

SEQ ID NO: 1952238 - RNA, 16 nt, Human
uguucccauucuugca

SEQ ID NO: 1952239 - RNA, 20 nt, Human
uguuauuuuuauaagaaaac

SEQ ID NO: 1952240 - RNA, 16 nt, Human
aguuacuaccuccucu

SEQ ID NO: 1952241 - RNA, 21 nt, Human
aguuacuaccuccucuccuga

SEQ ID NO: 1952242 - RNA, 15 nt, Human
aguuaguuccacuga

SEQ ID NO: 1952243 - RNA, 17 nt, Human
aguuaguuccacugaga

SEQ ID NO: 1952244 - RNA, 19 nt, Human
aguuaguuccacugagacc

SEQ ID NO: 1952245 - RNA, 13 nt, Human
aguuaguguagau

SEQ ID NO: 1952246 - RNA, 16 nt, Human
aguuaggcuuucucuu

SEQ ID NO: 1952247 - RNA, 18 nt, Human
aguuacccaaauuaagag

SEQ ID NO: 1952248 - RNA, 17 nt, Human
aguuacccaaauuaaga

SEQ ID NO: 1952249 - RNA, 15 nt, Human
aguuaccagugccuu

SEQ ID NO: 1952250 - RNA, 16 nt, Human
aguuaccagugccuua

SEQ ID NO: 1952251 - RNA, 12 nt, Human
aguguuuaaaug

SEQ ID NO: 1952252 - RNA, 18 nt, Human
uguucuuuccaaaguaca

SEQ ID NO: 1952253 - RNA, 20 nt, Human
uguucuuuccaaaguacacu

SEQ ID NO: 1952254 - RNA, 15 nt, Human
aguuauagaaagcaa

SEQ ID NO: 1952255 - RNA, 20 nt, Human
aguuauuauauuuacaaaug

SEQ ID NO: 1952256 - RNA, 13 nt, Human
aguuauguaaaua

SEQ ID NO: 1952257 - RNA, 14 nt, Human
aguuauguaaauaa

SEQ ID NO: 1952258 - RNA, 17 nt, Human
aguuauguaaauaauuc

SEQ ID NO: 1952259 - RNA, 18 nt, Human
aguuauguaaauaauucu

SEQ ID NO: 1952260 - RNA, 20 nt, Human
aguuauguaaauaauucuuu

SEQ ID NO: 1952261 - RNA, 12 nt, Human
aguuauguguau

SEQ ID NO: 1952262 - RNA, 14 nt, Human
aguuauguguaugu

SEQ ID NO: 1952263 - RNA, 19 nt, Human
aguuauguguaugugagua

SEQ ID NO: 1952264 - RNA, 22 nt, Human
aguuauuaauuuuuaaggaugu

SEQ ID NO: 1952265 - RNA, 22 nt, Human
aguuauguguaugugaguauuc

SEQ ID NO: 1952266 - RNA, 13 nt, Human
aguuauuaaaauu

SEQ ID NO: 1952267 - RNA, 14 nt, Human
aguuauuaaaauug

SEQ ID NO: 1952268 - RNA, 15 nt, Human
aguuauuaaaauugu

SEQ ID NO: 1952269 - RNA, 16 nt, Human
aguuauuaaaauuguu

SEQ ID NO: 1952270 - RNA, 17 nt, Human
aguuauuaaaauuguug

SEQ ID NO: 1952271 - RNA, 18 nt, Human
aguuauuaaaauuguugu

SEQ ID NO: 1952272 - RNA, 14 nt, Human
aguuccugucccug

SEQ ID NO: 1952273 - RNA, 15 nt, Human
aguucaagaaaugaa

SEQ ID NO: 1952274 - RNA, 17 nt, Human
aguuccuagccaccgcc

SEQ ID NO: 1952275 - RNA, 17 nt, Human
aguuccuagagaacugu

SEQ ID NO: 1952276 - RNA, 17 nt, Human
aguucccuacuuccugu

SEQ ID NO: 1952277 - RNA, 21 nt, Human
aguuauuuuuauuuauuuaaa

SEQ ID NO: 1952278 - RNA, 15 nt, Human
aguucaaagucauga

SEQ ID NO: 1952279 - RNA, 20 nt, Human
aguucaaagucaugauguuu

SEQ ID NO: 1952280 - RNA, 19 nt, Human
aguuauuucccuuuagcug

SEQ ID NO: 1952281 - RNA, 22 nt, Human
aguuauugucccuggcuuccuu

SEQ ID NO: 1952282 - RNA, 23 nt, Human
aguuauugucccuggcuuccuua

SEQ ID NO: 1952283 - RNA, 14 nt, Human
aguucaagaaauga

SEQ ID NO: 1952284 - RNA, 13 nt, Human
aguucaagaaaug

SEQ ID NO: 1952285 - RNA, 22 nt, Human
aguucaaagucaugauguuuuu

SEQ ID NO: 1952286 - RNA, 16 nt, Human
uguugggccaggagcc

SEQ ID NO: 1952287 - RNA, 18 nt, Human
uguugggagugaggaugu

SEQ ID NO: 1952288 - RNA, 13 nt, Human
uguugggccagga

SEQ ID NO: 1952289 - RNA, 20 nt, Human
uguugucaagaauagcauug

SEQ ID NO: 1952290 - RNA, 11 nt, Human
uguugucaaga

SEQ ID NO: 1952291 - RNA, 16 nt, Human
uguugucaagaauagc

SEQ ID NO: 1952292 - RNA, 13 nt, Human
uguugucagcuga

SEQ ID NO: 1952293 - RNA, 14 nt, Human
uguuguauucauug

SEQ ID NO: 1952294 - RNA, 14 nt, Human
uguuguauaaauuu

SEQ ID NO: 1952295 - RNA, 11 nt, Human
uguuguauaaa

SEQ ID NO: 1952296 - RNA, 13 nt, Human
uguuguauaaauu

SEQ ID NO: 1952297 - RNA, 13 nt, Human
uguuguaaaaugu

SEQ ID NO: 1952298 - RNA, 22 nt, Human
auacuagauuugggagaagggc

SEQ ID NO: 1952299 - RNA, 15 nt, Human
auacuagauuuggga

SEQ ID NO: 1952300 - RNA, 13 nt, Human
auacuacaguuug

SEQ ID NO: 1952301 - RNA, 15 nt, Human
auacuacaguuuguu

SEQ ID NO: 1952302 - RNA, 16 nt, Human
auacuacaguuuguua

SEQ ID NO: 1952303 - RNA, 20 nt, Human
auacuacaguuuguuaguau

SEQ ID NO: 1952304 - RNA, 21 nt, Human
auacuaaccagcagaaaugcc

SEQ ID NO: 1952305 - RNA, 19 nt, Human
auaccagccaguaaauggg

SEQ ID NO: 1952306 - RNA, 22 nt, Human
uuaucaugugaaaucauucauu

SEQ ID NO: 1952307 - RNA, 20 nt, Human
uuaucaugugaaaucauuca

SEQ ID NO: 1952308 - RNA, 18 nt, Human
uuaucaugugaaaucauu

SEQ ID NO: 1952309 - RNA, 17 nt, Human
uuaucaugugaaaucau

SEQ ID NO: 1952310 - RNA, 14 nt, Human
uuaucaacauuugu

SEQ ID NO: 1952311 - RNA, 17 nt, Human
auaccaagcauguggau

SEQ ID NO: 1952312 - RNA, 16 nt, Human
auacauuugauaaagu

SEQ ID NO: 1952313 - RNA, 16 nt, Human
auacauuuaaaacauu

SEQ ID NO: 1952314 - RNA, 21 nt, Human
auacauuuaaaacauuaaaau

SEQ ID NO: 1952315 - RNA, 21 nt, Human
auacauucuuuuugcucuaaa

SEQ ID NO: 1952316 - RNA, 16 nt, Human
auacauucuuuuugcu

SEQ ID NO: 1952317 - RNA, 12 nt, Human
auacauucuuuu

SEQ ID NO: 1952318 - RNA, 20 nt, Human
auacagucucugagaacugg

SEQ ID NO: 1952319 - RNA, 23 nt, Human
auacagcaaaccuaauugcacaa

SEQ ID NO: 1952320 - RNA, 17 nt, Human
auacaacaccaaaaaau

SEQ ID NO: 1952321 - RNA, 21 nt, Human
auacaaaugcaucuuugaugu

SEQ ID NO: 1952322 - RNA, 22 nt, Human
auacaaaugcaucuuugaugug

SEQ ID NO: 1952323 - RNA, 17 nt, Human
auacaaaugcaucuuug

SEQ ID NO: 1952324 - RNA, 18 nt, Human
auacaaaugcaucuuuga

SEQ ID NO: 1952325 - RNA, 19 nt, Human
auacaaaugcaucuuugau

SEQ ID NO: 1952326 - RNA, 20 nt, Human
auacaaaugcaucuuugaug

SEQ ID NO: 1952327 - RNA, 15 nt, Human
auacaaaugcaucuu

SEQ ID NO: 1952328 - RNA, 16 nt, Human
auacaaacaagcauau

SEQ ID NO: 1952329 - RNA, 14 nt, Human
auacaggaaaagcu

SEQ ID NO: 1952330 - RNA, 19 nt, Human
auacaggaaaagcugcuga

SEQ ID NO: 1952331 - RNA, 20 nt, Human
auacaggaaaagcugcugac

SEQ ID NO: 1952332 - RNA, 22 nt, Human
auacaggaaaagcugcugacag

SEQ ID NO: 1952333 - RNA, 21 nt, Human
auacaguucggugagcuacaa

SEQ ID NO: 1952334 - RNA, 13 nt, Human
uuauagugcaaua

SEQ ID NO: 1952335 - RNA, 14 nt, Human
uuauagugcaauau

SEQ ID NO: 1952336 - RNA, 15 nt, Human
uuauagugcaauaua

SEQ ID NO: 1952337 - RNA, 17 nt, Human
uuauagugcaauauauu

SEQ ID NO: 1952338 - RNA, 19 nt, Human
uuauagugcaauauauuuu

SEQ ID NO: 1952339 - RNA, 22 nt, Human
uuauagugcaauauauuuugua

SEQ ID NO: 1952340 - RNA, 13 nt, Human
uuauaguuaaucu

SEQ ID NO: 1952341 - RNA, 16 nt, Human
uuauaguacugacaga

SEQ ID NO: 1952342 - RNA, 18 nt, Human
uuauaguacugacagaua

SEQ ID NO: 1952343 - RNA, 18 nt, Human
uuauagguccuuuagaaa

SEQ ID NO: 1952344 - RNA, 14 nt, Human
uuauaccuguugcu

SEQ ID NO: 1952345 - RNA, 12 nt, Human
uuauaccuguuu

SEQ ID NO: 1952346 - RNA, 14 nt, Human
uuauaccuguuuaa

SEQ ID NO: 1952347 - RNA, 15 nt, Human
uuauaccuguuuaaa

SEQ ID NO: 1952348 - RNA, 15 nt, Human
uuauagagcagaaau

SEQ ID NO: 1952349 - RNA, 17 nt, Human
uuauagagcagaaauuc

SEQ ID NO: 1952350 - RNA, 22 nt, Human
uuauagagcagaaauucuguuu

SEQ ID NO: 1952351 - RNA, 23 nt, Human
uuauagagcagaaauucuguuuu

SEQ ID NO: 1952352 - RNA, 12 nt, Human
uuauagaagaau

SEQ ID NO: 1952353 - RNA, 15 nt, Human
uuauagaagaaugca

SEQ ID NO: 1952354 - RNA, 22 nt, Human
uuauagaagaaugcaugcuuuc

SEQ ID NO: 1952355 - RNA, 17 nt, Human
uuauagaagaaugcaug

SEQ ID NO: 1952356 - RNA, 19 nt, Human
uuauagaagaaugcaugcu

SEQ ID NO: 1952357 - RNA, 14 nt, Human
uuagccggagaucc

SEQ ID NO: 1952358 - RNA, 15 nt, Human
uuagccuaagauaua

SEQ ID NO: 1952359 - RNA, 16 nt, Human
uuagccuaagauauac

SEQ ID NO: 1952360 - RNA, 19 nt, Human
uuagccuaagauauacuug

SEQ ID NO: 1952361 - RNA, 16 nt, Human
uuagcaguuugcuuug

SEQ ID NO: 1952362 - RNA, 14 nt, Human
uuagccccauaauu

SEQ ID NO: 1952363 - RNA, 18 nt, Human
uuauacccccugcaaagc

SEQ ID NO: 1952364 - RNA, 21 nt, Human
uuauaaauuggugaugcuugu

SEQ ID NO: 1952365 - RNA, 22 nt, Human
auacaaaaaaaaaaaaaaauua

SEQ ID NO: 1952366 - RNA, 12 nt, Human
auacaaaagcau

SEQ ID NO: 1952367 - RNA, 13 nt, Human
auacaaaagcaug

SEQ ID NO: 1952368 - RNA, 15 nt, Human
auacaaaagcaugug

SEQ ID NO: 1952369 - RNA, 12 nt, Human
auaauuuuguaa

SEQ ID NO: 1952370 - RNA, 13 nt, Human
auaauuuuguaau

SEQ ID NO: 1952371 - RNA, 23 nt, Human
auaauuuuguaauguaucaaaua

SEQ ID NO: 1952372 - RNA, 13 nt, Human
auaauuuugauag

SEQ ID NO: 1952373 - RNA, 16 nt, Human
uuauauacuuguuguu

SEQ ID NO: 1952374 - RNA, 18 nt, Human
uuauauacuuguuguuua

SEQ ID NO: 1952375 - RNA, 22 nt, Human
uuauauacuuguuguuuaaugu

SEQ ID NO: 1952376 - RNA, 19 nt, Human
uuauauauauauauauuuc

SEQ ID NO: 1952377 - RNA, 22 nt, Human
uuauauauauuuuuuucugaaa

SEQ ID NO: 1952378 - RNA, 14 nt, Human
uuauauauauaucu

SEQ ID NO: 1952379 - RNA, 13 nt, Human
uuauauaucccug

SEQ ID NO: 1952380 - RNA, 18 nt, Human
uuauauaucccugauaaa

SEQ ID NO: 1952381 - RNA, 19 nt, Human
uuauauaucccugauaaau

SEQ ID NO: 1952382 - RNA, 12 nt, Human
auaauuuuacaa

SEQ ID NO: 1952383 - RNA, 12 nt, Human
auaauuuuccuu

SEQ ID NO: 1952384 - RNA, 13 nt, Human
auaauuuuccuuu

SEQ ID NO: 1952385 - RNA, 19 nt, Human
auaauuuuccuuuaauaug

SEQ ID NO: 1952386 - RNA, 22 nt, Human
auaauuuuccuuuaauaugaaa

SEQ ID NO: 1952387 - RNA, 14 nt, Human
uuauaguuaaucua

SEQ ID NO: 1952388 - RNA, 17 nt, Human
uuauaguuaaucuauaa

SEQ ID NO: 1952389 - RNA, 16 nt, Human
auaaaccgaacugaug

SEQ ID NO: 1952390 - RNA, 19 nt, Human
auaaacaucagguuaggca

SEQ ID NO: 1952391 - RNA, 22 nt, Human
auaaacaucagguuaggcagua

SEQ ID NO: 1952392 - RNA, 18 nt, Human
auaaacacucuugaaaaa

SEQ ID NO: 1952393 - RNA, 12 nt, Human
auaaacacuguu

SEQ ID NO: 1952394 - RNA, 20 nt, Human
auaaacauacgugugcaugu

SEQ ID NO: 1952395 - RNA, 22 nt, Human
auaaacauacgugugcaugugu

SEQ ID NO: 1952396 - RNA, 23 nt, Human
auaaacacucuugaaaaaugcau

SEQ ID NO: 1952397 - RNA, 16 nt, Human
aguuuucccugaaguu

SEQ ID NO: 1952398 - RNA, 13 nt, Human
auaaacuuuaccu

SEQ ID NO: 1952399 - RNA, 15 nt, Human
auaaacuuuaccuuu

SEQ ID NO: 1952400 - RNA, 16 nt, Human
auaaaguaguaaaaga

SEQ ID NO: 1952401 - RNA, 18 nt, Human
auaaacuggcagcucagc

SEQ ID NO: 1952402 - RNA, 17 nt, Human
auaaacucauuuugcuu

SEQ ID NO: 1952403 - RNA, 13 nt, Human
auaaacucuuuua

SEQ ID NO: 1952404 - RNA, 15 nt, Human
auaaacgucuuaaau

SEQ ID NO: 1952405 - RNA, 16 nt, Human
auaaacgucuuaaaua

SEQ ID NO: 1952406 - RNA, 18 nt, Human
auaaacgucuuaaauauu

SEQ ID NO: 1952407 - RNA, 22 nt, Human
auaaacguggagaaucacaggc

SEQ ID NO: 1952408 - RNA, 17 nt, Human
auaaacuagauuacauu

SEQ ID NO: 1952409 - RNA, 19 nt, Human
auaaacuagauuacauuca

SEQ ID NO: 1952410 - RNA, 18 nt, Human
auaacuguaauuauuuga

SEQ ID NO: 1952411 - RNA, 17 nt, Human
auaacuguaauuauuug

SEQ ID NO: 1952412 - RNA, 19 nt, Human
auaacuguaauuauuugaa

SEQ ID NO: 1952413 - RNA, 22 nt, Human
auaacuguaauuauuugaauga

SEQ ID NO: 1952414 - RNA, 16 nt, Human
uuacaggaaguacugg

SEQ ID NO: 1952415 - RNA, 15 nt, Human
uuacaggaaguacug

SEQ ID NO: 1952416 - RNA, 22 nt, Human
uuacaggaaguacuggagaaaa

SEQ ID NO: 1952417 - RNA, 18 nt, Human
uuacaggaaguacuggag

SEQ ID NO: 1952418 - RNA, 16 nt, Human
uuacccacacacagau

SEQ ID NO: 1952419 - RNA, 18 nt, Human
uuaccauuggaaauuuca

SEQ ID NO: 1952420 - RNA, 15 nt, Human
uuaccauuggaaauu

SEQ ID NO: 1952421 - RNA, 16 nt, Human
uuaccauuggaaauuu

SEQ ID NO: 1952422 - RNA, 20 nt, Human
uuaccgacaagcacagucag

SEQ ID NO: 1952423 - RNA, 23 nt, Human
uuaccauuuugggguacccacug

SEQ ID NO: 1952424 - RNA, 13 nt, Human
uuaccauuggaaa

SEQ ID NO: 1952425 - RNA, 22 nt, Human
uuacaugcagccacuuaggaca

SEQ ID NO: 1952426 - RNA, 20 nt, Human
auaaccaguguuguggauuu

SEQ ID NO: 1952427 - RNA, 14 nt, Human
auaaccagacacaa

SEQ ID NO: 1952428 - RNA, 16 nt, Human
auaaccagacacaaac

SEQ ID NO: 1952429 - RNA, 14 nt, Human
auaaauuauauucc

SEQ ID NO: 1952430 - RNA, 13 nt, Human
auaaauuauggua

SEQ ID NO: 1952431 - RNA, 21 nt, Human
auaaauuaugguaaaauuuug

SEQ ID NO: 1952432 - RNA, 19 nt, Human
auaacaugugaaaagaaua

SEQ ID NO: 1952433 - RNA, 19 nt, Human
auaaauaaaguuuguugaa

SEQ ID NO: 1952434 - RNA, 13 nt, Human
auaaauaaaguuu

SEQ ID NO: 1952435 - RNA, 22 nt, Human
auaauugacaggcgaaagaaaa

SEQ ID NO: 1952436 - RNA, 17 nt, Human
auaauucugaaguuaua

SEQ ID NO: 1952437 - RNA, 18 nt, Human
auaauucugaaguuauau

SEQ ID NO: 1952438 - RNA, 19 nt, Human
auaauucugaaguuauauu

SEQ ID NO: 1952439 - RNA, 20 nt, Human
auaauucugaaguuauauuu

SEQ ID NO: 1952440 - RNA, 22 nt, Human
auaauucugaaguuauauuucc

SEQ ID NO: 1952441 - RNA, 21 nt, Human
uuagcacuucagggcagauuu

SEQ ID NO: 1952442 - RNA, 21 nt, Human
uuagcagcugacuuucaaagu

SEQ ID NO: 1952443 - RNA, 21 nt, Human
uuagauuugccauagaguaca

SEQ ID NO: 1952444 - RNA, 23 nt, Human
uuagauuugccauagaguacacu

SEQ ID NO: 1952445 - RNA, 16 nt, Human
uuagauuuuguguuua

SEQ ID NO: 1952446 - RNA, 16 nt, Human
uuagaugcauauuacu

SEQ ID NO: 1952447 - RNA, 19 nt, Human
uuagaugcauauuacugua

SEQ ID NO: 1952448 - RNA, 15 nt, Human
uuagaugugagaaaa

SEQ ID NO: 1952449 - RNA, 16 nt, Human
uuagauguaauuuugu

SEQ ID NO: 1952450 - RNA, 16 nt, Human
uuagauuugccauaga

SEQ ID NO: 1952451 - RNA, 19 nt, Human
auaauacaguaucucaggg

SEQ ID NO: 1952452 - RNA, 14 nt, Human
auaauaaucucagu

SEQ ID NO: 1952453 - RNA, 15 nt, Human
auaaucaccagggcc

SEQ ID NO: 1952454 - RNA, 14 nt, Human
auaauucuacuuug

SEQ ID NO: 1952455 - RNA, 14 nt, Human
auaaugaauacuuu

SEQ ID NO: 1952456 - RNA, 12 nt, Human
auaaugaagccc

SEQ ID NO: 1952457 - RNA, 17 nt, Human
auaaguuaacuuccaau

SEQ ID NO: 1952458 - RNA, 12 nt, Human
auaagcaacaau

SEQ ID NO: 1952459 - RNA, 13 nt, Human
auaagcaacaauu

SEQ ID NO: 1952460 - RNA, 17 nt, Human
auaagcaacaauuuuca

SEQ ID NO: 1952461 - RNA, 18 nt, Human
auaagcaacaauuuucag

SEQ ID NO: 1952462 - RNA, 19 nt, Human
auaagcaacaauuuucaga

SEQ ID NO: 1952463 - RNA, 20 nt, Human
auaagcaacaauuuucagau

SEQ ID NO: 1952464 - RNA, 22 nt, Human
auaagcaacaauuuucagauuu

SEQ ID NO: 1952465 - RNA, 23 nt, Human
auaagaaccuuuugagugccuua

SEQ ID NO: 1952466 - RNA, 13 nt, Human
uuaccucuuugga

SEQ ID NO: 1952467 - RNA, 15 nt, Human
uuaccucuuuggaaa

SEQ ID NO: 1952468 - RNA, 16 nt, Human
uuaccucuuuggaaaa

SEQ ID NO: 1952469 - RNA, 22 nt, Human
auaagaaccuuuugagugccuu

SEQ ID NO: 1952470 - RNA, 21 nt, Human
uuaccugaagggguuuucuug

SEQ ID NO: 1952471 - RNA, 22 nt, Human
uuaccugaagggguuuucuuga

SEQ ID NO: 1952472 - RNA, 18 nt, Human
uuaccugaguugaagagg

SEQ ID NO: 1952473 - RNA, 22 nt, Human
auaaguuaacuuccaauuuaca

SEQ ID NO: 1952474 - RNA, 13 nt, Human
auaaguuggaaac

SEQ ID NO: 1952475 - RNA, 16 nt, Human
auaaguuggaaacacu

SEQ ID NO: 1952476 - RNA, 17 nt, Human
auaaguuggaaacacua

SEQ ID NO: 1952477 - RNA, 18 nt, Human
auaaguuggaaacacuaa

SEQ ID NO: 1952478 - RNA, 19 nt, Human
auaaguuggaaacacuaaa

SEQ ID NO: 1952479 - RNA, 21 nt, Human
auaaguuggaaacacuaaaug

SEQ ID NO: 1952480 - RNA, 22 nt, Human
auaaguuggaaacacuaaaugu

SEQ ID NO: 1952481 - RNA, 23 nt, Human
auaauacaccacuacauucuguu

SEQ ID NO: 1952482 - RNA, 21 nt, Human
auaauacaccacuacauucug

SEQ ID NO: 1952483 - RNA, 23 nt, Human
auaaguuggaaacacuaaauguu

SEQ ID NO: 1952484 - RNA, 17 nt, Human
auaauaaaaaauuucag

SEQ ID NO: 1952485 - RNA, 13 nt, Human
ugggucugugugu

SEQ ID NO: 1952486 - RNA, 15 nt, Human
ugggucugugugugu

SEQ ID NO: 1952487 - RNA, 21 nt, Human
agggugaguccuccagaacuc

SEQ ID NO: 1952488 - RNA, 12 nt, Human
agggugagccca

SEQ ID NO: 1952489 - RNA, 18 nt, Human
agggugaguccuccagaa

SEQ ID NO: 1952490 - RNA, 23 nt, Human
uggguggaugccugguggcagcu

SEQ ID NO: 1952491 - RNA, 16 nt, Human
uggguuuuguucuugu

SEQ ID NO: 1952492 - RNA, 15 nt, Human
ugguaaaaugaagaa

SEQ ID NO: 1952493 - RNA, 18 nt, Human
ugguaaaaugaagaauuu

SEQ ID NO: 1952494 - RNA, 14 nt, Human
uggguggaugccug

SEQ ID NO: 1952495 - RNA, 22 nt, Human
ugggucuuguuuuuuuuuucca

SEQ ID NO: 1952496 - RNA, 21 nt, Human
uggucaccaaaucagcugcua

SEQ ID NO: 1952497 - RNA, 23 nt, Human
uggucaccaaaucagcugcuacu

SEQ ID NO: 1952498 - RNA, 19 nt, Human
ugguaaaaugaagaauuua

SEQ ID NO: 1952499 - RNA, 22 nt, Human
ugguaauuuaagauuccagaga

SEQ ID NO: 1952500 - RNA, 16 nt, Human
ugguccauagagagca

SEQ ID NO: 1952501 - RNA, 15 nt, Human
ugguccauagagagc

SEQ ID NO: 1952502 - RNA, 14 nt, Human
ugguccacuuuucc

SEQ ID NO: 1952503 - RNA, 15 nt, Human
ugguccacuuuucca

SEQ ID NO: 1952504 - RNA, 16 nt, Human
ugguccacuuuuccag

SEQ ID NO: 1952505 - RNA, 19 nt, Human
aggguacuaaggaaucuuu

SEQ ID NO: 1952506 - RNA, 12 nt, Human
aggguacaugug

SEQ ID NO: 1952507 - RNA, 22 nt, Human
aggguaauaaccagacacaaac

SEQ ID NO: 1952508 - RNA, 21 nt, Human
aggguacaaaaaauucaguga

SEQ ID NO: 1952509 - RNA, 22 nt, Human
agggucuugguuccagccugcc

SEQ ID NO: 1952510 - RNA, 21 nt, Human
agggucuugguuccagccugc

SEQ ID NO: 1952511 - RNA, 18 nt, Human
aggguaucaggugcugcc

SEQ ID NO: 1952512 - RNA, 16 nt, Human
aggguaucaggugcug

SEQ ID NO: 1952513 - RNA, 12 nt, Human
aggguagggugg

SEQ ID NO: 1952514 - RNA, 18 nt, Human
aggguaggcagccugaga

SEQ ID NO: 1952515 - RNA, 12 nt, Human
agggggcuuccu

SEQ ID NO: 1952516 - RNA, 20 nt, Human
agggguccccuccaggagua

SEQ ID NO: 1952517 - RNA, 12 nt, Human
aggguaaguauu

SEQ ID NO: 1952518 - RNA, 22 nt, Human
aggggucuugcaaaauuccuga

SEQ ID NO: 1952519 - RNA, 13 nt, Human
agggggcugggac

SEQ ID NO: 1952520 - RNA, 21 nt, Human
aggggcuuaauuauugauguu

SEQ ID NO: 1952521 - RNA, 20 nt, Human
aggggaggccaucuggagag

SEQ ID NO: 1952522 - RNA, 15 nt, Human
aggggaggccaucug

SEQ ID NO: 1952523 - RNA, 16 nt, Human
aggggaggccaucugg

SEQ ID NO: 1952524 - RNA, 17 nt, Human
aggggagggggcaaagg

SEQ ID NO: 1952525 - RNA, 16 nt, Human
aggggauagagagaga

SEQ ID NO: 1952526 - RNA, 12 nt, Human
aggggaggccaa

SEQ ID NO: 1952527 - RNA, 23 nt, Human
ugggaauaagugccaggauggaa

SEQ ID NO: 1952528 - RNA, 20 nt, Human
ugggaauauaauauugucuc

SEQ ID NO: 1952529 - RNA, 15 nt, Human
agguagagucugagg

SEQ ID NO: 1952530 - RNA, 17 nt, Human
agguagcccccucuucc

SEQ ID NO: 1952531 - RNA, 18 nt, Human
agguagcccccucuuccc

SEQ ID NO: 1952532 - RNA, 17 nt, Human
aggguuucagagagccu

SEQ ID NO: 1952533 - RNA, 17 nt, Human
aggguuggcaccuuccc

SEQ ID NO: 1952534 - RNA, 20 nt, Human
aggguuggcaccuucccccu

SEQ ID NO: 1952535 - RNA, 17 nt, Human
aggguugggcugguguc

SEQ ID NO: 1952536 - RNA, 20 nt, Human
aggguuuauguuuaggaugu

SEQ ID NO: 1952537 - RNA, 23 nt, Human
agguagcuuugagguggaagagg

SEQ ID NO: 1952538 - RNA, 20 nt, Human
agguaggaauauuauauuug

SEQ ID NO: 1952539 - RNA, 23 nt, Human
agguagcugcagauaaguggccu

SEQ ID NO: 1952540 - RNA, 22 nt, Human
agguauaucauucuaaagauag

SEQ ID NO: 1952541 - RNA, 20 nt, Human
agguauaucauucuaaagau

SEQ ID NO: 1952542 - RNA, 21 nt, Human
agguauaucauucuaaagaua

SEQ ID NO: 1952543 - RNA, 15 nt, Human
agguauaucauucua

SEQ ID NO: 1952544 - RNA, 18 nt, Human
agguauaucauucuaaag

SEQ ID NO: 1952545 - RNA, 19 nt, Human
agguauaucauucuaaaga

SEQ ID NO: 1952546 - RNA, 17 nt, Human
agguaugcaaucaaauc

SEQ ID NO: 1952547 - RNA, 22 nt, Human
aggucuugaacuccuggccuca

SEQ ID NO: 1952548 - RNA, 19 nt, Human
aggugaaacuccagaugcc

SEQ ID NO: 1952549 - RNA, 20 nt, Human
aggugaaacuccagaugcca

SEQ ID NO: 1952550 - RNA, 21 nt, Human
aggugaaacuccagaugccac

SEQ ID NO: 1952551 - RNA, 22 nt, Human
aggugaaacuccagaugccaca

SEQ ID NO: 1952552 - RNA, 20 nt, Human
aggucuugaacuccuggccu

SEQ ID NO: 1952553 - RNA, 21 nt, Human
aggucuugaacuccuggccuc

SEQ ID NO: 1952554 - RNA, 17 nt, Human
agguccacaacacacag

SEQ ID NO: 1952555 - RNA, 22 nt, Human
aggucauuuuuuuuaagaaaaa

SEQ ID NO: 1952556 - RNA, 23 nt, Human
aggucauuuuuuuuaagaaaaag

SEQ ID NO: 1952557 - RNA, 21 nt, Human
aggucaaggcugcagugagcc

SEQ ID NO: 1952558 - RNA, 15 nt, Human
aggucagugcaaaua

SEQ ID NO: 1952559 - RNA, 13 nt, Human
aggguuggccccu

SEQ ID NO: 1952560 - RNA, 14 nt, Human
aggguuggccccug

SEQ ID NO: 1952561 - RNA, 13 nt, Human
aggguugggcugg

SEQ ID NO: 1952562 - RNA, 15 nt, Human
aggguugggcuggug

SEQ ID NO: 1952563 - RNA, 17 nt, Human
aggguggugaccucugc

SEQ ID NO: 1952564 - RNA, 18 nt, Human
aggguggugaccucugcc

SEQ ID NO: 1952565 - RNA, 19 nt, Human
aggguggugaccucugccu

SEQ ID NO: 1952566 - RNA, 21 nt, Human
aggguggugaccucugccuga

SEQ ID NO: 1952567 - RNA, 19 nt, Human
uggugaacagaacaaaagg

SEQ ID NO: 1952568 - RNA, 14 nt, Human
uggucuuuugguua

SEQ ID NO: 1952569 - RNA, 17 nt, Human
uggucuuuuccucgcuu

SEQ ID NO: 1952570 - RNA, 19 nt, Human
uggucuuuuccucgcuucu

SEQ ID NO: 1952571 - RNA, 20 nt, Human
uggucuuuuccucgcuucuu

SEQ ID NO: 1952572 - RNA, 12 nt, Human
uggucuuuuccu

SEQ ID NO: 1952573 - RNA, 13 nt, Human
uggucuuauauuu

SEQ ID NO: 1952574 - RNA, 16 nt, Human
uggucugggacucucu

SEQ ID NO: 1952575 - RNA, 18 nt, Human
uggucugacccacugcuu

SEQ ID NO: 1952576 - RNA, 16 nt, Human
uggucuuauuuguaaa

SEQ ID NO: 1952577 - RNA, 22 nt, Human
uggucugugagaugcuagaacu

SEQ ID NO: 1952578 - RNA, 12 nt, Human
uggucuguguga

SEQ ID NO: 1952579 - RNA, 13 nt, Human
uggucccacccca

SEQ ID NO: 1952580 - RNA, 15 nt, Human
uggucucgaacuccu

SEQ ID NO: 1952581 - RNA, 19 nt, Human
uggucucgaacuccugacc

SEQ ID NO: 1952582 - RNA, 20 nt, Human
uggucucgaacuccugaccu

SEQ ID NO: 1952583 - RNA, 21 nt, Human
uggucucgaacuccugaccuu

SEQ ID NO: 1952584 - RNA, 19 nt, Human
ugguccauagagagcaaga

SEQ ID NO: 1952585 - RNA, 20 nt, Human
ugguccaucugguuuucucu

SEQ ID NO: 1952586 - RNA, 22 nt, Human
ugguccaugggccauaugaaaa

SEQ ID NO: 1952587 - RNA, 23 nt, Human
ugguggcagcucaccucucccuu

SEQ ID NO: 1952588 - RNA, 20 nt, Human
ugguggcagcucaccucucc

SEQ ID NO: 1952589 - RNA, 19 nt, Human
ugguggcagcucaccucuc

SEQ ID NO: 1952590 - RNA, 16 nt, Human
ugguggcagcucaccu

SEQ ID NO: 1952591 - RNA, 12 nt, Human
ugguggcagcuc

SEQ ID NO: 1952592 - RNA, 15 nt, Human
ugguggcagagugga

SEQ ID NO: 1952593 - RNA, 14 nt, Human
aggugaacauuggu

SEQ ID NO: 1952594 - RNA, 16 nt, Human
aggugaacaaucaacu

SEQ ID NO: 1952595 - RNA, 21 nt, Human
aggugaacauugguucuuuca

SEQ ID NO: 1952596 - RNA, 13 nt, Human
aggugaaggaggc

SEQ ID NO: 1952597 - RNA, 18 nt, Human
aggugaaggaggcuccag

SEQ ID NO: 1952598 - RNA, 19 nt, Human
aggugaaggaggcuccagg

SEQ ID NO: 1952599 - RNA, 21 nt, Human
aggugaaggaggcuccaggca

SEQ ID NO: 1952600 - RNA, 21 nt, Human
ugguguucaaaaaacuuguaa

SEQ ID NO: 1952601 - RNA, 22 nt, Human
ugguguucaaaaaacuuguaaa

SEQ ID NO: 1952602 - RNA, 15 nt, Human
ugguguguguaugcg

SEQ ID NO: 1952603 - RNA, 12 nt, Human
ugguggcagcug

SEQ ID NO: 1952604 - RNA, 20 nt, Human
ugguucacucuuggagccug

SEQ ID NO: 1952605 - RNA, 21 nt, Human
ugguucacucuuggagccugc

SEQ ID NO: 1952606 - RNA, 22 nt, Human
ugguucacucuuggagccugca

SEQ ID NO: 1952607 - RNA, 21 nt, Human
ugguucaaauguguuuugguc

SEQ ID NO: 1952608 - RNA, 20 nt, Human
ugguucaggguuggccccug

SEQ ID NO: 1952609 - RNA, 22 nt, Human
ugguucaggguuggccccugcc

SEQ ID NO: 1952610 - RNA, 23 nt, Human
ugguucaggguuggccccugccc

SEQ ID NO: 1952611 - RNA, 17 nt, Human
ugguucacucuuggagc

SEQ ID NO: 1952612 - RNA, 19 nt, Human
ugguguuuuggauuuggag

SEQ ID NO: 1952613 - RNA, 17 nt, Human
ugguguuuccuggcacu

SEQ ID NO: 1952614 - RNA, 15 nt, Human
ugguguuuccuggca

SEQ ID NO: 1952615 - RNA, 18 nt, Human
ugguguuuuggauuugga

SEQ ID NO: 1952616 - RNA, 13 nt, Human
ugguuucucuucu

SEQ ID NO: 1952617 - RNA, 14 nt, Human
ugguuucucuucuc

SEQ ID NO: 1952618 - RNA, 15 nt, Human
ugguuucucuucucc

SEQ ID NO: 1952619 - RNA, 19 nt, Human
ugguuucucuucuccccuu

SEQ ID NO: 1952620 - RNA, 22 nt, Human
ugguuuauuggugaguuaggaa

SEQ ID NO: 1952621 - RNA, 14 nt, Human
ugguuucagaaaug

SEQ ID NO: 1952622 - RNA, 15 nt, Human
ugguuucagaaaugu

SEQ ID NO: 1952623 - RNA, 21 nt, Human
ugguuuuaaaauacuguagau

SEQ ID NO: 1952624 - RNA, 12 nt, Human
ugguuuuaaaau

SEQ ID NO: 1952625 - RNA, 13 nt, Human
ugguuuuaaaaua

SEQ ID NO: 1952626 - RNA, 14 nt, Human
ugguuuuaaaauac

SEQ ID NO: 1952627 - RNA, 16 nt, Human
ugguuuuaaaauacug

SEQ ID NO: 1952628 - RNA, 21 nt, Human
ugguuuguaaauuaacuuuua

SEQ ID NO: 1952629 - RNA, 15 nt, Human
ugguuucuuuuugaa

SEQ ID NO: 1952630 - RNA, 23 nt, Human
ugguuugaaaauauuuucauuau

SEQ ID NO: 1952631 - RNA, 12 nt, Human
ugguuuucuguu

SEQ ID NO: 1952632 - RNA, 18 nt, Human
ugguuuuaguugcaacuu

SEQ ID NO: 1952633 - RNA, 12 nt, Human
ugguuuuaugau

SEQ ID NO: 1952634 - RNA, 15 nt, Human
ugguuuuaugaugac

SEQ ID NO: 1952635 - RNA, 21 nt, Human
aggugauccacccaccucagc

SEQ ID NO: 1952636 - RNA, 23 nt, Human
aggugauccacccaccucagccu

SEQ ID NO: 1952637 - RNA, 13 nt, Human
ugguuuucuguuc

SEQ ID NO: 1952638 - RNA, 15 nt, Human
ugguuuucuguucuu

SEQ ID NO: 1952639 - RNA, 15 nt, Human
uguaaagauuucugu

SEQ ID NO: 1952640 - RNA, 16 nt, Human
uguaaagauuucuguu

SEQ ID NO: 1952641 - RNA, 18 nt, Human
uguaaagauuucuguuca

SEQ ID NO: 1952642 - RNA, 19 nt, Human
uguaaagauuucuguucag

SEQ ID NO: 1952643 - RNA, 22 nt, Human
uguaagcucuacugaggugcua

SEQ ID NO: 1952644 - RNA, 15 nt, Human
uguaagaaauacaga

SEQ ID NO: 1952645 - RNA, 12 nt, Human
uguaagaaauac

SEQ ID NO: 1952646 - RNA, 17 nt, Human
uguaagaaauacagacu

SEQ ID NO: 1952647 - RNA, 18 nt, Human
uguaagaaauacuguaca

SEQ ID NO: 1952648 - RNA, 15 nt, Human
uguaaggaaugauua

SEQ ID NO: 1952649 - RNA, 14 nt, Human
uguaaggaaugauu

SEQ ID NO: 1952650 - RNA, 13 nt, Human
uguaaggaaugau

SEQ ID NO: 1952651 - RNA, 15 nt, Human
aggugugaggcagga

SEQ ID NO: 1952652 - RNA, 17 nt, Human
aggugugaggcaggaga

SEQ ID NO: 1952653 - RNA, 16 nt, Human
agguugucugaaguca

SEQ ID NO: 1952654 - RNA, 20 nt, Human
agguugucugaagucacugc

SEQ ID NO: 1952655 - RNA, 17 nt, Human
agguugucacugagaag

SEQ ID NO: 1952656 - RNA, 16 nt, Human
agguggggcagcuuga

SEQ ID NO: 1952657 - RNA, 15 nt, Human
aggugggugucugcg

SEQ ID NO: 1952658 - RNA, 23 nt, Human
agguggggucacucuggcagcuc

SEQ ID NO: 1952659 - RNA, 14 nt, Human
agguggggcagcuu

SEQ ID NO: 1952660 - RNA, 16 nt, Human
aggugauuaacuugga

SEQ ID NO: 1952661 - RNA, 22 nt, Human
aggugaucugcugcagagcagu

SEQ ID NO: 1952662 - RNA, 16 nt, Human
aggugaugaagacagc

SEQ ID NO: 1952663 - RNA, 22 nt, Human
aggugauccacucgccuucauc

SEQ ID NO: 1952664 - RNA, 13 nt, Human
agguggggcagcu

SEQ ID NO: 1952665 - RNA, 18 nt, Human
aggugugacugaauuucu

SEQ ID NO: 1952666 - RNA, 23 nt, Human
aggugugaaccaccacacccagc

SEQ ID NO: 1952667 - RNA, 22 nt, Human
aggugugaaccaccacacccag

SEQ ID NO: 1952668 - RNA, 20 nt, Human
aggugugacugaauuucuuu

SEQ ID NO: 1952669 - RNA, 20 nt, Human
aggugugagccaccacgccc

SEQ ID NO: 1952670 - RNA, 14 nt, Human
aggugugagucacc

SEQ ID NO: 1952671 - RNA, 20 nt, Human
aggugugagucaccaagccc

SEQ ID NO: 1952672 - RNA, 21 nt, Human
uguacauauuagcgacaacag

SEQ ID NO: 1952673 - RNA, 22 nt, Human
uguacauauuagcgacaacaga

SEQ ID NO: 1952674 - RNA, 23 nt, Human
uguacaaaguagaagucuuagau

SEQ ID NO: 1952675 - RNA, 19 nt, Human
uguacaaaguagaagucuu

SEQ ID NO: 1952676 - RNA, 14 nt, Human
uguacauauaagug

SEQ ID NO: 1952677 - RNA, 14 nt, Human
uguaaggcaugaag

SEQ ID NO: 1952678 - RNA, 15 nt, Human
uguaaggcaugaagg

SEQ ID NO: 1952679 - RNA, 17 nt, Human
uguaauuugugauacaa

SEQ ID NO: 1952680 - RNA, 21 nt, Human
uguaauuugugauacaaugcu

SEQ ID NO: 1952681 - RNA, 18 nt, Human
uguaaggaaugauuaauu

SEQ ID NO: 1952682 - RNA, 23 nt, Human
uguaagcuguuugguuuuaaaau

SEQ ID NO: 1952683 - RNA, 16 nt, Human
uguaauuugugauaca

SEQ ID NO: 1952684 - RNA, 15 nt, Human
uguaaggcaaucaug

SEQ ID NO: 1952685 - RNA, 21 nt, Human
uguagaagucacauuccugaa

SEQ ID NO: 1952686 - RNA, 15 nt, Human
uguacuugcucuuga

SEQ ID NO: 1952687 - RNA, 17 nt, Human
uguacaugaaaacacau

SEQ ID NO: 1952688 - RNA, 18 nt, Human
uguacaugaaaacacauu

SEQ ID NO: 1952689 - RNA, 19 nt, Human
uguacaugaaaacacauuu

SEQ ID NO: 1952690 - RNA, 20 nt, Human
uguacaugaaaacacauuuu

SEQ ID NO: 1952691 - RNA, 19 nt, Human
uguacauuucuaagucaaa

SEQ ID NO: 1952692 - RNA, 12 nt, Human
uguacauuucua

SEQ ID NO: 1952693 - RNA, 15 nt, Human
uguacauuucuaagu

SEQ ID NO: 1952694 - RNA, 13 nt, Human
agucuuaagaacu

SEQ ID NO: 1952695 - RNA, 12 nt, Human
agucucugugag

SEQ ID NO: 1952696 - RNA, 19 nt, Human
agucuuagaucauaguuuu

SEQ ID NO: 1952697 - RNA, 20 nt, Human
agucuuagaucauaguuuua

SEQ ID NO: 1952698 - RNA, 13 nt, Human
agucuuagaucau

SEQ ID NO: 1952699 - RNA, 18 nt, Human
agucuuagaucauaguuu

SEQ ID NO: 1952700 - RNA, 14 nt, Human
agucuucuauuuau

SEQ ID NO: 1952701 - RNA, 23 nt, Human
agugaaaaaggaggaagagaaaa

SEQ ID NO: 1952702 - RNA, 20 nt, Human
agugaaaaaggaggaagaga

SEQ ID NO: 1952703 - RNA, 17 nt, Human
agugaaaaaggaggaag

SEQ ID NO: 1952704 - RNA, 11 nt, Human
agugaaaaagg

SEQ ID NO: 1952705 - RNA, 19 nt, Human
agucuuuuaaaaaguauug

SEQ ID NO: 1952706 - RNA, 20 nt, Human
agucuuuuaaaaaguauugc

SEQ ID NO: 1952707 - RNA, 21 nt, Human
agucuuagaucauaguuuuau

SEQ ID NO: 1952708 - RNA, 13 nt, Human
agucuuuuaaaaa

SEQ ID NO: 1952709 - RNA, 18 nt, Human
agucuuuuaaaaaguauu

SEQ ID NO: 1952710 - RNA, 19 nt, Human
ugugagcacaaagguagcu

SEQ ID NO: 1952711 - RNA, 22 nt, Human
ugugagaugcuagaacucccuu

SEQ ID NO: 1952712 - RNA, 14 nt, Human
ugugaacugaacuc

SEQ ID NO: 1952713 - RNA, 23 nt, Human
ugugaacugaacucugacaacag

SEQ ID NO: 1952714 - RNA, 23 nt, Human
agucucccccacccuuguuccag

SEQ ID NO: 1952715 - RNA, 15 nt, Human
ugugagcagcaccca

SEQ ID NO: 1952716 - RNA, 19 nt, Human
agucuccaaagucucugga

SEQ ID NO: 1952717 - RNA, 14 nt, Human
agucucccucccuu

SEQ ID NO: 1952718 - RNA, 18 nt, Human
agucucccucccuugggg

SEQ ID NO: 1952719 - RNA, 22 nt, Human
agugagacucugucucaaaaaa

SEQ ID NO: 1952720 - RNA, 16 nt, Human
agugagacucugucuc

SEQ ID NO: 1952721 - RNA, 17 nt, Human
agugagacucugucuca

SEQ ID NO: 1952722 - RNA, 13 nt, Human
agugagacagacu

SEQ ID NO: 1952723 - RNA, 17 nt, Human
agugagacccugucuca

SEQ ID NO: 1952724 - RNA, 21 nt, Human
agugagacccugucucaaaaa

SEQ ID NO: 1952725 - RNA, 13 nt, Human
agugagacucugu

SEQ ID NO: 1952726 - RNA, 17 nt, Human
agucuuuuuuuuuuaag

SEQ ID NO: 1952727 - RNA, 18 nt, Human
agucuuuuuuuuuuaagu

SEQ ID NO: 1952728 - RNA, 20 nt, Human
agugaaaaauguuaggacau

SEQ ID NO: 1952729 - RNA, 15 nt, Human
agugaaaacuuugua

SEQ ID NO: 1952730 - RNA, 16 nt, Human
agugaaaacuuuguag

SEQ ID NO: 1952731 - RNA, 14 nt, Human
agugaaaauauagc

SEQ ID NO: 1952732 - RNA, 18 nt, Human
agugaaacaucauagaaa

SEQ ID NO: 1952733 - RNA, 14 nt, Human
agugagacagcucu

SEQ ID NO: 1952734 - RNA, 17 nt, Human
agugaaagaaaauaaca

SEQ ID NO: 1952735 - RNA, 19 nt, Human
ugugaugugacauuuguca

SEQ ID NO: 1952736 - RNA, 11 nt, Human
ugugauguguc

SEQ ID NO: 1952737 - RNA, 15 nt, Human
ugugaugugacauuu

SEQ ID NO: 1952738 - RNA, 16 nt, Human
ugugaugugacauuug

SEQ ID NO: 1952739 - RNA, 17 nt, Human
ugugaugugacauuugu

SEQ ID NO: 1952740 - RNA, 18 nt, Human
ugugaugugacauuuguc

SEQ ID NO: 1952741 - RNA, 18 nt, Human
ugugauggggcccugccu

SEQ ID NO: 1952742 - RNA, 17 nt, Human
ugugauggggcccugcc

SEQ ID NO: 1952743 - RNA, 14 nt, Human
agugagagcugggu

SEQ ID NO: 1952744 - RNA, 12 nt, Human
agugagagcaga

SEQ ID NO: 1952745 - RNA, 14 nt, Human
agugagagcagaug

SEQ ID NO: 1952746 - RNA, 16 nt, Human
ugugauggggcccugc

SEQ ID NO: 1952747 - RNA, 15 nt, Human
ugugauggggcccug

SEQ ID NO: 1952748 - RNA, 16 nt, Human
agugagccgagauugu

SEQ ID NO: 1952749 - RNA, 13 nt, Human
ugucucuucuccu

SEQ ID NO: 1952750 - RNA, 14 nt, Human
ugucucuucuccuu

SEQ ID NO: 1952751 - RNA, 12 nt, Human
ugucucuucugg

SEQ ID NO: 1952752 - RNA, 21 nt, Human
ugucucuugguccugcugcag

SEQ ID NO: 1952753 - RNA, 20 nt, Human
ugucucuugguccugcugca

SEQ ID NO: 1952754 - RNA, 19 nt, Human
ugucucuugguccugcugc

SEQ ID NO: 1952755 - RNA, 18 nt, Human
ugucucuugguccugcug

SEQ ID NO: 1952756 - RNA, 16 nt, Human
ugucucuuuuuuaagu

SEQ ID NO: 1952757 - RNA, 17 nt, Human
ugucucuuuuuuaaguu

SEQ ID NO: 1952758 - RNA, 22 nt, Human
ugucucuuuaaugucacaggca

SEQ ID NO: 1952759 - RNA, 22 nt, Human
ugucucuugguccugcugcagu

SEQ ID NO: 1952760 - RNA, 21 nt, Human
ugucucuuuaaugucacaggc

SEQ ID NO: 1952761 - RNA, 18 nt, Human
ugucuuaauuuucuuuca

SEQ ID NO: 1952762 - RNA, 14 nt, Human
ugucuuauugacag

SEQ ID NO: 1952763 - RNA, 17 nt, Human
ugucucuacuaaaaaua

SEQ ID NO: 1952764 - RNA, 19 nt, Human
ugucucggaaccugugagc

SEQ ID NO: 1952765 - RNA, 13 nt, Human
ugucucugagagu

SEQ ID NO: 1952766 - RNA, 22 nt, Human
ugucucuggauuauauuaugaa

SEQ ID NO: 1952767 - RNA, 21 nt, Human
ugucuccucuauccugggcuu

SEQ ID NO: 1952768 - RNA, 17 nt, Human
ugucuccucuucuuugu

SEQ ID NO: 1952769 - RNA, 17 nt, Human
ugucuccuacugaggau

SEQ ID NO: 1952770 - RNA, 16 nt, Human
agucccugccaaugga

SEQ ID NO: 1952771 - RNA, 14 nt, Human
agucccugccaaug

SEQ ID NO: 1952772 - RNA, 13 nt, Human
agucccugccaau

SEQ ID NO: 1952773 - RNA, 23 nt, Human
aguccccuguuuguuucugaaag

SEQ ID NO: 1952774 - RNA, 15 nt, Human
ugucuugcaauggca

SEQ ID NO: 1952775 - RNA, 11 nt, Human
ugucuucugcu

SEQ ID NO: 1952776 - RNA, 13 nt, Human
ugucuucugcuuu

SEQ ID NO: 1952777 - RNA, 14 nt, Human
ugucuucugcuuug

SEQ ID NO: 1952778 - RNA, 15 nt, Human
ugucuucugcuuugu

SEQ ID NO: 1952779 - RNA, 23 nt, Human
ugucuucugcuuuguugugugcc

SEQ ID NO: 1952780 - RNA, 17 nt, Human
ugucuugcaauggcagc

SEQ ID NO: 1952781 - RNA, 18 nt, Human
ugucuugcaauggcagcc

SEQ ID NO: 1952782 - RNA, 20 nt, Human
ugucuugcaauggcagccuu

SEQ ID NO: 1952783 - RNA, 21 nt, Human
ugucuugcaauggcagccuug

SEQ ID NO: 1952784 - RNA, 19 nt, Human
ugucuuauugacaguugug

SEQ ID NO: 1952785 - RNA, 22 nt, Human
ugucuuccuaucaaaaagauau

SEQ ID NO: 1952786 - RNA, 16 nt, Human
ugucuuccuauuucag

SEQ ID NO: 1952787 - RNA, 17 nt, Human
ugucuuccuauuucaga

SEQ ID NO: 1952788 - RNA, 19 nt, Human
ugucuuccuauuucagaag

SEQ ID NO: 1952789 - RNA, 20 nt, Human
ugucuuccuauuucagaagu

SEQ ID NO: 1952790 - RNA, 21 nt, Human
ugucuuuccacuccuccuagc

SEQ ID NO: 1952791 - RNA, 14 nt, Human
ugugaacuauguuu

SEQ ID NO: 1952792 - RNA, 16 nt, Human
ugugaaccaccacacc

SEQ ID NO: 1952793 - RNA, 17 nt, Human
ugugaaccaccacaccc

SEQ ID NO: 1952794 - RNA, 22 nt, Human
ugugaaccaccacacccagccc

SEQ ID NO: 1952795 - RNA, 23 nt, Human
ugugaaccaccacacccagccca

SEQ ID NO: 1952796 - RNA, 22 nt, Human
ugugaacaguuguguuugaagc

SEQ ID NO: 1952797 - RNA, 15 nt, Human
ugugaaccaccacac

SEQ ID NO: 1952798 - RNA, 14 nt, Human
ugucuugcugucau

SEQ ID NO: 1952799 - RNA, 13 nt, Human
aguagcugggacu

SEQ ID NO: 1952800 - RNA, 14 nt, Human
aguagcugggacua

SEQ ID NO: 1952801 - RNA, 14 nt, Human
aguagcucugccuu

SEQ ID NO: 1952802 - RNA, 22 nt, Human
aguagcucugccuuugcucugg

SEQ ID NO: 1952803 - RNA, 20 nt, Human
ugucaaccccaaguuaguuc

SEQ ID NO: 1952804 - RNA, 19 nt, Human
ugucaaauauuuagaugua

SEQ ID NO: 1952805 - RNA, 19 nt, Human
ugucaaaguggugagaggc

SEQ ID NO: 1952806 - RNA, 16 nt, Human
ugucaaaguggugaga

SEQ ID NO: 1952807 - RNA, 15 nt, Human
ugucaaaguggugag

SEQ ID NO: 1952808 - RNA, 14 nt, Human
ugucaaagugguga

SEQ ID NO: 1952809 - RNA, 11 nt, Human
uguauuaugug

SEQ ID NO: 1952810 - RNA, 17 nt, Human
uguauuauauguaacua

SEQ ID NO: 1952811 - RNA, 19 nt, Human
uguauuauacuuagucaaa

SEQ ID NO: 1952812 - RNA, 15 nt, Human
uguauuagucacaga

SEQ ID NO: 1952813 - RNA, 21 nt, Human
uguaugugggggucugugugu

SEQ ID NO: 1952814 - RNA, 22 nt, Human
uguaugugggggucuguguguu

SEQ ID NO: 1952815 - RNA, 14 nt, Human
uguauguguaagua

SEQ ID NO: 1952816 - RNA, 15 nt, Human
uguaucccaugagcc

SEQ ID NO: 1952817 - RNA, 16 nt, Human
uguaucccaugagccu

SEQ ID NO: 1952818 - RNA, 21 nt, Human
uguauuaacacuacucaaagc

SEQ ID NO: 1952819 - RNA, 22 nt, Human
uguauuaacacuacucaaagca

SEQ ID NO: 1952820 - RNA, 14 nt, Human
uguauuaaauuaca

SEQ ID NO: 1952821 - RNA, 17 nt, Human
uguauuaaauuacauuu

SEQ ID NO: 1952822 - RNA, 18 nt, Human
uguauuaaauuacauuug

SEQ ID NO: 1952823 - RNA, 19 nt, Human
uguauuaaauuacauuugu

SEQ ID NO: 1952824 - RNA, 21 nt, Human
uguauuaaauuacauuuguaa

SEQ ID NO: 1952825 - RNA, 23 nt, Human
uguauuaaauuacauuuguaauu

SEQ ID NO: 1952826 - RNA, 16 nt, Human
agguuugggaccccug

SEQ ID NO: 1952827 - RNA, 14 nt, Human
agguuuggcuccug

SEQ ID NO: 1952828 - RNA, 16 nt, Human
agguuuggcuccugcc

SEQ ID NO: 1952829 - RNA, 18 nt, Human
agguuuggcuccugccca

SEQ ID NO: 1952830 - RNA, 20 nt, Human
agguuuggcuccugcccacu

SEQ ID NO: 1952831 - RNA, 21 nt, Human
agguuugggaccccugguggu

SEQ ID NO: 1952832 - RNA, 22 nt, Human
uguauccauccauggggcugau

SEQ ID NO: 1952833 - RNA, 23 nt, Human
agguuuggacaaaauggaauacu

SEQ ID NO: 1952834 - RNA, 12 nt, Human
agguuugaaucu

SEQ ID NO: 1952835 - RNA, 12 nt, Human
uguagagccagg

SEQ ID NO: 1952836 - RNA, 15 nt, Human
uguagagccaggguc

SEQ ID NO: 1952837 - RNA, 15 nt, Human
aguauuauaccuuuu

SEQ ID NO: 1952838 - RNA, 14 nt, Human
aguauuauaccuuu

SEQ ID NO: 1952839 - RNA, 13 nt, Human
aguauuauaaaca

SEQ ID NO: 1952840 - RNA, 14 nt, Human
aguauugccaaaca

SEQ ID NO: 1952841 - RNA, 15 nt, Human
aguauugccaaacau

SEQ ID NO: 1952842 - RNA, 16 nt, Human
aguauugccaaacauu

SEQ ID NO: 1952843 - RNA, 17 nt, Human
aguauugccaaacauua

SEQ ID NO: 1952844 - RNA, 18 nt, Human
aguauugccaaacauuaa

SEQ ID NO: 1952845 - RNA, 11 nt, Human
aguauuguaca

SEQ ID NO: 1952846 - RNA, 22 nt, Human
aguagcugggacuacaggcacc

SEQ ID NO: 1952847 - RNA, 19 nt, Human
aguagcugggacuacaggc

SEQ ID NO: 1952848 - RNA, 21 nt, Human
aguagcugggacuacaggcac

SEQ ID NO: 1952849 - RNA, 21 nt, Human
aguauuuaauucauguugccu

SEQ ID NO: 1952850 - RNA, 22 nt, Human
agucacagagauaauucuagcu

SEQ ID NO: 1952851 - RNA, 14 nt, Human
aguauuuaagccua

SEQ ID NO: 1952852 - RNA, 18 nt, Human
aguauuuaagccuaaaga

SEQ ID NO: 1952853 - RNA, 19 nt, Human
aguauuuaagccuaaagau

SEQ ID NO: 1952854 - RNA, 20 nt, Human
aguauuuaagccuaaagauu

SEQ ID NO: 1952855 - RNA, 22 nt, Human
aguauugccaaacauuaauguu

SEQ ID NO: 1952856 - RNA, 15 nt, Human
ugucagcauagaagu

SEQ ID NO: 1952857 - RNA, 17 nt, Human
agucacugagacagccc

SEQ ID NO: 1952858 - RNA, 16 nt, Human
agucacugagacagcc

SEQ ID NO: 1952859 - RNA, 15 nt, Human
agucacugagacagc

SEQ ID NO: 1952860 - RNA, 20 nt, Human
agucacauuccaagccucau

SEQ ID NO: 1952861 - RNA, 21 nt, Human
aguauuuaagccuaaagauuu

SEQ ID NO: 1952862 - RNA, 17 nt, Human
agucaucgaguggccca

SEQ ID NO: 1952863 - RNA, 15 nt, Human
agucagucauucaga

SEQ ID NO: 1952864 - RNA, 21 nt, Human
agucagucauucagauaugau

SEQ ID NO: 1952865 - RNA, 22 nt, Human
agucagucgccuuucagcaggc

SEQ ID NO: 1952866 - RNA, 23 nt, Human
agucagucgccuuucagcaggca

SEQ ID NO: 1952867 - RNA, 19 nt, Human
agucagggguucccuuuuu

SEQ ID NO: 1952868 - RNA, 19 nt, Human
ugucuaagaaacauuggaa

SEQ ID NO: 1952869 - RNA, 21 nt, Human
ugucuaagauuaauagcauuc

SEQ ID NO: 1952870 - RNA, 14 nt, Human
ugucuaagaaacau

SEQ ID NO: 1952871 - RNA, 15 nt, Human
ugucuaagaaacauu

SEQ ID NO: 1952872 - RNA, 16 nt, Human
ugucuaagaaacauug

SEQ ID NO: 1952873 - RNA, 14 nt, Human
agucccacuccaag

SEQ ID NO: 1952874 - RNA, 20 nt, Human
agucccaggcugagccucag

SEQ ID NO: 1952875 - RNA, 18 nt, Human
agucccacuccaagccag

SEQ ID NO: 1952876 - RNA, 19 nt, Human
agucccacuccaagccagc

SEQ ID NO: 1952877 - RNA, 13 nt, Human
aguccccagaacu

SEQ ID NO: 1952878 - RNA, 14 nt, Human
aguccccagaacuc

SEQ ID NO: 1952879 - RNA, 19 nt, Human
aguccccuguuuguuucug

SEQ ID NO: 1952880 - RNA, 14 nt, Human
aguccccuguuugu

SEQ ID NO: 1952881 - RNA, 21 nt, Human
agucccaccuuggcugcaggg

SEQ ID NO: 1952882 - RNA, 23 nt, Human
agucccaccuuggcugcagggag

SEQ ID NO: 1952883 - RNA, 20 nt, Human
agucccaccuuggcugcagg

SEQ ID NO: 1952884 - RNA, 16 nt, Human
ugucagccauuccugu

SEQ ID NO: 1952885 - RNA, 22 nt, Human
ugucagcgcucuggugcugcag

SEQ ID NO: 1952886 - RNA, 19 nt, Human
uguccaggcacugcugccc

SEQ ID NO: 1952887 - RNA, 20 nt, Human
uguccaggcacugcugccca

SEQ ID NO: 1952888 - RNA, 21 nt, Human
uguccaggcacugcugcccag

SEQ ID NO: 1952889 - RNA, 20 nt, Human
ugucccuaccgagucucuuc

SEQ ID NO: 1952890 - RNA, 21 nt, Human
ugucccuaccgagucucuucu

SEQ ID NO: 1952891 - RNA, 22 nt, Human
ugucccuaccgagucucuucuc

SEQ ID NO: 1952892 - RNA, 15 nt, Human
ugucccugaaaccua

SEQ ID NO: 1952893 - RNA, 14 nt, Human
ugucccugcacuug

SEQ ID NO: 1952894 - RNA, 12 nt, Human
ugucccuuucuu

SEQ ID NO: 1952895 - RNA, 14 nt, Human
ugucccuuucuucu

SEQ ID NO: 1952896 - RNA, 15 nt, Human
ugucccuuucuucuc

SEQ ID NO: 1952897 - RNA, 16 nt, Human
ugucccuuucuucucc

SEQ ID NO: 1952898 - RNA, 17 nt, Human
ugucccuuucuucuccc

SEQ ID NO: 1952899 - RNA, 12 nt, Human
ugucccuuuucc

SEQ ID NO: 1952900 - RNA, 21 nt, Human
uguccugugucaguuuauguu

SEQ ID NO: 1952901 - RNA, 19 nt, Human
uguccugugucaguuuaug

SEQ ID NO: 1952902 - RNA, 16 nt, Human
uguccugugucaguuu

SEQ ID NO: 1952903 - RNA, 17 nt, Human
uguccugugucaguuua

SEQ ID NO: 1952904 - RNA, 18 nt, Human
uguccugugucaguuuau

SEQ ID NO: 1952905 - RNA, 22 nt, Human
ugaaagaaaauaccaaggaaca

SEQ ID NO: 1952906 - RNA, 15 nt, Human
ugaaagaaaacuuuu

SEQ ID NO: 1952907 - RNA, 16 nt, Human
ugaaagacuguacaaa

SEQ ID NO: 1952908 - RNA, 18 nt, Human
ugaaagaaaacuuuuaug

SEQ ID NO: 1952909 - RNA, 17 nt, Human
ugaaagaggaaugaagu

SEQ ID NO: 1952910 - RNA, 22 nt, Human
ugaaagacuguacaaaguagaa

SEQ ID NO: 1952911 - RNA, 19 nt, Human
ugaaagacuguacaaagua

SEQ ID NO: 1952912 - RNA, 18 nt, Human
ugaaagacuguacaaagu

SEQ ID NO: 1952913 - RNA, 18 nt, Human
agagaccaucccugaagg

SEQ ID NO: 1952914 - RNA, 18 nt, Human
ugaaagaggaaugaagua

SEQ ID NO: 1952915 - RNA, 21 nt, Human
agagaccaucccugaaggccc

SEQ ID NO: 1952916 - RNA, 19 nt, Human
agagaccaucccugaaggc

SEQ ID NO: 1952917 - RNA, 23 nt, Human
agagaccaucccugaaggccccg

SEQ ID NO: 1952918 - RNA, 22 nt, Human
agagaccaucccugaaggcccc

SEQ ID NO: 1952919 - RNA, 22 nt, Human
agagauaggaaggucauuucca

SEQ ID NO: 1952920 - RNA, 23 nt, Human
agagauaggaaggucauuuccau

SEQ ID NO: 1952921 - RNA, 17 nt, Human
agagaguggcuccuccc

SEQ ID NO: 1952922 - RNA, 14 nt, Human
agagauacucuggg

SEQ ID NO: 1952923 - RNA, 20 nt, Human
agagauaggaaggucauuuc

SEQ ID NO: 1952924 - RNA, 14 nt, Human
agagacuccugcag

SEQ ID NO: 1952925 - RNA, 13 nt, Human
agagacuccugca

SEQ ID NO: 1952926 - RNA, 12 nt, Human
agagacuccugc

SEQ ID NO: 1952927 - RNA, 11 nt, Human
agagacuccug

SEQ ID NO: 1952928 - RNA, 14 nt, Human
ugaaaauaagccau

SEQ ID NO: 1952929 - RNA, 18 nt, Human
ugaaaauaagccaugaga

SEQ ID NO: 1952930 - RNA, 19 nt, Human
ugaaaauaagccaugagaa

SEQ ID NO: 1952931 - RNA, 20 nt, Human
ugaaaauaagccaugagaau

SEQ ID NO: 1952932 - RNA, 17 nt, Human
ugaaaauaaugcuguuc

SEQ ID NO: 1952933 - RNA, 12 nt, Human
ugaaaauaauug

SEQ ID NO: 1952934 - RNA, 15 nt, Human
ugaaaacacauuuuu

SEQ ID NO: 1952935 - RNA, 17 nt, Human
ugaaaacacauuuuucu

SEQ ID NO: 1952936 - RNA, 19 nt, Human
ugaaaacacauuuuucuua

SEQ ID NO: 1952937 - RNA, 20 nt, Human
ugaaaacacauuuuucuuag

SEQ ID NO: 1952938 - RNA, 14 nt, Human
ugaaaacacauuuu

SEQ ID NO: 1952939 - RNA, 12 nt, Human
ugaaaacacauu

SEQ ID NO: 1952940 - RNA, 13 nt, Human
ugaaaacacauuu

SEQ ID NO: 1952941 - RNA, 18 nt, Human
ugaaaaaaaaaaugcuga

SEQ ID NO: 1952942 - RNA, 19 nt, Human
ucuuuuuuuuuuaagugaa

SEQ ID NO: 1952943 - RNA, 23 nt, Human
ucuuuuuuuuuuaagugaaauuu

SEQ ID NO: 1952944 - RNA, 22 nt, Human
ugaaaaaaaaaaugcugaacau

SEQ ID NO: 1952945 - RNA, 20 nt, Human
ugaaaaaaaaaaugcugaac

SEQ ID NO: 1952946 - RNA, 21 nt, Human
ugaaaaaaaaaaugcugaaca

SEQ ID NO: 1952947 - RNA, 14 nt, Human
ucuuuuuuugugau

SEQ ID NO: 1952948 - RNA, 16 nt, Human
ucuuuuuuugugaugu

SEQ ID NO: 1952949 - RNA, 18 nt, Human
ugaaaauaguuuauuuua

SEQ ID NO: 1952950 - RNA, 14 nt, Human
ugaaaauuaacaug

SEQ ID NO: 1952951 - RNA, 17 nt, Human
ugaaacuggauuaaacu

SEQ ID NO: 1952952 - RNA, 18 nt, Human
ugaaacuggauuaaacuu

SEQ ID NO: 1952953 - RNA, 13 nt, Human
ugaaagaaaauaa

SEQ ID NO: 1952954 - RNA, 19 nt, Human
agagacacaagccuucggc

SEQ ID NO: 1952955 - RNA, 16 nt, Human
agagacacaagccuuc

SEQ ID NO: 1952956 - RNA, 19 nt, Human
agacuuuucuuucagccaa

SEQ ID NO: 1952957 - RNA, 15 nt, Human
agagacacaagccuu

SEQ ID NO: 1952958 - RNA, 19 nt, Human
agacuuuuccaauauguga

SEQ ID NO: 1952959 - RNA, 19 nt, Human
agacuuuggaaagaguagg

SEQ ID NO: 1952960 - RNA, 12 nt, Human
agacuuuuauga

SEQ ID NO: 1952961 - RNA, 15 nt, Human
agacuuuuccaaccc

SEQ ID NO: 1952962 - RNA, 15 nt, Human
agacuuuuaugauac

SEQ ID NO: 1952963 - RNA, 15 nt, Human
agacuuuggaaagag

SEQ ID NO: 1952964 - RNA, 17 nt, Human
agacuuuggaaagacuu

SEQ ID NO: 1952965 - RNA, 14 nt, Human
agacuguacaaagu

SEQ ID NO: 1952966 - RNA, 20 nt, Human
agacugguuccauggccucu

SEQ ID NO: 1952967 - RNA, 14 nt, Human
agagacagaaagca

SEQ ID NO: 1952968 - RNA, 15 nt, Human
agagacagaaagcag

SEQ ID NO: 1952969 - RNA, 21 nt, Human
agacuuuuccaauaugugauu

SEQ ID NO: 1952970 - RNA, 20 nt, Human
ucuuuguacagacaacaaac

SEQ ID NO: 1952971 - RNA, 15 nt, Human
ucuuuguacagacaa

SEQ ID NO: 1952972 - RNA, 14 nt, Human
ucuuuguacagaca

SEQ ID NO: 1952973 - RNA, 16 nt, Human
ucuuuguaaugaaaac

SEQ ID NO: 1952974 - RNA, 14 nt, Human
ucuuuguggcuucc

SEQ ID NO: 1952975 - RNA, 22 nt, Human
ucuuuuuucuaaaguaaaaaca

SEQ ID NO: 1952976 - RNA, 21 nt, Human
ucuuuuuucuaaaguaaaaac

SEQ ID NO: 1952977 - RNA, 16 nt, Human
ucuuuuuuucucuaga

SEQ ID NO: 1952978 - RNA, 12 nt, Human
agacuccaccaa

SEQ ID NO: 1952979 - RNA, 16 nt, Human
agacuccaccaagccu

SEQ ID NO: 1952980 - RNA, 16 nt, Human
ucuuucccuuccucca

SEQ ID NO: 1952981 - RNA, 17 nt, Human
ucuuucccuuccuccau

SEQ ID NO: 1952982 - RNA, 12 nt, Human
ucuuuccugagg

SEQ ID NO: 1952983 - RNA, 19 nt, Human
ucuuucuaaugugugaauc

SEQ ID NO: 1952984 - RNA, 17 nt, Human
ucuuuaaugauuccuau

SEQ ID NO: 1952985 - RNA, 18 nt, Human
ucuuuaaugauuccuaua

SEQ ID NO: 1952986 - RNA, 20 nt, Human
ucuuuaaugauuccuauaaa

SEQ ID NO: 1952987 - RNA, 15 nt, Human
ucuuucccuuccagu

SEQ ID NO: 1952988 - RNA, 16 nt, Human
ucuuucccuuccaguu

SEQ ID NO: 1952989 - RNA, 14 nt, Human
ucuuucccuuccuc

SEQ ID NO: 1952990 - RNA, 15 nt, Human
ucuuucccuuccucc

SEQ ID NO: 1952991 - RNA, 18 nt, Human
ucuuuaaugucacaggca

SEQ ID NO: 1952992 - RNA, 19 nt, Human
ucuuuaaugucacaggcag

SEQ ID NO: 1952993 - RNA, 20 nt, Human
agacaggcaagcaccuccug

SEQ ID NO: 1952994 - RNA, 19 nt, Human
agacagagcgacagagcag

SEQ ID NO: 1952995 - RNA, 14 nt, Human
agacaggaccccug

SEQ ID NO: 1952996 - RNA, 15 nt, Human
agacaggaccccugc

SEQ ID NO: 1952997 - RNA, 22 nt, Human
agacaggaccccugcaguuccc

SEQ ID NO: 1952998 - RNA, 22 nt, Human
agacaggcaagcaccuccugcc

SEQ ID NO: 1952999 - RNA, 18 nt, Human
agacaggagaagaaagaa

SEQ ID NO: 1953000 - RNA, 21 nt, Human
agacaggagaagaaagaacua

SEQ ID NO: 1953001 - RNA, 15 nt, Human
ucuuuaaugucacag

SEQ ID NO: 1953002 - RNA, 20 nt, Human
agacuggccugaaccacagg

SEQ ID NO: 1953003 - RNA, 13 nt, Human
agacucucucugg

SEQ ID NO: 1953004 - RNA, 15 nt, Human
agacucuagggucca

SEQ ID NO: 1953005 - RNA, 16 nt, Human
agacucccaagcugga

SEQ ID NO: 1953006 - RNA, 21 nt, Human
agacuccagcuggguuggaaa

SEQ ID NO: 1953007 - RNA, 22 nt, Human
agacuccagaaaugucccuuuc

SEQ ID NO: 1953008 - RNA, 13 nt, Human
agacuccugcagg

SEQ ID NO: 1953009 - RNA, 23 nt, Human
agaggccuccuguggccugccag

SEQ ID NO: 1953010 - RNA, 18 nt, Human
agaggccgagagcuaugg

SEQ ID NO: 1953011 - RNA, 18 nt, Human
agaggccacauuacuaga

SEQ ID NO: 1953012 - RNA, 16 nt, Human
agaggccaaacaggcc

SEQ ID NO: 1953013 - RNA, 19 nt, Human
agaggccaaacaggcccuc

SEQ ID NO: 1953014 - RNA, 18 nt, Human
agaggcaguugcccagcc

SEQ ID NO: 1953015 - RNA, 22 nt, Human
agaggcaguugcccagccucuu

SEQ ID NO: 1953016 - RNA, 21 nt, Human
agaggcaugggcuugcugugg

SEQ ID NO: 1953017 - RNA, 21 nt, Human
agaggcagccccauucugccu

SEQ ID NO: 1953018 - RNA, 22 nt, Human
agaggcagccccauucugccug

SEQ ID NO: 1953019 - RNA, 21 nt, Human
agaggcagggucucacucugu

SEQ ID NO: 1953020 - RNA, 23 nt, Human
agaggcagccccauucugccugc

SEQ ID NO: 1953021 - RNA, 22 nt, Human
agagcugugggcaaaagagugu

SEQ ID NO: 1953022 - RNA, 16 nt, Human
agaggcugcagccagg

SEQ ID NO: 1953023 - RNA, 22 nt, Human
agaggcugccucucccaucacu

SEQ ID NO: 1953024 - RNA, 13 nt, Human
agagguucaaaga

SEQ ID NO: 1953025 - RNA, 20 nt, Human
agagggagugacagaggcag

SEQ ID NO: 1953026 - RNA, 15 nt, Human
agagggagguaagga

SEQ ID NO: 1953027 - RNA, 15 nt, Human
agagggagugacaga

SEQ ID NO: 1953028 - RNA, 16 nt, Human
agagguucaaagauau

SEQ ID NO: 1953029 - RNA, 19 nt, Human
agagguucaaagauauuuu

SEQ ID NO: 1953030 - RNA, 20 nt, Human
agagguucaaagauauuuug

SEQ ID NO: 1953031 - RNA, 18 nt, Human
agaguaauccaagcaaau

SEQ ID NO: 1953032 - RNA, 20 nt, Human
agaguaauccaagcaaaugu

SEQ ID NO: 1953033 - RNA, 13 nt, Human
ugaagauuguuua

SEQ ID NO: 1953034 - RNA, 16 nt, Human
ugaagauuguuuaucu

SEQ ID NO: 1953035 - RNA, 13 nt, Human
ugaagguuuuuga

SEQ ID NO: 1953036 - RNA, 14 nt, Human
ugaagguuuuugau

SEQ ID NO: 1953037 - RNA, 18 nt, Human
ugaagguuuuugauagca

SEQ ID NO: 1953038 - RNA, 19 nt, Human
ugaagguuuuugauagcau

SEQ ID NO: 1953039 - RNA, 13 nt, Human
ugaagguuuuugu

SEQ ID NO: 1953040 - RNA, 15 nt, Human
ugaagguuuuuguaa

SEQ ID NO: 1953041 - RNA, 16 nt, Human
ugaagguuuuuguaaa

SEQ ID NO: 1953042 - RNA, 22 nt, Human
ugaagauuguuuaucuagaugu

SEQ ID NO: 1953043 - RNA, 24 nt, Human
ugaagauuguuuaucuagauguaa

SEQ ID NO: 1953044 - RNA, 15 nt, Human
ugaaguaauaugcac

SEQ ID NO: 1953045 - RNA, 13 nt, Human
ugaaguaagcaaa

SEQ ID NO: 1953046 - RNA, 14 nt, Human
ugaaguaagcaaag

SEQ ID NO: 1953047 - RNA, 17 nt, Human
ugaagguuuuuguaaag

SEQ ID NO: 1953048 - RNA, 18 nt, Human
ugaagguuuuuguaaaga

SEQ ID NO: 1953049 - RNA, 19 nt, Human
ugaagguuuuuguaaagau

SEQ ID NO: 1953050 - RNA, 21 nt, Human
ugaagguuuuuguaaagauuu

SEQ ID NO: 1953051 - RNA, 16 nt, Human
ugaaguaauaugcaca

SEQ ID NO: 1953052 - RNA, 20 nt, Human
ugaaguaauaugcacacauu

SEQ ID NO: 1953053 - RNA, 21 nt, Human
ugaaguaauaugcacacauuu

SEQ ID NO: 1953054 - RNA, 22 nt, Human
ugaaguaauaugcacacauuuu

SEQ ID NO: 1953055 - RNA, 18 nt, Human
ugaauauuuaguguucau

SEQ ID NO: 1953056 - RNA, 13 nt, Human
ugaauaauacagu

SEQ ID NO: 1953057 - RNA, 17 nt, Human
ugaauaagccauucuga

SEQ ID NO: 1953058 - RNA, 22 nt, Human
ugaauaagccauucugacucau

SEQ ID NO: 1953059 - RNA, 13 nt, Human
ugaauaaugauuu

SEQ ID NO: 1953060 - RNA, 23 nt, Human
ugaauaauguaagacaaauaugu

SEQ ID NO: 1953061 - RNA, 13 nt, Human
ugaauaauuacag

SEQ ID NO: 1953062 - RNA, 17 nt, Human
ugaauaauuacagugcc

SEQ ID NO: 1953063 - RNA, 18 nt, Human
ugaauaauuacagugccu

SEQ ID NO: 1953064 - RNA, 12 nt, Human
ugaauaauacag

SEQ ID NO: 1953065 - RNA, 23 nt, Human
ugaauaacugauuaguaagucuu

SEQ ID NO: 1953066 - RNA, 12 nt, Human
ugaauaagcacu

SEQ ID NO: 1953067 - RNA, 13 nt, Human
ugaauaagcacuu

SEQ ID NO: 1953068 - RNA, 15 nt, Human
ugaauaagcacuuuu

SEQ ID NO: 1953069 - RNA, 13 nt, Human
ugaagucacacag

SEQ ID NO: 1953070 - RNA, 17 nt, Human
ugaaguacucauacaug

SEQ ID NO: 1953071 - RNA, 15 nt, Human
ugaaguaagcaaaga

SEQ ID NO: 1953072 - RNA, 21 nt, Human
ugaaauuuuucauauuuuaau

SEQ ID NO: 1953073 - RNA, 16 nt, Human
ugaaauuuuucauauu

SEQ ID NO: 1953074 - RNA, 17 nt, Human
ugaaauuuuucauauuu

SEQ ID NO: 1953075 - RNA, 18 nt, Human
ugaaauuuuucauauuuu

SEQ ID NO: 1953076 - RNA, 20 nt, Human
ugaaauuuuucauauuuuaa

SEQ ID NO: 1953077 - RNA, 23 nt, Human
ugaaauuuuuuuucaugcuuuau

SEQ ID NO: 1953078 - RNA, 14 nt, Human
ugaacaaaauaaau

SEQ ID NO: 1953079 - RNA, 16 nt, Human
ugaacaaaauaaauug

SEQ ID NO: 1953080 - RNA, 18 nt, Human
ugaacaaaauaaauugga

SEQ ID NO: 1953081 - RNA, 15 nt, Human
ugaacaaagaccaau

SEQ ID NO: 1953082 - RNA, 19 nt, Human
ugaacaaagaccaauuuuu

SEQ ID NO: 1953083 - RNA, 15 nt, Human
ugaaauuuccuggga

SEQ ID NO: 1953084 - RNA, 19 nt, Human
ugaaauuuuuauuaaauua

SEQ ID NO: 1953085 - RNA, 21 nt, Human
ugaaauuuccugggagcuuuu

SEQ ID NO: 1953086 - RNA, 12 nt, Human
ugaaauuuuuca

SEQ ID NO: 1953087 - RNA, 13 nt, Human
ugaaauuuuucau

SEQ ID NO: 1953088 - RNA, 14 nt, Human
ugaaauuuuucaua

SEQ ID NO: 1953089 - RNA, 20 nt, Human
ugaaauuuuuauuaaauuau

SEQ ID NO: 1953090 - RNA, 23 nt, Human
ugaaauagacccacaagaggcag

SEQ ID NO: 1953091 - RNA, 16 nt, Human
ugaaauugaaaaguua

SEQ ID NO: 1953092 - RNA, 18 nt, Human
ugaaauugaaaaguuauu

SEQ ID NO: 1953093 - RNA, 23 nt, Human
ugaaauuuauugaggaaaaauau

SEQ ID NO: 1953094 - RNA, 13 nt, Human
ugaaauuuauuga

SEQ ID NO: 1953095 - RNA, 15 nt, Human
ugaaauuuauugagg

SEQ ID NO: 1953096 - RNA, 17 nt, Human
ugaaauuuauugaggaa

SEQ ID NO: 1953097 - RNA, 22 nt, Human
ugaaauuuauugaggaaaaaua

SEQ ID NO: 1953098 - RNA, 14 nt, Human
ugaaauaagccaga

SEQ ID NO: 1953099 - RNA, 21 nt, Human
ugaaauaaagacccaggggga

SEQ ID NO: 1953100 - RNA, 17 nt, Human
ugaaauaacacagcagu

SEQ ID NO: 1953101 - RNA, 16 nt, Human
ugaaauaccauuauua

SEQ ID NO: 1953102 - RNA, 13 nt, Human
ugaaauaaacguc

SEQ ID NO: 1953103 - RNA, 18 nt, Human
ugaaauaaacgucuuaaa

SEQ ID NO: 1953104 - RNA, 22 nt, Human
ugaaauaaacgucuuaaauauu

SEQ ID NO: 1953105 - RNA, 23 nt, Human
ugaaauaaacgucuuaaauauuc

SEQ ID NO: 1953106 - RNA, 16 nt, Human
ugaaauaacauggccu

SEQ ID NO: 1953107 - RNA, 17 nt, Human
ugaaauaacauggccuu

SEQ ID NO: 1953108 - RNA, 14 nt, Human
ugaaauaaaagcua

SEQ ID NO: 1953109 - RNA, 16 nt, Human
agagauugugguuuca

SEQ ID NO: 1953110 - RNA, 13 nt, Human
ugaacaaauuuac

SEQ ID NO: 1953111 - RNA, 21 nt, Human
ugaaccaccacacccagccca

SEQ ID NO: 1953112 - RNA, 22 nt, Human
ugaaccaccacacccagcccac

SEQ ID NO: 1953113 - RNA, 18 nt, Human
ugaaccauaaaaugucca

SEQ ID NO: 1953114 - RNA, 18 nt, Human
ugaaccauaguuacugua

SEQ ID NO: 1953115 - RNA, 19 nt, Human
ugaaccauaguuacuguaa

SEQ ID NO: 1953116 - RNA, 13 nt, Human
ugaaccacuugua

SEQ ID NO: 1953117 - RNA, 14 nt, Human
ugaaccacuuguag

SEQ ID NO: 1953118 - RNA, 15 nt, Human
ugaaccacuuguaga

SEQ ID NO: 1953119 - RNA, 16 nt, Human
ugaaccacuuguagau

SEQ ID NO: 1953120 - RNA, 20 nt, Human
ugaaccacuuguagauuuga

SEQ ID NO: 1953121 - RNA, 21 nt, Human
ugaaccacuuguagauuugau

SEQ ID NO: 1953122 - RNA, 23 nt, Human
ugaaccacuuguagauuugauuu

SEQ ID NO: 1953123 - RNA, 18 nt, Human
ugaaccagaaccagucuu

SEQ ID NO: 1953124 - RNA, 13 nt, Human
ugaaccauaaaau

SEQ ID NO: 1953125 - RNA, 15 nt, Human
ugaaccauaaaaugu

SEQ ID NO: 1953126 - RNA, 16 nt, Human
ugaaccauaaaauguc

SEQ ID NO: 1953127 - RNA, 22 nt, Human
ugaacccauauuuguacaccaa

SEQ ID NO: 1953128 - RNA, 18 nt, Human
ugaacccgggaggcagag

SEQ ID NO: 1953129 - RNA, 21 nt, Human
ugaacguuugguucaaaugug

SEQ ID NO: 1953130 - RNA, 17 nt, Human
ugaacguuugguucaaa

SEQ ID NO: 1953131 - RNA, 19 nt, Human
ugaacguuugguucaaaug

SEQ ID NO: 1953132 - RNA, 20 nt, Human
ugaacguuugguucaaaugu

SEQ ID NO: 1953133 - RNA, 11 nt, Human
ugaacuccugg

SEQ ID NO: 1953134 - RNA, 15 nt, Human
ugaacuccugaccuc

SEQ ID NO: 1953135 - RNA, 22 nt, Human
ugaagacaaugacuuacuguac

SEQ ID NO: 1953136 - RNA, 23 nt, Human
ugaagacaaugacuuacuguaca

SEQ ID NO: 1953137 - RNA, 13 nt, Human
ugaagacagagcu

SEQ ID NO: 1953138 - RNA, 16 nt, Human
ugaagaauuuaaagaa

SEQ ID NO: 1953139 - RNA, 11 nt, Human
ugaagaauuua

SEQ ID NO: 1953140 - RNA, 13 nt, Human
ugaagaauuuaaa

SEQ ID NO: 1953141 - RNA, 15 nt, Human
ugaagaauuuaaaga

SEQ ID NO: 1953142 - RNA, 14 nt, Human
ugagauguguucac

SEQ ID NO: 1953143 - RNA, 20 nt, Human
ugagaugguaugcacaauuc

SEQ ID NO: 1953144 - RNA, 22 nt, Human
ugagaugguaugcacaauucca

SEQ ID NO: 1953145 - RNA, 23 nt, Human
ugagauguagccccucuccugga

SEQ ID NO: 1953146 - RNA, 17 nt, Human
ugagaggaaaucaccga

SEQ ID NO: 1953147 - RNA, 23 nt, Human
ugagaggacuuuucuuuguggcu

SEQ ID NO: 1953148 - RNA, 16 nt, Human
ugagaggacacucccg

SEQ ID NO: 1953149 - RNA, 14 nt, Human
ugagaggaaaucac

SEQ ID NO: 1953150 - RNA, 13 nt, Human
ugagaggaaauca

SEQ ID NO: 1953151 - RNA, 12 nt, Human
ugagaggaaauc

SEQ ID NO: 1953152 - RNA, 11 nt, Human
ugagaggaaau

SEQ ID NO: 1953153 - RNA, 17 nt, Human
ugagagcugugcaucag

SEQ ID NO: 1953154 - RNA, 10 nt, Human
ugagaggaaa

SEQ ID NO: 1953155 - RNA, 14 nt, Human
ugagagcugggugu

SEQ ID NO: 1953156 - RNA, 20 nt, Human
ugagagaggcuaaaauguuu

SEQ ID NO: 1953157 - RNA, 21 nt, Human
ugagagaggcuaaaauguuuu

SEQ ID NO: 1953158 - RNA, 22 nt, Human
ugagagagauguguaauuuuuc

SEQ ID NO: 1953159 - RNA, 18 nt, Human
ugagagaggcuaaaaugu

SEQ ID NO: 1953160 - RNA, 19 nt, Human
ugagagaggcuaaaauguu

SEQ ID NO: 1953161 - RNA, 14 nt, Human
ugagagagaugugu

SEQ ID NO: 1953162 - RNA, 16 nt, Human
ugagagagauguguaa

SEQ ID NO: 1953163 - RNA, 15 nt, Human
ugagacagcagucuu

SEQ ID NO: 1953164 - RNA, 20 nt, Human
ugagacagcccgggcucugc

SEQ ID NO: 1953165 - RNA, 19 nt, Human
ugagacagcccgggcucug

SEQ ID NO: 1953166 - RNA, 18 nt, Human
ugagacagcccgggcucu

SEQ ID NO: 1953167 - RNA, 17 nt, Human
ugagacagcccgggcuc

SEQ ID NO: 1953168 - RNA, 12 nt, Human
ugagacagcucu

SEQ ID NO: 1953169 - RNA, 22 nt, Human
ugagacagcccgggcucugccu

SEQ ID NO: 1953170 - RNA, 20 nt, Human
ugagacucugucucagucca

SEQ ID NO: 1953171 - RNA, 20 nt, Human
ugagacucugucucaaaaaa

SEQ ID NO: 1953172 - RNA, 13 nt, Human
ugagaaugaacaa

SEQ ID NO: 1953173 - RNA, 14 nt, Human
ugagaaugaacaaa

SEQ ID NO: 1953174 - RNA, 15 nt, Human
ugagaaugaacaaag

SEQ ID NO: 1953175 - RNA, 17 nt, Human
ugagaaugaacaaagac

SEQ ID NO: 1953176 - RNA, 20 nt, Human
ugagacagaaucucgcucug

SEQ ID NO: 1953177 - RNA, 11 nt, Human
ugagacagagu

SEQ ID NO: 1953178 - RNA, 13 nt, Human
ugagacagcccgg

SEQ ID NO: 1953179 - RNA, 21 nt, Human
ugagacagaguuuucacucuu

SEQ ID NO: 1953180 - RNA, 17 nt, Human
agcaccuagccucgcuc

SEQ ID NO: 1953181 - RNA, 13 nt, Human
agcaccuccugcc

SEQ ID NO: 1953182 - RNA, 14 nt, Human
agcaccuccugccu

SEQ ID NO: 1953183 - RNA, 16 nt, Human
agcaccuccugccucg

SEQ ID NO: 1953184 - RNA, 16 nt, Human
agcaccgccucuuccc

SEQ ID NO: 1953185 - RNA, 18 nt, Human
agcaccgccucuucccgc

SEQ ID NO: 1953186 - RNA, 23 nt, Human
agcacaugccucucucaggccaa

SEQ ID NO: 1953187 - RNA, 14 nt, Human
agcaccauccccuc

SEQ ID NO: 1953188 - RNA, 15 nt, Human
agcaccauccccucc

SEQ ID NO: 1953189 - RNA, 16 nt, Human
agcaccaucucuccuc

SEQ ID NO: 1953190 - RNA, 16 nt, Human
agcaccauccccuccg

SEQ ID NO: 1953191 - RNA, 23 nt, Human
agcacccauccaccguccccucc

SEQ ID NO: 1953192 - RNA, 22 nt, Human
agcacaugccucucucaggcca

SEQ ID NO: 1953193 - RNA, 21 nt, Human
agcacaugccucucucaggcc

SEQ ID NO: 1953194 - RNA, 20 nt, Human
agcacaugccucucucaggc

SEQ ID NO: 1953195 - RNA, 19 nt, Human
agcacaugccucucucagg

SEQ ID NO: 1953196 - RNA, 16 nt, Human
agcacaugccucucuc

SEQ ID NO: 1953197 - RNA, 23 nt, Human
agcacaggcugagugcaggccca

SEQ ID NO: 1953198 - RNA, 18 nt, Human
agcacaugccucucucag

SEQ ID NO: 1953199 - RNA, 18 nt, Human
agcacaggcugagugcag

SEQ ID NO: 1953200 - RNA, 12 nt, Human
agcacaggcuga

SEQ ID NO: 1953201 - RNA, 19 nt, Human
agcacaggcugagugcagg

SEQ ID NO: 1953202 - RNA, 20 nt, Human
agcacaggcugagugcaggc

SEQ ID NO: 1953203 - RNA, 21 nt, Human
agcacaggcugagugcaggcc

SEQ ID NO: 1953204 - RNA, 22 nt, Human
agcacaggcugagugcaggccc

SEQ ID NO: 1953205 - RNA, 21 nt, Human
agcacagcuucauuuccugug

SEQ ID NO: 1953206 - RNA, 13 nt, Human
agcaauaucugcu

SEQ ID NO: 1953207 - RNA, 12 nt, Human
agcaauauucuu

SEQ ID NO: 1953208 - RNA, 21 nt, Human
agcaauauucuuggagauuga

SEQ ID NO: 1953209 - RNA, 17 nt, Human
agcaagugagagcuggg

SEQ ID NO: 1953210 - RNA, 12 nt, Human
agcaauaauuuc

SEQ ID NO: 1953211 - RNA, 16 nt, Human
agcaauaauuucugua

SEQ ID NO: 1953212 - RNA, 21 nt, Human
ugagccagauuucacucuccu

SEQ ID NO: 1953213 - RNA, 20 nt, Human
ugagccagauuucacucucc

SEQ ID NO: 1953214 - RNA, 19 nt, Human
ugagccagauuucacucuc

SEQ ID NO: 1953215 - RNA, 18 nt, Human
ugagccagauuucacucu

SEQ ID NO: 1953216 - RNA, 14 nt, Human
ugagccacugcacc

SEQ ID NO: 1953217 - RNA, 12 nt, Human
ugagccacugca

SEQ ID NO: 1953218 - RNA, 13 nt, Human
ugagccacugcac

SEQ ID NO: 1953219 - RNA, 16 nt, Human
ugagcauuagauuucu

SEQ ID NO: 1953220 - RNA, 16 nt, Human
ugagcauuacaggcaa

SEQ ID NO: 1953221 - RNA, 14 nt, Human
ugagcauuagauuu

SEQ ID NO: 1953222 - RNA, 17 nt, Human
agcaaggagauuuacaa

SEQ ID NO: 1953223 - RNA, 19 nt, Human
agcaaggagauuuacaacu

SEQ ID NO: 1953224 - RNA, 14 nt, Human
agcaaggagauuua

SEQ ID NO: 1953225 - RNA, 22 nt, Human
agcaagcuuuuacaacagugcu

SEQ ID NO: 1953226 - RNA, 23 nt, Human
agcaagcuuuuacaacagugcug

SEQ ID NO: 1953227 - RNA, 16 nt, Human
agcaaggaagguaaaa

SEQ ID NO: 1953228 - RNA, 21 nt, Human
agcaaggaagguaaaaaguua

SEQ ID NO: 1953229 - RNA, 22 nt, Human
agcaaggaagguaaaaaguuaa

SEQ ID NO: 1953230 - RNA, 17 nt, Human
agcaaggcgcuaacuug

SEQ ID NO: 1953231 - RNA, 20 nt, Human
agcaaggcgcuaacuugcuu

SEQ ID NO: 1953232 - RNA, 22 nt, Human
agcaaggccaccucuuccuggc

SEQ ID NO: 1953233 - RNA, 19 nt, Human
agcaaggccaccucuuccu

SEQ ID NO: 1953234 - RNA, 21 nt, Human
agcaaggccaccucuuccugg

SEQ ID NO: 1953235 - RNA, 12 nt, Human
agcaaggccacc

SEQ ID NO: 1953236 - RNA, 14 nt, Human
agcaaggccaccuc

SEQ ID NO: 1953237 - RNA, 15 nt, Human
agcaaggccaccucu

SEQ ID NO: 1953238 - RNA, 19 nt, Human
agcaaggucuugcucuccu

SEQ ID NO: 1953239 - RNA, 20 nt, Human
agcaaggucuugcucuccua

SEQ ID NO: 1953240 - RNA, 15 nt, Human
agcaagucagaauag

SEQ ID NO: 1953241 - RNA, 15 nt, Human
agcaagugagagcug

SEQ ID NO: 1953242 - RNA, 16 nt, Human
agcaagugagagcugg

SEQ ID NO: 1953243 - RNA, 16 nt, Human
agcaagugagacccug

SEQ ID NO: 1953244 - RNA, 18 nt, Human
agaucucuaacuucacca

SEQ ID NO: 1953245 - RNA, 13 nt, Human
agaucucaggucc

SEQ ID NO: 1953246 - RNA, 21 nt, Human
agaucucccacaugccagggg

SEQ ID NO: 1953247 - RNA, 13 nt, Human
agaucuaaaaaua

SEQ ID NO: 1953248 - RNA, 20 nt, Human
agaucuaaaaauaacuguaa

SEQ ID NO: 1953249 - RNA, 18 nt, Human
agauccccaagccuggca

SEQ ID NO: 1953250 - RNA, 20 nt, Human
ugacauuugucauuuucauu

SEQ ID NO: 1953251 - RNA, 15 nt, Human
ugacauuuguuuggu

SEQ ID NO: 1953252 - RNA, 22 nt, Human
ugacauuuguuugguuauagug

SEQ ID NO: 1953253 - RNA, 21 nt, Human
agaugcuagaacucccuuuca

SEQ ID NO: 1953254 - RNA, 22 nt, Human
agaugcuagaacucccuuucaa

SEQ ID NO: 1953255 - RNA, 22 nt, Human
agauguagccccucuccuggaa

SEQ ID NO: 1953256 - RNA, 21 nt, Human
agauguagccccucuccugga

SEQ ID NO: 1953257 - RNA, 20 nt, Human
agaugcaaugacucaggaca

SEQ ID NO: 1953258 - RNA, 19 nt, Human
agaugcuagaacucccuuu

SEQ ID NO: 1953259 - RNA, 14 nt, Human
agaugcauuuggaa

SEQ ID NO: 1953260 - RNA, 19 nt, Human
ugacacgaauauugcugau

SEQ ID NO: 1953261 - RNA, 15 nt, Human
ugacacuuaaaaaug

SEQ ID NO: 1953262 - RNA, 22 nt, Human
ugacagagugagacucugucuc

SEQ ID NO: 1953263 - RNA, 16 nt, Human
ugacacgaauauugcu

SEQ ID NO: 1953264 - RNA, 13 nt, Human
ugacauuugucau

SEQ ID NO: 1953265 - RNA, 14 nt, Human
ugacauuugucauu

SEQ ID NO: 1953266 - RNA, 15 nt, Human
ugacauuugucauuu

SEQ ID NO: 1953267 - RNA, 16 nt, Human
ugacauuugucauuuu

SEQ ID NO: 1953268 - RNA, 17 nt, Human
ugacauuugucauuuuc

SEQ ID NO: 1953269 - RNA, 18 nt, Human
ugacauuugucauuuuca

SEQ ID NO: 1953270 - RNA, 19 nt, Human
ugacauuugucauuuucau

SEQ ID NO: 1953271 - RNA, 14 nt, Human
ugacagccagaacu

SEQ ID NO: 1953272 - RNA, 11 nt, Human
ugacagccccu

SEQ ID NO: 1953273 - RNA, 19 nt, Human
ugacagccccucccuccuc

SEQ ID NO: 1953274 - RNA, 17 nt, Human
ugacaggcaaugcuggc

SEQ ID NO: 1953275 - RNA, 19 nt, Human
ugacaggcaaugcuggcug

SEQ ID NO: 1953276 - RNA, 15 nt, Human
ugacagguuugggac

SEQ ID NO: 1953277 - RNA, 22 nt, Human
ugacagggcacaccgggcacuc

SEQ ID NO: 1953278 - RNA, 22 nt, Human
agauuucauccagaagucaaca

SEQ ID NO: 1953279 - RNA, 20 nt, Human
agauuuuaaaacuucaucug

SEQ ID NO: 1953280 - RNA, 15 nt, Human
agauuucauccagaa

SEQ ID NO: 1953281 - RNA, 17 nt, Human
agauuucacucuccuug

SEQ ID NO: 1953282 - RNA, 21 nt, Human
agauuuaaacucugaauuuau

SEQ ID NO: 1953283 - RNA, 19 nt, Human
agauuucacucuccuuggu

SEQ ID NO: 1953284 - RNA, 21 nt, Human
agauuguuuaucuagauguaa

SEQ ID NO: 1953285 - RNA, 22 nt, Human
agauuguuuaucuagauguaaa

SEQ ID NO: 1953286 - RNA, 19 nt, Human
agauuuaaacucugaauuu

SEQ ID NO: 1953287 - RNA, 20 nt, Human
agauuuaaacucugaauuua

SEQ ID NO: 1953288 - RNA, 14 nt, Human
agauuguuuaucua

SEQ ID NO: 1953289 - RNA, 16 nt, Human
agauuguuuaucuaga

SEQ ID NO: 1953290 - RNA, 18 nt, Human
agauuguuuaucuagaug

SEQ ID NO: 1953291 - RNA, 19 nt, Human
agauuguuuaucuagaugu

SEQ ID NO: 1953292 - RNA, 19 nt, Human
agauucauauuuacuucuu

SEQ ID NO: 1953293 - RNA, 21 nt, Human
agauuccagagaguggcuccu

SEQ ID NO: 1953294 - RNA, 22 nt, Human
agauuccagagaguggcuccuc

SEQ ID NO: 1953295 - RNA, 19 nt, Human
agauuccagagaguggcuc

SEQ ID NO: 1953296 - RNA, 16 nt, Human
agauucauauuuacuu

SEQ ID NO: 1953297 - RNA, 13 nt, Human
agauucauauuua

SEQ ID NO: 1953298 - RNA, 14 nt, Human
agauucaggcauuu

SEQ ID NO: 1953299 - RNA, 13 nt, Human
agauuauaauugu

SEQ ID NO: 1953300 - RNA, 18 nt, Human
agauuauaauuguugcau

SEQ ID NO: 1953301 - RNA, 18 nt, Human
agauuaauagcauucgaa

SEQ ID NO: 1953302 - RNA, 14 nt, Human
agauuaagaaauag

SEQ ID NO: 1953303 - RNA, 15 nt, Human
agauuaagaaauaga

SEQ ID NO: 1953304 - RNA, 12 nt, Human
ugacuuacugua

SEQ ID NO: 1953305 - RNA, 20 nt, Human
ugacuuacuguacaugaaaa

SEQ ID NO: 1953306 - RNA, 13 nt, Human
ugacuuagaaucc

SEQ ID NO: 1953307 - RNA, 19 nt, Human
ugacuuagaaucccugugu

SEQ ID NO: 1953308 - RNA, 20 nt, Human
ugacuuagaaucccuguguu

SEQ ID NO: 1953309 - RNA, 21 nt, Human
ugacuuagaaucccuguguua

SEQ ID NO: 1953310 - RNA, 22 nt, Human
ugacuuagaaucccuguguuaa

SEQ ID NO: 1953311 - RNA, 23 nt, Human
ugacuuagaaucccuguguuaau

SEQ ID NO: 1953312 - RNA, 12 nt, Human
ugaccuuguaau

SEQ ID NO: 1953313 - RNA, 13 nt, Human
ugaccuuguaaug

SEQ ID NO: 1953314 - RNA, 14 nt, Human
ugaccuuguaaugu

SEQ ID NO: 1953315 - RNA, 16 nt, Human
ugaccuuguaauguaa

SEQ ID NO: 1953316 - RNA, 15 nt, Human
ugaccuuuaagagaa

SEQ ID NO: 1953317 - RNA, 20 nt, Human
ugaccuggaaggcccagcac

SEQ ID NO: 1953318 - RNA, 13 nt, Human
ugaccuggucagg

SEQ ID NO: 1953319 - RNA, 21 nt, Human
ugacucguauaugucucaggu

SEQ ID NO: 1953320 - RNA, 19 nt, Human
ugacucuaguacugugaau

SEQ ID NO: 1953321 - RNA, 23 nt, Human
ugacucuaguacugugaauccag

SEQ ID NO: 1953322 - RNA, 21 nt, Human
ugacuguuuucucuugagagg

SEQ ID NO: 1953323 - RNA, 19 nt, Human
ugacuuaacauagccaaaa

SEQ ID NO: 1953324 - RNA, 20 nt, Human
ugacuuaacauagccaaaau

SEQ ID NO: 1953325 - RNA, 22 nt, Human
ugacuuaacauagccaaaaugu

SEQ ID NO: 1953326 - RNA, 13 nt, Human
ugaccuuucaaua

SEQ ID NO: 1953327 - RNA, 18 nt, Human
ugaccuuguaauguaacu

SEQ ID NO: 1953328 - RNA, 21 nt, Human
ugaccuuguaauguaacugcu

SEQ ID NO: 1953329 - RNA, 12 nt, Human
ugaccuuucaau

SEQ ID NO: 1953330 - RNA, 20 nt, Human
acuuucugaaauaacauggc

SEQ ID NO: 1953331 - RNA, 14 nt, Human
acuuucugaaauaa

SEQ ID NO: 1953332 - RNA, 12 nt, Human
acuuuaccuuuu

SEQ ID NO: 1953333 - RNA, 14 nt, Human
acuuucuucaaaau

SEQ ID NO: 1953334 - RNA, 23 nt, Human
acuuugaauuuuagcacauugca

SEQ ID NO: 1953335 - RNA, 17 nt, Human
acuuucuucaaaauaua

SEQ ID NO: 1953336 - RNA, 19 nt, Human
acuuugacagcgcacagcu

SEQ ID NO: 1953337 - RNA, 19 nt, Human
acuuucugaaauucacaaa

SEQ ID NO: 1953338 - RNA, 12 nt, Human
acuuucuguuaa

SEQ ID NO: 1953339 - RNA, 13 nt, Human
acuuucuguuaaa

SEQ ID NO: 1953340 - RNA, 16 nt, Human
acuuucuguuaaaaug

SEQ ID NO: 1953341 - RNA, 17 nt, Human
acuuucuguuaaaaugc

SEQ ID NO: 1953342 - RNA, 19 nt, Human
acuuucuguuaaaaugcau

SEQ ID NO: 1953343 - RNA, 22 nt, Human
acuuucuguuaaaaugcaugau

SEQ ID NO: 1953344 - RNA, 23 nt, Human
acuuucuguuaaaaugcaugauu

SEQ ID NO: 1953345 - RNA, 16 nt, Human
ucuccucugcugcugg

SEQ ID NO: 1953346 - RNA, 15 nt, Human
ucuccucugcugcug

SEQ ID NO: 1953347 - RNA, 15 nt, Human
ucuccuccagaguca

SEQ ID NO: 1953348 - RNA, 18 nt, Human
ucuccucugcugcuggcu

SEQ ID NO: 1953349 - RNA, 17 nt, Human
ucuccucugcugcuggc

SEQ ID NO: 1953350 - RNA, 19 nt, Human
ucuccaagcaggacaugga

SEQ ID NO: 1953351 - RNA, 18 nt, Human
ucuccaagcaggacaugg

SEQ ID NO: 1953352 - RNA, 23 nt, Human
ucuccccagcaagugagagcugg

SEQ ID NO: 1953353 - RNA, 12 nt, Human
ucuccacccugc

SEQ ID NO: 1953354 - RNA, 15 nt, Human
ucucccuuuuccaug

SEQ ID NO: 1953355 - RNA, 17 nt, Human
ucuccgaaaugcugucu

SEQ ID NO: 1953356 - RNA, 16 nt, Human
ucuccucauguucugc

SEQ ID NO: 1953357 - RNA, 10 nt, Human
ucuccucagg

SEQ ID NO: 1953358 - RNA, 14 nt, Human
ucuccucaggacca

SEQ ID NO: 1953359 - RNA, 20 nt, Human
ucuccgaaaugcugucuuuc

SEQ ID NO: 1953360 - RNA, 23 nt, Human
ucuccgaaaugcugucuuucuug

SEQ ID NO: 1953361 - RNA, 17 nt, Human
ucuccgaccagacaccu

SEQ ID NO: 1953362 - RNA, 23 nt, Human
ucuccgaccagacaccuugacag

SEQ ID NO: 1953363 - RNA, 12 nt, Human
acuuugaccucu

SEQ ID NO: 1953364 - RNA, 13 nt, Human
acuuugaccucug

SEQ ID NO: 1953365 - RNA, 21 nt, Human
acuuugacagcgcacagcugc

SEQ ID NO: 1953366 - RNA, 16 nt, Human
acuuuggaucaggaaa

SEQ ID NO: 1953367 - RNA, 20 nt, Human
acuuuguuaguuucuccaag

SEQ ID NO: 1953368 - RNA, 14 nt, Human
acuuuguuaggcca

SEQ ID NO: 1953369 - RNA, 18 nt, Human
acuuuguuaggccaaaga

SEQ ID NO: 1953370 - RNA, 14 nt, Human
acuuuguaaauucu

SEQ ID NO: 1953371 - RNA, 21 nt, Human
acuuuguaaauucugauuucu

SEQ ID NO: 1953372 - RNA, 23 nt, Human
acuuuguaaauucugauuucuuu

SEQ ID NO: 1953373 - RNA, 16 nt, Human
acuuuguaaauucuga

SEQ ID NO: 1953374 - RNA, 17 nt, Human
acuuuguaaauucugau

SEQ ID NO: 1953375 - RNA, 18 nt, Human
acuuuguaaauucugauu

SEQ ID NO: 1953376 - RNA, 19 nt, Human
acuuuguaaauucugauuu

SEQ ID NO: 1953377 - RNA, 14 nt, Human
acuuuguucuggcu

SEQ ID NO: 1953378 - RNA, 21 nt, Human
acuuuguuaguuucuccaagc

SEQ ID NO: 1953379 - RNA, 12 nt, Human
acuuuuguucuu

SEQ ID NO: 1953380 - RNA, 13 nt, Human
acuuuuguucuug

SEQ ID NO: 1953381 - RNA, 17 nt, Human
agaaaaaagagaaaaga

SEQ ID NO: 1953382 - RNA, 18 nt, Human
agaaaaaagagaaaagaa

SEQ ID NO: 1953383 - RNA, 10 nt, Human
agaaaaaagu

SEQ ID NO: 1953384 - RNA, 12 nt, Human
agaaaaaaguug

SEQ ID NO: 1953385 - RNA, 14 nt, Human
agaaaaaaguugua

SEQ ID NO: 1953386 - RNA, 22 nt, Human
acuuuguuaggccaaagacaaa

SEQ ID NO: 1953387 - RNA, 18 nt, Human
acuuuuuaaaaaacuuuc

SEQ ID NO: 1953388 - RNA, 15 nt, Human
acuuuuguucuuggu

SEQ ID NO: 1953389 - RNA, 23 nt, Human
acuuuuguucuugguuuguaaau

SEQ ID NO: 1953390 - RNA, 16 nt, Human
ucuccuucaccuuugu

SEQ ID NO: 1953391 - RNA, 13 nt, Human
ucuccuuguguua

SEQ ID NO: 1953392 - RNA, 21 nt, Human
ucuccuuguguuacuaaguuu

SEQ ID NO: 1953393 - RNA, 15 nt, Human
ucuccuucaccuuug

SEQ ID NO: 1953394 - RNA, 14 nt, Human
ucuccuucaccuuu

SEQ ID NO: 1953395 - RNA, 17 nt, Human
agaaaaaauauuuuccc

SEQ ID NO: 1953396 - RNA, 22 nt, Human
agaaaaaagguucuuuguguau

SEQ ID NO: 1953397 - RNA, 19 nt, Human
ucucauuguucaauuccca

SEQ ID NO: 1953398 - RNA, 21 nt, Human
ucucaugccucagccuccuga

SEQ ID NO: 1953399 - RNA, 13 nt, Human
ucucaugcugccc

SEQ ID NO: 1953400 - RNA, 19 nt, Human
ucucaugcugccccugccu

SEQ ID NO: 1953401 - RNA, 18 nt, Human
ucucaggccagcugcuug

SEQ ID NO: 1953402 - RNA, 17 nt, Human
ucucaggccagcugcuu

SEQ ID NO: 1953403 - RNA, 21 nt, Human
ucucaggccagcugcuugggc

SEQ ID NO: 1953404 - RNA, 20 nt, Human
ucucaugccucagccuccug

SEQ ID NO: 1953405 - RNA, 16 nt, Human
ucuccaagcaggacau

SEQ ID NO: 1953406 - RNA, 15 nt, Human
ucuccaagcaggaca

SEQ ID NO: 1953407 - RNA, 13 nt, Human
ucuccaaaauaaa

SEQ ID NO: 1953408 - RNA, 16 nt, Human
ucucauuugucacaca

SEQ ID NO: 1953409 - RNA, 19 nt, Human
ucucauuugccaauaauaa

SEQ ID NO: 1953410 - RNA, 14 nt, Human
ucucauuugucaca

SEQ ID NO: 1953411 - RNA, 10 nt, Human
ucucaggcca

SEQ ID NO: 1953412 - RNA, 13 nt, Human
ucucaggccagcu

SEQ ID NO: 1953413 - RNA, 12 nt, Human
ucucaggccagc

SEQ ID NO: 1953414 - RNA, 12 nt, Human
ucucaggccaaa

SEQ ID NO: 1953415 - RNA, 21 nt, Human
ucucagcauuaccucuuugga

SEQ ID NO: 1953416 - RNA, 19 nt, Human
acuuguauuauguguguuu

SEQ ID NO: 1953417 - RNA, 18 nt, Human
acuuguauuauguguguu

SEQ ID NO: 1953418 - RNA, 19 nt, Human
acuugcuuuggucacuuuu

SEQ ID NO: 1953419 - RNA, 23 nt, Human
acuugcuuuggucacuuuuagau

SEQ ID NO: 1953420 - RNA, 14 nt, Human
acuugcuuuuaaaa

SEQ ID NO: 1953421 - RNA, 18 nt, Human
acuugcuuaaaugugaau

SEQ ID NO: 1953422 - RNA, 16 nt, Human
acuugcuuaaauguga

SEQ ID NO: 1953423 - RNA, 17 nt, Human
acuugcuuaaaugugaa

SEQ ID NO: 1953424 - RNA, 13 nt, Human
acuugcugccucg

SEQ ID NO: 1953425 - RNA, 14 nt, Human
acuugcugugacuu

SEQ ID NO: 1953426 - RNA, 14 nt, Human
acuugcuuaaaugu

SEQ ID NO: 1953427 - RNA, 15 nt, Human
acuugcuuaaaugug

SEQ ID NO: 1953428 - RNA, 11 nt, Human
acuugcugccu

SEQ ID NO: 1953429 - RNA, 12 nt, Human
acuugcugccuc

SEQ ID NO: 1953430 - RNA, 21 nt, Human
acuugucuuuggacccugagg

SEQ ID NO: 1953431 - RNA, 18 nt, Human
acuugucuuuggacccug

SEQ ID NO: 1953432 - RNA, 20 nt, Human
acuugucuuuggacccugag

SEQ ID NO: 1953433 - RNA, 19 nt, Human
acuuguggacacagcucuu

SEQ ID NO: 1953434 - RNA, 22 nt, Human
acuuguggacacagcucuucuc

SEQ ID NO: 1953435 - RNA, 20 nt, Human
acuugcucuugaugccuggc

SEQ ID NO: 1953436 - RNA, 16 nt, Human
acuugcacucuucuac

SEQ ID NO: 1953437 - RNA, 18 nt, Human
acuugcucuugaugccug

SEQ ID NO: 1953438 - RNA, 17 nt, Human
acuugcucuugaugccu

SEQ ID NO: 1953439 - RNA, 16 nt, Human
acuugcucuugaugcc

SEQ ID NO: 1953440 - RNA, 23 nt, Human
acuugcagacucuacagaggcca

SEQ ID NO: 1953441 - RNA, 19 nt, Human
acuugcagacucuacagag

SEQ ID NO: 1953442 - RNA, 22 nt, Human
acuugcagacucuacagaggcc

SEQ ID NO: 1953443 - RNA, 20 nt, Human
ucucacuauguugcccaggc

SEQ ID NO: 1953444 - RNA, 21 nt, Human
ucucacuauguugcccaggca

SEQ ID NO: 1953445 - RNA, 22 nt, Human
ucucacuauguugcccaggcag

SEQ ID NO: 1953446 - RNA, 23 nt, Human
ucucacuauguugcccaggcagg

SEQ ID NO: 1953447 - RNA, 15 nt, Human
acuugcacucuucua

SEQ ID NO: 1953448 - RNA, 17 nt, Human
acuugauuugagauuuu

SEQ ID NO: 1953449 - RNA, 13 nt, Human
acuuaagcacacu

SEQ ID NO: 1953450 - RNA, 17 nt, Human
acuuaaucuaaauggaa

SEQ ID NO: 1953451 - RNA, 19 nt, Human
acuuaaucuaaauggaacc

SEQ ID NO: 1953452 - RNA, 22 nt, Human
acuuaaucuaaauggaaccacu

SEQ ID NO: 1953453 - RNA, 16 nt, Human
acuuacacuuuaugca

SEQ ID NO: 1953454 - RNA, 20 nt, Human
acuuaaauaaugugaaacug

SEQ ID NO: 1953455 - RNA, 14 nt, Human
acuuaaauguuaug

SEQ ID NO: 1953456 - RNA, 16 nt, Human
acuuaaauguuaugua

SEQ ID NO: 1953457 - RNA, 22 nt, Human
acuuaaauguuauguauauggu

SEQ ID NO: 1953458 - RNA, 20 nt, Human
acuuaacauagccaaaaugu

SEQ ID NO: 1953459 - RNA, 17 nt, Human
acuuacacuuuaugcac

SEQ ID NO: 1953460 - RNA, 19 nt, Human
acuuacauauuuauuuuua

SEQ ID NO: 1953461 - RNA, 21 nt, Human
acuuacuguacaugaaaacac

SEQ ID NO: 1953462 - RNA, 16 nt, Human
acuuacuguacaugaa

SEQ ID NO: 1953463 - RNA, 22 nt, Human
acuuacuguacaugaaaacaca

SEQ ID NO: 1953464 - RNA, 14 nt, Human
acuuagcugggaga

SEQ ID NO: 1953465 - RNA, 19 nt, Human
acuuagcuggagaugucuc

SEQ ID NO: 1953466 - RNA, 21 nt, Human
acuuagcuggagaugucucua

SEQ ID NO: 1953467 - RNA, 23 nt, Human
acuuaggaagguggccuuccugc

SEQ ID NO: 1953468 - RNA, 15 nt, Human
acuuagguguggggg

SEQ ID NO: 1953469 - RNA, 15 nt, Human
acuucaguuaucuug

SEQ ID NO: 1953470 - RNA, 14 nt, Human
ucuacccuggcacu

SEQ ID NO: 1953471 - RNA, 19 nt, Human
ucuacccuggcacuauaau

SEQ ID NO: 1953472 - RNA, 14 nt, Human
ucuacccaggugcu

SEQ ID NO: 1953473 - RNA, 20 nt, Human
ucuacccagcgagcccuggu

SEQ ID NO: 1953474 - RNA, 21 nt, Human
ucuacccuggcacuauaaugu

SEQ ID NO: 1953475 - RNA, 18 nt, Human
acuguucucugcccucca

SEQ ID NO: 1953476 - RNA, 19 nt, Human
acuguucucugcccuccaa

SEQ ID NO: 1953477 - RNA, 18 nt, Human
acuguucccaccugcugg

SEQ ID NO: 1953478 - RNA, 17 nt, Human
acuguucagcuuuuauu

SEQ ID NO: 1953479 - RNA, 17 nt, Human
acuguucucugcccucc

SEQ ID NO: 1953480 - RNA, 16 nt, Human
acuguucucugcccuc

SEQ ID NO: 1953481 - RNA, 18 nt, Human
uccugggagugagcuggu

SEQ ID NO: 1953482 - RNA, 15 nt, Human
uccugggcacacgcu

SEQ ID NO: 1953483 - RNA, 18 nt, Human
uccugggcacacgcugcu

SEQ ID NO: 1953484 - RNA, 19 nt, Human
uccugggcacacgcugcuc

SEQ ID NO: 1953485 - RNA, 21 nt, Human
uccugggcacacgcugcucug

SEQ ID NO: 1953486 - RNA, 23 nt, Human
uccugggcacacgcugcucugcc

SEQ ID NO: 1953487 - RNA, 21 nt, Human
ucuacagaggccaugggccuc

SEQ ID NO: 1953488 - RNA, 22 nt, Human
ucuaaguuuuaggguacaugug

SEQ ID NO: 1953489 - RNA, 23 nt, Human
ucuaaguuuuaggguacaugugc

SEQ ID NO: 1953490 - RNA, 18 nt, Human
ucuaauaagcuaguugaa

SEQ ID NO: 1953491 - RNA, 11 nt, Human
ucuaauaauaa

SEQ ID NO: 1953492 - RNA, 13 nt, Human
ucuaauaauaaau

SEQ ID NO: 1953493 - RNA, 14 nt, Human
ucuaauaauaaaua

SEQ ID NO: 1953494 - RNA, 15 nt, Human
ucuaauaauaaauag

SEQ ID NO: 1953495 - RNA, 22 nt, Human
ucuaauaauaaauaguucuucu

SEQ ID NO: 1953496 - RNA, 19 nt, Human
ucuacccagcgagcccugg

SEQ ID NO: 1953497 - RNA, 23 nt, Human
ucuacagcuaaucagcauucuca

SEQ ID NO: 1953498 - RNA, 12 nt, Human
ucuacagcuccc

SEQ ID NO: 1953499 - RNA, 15 nt, Human
ucuacagcuccccca

SEQ ID NO: 1953500 - RNA, 16 nt, Human
ucuacagcucccccag

SEQ ID NO: 1953501 - RNA, 20 nt, Human
ucuacagcucccccagcucc

SEQ ID NO: 1953502 - RNA, 20 nt, Human
ucuacagcuaaucagcauuc

SEQ ID NO: 1953503 - RNA, 21 nt, Human
ucuagagaaguggacuggagg

SEQ ID NO: 1953504 - RNA, 22 nt, Human
ucuagaguagagguauaauugu

SEQ ID NO: 1953505 - RNA, 18 nt, Human
ucuagcauggcugccaau

SEQ ID NO: 1953506 - RNA, 13 nt, Human
ucuagauacugua

SEQ ID NO: 1953507 - RNA, 16 nt, Human
acuucaucccucuggg

SEQ ID NO: 1953508 - RNA, 13 nt, Human
acuuccccuuccu

SEQ ID NO: 1953509 - RNA, 19 nt, Human
acuuccccuuccuaauucc

SEQ ID NO: 1953510 - RNA, 23 nt, Human
ucuagacacuuuuucuuuacaaa

SEQ ID NO: 1953511 - RNA, 15 nt, Human
ucuagacacuuuuuc

SEQ ID NO: 1953512 - RNA, 16 nt, Human
ucuagacacuuuuucu

SEQ ID NO: 1953513 - RNA, 22 nt, Human
acuucccuggguuagacugcca

SEQ ID NO: 1953514 - RNA, 23 nt, Human
acuucccuggguuagacugccag

SEQ ID NO: 1953515 - RNA, 17 nt, Human
ucuagaauuuuaagccu

SEQ ID NO: 1953516 - RNA, 19 nt, Human
ucuagaauuuuaagccuuu

SEQ ID NO: 1953517 - RNA, 21 nt, Human
acuucccuggguuagacugcc

SEQ ID NO: 1953518 - RNA, 19 nt, Human
ucuagcauuagguauaucu

SEQ ID NO: 1953519 - RNA, 13 nt, Human
ucuagccagagga

SEQ ID NO: 1953520 - RNA, 12 nt, Human
ucuaggaagacu

SEQ ID NO: 1953521 - RNA, 22 nt, Human
ucuaguuguuugauucagacag

SEQ ID NO: 1953522 - RNA, 13 nt, Human
ucuauaaaccgaa

SEQ ID NO: 1953523 - RNA, 22 nt, Human
ucuaguuugauuaaauucuugc

SEQ ID NO: 1953524 - RNA, 21 nt, Human
ucuaguuugauuaaauucuug

SEQ ID NO: 1953525 - RNA, 23 nt, Human
ucuaguuguuugauucagacagc

SEQ ID NO: 1953526 - RNA, 19 nt, Human
ucuauuuucucugauacuu

SEQ ID NO: 1953527 - RNA, 11 nt, Human
ucuauuuuaca

SEQ ID NO: 1953528 - RNA, 13 nt, Human
ucuauuuuacaac

SEQ ID NO: 1953529 - RNA, 13 nt, Human
ucuauuuauuuau

SEQ ID NO: 1953530 - RNA, 14 nt, Human
ucuauuuauuuauu

SEQ ID NO: 1953531 - RNA, 20 nt, Human
ucuauuuucucugauacuuu

SEQ ID NO: 1953532 - RNA, 21 nt, Human
ucucaccauuuccccagggca

SEQ ID NO: 1953533 - RNA, 17 nt, Human
ucucacuauguugccca

SEQ ID NO: 1953534 - RNA, 19 nt, Human
ucucacuauguugcccagg

SEQ ID NO: 1953535 - RNA, 19 nt, Human
ucuauagaaaguguucugu

SEQ ID NO: 1953536 - RNA, 21 nt, Human
ucuauagaaaguguucuguua

SEQ ID NO: 1953537 - RNA, 22 nt, Human
ucuauagaaaguguucuguuac

SEQ ID NO: 1953538 - RNA, 23 nt, Human
ucuauagaaaguguucuguuaca

SEQ ID NO: 1953539 - RNA, 12 nt, Human
ucuauagaaagu

SEQ ID NO: 1953540 - RNA, 13 nt, Human
ucuauagaaagug

SEQ ID NO: 1953541 - RNA, 14 nt, Human
ucuauagaaagugu

SEQ ID NO: 1953542 - RNA, 15 nt, Human
ucuauagaaaguguu

SEQ ID NO: 1953543 - RNA, 16 nt, Human
ucuauagaaaguguuc

SEQ ID NO: 1953544 - RNA, 16 nt, Human
ucuauguuaauauuuu

SEQ ID NO: 1953545 - RNA, 14 nt, Human
ucuauguuaauauu

SEQ ID NO: 1953546 - RNA, 15 nt, Human
ucuauagcaucacuu

SEQ ID NO: 1953547 - RNA, 17 nt, Human
ucuauagcaucacuuaa

SEQ ID NO: 1953548 - RNA, 24 nt, Human
ucuauagaaaguguucuguuacaa

SEQ ID NO: 1953549 - RNA, 23 nt, Human
ucuaugggacucaaugcacugac

SEQ ID NO: 1953550 - RNA, 18 nt, Human
ucuauuagcuuacugauu

SEQ ID NO: 1953551 - RNA, 20 nt, Human
ucuauuagcuuacugauuaa

SEQ ID NO: 1953552 - RNA, 13 nt, Human
agacacaggggac

SEQ ID NO: 1953553 - RNA, 20 nt, Human
agacacauguccaagaagcc

SEQ ID NO: 1953554 - RNA, 16 nt, Human
agacacauguccaaga

SEQ ID NO: 1953555 - RNA, 18 nt, Human
agacaccuugacagggca

SEQ ID NO: 1953556 - RNA, 17 nt, Human
agacaccuugacagggc

SEQ ID NO: 1953557 - RNA, 16 nt, Human
agacaggaccagggau

SEQ ID NO: 1953558 - RNA, 20 nt, Human
agacagagcaaccccuggac

SEQ ID NO: 1953559 - RNA, 13 nt, Human
agacacuuccguc

SEQ ID NO: 1953560 - RNA, 20 nt, Human
agacacuuccgucacauccc

SEQ ID NO: 1953561 - RNA, 22 nt, Human
agaauuugauaugugaacaguu

SEQ ID NO: 1953562 - RNA, 20 nt, Human
agaauugcaaucuauaauau

SEQ ID NO: 1953563 - RNA, 16 nt, Human
agaauuugucacagga

SEQ ID NO: 1953564 - RNA, 21 nt, Human
agaauuugauaugugaacagu

SEQ ID NO: 1953565 - RNA, 15 nt, Human
agaauugcaaucuau

SEQ ID NO: 1953566 - RNA, 17 nt, Human
agaauugcaaucuauaa

SEQ ID NO: 1953567 - RNA, 14 nt, Human
agaauuuuaagccu

SEQ ID NO: 1953568 - RNA, 16 nt, Human
agaauuuuaagccuuu

SEQ ID NO: 1953569 - RNA, 22 nt, Human
agaauuuuaagccuuuguugaa

SEQ ID NO: 1953570 - RNA, 12 nt, Human
agaauugaaggu

SEQ ID NO: 1953571 - RNA, 13 nt, Human
agaauugaagguu

SEQ ID NO: 1953572 - RNA, 14 nt, Human
agaauugaagguuu

SEQ ID NO: 1953573 - RNA, 15 nt, Human
agaauugaagguuuu

SEQ ID NO: 1953574 - RNA, 16 nt, Human
agaauugaagguuuuu

SEQ ID NO: 1953575 - RNA, 18 nt, Human
agaauugaagguuuuuga

SEQ ID NO: 1953576 - RNA, 20 nt, Human
agaauugaagguuuuugaua

SEQ ID NO: 1953577 - RNA, 21 nt, Human
agaauugaagguuuuugauag

SEQ ID NO: 1953578 - RNA, 12 nt, Human
agacacaggccc

SEQ ID NO: 1953579 - RNA, 13 nt, Human
agacacaggcccg

SEQ ID NO: 1953580 - RNA, 16 nt, Human
agacacaggcccggcu

SEQ ID NO: 1953581 - RNA, 14 nt, Human
ucugugagaugcua

SEQ ID NO: 1953582 - RNA, 19 nt, Human
ucugugacuuaguggacag

SEQ ID NO: 1953583 - RNA, 23 nt, Human
ucugugagaugcuagaacucccu

SEQ ID NO: 1953584 - RNA, 17 nt, Human
ucugugagaugcuagaa

SEQ ID NO: 1953585 - RNA, 22 nt, Human
ucugugagaugcuagaacuccc

SEQ ID NO: 1953586 - RNA, 14 nt, Human
ucugggccagaauu

SEQ ID NO: 1953587 - RNA, 15 nt, Human
ucugggccagaauuu

SEQ ID NO: 1953588 - RNA, 22 nt, Human
ucugugaaaggaaagagggagg

SEQ ID NO: 1953589 - RNA, 14 nt, Human
ucuguauuugaaag

SEQ ID NO: 1953590 - RNA, 15 nt, Human
ucuguauuugaaagu

SEQ ID NO: 1953591 - RNA, 18 nt, Human
ucuguauuugaaagugcc

SEQ ID NO: 1953592 - RNA, 22 nt, Human
ucuguauuugaaagugccuuug

SEQ ID NO: 1953593 - RNA, 15 nt, Human
ucugucaaagucaga

SEQ ID NO: 1953594 - RNA, 14 nt, Human
ucuguuuacagugu

SEQ ID NO: 1953595 - RNA, 16 nt, Human
ucuguuguauucauug

SEQ ID NO: 1953596 - RNA, 13 nt, Human
ucuguuuagauaa

SEQ ID NO: 1953597 - RNA, 13 nt, Human
ucuguucuuucca

SEQ ID NO: 1953598 - RNA, 22 nt, Human
ucuguucuuuccaaaguacacu

SEQ ID NO: 1953599 - RNA, 15 nt, Human
ucuguugcugccuca

SEQ ID NO: 1953600 - RNA, 13 nt, Human
ucuguugcccagg

SEQ ID NO: 1953601 - RNA, 12 nt, Human
ucuguuggccag

SEQ ID NO: 1953602 - RNA, 17 nt, Human
ucuguuggccaguguga

SEQ ID NO: 1953603 - RNA, 21 nt, Human
agaauacugauggaauuuuuu

SEQ ID NO: 1953604 - RNA, 17 nt, Human
agaauacugauggaauu

SEQ ID NO: 1953605 - RNA, 17 nt, Human
agaauaaaauuuuuaau

SEQ ID NO: 1953606 - RNA, 14 nt, Human
agaauaaaauuuuu

SEQ ID NO: 1953607 - RNA, 12 nt, Human
agaauaaaauuu

SEQ ID NO: 1953608 - RNA, 19 nt, Human
agaauagaacaacauauac

SEQ ID NO: 1953609 - RNA, 21 nt, Human
agaauagaacaacauauacaa

SEQ ID NO: 1953610 - RNA, 16 nt, Human
agaauagaugcugacu

SEQ ID NO: 1953611 - RNA, 20 nt, Human
agaauaugcaucuuaaaaug

SEQ ID NO: 1953612 - RNA, 23 nt, Human
agaaguuucugccgcagcccugc

SEQ ID NO: 1953613 - RNA, 22 nt, Human
agaaguuucugccgcagcccug

SEQ ID NO: 1953614 - RNA, 21 nt, Human
agaaguuucugccgcagcccu

SEQ ID NO: 1953615 - RNA, 20 nt, Human
agaaguggggacagagcaga

SEQ ID NO: 1953616 - RNA, 17 nt, Human
agaaguggacuggagga

SEQ ID NO: 1953617 - RNA, 12 nt, Human
ucugcuuuccuc

SEQ ID NO: 1953618 - RNA, 13 nt, Human
ucugcuuuccucu

SEQ ID NO: 1953619 - RNA, 18 nt, Human
ucugcuuuccucuuccug

SEQ ID NO: 1953620 - RNA, 12 nt, Human
ucugcuuuagac

SEQ ID NO: 1953621 - RNA, 16 nt, Human
ucugcuuuagacuuga

SEQ ID NO: 1953622 - RNA, 17 nt, Human
ucugcuuuagacuugaa

SEQ ID NO: 1953623 - RNA, 18 nt, Human
ucugcuuuagacuugaaa

SEQ ID NO: 1953624 - RNA, 19 nt, Human
ucugcuuuagacuugaaaa

SEQ ID NO: 1953625 - RNA, 15 nt, Human
agaaucccuguguua

SEQ ID NO: 1953626 - RNA, 17 nt, Human
agaaucccuguguuaau

SEQ ID NO: 1953627 - RNA, 18 nt, Human
agaaucccuguguuaauu

SEQ ID NO: 1953628 - RNA, 19 nt, Human
agaaucccuguguuaauuu

SEQ ID NO: 1953629 - RNA, 21 nt, Human
agaaucccuguguuaauuuaa

SEQ ID NO: 1953630 - RNA, 15 nt, Human
agaauguaaagcaac

SEQ ID NO: 1953631 - RNA, 12 nt, Human
agaauguaaagc

SEQ ID NO: 1953632 - RNA, 17 nt, Human
agaauggggcugggccc

SEQ ID NO: 1953633 - RNA, 14 nt, Human
agaauggugauuuu

SEQ ID NO: 1953634 - RNA, 16 nt, Human
agaauggugauuuuaa

SEQ ID NO: 1953635 - RNA, 18 nt, Human
agaauggugauuuuaaau

SEQ ID NO: 1953636 - RNA, 19 nt, Human
agaauggugauuuuaaaug

SEQ ID NO: 1953637 - RNA, 20 nt, Human
agaauggugauuuuaaaugu

SEQ ID NO: 1953638 - RNA, 21 nt, Human
agaauggugauuuuaaaugug

SEQ ID NO: 1953639 - RNA, 23 nt, Human
agaauggugauuuuaaaugugug

SEQ ID NO: 1953640 - RNA, 18 nt, Human
agaaucauguuucuuuga

SEQ ID NO: 1953641 - RNA, 19 nt, Human
agaaucauguuucuuugau

SEQ ID NO: 1953642 - RNA, 21 nt, Human
agaaucauguuucuuugauca

SEQ ID NO: 1953643 - RNA, 21 nt, Human
agaaucaugugcgucagucca

SEQ ID NO: 1953644 - RNA, 13 nt, Human
agaaucauguuuc

SEQ ID NO: 1953645 - RNA, 14 nt, Human
agaaucauguuucu

SEQ ID NO: 1953646 - RNA, 15 nt, Human
agaaucauguuucuu

SEQ ID NO: 1953647 - RNA, 16 nt, Human
agaaucauguuucuuu

SEQ ID NO: 1953648 - RNA, 13 nt, Human
agaaugucaguau

SEQ ID NO: 1953649 - RNA, 15 nt, Human
agaauguuuucaaau

SEQ ID NO: 1953650 - RNA, 21 nt, Human
agaauguuuucaaauguucuc

SEQ ID NO: 1953651 - RNA, 19 nt, Human
agaauguaagguauaucau

SEQ ID NO: 1953652 - RNA, 21 nt, Human
agaauguaagguauaucauuc

SEQ ID NO: 1953653 - RNA, 23 nt, Human
agaauguaagguauaucauucua

SEQ ID NO: 1953654 - RNA, 18 nt, Human
agaauguaguuugaggaa

SEQ ID NO: 1953655 - RNA, 14 nt, Human
agaauguaguuuga

SEQ ID NO: 1953656 - RNA, 23 nt, Human
agaauuaacacaugauccugcaa

SEQ ID NO: 1953657 - RNA, 15 nt, Human
agaauuaacacauga

SEQ ID NO: 1953658 - RNA, 14 nt, Human
ucugggagcuggag

SEQ ID NO: 1953659 - RNA, 19 nt, Human
ucugcccuccaagaccuuc

SEQ ID NO: 1953660 - RNA, 18 nt, Human
ucugcccuccaagaccuu

SEQ ID NO: 1953661 - RNA, 21 nt, Human
ucugcccacucccugcaaccu

SEQ ID NO: 1953662 - RNA, 18 nt, Human
ucugcccacucccugcaa

SEQ ID NO: 1953663 - RNA, 15 nt, Human
ucugccgcagcccug

SEQ ID NO: 1953664 - RNA, 14 nt, Human
ucugccgcagcccu

SEQ ID NO: 1953665 - RNA, 10 nt, Human
ucugcccugc

SEQ ID NO: 1953666 - RNA, 11 nt, Human
ucugcccugcg

SEQ ID NO: 1953667 - RNA, 12 nt, Human
ucugcccugcgg

SEQ ID NO: 1953668 - RNA, 12 nt, Human
ucugccugcccu

SEQ ID NO: 1953669 - RNA, 22 nt, Human
ucugccgcagcccugcagaggg

SEQ ID NO: 1953670 - RNA, 23 nt, Human
ucugccgcagcccugcagagggc

SEQ ID NO: 1953671 - RNA, 21 nt, Human
ucugccugcccaggccccugc

SEQ ID NO: 1953672 - RNA, 22 nt, Human
ucugccugcccaggccccugcc

SEQ ID NO: 1953673 - RNA, 15 nt, Human
ucugcuaaauugaug

SEQ ID NO: 1953674 - RNA, 17 nt, Human
ucugcuaaauugauguu

SEQ ID NO: 1953675 - RNA, 19 nt, Human
ucugcuaaauugauguuga

SEQ ID NO: 1953676 - RNA, 20 nt, Human
ucugcuaaauugauguugau

SEQ ID NO: 1953677 - RNA, 21 nt, Human
ucugcuaaauugauguugaug

SEQ ID NO: 1953678 - RNA, 19 nt, Human
ucugcucacauaucuguca

SEQ ID NO: 1953679 - RNA, 20 nt, Human
ucugcucacauaucugucau

SEQ ID NO: 1953680 - RNA, 15 nt, Human
ucugcuaaauuucaa

SEQ ID NO: 1953681 - RNA, 17 nt, Human
ucugcuaaauuucaaau

SEQ ID NO: 1953682 - RNA, 14 nt, Human
ucugcuucagccuc

SEQ ID NO: 1953683 - RNA, 15 nt, Human
ucugcuucagccucc

SEQ ID NO: 1953684 - RNA, 13 nt, Human
ucugcuucagccu

SEQ ID NO: 1953685 - RNA, 14 nt, Human
ucugcuccagcucu

SEQ ID NO: 1953686 - RNA, 15 nt, Human
ucugcuccagcucug

SEQ ID NO: 1953687 - RNA, 20 nt, Human
ucugcuccagcucuggcaug

SEQ ID NO: 1953688 - RNA, 12 nt, Human
agaagcccagaa

SEQ ID NO: 1953689 - RNA, 13 nt, Human
agaagcccagaau

SEQ ID NO: 1953690 - RNA, 11 nt, Human
agaagcccaga

SEQ ID NO: 1953691 - RNA, 18 nt, Human
agaagauuuugaaauuuu

SEQ ID NO: 1953692 - RNA, 17 nt, Human
ucugcccacucccugca

SEQ ID NO: 1953693 - RNA, 16 nt, Human
ucugcccacucccugc

SEQ ID NO: 1953694 - RNA, 22 nt, Human
agaagcccaggaaaggcuccag

SEQ ID NO: 1953695 - RNA, 21 nt, Human
agaagcccaggaaaggcucca

SEQ ID NO: 1953696 - RNA, 20 nt, Human
agaagcccaggaaaggcucc

SEQ ID NO: 1953697 - RNA, 18 nt, Human
agaagcccaggaaaggcu

SEQ ID NO: 1953698 - RNA, 16 nt, Human
agaagcccaggaaagg

SEQ ID NO: 1953699 - RNA, 12 nt, Human
agaagcccagga

SEQ ID NO: 1953700 - RNA, 14 nt, Human
agaagaaguguguc

SEQ ID NO: 1953701 - RNA, 18 nt, Human
agaagaaauaguucugug

SEQ ID NO: 1953702 - RNA, 15 nt, Human
agaagaaugcaugcu

SEQ ID NO: 1953703 - RNA, 22 nt, Human
agaagaaugcaugcuuuccaua

SEQ ID NO: 1953704 - RNA, 23 nt, Human
agaacugcuuucuuucguuuguu

SEQ ID NO: 1953705 - RNA, 18 nt, Human
agaacuuccccauacaaa

SEQ ID NO: 1953706 - RNA, 20 nt, Human
agaacuuccccauacaaaua

SEQ ID NO: 1953707 - RNA, 24 nt, Human
agaacuuccccauacaaauaagca

SEQ ID NO: 1953708 - RNA, 16 nt, Human
agaaauucuguuuuua

SEQ ID NO: 1953709 - RNA, 17 nt, Human
agaaauugcauuuccug

SEQ ID NO: 1953710 - RNA, 20 nt, Human
agaaauugcauuuccugaca

SEQ ID NO: 1953711 - RNA, 19 nt, Human
agaaauucuguuuuuaaaa

SEQ ID NO: 1953712 - RNA, 21 nt, Human
agaaauucuguuuuuaaaaau

SEQ ID NO: 1953713 - RNA, 21 nt, Human
ucugagacucgcgacaaugca

SEQ ID NO: 1953714 - RNA, 12 nt, Human
ucugagaaugaa

SEQ ID NO: 1953715 - RNA, 14 nt, Human
ucugagaaugaaca

SEQ ID NO: 1953716 - RNA, 16 nt, Human
ucugagaaugaacaaa

SEQ ID NO: 1953717 - RNA, 16 nt, Human
ucugacucuuccccag

SEQ ID NO: 1953718 - RNA, 13 nt, Human
ucugacugacaug

SEQ ID NO: 1953719 - RNA, 17 nt, Human
ucugaucauccacugug

SEQ ID NO: 1953720 - RNA, 21 nt, Human
ucugaucauccacugugccau

SEQ ID NO: 1953721 - RNA, 16 nt, Human
ucugaugcaagcaaga

SEQ ID NO: 1953722 - RNA, 18 nt, Human
ucugcagauaaacaguag

SEQ ID NO: 1953723 - RNA, 15 nt, Human
ucugcagauaaacag

SEQ ID NO: 1953724 - RNA, 17 nt, Human
ucugcagcaauaaagca

SEQ ID NO: 1953725 - RNA, 15 nt, Human
ucugcacuccccugc

SEQ ID NO: 1953726 - RNA, 14 nt, Human
ucugcacuccccug

SEQ ID NO: 1953727 - RNA, 16 nt, Human
ucugcacuccccugcu

SEQ ID NO: 1953728 - RNA, 17 nt, Human
ucugcacuccccugcug

SEQ ID NO: 1953729 - RNA, 21 nt, Human
ucugaugcaagcaagaaacac

SEQ ID NO: 1953730 - RNA, 14 nt, Human
agaaauguacagca

SEQ ID NO: 1953731 - RNA, 15 nt, Human
agaaauguacagcaa

SEQ ID NO: 1953732 - RNA, 12 nt, Human
ucugcagguccc

SEQ ID NO: 1953733 - RNA, 11 nt, Human
ucugcaggucc

SEQ ID NO: 1953734 - RNA, 13 nt, Human
ucugcaggucccu

SEQ ID NO: 1953735 - RNA, 15 nt, Human
ucugaauuauuuucu

SEQ ID NO: 1953736 - RNA, 13 nt, Human
ucugacacacagc

SEQ ID NO: 1953737 - RNA, 14 nt, Human
ucugacacacagcu

SEQ ID NO: 1953738 - RNA, 15 nt, Human
ucugacacacagcuc

SEQ ID NO: 1953739 - RNA, 19 nt, Human
ucugacucauauccccuau

SEQ ID NO: 1953740 - RNA, 10 nt, Human
ucugaauuau

SEQ ID NO: 1953741 - RNA, 22 nt, Human
ucugaaggacauugcggacagc

SEQ ID NO: 1953742 - RNA, 21 nt, Human
ucugaaggacauugcggacag

SEQ ID NO: 1953743 - RNA, 15 nt, Human
ucuccuuuguauucu

SEQ ID NO: 1953744 - RNA, 17 nt, Human
ucuccuuuguauucugu

SEQ ID NO: 1953745 - RNA, 22 nt, Human
ucuccuuuguauucugucuuca

SEQ ID NO: 1953746 - RNA, 16 nt, Human
ucuccuuucacaaccu

SEQ ID NO: 1953747 - RNA, 20 nt, Human
ucuccuuuagggacagcuua

SEQ ID NO: 1953748 - RNA, 14 nt, Human
agaaauauuuuaau

SEQ ID NO: 1953749 - RNA, 21 nt, Human
agaaauauuuuaauuuuuaaa

SEQ ID NO: 1953750 - RNA, 23 nt, Human
agaaauauuuuaauuuuuaaaug

SEQ ID NO: 1953751 - RNA, 17 nt, Human
agaaauauguauucugu

SEQ ID NO: 1953752 - RNA, 19 nt, Human
ucccuuuuuuggcugcuga

SEQ ID NO: 1953753 - RNA, 17 nt, Human
ucccuuuuuuggcugcu

SEQ ID NO: 1953754 - RNA, 19 nt, Human
ucccuuugacgccauccca

SEQ ID NO: 1953755 - RNA, 21 nt, Human
ucccuuugacgccaucccagc

SEQ ID NO: 1953756 - RNA, 22 nt, Human
ucccuuuuuuggcugcugaagg

SEQ ID NO: 1953757 - RNA, 20 nt, Human
ucccuuuuuuggcugcugaa

SEQ ID NO: 1953758 - RNA, 23 nt, Human
ucccuuuuuuggcugcugaaggc

SEQ ID NO: 1953759 - RNA, 13 nt, Human
ucccuuuuuuuaa

SEQ ID NO: 1953760 - RNA, 20 nt, Human
ucccuuggauuguccccgac

SEQ ID NO: 1953761 - RNA, 19 nt, Human
ucccuuggauuguccccga

SEQ ID NO: 1953762 - RNA, 23 nt, Human
ucccugguggcagcucaccucuc

SEQ ID NO: 1953763 - RNA, 22 nt, Human
ucccugguggcagcucaccucu

SEQ ID NO: 1953764 - RNA, 18 nt, Human
ucccuuugacgccauccc

SEQ ID NO: 1953765 - RNA, 16 nt, Human
ucccuuugacgccauc

SEQ ID NO: 1953766 - RNA, 21 nt, Human
ucccuuuuuuuaaguaaggaa

SEQ ID NO: 1953767 - RNA, 16 nt, Human
ucccuuuuuuuaagua

SEQ ID NO: 1953768 - RNA, 18 nt, Human
uccgguguuuaagacauu

SEQ ID NO: 1953769 - RNA, 13 nt, Human
uccuacucugugu

SEQ ID NO: 1953770 - RNA, 14 nt, Human
uccuacucuguguc

SEQ ID NO: 1953771 - RNA, 15 nt, Human
uccgguuuacuuuaa

SEQ ID NO: 1953772 - RNA, 16 nt, Human
uccgguuuacuuuaac

SEQ ID NO: 1953773 - RNA, 15 nt, Human
uccuacucuguguca

SEQ ID NO: 1953774 - RNA, 13 nt, Human
uccuacucuucuc

SEQ ID NO: 1953775 - RNA, 16 nt, Human
uccuacucuucucucu

SEQ ID NO: 1953776 - RNA, 21 nt, Human
uccuagcuggagaggagcccu

SEQ ID NO: 1953777 - RNA, 22 nt, Human
uccuagcuggagaggagcccug

SEQ ID NO: 1953778 - RNA, 23 nt, Human
uccuagcuggagaggagcccugc

SEQ ID NO: 1953779 - RNA, 24 nt, Human
uccuagcuggagaggagcccugcc

SEQ ID NO: 1953780 - RNA, 13 nt, Human
uccuaggcauuug

SEQ ID NO: 1953781 - RNA, 12 nt, Human
acuccuggccuc

SEQ ID NO: 1953782 - RNA, 13 nt, Human
acuccuggccuca

SEQ ID NO: 1953783 - RNA, 14 nt, Human
acuccuggccucaa

SEQ ID NO: 1953784 - RNA, 14 nt, Human
acuccugcaggcag

SEQ ID NO: 1953785 - RNA, 12 nt, Human
acuccugcaggc

SEQ ID NO: 1953786 - RNA, 12 nt, Human
acuccucccagg

SEQ ID NO: 1953787 - RNA, 16 nt, Human
acuccugcaggcagcc

SEQ ID NO: 1953788 - RNA, 15 nt, Human
acuccugcaggcagc

SEQ ID NO: 1953789 - RNA, 22 nt, Human
acuccugcaggcagccaggcca

SEQ ID NO: 1953790 - RNA, 21 nt, Human
ucccugguggcagcucaccuc

SEQ ID NO: 1953791 - RNA, 20 nt, Human
ucccugguggcagcucaccu

SEQ ID NO: 1953792 - RNA, 19 nt, Human
ucccugguggcagcucacc

SEQ ID NO: 1953793 - RNA, 18 nt, Human
ucccugguggcagcucac

SEQ ID NO: 1953794 - RNA, 17 nt, Human
ucccugguggcagcuca

SEQ ID NO: 1953795 - RNA, 16 nt, Human
ucccugguggcagcuc

SEQ ID NO: 1953796 - RNA, 10 nt, Human
acuccugcuc

SEQ ID NO: 1953797 - RNA, 13 nt, Human
acuccugcucugc

SEQ ID NO: 1953798 - RNA, 15 nt, Human
acuccugcucugcuc

SEQ ID NO: 1953799 - RNA, 16 nt, Human
acuccugcucugcucg

SEQ ID NO: 1953800 - RNA, 11 nt, Human
acuccuggccu

SEQ ID NO: 1953801 - RNA, 15 nt, Human
acucaccccagcccc

SEQ ID NO: 1953802 - RNA, 14 nt, Human
acucaccccagccc

SEQ ID NO: 1953803 - RNA, 16 nt, Human
acucaccccagcccca

SEQ ID NO: 1953804 - RNA, 13 nt, Human
acuccagaccccu

SEQ ID NO: 1953805 - RNA, 15 nt, Human
acuccagaccccugg

SEQ ID NO: 1953806 - RNA, 13 nt, Human
acucaccccagcc

SEQ ID NO: 1953807 - RNA, 13 nt, Human
acucacagccagc

SEQ ID NO: 1953808 - RNA, 18 nt, Human
acucacagccagcgaacu

SEQ ID NO: 1953809 - RNA, 22 nt, Human
acucacagccagcgaacugaca

SEQ ID NO: 1953810 - RNA, 19 nt, Human
acuccagugagacagcucu

SEQ ID NO: 1953811 - RNA, 18 nt, Human
acuccagaccccuggcuu

SEQ ID NO: 1953812 - RNA, 19 nt, Human
acuccagaccccuggcuuu

SEQ ID NO: 1953813 - RNA, 21 nt, Human
acuccagaccccuggcuuuuc

SEQ ID NO: 1953814 - RNA, 14 nt, Human
acucacaucuuuuu

SEQ ID NO: 1953815 - RNA, 22 nt, Human
acuccuaguagggguaccacug

SEQ ID NO: 1953816 - RNA, 14 nt, Human
acuccuaugcuuua

SEQ ID NO: 1953817 - RNA, 21 nt, Human
acucucugaaccccucccucc

SEQ ID NO: 1953818 - RNA, 19 nt, Human
acucucugaaccccucccu

SEQ ID NO: 1953819 - RNA, 19 nt, Human
acucucucuuguucuuacu

SEQ ID NO: 1953820 - RNA, 22 nt, Human
acucugagacucgcgacaaugc

SEQ ID NO: 1953821 - RNA, 11 nt, Human
acucugagacu

SEQ ID NO: 1953822 - RNA, 18 nt, Human
acucucugaaccccuccc

SEQ ID NO: 1953823 - RNA, 23 nt, Human
acucuccuuggugucgggcauga

SEQ ID NO: 1953824 - RNA, 16 nt, Human
acucuccuuggugucg

SEQ ID NO: 1953825 - RNA, 15 nt, Human
acucuggcagcucag

SEQ ID NO: 1953826 - RNA, 13 nt, Human
acucuggcagcuc

SEQ ID NO: 1953827 - RNA, 15 nt, Human
acucuggcagcaccg

SEQ ID NO: 1953828 - RNA, 20 nt, Human
acucuggcagcaccgccucu

SEQ ID NO: 1953829 - RNA, 17 nt, Human
acucuggauucagccuu

SEQ ID NO: 1953830 - RNA, 20 nt, Human
acucuggauucagccuucuu

SEQ ID NO: 1953831 - RNA, 21 nt, Human
acucuggauucagccuucuuu

SEQ ID NO: 1953832 - RNA, 16 nt, Human
acucugccuccucuuc

SEQ ID NO: 1953833 - RNA, 12 nt, Human
acucugccuccu

SEQ ID NO: 1953834 - RNA, 15 nt, Human
acucuccuugguguc

SEQ ID NO: 1953835 - RNA, 18 nt, Human
acucuccuggaaauauua

SEQ ID NO: 1953836 - RNA, 16 nt, Human
acucuccucugcugcu

SEQ ID NO: 1953837 - RNA, 14 nt, Human
acucuccucugcug

SEQ ID NO: 1953838 - RNA, 13 nt, Human
acucuccucugcu

SEQ ID NO: 1953839 - RNA, 12 nt, Human
acucuccucugc

SEQ ID NO: 1953840 - RNA, 17 nt, Human
acucuccuccagaguca

SEQ ID NO: 1953841 - RNA, 14 nt, Human
acucuccuccagag

SEQ ID NO: 1953842 - RNA, 24 nt, Human
acuccuugaaaacacuguucucug

SEQ ID NO: 1953843 - RNA, 23 nt, Human
acuccuugaaaacacuguucucu

SEQ ID NO: 1953844 - RNA, 12 nt, Human
uccucaggacca

SEQ ID NO: 1953845 - RNA, 21 nt, Human
uccucagggagcagggaaggc

SEQ ID NO: 1953846 - RNA, 23 nt, Human
uccucauacccacccccacccaa

SEQ ID NO: 1953847 - RNA, 22 nt, Human
uccucauaguaugguggcuggg

SEQ ID NO: 1953848 - RNA, 13 nt, Human
uccucccaggcgc

SEQ ID NO: 1953849 - RNA, 19 nt, Human
uccucccaggcgccccuuc

SEQ ID NO: 1953850 - RNA, 21 nt, Human
uccucccaggcgccccuuccc

SEQ ID NO: 1953851 - RNA, 22 nt, Human
acucuuggagccugcagagcug

SEQ ID NO: 1953852 - RNA, 23 nt, Human
acucuuggagccugcagagcugc

SEQ ID NO: 1953853 - RNA, 15 nt, Human
acucuuggagccugc

SEQ ID NO: 1953854 - RNA, 16 nt, Human
acucuuggagccugca

SEQ ID NO: 1953855 - RNA, 14 nt, Human
acucuuggagccug

SEQ ID NO: 1953856 - RNA, 22 nt, Human
acucuugaguuguuuuuguaua

SEQ ID NO: 1953857 - RNA, 15 nt, Human
acucuugaguuguuu

SEQ ID NO: 1953858 - RNA, 16 nt, Human
acucuugaguuguuuu

SEQ ID NO: 1953859 - RNA, 20 nt, Human
acucuugaguuguuuuugua

SEQ ID NO: 1953860 - RNA, 21 nt, Human
acucuugaguuguuuuuguau

SEQ ID NO: 1953861 - RNA, 19 nt, Human
acucuuauaucuauauuuu

SEQ ID NO: 1953862 - RNA, 12 nt, Human
acucuugacagc

SEQ ID NO: 1953863 - RNA, 15 nt, Human
acucuugacucuugc

SEQ ID NO: 1953864 - RNA, 15 nt, Human
acucuugaccucagg

SEQ ID NO: 1953865 - RNA, 16 nt, Human
acucuugaccucaggu

SEQ ID NO: 1953866 - RNA, 16 nt, Human
acucuuauaucuauau

SEQ ID NO: 1953867 - RNA, 17 nt, Human
acucuuauaucuauauu

SEQ ID NO: 1953868 - RNA, 18 nt, Human
acucuuauaucuauauuu

SEQ ID NO: 1953869 - RNA, 14 nt, Human
acucuugaccucag

SEQ ID NO: 1953870 - RNA, 22 nt, Human
acucuggcagcaccgccucuuc

SEQ ID NO: 1953871 - RNA, 18 nt, Human
acugagagccuuuuugaa

SEQ ID NO: 1953872 - RNA, 18 nt, Human
acugagagugaacaaauu

SEQ ID NO: 1953873 - RNA, 15 nt, Human
acugagagccuuuuu

SEQ ID NO: 1953874 - RNA, 16 nt, Human
acugagagagcgcagc

SEQ ID NO: 1953875 - RNA, 23 nt, Human
acugagacagcccgggcucugcc

SEQ ID NO: 1953876 - RNA, 22 nt, Human
acugagacagcccgggcucugc

SEQ ID NO: 1953877 - RNA, 21 nt, Human
acugagacagcccgggcucug

SEQ ID NO: 1953878 - RNA, 18 nt, Human
acugagacagcccgggcu

SEQ ID NO: 1953879 - RNA, 15 nt, Human
acugagacagcccgg

SEQ ID NO: 1953880 - RNA, 21 nt, Human
acugagaaauuuauaaacuuu

SEQ ID NO: 1953881 - RNA, 17 nt, Human
acugagaaauuuauaaa

SEQ ID NO: 1953882 - RNA, 12 nt, Human
acugagaaauuu

SEQ ID NO: 1953883 - RNA, 21 nt, Human
acugacugaggcaguuugagg

SEQ ID NO: 1953884 - RNA, 12 nt, Human
acugacucugga

SEQ ID NO: 1953885 - RNA, 21 nt, Human
acugacucuggaaaaggcaua

SEQ ID NO: 1953886 - RNA, 12 nt, Human
acugacugaggc

SEQ ID NO: 1953887 - RNA, 15 nt, Human
acugacugaggcagu

SEQ ID NO: 1953888 - RNA, 12 nt, Human
uccucuuuccau

SEQ ID NO: 1953889 - RNA, 11 nt, Human
uccucuuucca

SEQ ID NO: 1953890 - RNA, 14 nt, Human
uccucccucccucu

SEQ ID NO: 1953891 - RNA, 11 nt, Human
uccucccuccc

SEQ ID NO: 1953892 - RNA, 21 nt, Human
uccucuuuggucuacacugug

SEQ ID NO: 1953893 - RNA, 19 nt, Human
uccucuuuggucuacacug

SEQ ID NO: 1953894 - RNA, 19 nt, Human
uccucuuuccaucuacccu

SEQ ID NO: 1953895 - RNA, 15 nt, Human
uccucccucccagcu

SEQ ID NO: 1953896 - RNA, 13 nt, Human
uccucccucccag

SEQ ID NO: 1953897 - RNA, 22 nt, Human
uccucuuuggucuacacugugc

SEQ ID NO: 1953898 - RNA, 21 nt, Human
uccugaauuuuauuuuuuggg

SEQ ID NO: 1953899 - RNA, 15 nt, Human
uccugacaccccacu

SEQ ID NO: 1953900 - RNA, 16 nt, Human
uccugacaccccacuu

SEQ ID NO: 1953901 - RNA, 19 nt, Human
uccugacaccccacuuagc

SEQ ID NO: 1953902 - RNA, 20 nt, Human
acugaacucugacaacagac

SEQ ID NO: 1953903 - RNA, 16 nt, Human
acugaaccacuuguag

SEQ ID NO: 1953904 - RNA, 18 nt, Human
acugaaccacuuguagau

SEQ ID NO: 1953905 - RNA, 19 nt, Human
acugaaccacuuguagauu

SEQ ID NO: 1953906 - RNA, 20 nt, Human
acugaaccacuuguagauuu

SEQ ID NO: 1953907 - RNA, 21 nt, Human
acugaaccacuuguagauuug

SEQ ID NO: 1953908 - RNA, 22 nt, Human
acugaaccugggaaagagauuu

SEQ ID NO: 1953909 - RNA, 15 nt, Human
acucuuguuuccuua

SEQ ID NO: 1953910 - RNA, 15 nt, Human
acucuuuaacuugua

SEQ ID NO: 1953911 - RNA, 20 nt, Human
uccugacaccccacuuagcc

SEQ ID NO: 1953912 - RNA, 19 nt, Human
acucuuucuauuguuucuu

SEQ ID NO: 1953913 - RNA, 19 nt, Human
acucuuuaacuuguaauaa

SEQ ID NO: 1953914 - RNA, 21 nt, Human
acucuuuuccaaacacaggca

SEQ ID NO: 1953915 - RNA, 14 nt, Human
uccugcaggcagcc

SEQ ID NO: 1953916 - RNA, 13 nt, Human
uccugcaggcagc

SEQ ID NO: 1953917 - RNA, 12 nt, Human
uccugcaggcag

SEQ ID NO: 1953918 - RNA, 21 nt, Human
uccugcugcaguugccaguca

SEQ ID NO: 1953919 - RNA, 21 nt, Human
uccugcugccaguaccagccc

SEQ ID NO: 1953920 - RNA, 13 nt, Human
uccugcugccagu

SEQ ID NO: 1953921 - RNA, 13 nt, Human
uccugcuuccuca

SEQ ID NO: 1953922 - RNA, 14 nt, Human
uccugcuguuacau

SEQ ID NO: 1953923 - RNA, 14 nt, Human
uccugcgaggcuau

SEQ ID NO: 1953924 - RNA, 17 nt, Human
uccugcgaggcuaugag

SEQ ID NO: 1953925 - RNA, 15 nt, Human
uccugggagcuuuug

SEQ ID NO: 1953926 - RNA, 12 nt, Human
uccugggaguga

SEQ ID NO: 1953927 - RNA, 14 nt, Human
uccugggagugagc

SEQ ID NO: 1953928 - RNA, 17 nt, Human
uccugggagugagcugg

SEQ ID NO: 1953929 - RNA, 22 nt, Human
uccuggaauaucuccgucaacu

SEQ ID NO: 1953930 - RNA, 23 nt, Human
uccuggaagugcuaauuuugaaa

SEQ ID NO: 1953931 - RNA, 15 nt, Human
uccuggaaauauuaa

SEQ ID NO: 1953932 - RNA, 20 nt, Human
acugcacuccagccugggug

SEQ ID NO: 1953933 - RNA, 19 nt, Human
acugcacuccagccugggu

SEQ ID NO: 1953934 - RNA, 18 nt, Human
acugcacuccagccuggg

SEQ ID NO: 1953935 - RNA, 17 nt, Human
acugcacuccagccugg

SEQ ID NO: 1953936 - RNA, 14 nt, Human
acugcacguuuuca

SEQ ID NO: 1953937 - RNA, 14 nt, Human
acugcacuccagcc

SEQ ID NO: 1953938 - RNA, 21 nt, Human
acugcacuauagccuagguga

SEQ ID NO: 1953939 - RNA, 21 nt, Human
uccugaugcuucuucagagac

SEQ ID NO: 1953940 - RNA, 20 nt, Human
uccugaugcuucuucagaga

SEQ ID NO: 1953941 - RNA, 19 nt, Human
uccugaugcuucuucagag

SEQ ID NO: 1953942 - RNA, 14 nt, Human
uccugcacacgcuc

SEQ ID NO: 1953943 - RNA, 21 nt, Human
uccugcacacgcuccuuccuc

SEQ ID NO: 1953944 - RNA, 22 nt, Human
uccugcacacgcuccuuccucu

SEQ ID NO: 1953945 - RNA, 22 nt, Human
acugcacagugcaucucagccc

SEQ ID NO: 1953946 - RNA, 23 nt, Human
acugcacagugcaucucagccca

SEQ ID NO: 1953947 - RNA, 15 nt, Human
acugcacaugauuuc

SEQ ID NO: 1953948 - RNA, 16 nt, Human
acugcacaugauuuca

SEQ ID NO: 1953949 - RNA, 17 nt, Human
acugcacaugauuucac

SEQ ID NO: 1953950 - RNA, 18 nt, Human
acugcacaugauuucaca

SEQ ID NO: 1953951 - RNA, 19 nt, Human
acugcacaugauuucacaa

SEQ ID NO: 1953952 - RNA, 20 nt, Human
acugcacaugauuucacaaa

SEQ ID NO: 1953953 - RNA, 21 nt, Human
acugcacaugauuucacaaau

SEQ ID NO: 1953954 - RNA, 22 nt, Human
acugcacaugauuucacaaaua

SEQ ID NO: 1953955 - RNA, 23 nt, Human
acugcacaugauuucacaaauau

SEQ ID NO: 1953956 - RNA, 16 nt, Human
acugcaccgggccaca

SEQ ID NO: 1953957 - RNA, 20 nt, Human
acugcacuauagccuaggug

SEQ ID NO: 1953958 - RNA, 14 nt, Human
acugcaccgggcca

SEQ ID NO: 1953959 - RNA, 13 nt, Human
acugauaaagaug

SEQ ID NO: 1953960 - RNA, 21 nt, Human
acugauaaagaugagugagca

SEQ ID NO: 1953961 - RNA, 16 nt, Human
acugagcagugauauu

SEQ ID NO: 1953962 - RNA, 20 nt, Human
acugcaacuuguaaaugugg

SEQ ID NO: 1953963 - RNA, 19 nt, Human
acugauauauuuaaaaaca

SEQ ID NO: 1953964 - RNA, 17 nt, Human
acguggcugcuucaagg

SEQ ID NO: 1953965 - RNA, 18 nt, Human
acguggcugcuucaagga

SEQ ID NO: 1953966 - RNA, 15 nt, Human
acgucagauguuuaa

SEQ ID NO: 1953967 - RNA, 17 nt, Human
acgucagauguuuaaaa

SEQ ID NO: 1953968 - RNA, 18 nt, Human
acgucagauguuuaaaac

SEQ ID NO: 1953969 - RNA, 20 nt, Human
acgucagauguuuaaaacac

SEQ ID NO: 1953970 - RNA, 22 nt, Human
acgucauaggaaguuagccuuu

SEQ ID NO: 1953971 - RNA, 21 nt, Human
acguggcugcuucaaggaucc

SEQ ID NO: 1953972 - RNA, 19 nt, Human
acguggcugcuucaaggau

SEQ ID NO: 1953973 - RNA, 15 nt, Human
acguuucuaaaggcu

SEQ ID NO: 1953974 - RNA, 16 nt, Human
acguuucuaaaggcua

SEQ ID NO: 1953975 - RNA, 14 nt, Human
acguugugcauuug

SEQ ID NO: 1953976 - RNA, 15 nt, Human
acguugugcauuugg

SEQ ID NO: 1953977 - RNA, 13 nt, Human
acguugugcauuu

SEQ ID NO: 1953978 - RNA, 15 nt, Human
acguuaccaggcagg

SEQ ID NO: 1953979 - RNA, 18 nt, Human
acguaaugaaacuuggau

SEQ ID NO: 1953980 - RNA, 15 nt, Human
acguacaaguaguuc

SEQ ID NO: 1953981 - RNA, 16 nt, Human
acguacaaguaguucu

SEQ ID NO: 1953982 - RNA, 17 nt, Human
acguacaaguaguucug

SEQ ID NO: 1953983 - RNA, 22 nt, Human
acguacaaguaguucuguauuu

SEQ ID NO: 1953984 - RNA, 24 nt, Human
acguacaaguaguucuguauuuga

SEQ ID NO: 1953985 - RNA, 18 nt, Human
acguacaaguaguucugu

SEQ ID NO: 1953986 - RNA, 19 nt, Human
acguacaaguaguucugua

SEQ ID NO: 1953987 - RNA, 20 nt, Human
acguacaaguaguucuguau

SEQ ID NO: 1953988 - RNA, 21 nt, Human
acguacaaguaguucuguauu

SEQ ID NO: 1953989 - RNA, 12 nt, Human
uccauccugagg

SEQ ID NO: 1953990 - RNA, 15 nt, Human
uccauccugaggcuc

SEQ ID NO: 1953991 - RNA, 19 nt, Human
uccauccugaggcuccacu

SEQ ID NO: 1953992 - RNA, 23 nt, Human
acuacacgguucaaaccugugaa

SEQ ID NO: 1953993 - RNA, 16 nt, Human
ucccacuuuugccaga

SEQ ID NO: 1953994 - RNA, 16 nt, Human
ucccagauacuugggg

SEQ ID NO: 1953995 - RNA, 20 nt, Human
ucccagagcucccucugccc

SEQ ID NO: 1953996 - RNA, 18 nt, Human
ucccagauacuugggggg

SEQ ID NO: 1953997 - RNA, 19 nt, Human
acguuugguucaaaugugu

SEQ ID NO: 1953998 - RNA, 12 nt, Human
acguuuuaagga

SEQ ID NO: 1953999 - RNA, 14 nt, Human
acguuuuaaggacu

SEQ ID NO: 1954000 - RNA, 18 nt, Human
acguuuuaaggacugacu

SEQ ID NO: 1954001 - RNA, 22 nt, Human
acguuucuaaaggcuaccuuug

SEQ ID NO: 1954002 - RNA, 16 nt, Human
acguugggacagggag

SEQ ID NO: 1954003 - RNA, 11 nt, Human
acuaaauguua

SEQ ID NO: 1954004 - RNA, 12 nt, Human
acuaaauguuaa

SEQ ID NO: 1954005 - RNA, 13 nt, Human
acuaaauguuaaa

SEQ ID NO: 1954006 - RNA, 14 nt, Human
acuaaauguuaaag

SEQ ID NO: 1954007 - RNA, 15 nt, Human
acuaaauguuaaaga

SEQ ID NO: 1954008 - RNA, 23 nt, Human
acuaauuuugcaugcguauuuau

SEQ ID NO: 1954009 - RNA, 15 nt, Human
acuaauuuuaaaaug

SEQ ID NO: 1954010 - RNA, 18 nt, Human
acuaaauguuaaagaugu

SEQ ID NO: 1954011 - RNA, 19 nt, Human
acuaaauguuaaagaugua

SEQ ID NO: 1954012 - RNA, 20 nt, Human
acuaacaaaguuuucaugug

SEQ ID NO: 1954013 - RNA, 21 nt, Human
uccccaggaggccagccuuga

SEQ ID NO: 1954014 - RNA, 20 nt, Human
uccccaggaggccagccuug

SEQ ID NO: 1954015 - RNA, 12 nt, Human
uccccagggcac

SEQ ID NO: 1954016 - RNA, 13 nt, Human
uccccagggcacg

SEQ ID NO: 1954017 - RNA, 21 nt, Human
uccccagggcacgugguugag

SEQ ID NO: 1954018 - RNA, 11 nt, Human
ucccccagccc

SEQ ID NO: 1954019 - RNA, 15 nt, Human
ucccccagccccauc

SEQ ID NO: 1954020 - RNA, 13 nt, Human
ucccccagcccca

SEQ ID NO: 1954021 - RNA, 16 nt, Human
ucccccagccccaucc

SEQ ID NO: 1954022 - RNA, 19 nt, Human
acuagacucccaagcugga

SEQ ID NO: 1954023 - RNA, 20 nt, Human
acuacuguucagcuuuuauu

SEQ ID NO: 1954024 - RNA, 19 nt, Human
acuacugaccagacaagcu

SEQ ID NO: 1954025 - RNA, 18 nt, Human
acuacugggacucuucag

SEQ ID NO: 1954026 - RNA, 15 nt, Human
ucccagcuccacccc

SEQ ID NO: 1954027 - RNA, 14 nt, Human
ucccagcuccaccc

SEQ ID NO: 1954028 - RNA, 16 nt, Human
ucccagcuaccucaac

SEQ ID NO: 1954029 - RNA, 12 nt, Human
uccccacccuga

SEQ ID NO: 1954030 - RNA, 23 nt, Human
ucccauuuagaauggugauuuua

SEQ ID NO: 1954031 - RNA, 15 nt, Human
ucccauuuagaaugg

SEQ ID NO: 1954032 - RNA, 21 nt, Human
ucccauuuagaauggugauuu

SEQ ID NO: 1954033 - RNA, 18 nt, Human
uccccaggaggccagccu

SEQ ID NO: 1954034 - RNA, 16 nt, Human
uccccaccgcagacag

SEQ ID NO: 1954035 - RNA, 15 nt, Human
uccccaccgcagaca

SEQ ID NO: 1954036 - RNA, 23 nt, Human
uccccacccugaaagcccugagc

SEQ ID NO: 1954037 - RNA, 17 nt, Human
acuauguugcccaggca

SEQ ID NO: 1954038 - RNA, 15 nt, Human
acuauguugcccagg

SEQ ID NO: 1954039 - RNA, 16 nt, Human
acuauguugcccaggc

SEQ ID NO: 1954040 - RNA, 22 nt, Human
acuauggcccuggccuagcaua

SEQ ID NO: 1954041 - RNA, 14 nt, Human
acuauguugcccag

SEQ ID NO: 1954042 - RNA, 16 nt, Human
acucaaugcacugaca

SEQ ID NO: 1954043 - RNA, 19 nt, Human
acucaaugugugccgagcc

SEQ ID NO: 1954044 - RNA, 18 nt, Human
acuauagccuaggugaca

SEQ ID NO: 1954045 - RNA, 19 nt, Human
acuagagggaccucuccca

SEQ ID NO: 1954046 - RNA, 18 nt, Human
acuagagggaccucuccc

SEQ ID NO: 1954047 - RNA, 20 nt, Human
acuauagccuaggugacaga

SEQ ID NO: 1954048 - RNA, 22 nt, Human
acuauagccuaggugacagagu

SEQ ID NO: 1954049 - RNA, 21 nt, Human
acuaucuaaauguugaaagau

SEQ ID NO: 1954050 - RNA, 16 nt, Human
acuaucuaaauguuga

SEQ ID NO: 1954051 - RNA, 16 nt, Human
uccagucuaucauugu

SEQ ID NO: 1954052 - RNA, 22 nt, Human
uccaguccccagaacucugccu

SEQ ID NO: 1954053 - RNA, 16 nt, Human
uccaguccccagaacu

SEQ ID NO: 1954054 - RNA, 21 nt, Human
uccaguccccagaacucugcc

SEQ ID NO: 1954055 - RNA, 13 nt, Human
uccagucaggcuc

SEQ ID NO: 1954056 - RNA, 20 nt, Human
uccagucaggcucucugggc

SEQ ID NO: 1954057 - RNA, 14 nt, Human
uccagucauuaugu

SEQ ID NO: 1954058 - RNA, 15 nt, Human
uccagucauuauguu

SEQ ID NO: 1954059 - RNA, 21 nt, Human
uccagucauuauguuaauauu

SEQ ID NO: 1954060 - RNA, 23 nt, Human
uccagucauuauguuaauauuuc

SEQ ID NO: 1954061 - RNA, 12 nt, Human
uccaguccccag

SEQ ID NO: 1954062 - RNA, 14 nt, Human
uccaguccccagaa

SEQ ID NO: 1954063 - RNA, 15 nt, Human
uccaguccccagaac

SEQ ID NO: 1954064 - RNA, 18 nt, Human
uccaguaucuugaagacu

SEQ ID NO: 1954065 - RNA, 16 nt, Human
uccaguaucuugaaga

SEQ ID NO: 1954066 - RNA, 12 nt, Human
uccagucaggcu

SEQ ID NO: 1954067 - RNA, 14 nt, Human
uccaguauuuuagu

SEQ ID NO: 1954068 - RNA, 22 nt, Human
uccaguaagaucacuguuuaga

SEQ ID NO: 1954069 - RNA, 18 nt, Human
uccagugagacagcucug

SEQ ID NO: 1954070 - RNA, 15 nt, Human
uccagugaggcucug

SEQ ID NO: 1954071 - RNA, 16 nt, Human
uccagugaggcucugc

SEQ ID NO: 1954072 - RNA, 23 nt, Human
uccagugaggcucugcccuuggu

SEQ ID NO: 1954073 - RNA, 22 nt, Human
uccagugaggcucugcccuugg

SEQ ID NO: 1954074 - RNA, 16 nt, Human
acggcucacugcagcc

SEQ ID NO: 1954075 - RNA, 17 nt, Human
acggcucacugcagccu

SEQ ID NO: 1954076 - RNA, 18 nt, Human
acggcucacugcagccuc

SEQ ID NO: 1954077 - RNA, 12 nt, Human
acggccaggcca

SEQ ID NO: 1954078 - RNA, 22 nt, Human
acggauccugcacugacucugg

SEQ ID NO: 1954079 - RNA, 23 nt, Human
acggauccugcacugacucugga

SEQ ID NO: 1954080 - RNA, 23 nt, Human
uccaguaagaucacuguuuagau

SEQ ID NO: 1954081 - RNA, 15 nt, Human
uccaguaucuugaag

SEQ ID NO: 1954082 - RNA, 14 nt, Human
uccaguaucuugaa

SEQ ID NO: 1954083 - RNA, 18 nt, Human
acggcuuuuacuuaaacc

SEQ ID NO: 1954084 - RNA, 23 nt, Human
acggagucccaccuuggcugcag

SEQ ID NO: 1954085 - RNA, 17 nt, Human
acgcuggagugcaguga

SEQ ID NO: 1954086 - RNA, 18 nt, Human
acgcuggagugcagugag

SEQ ID NO: 1954087 - RNA, 20 nt, Human
acgcuggaccuugaacuggg

SEQ ID NO: 1954088 - RNA, 23 nt, Human
acgcuggaccuugaacuggguac

SEQ ID NO: 1954089 - RNA, 15 nt, Human
acgcuggagugcagu

SEQ ID NO: 1954090 - RNA, 16 nt, Human
acgcuggagugcagug

SEQ ID NO: 1954091 - RNA, 11 nt, Human
acgcucucugg

SEQ ID NO: 1954092 - RNA, 14 nt, Human
acgcucucuggccu

SEQ ID NO: 1954093 - RNA, 13 nt, Human
acgcuggaccuug

SEQ ID NO: 1954094 - RNA, 14 nt, Human
acgcuccuuccucu

SEQ ID NO: 1954095 - RNA, 15 nt, Human
acgcuccuuccucug

SEQ ID NO: 1954096 - RNA, 14 nt, Human
acgcuccuuucuga

SEQ ID NO: 1954097 - RNA, 20 nt, Human
acgcuccuuucugaucuuca

SEQ ID NO: 1954098 - RNA, 17 nt, Human
acgccuagccucacgcu

SEQ ID NO: 1954099 - RNA, 21 nt, Human
acgaauauugcugauggugca

SEQ ID NO: 1954100 - RNA, 12 nt, Human
acgccugccuuu

SEQ ID NO: 1954101 - RNA, 21 nt, Human
acgcuacccgggaagggggcu

SEQ ID NO: 1954102 - RNA, 17 nt, Human
accuuuguccccaccgc

SEQ ID NO: 1954103 - RNA, 18 nt, Human
accuuugacaaagguaaa

SEQ ID NO: 1954104 - RNA, 17 nt, Human
accuuugacaaagguaa

SEQ ID NO: 1954105 - RNA, 18 nt, Human
accuuuguccccaccgca

SEQ ID NO: 1954106 - RNA, 22 nt, Human
accuuuguuugcaucugaaaau

SEQ ID NO: 1954107 - RNA, 20 nt, Human
ucauucccucgucuuuccca

SEQ ID NO: 1954108 - RNA, 19 nt, Human
ucauucccucgucuuuccc

SEQ ID NO: 1954109 - RNA, 19 nt, Human
accuugaaaacuuuaugcu

SEQ ID NO: 1954110 - RNA, 20 nt, Human
accuuucuauaauuuuacaa

SEQ ID NO: 1954111 - RNA, 15 nt, Human
accuugaacugaagg

SEQ ID NO: 1954112 - RNA, 20 nt, Human
accuugaacuggguacuugu

SEQ ID NO: 1954113 - RNA, 13 nt, Human
accuuuuuuauac

SEQ ID NO: 1954114 - RNA, 16 nt, Human
accuuuuuauuucaaa

SEQ ID NO: 1954115 - RNA, 22 nt, Human
uccacugguucuucuuggucuc

SEQ ID NO: 1954116 - RNA, 22 nt, Human
uccagaauguauagacaggaaa

SEQ ID NO: 1954117 - RNA, 18 nt, Human
uccagaauggucuuucua

SEQ ID NO: 1954118 - RNA, 21 nt, Human
uccacugugccaugugccagg

SEQ ID NO: 1954119 - RNA, 17 nt, Human
uccacugggguggccug

SEQ ID NO: 1954120 - RNA, 18 nt, Human
uccacugggguggccuga

SEQ ID NO: 1954121 - RNA, 11 nt, Human
uccagccuggg

SEQ ID NO: 1954122 - RNA, 22 nt, Human
uccagccuggaaaccugucuga

SEQ ID NO: 1954123 - RNA, 13 nt, Human
uccagccugccac

SEQ ID NO: 1954124 - RNA, 20 nt, Human
uccagccugcugccugcuuu

SEQ ID NO: 1954125 - RNA, 20 nt, Human
uccagcccugaguuccuagc

SEQ ID NO: 1954126 - RNA, 22 nt, Human
uccagcccugaguuccuagcca

SEQ ID NO: 1954127 - RNA, 13 nt, Human
uccagaccccugg

SEQ ID NO: 1954128 - RNA, 15 nt, Human
uccagaauuucccaa

SEQ ID NO: 1954129 - RNA, 14 nt, Human
uccagaauuuccca

SEQ ID NO: 1954130 - RNA, 10 nt, Human
uccaggcucc

SEQ ID NO: 1954131 - RNA, 21 nt, Human
uccaggcugggagagccuucc

SEQ ID NO: 1954132 - RNA, 20 nt, Human
uccaggcugggagagccuuc

SEQ ID NO: 1954133 - RNA, 12 nt, Human
uccaggcuccuu

SEQ ID NO: 1954134 - RNA, 22 nt, Human
uccaggcuccuuuagcgcccag

SEQ ID NO: 1954135 - RNA, 23 nt, Human
uccaggcugggagagccuuccag

SEQ ID NO: 1954136 - RNA, 18 nt, Human
acgaauauugcugauggu

SEQ ID NO: 1954137 - RNA, 15 nt, Human
acgaauauugcugau

SEQ ID NO: 1954138 - RNA, 15 nt, Human
ucauauuuucaugcu

SEQ ID NO: 1954139 - RNA, 22 nt, Human
ucauauuuguacuuucuguuaa

SEQ ID NO: 1954140 - RNA, 16 nt, Human
ucauauuuuaauuuca

SEQ ID NO: 1954141 - RNA, 17 nt, Human
ucauauuuuaauuucaa

SEQ ID NO: 1954142 - RNA, 21 nt, Human
ucauauuuuaauuucaagcuu

SEQ ID NO: 1954143 - RNA, 20 nt, Human
ucauauuuuaaacagaggau

SEQ ID NO: 1954144 - RNA, 14 nt, Human
ucauauuuguacuu

SEQ ID NO: 1954145 - RNA, 19 nt, Human
ucauauuuguacuuucugu

SEQ ID NO: 1954146 - RNA, 16 nt, Human
accgagucucuucucc

SEQ ID NO: 1954147 - RNA, 17 nt, Human
accgagucucuucucca

SEQ ID NO: 1954148 - RNA, 23 nt, Human
ucauauuuacuucuuauacauuu

SEQ ID NO: 1954149 - RNA, 15 nt, Human
ucauauuuacuucuu

SEQ ID NO: 1954150 - RNA, 21 nt, Human
ucauauugguauauccuuuuc

SEQ ID NO: 1954151 - RNA, 22 nt, Human
ucauauugguauauccuuuucu

SEQ ID NO: 1954152 - RNA, 13 nt, Human
ucauauuuaauau

SEQ ID NO: 1954153 - RNA, 16 nt, Human
ucauauauuuuaugaa

SEQ ID NO: 1954154 - RNA, 22 nt, Human
ucauauauuuuaugaaucagaa

SEQ ID NO: 1954155 - RNA, 18 nt, Human
ucauauccccuauuuaac

SEQ ID NO: 1954156 - RNA, 16 nt, Human
ucauaaauuuaugguu

SEQ ID NO: 1954157 - RNA, 13 nt, Human
ucauaaauucaaa

SEQ ID NO: 1954158 - RNA, 14 nt, Human
ucauaaccuagccu

SEQ ID NO: 1954159 - RNA, 15 nt, Human
ucauaguaugguggc

SEQ ID NO: 1954160 - RNA, 24 nt, Human
ucauaaauucaaaccuaaguugcu

SEQ ID NO: 1954161 - RNA, 20 nt, Human
ucauaguagaacuuuauaaa

SEQ ID NO: 1954162 - RNA, 18 nt, Human
ucauaguaugguggcugg

SEQ ID NO: 1954163 - RNA, 19 nt, Human
ucauaguaugguggcuggg

SEQ ID NO: 1954164 - RNA, 21 nt, Human
ucauaguaugguggcuggguu

SEQ ID NO: 1954165 - RNA, 17 nt, Human
ucauaguuuuauuuaua

SEQ ID NO: 1954166 - RNA, 15 nt, Human
ucauaguuuuauuua

SEQ ID NO: 1954167 - RNA, 16 nt, Human
ucauaguuuuauuuau

SEQ ID NO: 1954168 - RNA, 18 nt, Human
ucauauaagauucauauu

SEQ ID NO: 1954169 - RNA, 15 nt, Human
ucagugccuuaugga

SEQ ID NO: 1954170 - RNA, 14 nt, Human
ucagugccuuaugg

SEQ ID NO: 1954171 - RNA, 12 nt, Human
ucagugccuuau

SEQ ID NO: 1954172 - RNA, 11 nt, Human
ucagugccuua

SEQ ID NO: 1954173 - RNA, 10 nt, Human
ucagugccuu

SEQ ID NO: 1954174 - RNA, 9 nt, Human
ucagugccu

SEQ ID NO: 1954175 - RNA, 20 nt, Human
ucagugcccuccaggauaga

SEQ ID NO: 1954176 - RNA, 23 nt, Human
ucagugccccgucuacagcuccc

SEQ ID NO: 1954177 - RNA, 22 nt, Human
ucaguaguuugcauuucagaaa

SEQ ID NO: 1954178 - RNA, 19 nt, Human
ucaguaguuugcauuucag

SEQ ID NO: 1954179 - RNA, 20 nt, Human
ucaguaguuugcauuucaga

SEQ ID NO: 1954180 - RNA, 21 nt, Human
ucaguaguuugcauuucagaa

SEQ ID NO: 1954181 - RNA, 13 nt, Human
ucaguauccaggc

SEQ ID NO: 1954182 - RNA, 17 nt, Human
ucaguauccaggcuuug

SEQ ID NO: 1954183 - RNA, 19 nt, Human
accgaaaacguggcugcuu

SEQ ID NO: 1954184 - RNA, 17 nt, Human
accgaaaacguggcugc

SEQ ID NO: 1954185 - RNA, 14 nt, Human
ucaguauguggaag

SEQ ID NO: 1954186 - RNA, 16 nt, Human
ucaguauguggaagug

SEQ ID NO: 1954187 - RNA, 12 nt, Human
ucaguaugugga

SEQ ID NO: 1954188 - RNA, 16 nt, Human
ucagugccaaaaacaa

SEQ ID NO: 1954189 - RNA, 12 nt, Human
ucagugccacua

SEQ ID NO: 1954190 - RNA, 16 nt, Human
ucaguggggaggggcu

SEQ ID NO: 1954191 - RNA, 12 nt, Human
ucaguggcagcu

SEQ ID NO: 1954192 - RNA, 18 nt, Human
ucagugccuuauggaaca

SEQ ID NO: 1954193 - RNA, 16 nt, Human
ucagugccuuauggaa

SEQ ID NO: 1954194 - RNA, 11 nt, Human
ucaguggcagc

SEQ ID NO: 1954195 - RNA, 15 nt, Human
ucaguuuuucuuaau

SEQ ID NO: 1954196 - RNA, 17 nt, Human
ucaguuuuugugaaaag

SEQ ID NO: 1954197 - RNA, 15 nt, Human
ucaguuuuugugaaa

SEQ ID NO: 1954198 - RNA, 20 nt, Human
accucccacaaaggagagcu

SEQ ID NO: 1954199 - RNA, 22 nt, Human
accuccauguggacuuaggaag

SEQ ID NO: 1954200 - RNA, 21 nt, Human
accucacucagaaguccagag

SEQ ID NO: 1954201 - RNA, 14 nt, Human
accucacucagcac

SEQ ID NO: 1954202 - RNA, 15 nt, Human
accucacucagcacc

SEQ ID NO: 1954203 - RNA, 16 nt, Human
accucacucagcacca

SEQ ID NO: 1954204 - RNA, 17 nt, Human
accucacucagcaccac

SEQ ID NO: 1954205 - RNA, 19 nt, Human
accucacucagcaccacuc

SEQ ID NO: 1954206 - RNA, 20 nt, Human
accucacucagcaccacuca

SEQ ID NO: 1954207 - RNA, 22 nt, Human
accucacucagcaccacucaag

SEQ ID NO: 1954208 - RNA, 13 nt, Human
accuccucuccug

SEQ ID NO: 1954209 - RNA, 14 nt, Human
accuccucuccuga

SEQ ID NO: 1954210 - RNA, 15 nt, Human
accuccccuugccag

SEQ ID NO: 1954211 - RNA, 16 nt, Human
accuccccuugccagc

SEQ ID NO: 1954212 - RNA, 17 nt, Human
accuccccuugccagcu

SEQ ID NO: 1954213 - RNA, 19 nt, Human
accuccccuugccagcugc

SEQ ID NO: 1954214 - RNA, 21 nt, Human
accucacgugcaaagccacca

SEQ ID NO: 1954215 - RNA, 12 nt, Human
accuagaaaaca

SEQ ID NO: 1954216 - RNA, 16 nt, Human
accgcagacaggacca

SEQ ID NO: 1954217 - RNA, 12 nt, Human
accgcagacagg

SEQ ID NO: 1954218 - RNA, 17 nt, Human
accgcagacaggaccag

SEQ ID NO: 1954219 - RNA, 17 nt, Human
ucauguuuacagaggac

SEQ ID NO: 1954220 - RNA, 11 nt, Human
ucauguuucuu

SEQ ID NO: 1954221 - RNA, 12 nt, Human
ucauguuucuuu

SEQ ID NO: 1954222 - RNA, 14 nt, Human
ucauguuucuuuga

SEQ ID NO: 1954223 - RNA, 15 nt, Human
ucauguuucuuugau

SEQ ID NO: 1954224 - RNA, 21 nt, Human
ucauguuucuuugaucaugaa

SEQ ID NO: 1954225 - RNA, 22 nt, Human
ucaugugggccacacaagugca

SEQ ID NO: 1954226 - RNA, 23 nt, Human
ucaugcaaacuuuauuuuguguu

SEQ ID NO: 1954227 - RNA, 17 nt, Human
ucaugcagaguauuucu

SEQ ID NO: 1954228 - RNA, 21 nt, Human
ucaugcagaguauuucuaaag

SEQ ID NO: 1954229 - RNA, 16 nt, Human
ucaugcagguuagaaa

SEQ ID NO: 1954230 - RNA, 16 nt, Human
ucaugugaaaucauuc

SEQ ID NO: 1954231 - RNA, 17 nt, Human
ucaugugaaaucauuca

SEQ ID NO: 1954232 - RNA, 13 nt, Human
ucauccauccagg

SEQ ID NO: 1954233 - RNA, 23 nt, Human
ucauccuuucacuucuuucccuu

SEQ ID NO: 1954234 - RNA, 13 nt, Human
ucaucuaggauuu

SEQ ID NO: 1954235 - RNA, 16 nt, Human
ucaugaaagauucaau

SEQ ID NO: 1954236 - RNA, 17 nt, Human
ucaugaaagauucaaug

SEQ ID NO: 1954237 - RNA, 18 nt, Human
ucaugaaaugcuauguca

SEQ ID NO: 1954238 - RNA, 20 nt, Human
ucaugaaaugcuaugucauu

SEQ ID NO: 1954239 - RNA, 21 nt, Human
ucaugaaaugcuaugucauuu

SEQ ID NO: 1954240 - RNA, 15 nt, Human
ucaugaaauuacccu

SEQ ID NO: 1954241 - RNA, 14 nt, Human
ucaugcaaacuuua

SEQ ID NO: 1954242 - RNA, 11 nt, Human
ucaugauuuuu

SEQ ID NO: 1954243 - RNA, 13 nt, Human
ucagcccucccug

SEQ ID NO: 1954244 - RNA, 14 nt, Human
ucagcccucccugc

SEQ ID NO: 1954245 - RNA, 15 nt, Human
ucagcccucccugcc

SEQ ID NO: 1954246 - RNA, 16 nt, Human
ucagcccucccugccc

SEQ ID NO: 1954247 - RNA, 19 nt, Human
acccaggagccccgaggcc

SEQ ID NO: 1954248 - RNA, 23 nt, Human
acccaggagccccgaggccuucu

SEQ ID NO: 1954249 - RNA, 17 nt, Human
ucagcccucccugcccc

SEQ ID NO: 1954250 - RNA, 17 nt, Human
accccacacacgccaga

SEQ ID NO: 1954251 - RNA, 13 nt, Human
accccagccccaa

SEQ ID NO: 1954252 - RNA, 22 nt, Human
accccagccccaaaacucuccu

SEQ ID NO: 1954253 - RNA, 12 nt, Human
accccagccuca

SEQ ID NO: 1954254 - RNA, 17 nt, Human
ucagauuugccuuauug

SEQ ID NO: 1954255 - RNA, 15 nt, Human
ucagauuugcacaaa

SEQ ID NO: 1954256 - RNA, 16 nt, Human
ucagauuugcacaaaa

SEQ ID NO: 1954257 - RNA, 19 nt, Human
ucagauuugcacaaaaaga

SEQ ID NO: 1954258 - RNA, 20 nt, Human
ucagauuugcacaaaaagau

SEQ ID NO: 1954259 - RNA, 22 nt, Human
ucagauuugccuuauuggcagc

SEQ ID NO: 1954260 - RNA, 21 nt, Human
ucagccagaagccacccaaag

SEQ ID NO: 1954261 - RNA, 15 nt, Human
ucagccacugaggga

SEQ ID NO: 1954262 - RNA, 15 nt, Human
ucagcaaaagaugcu

SEQ ID NO: 1954263 - RNA, 18 nt, Human
accaguguuguggauuua

SEQ ID NO: 1954264 - RNA, 21 nt, Human
ucagauuugaacucuucaauc

SEQ ID NO: 1954265 - RNA, 14 nt, Human
ucagauuugcacaa

SEQ ID NO: 1954266 - RNA, 12 nt, Human
ucagauuugaac

SEQ ID NO: 1954267 - RNA, 15 nt, Human
accccuggaccccag

SEQ ID NO: 1954268 - RNA, 17 nt, Human
accccuggaccccagcc

SEQ ID NO: 1954269 - RNA, 16 nt, Human
accccuggugguucac

SEQ ID NO: 1954270 - RNA, 18 nt, Human
accccuggcuuuucacug

SEQ ID NO: 1954271 - RNA, 19 nt, Human
accccuggcuuuucacugc

SEQ ID NO: 1954272 - RNA, 20 nt, Human
accccuggcuuuucacugcu

SEQ ID NO: 1954273 - RNA, 21 nt, Human
accccuggcuuuucacugcug

SEQ ID NO: 1954274 - RNA, 12 nt, Human
ucagccuucuuu

SEQ ID NO: 1954275 - RNA, 15 nt, Human
ucagccuucuuuuuc

SEQ ID NO: 1954276 - RNA, 18 nt, Human
ucagccuucuuuuucugg

SEQ ID NO: 1954277 - RNA, 19 nt, Human
ucagccuucuuuuucugga

SEQ ID NO: 1954278 - RNA, 12 nt, Human
ucagcucaugga

SEQ ID NO: 1954279 - RNA, 12 nt, Human
ucagcuccagcu

SEQ ID NO: 1954280 - RNA, 14 nt, Human
ucagcguuuugcaa

SEQ ID NO: 1954281 - RNA, 19 nt, Human
ucagcggggacagcuccuu

SEQ ID NO: 1954282 - RNA, 20 nt, Human
ucagcggggacagcuccuuc

SEQ ID NO: 1954283 - RNA, 21 nt, Human
ucagcggggacagcuccuucu

SEQ ID NO: 1954284 - RNA, 23 nt, Human
ucagcggggacagcuccuucugu

SEQ ID NO: 1954285 - RNA, 18 nt, Human
accccauccuccagggcu

SEQ ID NO: 1954286 - RNA, 18 nt, Human
accccaucucuacaaaaa

SEQ ID NO: 1954287 - RNA, 20 nt, Human
accccagccucaaauccagg

SEQ ID NO: 1954288 - RNA, 21 nt, Human
accccagccucaaauccagga

SEQ ID NO: 1954289 - RNA, 15 nt, Human
accccugagcuugca

SEQ ID NO: 1954290 - RNA, 22 nt, Human
accccugcaguuccccuggaag

SEQ ID NO: 1954291 - RNA, 16 nt, Human
accccugcccagauca

SEQ ID NO: 1954292 - RNA, 11 nt, Human
accccugcccc

SEQ ID NO: 1954293 - RNA, 14 nt, Human
accccucgcccagu

SEQ ID NO: 1954294 - RNA, 18 nt, Human
accccucgcccaguccca

SEQ ID NO: 1954295 - RNA, 19 nt, Human
accccucgcccagucccag

SEQ ID NO: 1954296 - RNA, 22 nt, Human
accccucgcccagucccagcag

SEQ ID NO: 1954297 - RNA, 23 nt, Human
accccucgcccagucccagcagc

SEQ ID NO: 1954298 - RNA, 24 nt, Human
accccucgcccagucccagcagcc

SEQ ID NO: 1954299 - RNA, 12 nt, Human
accccuggaccc

SEQ ID NO: 1954300 - RNA, 14 nt, Human
accccuggacccca

SEQ ID NO: 1954301 - RNA, 20 nt, Human
ucaggccaggcccucugccc

SEQ ID NO: 1954302 - RNA, 22 nt, Human
ucaggccaggcccucugcccac

SEQ ID NO: 1954303 - RNA, 21 nt, Human
ucaggccaggcccucugccca

SEQ ID NO: 1954304 - RNA, 14 nt, Human
ucagcuccagcuca

SEQ ID NO: 1954305 - RNA, 15 nt, Human
ucagcuccagcucac

SEQ ID NO: 1954306 - RNA, 21 nt, Human
ucagcuuguaaauagcucagg

SEQ ID NO: 1954307 - RNA, 22 nt, Human
ucagcuuguaaauagcucaggu

SEQ ID NO: 1954308 - RNA, 23 nt, Human
ucaggccaggcccucugcccacu

SEQ ID NO: 1954309 - RNA, 19 nt, Human
ucagggucccugguggcag

SEQ ID NO: 1954310 - RNA, 16 nt, Human
ucaggguuggccccug

SEQ ID NO: 1954311 - RNA, 23 nt, Human
ucagguaacaggcagauacagga

SEQ ID NO: 1954312 - RNA, 21 nt, Human
ucagguaacaggcagauacag

SEQ ID NO: 1954313 - RNA, 22 nt, Human
ucagguaacaggcagauacagg

SEQ ID NO: 1954314 - RNA, 14 nt, Human
acccggccccugcu

SEQ ID NO: 1954315 - RNA, 18 nt, Human
acccggaggggccuggca

SEQ ID NO: 1954316 - RNA, 21 nt, Human
acccggaggggccuggcagcc

SEQ ID NO: 1954317 - RNA, 15 nt, Human
acccggccccugcug

SEQ ID NO: 1954318 - RNA, 16 nt, Human
acccggccccugcugg

SEQ ID NO: 1954319 - RNA, 22 nt, Human
acccggccccugcugguucagg

SEQ ID NO: 1954320 - RNA, 17 nt, Human
acccggccccugcuggu

SEQ ID NO: 1954321 - RNA, 20 nt, Human
acccggccccugcugguuca

SEQ ID NO: 1954322 - RNA, 13 nt, Human
acccgggaagggg

SEQ ID NO: 1954323 - RNA, 12 nt, Human
acccgggaaggg

SEQ ID NO: 1954324 - RNA, 17 nt, Human
acccgggaggcagaggu

SEQ ID NO: 1954325 - RNA, 23 nt, Human
acccuuguggucccaccccacac

SEQ ID NO: 1954326 - RNA, 20 nt, Human
acccuuguggucccacccca

SEQ ID NO: 1954327 - RNA, 17 nt, Human
acccuugccgucuaccu

SEQ ID NO: 1954328 - RNA, 19 nt, Human
acccuuucuacuuccaaga

SEQ ID NO: 1954329 - RNA, 15 nt, Human
accgaaaacguggcu

SEQ ID NO: 1954330 - RNA, 13 nt, Human
acccuuguuccag

SEQ ID NO: 1954331 - RNA, 21 nt, Human
acccuuuccagguucugaaag

SEQ ID NO: 1954332 - RNA, 18 nt, Human
acccuuucuacuuccaag

SEQ ID NO: 1954333 - RNA, 15 nt, Human
acccugcccuguggg

SEQ ID NO: 1954334 - RNA, 17 nt, Human
acccugaggcccagagg

SEQ ID NO: 1954335 - RNA, 16 nt, Human
acccugaggcccagag

SEQ ID NO: 1954336 - RNA, 15 nt, Human
acccugaggcccaga

SEQ ID NO: 1954337 - RNA, 22 nt, Human
acccugcccugugggcccccaa

SEQ ID NO: 1954338 - RNA, 17 nt, Human
acccugcccugugggcc

SEQ ID NO: 1954339 - RNA, 13 nt, Human
acccugaaaugug

SEQ ID NO: 1954340 - RNA, 14 nt, Human
acccugaaaugugu

SEQ ID NO: 1954341 - RNA, 15 nt, Human
acccugaaaugugug

SEQ ID NO: 1954342 - RNA, 23 nt, Human
acccugaacaacgagccuuuuca

SEQ ID NO: 1954343 - RNA, 11 nt, Human
acccugaaaug

SEQ ID NO: 1954344 - RNA, 12 nt, Human
acccugaaaugu

SEQ ID NO: 1954345 - RNA, 14 nt, Human
acccugaggcccag

SEQ ID NO: 1954346 - RNA, 18 nt, Human
acccugaaagcccugagc

SEQ ID NO: 1954347 - RNA, 16 nt, Human
acccugaaagcccuga

SEQ ID NO: 1954348 - RNA, 14 nt, Human
acccgguccccacu

SEQ ID NO: 1954349 - RNA, 14 nt, Human
acccgguucagugu

SEQ ID NO: 1954350 - RNA, 22 nt, Human
acccgguucaguguuucugggg

SEQ ID NO: 1954351 - RNA, 19 nt, Human
acauguccaagaagcccag

SEQ ID NO: 1954352 - RNA, 15 nt, Human
acauguccaagaagc

SEQ ID NO: 1954353 - RNA, 23 nt, Human
acauguaauuaaguacuauguau

SEQ ID NO: 1954354 - RNA, 15 nt, Human
acauguaauuugugu

SEQ ID NO: 1954355 - RNA, 14 nt, Human
acauuccugaacag

SEQ ID NO: 1954356 - RNA, 15 nt, Human
acauuccugaacagg

SEQ ID NO: 1954357 - RNA, 14 nt, Human
acauuccugaugcu

SEQ ID NO: 1954358 - RNA, 18 nt, Human
acauucuauuucaacuuc

SEQ ID NO: 1954359 - RNA, 13 nt, Human
acauucucaguuu

SEQ ID NO: 1954360 - RNA, 14 nt, Human
acauucucaguuuu

SEQ ID NO: 1954361 - RNA, 15 nt, Human
acauucucaguuuuu

SEQ ID NO: 1954362 - RNA, 17 nt, Human
acauucucaguuuuucu

SEQ ID NO: 1954363 - RNA, 19 nt, Human
acauucucaguuuuucuua

SEQ ID NO: 1954364 - RNA, 14 nt, Human
ucaaccagcagaug

SEQ ID NO: 1954365 - RNA, 12 nt, Human
ucaaccacaaaa

SEQ ID NO: 1954366 - RNA, 14 nt, Human
ucaaccacaaaacu

SEQ ID NO: 1954367 - RNA, 15 nt, Human
ucaaccauuccccau

SEQ ID NO: 1954368 - RNA, 18 nt, Human
ucaaccauuccccauggg

SEQ ID NO: 1954369 - RNA, 20 nt, Human
ucaacugcaucaagauguga

SEQ ID NO: 1954370 - RNA, 21 nt, Human
ucaacaacauuccucaaaaug

SEQ ID NO: 1954371 - RNA, 21 nt, Human
ucaacaaggcaaaaacaaaga

SEQ ID NO: 1954372 - RNA, 16 nt, Human
ucaacaaggcuugcug

SEQ ID NO: 1954373 - RNA, 20 nt, Human
ucaacaaggcuugcugcaga

SEQ ID NO: 1954374 - RNA, 17 nt, Human
ucaaccaaugccaaaaa

SEQ ID NO: 1954375 - RNA, 20 nt, Human
ucaaccaaaugguacaaaac

SEQ ID NO: 1954376 - RNA, 14 nt, Human
ucaaccaaauggua

SEQ ID NO: 1954377 - RNA, 16 nt, Human
ucaaccaaaugguaca

SEQ ID NO: 1954378 - RNA, 17 nt, Human
ucaaccaaaugguacaa

SEQ ID NO: 1954379 - RNA, 18 nt, Human
ucaaccaaaugguacaaa

SEQ ID NO: 1954380 - RNA, 17 nt, Human
ucaacauuucucauguu

SEQ ID NO: 1954381 - RNA, 13 nt, Human
ucaaccaaauggu

SEQ ID NO: 1954382 - RNA, 13 nt, Human
ucaaauuucuaaa

SEQ ID NO: 1954383 - RNA, 22 nt, Human
acauggcuggagcuagaauuug

SEQ ID NO: 1954384 - RNA, 22 nt, Human
acaugcuuguugacagagagag

SEQ ID NO: 1954385 - RNA, 13 nt, Human
acaugcuuuguga

SEQ ID NO: 1954386 - RNA, 12 nt, Human
acauggaacagu

SEQ ID NO: 1954387 - RNA, 18 nt, Human
acaugggacuaugcuuuu

SEQ ID NO: 1954388 - RNA, 20 nt, Human
acaugggacuaugcuuuucu

SEQ ID NO: 1954389 - RNA, 17 nt, Human
acaugggacuaugcuuu

SEQ ID NO: 1954390 - RNA, 22 nt, Human
acauguaauuaaguacuaugua

SEQ ID NO: 1954391 - RNA, 21 nt, Human
acauguaauuaaguacuaugu

SEQ ID NO: 1954392 - RNA, 19 nt, Human
acauguaauuaaguacuau

SEQ ID NO: 1954393 - RNA, 17 nt, Human
acauguaauuaaguacu

SEQ ID NO: 1954394 - RNA, 11 nt, Human
acauggugaug

SEQ ID NO: 1954395 - RNA, 15 nt, Human
acauguaauuaagua

SEQ ID NO: 1954396 - RNA, 20 nt, Human
acaugcuuguguuucuuagu

SEQ ID NO: 1954397 - RNA, 23 nt, Human
acaugagguacugagagugaaca

SEQ ID NO: 1954398 - RNA, 15 nt, Human
acaugcuacacacug

SEQ ID NO: 1954399 - RNA, 21 nt, Human
acaugcuacacacugcauguu

SEQ ID NO: 1954400 - RNA, 15 nt, Human
acagucagguugaag

SEQ ID NO: 1954401 - RNA, 16 nt, Human
acagucagguugaaga

SEQ ID NO: 1954402 - RNA, 12 nt, Human
acagucccugcc

SEQ ID NO: 1954403 - RNA, 20 nt, Human
acaugaauauuuaguguuca

SEQ ID NO: 1954404 - RNA, 20 nt, Human
acaugagguacugagaguga

SEQ ID NO: 1954405 - RNA, 13 nt, Human
acauuuucucuua

SEQ ID NO: 1954406 - RNA, 16 nt, Human
acauuuucucuuagaa

SEQ ID NO: 1954407 - RNA, 17 nt, Human
acauuuucucuuagaaa

SEQ ID NO: 1954408 - RNA, 18 nt, Human
acauuuucucuuagaaaa

SEQ ID NO: 1954409 - RNA, 17 nt, Human
acauuuucuuaauccag

SEQ ID NO: 1954410 - RNA, 18 nt, Human
acauuuuauuuuauuaug

SEQ ID NO: 1954411 - RNA, 14 nt, Human
acauuuuauuuuau

SEQ ID NO: 1954412 - RNA, 19 nt, Human
acauuuuauuuuauuaugc

SEQ ID NO: 1954413 - RNA, 20 nt, Human
acauuuuauuuuauuaugca

SEQ ID NO: 1954414 - RNA, 16 nt, Human
acauugauuugauuuu

SEQ ID NO: 1954415 - RNA, 19 nt, Human
acauugcauauaacuuaua

SEQ ID NO: 1954416 - RNA, 21 nt, Human
acauuuuuaagugcugcauuu

SEQ ID NO: 1954417 - RNA, 22 nt, Human
acauuuuuaagugcugcauuua

SEQ ID NO: 1954418 - RNA, 23 nt, Human
acauuuuuaagugcugcauuuaa

SEQ ID NO: 1954419 - RNA, 19 nt, Human
acauuuuuaagugcugcau

SEQ ID NO: 1954420 - RNA, 14 nt, Human
acauuuuuuaaaug

SEQ ID NO: 1954421 - RNA, 16 nt, Human
acauuuuuuaaaugca

SEQ ID NO: 1954422 - RNA, 17 nt, Human
acauuuuuuaaaugcac

SEQ ID NO: 1954423 - RNA, 21 nt, Human
acauuuuuuaaaugcaccugg

SEQ ID NO: 1954424 - RNA, 16 nt, Human
accaaaaguuauuaaa

SEQ ID NO: 1954425 - RNA, 18 nt, Human
accaaaaguuauuaaaau

SEQ ID NO: 1954426 - RNA, 19 nt, Human
accaaaaguuauuaaaauu

SEQ ID NO: 1954427 - RNA, 13 nt, Human
accaaaauaagaa

SEQ ID NO: 1954428 - RNA, 15 nt, Human
accaaaauaagaaaa

SEQ ID NO: 1954429 - RNA, 16 nt, Human
accaaaauaagaaaag

SEQ ID NO: 1954430 - RNA, 17 nt, Human
accaaaauaagaaaaga

SEQ ID NO: 1954431 - RNA, 18 nt, Human
accaaaauaagaaaagau

SEQ ID NO: 1954432 - RNA, 22 nt, Human
accaaaaguuauuaaaauuguu

SEQ ID NO: 1954433 - RNA, 13 nt, Human
accaaagaagaaa

SEQ ID NO: 1954434 - RNA, 14 nt, Human
accaaaccuucuga

SEQ ID NO: 1954435 - RNA, 15 nt, Human
accaaacucccauca

SEQ ID NO: 1954436 - RNA, 18 nt, Human
accaaacuggaucacugg

SEQ ID NO: 1954437 - RNA, 12 nt, Human
accaaagaagaa

SEQ ID NO: 1954438 - RNA, 19 nt, Human
accaaacccacccuuucua

SEQ ID NO: 1954439 - RNA, 20 nt, Human
accaaacccacccuuucuac

SEQ ID NO: 1954440 - RNA, 22 nt, Human
accaaacccacccuuucuacuu

SEQ ID NO: 1954441 - RNA, 21 nt, Human
accaaaauuugggguauuuau

SEQ ID NO: 1954442 - RNA, 19 nt, Human
ucaaucuggauucauauuu

SEQ ID NO: 1954443 - RNA, 22 nt, Human
ucaaucucguauagaagucuuc

SEQ ID NO: 1954444 - RNA, 24 nt, Human
ucaaucucguauagaagucuucau

SEQ ID NO: 1954445 - RNA, 17 nt, Human
ucaaucucguauagaag

SEQ ID NO: 1954446 - RNA, 18 nt, Human
ucaaucucguauagaagu

SEQ ID NO: 1954447 - RNA, 20 nt, Human
ucaaucucguauagaagucu

SEQ ID NO: 1954448 - RNA, 21 nt, Human
ucaaucucguauagaagucuu

SEQ ID NO: 1954449 - RNA, 16 nt, Human
ucaaucucguauagaa

SEQ ID NO: 1954450 - RNA, 23 nt, Human
ucaaugaaugaaugaauggcuaa

SEQ ID NO: 1954451 - RNA, 17 nt, Human
ucaaugaacaagcauuc

SEQ ID NO: 1954452 - RNA, 14 nt, Human
acauucuuuuugcu

SEQ ID NO: 1954453 - RNA, 18 nt, Human
acauucuuuuugcucuaa

SEQ ID NO: 1954454 - RNA, 19 nt, Human
acauucuuuuugcucuaaa

SEQ ID NO: 1954455 - RNA, 23 nt, Human
acauucuuuuugcucuaaaauau

SEQ ID NO: 1954456 - RNA, 15 nt, Human
ucaauauauuuguau

SEQ ID NO: 1954457 - RNA, 13 nt, Human
ucaauaguaauau

SEQ ID NO: 1954458 - RNA, 14 nt, Human
ucaauaguaauaua

SEQ ID NO: 1954459 - RNA, 22 nt, Human
ucaauaucuuuuuuuuaauaaa

SEQ ID NO: 1954460 - RNA, 14 nt, Human
ucaacuucaggaaa

SEQ ID NO: 1954461 - RNA, 22 nt, Human
ucaaguccucuuuucugagagg

SEQ ID NO: 1954462 - RNA, 19 nt, Human
accagcuuggcucaggcug

SEQ ID NO: 1954463 - RNA, 20 nt, Human
accagcuuggcucaggcuga

SEQ ID NO: 1954464 - RNA, 15 nt, Human
accagcuuugacccg

SEQ ID NO: 1954465 - RNA, 18 nt, Human
accagcuguguccggccc

SEQ ID NO: 1954466 - RNA, 13 nt, Human
accagcugugucc

SEQ ID NO: 1954467 - RNA, 17 nt, Human
accacuacauucuguua

SEQ ID NO: 1954468 - RNA, 16 nt, Human
accacuacauucuguu

SEQ ID NO: 1954469 - RNA, 13 nt, Human
accaccagaagcc

SEQ ID NO: 1954470 - RNA, 15 nt, Human
accacuacauucugu

SEQ ID NO: 1954471 - RNA, 22 nt, Human
accagcgugugacuacuccccc

SEQ ID NO: 1954472 - RNA, 14 nt, Human
ucacgugcaaagcc

SEQ ID NO: 1954473 - RNA, 17 nt, Human
ucacgucauaggaaguu

SEQ ID NO: 1954474 - RNA, 14 nt, Human
ucacgucauaggaa

SEQ ID NO: 1954475 - RNA, 16 nt, Human
ucacgucauaggaagu

SEQ ID NO: 1954476 - RNA, 13 nt, Human
ucacuaaacucug

SEQ ID NO: 1954477 - RNA, 22 nt, Human
ucacuaagaacaaaagaagcag

SEQ ID NO: 1954478 - RNA, 16 nt, Human
ucacuaggcuucuggu

SEQ ID NO: 1954479 - RNA, 18 nt, Human
ucacuacagguuaaaaga

SEQ ID NO: 1954480 - RNA, 23 nt, Human
ucacuugaacccgggaggcagag

SEQ ID NO: 1954481 - RNA, 21 nt, Human
ucacuguuuagauuugccaua

SEQ ID NO: 1954482 - RNA, 15 nt, Human
ucacuguuuagauuu

SEQ ID NO: 1954483 - RNA, 16 nt, Human
ucacuguuuagauuug

SEQ ID NO: 1954484 - RNA, 17 nt, Human
ucacuguuuagauuugc

SEQ ID NO: 1954485 - RNA, 13 nt, Human
ucacuguuuagau

SEQ ID NO: 1954486 - RNA, 12 nt, Human
ucacuguuuaga

SEQ ID NO: 1954487 - RNA, 10 nt, Human
ucacuugagu

SEQ ID NO: 1954488 - RNA, 18 nt, Human
accaguacauucucaguu

SEQ ID NO: 1954489 - RNA, 20 nt, Human
accagucuuucaacucauug

SEQ ID NO: 1954490 - RNA, 15 nt, Human
accaguguuguggau

SEQ ID NO: 1954491 - RNA, 17 nt, Human
accaguguuguggauuu

SEQ ID NO: 1954492 - RNA, 16 nt, Human
ucacugagacagcccg

SEQ ID NO: 1954493 - RNA, 19 nt, Human
ucacuaucccggcugcccu

SEQ ID NO: 1954494 - RNA, 20 nt, Human
ucacuaucccggcugcccuu

SEQ ID NO: 1954495 - RNA, 21 nt, Human
ucacugagacagcccgggcuc

SEQ ID NO: 1954496 - RNA, 17 nt, Human
ucacugagacagcccgg

SEQ ID NO: 1954497 - RNA, 22 nt, Human
ucacugagacagcccgggcucu

SEQ ID NO: 1954498 - RNA, 14 nt, Human
ucacugcagccuca

SEQ ID NO: 1954499 - RNA, 23 nt, Human
ucacuguugcccaggcuggcgug

SEQ ID NO: 1954500 - RNA, 16 nt, Human
ucacuguggugucugu

SEQ ID NO: 1954501 - RNA, 12 nt, Human
ucacuguguaua

SEQ ID NO: 1954502 - RNA, 14 nt, Human
ucacuguguauauu

SEQ ID NO: 1954503 - RNA, 15 nt, Human
ucacuguguauauuu

SEQ ID NO: 1954504 - RNA, 17 nt, Human
ucacuguguauauuuga

SEQ ID NO: 1954505 - RNA, 18 nt, Human
ucacuguguauauuugau

SEQ ID NO: 1954506 - RNA, 19 nt, Human
ucacuguguauauuugauu

SEQ ID NO: 1954507 - RNA, 21 nt, Human
ucacuguguauauuugauuua

SEQ ID NO: 1954508 - RNA, 15 nt, Human
ucacugcagccucaa

SEQ ID NO: 1954509 - RNA, 14 nt, Human
ucacugcagccucc

SEQ ID NO: 1954510 - RNA, 22 nt, Human
ucacugcagccuccgcuucccu

SEQ ID NO: 1954511 - RNA, 23 nt, Human
ucacugcagccuccgcuucccug

SEQ ID NO: 1954512 - RNA, 13 nt, Human
ucacugcauccuc

SEQ ID NO: 1954513 - RNA, 15 nt, Human
accaccacacccagc

SEQ ID NO: 1954514 - RNA, 20 nt, Human
accaccacacccagcccacu

SEQ ID NO: 1954515 - RNA, 24 nt, Human
accacauuggagauguuuaguaau

SEQ ID NO: 1954516 - RNA, 19 nt, Human
accaccaacuacuaccugu

SEQ ID NO: 1954517 - RNA, 18 nt, Human
accacaugugcacaugca

SEQ ID NO: 1954518 - RNA, 21 nt, Human
accacaguguaccauuaaaau

SEQ ID NO: 1954519 - RNA, 17 nt, Human
accacaucuugcucugc

SEQ ID NO: 1954520 - RNA, 15 nt, Human
accacaggugcccgc

SEQ ID NO: 1954521 - RNA, 18 nt, Human
accacaucuugcucugcu

SEQ ID NO: 1954522 - RNA, 19 nt, Human
accacaucuugcucugcug

SEQ ID NO: 1954523 - RNA, 12 nt, Human
accacagcuccu

SEQ ID NO: 1954524 - RNA, 15 nt, Human
accacagcuccuuuu

SEQ ID NO: 1954525 - RNA, 17 nt, Human
accacagcuccuuuucc

SEQ ID NO: 1954526 - RNA, 21 nt, Human
accacagcuccuuuuccagag

SEQ ID NO: 1954527 - RNA, 20 nt, Human
ucacagcuaugcaaaaagcu

SEQ ID NO: 1954528 - RNA, 19 nt, Human
ucaccauguuggccaggcu

SEQ ID NO: 1954529 - RNA, 22 nt, Human
ucaccauguuggccaggcuggu

SEQ ID NO: 1954530 - RNA, 21 nt, Human
ucaccauucguacauaauacu

SEQ ID NO: 1954531 - RNA, 16 nt, Human
ucaccauuuccccagg

SEQ ID NO: 1954532 - RNA, 17 nt, Human
ucaccauuuccccaggg

SEQ ID NO: 1954533 - RNA, 19 nt, Human
ucaccauuuccccagggca

SEQ ID NO: 1954534 - RNA, 20 nt, Human
ucaccauuuccccagggcac

SEQ ID NO: 1954535 - RNA, 16 nt, Human
ucacccaccagacuuu

SEQ ID NO: 1954536 - RNA, 20 nt, Human
ucacaguucucuccuucuuc

SEQ ID NO: 1954537 - RNA, 16 nt, Human
ucacaguucucuccuu

SEQ ID NO: 1954538 - RNA, 13 nt, Human
ucacagccucuga

SEQ ID NO: 1954539 - RNA, 23 nt, Human
ucacagcaagucacuggccagug

SEQ ID NO: 1954540 - RNA, 23 nt, Human
ucacagaugugugauucacagug

SEQ ID NO: 1954541 - RNA, 21 nt, Human
ucacagaugugugauucacag

SEQ ID NO: 1954542 - RNA, 20 nt, Human
ucacagaugggugcuuggag

SEQ ID NO: 1954543 - RNA, 14 nt, Human
ucacaaccuucugu

SEQ ID NO: 1954544 - RNA, 19 nt, Human
ucaauuucaauuuugucug

SEQ ID NO: 1954545 - RNA, 17 nt, Human
ucacaaaggaugcccaa

SEQ ID NO: 1954546 - RNA, 16 nt, Human
accaaagcgaauuuua

SEQ ID NO: 1954547 - RNA, 16 nt, Human
ucaauucuugccaaau

SEQ ID NO: 1954548 - RNA, 22 nt, Human
aauauugaauuuuuauuuuuga

SEQ ID NO: 1954549 - RNA, 20 nt, Human
aauauugaaaggcaaacauu

SEQ ID NO: 1954550 - RNA, 21 nt, Human
aauauuugaauguaugcuuca

SEQ ID NO: 1954551 - RNA, 23 nt, Human
aauauuugaauguaugcuucaua

SEQ ID NO: 1954552 - RNA, 14 nt, Human
aauauuugaaugua

SEQ ID NO: 1954553 - RNA, 15 nt, Human
aauauuuaauguuga

SEQ ID NO: 1954554 - RNA, 12 nt, Human
aauauuuagugu

SEQ ID NO: 1954555 - RNA, 13 nt, Human
aauauuuaauguu

SEQ ID NO: 1954556 - RNA, 14 nt, Human
aauauuuaauguug

SEQ ID NO: 1954557 - RNA, 22 nt, Human
aauaugcacacauuuuuuaaau

SEQ ID NO: 1954558 - RNA, 17 nt, Human
aauaugcacuaagucuc

SEQ ID NO: 1954559 - RNA, 18 nt, Human
aauaugcacuaagucucu

SEQ ID NO: 1954560 - RNA, 16 nt, Human
aauaugcacacauuuu

SEQ ID NO: 1954561 - RNA, 17 nt, Human
aauaugcacacauuuuu

SEQ ID NO: 1954562 - RNA, 15 nt, Human
uaagagaaaugagcu

SEQ ID NO: 1954563 - RNA, 21 nt, Human
aauauucucuguacauauuag

SEQ ID NO: 1954564 - RNA, 17 nt, Human
aauauucucuguacaua

SEQ ID NO: 1954565 - RNA, 18 nt, Human
aauauucucuguacauau

SEQ ID NO: 1954566 - RNA, 14 nt, Human
aauauucucuguac

SEQ ID NO: 1954567 - RNA, 15 nt, Human
aauauucucuguaca

SEQ ID NO: 1954568 - RNA, 15 nt, Human
aauauuccugcauuu

SEQ ID NO: 1954569 - RNA, 19 nt, Human
aauauucauaguagaacuu

SEQ ID NO: 1954570 - RNA, 20 nt, Human
aauaugcacuaagucucuuu

SEQ ID NO: 1954571 - RNA, 22 nt, Human
aauaugcacuaagucucuuuuu

SEQ ID NO: 1954572 - RNA, 18 nt, Human
uaagcacacuugacauca

SEQ ID NO: 1954573 - RNA, 13 nt, Human
uaagcaacaauuu

SEQ ID NO: 1954574 - RNA, 16 nt, Human
uaagcaacaauuuuca

SEQ ID NO: 1954575 - RNA, 18 nt, Human
uaagcaacaauuuucaga

SEQ ID NO: 1954576 - RNA, 21 nt, Human
uaagcagaauuggaaaagacu

SEQ ID NO: 1954577 - RNA, 22 nt, Human
uaagcuguuacugucuucagua

SEQ ID NO: 1954578 - RNA, 17 nt, Human
uaagcagaauuggaaaa

SEQ ID NO: 1954579 - RNA, 21 nt, Human
uaagcacuuuuuaaaaaacuu

SEQ ID NO: 1954580 - RNA, 13 nt, Human
uaagcacuuuuua

SEQ ID NO: 1954581 - RNA, 15 nt, Human
uaagcacuuuuuaaa

SEQ ID NO: 1954582 - RNA, 16 nt, Human
uaagcacuuuuuaaaa

SEQ ID NO: 1954583 - RNA, 17 nt, Human
aauauuugugugcuaaa

SEQ ID NO: 1954584 - RNA, 21 nt, Human
aauauuugugugcuaaacgug

SEQ ID NO: 1954585 - RNA, 14 nt, Human
uaagauuccagaga

SEQ ID NO: 1954586 - RNA, 21 nt, Human
uaagauuccagagaguggcuc

SEQ ID NO: 1954587 - RNA, 18 nt, Human
aaucagguccugcucagc

SEQ ID NO: 1954588 - RNA, 19 nt, Human
uaagaugaucaucuaauuu

SEQ ID NO: 1954589 - RNA, 16 nt, Human
uaacuucauaagcaaa

SEQ ID NO: 1954590 - RNA, 13 nt, Human
uaacuugcuuaaa

SEQ ID NO: 1954591 - RNA, 14 nt, Human
uaacuugcuuaaau

SEQ ID NO: 1954592 - RNA, 15 nt, Human
uaacuugcuuaaaug

SEQ ID NO: 1954593 - RNA, 16 nt, Human
uaacuugcuuaaaugu

SEQ ID NO: 1954594 - RNA, 17 nt, Human
uaacuugcuuaaaugug

SEQ ID NO: 1954595 - RNA, 16 nt, Human
uaacuuucugaaauaa

SEQ ID NO: 1954596 - RNA, 18 nt, Human
uaacuugcuuaaauguga

SEQ ID NO: 1954597 - RNA, 19 nt, Human
uaacuugcuuaaaugugaa

SEQ ID NO: 1954598 - RNA, 20 nt, Human
uaacuugcuuaaaugugaau

SEQ ID NO: 1954599 - RNA, 17 nt, Human
uaacuuggaugaguuuu

SEQ ID NO: 1954600 - RNA, 23 nt, Human
uaacuuggaugaguuuugggaag

SEQ ID NO: 1954601 - RNA, 15 nt, Human
uaagaauauuugaau

SEQ ID NO: 1954602 - RNA, 14 nt, Human
uaagacacuuccgu

SEQ ID NO: 1954603 - RNA, 14 nt, Human
uaagaauauuugaa

SEQ ID NO: 1954604 - RNA, 13 nt, Human
uaagacaaauaug

SEQ ID NO: 1954605 - RNA, 13 nt, Human
uaagaauauuuga

SEQ ID NO: 1954606 - RNA, 19 nt, Human
uaagaauagaacaacauau

SEQ ID NO: 1954607 - RNA, 18 nt, Human
uaacuuugguuaaaaucu

SEQ ID NO: 1954608 - RNA, 18 nt, Human
uaagaagugaaaaucuac

SEQ ID NO: 1954609 - RNA, 22 nt, Human
uaacuuaaaagaacauguauau

SEQ ID NO: 1954610 - RNA, 13 nt, Human
uaacuuaauaauc

SEQ ID NO: 1954611 - RNA, 14 nt, Human
uaacuuaauaauca

SEQ ID NO: 1954612 - RNA, 16 nt, Human
uaacuuaauaaucaag

SEQ ID NO: 1954613 - RNA, 17 nt, Human
uaacuuaauaaucaaga

SEQ ID NO: 1954614 - RNA, 21 nt, Human
uaacuucacauauugauuucc

SEQ ID NO: 1954615 - RNA, 13 nt, Human
uaacuucacauau

SEQ ID NO: 1954616 - RNA, 21 nt, Human
uaacuuaauaaucaagagccu

SEQ ID NO: 1954617 - RNA, 17 nt, Human
uaacuuccaauuuacau

SEQ ID NO: 1954618 - RNA, 14 nt, Human
uaacuucaccauau

SEQ ID NO: 1954619 - RNA, 17 nt, Human
uaaccuuaucauaaauu

SEQ ID NO: 1954620 - RNA, 20 nt, Human
uaacgauaaaagacagugaa

SEQ ID NO: 1954621 - RNA, 16 nt, Human
aauaguggugugauuu

SEQ ID NO: 1954622 - RNA, 22 nt, Human
aauaguggugugauuuggggau

SEQ ID NO: 1954623 - RNA, 12 nt, Human
aauaguguggaa

SEQ ID NO: 1954624 - RNA, 21 nt, Human
uaaaauuuccccuaaucuuuu

SEQ ID NO: 1954625 - RNA, 16 nt, Human
uaaaauuucuuagaaa

SEQ ID NO: 1954626 - RNA, 18 nt, Human
uaaaauuucuuagaaaac

SEQ ID NO: 1954627 - RNA, 12 nt, Human
uaaaauuugaaa

SEQ ID NO: 1954628 - RNA, 14 nt, Human
uaaaauuugaaaca

SEQ ID NO: 1954629 - RNA, 15 nt, Human
uaaaauuugaaacau

SEQ ID NO: 1954630 - RNA, 16 nt, Human
uaaaauuugaaacauu

SEQ ID NO: 1954631 - RNA, 17 nt, Human
uaaaauuugaaacauug

SEQ ID NO: 1954632 - RNA, 21 nt, Human
uaaaauuugaaacauugcuuu

SEQ ID NO: 1954633 - RNA, 15 nt, Human
aauauauuuuaagac

SEQ ID NO: 1954634 - RNA, 14 nt, Human
aauauauuuuaaga

SEQ ID NO: 1954635 - RNA, 17 nt, Human
aauaguuuauuuuaaaa

SEQ ID NO: 1954636 - RNA, 14 nt, Human
aauaguuguugauu

SEQ ID NO: 1954637 - RNA, 22 nt, Human
aauaguguggaaauuaagaaga

SEQ ID NO: 1954638 - RNA, 19 nt, Human
aauaguguggaaauuaaga

SEQ ID NO: 1954639 - RNA, 20 nt, Human
aauaguguggaaauuaagaa

SEQ ID NO: 1954640 - RNA, 11 nt, Human
aauaguucugu

SEQ ID NO: 1954641 - RNA, 13 nt, Human
aauaguuggcuag

SEQ ID NO: 1954642 - RNA, 18 nt, Human
uaacauggacaugaucuu

SEQ ID NO: 1954643 - RNA, 17 nt, Human
uaacauguaauuaagua

SEQ ID NO: 1954644 - RNA, 23 nt, Human
uaacauggacaugaucuucuuua

SEQ ID NO: 1954645 - RNA, 19 nt, Human
uaacauagccaaaauguga

SEQ ID NO: 1954646 - RNA, 18 nt, Human
aauauauuuuaagacgaa

SEQ ID NO: 1954647 - RNA, 19 nt, Human
aauaguuuauuuuaaaaca

SEQ ID NO: 1954648 - RNA, 17 nt, Human
uaacaguggacaaaguu

SEQ ID NO: 1954649 - RNA, 15 nt, Human
aaucauuagguguga

SEQ ID NO: 1954650 - RNA, 16 nt, Human
aaucauguuucuuuga

SEQ ID NO: 1954651 - RNA, 17 nt, Human
aaucauguuucuuugau

SEQ ID NO: 1954652 - RNA, 18 nt, Human
aaucauguuucuuugauc

SEQ ID NO: 1954653 - RNA, 19 nt, Human
aaucauguuucuuugauca

SEQ ID NO: 1954654 - RNA, 17 nt, Human
aaucauuaggugugacu

SEQ ID NO: 1954655 - RNA, 23 nt, Human
aaucauuaggugugacugaauuu

SEQ ID NO: 1954656 - RNA, 12 nt, Human
aauccgcccauc

SEQ ID NO: 1954657 - RNA, 15 nt, Human
aaucgaccugccucg

SEQ ID NO: 1954658 - RNA, 21 nt, Human
aaucgagugccgcaucucaca

SEQ ID NO: 1954659 - RNA, 16 nt, Human
aaucuggauucauauu

SEQ ID NO: 1954660 - RNA, 17 nt, Human
aaucuggauucauauuu

SEQ ID NO: 1954661 - RNA, 19 nt, Human
aaucuacacuccagugaga

SEQ ID NO: 1954662 - RNA, 13 nt, Human
aaucuaaugacau

SEQ ID NO: 1954663 - RNA, 17 nt, Human
aaucuaaugacauucaa

SEQ ID NO: 1954664 - RNA, 18 nt, Human
aaucuaaugacauucaau

SEQ ID NO: 1954665 - RNA, 16 nt, Human
aaucugggccagaauu

SEQ ID NO: 1954666 - RNA, 17 nt, Human
aaucugggccagaauuu

SEQ ID NO: 1954667 - RNA, 18 nt, Human
aaucuggauucauauuua

SEQ ID NO: 1954668 - RNA, 19 nt, Human
aaucuggauucauauuuaa

SEQ ID NO: 1954669 - RNA, 19 nt, Human
aaucuuauaauuuaaaaua

SEQ ID NO: 1954670 - RNA, 22 nt, Human
aaucuuaauacuguuauucuuu

SEQ ID NO: 1954671 - RNA, 13 nt, Human
aaucuuacuuugu

SEQ ID NO: 1954672 - RNA, 14 nt, Human
aaucuuacuuugua

SEQ ID NO: 1954673 - RNA, 15 nt, Human
aaucuuacuuuguaa

SEQ ID NO: 1954674 - RNA, 16 nt, Human
aaucuuacuuuguaaa

SEQ ID NO: 1954675 - RNA, 17 nt, Human
aaucuuacuuuguaaau

SEQ ID NO: 1954676 - RNA, 18 nt, Human
aaucuuacuuuguaaauu

SEQ ID NO: 1954677 - RNA, 19 nt, Human
aaucuuacuuuguaaauuc

SEQ ID NO: 1954678 - RNA, 20 nt, Human
aaucuuacuuuguaaauucu

SEQ ID NO: 1954679 - RNA, 12 nt, Human
aaucuuaauacu

SEQ ID NO: 1954680 - RNA, 14 nt, Human
aaucuuaauacugu

SEQ ID NO: 1954681 - RNA, 15 nt, Human
aaucuuaauacuguu

SEQ ID NO: 1954682 - RNA, 16 nt, Human
aaucuuaauacuguua

SEQ ID NO: 1954683 - RNA, 17 nt, Human
aaucuuaauacuguuau

SEQ ID NO: 1954684 - RNA, 18 nt, Human
aaucuuaauacuguuauu

SEQ ID NO: 1954685 - RNA, 21 nt, Human
aaucuuaauacuguuauucuu

SEQ ID NO: 1954686 - RNA, 15 nt, Human
aaucuuaagaaauaa

SEQ ID NO: 1954687 - RNA, 13 nt, Human
aaucuuaagaaau

SEQ ID NO: 1954688 - RNA, 14 nt, Human
aaucuuaagaaaua

SEQ ID NO: 1954689 - RNA, 21 nt, Human
aaucuguuuuauaccuugcuu

SEQ ID NO: 1954690 - RNA, 18 nt, Human
uaagcuguuugguuuuaa

SEQ ID NO: 1954691 - RNA, 21 nt, Human
uaagcuguuugguuuuaaaau

SEQ ID NO: 1954692 - RNA, 22 nt, Human
uaagcuguuugguuuuaaaaua

SEQ ID NO: 1954693 - RNA, 16 nt, Human
uaaguaaaucucuucu

SEQ ID NO: 1954694 - RNA, 18 nt, Human
uaaguaaaucucuucugu

SEQ ID NO: 1954695 - RNA, 22 nt, Human
uaaguaaaucucuucuguguuu

SEQ ID NO: 1954696 - RNA, 19 nt, Human
uaaguauucuuauuuaaug

SEQ ID NO: 1954697 - RNA, 20 nt, Human
uaaguauucuuauuuaauga

SEQ ID NO: 1954698 - RNA, 19 nt, Human
uaaguacuauguaucaaug

SEQ ID NO: 1954699 - RNA, 17 nt, Human
uaaguacuauguaucaa

SEQ ID NO: 1954700 - RNA, 16 nt, Human
uaaguacuauguauca

SEQ ID NO: 1954701 - RNA, 13 nt, Human
uaaguacuaugua

SEQ ID NO: 1954702 - RNA, 15 nt, Human
uaaguuggaaacacu

SEQ ID NO: 1954703 - RNA, 16 nt, Human
uaaguuggaaacacua

SEQ ID NO: 1954704 - RNA, 17 nt, Human
uaaguuggaaacacuaa

SEQ ID NO: 1954705 - RNA, 18 nt, Human
uaaguuggaaacacuaaa

SEQ ID NO: 1954706 - RNA, 21 nt, Human
uaaguuggaaacacuaaaugu

SEQ ID NO: 1954707 - RNA, 22 nt, Human
uaaguuggaaacacuaaauguu

SEQ ID NO: 1954708 - RNA, 23 nt, Human
uaaguuggaaacacuaaauguua

SEQ ID NO: 1954709 - RNA, 12 nt, Human
uaaguugaguau

SEQ ID NO: 1954710 - RNA, 12 nt, Human
uaaguuggaaac

SEQ ID NO: 1954711 - RNA, 13 nt, Human
uaaguuggaaaca

SEQ ID NO: 1954712 - RNA, 18 nt, Human
uaauaaacacucuugaaa

SEQ ID NO: 1954713 - RNA, 12 nt, Human
uaauaaacacuc

SEQ ID NO: 1954714 - RNA, 17 nt, Human
aaucauauuagacuucu

SEQ ID NO: 1954715 - RNA, 20 nt, Human
aaucauacuccuaugcuuua

SEQ ID NO: 1954716 - RNA, 14 nt, Human
aaucauaaguauuu

SEQ ID NO: 1954717 - RNA, 15 nt, Human
aaucauaaguauuug

SEQ ID NO: 1954718 - RNA, 16 nt, Human
aaucauaaguauuugg

SEQ ID NO: 1954719 - RNA, 19 nt, Human
aaucauacuccuaugcuuu

SEQ ID NO: 1954720 - RNA, 12 nt, Human
aaucauaaguau

SEQ ID NO: 1954721 - RNA, 16 nt, Human
aaucuuuaauuuuaca

SEQ ID NO: 1954722 - RNA, 15 nt, Human
aaucuuuaauuuuac

SEQ ID NO: 1954723 - RNA, 13 nt, Human
aaucuuuaauuaa

SEQ ID NO: 1954724 - RNA, 14 nt, Human
aaucuuuaauuaaa

SEQ ID NO: 1954725 - RNA, 17 nt, Human
aaucuuuagaaaaggca

SEQ ID NO: 1954726 - RNA, 19 nt, Human
uaaugugucaucuagcauu

SEQ ID NO: 1954727 - RNA, 13 nt, Human
uaauguacugcau

SEQ ID NO: 1954728 - RNA, 19 nt, Human
uaauguaucaaauacauuu

SEQ ID NO: 1954729 - RNA, 15 nt, Human
uaaugaaugcauaaa

SEQ ID NO: 1954730 - RNA, 19 nt, Human
uaauguauucauauuugua

SEQ ID NO: 1954731 - RNA, 20 nt, Human
uaauguauucauauuuguac

SEQ ID NO: 1954732 - RNA, 18 nt, Human
uaaugucacaggcagguc

SEQ ID NO: 1954733 - RNA, 14 nt, Human
uaauguauucauau

SEQ ID NO: 1954734 - RNA, 15 nt, Human
uaauguauucauauu

SEQ ID NO: 1954735 - RNA, 16 nt, Human
uaauguauucauauuu

SEQ ID NO: 1954736 - RNA, 17 nt, Human
uaauguauucauauuug

SEQ ID NO: 1954737 - RNA, 18 nt, Human
uaauguauucauauuugu

SEQ ID NO: 1954738 - RNA, 14 nt, Human
aaugaaacuuggau

SEQ ID NO: 1954739 - RNA, 17 nt, Human
aaugaaaccugugucuc

SEQ ID NO: 1954740 - RNA, 17 nt, Human
aaugaaagacuguacaa

SEQ ID NO: 1954741 - RNA, 16 nt, Human
aaugaaagacuguaca

SEQ ID NO: 1954742 - RNA, 17 nt, Human
aaugaaacauuuuguca

SEQ ID NO: 1954743 - RNA, 17 nt, Human
aaucuuuccauauccau

SEQ ID NO: 1954744 - RNA, 13 nt, Human
aaugaaugucagu

SEQ ID NO: 1954745 - RNA, 22 nt, Human
aaugaauggcuaagcaaaaugu

SEQ ID NO: 1954746 - RNA, 17 nt, Human
aaugaaugcauaaaaug

SEQ ID NO: 1954747 - RNA, 22 nt, Human
aaugaaugucagugugacugau

SEQ ID NO: 1954748 - RNA, 17 nt, Human
aaucuuauuaaaguuuc

SEQ ID NO: 1954749 - RNA, 18 nt, Human
aaucuuauuaaaguuuca

SEQ ID NO: 1954750 - RNA, 18 nt, Human
uaauagacaauuuauuau

SEQ ID NO: 1954751 - RNA, 22 nt, Human
uaauagacaauuuauuauggca

SEQ ID NO: 1954752 - RNA, 18 nt, Human
uaauagauugugaauaau

SEQ ID NO: 1954753 - RNA, 13 nt, Human
uaauauuuauuaa

SEQ ID NO: 1954754 - RNA, 16 nt, Human
uaauauuuauuaaauu

SEQ ID NO: 1954755 - RNA, 17 nt, Human
uaauauuuauuaaauuu

SEQ ID NO: 1954756 - RNA, 16 nt, Human
uaauacaccacuacau

SEQ ID NO: 1954757 - RNA, 13 nt, Human
aaucuuauuaaag

SEQ ID NO: 1954758 - RNA, 14 nt, Human
aaucuuauuaaagu

SEQ ID NO: 1954759 - RNA, 15 nt, Human
aaucuuauuaaaguu

SEQ ID NO: 1954760 - RNA, 16 nt, Human
aaucuuauuaaaguuu

SEQ ID NO: 1954761 - RNA, 19 nt, Human
aaucuuauuaaaguuucaa

SEQ ID NO: 1954762 - RNA, 14 nt, Human
uaauacaccacuac

SEQ ID NO: 1954763 - RNA, 18 nt, Human
uaauacaccacuacauuc

SEQ ID NO: 1954764 - RNA, 19 nt, Human
uaauacaccacuacauucu

SEQ ID NO: 1954765 - RNA, 14 nt, Human
uaauagacaauuua

SEQ ID NO: 1954766 - RNA, 16 nt, Human
uaauagacaauuuauu

SEQ ID NO: 1954767 - RNA, 17 nt, Human
uaauauuuuuacaugca

SEQ ID NO: 1954768 - RNA, 22 nt, Human
uaaucacuguguauauuugauu

SEQ ID NO: 1954769 - RNA, 20 nt, Human
uaaucacuguguauauuuga

SEQ ID NO: 1954770 - RNA, 21 nt, Human
uaaucacuguguauauuugau

SEQ ID NO: 1954771 - RNA, 10 nt, Human
uaaucacugu

SEQ ID NO: 1954772 - RNA, 16 nt, Human
uaaucacucagagcag

SEQ ID NO: 1954773 - RNA, 12 nt, Human
uaaucacugugu

SEQ ID NO: 1954774 - RNA, 13 nt, Human
uaaucacugugua

SEQ ID NO: 1954775 - RNA, 14 nt, Human
uaaucacuguguau

SEQ ID NO: 1954776 - RNA, 15 nt, Human
uaaucacuguguaua

SEQ ID NO: 1954777 - RNA, 16 nt, Human
uaaucacuguguauau

SEQ ID NO: 1954778 - RNA, 17 nt, Human
uaaugaaugaaacauuu

SEQ ID NO: 1954779 - RNA, 12 nt, Human
uaaugaaugacu

SEQ ID NO: 1954780 - RNA, 15 nt, Human
uaaucuuuucugaau

SEQ ID NO: 1954781 - RNA, 14 nt, Human
uaaucuuuucugaa

SEQ ID NO: 1954782 - RNA, 17 nt, Human
uaccugucccccugaca

SEQ ID NO: 1954783 - RNA, 16 nt, Human
uaccugucccccugac

SEQ ID NO: 1954784 - RNA, 14 nt, Human
uaccugucccccug

SEQ ID NO: 1954785 - RNA, 13 nt, Human
uaccugucccccu

SEQ ID NO: 1954786 - RNA, 10 nt, Human
uaccuguccc

SEQ ID NO: 1954787 - RNA, 16 nt, Human
uaccugcgcuuguuuu

SEQ ID NO: 1954788 - RNA, 20 nt, Human
uaccugcgcuuguuuuaaag

SEQ ID NO: 1954789 - RNA, 17 nt, Human
uaccuggguccccagcc

SEQ ID NO: 1954790 - RNA, 19 nt, Human
uaccuggguccccagcccu

SEQ ID NO: 1954791 - RNA, 20 nt, Human
uaccuggguccccagcccuu

SEQ ID NO: 1954792 - RNA, 20 nt, Human
uaccugccaggaagccagca

SEQ ID NO: 1954793 - RNA, 18 nt, Human
uaccugccaggaagccag

SEQ ID NO: 1954794 - RNA, 23 nt, Human
uaccugccaggaagccagcaggc

SEQ ID NO: 1954795 - RNA, 22 nt, Human
aauuaauugugugaacuuggaa

SEQ ID NO: 1954796 - RNA, 16 nt, Human
uaccacgaaauacuua

SEQ ID NO: 1954797 - RNA, 18 nt, Human
uaccacggccuccuuucc

SEQ ID NO: 1954798 - RNA, 19 nt, Human
uaccacggccuccuuuccg

SEQ ID NO: 1954799 - RNA, 18 nt, Human
uaccacccgguccccacu

SEQ ID NO: 1954800 - RNA, 23 nt, Human
uaccaccucacuuuuucauuucc

SEQ ID NO: 1954801 - RNA, 22 nt, Human
uacauucuuuuugcucuaaaau

SEQ ID NO: 1954802 - RNA, 21 nt, Human
uaccaccaucccgugcuuuua

SEQ ID NO: 1954803 - RNA, 22 nt, Human
aauuagccuaagauauacuugu

SEQ ID NO: 1954804 - RNA, 19 nt, Human
aauuagccuaagauauacu

SEQ ID NO: 1954805 - RNA, 20 nt, Human
aauuagccuaagauauacuu

SEQ ID NO: 1954806 - RNA, 15 nt, Human
aauuagccaagugug

SEQ ID NO: 1954807 - RNA, 15 nt, Human
aauuagccuaagaua

SEQ ID NO: 1954808 - RNA, 13 nt, Human
aauuagauuuuaa

SEQ ID NO: 1954809 - RNA, 21 nt, Human
aauuagauuuuaaaacuucau

SEQ ID NO: 1954810 - RNA, 20 nt, Human
uaccuguauacguuucaaaa

SEQ ID NO: 1954811 - RNA, 12 nt, Human
aauuaauuucag

SEQ ID NO: 1954812 - RNA, 13 nt, Human
aauuaauuucagu

SEQ ID NO: 1954813 - RNA, 11 nt, Human
aauuacaggaa

SEQ ID NO: 1954814 - RNA, 16 nt, Human
aauuacaauauuucug

SEQ ID NO: 1954815 - RNA, 20 nt, Human
aauuacacucuuccuccauu

SEQ ID NO: 1954816 - RNA, 17 nt, Human
aauuacccuuuugcagg

SEQ ID NO: 1954817 - RNA, 13 nt, Human
aauuacuaacuuc

SEQ ID NO: 1954818 - RNA, 14 nt, Human
aauuacuaacuucu

SEQ ID NO: 1954819 - RNA, 15 nt, Human
aauuacuaacuucua

SEQ ID NO: 1954820 - RNA, 16 nt, Human
aauuacuaacuucuaa

SEQ ID NO: 1954821 - RNA, 17 nt, Human
aauuacuaacuucuaaa

SEQ ID NO: 1954822 - RNA, 18 nt, Human
aauuacuaacuucuaaaa

SEQ ID NO: 1954823 - RNA, 20 nt, Human
aauuacuaacuucuaaaacu

SEQ ID NO: 1954824 - RNA, 21 nt, Human
aauuacuaacuucuaaaacug

SEQ ID NO: 1954825 - RNA, 23 nt, Human
aauuacuaacuucuaaaacugua

SEQ ID NO: 1954826 - RNA, 24 nt, Human
aauuccaucaagccaagccuccug

SEQ ID NO: 1954827 - RNA, 14 nt, Human
aauuccaugaaugu

SEQ ID NO: 1954828 - RNA, 16 nt, Human
aauuccaugaauguuc

SEQ ID NO: 1954829 - RNA, 14 nt, Human
aauuccccacccug

SEQ ID NO: 1954830 - RNA, 12 nt, Human
aauuccccagau

SEQ ID NO: 1954831 - RNA, 22 nt, Human
aauuccacuuauaggaauugac

SEQ ID NO: 1954832 - RNA, 14 nt, Human
aauuccagaaugaa

SEQ ID NO: 1954833 - RNA, 14 nt, Human
aauuccaaacaugg

SEQ ID NO: 1954834 - RNA, 17 nt, Human
aauuccaaacaugguuu

SEQ ID NO: 1954835 - RNA, 15 nt, Human
aauucacaaaguuaa

SEQ ID NO: 1954836 - RNA, 17 nt, Human
aauucaccacagacuuu

SEQ ID NO: 1954837 - RNA, 18 nt, Human
aauucaccacagacuuua

SEQ ID NO: 1954838 - RNA, 18 nt, Human
aauuccaagugauugaaa

SEQ ID NO: 1954839 - RNA, 16 nt, Human
aauucauuuucucuuu

SEQ ID NO: 1954840 - RNA, 14 nt, Human
aauucaaagaauca

SEQ ID NO: 1954841 - RNA, 13 nt, Human
aauucaaaccuaa

SEQ ID NO: 1954842 - RNA, 16 nt, Human
aauucaaaccuaaguu

SEQ ID NO: 1954843 - RNA, 15 nt, Human
aauuauuuuuaagug

SEQ ID NO: 1954844 - RNA, 17 nt, Human
aauuauugauguuuuca

SEQ ID NO: 1954845 - RNA, 14 nt, Human
aauuauugauugcu

SEQ ID NO: 1954846 - RNA, 15 nt, Human
aauuauugaugaaaa

SEQ ID NO: 1954847 - RNA, 16 nt, Human
aauuauugaugaaaau

SEQ ID NO: 1954848 - RNA, 18 nt, Human
aauuagggcucuaauuuc

SEQ ID NO: 1954849 - RNA, 19 nt, Human
aauuagggcucuaauuucc

SEQ ID NO: 1954850 - RNA, 20 nt, Human
aauuagggcucuaauuuccu

SEQ ID NO: 1954851 - RNA, 16 nt, Human
aauuauuauuuggccc

SEQ ID NO: 1954852 - RNA, 18 nt, Human
uacuguaaggcaaucaug

SEQ ID NO: 1954853 - RNA, 19 nt, Human
uacuguaauuugugauaca

SEQ ID NO: 1954854 - RNA, 20 nt, Human
uacuguaauuugugauacaa

SEQ ID NO: 1954855 - RNA, 18 nt, Human
uacuguaauuugugauac

SEQ ID NO: 1954856 - RNA, 19 nt, Human
uacuguaaggcaaucaugg

SEQ ID NO: 1954857 - RNA, 11 nt, Human
uacucugggaa

SEQ ID NO: 1954858 - RNA, 12 nt, Human
uacucugggaac

SEQ ID NO: 1954859 - RNA, 13 nt, Human
uacucugggaacu

SEQ ID NO: 1954860 - RNA, 16 nt, Human
uacuggagaaaaugga

SEQ ID NO: 1954861 - RNA, 12 nt, Human
uacucuguguca

SEQ ID NO: 1954862 - RNA, 22 nt, Human
aauugacccacaagaaaugaaa

SEQ ID NO: 1954863 - RNA, 23 nt, Human
aauugaccgacagcuuuccagua

SEQ ID NO: 1954864 - RNA, 21 nt, Human
aauugacccacaagaaaugaa

SEQ ID NO: 1954865 - RNA, 22 nt, Human
uacuguacaugaaaacacauuu

SEQ ID NO: 1954866 - RNA, 18 nt, Human
uacuguacaugaaaacac

SEQ ID NO: 1954867 - RNA, 15 nt, Human
uacuguacaugggac

SEQ ID NO: 1954868 - RNA, 21 nt, Human
uacuguacaugaaaacacauu

SEQ ID NO: 1954869 - RNA, 23 nt, Human
uacuguaauuugugauacaaugc

SEQ ID NO: 1954870 - RNA, 19 nt, Human
aauugaugggauuugguca

SEQ ID NO: 1954871 - RNA, 12 nt, Human
aauugcauuucc

SEQ ID NO: 1954872 - RNA, 16 nt, Human
aauugcauuugcuuuu

SEQ ID NO: 1954873 - RNA, 14 nt, Human
aauugccuuucugu

SEQ ID NO: 1954874 - RNA, 13 nt, Human
uacguacacauuu

SEQ ID NO: 1954875 - RNA, 14 nt, Human
uacguacacauuuu

SEQ ID NO: 1954876 - RNA, 15 nt, Human
uacguugugcauuug

SEQ ID NO: 1954877 - RNA, 16 nt, Human
uacguugugcauuugg

SEQ ID NO: 1954878 - RNA, 12 nt, Human
uacguacacauu

SEQ ID NO: 1954879 - RNA, 22 nt, Human
uacguaaaaaucucucauuugu

SEQ ID NO: 1954880 - RNA, 18 nt, Human
uacgggaggguaaggcug

SEQ ID NO: 1954881 - RNA, 20 nt, Human
uacgaguaauugcauuugcu

SEQ ID NO: 1954882 - RNA, 20 nt, Human
uacgagcaagcuuuuacaac

SEQ ID NO: 1954883 - RNA, 22 nt, Human
uacgccaggggaaaaucagccu

SEQ ID NO: 1954884 - RNA, 13 nt, Human
uacuauguaucaa

SEQ ID NO: 1954885 - RNA, 12 nt, Human
uacuauguauca

SEQ ID NO: 1954886 - RNA, 17 nt, Human
uacuaucuuaucucaga

SEQ ID NO: 1954887 - RNA, 21 nt, Human
uacuaucuuaucucagauauu

SEQ ID NO: 1954888 - RNA, 23 nt, Human
uacuauggcccuggccuagcaua

SEQ ID NO: 1954889 - RNA, 23 nt, Human
uacucuccuggaaauauuaagaa

SEQ ID NO: 1954890 - RNA, 22 nt, Human
uacucuccuggaaauauuaaga

SEQ ID NO: 1954891 - RNA, 22 nt, Human
uacuaucuuaucucagauauuu

SEQ ID NO: 1954892 - RNA, 14 nt, Human
uacuauguaucaau

SEQ ID NO: 1954893 - RNA, 17 nt, Human
uacuacuccuguaggaa

SEQ ID NO: 1954894 - RNA, 13 nt, Human
uacuacuccugua

SEQ ID NO: 1954895 - RNA, 20 nt, Human
uacuaucaugucaaacguga

SEQ ID NO: 1954896 - RNA, 16 nt, Human
uacuacugaccagaca

SEQ ID NO: 1954897 - RNA, 20 nt, Human
uacuacugaccagacaagcu

SEQ ID NO: 1954898 - RNA, 21 nt, Human
aaugcacuuuguucuggcucu

SEQ ID NO: 1954899 - RNA, 17 nt, Human
aaugaccuuucaauagg

SEQ ID NO: 1954900 - RNA, 16 nt, Human
aaugaccuuucaauag

SEQ ID NO: 1954901 - RNA, 18 nt, Human
aaugaccuuucaauagga

SEQ ID NO: 1954902 - RNA, 21 nt, Human
uacaaugcugugcccuaaagu

SEQ ID NO: 1954903 - RNA, 12 nt, Human
aaugcagaacuc

SEQ ID NO: 1954904 - RNA, 13 nt, Human
uacaaugugacuu

SEQ ID NO: 1954905 - RNA, 14 nt, Human
uacaaugugacuuu

SEQ ID NO: 1954906 - RNA, 22 nt, Human
aaugcacuuuguucuggcucuu

SEQ ID NO: 1954907 - RNA, 20 nt, Human
aauggacuaacuugucuuug

SEQ ID NO: 1954908 - RNA, 23 nt, Human
aauggacguguuaugacuccaga

SEQ ID NO: 1954909 - RNA, 14 nt, Human
aauggaaccacucu

SEQ ID NO: 1954910 - RNA, 21 nt, Human
aauggaaaugggcagagcaga

SEQ ID NO: 1954911 - RNA, 20 nt, Human
aauggaaaugggcagagcag

SEQ ID NO: 1954912 - RNA, 16 nt, Human
aaugcuucaucccuuu

SEQ ID NO: 1954913 - RNA, 12 nt, Human
aaugcccagccc

SEQ ID NO: 1954914 - RNA, 11 nt, Human
aaugcccagcc

SEQ ID NO: 1954915 - RNA, 13 nt, Human
aaugcccagcccc

SEQ ID NO: 1954916 - RNA, 22 nt, Human
aaugcuguauuagucacagaga

SEQ ID NO: 1954917 - RNA, 15 nt, Human
aauggcauuugcaau

SEQ ID NO: 1954918 - RNA, 14 nt, Human
aauggcugaagcca

SEQ ID NO: 1954919 - RNA, 11 nt, Human
aauguaacugc

SEQ ID NO: 1954920 - RNA, 15 nt, Human
aauguaacugcucuu

SEQ ID NO: 1954921 - RNA, 16 nt, Human
aauguaacugcucuug

SEQ ID NO: 1954922 - RNA, 12 nt, Human
aauguaacuguu

SEQ ID NO: 1954923 - RNA, 13 nt, Human
aauguaacuguua

SEQ ID NO: 1954924 - RNA, 20 nt, Human
aauguaacuguuaccauugg

SEQ ID NO: 1954925 - RNA, 22 nt, Human
aauguaacuguuaccauuggaa

SEQ ID NO: 1954926 - RNA, 16 nt, Human
aauggcagccuuggca

SEQ ID NO: 1954927 - RNA, 20 nt, Human
aauggcaauguuuugcuuuu

SEQ ID NO: 1954928 - RNA, 12 nt, Human
aauggcagccuu

SEQ ID NO: 1954929 - RNA, 23 nt, Human
aauggcacaaucucggcucacug

SEQ ID NO: 1954930 - RNA, 14 nt, Human
aauggcaaguuuuc

SEQ ID NO: 1954931 - RNA, 17 nt, Human
aauggcaaguuuuccau

SEQ ID NO: 1954932 - RNA, 14 nt, Human
aauggcaacaaacu

SEQ ID NO: 1954933 - RNA, 17 nt, Human
aauggcaacaaacugca

SEQ ID NO: 1954934 - RNA, 20 nt, Human
aauggcaacaaacugcacau

SEQ ID NO: 1954935 - RNA, 21 nt, Human
aauggcaacaaacugcacaug

SEQ ID NO: 1954936 - RNA, 15 nt, Human
uacacuaaaagguga

SEQ ID NO: 1954937 - RNA, 23 nt, Human
uacacauuuuauuuuauuaugca

SEQ ID NO: 1954938 - RNA, 21 nt, Human
uacacauuuuauuuuauuaug

SEQ ID NO: 1954939 - RNA, 22 nt, Human
uacacauuuuauuuuauuaugc

SEQ ID NO: 1954940 - RNA, 19 nt, Human
uacacauuuuauuuuauua

SEQ ID NO: 1954941 - RNA, 23 nt, Human
aauguaacuguuaccauuggaaa

SEQ ID NO: 1954942 - RNA, 22 nt, Human
uacagacaacaaaccuguuucu

SEQ ID NO: 1954943 - RNA, 19 nt, Human
uacagaccgaacuguugua

SEQ ID NO: 1954944 - RNA, 20 nt, Human
uacagaccgaacuguuguau

SEQ ID NO: 1954945 - RNA, 21 nt, Human
uacagaccgaacuguuguaua

SEQ ID NO: 1954946 - RNA, 23 nt, Human
uacagaccgaacuguuguauaaa

SEQ ID NO: 1954947 - RNA, 20 nt, Human
uacagauccccaagccuggc

SEQ ID NO: 1954948 - RNA, 21 nt, Human
uacagauaaaugauucaaaaa

SEQ ID NO: 1954949 - RNA, 13 nt, Human
uacagauaaauga

SEQ ID NO: 1954950 - RNA, 15 nt, Human
uacagauaaaugauu

SEQ ID NO: 1954951 - RNA, 16 nt, Human
uacagauaaaugauuc

SEQ ID NO: 1954952 - RNA, 20 nt, Human
uacagauaaaugauucaaaa

SEQ ID NO: 1954953 - RNA, 22 nt, Human
aauguauuacaguggggaauga

SEQ ID NO: 1954954 - RNA, 18 nt, Human
aauguaucaaauacauuu

SEQ ID NO: 1954955 - RNA, 20 nt, Human
aauguauguguaaguauucu

SEQ ID NO: 1954956 - RNA, 19 nt, Human
aauguauguguaaguauuc

SEQ ID NO: 1954957 - RNA, 14 nt, Human
aauguauaguauuu

SEQ ID NO: 1954958 - RNA, 15 nt, Human
aauguauaguauuug

SEQ ID NO: 1954959 - RNA, 16 nt, Human
aauguauaguauuuga

SEQ ID NO: 1954960 - RNA, 17 nt, Human
aauguauaguauuugaa

SEQ ID NO: 1954961 - RNA, 18 nt, Human
aauguauaguauuugaaa

SEQ ID NO: 1954962 - RNA, 19 nt, Human
aauguauaguauuugaaaa

SEQ ID NO: 1954963 - RNA, 21 nt, Human
aauguauaguauuugaaaaca

SEQ ID NO: 1954964 - RNA, 22 nt, Human
aauguauaguauuugaaaacag

SEQ ID NO: 1954965 - RNA, 11 nt, Human
aaugugugugu

SEQ ID NO: 1954966 - RNA, 19 nt, Human
aaugugaaaagaaaaauga

SEQ ID NO: 1954967 - RNA, 14 nt, Human
aaugugaaacugga

SEQ ID NO: 1954968 - RNA, 15 nt, Human
aaugugaaacuggau

SEQ ID NO: 1954969 - RNA, 18 nt, Human
aauguaguuugaggaaau

SEQ ID NO: 1954970 - RNA, 20 nt, Human
aauguaguuugaggaaauuu

SEQ ID NO: 1954971 - RNA, 23 nt, Human
aauguaguuugaggaaauuugca

SEQ ID NO: 1954972 - RNA, 22 nt, Human
uacauauaagugauugcugguu

SEQ ID NO: 1954973 - RNA, 15 nt, Human
uacauaugauaaauu

SEQ ID NO: 1954974 - RNA, 21 nt, Human
uacauaaugcgugcauaccac

SEQ ID NO: 1954975 - RNA, 23 nt, Human
uacauaaugcgugcauaccacuu

SEQ ID NO: 1954976 - RNA, 24 nt, Human
uacauaaugcgugcauaccacuuu

SEQ ID NO: 1954977 - RNA, 16 nt, Human
uacagguaccaguucu

SEQ ID NO: 1954978 - RNA, 16 nt, Human
uacagaugugggccac

SEQ ID NO: 1954979 - RNA, 16 nt, Human
uacaggugugagucac

SEQ ID NO: 1954980 - RNA, 20 nt, Human
uacagguacuuugucuaaga

SEQ ID NO: 1954981 - RNA, 14 nt, Human
uacagguacuuugu

SEQ ID NO: 1954982 - RNA, 15 nt, Human
uacagguacuuuguc

SEQ ID NO: 1954983 - RNA, 22 nt, Human
aauguuaagcaucuaaggacaa

SEQ ID NO: 1954984 - RNA, 21 nt, Human
aauguuaaagauguagcaaac

SEQ ID NO: 1954985 - RNA, 13 nt, Human
aauguuaaagaug

SEQ ID NO: 1954986 - RNA, 14 nt, Human
aauguuaaagaugu

SEQ ID NO: 1954987 - RNA, 15 nt, Human
aauguuaaagaugua

SEQ ID NO: 1954988 - RNA, 16 nt, Human
aauguuaaagauguag

SEQ ID NO: 1954989 - RNA, 19 nt, Human
aauguuaaagauguagcaa

SEQ ID NO: 1954990 - RNA, 20 nt, Human
aauguuaaagauguagcaaa

SEQ ID NO: 1954991 - RNA, 15 nt, Human
aauguguuuuggucc

SEQ ID NO: 1954992 - RNA, 11 nt, Human
aauuaacuuuu

SEQ ID NO: 1954993 - RNA, 15 nt, Human
aauguugaacaaaau

SEQ ID NO: 1954994 - RNA, 20 nt, Human
aauuaaccaagguagaauga

SEQ ID NO: 1954995 - RNA, 21 nt, Human
aauguucucucuucuccaccu

SEQ ID NO: 1954996 - RNA, 14 nt, Human
aauguucuuccagu

SEQ ID NO: 1954997 - RNA, 19 nt, Human
aauguucugcuaaauuuca

SEQ ID NO: 1954998 - RNA, 12 nt, Human
aauguucuucca

SEQ ID NO: 1954999 - RNA, 15 nt, Human
aauuaagaagaaaau

SEQ ID NO: 1955000 - RNA, 16 nt, Human
aauuaagaagaaacua

SEQ ID NO: 1955001 - RNA, 21 nt, Human
aauuaagaaaggauaaaguug

SEQ ID NO: 1955002 - RNA, 20 nt, Human
aauuaagaaaggauaaaguu

SEQ ID NO: 1955003 - RNA, 12 nt, Human
aauuaagaagaa

SEQ ID NO: 1955004 - RNA, 22 nt, Human
aauuaaucugggccagaauuuc

SEQ ID NO: 1955005 - RNA, 13 nt, Human
aauuaauugugug

SEQ ID NO: 1955006 - RNA, 13 nt, Human
uacauucuguuaa

SEQ ID NO: 1955007 - RNA, 16 nt, Human
uacauucuuuuugcuc

SEQ ID NO: 1955008 - RNA, 15 nt, Human
uacauucuuuuugcu

SEQ ID NO: 1955009 - RNA, 18 nt, Human
uacauucuuuuugcucua

SEQ ID NO: 1955010 - RNA, 21 nt, Human
uacauucuuuuugcucuaaaa

SEQ ID NO: 1955011 - RNA, 16 nt, Human
uacaugugcacauugu

SEQ ID NO: 1955012 - RNA, 20 nt, Human
uacaugugcacauugugcag

SEQ ID NO: 1955013 - RNA, 15 nt, Human
aauuaauugugugaa

SEQ ID NO: 1955014 - RNA, 17 nt, Human
uauuagaaaacuuuguu

SEQ ID NO: 1955015 - RNA, 18 nt, Human
uauuagaaaacuuuguua

SEQ ID NO: 1955016 - RNA, 19 nt, Human
uauuagaaaacuuuguuag

SEQ ID NO: 1955017 - RNA, 14 nt, Human
uauuagaaaacuuu

SEQ ID NO: 1955018 - RNA, 16 nt, Human
uauuagaaaacuuugu

SEQ ID NO: 1955019 - RNA, 21 nt, Human
uauuagugaccucagcuuuga

SEQ ID NO: 1955020 - RNA, 14 nt, Human
uauucaaacugaaa

SEQ ID NO: 1955021 - RNA, 19 nt, Human
uauuagugaccucagcuuu

SEQ ID NO: 1955022 - RNA, 14 nt, Human
uauuacuucugcua

SEQ ID NO: 1955023 - RNA, 18 nt, Human
uauuaaaauuguuguccg

SEQ ID NO: 1955024 - RNA, 13 nt, Human
uauuacuucugcu

SEQ ID NO: 1955025 - RNA, 22 nt, Human
uauuacuagacugccacaagga

SEQ ID NO: 1955026 - RNA, 11 nt, Human
uauuaaaauug

SEQ ID NO: 1955027 - RNA, 10 nt, Human
uauuaaaauu

SEQ ID NO: 1955028 - RNA, 15 nt, Human
uauuaaaauuguugu

SEQ ID NO: 1955029 - RNA, 16 nt, Human
uauuaaaauuguuguc

SEQ ID NO: 1955030 - RNA, 20 nt, Human
uauucaguaauaacucuacc

SEQ ID NO: 1955031 - RNA, 14 nt, Human
uauucaggaagcuc

SEQ ID NO: 1955032 - RNA, 16 nt, Human
uauucaggaagcucag

SEQ ID NO: 1955033 - RNA, 22 nt, Human
acaggcgugagccaccgugccu

SEQ ID NO: 1955034 - RNA, 12 nt, Human
acaggcuccugc

SEQ ID NO: 1955035 - RNA, 17 nt, Human
uauucaauuaaagaaau

SEQ ID NO: 1955036 - RNA, 15 nt, Human
uauucaccuucaguu

SEQ ID NO: 1955037 - RNA, 21 nt, Human
uauucagcucauggacuucug

SEQ ID NO: 1955038 - RNA, 17 nt, Human
uauucaccuucaguuuu

SEQ ID NO: 1955039 - RNA, 21 nt, Human
uauucagcuugcacauuuggu

SEQ ID NO: 1955040 - RNA, 13 nt, Human
acagucacaaauu

SEQ ID NO: 1955041 - RNA, 12 nt, Human
acagggcacacc

SEQ ID NO: 1955042 - RNA, 20 nt, Human
acagggcacaccgggcacuc

SEQ ID NO: 1955043 - RNA, 16 nt, Human
acagggauugauuuua

SEQ ID NO: 1955044 - RNA, 22 nt, Human
acagggauugauuuuaaaaugu

SEQ ID NO: 1955045 - RNA, 20 nt, Human
acaguacccugguugugugu

SEQ ID NO: 1955046 - RNA, 14 nt, Human
acaguacuuugaau

SEQ ID NO: 1955047 - RNA, 22 nt, Human
acaguaccccucuagcuuuguu

SEQ ID NO: 1955048 - RNA, 19 nt, Human
acaguacccugguugugug

SEQ ID NO: 1955049 - RNA, 13 nt, Human
acaguaaucaguu

SEQ ID NO: 1955050 - RNA, 22 nt, Human
acagggacugaaaaccucuccu

SEQ ID NO: 1955051 - RNA, 20 nt, Human
acagggaggacgcucucugg

SEQ ID NO: 1955052 - RNA, 21 nt, Human
acagggaggacgcucucuggc

SEQ ID NO: 1955053 - RNA, 12 nt, Human
acaggcugggcu

SEQ ID NO: 1955054 - RNA, 22 nt, Human
acaggcugggcuucaguggcag

SEQ ID NO: 1955055 - RNA, 23 nt, Human
acaggcugggcuucaguggcagc

SEQ ID NO: 1955056 - RNA, 23 nt, Human
acaggcugagugcaggcccaccc

SEQ ID NO: 1955057 - RNA, 13 nt, Human
acaggcuccugcc

SEQ ID NO: 1955058 - RNA, 15 nt, Human
acaggcuccugccac

SEQ ID NO: 1955059 - RNA, 21 nt, Human
acaggcuccugccaccacgcc

SEQ ID NO: 1955060 - RNA, 22 nt, Human
acaggcuccugccaccacgccc

SEQ ID NO: 1955061 - RNA, 15 nt, Human
acaggcugagugcag

SEQ ID NO: 1955062 - RNA, 16 nt, Human
acaggcugagugcagg

SEQ ID NO: 1955063 - RNA, 17 nt, Human
acaggcugagugcaggc

SEQ ID NO: 1955064 - RNA, 18 nt, Human
acaggcugagugcaggcc

SEQ ID NO: 1955065 - RNA, 19 nt, Human
acaggcugagugcaggccc

SEQ ID NO: 1955066 - RNA, 20 nt, Human
acaggcugagugcaggccca

SEQ ID NO: 1955067 - RNA, 21 nt, Human
acaggcugagugcaggcccac

SEQ ID NO: 1955068 - RNA, 22 nt, Human
acaggcugagugcaggcccacc

SEQ ID NO: 1955069 - RNA, 18 nt, Human
acaggacagggguuccuu

SEQ ID NO: 1955070 - RNA, 23 nt, Human
acaggaccagggauuuccaugau

SEQ ID NO: 1955071 - RNA, 14 nt, Human
acaggacucugccu

SEQ ID NO: 1955072 - RNA, 15 nt, Human
acaggaccccugcag

SEQ ID NO: 1955073 - RNA, 16 nt, Human
acaggaccccugcagu

SEQ ID NO: 1955074 - RNA, 20 nt, Human
acaggaccccugcaguuccc

SEQ ID NO: 1955075 - RNA, 14 nt, Human
acaggcauguucuc

SEQ ID NO: 1955076 - RNA, 14 nt, Human
acaggcagguccag

SEQ ID NO: 1955077 - RNA, 16 nt, Human
acaggcagguccaggg

SEQ ID NO: 1955078 - RNA, 16 nt, Human
acaggagugagcacua

SEQ ID NO: 1955079 - RNA, 15 nt, Human
acaggagguuggagg

SEQ ID NO: 1955080 - RNA, 17 nt, Human
acaggagguuggaggga

SEQ ID NO: 1955081 - RNA, 14 nt, Human
acaggaucagucug

SEQ ID NO: 1955082 - RNA, 13 nt, Human
acaggcaggucca

SEQ ID NO: 1955083 - RNA, 13 nt, Human
acagcuaacaugg

SEQ ID NO: 1955084 - RNA, 16 nt, Human
acagcguuaugugucu

SEQ ID NO: 1955085 - RNA, 22 nt, Human
acagcggcuggacuuggaggua

SEQ ID NO: 1955086 - RNA, 21 nt, Human
acagcggcuggacuuggaggu

SEQ ID NO: 1955087 - RNA, 11 nt, Human
acagccuggca

SEQ ID NO: 1955088 - RNA, 17 nt, Human
acaggaaguagaggagg

SEQ ID NO: 1955089 - RNA, 13 nt, Human
acaggaaguacug

SEQ ID NO: 1955090 - RNA, 19 nt, Human
acaggaaaagcaugucuua

SEQ ID NO: 1955091 - RNA, 21 nt, Human
acaggaaaagcaugucuuauu

SEQ ID NO: 1955092 - RNA, 15 nt, Human
acaggaaaagcugcu

SEQ ID NO: 1955093 - RNA, 16 nt, Human
acaggaaaagcugcug

SEQ ID NO: 1955094 - RNA, 17 nt, Human
acaggaaaagcugcuga

SEQ ID NO: 1955095 - RNA, 12 nt, Human
uauuaaaaaguc

SEQ ID NO: 1955096 - RNA, 13 nt, Human
uauuaaaaagucu

SEQ ID NO: 1955097 - RNA, 14 nt, Human
uauuaaaaagucuu

SEQ ID NO: 1955098 - RNA, 15 nt, Human
uauuaaaaagucuuu

SEQ ID NO: 1955099 - RNA, 17 nt, Human
uauuaaaaagucuuuua

SEQ ID NO: 1955100 - RNA, 19 nt, Human
uauuaaaaagucuuuuaaa

SEQ ID NO: 1955101 - RNA, 22 nt, Human
uauuaaaaagucuuuuaaaaag

SEQ ID NO: 1955102 - RNA, 18 nt, Human
uauguuuuucaguucaaa

SEQ ID NO: 1955103 - RNA, 19 nt, Human
uauguuuuucaguucaaag

SEQ ID NO: 1955104 - RNA, 20 nt, Human
uauguuuuucaguucaaagu

SEQ ID NO: 1955105 - RNA, 14 nt, Human
uauguuuuugaagg

SEQ ID NO: 1955106 - RNA, 16 nt, Human
uauguuuuugaaggca

SEQ ID NO: 1955107 - RNA, 12 nt, Human
uauguguaugug

SEQ ID NO: 1955108 - RNA, 16 nt, Human
uauguguccauuuccu

SEQ ID NO: 1955109 - RNA, 22 nt, Human
uauguguccauuuccuuaugcu

SEQ ID NO: 1955110 - RNA, 11 nt, Human
uauguuuuuca

SEQ ID NO: 1955111 - RNA, 13 nt, Human
uauguuuuucagu

SEQ ID NO: 1955112 - RNA, 14 nt, Human
uauguuuuucaguu

SEQ ID NO: 1955113 - RNA, 15 nt, Human
uauguuuuucaguuc

SEQ ID NO: 1955114 - RNA, 16 nt, Human
uauguuuuucaguuca

SEQ ID NO: 1955115 - RNA, 12 nt, Human
uauguuuugguc

SEQ ID NO: 1955116 - RNA, 12 nt, Human
uauguggaagug

SEQ ID NO: 1955117 - RNA, 16 nt, Human
uauguggaaguguggg

SEQ ID NO: 1955118 - RNA, 20 nt, Human
uauguggaguucaucuugaa

SEQ ID NO: 1955119 - RNA, 23 nt, Human
uaugugccagauuuaugcauauu

SEQ ID NO: 1955120 - RNA, 17 nt, Human
uaugugaguauucucau

SEQ ID NO: 1955121 - RNA, 18 nt, Human
uaugugaguauucucauu

SEQ ID NO: 1955122 - RNA, 14 nt, Human
uaugugaguauucu

SEQ ID NO: 1955123 - RNA, 12 nt, Human
uaugugaacagu

SEQ ID NO: 1955124 - RNA, 22 nt, Human
uaugugaacaguuguguuugaa

SEQ ID NO: 1955125 - RNA, 17 nt, Human
uaugugaaacauguuuc

SEQ ID NO: 1955126 - RNA, 15 nt, Human
acaggcauguucucu

SEQ ID NO: 1955127 - RNA, 18 nt, Human
acaggcauguucucugag

SEQ ID NO: 1955128 - RNA, 19 nt, Human
acaggcauguucucugagg

SEQ ID NO: 1955129 - RNA, 20 nt, Human
acaggcauguucucugagga

SEQ ID NO: 1955130 - RNA, 22 nt, Human
acaggcauguucucugaggaca

SEQ ID NO: 1955131 - RNA, 16 nt, Human
acaggccacccugugc

SEQ ID NO: 1955132 - RNA, 19 nt, Human
acaggccacccugugcaga

SEQ ID NO: 1955133 - RNA, 21 nt, Human
acaggccacccugugcagaag

SEQ ID NO: 1955134 - RNA, 14 nt, Human
uaugugaaacaugu

SEQ ID NO: 1955135 - RNA, 17 nt, Human
acagaaaauucuucucc

SEQ ID NO: 1955136 - RNA, 20 nt, Human
acagaaaauggaagacagcu

SEQ ID NO: 1955137 - RNA, 14 nt, Human
acagaaauguacag

SEQ ID NO: 1955138 - RNA, 16 nt, Human
acagaaauguacagca

SEQ ID NO: 1955139 - RNA, 17 nt, Human
acagaaauguacagcaa

SEQ ID NO: 1955140 - RNA, 12 nt, Human
acagaaaauaug

SEQ ID NO: 1955141 - RNA, 13 nt, Human
acagaaaauaugu

SEQ ID NO: 1955142 - RNA, 14 nt, Human
acagaaaauaugua

SEQ ID NO: 1955143 - RNA, 15 nt, Human
acagaaaauauguau

SEQ ID NO: 1955144 - RNA, 12 nt, Human
acagaaauuggu

SEQ ID NO: 1955145 - RNA, 20 nt, Human
acagaaauugguaccuugca

SEQ ID NO: 1955146 - RNA, 13 nt, Human
uauacaacaccaa

SEQ ID NO: 1955147 - RNA, 18 nt, Human
uauacaacaccaaaaaau

SEQ ID NO: 1955148 - RNA, 21 nt, Human
uauacaacaccaaaaaauauc

SEQ ID NO: 1955149 - RNA, 23 nt, Human
uauacaacaccaaaaaauaucua

SEQ ID NO: 1955150 - RNA, 23 nt, Human
uauaaguguguguuuuucauaaa

SEQ ID NO: 1955151 - RNA, 17 nt, Human
uauaaguguguguuuuu

SEQ ID NO: 1955152 - RNA, 20 nt, Human
uauauuguaagaaauacugu

SEQ ID NO: 1955153 - RNA, 22 nt, Human
uauauuguaagaaauacuguac

SEQ ID NO: 1955154 - RNA, 23 nt, Human
uauauugguuuuaugaugacgua

SEQ ID NO: 1955155 - RNA, 12 nt, Human
uauauuguaaga

SEQ ID NO: 1955156 - RNA, 15 nt, Human
uauauuguaagaaau

SEQ ID NO: 1955157 - RNA, 19 nt, Human
uauauuguaagaaauacug

SEQ ID NO: 1955158 - RNA, 14 nt, Human
uauauuuaaaaaca

SEQ ID NO: 1955159 - RNA, 16 nt, Human
uauauuuaguaucuuu

SEQ ID NO: 1955160 - RNA, 15 nt, Human
acagacccugcccug

SEQ ID NO: 1955161 - RNA, 21 nt, Human
acagaaauugguaccuugcac

SEQ ID NO: 1955162 - RNA, 14 nt, Human
acagacccugcccu

SEQ ID NO: 1955163 - RNA, 13 nt, Human
acagacccugccc

SEQ ID NO: 1955164 - RNA, 13 nt, Human
uauauuauaauag

SEQ ID NO: 1955165 - RNA, 23 nt, Human
uaucuauauuuuacauaaauuua

SEQ ID NO: 1955166 - RNA, 14 nt, Human
uaucucccccagcc

SEQ ID NO: 1955167 - RNA, 16 nt, Human
uaucucccccagcccc

SEQ ID NO: 1955168 - RNA, 15 nt, Human
uaucuccaagaccag

SEQ ID NO: 1955169 - RNA, 13 nt, Human
uaucucccccagc

SEQ ID NO: 1955170 - RNA, 11 nt, Human
acagagaaagu

SEQ ID NO: 1955171 - RNA, 18 nt, Human
acagagaaaguacuucuc

SEQ ID NO: 1955172 - RNA, 14 nt, Human
acagagaaagaaau

SEQ ID NO: 1955173 - RNA, 15 nt, Human
uaucuauauuuuaca

SEQ ID NO: 1955174 - RNA, 17 nt, Human
uaucccuuggacauuuu

SEQ ID NO: 1955175 - RNA, 18 nt, Human
uaucccuuggacauuuua

SEQ ID NO: 1955176 - RNA, 19 nt, Human
uaucccuuggacauuuuau

SEQ ID NO: 1955177 - RNA, 22 nt, Human
uauccauagugacuuuucaagu

SEQ ID NO: 1955178 - RNA, 19 nt, Human
uauccauagugacuuuuca

SEQ ID NO: 1955179 - RNA, 13 nt, Human
uauccacuugucc

SEQ ID NO: 1955180 - RNA, 15 nt, Human
uauccagaauggaau

SEQ ID NO: 1955181 - RNA, 21 nt, Human
uauccagaauggaauuuugcu

SEQ ID NO: 1955182 - RNA, 17 nt, Human
uauccacgagagcgcag

SEQ ID NO: 1955183 - RNA, 18 nt, Human
uauccacgagagcgcagc

SEQ ID NO: 1955184 - RNA, 22 nt, Human
uaucaagccuagauguuuuaua

SEQ ID NO: 1955185 - RNA, 19 nt, Human
uaucaaauuaauuguguga

SEQ ID NO: 1955186 - RNA, 20 nt, Human
uaucaaauuaauugugugaa

SEQ ID NO: 1955187 - RNA, 21 nt, Human
uaucaaauuaauugugugaac

SEQ ID NO: 1955188 - RNA, 15 nt, Human
uaucauuuuuuccug

SEQ ID NO: 1955189 - RNA, 16 nt, Human
uaucauuuuuuccugu

SEQ ID NO: 1955190 - RNA, 18 nt, Human
uaucauuuuuuccuguuu

SEQ ID NO: 1955191 - RNA, 20 nt, Human
acagaugccauauaguguua

SEQ ID NO: 1955192 - RNA, 18 nt, Human
acagaugaccccugccca

SEQ ID NO: 1955193 - RNA, 17 nt, Human
acagcaaggagauuuac

SEQ ID NO: 1955194 - RNA, 14 nt, Human
acagauuugagcuc

SEQ ID NO: 1955195 - RNA, 15 nt, Human
acagauuugagcuca

SEQ ID NO: 1955196 - RNA, 23 nt, Human
acagauuggauuuuauguugaca

SEQ ID NO: 1955197 - RNA, 13 nt, Human
acagauuggauuu

SEQ ID NO: 1955198 - RNA, 15 nt, Human
acagauuggauuuua

SEQ ID NO: 1955199 - RNA, 17 nt, Human
acagauuggauuuuaug

SEQ ID NO: 1955200 - RNA, 21 nt, Human
acagauuggauuuuauguuga

SEQ ID NO: 1955201 - RNA, 22 nt, Human
acagauuggauuuuauguugac

SEQ ID NO: 1955202 - RNA, 19 nt, Human
acagagcccacgcccccac

SEQ ID NO: 1955203 - RNA, 18 nt, Human
acagagcccacgccccca

SEQ ID NO: 1955204 - RNA, 15 nt, Human
acagagcccacgccc

SEQ ID NO: 1955205 - RNA, 14 nt, Human
acagagcccacgcc

SEQ ID NO: 1955206 - RNA, 18 nt, Human
acagauccccaagccugg

SEQ ID NO: 1955207 - RNA, 22 nt, Human
acagaucucugcuuuggaaauc

SEQ ID NO: 1955208 - RNA, 17 nt, Human
acagauccccaagccug

SEQ ID NO: 1955209 - RNA, 17 nt, Human
acagcccgggcucugcc

SEQ ID NO: 1955210 - RNA, 21 nt, Human
acagcaaggagauuuacaacu

SEQ ID NO: 1955211 - RNA, 16 nt, Human
acagcaaggagauuua

SEQ ID NO: 1955212 - RNA, 20 nt, Human
acagcccgggcucugccucc

SEQ ID NO: 1955213 - RNA, 13 nt, Human
acagccgcuccag

SEQ ID NO: 1955214 - RNA, 14 nt, Human
acagccgcuccaga

SEQ ID NO: 1955215 - RNA, 19 nt, Human
acagcccgggcucugccuc

SEQ ID NO: 1955216 - RNA, 18 nt, Human
acagcccgggcucugccu

SEQ ID NO: 1955217 - RNA, 18 nt, Human
acagccguuuguucccca

SEQ ID NO: 1955218 - RNA, 15 nt, Human
acagccgcuccagag

SEQ ID NO: 1955219 - RNA, 14 nt, Human
uaugaacagacuuu

SEQ ID NO: 1955220 - RNA, 20 nt, Human
uaugaaauuuuuuuucaugc

SEQ ID NO: 1955221 - RNA, 18 nt, Human
uauggcuuuugugcauua

SEQ ID NO: 1955222 - RNA, 21 nt, Human
uauggcuuuugugcauuaucu

SEQ ID NO: 1955223 - RNA, 17 nt, Human
uauggcuuuugugcauu

SEQ ID NO: 1955224 - RNA, 15 nt, Human
uaugcuuauacacuu

SEQ ID NO: 1955225 - RNA, 22 nt, Human
uaugcuggaagucucaaauaau

SEQ ID NO: 1955226 - RNA, 16 nt, Human
uaugcuguaaaagcaa

SEQ ID NO: 1955227 - RNA, 20 nt, Human
uauggggauagaugugugga

SEQ ID NO: 1955228 - RNA, 23 nt, Human
uauggcuuuugugcauuaucuag

SEQ ID NO: 1955229 - RNA, 14 nt, Human
uaugguaaucauau

SEQ ID NO: 1955230 - RNA, 12 nt, Human
acagccuggcac

SEQ ID NO: 1955231 - RNA, 18 nt, Human
uaugguaaucauauuaga

SEQ ID NO: 1955232 - RNA, 16 nt, Human
uaugguaaucauauua

SEQ ID NO: 1955233 - RNA, 11 nt, Human
uaugcauuuga

SEQ ID NO: 1955234 - RNA, 23 nt, Human
uaugcauuugaaaauuuugaugu

SEQ ID NO: 1955235 - RNA, 24 nt, Human
uaugcauuugaaaauuuugauguu

SEQ ID NO: 1955236 - RNA, 17 nt, Human
uaugaacauacaaaugc

SEQ ID NO: 1955237 - RNA, 18 nt, Human
uaugaacucaucauuuuu

SEQ ID NO: 1955238 - RNA, 17 nt, Human
uaugccugggcagaagg

SEQ ID NO: 1955239 - RNA, 14 nt, Human
uaugccugcucuuu

SEQ ID NO: 1955240 - RNA, 16 nt, Human
uaugccugcucuuugg

SEQ ID NO: 1955241 - RNA, 14 nt, Human
uaugcuaagaauuu

SEQ ID NO: 1955242 - RNA, 16 nt, Human
uaugcuaagaauuuuu

SEQ ID NO: 1955243 - RNA, 19 nt, Human
acacacagcucuguccugg

SEQ ID NO: 1955244 - RNA, 17 nt, Human
acacacagcucuguccu

SEQ ID NO: 1955245 - RNA, 13 nt, Human
acacacagcucug

SEQ ID NO: 1955246 - RNA, 14 nt, Human
acacacagcucugu

SEQ ID NO: 1955247 - RNA, 22 nt, Human
acacacacgcgugcacacacca

SEQ ID NO: 1955248 - RNA, 21 nt, Human
acacacugcauguuugugauu

SEQ ID NO: 1955249 - RNA, 14 nt, Human
acacacgcugccuu

SEQ ID NO: 1955250 - RNA, 13 nt, Human
acacacgcugccu

SEQ ID NO: 1955251 - RNA, 14 nt, Human
acacaccagagccc

SEQ ID NO: 1955252 - RNA, 15 nt, Human
acacaccagagccca

SEQ ID NO: 1955253 - RNA, 20 nt, Human
acacaccagagcccaccuug

SEQ ID NO: 1955254 - RNA, 21 nt, Human
acacacgcgugcacacaccag

SEQ ID NO: 1955255 - RNA, 21 nt, Human
acaaugcugugcccuaaagug

SEQ ID NO: 1955256 - RNA, 22 nt, Human
acaaugcugugcccuaaagugu

SEQ ID NO: 1955257 - RNA, 23 nt, Human
acaaugcugugcccuaaagugua

SEQ ID NO: 1955258 - RNA, 24 nt, Human
acaaugcugugcccuaaaguguau

SEQ ID NO: 1955259 - RNA, 19 nt, Human
acaauggauaggcacagga

SEQ ID NO: 1955260 - RNA, 13 nt, Human
acacacaaagcag

SEQ ID NO: 1955261 - RNA, 17 nt, Human
acaaugugaaaagaaaa

SEQ ID NO: 1955262 - RNA, 19 nt, Human
acaaugugaaaagaaaaau

SEQ ID NO: 1955263 - RNA, 18 nt, Human
uagugaagacuccagaaa

SEQ ID NO: 1955264 - RNA, 17 nt, Human
uagugaagacuccagaa

SEQ ID NO: 1955265 - RNA, 14 nt, Human
uaguuaaucuauaa

SEQ ID NO: 1955266 - RNA, 19 nt, Human
acacaguauuacuucugcu

SEQ ID NO: 1955267 - RNA, 22 nt, Human
acacaguauuacuucugcuaca

SEQ ID NO: 1955268 - RNA, 18 nt, Human
acacaguauuacuucugc

SEQ ID NO: 1955269 - RNA, 16 nt, Human
acacaguauuacuucu

SEQ ID NO: 1955270 - RNA, 16 nt, Human
uaguaaauguaguuca

SEQ ID NO: 1955271 - RNA, 12 nt, Human
acacauaaauau

SEQ ID NO: 1955272 - RNA, 15 nt, Human
acacauaauuaacac

SEQ ID NO: 1955273 - RNA, 12 nt, Human
acaccuucuaua

SEQ ID NO: 1955274 - RNA, 21 nt, Human
acaccuuagccugcccuccuu

SEQ ID NO: 1955275 - RNA, 20 nt, Human
acacuaaccacgcuggaccu

SEQ ID NO: 1955276 - RNA, 21 nt, Human
acaccucugcacaagcugcac

SEQ ID NO: 1955277 - RNA, 16 nt, Human
acaccugacagccccu

SEQ ID NO: 1955278 - RNA, 16 nt, Human
acaccgggcacucaga

SEQ ID NO: 1955279 - RNA, 14 nt, Human
acaccgggccugga

SEQ ID NO: 1955280 - RNA, 18 nt, Human
acacccuuggagcucuga

SEQ ID NO: 1955281 - RNA, 14 nt, Human
acacccuuggagcu

SEQ ID NO: 1955282 - RNA, 19 nt, Human
acacccugugauggggccc

SEQ ID NO: 1955283 - RNA, 15 nt, Human
acacucaaaagcugg

SEQ ID NO: 1955284 - RNA, 15 nt, Human
uauaaguguguguuu

SEQ ID NO: 1955285 - RNA, 16 nt, Human
uauaagaaaaauguga

SEQ ID NO: 1955286 - RNA, 19 nt, Human
uauaacuuauauuguaaga

SEQ ID NO: 1955287 - RNA, 21 nt, Human
uauaacuuauauuguaagaaa

SEQ ID NO: 1955288 - RNA, 22 nt, Human
uauaacuuauauuguaagaaau

SEQ ID NO: 1955289 - RNA, 24 nt, Human
uauaacuuauauuguaagaaauac

SEQ ID NO: 1955290 - RNA, 20 nt, Human
acacucacauuuauucugcu

SEQ ID NO: 1955291 - RNA, 22 nt, Human
acacucacauuuauucugcuca

SEQ ID NO: 1955292 - RNA, 17 nt, Human
uauaacuuauauuguaa

SEQ ID NO: 1955293 - RNA, 20 nt, Human
acacaucagccaucaacuaa

SEQ ID NO: 1955294 - RNA, 20 nt, Human
acaccaucgaucaugaugua

SEQ ID NO: 1955295 - RNA, 18 nt, Human
acacaugauccugcaauu

SEQ ID NO: 1955296 - RNA, 21 nt, Human
acacaugagcaucaggccagg

SEQ ID NO: 1955297 - RNA, 14 nt, Human
acacauuuuauuuu

SEQ ID NO: 1955298 - RNA, 19 nt, Human
acacauuuuauuuuauuau

SEQ ID NO: 1955299 - RNA, 20 nt, Human
acacauuuuauuuuauuaug

SEQ ID NO: 1955300 - RNA, 20 nt, Human
uaguucaucccuucucuucc

SEQ ID NO: 1955301 - RNA, 12 nt, Human
uaguuacuguaa

SEQ ID NO: 1955302 - RNA, 20 nt, Human
uaguuccaccaucaagccac

SEQ ID NO: 1955303 - RNA, 14 nt, Human
uaguuccacugaga

SEQ ID NO: 1955304 - RNA, 15 nt, Human
uaguuccacugagac

SEQ ID NO: 1955305 - RNA, 20 nt, Human
uauaaaagccuguuuaagag

SEQ ID NO: 1955306 - RNA, 19 nt, Human
uauaaaaauaaaaaacacu

SEQ ID NO: 1955307 - RNA, 22 nt, Human
uauaaaagggacugagaaauuu

SEQ ID NO: 1955308 - RNA, 19 nt, Human
uauaaaagccuguuuaaga

SEQ ID NO: 1955309 - RNA, 23 nt, Human
acacauauaaauugucuuaaugg

SEQ ID NO: 1955310 - RNA, 17 nt, Human
acaaugacuuacuguac

SEQ ID NO: 1955311 - RNA, 18 nt, Human
acaaugacuuacuguaca

SEQ ID NO: 1955312 - RNA, 19 nt, Human
uagcuaauaacaugugaaa

SEQ ID NO: 1955313 - RNA, 12 nt, Human
acaaugacuuac

SEQ ID NO: 1955314 - RNA, 13 nt, Human
acaaucauguaca

SEQ ID NO: 1955315 - RNA, 18 nt, Human
acaagaccacguuucuaa

SEQ ID NO: 1955316 - RNA, 22 nt, Human
acaaggacagccccuccuccau

SEQ ID NO: 1955317 - RNA, 21 nt, Human
acaaggacagccccuccucca

SEQ ID NO: 1955318 - RNA, 18 nt, Human
acaaggacuaggguccug

SEQ ID NO: 1955319 - RNA, 19 nt, Human
acaaggacuaggguccugg

SEQ ID NO: 1955320 - RNA, 17 nt, Human
uaggcaagauggcacag

SEQ ID NO: 1955321 - RNA, 17 nt, Human
uaggcaaguuuucccug

SEQ ID NO: 1955322 - RNA, 19 nt, Human
uaggcaagauggcacaggg

SEQ ID NO: 1955323 - RNA, 20 nt, Human
uaggcauuugcugaauacag

SEQ ID NO: 1955324 - RNA, 16 nt, Human
uaggcauuugcugaau

SEQ ID NO: 1955325 - RNA, 14 nt, Human
uaggcauuguggga

SEQ ID NO: 1955326 - RNA, 14 nt, Human
uagggaccagaacc

SEQ ID NO: 1955327 - RNA, 16 nt, Human
uaggcagccugagagu

SEQ ID NO: 1955328 - RNA, 21 nt, Human
uagggaaggauacaaaagcau

SEQ ID NO: 1955329 - RNA, 15 nt, Human
uaggccaaagacaaa

SEQ ID NO: 1955330 - RNA, 15 nt, Human
uagggaccagaacca

SEQ ID NO: 1955331 - RNA, 16 nt, Human
uaggaaauccagggug

SEQ ID NO: 1955332 - RNA, 11 nt, Human
uagcuguguua

SEQ ID NO: 1955333 - RNA, 12 nt, Human
uagcuuaagaaa

SEQ ID NO: 1955334 - RNA, 14 nt, Human
uagcuuaagaaaaa

SEQ ID NO: 1955335 - RNA, 15 nt, Human
uagcuuaagaaaaaa

SEQ ID NO: 1955336 - RNA, 20 nt, Human
uaggagaagucuucuauuua

SEQ ID NO: 1955337 - RNA, 17 nt, Human
uaggacuuguuuuuguu

SEQ ID NO: 1955338 - RNA, 16 nt, Human
uagcauuuugcuaaau

SEQ ID NO: 1955339 - RNA, 14 nt, Human
uagccaaggccaaa

SEQ ID NO: 1955340 - RNA, 15 nt, Human
uagcauuuuggcgcu

SEQ ID NO: 1955341 - RNA, 22 nt, Human
uagcauuuugcuaaaugugaau

SEQ ID NO: 1955342 - RNA, 21 nt, Human
uagccaaggccaaaggaagca

SEQ ID NO: 1955343 - RNA, 23 nt, Human
uagaugcugacuguacuccuccc

SEQ ID NO: 1955344 - RNA, 14 nt, Human
uagaugcugacugu

SEQ ID NO: 1955345 - RNA, 19 nt, Human
uagcauggcugccaauggg

SEQ ID NO: 1955346 - RNA, 20 nt, Human
acaagacccaaaaggcagaa

SEQ ID NO: 1955347 - RNA, 19 nt, Human
acaagacccuugugguccc

SEQ ID NO: 1955348 - RNA, 19 nt, Human
acaagaccacguuucuaaa

SEQ ID NO: 1955349 - RNA, 22 nt, Human
acaacagagacugaaauguguu

SEQ ID NO: 1955350 - RNA, 13 nt, Human
acaacagauugga

SEQ ID NO: 1955351 - RNA, 18 nt, Human
acaacagauuggauuuua

SEQ ID NO: 1955352 - RNA, 20 nt, Human
acaacagauuggauuuuaug

SEQ ID NO: 1955353 - RNA, 22 nt, Human
acaacagauuggauuuuauguu

SEQ ID NO: 1955354 - RNA, 23 nt, Human
acaacagauuggauuuuauguug

SEQ ID NO: 1955355 - RNA, 16 nt, Human
acaaauuuuucugugg

SEQ ID NO: 1955356 - RNA, 14 nt, Human
acaaauuuuucugu

SEQ ID NO: 1955357 - RNA, 15 nt, Human
acaacacuuuaaugg

SEQ ID NO: 1955358 - RNA, 21 nt, Human
acaacacucauugaccugagg

SEQ ID NO: 1955359 - RNA, 23 nt, Human
acaacacucauugaccugaggcc

SEQ ID NO: 1955360 - RNA, 13 nt, Human
uagccaaaaugug

SEQ ID NO: 1955361 - RNA, 15 nt, Human
uagccagaggagaga

SEQ ID NO: 1955362 - RNA, 11 nt, Human
uagccagagga

SEQ ID NO: 1955363 - RNA, 20 nt, Human
acaaauuucucuguuccaua

SEQ ID NO: 1955364 - RNA, 19 nt, Human
acaaauuuacagagacaga

SEQ ID NO: 1955365 - RNA, 18 nt, Human
acaaauuuacagagacag

SEQ ID NO: 1955366 - RNA, 19 nt, Human
uagauauaugcucugcaug

SEQ ID NO: 1955367 - RNA, 15 nt, Human
uagauauccucugcu

SEQ ID NO: 1955368 - RNA, 22 nt, Human
uagaggagaaacuggaacucuc

SEQ ID NO: 1955369 - RNA, 23 nt, Human
uagaggcaguucgaccagccagg

SEQ ID NO: 1955370 - RNA, 15 nt, Human
uagauauaugcucug

SEQ ID NO: 1955371 - RNA, 16 nt, Human
uagauauagagucauu

SEQ ID NO: 1955372 - RNA, 19 nt, Human
uagauauagagucauugua

SEQ ID NO: 1955373 - RNA, 20 nt, Human
uagaggcaugggcuugcugu

SEQ ID NO: 1955374 - RNA, 19 nt, Human
uagaggagaaacuggaacu

SEQ ID NO: 1955375 - RNA, 16 nt, Human
aauuguuacaaauugu

SEQ ID NO: 1955376 - RNA, 16 nt, Human
aauuguuacuccauau

SEQ ID NO: 1955377 - RNA, 20 nt, Human
aauuguguuuauaauuuuaa

SEQ ID NO: 1955378 - RNA, 19 nt, Human
aauugccuuucuguguuua

SEQ ID NO: 1955379 - RNA, 21 nt, Human
aauuguguuuauaauuuuaaa

SEQ ID NO: 1955380 - RNA, 11 nt, Human
acaaaagcaug

SEQ ID NO: 1955381 - RNA, 22 nt, Human
acaaaagcaugugagacugguu

SEQ ID NO: 1955382 - RNA, 18 nt, Human
acaaaaggauaaugaaua

SEQ ID NO: 1955383 - RNA, 17 nt, Human
acaaaggggcuuaauua

SEQ ID NO: 1955384 - RNA, 20 nt, Human
acaaaggcuguauucagcaa

SEQ ID NO: 1955385 - RNA, 16 nt, Human
acaaaggcuguauuca

SEQ ID NO: 1955386 - RNA, 19 nt, Human
acaaaggcuguauucagca

SEQ ID NO: 1955387 - RNA, 22 nt, Human
acaaaggaugcccaaagaugca

SEQ ID NO: 1955388 - RNA, 22 nt, Human
acaaaagcugaacacauuucuu

SEQ ID NO: 1955389 - RNA, 21 nt, Human
acaaaagcauucggagggagg

SEQ ID NO: 1955390 - RNA, 21 nt, Human
acaaaagcugaacacauuucu

SEQ ID NO: 1955391 - RNA, 21 nt, Human
aacuugagccugucaagaggc

SEQ ID NO: 1955392 - RNA, 13 nt, Human
aacuucuuucacu

SEQ ID NO: 1955393 - RNA, 18 nt, Human
aacuugaagccugcuccu

SEQ ID NO: 1955394 - RNA, 13 nt, Human
aacuucagacaua

SEQ ID NO: 1955395 - RNA, 13 nt, Human
aacuucuaaaacu

SEQ ID NO: 1955396 - RNA, 15 nt, Human
aacuucuaaaacugu

SEQ ID NO: 1955397 - RNA, 16 nt, Human
aacuucuaaaacugua

SEQ ID NO: 1955398 - RNA, 23 nt, Human
aacuucuaaaacuguacuuugau

SEQ ID NO: 1955399 - RNA, 14 nt, Human
aacuucacauauug

SEQ ID NO: 1955400 - RNA, 22 nt, Human
aacuucacauauugauuuccgu

SEQ ID NO: 1955401 - RNA, 22 nt, Human
aacuucaccauauuaccacaga

SEQ ID NO: 1955402 - RNA, 18 nt, Human
aacugcccccucugcccu

SEQ ID NO: 1955403 - RNA, 19 nt, Human
aacugcccccucugcccug

SEQ ID NO: 1955404 - RNA, 20 nt, Human
aacugcccccucugcccugc

SEQ ID NO: 1955405 - RNA, 21 nt, Human
aacugcccccucugcccugcg

SEQ ID NO: 1955406 - RNA, 16 nt, Human
aacugcccccucugcc

SEQ ID NO: 1955407 - RNA, 17 nt, Human
aacugcccccucugccc

SEQ ID NO: 1955408 - RNA, 14 nt, Human
aacugccaguuuug

SEQ ID NO: 1955409 - RNA, 19 nt, Human
aacugccaguuuuguuucc

SEQ ID NO: 1955410 - RNA, 15 nt, Human
aacugucgugucaua

SEQ ID NO: 1955411 - RNA, 20 nt, Human
aacugucgugucauacucga

SEQ ID NO: 1955412 - RNA, 19 nt, Human
aacugucuagcacuuccuu

SEQ ID NO: 1955413 - RNA, 15 nt, Human
aacugucauuacaga

SEQ ID NO: 1955414 - RNA, 16 nt, Human
aacugcccaguuucca

SEQ ID NO: 1955415 - RNA, 13 nt, Human
gugcaauauauuu

SEQ ID NO: 1955416 - RNA, 14 nt, Human
gugcaauauauuuu

SEQ ID NO: 1955417 - RNA, 15 nt, Human
gugcaauauauuuug

SEQ ID NO: 1955418 - RNA, 11 nt, Human
gugauuaccag

SEQ ID NO: 1955419 - RNA, 16 nt, Human
gugauuaccagggacu

SEQ ID NO: 1955420 - RNA, 17 nt, Human
gugauuaccagggacug

SEQ ID NO: 1955421 - RNA, 13 nt, Human
gugaugugacauu

SEQ ID NO: 1955422 - RNA, 16 nt, Human
gugaugugacauuugu

SEQ ID NO: 1955423 - RNA, 18 nt, Human
gugaugugacauuuguca

SEQ ID NO: 1955424 - RNA, 10 nt, Human
gugauguguc

SEQ ID NO: 1955425 - RNA, 23 nt, Human
gugaucucauuguucaauuccca

SEQ ID NO: 1955426 - RNA, 23 nt, Human
gugaugguuccccuguucacucu

SEQ ID NO: 1955427 - RNA, 19 nt, Human
gugaucugcugcagagcag

SEQ ID NO: 1955428 - RNA, 20 nt, Human
gugaucugcugcagagcagu

SEQ ID NO: 1955429 - RNA, 21 nt, Human
gugcacaagcuccaagcuccc

SEQ ID NO: 1955430 - RNA, 16 nt, Human
gugcacaagcuccaag

SEQ ID NO: 1955431 - RNA, 13 nt, Human
gugcacaagcucc

SEQ ID NO: 1955432 - RNA, 18 nt, Human
gugcaaugaccuuucaau

SEQ ID NO: 1955433 - RNA, 23 nt, Human
gugcacaagcuccaagcucccag

SEQ ID NO: 1955434 - RNA, 21 nt, Human
gugcacaugcacgugugugca

SEQ ID NO: 1955435 - RNA, 16 nt, Human
gugcaauauauuuugu

SEQ ID NO: 1955436 - RNA, 20 nt, Human
gugcaauauauuuuguaugc

SEQ ID NO: 1955437 - RNA, 23 nt, Human
gugcaauauauuuuguaugcaag

SEQ ID NO: 1955438 - RNA, 22 nt, Human
gugcaccugggacagggagcag

SEQ ID NO: 1955439 - RNA, 23 nt, Human
gugcaccugggacagggagcagc

SEQ ID NO: 1955440 - RNA, 17 nt, Human
gugcauuugaggucugu

SEQ ID NO: 1955441 - RNA, 19 nt, Human
gugcauuugaggucuguuc

SEQ ID NO: 1955442 - RNA, 23 nt, Human
gugccaaaaacaacaacaaaaug

SEQ ID NO: 1955443 - RNA, 21 nt, Human
gugcauuuggugguuucagaa

SEQ ID NO: 1955444 - RNA, 21 nt, Human
aacuuuaccuuuuuuauacau

SEQ ID NO: 1955445 - RNA, 22 nt, Human
aacuuuaccuuuuuuauacaua

SEQ ID NO: 1955446 - RNA, 23 nt, Human
aacuuuaccuuuuuuauacauaa

SEQ ID NO: 1955447 - RNA, 19 nt, Human
gugccagauuuaugcauau

SEQ ID NO: 1955448 - RNA, 18 nt, Human
aagaaaaagaaaaagaaa

SEQ ID NO: 1955449 - RNA, 13 nt, Human
aagaaaaagaaaa

SEQ ID NO: 1955450 - RNA, 19 nt, Human
aagaaaaaauauuuucccu

SEQ ID NO: 1955451 - RNA, 18 nt, Human
aagaaaaaugagccuggc

SEQ ID NO: 1955452 - RNA, 12 nt, Human
aagaaaaaugug

SEQ ID NO: 1955453 - RNA, 22 nt, Human
aagaaaacaaaaccaaaaguua

SEQ ID NO: 1955454 - RNA, 17 nt, Human
aagaaaaaugagccugg

SEQ ID NO: 1955455 - RNA, 14 nt, Human
aagaaaaacuguuu

SEQ ID NO: 1955456 - RNA, 14 nt, Human
aagaaagaaaauca

SEQ ID NO: 1955457 - RNA, 13 nt, Human
aagaaagaaaauc

SEQ ID NO: 1955458 - RNA, 16 nt, Human
aagaaagaaaaucagg

SEQ ID NO: 1955459 - RNA, 12 nt, Human
aagaaagaaaga

SEQ ID NO: 1955460 - RNA, 12 nt, Human
aagaaagaaaua

SEQ ID NO: 1955461 - RNA, 12 nt, Human
aagaaagaggaa

SEQ ID NO: 1955462 - RNA, 17 nt, Human
aagaaagaggaaaagaa

SEQ ID NO: 1955463 - RNA, 16 nt, Human
aagaaaauaccaagga

SEQ ID NO: 1955464 - RNA, 13 nt, Human
aagaaaacacugu

SEQ ID NO: 1955465 - RNA, 15 nt, Human
aagaaaacacuguua

SEQ ID NO: 1955466 - RNA, 15 nt, Human
aagaaaauaguggug

SEQ ID NO: 1955467 - RNA, 21 nt, Human
aagaaaauaguggugugauuu

SEQ ID NO: 1955468 - RNA, 22 nt, Human
aagaaaauaguggugugauuug

SEQ ID NO: 1955469 - RNA, 13 nt, Human
aagaaaauacuua

SEQ ID NO: 1955470 - RNA, 16 nt, Human
aagaaaauacuuaaau

SEQ ID NO: 1955471 - RNA, 20 nt, Human
aagaaaauacuuaaauguua

SEQ ID NO: 1955472 - RNA, 14 nt, Human
aagaaacauuggaa

SEQ ID NO: 1955473 - RNA, 17 nt, Human
aagaaacauuggaagca

SEQ ID NO: 1955474 - RNA, 19 nt, Human
aagaaacagcuaugagagg

SEQ ID NO: 1955475 - RNA, 11 nt, Human
aagaaacauug

SEQ ID NO: 1955476 - RNA, 16 nt, Human
aagaauaaaggcagcu

SEQ ID NO: 1955477 - RNA, 14 nt, Human
aagaaguuuaagga

SEQ ID NO: 1955478 - RNA, 17 nt, Human
aagaaguuuaaggaaua

SEQ ID NO: 1955479 - RNA, 14 nt, Human
aagaaguucuuuga

SEQ ID NO: 1955480 - RNA, 20 nt, Human
aagaaguucuuugauucugu

SEQ ID NO: 1955481 - RNA, 11 nt, Human
aagaauaauuu

SEQ ID NO: 1955482 - RNA, 11 nt, Human
gugcuacagaa

SEQ ID NO: 1955483 - RNA, 18 nt, Human
gugcuaucucccccagcc

SEQ ID NO: 1955484 - RNA, 15 nt, Human
gugcuaucuccccca

SEQ ID NO: 1955485 - RNA, 17 nt, Human
gugcuaggaacacuccu

SEQ ID NO: 1955486 - RNA, 15 nt, Human
gugcugcccugccca

SEQ ID NO: 1955487 - RNA, 14 nt, Human
gugcugcccugccc

SEQ ID NO: 1955488 - RNA, 13 nt, Human
gugcugcccugcc

SEQ ID NO: 1955489 - RNA, 12 nt, Human
gugcugcccugc

SEQ ID NO: 1955490 - RNA, 15 nt, Human
gugcucuccaagccc

SEQ ID NO: 1955491 - RNA, 16 nt, Human
gugcucugaucaucca

SEQ ID NO: 1955492 - RNA, 13 nt, Human
gugcucuggacag

SEQ ID NO: 1955493 - RNA, 14 nt, Human
gugcucuggacagg

SEQ ID NO: 1955494 - RNA, 16 nt, Human
gugcucaggagcccug

SEQ ID NO: 1955495 - RNA, 19 nt, Human
gugcuaucucccccagccc

SEQ ID NO: 1955496 - RNA, 18 nt, Human
gugcucaggagcccuggg

SEQ ID NO: 1955497 - RNA, 19 nt, Human
gugcucaggagcccuggga

SEQ ID NO: 1955498 - RNA, 22 nt, Human
gugcucaucagaaacaauuucu

SEQ ID NO: 1955499 - RNA, 15 nt, Human
gugcucaucagaaac

SEQ ID NO: 1955500 - RNA, 18 nt, Human
gugaggcucugcccuugg

SEQ ID NO: 1955501 - RNA, 23 nt, Human
gugaguacuacaguccucccauc

SEQ ID NO: 1955502 - RNA, 17 nt, Human
gugagucaccaagccca

SEQ ID NO: 1955503 - RNA, 21 nt, Human
aacucuccucugcugcuggcu

SEQ ID NO: 1955504 - RNA, 19 nt, Human
aacucuccucugcugcugg

SEQ ID NO: 1955505 - RNA, 19 nt, Human
gugagucaccaagcccagu

SEQ ID NO: 1955506 - RNA, 17 nt, Human
gugaggcucugcccuug

SEQ ID NO: 1955507 - RNA, 16 nt, Human
gugaggcucugcccuu

SEQ ID NO: 1955508 - RNA, 15 nt, Human
gugaggcucugcccu

SEQ ID NO: 1955509 - RNA, 14 nt, Human
gugaggcucugccc

SEQ ID NO: 1955510 - RNA, 13 nt, Human
gugaggcucugcc

SEQ ID NO: 1955511 - RNA, 12 nt, Human
gugaggcucugc

SEQ ID NO: 1955512 - RNA, 18 nt, Human
gugagacucugucucaaa

SEQ ID NO: 1955513 - RNA, 12 nt, Human
aacucucugaac

SEQ ID NO: 1955514 - RNA, 23 nt, Human
aacucuccucugcugcuggcugg

SEQ ID NO: 1955515 - RNA, 22 nt, Human
aacucuccucugcugcuggcug

SEQ ID NO: 1955516 - RNA, 16 nt, Human
aacucuucucauuacu

SEQ ID NO: 1955517 - RNA, 17 nt, Human
aacucuucucauuacuu

SEQ ID NO: 1955518 - RNA, 11 nt, Human
aacucuuccuc

SEQ ID NO: 1955519 - RNA, 12 nt, Human
aacucuuccucc

SEQ ID NO: 1955520 - RNA, 13 nt, Human
aacucuucucauu

SEQ ID NO: 1955521 - RNA, 21 nt, Human
aacucuugacagcuauaauua

SEQ ID NO: 1955522 - RNA, 11 nt, Human
aacucuuuaac

SEQ ID NO: 1955523 - RNA, 13 nt, Human
aacucuuuaacuu

SEQ ID NO: 1955524 - RNA, 16 nt, Human
aacucugacaacagac

SEQ ID NO: 1955525 - RNA, 12 nt, Human
aacucugaauaa

SEQ ID NO: 1955526 - RNA, 15 nt, Human
aacucugaauaagca

SEQ ID NO: 1955527 - RNA, 18 nt, Human
aacucugaauaagcacuu

SEQ ID NO: 1955528 - RNA, 16 nt, Human
aacucugaauuuaucu

SEQ ID NO: 1955529 - RNA, 19 nt, Human
aacucugaauuuaucuuug

SEQ ID NO: 1955530 - RNA, 21 nt, Human
aacucugaauuuaucuuugau

SEQ ID NO: 1955531 - RNA, 22 nt, Human
aacucugaauuuaucuuugaua

SEQ ID NO: 1955532 - RNA, 23 nt, Human
aacucugaauuuaucuuugauaa

SEQ ID NO: 1955533 - RNA, 16 nt, Human
aacugcauuggcuuug

SEQ ID NO: 1955534 - RNA, 23 nt, Human
aacugauuuuuuuuuccuucagu

SEQ ID NO: 1955535 - RNA, 22 nt, Human
aacugauuuuuuuuuccuucag

SEQ ID NO: 1955536 - RNA, 23 nt, Human
aacucuuuuaucuccugaaaaaa

SEQ ID NO: 1955537 - RNA, 21 nt, Human
aacugauuuuuuuuuccuuca

SEQ ID NO: 1955538 - RNA, 20 nt, Human
aacugauuuuuuuuuccuuc

SEQ ID NO: 1955539 - RNA, 14 nt, Human
gugaauaaugauuu

SEQ ID NO: 1955540 - RNA, 14 nt, Human
gugaauaauuacag

SEQ ID NO: 1955541 - RNA, 23 nt, Human
gugacagaggcagccccauucug

SEQ ID NO: 1955542 - RNA, 20 nt, Human
gugacagagugagacucugu

SEQ ID NO: 1955543 - RNA, 22 nt, Human
gugacagagugagacucugucu

SEQ ID NO: 1955544 - RNA, 12 nt, Human
gugacaguguug

SEQ ID NO: 1955545 - RNA, 23 nt, Human
gugaauaauacaguaucucaggg

SEQ ID NO: 1955546 - RNA, 12 nt, Human
aacuccugaccu

SEQ ID NO: 1955547 - RNA, 14 nt, Human
aacuccugaccuca

SEQ ID NO: 1955548 - RNA, 19 nt, Human
aacuccaacauccacucuc

SEQ ID NO: 1955549 - RNA, 19 nt, Human
gugacaugucuuuucuugc

SEQ ID NO: 1955550 - RNA, 22 nt, Human
gugacauguguuggcagccucu

SEQ ID NO: 1955551 - RNA, 17 nt, Human
gugacauuugucauuuu

SEQ ID NO: 1955552 - RNA, 19 nt, Human
gugacauuugucauuuuca

SEQ ID NO: 1955553 - RNA, 20 nt, Human
gugacauuugucauuuucau

SEQ ID NO: 1955554 - RNA, 16 nt, Human
gugacuucagcucugu

SEQ ID NO: 1955555 - RNA, 12 nt, Human
gugacuuugaaa

SEQ ID NO: 1955556 - RNA, 22 nt, Human
gugagacccugucucaaaaaaa

SEQ ID NO: 1955557 - RNA, 13 nt, Human
gugagaccugccc

SEQ ID NO: 1955558 - RNA, 14 nt, Human
gugagaccugcccc

SEQ ID NO: 1955559 - RNA, 15 nt, Human
gugagaccugccccu

SEQ ID NO: 1955560 - RNA, 16 nt, Human
gugagaccugccccuc

SEQ ID NO: 1955561 - RNA, 23 nt, Human
gugagaccugccccuccucucug

SEQ ID NO: 1955562 - RNA, 14 nt, Human
gugagacucugucu

SEQ ID NO: 1955563 - RNA, 16 nt, Human
gugagacucugucuca

SEQ ID NO: 1955564 - RNA, 13 nt, Human
aacgucugugcca

SEQ ID NO: 1955565 - RNA, 12 nt, Human
aaccuucuggcc

SEQ ID NO: 1955566 - RNA, 12 nt, Human
aacgucuuaaau

SEQ ID NO: 1955567 - RNA, 14 nt, Human
aacgucuuaaauau

SEQ ID NO: 1955568 - RNA, 21 nt, Human
aaccuucgccaccuggguucc

SEQ ID NO: 1955569 - RNA, 19 nt, Human
aaccuuccuuccugcuuga

SEQ ID NO: 1955570 - RNA, 17 nt, Human
aaccuucuggccuccca

SEQ ID NO: 1955571 - RNA, 23 nt, Human
aacgugaugugcucaucagaaac

SEQ ID NO: 1955572 - RNA, 15 nt, Human
aacgucuuaaauauu

SEQ ID NO: 1955573 - RNA, 12 nt, Human
aacgugaaaaug

SEQ ID NO: 1955574 - RNA, 20 nt, Human
aacguggagaaucacaggcu

SEQ ID NO: 1955575 - RNA, 10 nt, Human
gucuuuccca

SEQ ID NO: 1955576 - RNA, 16 nt, Human
aaccugggaaagagau

SEQ ID NO: 1955577 - RNA, 21 nt, Human
aaccugggaaagagauuuaaa

SEQ ID NO: 1955578 - RNA, 12 nt, Human
gucuuucugggg

SEQ ID NO: 1955579 - RNA, 19 nt, Human
gucuuucugggguuuuucu

SEQ ID NO: 1955580 - RNA, 15 nt, Human
gucuuucuucuucaa

SEQ ID NO: 1955581 - RNA, 16 nt, Human
gucuuucuugcucccu

SEQ ID NO: 1955582 - RNA, 23 nt, Human
aaccuggucacaggacucugccu

SEQ ID NO: 1955583 - RNA, 17 nt, Human
aacuagggaagauaaua

SEQ ID NO: 1955584 - RNA, 21 nt, Human
aacuaggugcauauuuauaaa

SEQ ID NO: 1955585 - RNA, 15 nt, Human
aacuaaaauaauuuu

SEQ ID NO: 1955586 - RNA, 19 nt, Human
aacuaaaauaauuuuguaa

SEQ ID NO: 1955587 - RNA, 17 nt, Human
aacuaaaauaauuuugu

SEQ ID NO: 1955588 - RNA, 15 nt, Human
aacuaaaauguucua

SEQ ID NO: 1955589 - RNA, 20 nt, Human
aacguuugguucaaaugugu

SEQ ID NO: 1955590 - RNA, 13 nt, Human
aacguggcugcuu

SEQ ID NO: 1955591 - RNA, 12 nt, Human
aacguggcugcu

SEQ ID NO: 1955592 - RNA, 12 nt, Human
aacuauggccug

SEQ ID NO: 1955593 - RNA, 15 nt, Human
aacuaggcuccuuca

SEQ ID NO: 1955594 - RNA, 22 nt, Human
aacuaggucugauauucaaaug

SEQ ID NO: 1955595 - RNA, 15 nt, Human
aacuauguugauaaa

SEQ ID NO: 1955596 - RNA, 17 nt, Human
aacuauguuuaaaguaa

SEQ ID NO: 1955597 - RNA, 18 nt, Human
aacuauguuuaaaguaau

SEQ ID NO: 1955598 - RNA, 16 nt, Human
aacuccaacauccacu

SEQ ID NO: 1955599 - RNA, 22 nt, Human
gucuuuccacuccuccuagcca

SEQ ID NO: 1955600 - RNA, 13 nt, Human
gucuuuccacucu

SEQ ID NO: 1955601 - RNA, 14 nt, Human
gucuuuccacucug

SEQ ID NO: 1955602 - RNA, 22 nt, Human
gucuuguuuuuuuuuuccacuu

SEQ ID NO: 1955603 - RNA, 17 nt, Human
gucuuaauggaugaaau

SEQ ID NO: 1955604 - RNA, 21 nt, Human
gucuuauauuuacaacacuuu

SEQ ID NO: 1955605 - RNA, 14 nt, Human
gucuuaugcuucca

SEQ ID NO: 1955606 - RNA, 15 nt, Human
gucuuaugcuuccag

SEQ ID NO: 1955607 - RNA, 21 nt, Human
gucuuaugcuuccagaaacac

SEQ ID NO: 1955608 - RNA, 23 nt, Human
gucuuauuaaaacacuucauuga

SEQ ID NO: 1955609 - RNA, 18 nt, Human
gucuggaaugcaguggua

SEQ ID NO: 1955610 - RNA, 15 nt, Human
gucuggaaugcagug

SEQ ID NO: 1955611 - RNA, 16 nt, Human
gucuggaaugcagugg

SEQ ID NO: 1955612 - RNA, 19 nt, Human
gucuuauauauuguagaua

SEQ ID NO: 1955613 - RNA, 23 nt, Human
gucugacaagguggucaacaaca

SEQ ID NO: 1955614 - RNA, 20 nt, Human
gucugacaggcaaugcuggc

SEQ ID NO: 1955615 - RNA, 15 nt, Human
gucugacaggcaaug

SEQ ID NO: 1955616 - RNA, 18 nt, Human
gucugacaggcaaugcug

SEQ ID NO: 1955617 - RNA, 12 nt, Human
gucugacaggca

SEQ ID NO: 1955618 - RNA, 13 nt, Human
gucugacaggcaa

SEQ ID NO: 1955619 - RNA, 14 nt, Human
gucugacaggcaau

SEQ ID NO: 1955620 - RNA, 19 nt, Human
gucucaaaaaaagaaaaag

SEQ ID NO: 1955621 - RNA, 17 nt, Human
gucucaaaaaaagaaaa

SEQ ID NO: 1955622 - RNA, 20 nt, Human
gucuauuucaucagaacagc

SEQ ID NO: 1955623 - RNA, 22 nt, Human
gucuauuucaucagaacagcug

SEQ ID NO: 1955624 - RNA, 14 nt, Human
gucucaaaaaaaca

SEQ ID NO: 1955625 - RNA, 20 nt, Human
gucuauuuggauuauucuuu

SEQ ID NO: 1955626 - RNA, 15 nt, Human
gucucuuuuuuacaa

SEQ ID NO: 1955627 - RNA, 20 nt, Human
gucucuuuuuuacaaaggcu

SEQ ID NO: 1955628 - RNA, 16 nt, Human
gucucuuuuuuacaaa

SEQ ID NO: 1955629 - RNA, 18 nt, Human
gucucuuuuuuacaaagg

SEQ ID NO: 1955630 - RNA, 17 nt, Human
aaauucaauaguaauau

SEQ ID NO: 1955631 - RNA, 14 nt, Human
aaauucaauaguaa

SEQ ID NO: 1955632 - RNA, 23 nt, Human
aaauuaugugccagauuuaugca

SEQ ID NO: 1955633 - RNA, 18 nt, Human
aaauuaggauuucaugau

SEQ ID NO: 1955634 - RNA, 19 nt, Human
aaauuaggauuucaugauu

SEQ ID NO: 1955635 - RNA, 17 nt, Human
aaauuaugcuaagaauu

SEQ ID NO: 1955636 - RNA, 21 nt, Human
aaauuaugcuaagaauuuuuu

SEQ ID NO: 1955637 - RNA, 14 nt, Human
aaauuaugguaaaa

SEQ ID NO: 1955638 - RNA, 15 nt, Human
aaauguggcuccugg

SEQ ID NO: 1955639 - RNA, 14 nt, Human
aaauuaaucugggc

SEQ ID NO: 1955640 - RNA, 13 nt, Human
aaauuaauugugu

SEQ ID NO: 1955641 - RNA, 19 nt, Human
aaauuagccuaagauauac

SEQ ID NO: 1955642 - RNA, 20 nt, Human
aaauuagccuaagauauacu

SEQ ID NO: 1955643 - RNA, 21 nt, Human
aaauuagccuaagauauacuu

SEQ ID NO: 1955644 - RNA, 22 nt, Human
aaauuagccuaagauauacuug

SEQ ID NO: 1955645 - RNA, 20 nt, Human
aaauuacauuuguaauuuaa

SEQ ID NO: 1955646 - RNA, 23 nt, Human
aaauuacauuuguaauuuaaggu

SEQ ID NO: 1955647 - RNA, 13 nt, Human
aaauuacauuugu

SEQ ID NO: 1955648 - RNA, 15 nt, Human
aaauuacauuuguaa

SEQ ID NO: 1955649 - RNA, 16 nt, Human
aaauuacauuuguaau

SEQ ID NO: 1955650 - RNA, 18 nt, Human
aaauuacauuuguaauuu

SEQ ID NO: 1955651 - RNA, 15 nt, Human
aaauuaauuguguga

SEQ ID NO: 1955652 - RNA, 16 nt, Human
aaauuaauugugugaa

SEQ ID NO: 1955653 - RNA, 18 nt, Human
aaauuaauugugugaacu

SEQ ID NO: 1955654 - RNA, 13 nt, Human
aaauuacauuucg

SEQ ID NO: 1955655 - RNA, 12 nt, Human
aaauuacauuug

SEQ ID NO: 1955656 - RNA, 13 nt, Human
aaauuccagaaug

SEQ ID NO: 1955657 - RNA, 16 nt, Human
aaauucacaaaguuaa

SEQ ID NO: 1955658 - RNA, 16 nt, Human
aaauuccccacccuga

SEQ ID NO: 1955659 - RNA, 17 nt, Human
aaauuccaagugauuga

SEQ ID NO: 1955660 - RNA, 17 nt, Human
aaauuguauuacaaauc

SEQ ID NO: 1955661 - RNA, 18 nt, Human
aaauugucagaugcugug

SEQ ID NO: 1955662 - RNA, 19 nt, Human
aaauugucaccugcuucuc

SEQ ID NO: 1955663 - RNA, 18 nt, Human
aaauuuaaaaagcccaac

SEQ ID NO: 1955664 - RNA, 18 nt, Human
guauucucuccuguaccu

SEQ ID NO: 1955665 - RNA, 21 nt, Human
guauucucuccuguaccucuu

SEQ ID NO: 1955666 - RNA, 22 nt, Human
guauucuaauaagcuaguugaa

SEQ ID NO: 1955667 - RNA, 14 nt, Human
guauucucauucuu

SEQ ID NO: 1955668 - RNA, 19 nt, Human
guauucuaauaagcuaguu

SEQ ID NO: 1955669 - RNA, 16 nt, Human
aaaucauucauuuucu

SEQ ID NO: 1955670 - RNA, 19 nt, Human
aaaucauauuuggaauaaa

SEQ ID NO: 1955671 - RNA, 13 nt, Human
guauuguccuauu

SEQ ID NO: 1955672 - RNA, 21 nt, Human
guauuguccuauuaguguuau

SEQ ID NO: 1955673 - RNA, 10 nt, Human
guauuguaca

SEQ ID NO: 1955674 - RNA, 17 nt, Human
guauuguaggugguguu

SEQ ID NO: 1955675 - RNA, 21 nt, Human
aaaugucucuuuaaugucaca

SEQ ID NO: 1955676 - RNA, 14 nt, Human
aaaugucuuccugg

SEQ ID NO: 1955677 - RNA, 21 nt, Human
guauuuauaagaaaaauguga

SEQ ID NO: 1955678 - RNA, 11 nt, Human
guauuuauuca

SEQ ID NO: 1955679 - RNA, 13 nt, Human
aaauguaguucau

SEQ ID NO: 1955680 - RNA, 23 nt, Human
gucacugagacagcccgggcucu

SEQ ID NO: 1955681 - RNA, 21 nt, Human
gucacugagacagcccgggcu

SEQ ID NO: 1955682 - RNA, 18 nt, Human
gucacugagacagcccgg

SEQ ID NO: 1955683 - RNA, 17 nt, Human
gucacugagacagcccg

SEQ ID NO: 1955684 - RNA, 10 nt, Human
gucacugcuu

SEQ ID NO: 1955685 - RNA, 20 nt, Human
gucacugcacagugcaucuc

SEQ ID NO: 1955686 - RNA, 23 nt, Human
gucacugcacagugcaucucagc

SEQ ID NO: 1955687 - RNA, 16 nt, Human
gucacugagacagccc

SEQ ID NO: 1955688 - RNA, 15 nt, Human
gucacugagacagcc

SEQ ID NO: 1955689 - RNA, 14 nt, Human
gucacugagacagc

SEQ ID NO: 1955690 - RNA, 12 nt, Human
gucaccaagccc

SEQ ID NO: 1955691 - RNA, 15 nt, Human
gucaccaagcccagu

SEQ ID NO: 1955692 - RNA, 23 nt, Human
gucacucuggcagcucagagagg

SEQ ID NO: 1955693 - RNA, 22 nt, Human
gucaauuacaggaaguacugga

SEQ ID NO: 1955694 - RNA, 13 nt, Human
gucacaggaagua

SEQ ID NO: 1955695 - RNA, 15 nt, Human
gucacaggaaguaga

SEQ ID NO: 1955696 - RNA, 21 nt, Human
gucaauuuuguuauguauauu

SEQ ID NO: 1955697 - RNA, 20 nt, Human
gucacaggaaguagaggagg

SEQ ID NO: 1955698 - RNA, 17 nt, Human
gucacaggacucugccu

SEQ ID NO: 1955699 - RNA, 18 nt, Human
gucacaggacucugccuc

SEQ ID NO: 1955700 - RNA, 12 nt, Human
gucacaggcagg

SEQ ID NO: 1955701 - RNA, 19 nt, Human
gucacaggacucugccucc

SEQ ID NO: 1955702 - RNA, 16 nt, Human
gucacaggagggaggg

SEQ ID NO: 1955703 - RNA, 22 nt, Human
gucaccaaaucagcugcuacua

SEQ ID NO: 1955704 - RNA, 18 nt, Human
gucacauuccugaacagg

SEQ ID NO: 1955705 - RNA, 22 nt, Human
gucacaucccaccccauccucc

SEQ ID NO: 1955706 - RNA, 21 nt, Human
gucaguccaagggguccccuc

SEQ ID NO: 1955707 - RNA, 15 nt, Human
gucagggugagccca

SEQ ID NO: 1955708 - RNA, 13 nt, Human
gucagguugacag

SEQ ID NO: 1955709 - RNA, 18 nt, Human
gucagguugacaggaggu

SEQ ID NO: 1955710 - RNA, 14 nt, Human
gucagucgccuuuc

SEQ ID NO: 1955711 - RNA, 23 nt, Human
gucagucgccuuucagcaggcag

SEQ ID NO: 1955712 - RNA, 12 nt, Human
gucagucuuuag

SEQ ID NO: 1955713 - RNA, 13 nt, Human
aaauuucuaaauc

SEQ ID NO: 1955714 - RNA, 15 nt, Human
aaauuucuaaaucuc

SEQ ID NO: 1955715 - RNA, 12 nt, Human
aaauuucuaaau

SEQ ID NO: 1955716 - RNA, 16 nt, Human
gucaguguagaucaac

SEQ ID NO: 1955717 - RNA, 16 nt, Human
gucagguggggcagcu

SEQ ID NO: 1955718 - RNA, 17 nt, Human
gucagguggggcagcuu

SEQ ID NO: 1955719 - RNA, 18 nt, Human
gucagguggggcagcuug

SEQ ID NO: 1955720 - RNA, 22 nt, Human
gucagguggggcagcuugaggg

SEQ ID NO: 1955721 - RNA, 15 nt, Human
gucaggaggcagaag

SEQ ID NO: 1955722 - RNA, 17 nt, Human
gucaggaggcagaagga

SEQ ID NO: 1955723 - RNA, 22 nt, Human
gucacugcugcuucauguuugc

SEQ ID NO: 1955724 - RNA, 15 nt, Human
gucacugcuuaacuu

SEQ ID NO: 1955725 - RNA, 21 nt, Human
gucacugcuuaacuucacaua

SEQ ID NO: 1955726 - RNA, 22 nt, Human
gucacuggggcccaagagucug

SEQ ID NO: 1955727 - RNA, 17 nt, Human
gucacuggggcccaaga

SEQ ID NO: 1955728 - RNA, 21 nt, Human
gucagaaguuucugccgcagc

SEQ ID NO: 1955729 - RNA, 22 nt, Human
gucagaagagagggugaguccu

SEQ ID NO: 1955730 - RNA, 15 nt, Human
gucagaaacuaaaac

SEQ ID NO: 1955731 - RNA, 11 nt, Human
gucacuuuuag

SEQ ID NO: 1955732 - RNA, 17 nt, Human
gucacuuuguuuuacug

SEQ ID NO: 1955733 - RNA, 19 nt, Human
gucacuucuucuguccaag

SEQ ID NO: 1955734 - RNA, 13 nt, Human
gucacuucuucug

SEQ ID NO: 1955735 - RNA, 14 nt, Human
gucacuucuucugu

SEQ ID NO: 1955736 - RNA, 17 nt, Human
gucacuucuucugucca

SEQ ID NO: 1955737 - RNA, 23 nt, Human
guccccagaacucugccugcccu

SEQ ID NO: 1955738 - RNA, 22 nt, Human
guccccagcccuuccucugcuc

SEQ ID NO: 1955739 - RNA, 18 nt, Human
guccccuguuuguuucug

SEQ ID NO: 1955740 - RNA, 22 nt, Human
guccccuguuuguuucugaaag

SEQ ID NO: 1955741 - RNA, 12 nt, Human
gucccuaauaaa

SEQ ID NO: 1955742 - RNA, 19 nt, Human
gucccuuacgugaguccug

SEQ ID NO: 1955743 - RNA, 18 nt, Human
gucccuuacgugaguccu

SEQ ID NO: 1955744 - RNA, 18 nt, Human
gucccugguggcagcuca

SEQ ID NO: 1955745 - RNA, 15 nt, Human
gucccuaauaaagcu

SEQ ID NO: 1955746 - RNA, 19 nt, Human
gucccugguggcagcucac

SEQ ID NO: 1955747 - RNA, 18 nt, Human
guccccaccgcagacagg

SEQ ID NO: 1955748 - RNA, 20 nt, Human
gucccaccccacacacgcca

SEQ ID NO: 1955749 - RNA, 22 nt, Human
guccccagacuccaccaagccu

SEQ ID NO: 1955750 - RNA, 22 nt, Human
guccccaccgcagacaggacca

SEQ ID NO: 1955751 - RNA, 15 nt, Human
gucccaccccacaca

SEQ ID NO: 1955752 - RNA, 17 nt, Human
gucccaagguucugggu

SEQ ID NO: 1955753 - RNA, 18 nt, Human
gucccaagguucugggug

SEQ ID NO: 1955754 - RNA, 19 nt, Human
gucauuugagcagggcuca

SEQ ID NO: 1955755 - RNA, 12 nt, Human
gucauuucugau

SEQ ID NO: 1955756 - RNA, 22 nt, Human
guccaugaagauguagaggaga

SEQ ID NO: 1955757 - RNA, 23 nt, Human
guccaugaagauguagaggagaa

SEQ ID NO: 1955758 - RNA, 19 nt, Human
aaauuucuaaaucuccaaa

SEQ ID NO: 1955759 - RNA, 12 nt, Human
aaauuucucugu

SEQ ID NO: 1955760 - RNA, 20 nt, Human
aaauuugaaacauugcuuuu

SEQ ID NO: 1955761 - RNA, 23 nt, Human
aaauuugaaacauugcuuuuaaa

SEQ ID NO: 1955762 - RNA, 13 nt, Human
aaauuugaaacau

SEQ ID NO: 1955763 - RNA, 14 nt, Human
aaauuugaaacauu

SEQ ID NO: 1955764 - RNA, 15 nt, Human
aaauuugaaacauug

SEQ ID NO: 1955765 - RNA, 16 nt, Human
aaauuugaaacauugc

SEQ ID NO: 1955766 - RNA, 19 nt, Human
aacacaaacgggcucagca

SEQ ID NO: 1955767 - RNA, 22 nt, Human
aacacacagaaggggacugcca

SEQ ID NO: 1955768 - RNA, 17 nt, Human
aacacucauugaccuga

SEQ ID NO: 1955769 - RNA, 21 nt, Human
aacacugggagaaaugaaaaa

SEQ ID NO: 1955770 - RNA, 21 nt, Human
aacacucacauuuauucugcu

SEQ ID NO: 1955771 - RNA, 19 nt, Human
aacacuguucucugcccuc

SEQ ID NO: 1955772 - RNA, 17 nt, Human
gucauuugagcagggcu

SEQ ID NO: 1955773 - RNA, 13 nt, Human
gucauuucauguc

SEQ ID NO: 1955774 - RNA, 11 nt, Human
gucauuuccau

SEQ ID NO: 1955775 - RNA, 12 nt, Human
gucauuuccaug

SEQ ID NO: 1955776 - RNA, 18 nt, Human
gucauuuccauguaugca

SEQ ID NO: 1955777 - RNA, 21 nt, Human
gucauuuccauguaugcauaa

SEQ ID NO: 1955778 - RNA, 22 nt, Human
gucauuuccauguaugcauaau

SEQ ID NO: 1955779 - RNA, 18 nt, Human
aacacuguucucugcccu

SEQ ID NO: 1955780 - RNA, 17 nt, Human
aacacuguucucugccc

SEQ ID NO: 1955781 - RNA, 16 nt, Human
aacacuguucucugcc

SEQ ID NO: 1955782 - RNA, 16 nt, Human
gucgaggacagggagg

SEQ ID NO: 1955783 - RNA, 12 nt, Human
gucgaggcagga

SEQ ID NO: 1955784 - RNA, 16 nt, Human
guccuggcaugggaau

SEQ ID NO: 1955785 - RNA, 19 nt, Human
guccugcugcaguugccag

SEQ ID NO: 1955786 - RNA, 14 nt, Human
guccucuuuucuga

SEQ ID NO: 1955787 - RNA, 16 nt, Human
gucuaccugaggggcc

SEQ ID NO: 1955788 - RNA, 15 nt, Human
gucuaccugaggggc

SEQ ID NO: 1955789 - RNA, 13 nt, Human
gucuaccugaggg

SEQ ID NO: 1955790 - RNA, 14 nt, Human
gucuaccugagggg

SEQ ID NO: 1955791 - RNA, 20 nt, Human
gucgccuuucagcaggcagc

SEQ ID NO: 1955792 - RNA, 21 nt, Human
gucgccuuucagcaggcagcc

SEQ ID NO: 1955793 - RNA, 12 nt, Human
gucgccucugca

SEQ ID NO: 1955794 - RNA, 21 nt, Human
gucuagcguagugcagcaggg

SEQ ID NO: 1955795 - RNA, 20 nt, Human
gucuauuuacggaacucaaa

SEQ ID NO: 1955796 - RNA, 22 nt, Human
gucuaugggacucaaugcacug

SEQ ID NO: 1955797 - RNA, 15 nt, Human
guccgguuuacuuua

SEQ ID NO: 1955798 - RNA, 17 nt, Human
guccgguuuacuuuaac

SEQ ID NO: 1955799 - RNA, 18 nt, Human
aacaguccauugaaaggg

SEQ ID NO: 1955800 - RNA, 20 nt, Human
gucccuugaacuacugggug

SEQ ID NO: 1955801 - RNA, 17 nt, Human
aacauagccaaaaugug

SEQ ID NO: 1955802 - RNA, 11 nt, Human
aacauguaugu

SEQ ID NO: 1955803 - RNA, 16 nt, Human
aacauguaugugcauu

SEQ ID NO: 1955804 - RNA, 17 nt, Human
aacaugugaaaagaaua

SEQ ID NO: 1955805 - RNA, 22 nt, Human
aacauguggcuugaauuaagaa

SEQ ID NO: 1955806 - RNA, 18 nt, Human
aacauucaugcucauugc

SEQ ID NO: 1955807 - RNA, 16 nt, Human
aacauuccucaaaaug

SEQ ID NO: 1955808 - RNA, 14 nt, Human
guccuccugcugcc

SEQ ID NO: 1955809 - RNA, 15 nt, Human
guccuccugcugcca

SEQ ID NO: 1955810 - RNA, 16 nt, Human
guccuccugcugccag

SEQ ID NO: 1955811 - RNA, 17 nt, Human
guccuccugcugccagu

SEQ ID NO: 1955812 - RNA, 24 nt, Human
aacauuggaagcagguuaaauguu

SEQ ID NO: 1955813 - RNA, 14 nt, Human
aacauugcuuuuaa

SEQ ID NO: 1955814 - RNA, 15 nt, Human
aacauugcuuuuaaa

SEQ ID NO: 1955815 - RNA, 17 nt, Human
aacauugcuuuuaaaac

SEQ ID NO: 1955816 - RNA, 19 nt, Human
aacauugcuuuuaaaacua

SEQ ID NO: 1955817 - RNA, 12 nt, Human
aacauuggaagc

SEQ ID NO: 1955818 - RNA, 16 nt, Human
aacauuggaagcaggu

SEQ ID NO: 1955819 - RNA, 22 nt, Human
aacauuggaagcagguuaaaug

SEQ ID NO: 1955820 - RNA, 23 nt, Human
aacauuggaagcagguuaaaugu

SEQ ID NO: 1955821 - RNA, 23 nt, Human
uaaaacuguacuuugauucacau

SEQ ID NO: 1955822 - RNA, 15 nt, Human
uaaaacuguacuuug

SEQ ID NO: 1955823 - RNA, 16 nt, Human
uaaaacuguacuuuga

SEQ ID NO: 1955824 - RNA, 17 nt, Human
uaaaacuguacuuugau

SEQ ID NO: 1955825 - RNA, 19 nt, Human
uaaaacuguacuuugauuc

SEQ ID NO: 1955826 - RNA, 20 nt, Human
uaaaacuguacuuugauuca

SEQ ID NO: 1955827 - RNA, 22 nt, Human
uaaaacuguacuuugauucaca

SEQ ID NO: 1955828 - RNA, 12 nt, Human
uaaaacuuuuua

SEQ ID NO: 1955829 - RNA, 15 nt, Human
uaaaacuuuuuaaaa

SEQ ID NO: 1955830 - RNA, 14 nt, Human
uaaaacuguacuuu

SEQ ID NO: 1955831 - RNA, 13 nt, Human
uaaaacuguacuu

SEQ ID NO: 1955832 - RNA, 17 nt, Human
uaaaaccaggcuuucua

SEQ ID NO: 1955833 - RNA, 17 nt, Human
uaaaacuacuuagcacu

SEQ ID NO: 1955834 - RNA, 13 nt, Human
uaaaacccaagug

SEQ ID NO: 1955835 - RNA, 23 nt, Human
uaaaaaucucaaauuucuaaauc

SEQ ID NO: 1955836 - RNA, 15 nt, Human
uaaaaaugagguacu

SEQ ID NO: 1955837 - RNA, 23 nt, Human
uaaaaauaucaaauuaauugugu

SEQ ID NO: 1955838 - RNA, 16 nt, Human
uaaaaaucucucauuu

SEQ ID NO: 1955839 - RNA, 22 nt, Human
uaaaaaugagguacucuccugg

SEQ ID NO: 1955840 - RNA, 21 nt, Human
uaaaaaaaaaccugagcccca

SEQ ID NO: 1955841 - RNA, 22 nt, Human
uaaaaagcuccaaaugcagcuu

SEQ ID NO: 1955842 - RNA, 21 nt, Human
uaaaaauauacauguuuaugu

SEQ ID NO: 1955843 - RNA, 13 nt, Human
uaaaaauauacau

SEQ ID NO: 1955844 - RNA, 15 nt, Human
uaaaaauauacaugu

SEQ ID NO: 1955845 - RNA, 16 nt, Human
uaaaaauauacauguu

SEQ ID NO: 1955846 - RNA, 17 nt, Human
uaaaaauauacauguuu

SEQ ID NO: 1955847 - RNA, 21 nt, Human
uaaaaaguauugccaaacauu

SEQ ID NO: 1955848 - RNA, 14 nt, Human
uaaaaagucuuuua

SEQ ID NO: 1955849 - RNA, 16 nt, Human
uaaaaagucuuuuaaa

SEQ ID NO: 1955850 - RNA, 18 nt, Human
uaaaaaggaauaugaaag

SEQ ID NO: 1955851 - RNA, 23 nt, Human
uaaaaagguccucacaggugucu

SEQ ID NO: 1955852 - RNA, 13 nt, Human
uaaaaaguauugc

SEQ ID NO: 1955853 - RNA, 20 nt, Human
uaaaaaguauugccaaacau

SEQ ID NO: 1955854 - RNA, 22 nt, Human
uaaaauaagaauagaacaacau

SEQ ID NO: 1955855 - RNA, 13 nt, Human
uaaaauaaacuuu

SEQ ID NO: 1955856 - RNA, 14 nt, Human
uaaaauaaacuuuc

SEQ ID NO: 1955857 - RNA, 15 nt, Human
uaaaauaaacuuucu

SEQ ID NO: 1955858 - RNA, 16 nt, Human
uaaaauaaacuuucuu

SEQ ID NO: 1955859 - RNA, 14 nt, Human
uaaaagaaaauaaa

SEQ ID NO: 1955860 - RNA, 17 nt, Human
uaaaagaaaauaaaaaa

SEQ ID NO: 1955861 - RNA, 22 nt, Human
uaaaagaaaauaaaaaaaagaa

SEQ ID NO: 1955862 - RNA, 21 nt, Human
uaaaagaagaaauaguucugu

SEQ ID NO: 1955863 - RNA, 13 nt, Human
uaaaagucuugug

SEQ ID NO: 1955864 - RNA, 22 nt, Human
uaaaagaagaaauaguucugug

SEQ ID NO: 1955865 - RNA, 21 nt, Human
uaaaauaccagccaguaaaug

SEQ ID NO: 1955866 - RNA, 12 nt, Human
uaaaauaauaaa

SEQ ID NO: 1955867 - RNA, 13 nt, Human
aagugauccuccc

SEQ ID NO: 1955868 - RNA, 19 nt, Human
aagugauccucccaccuca

SEQ ID NO: 1955869 - RNA, 20 nt, Human
aagugauccucccaccucag

SEQ ID NO: 1955870 - RNA, 19 nt, Human
aagugcagaacugcaguca

SEQ ID NO: 1955871 - RNA, 17 nt, Human
aagugauucucaugccu

SEQ ID NO: 1955872 - RNA, 23 nt, Human
aagugauccucccaccucagccu

SEQ ID NO: 1955873 - RNA, 13 nt, Human
aagugauucucau

SEQ ID NO: 1955874 - RNA, 16 nt, Human
aagugauucucaugcc

SEQ ID NO: 1955875 - RNA, 19 nt, Human
aagugauucucaugccuca

SEQ ID NO: 1955876 - RNA, 23 nt, Human
aaguuauauuuccuauaccauuu

SEQ ID NO: 1955877 - RNA, 14 nt, Human
aaguuauguguaug

SEQ ID NO: 1955878 - RNA, 15 nt, Human
aaguuauguguaugu

SEQ ID NO: 1955879 - RNA, 14 nt, Human
aaguuauauuuccu

SEQ ID NO: 1955880 - RNA, 22 nt, Human
aaguuauauuuccuauaccauu

SEQ ID NO: 1955881 - RNA, 16 nt, Human
aaguuauguguaugug

SEQ ID NO: 1955882 - RNA, 14 nt, Human
aaguuauuaaaauu

SEQ ID NO: 1955883 - RNA, 16 nt, Human
aaguuauuaaaauugu

SEQ ID NO: 1955884 - RNA, 17 nt, Human
aaguuauuaaaauuguu

SEQ ID NO: 1955885 - RNA, 18 nt, Human
aaguuaguuccacugaga

SEQ ID NO: 1955886 - RNA, 19 nt, Human
aaguuaguuccacugagac

SEQ ID NO: 1955887 - RNA, 14 nt, Human
aaguuaguuucagu

SEQ ID NO: 1955888 - RNA, 15 nt, Human
aaguuaguaggauau

SEQ ID NO: 1955889 - RNA, 21 nt, Human
aaguuagccuuuaucuaccaa

SEQ ID NO: 1955890 - RNA, 19 nt, Human
aaguuaguaggauaugccu

SEQ ID NO: 1955891 - RNA, 16 nt, Human
aaguuaguaggauaug

SEQ ID NO: 1955892 - RNA, 21 nt, Human
aaguguguguuuuucauaaag

SEQ ID NO: 1955893 - RNA, 16 nt, Human
aaguguguguuuuuca

SEQ ID NO: 1955894 - RNA, 11 nt, Human
aaguuaagaau

SEQ ID NO: 1955895 - RNA, 16 nt, Human
aaguuagccuuuaucu

SEQ ID NO: 1955896 - RNA, 17 nt, Human
aaguuagccuuuaucua

SEQ ID NO: 1955897 - RNA, 23 nt, Human
aaguuaagaauguucuuauguug

SEQ ID NO: 1955898 - RNA, 10 nt, Human
aagugugggu

SEQ ID NO: 1955899 - RNA, 17 nt, Human
aagugugggucugugug

SEQ ID NO: 1955900 - RNA, 18 nt, Human
aagugugggucugugugu

SEQ ID NO: 1955901 - RNA, 20 nt, Human
aagugugaauacugcuugaa

SEQ ID NO: 1955902 - RNA, 20 nt, Human
aagugugggucugugugugu

SEQ ID NO: 1955903 - RNA, 13 nt, Human
aagugugguagag

SEQ ID NO: 1955904 - RNA, 12 nt, Human
aaguguguguuu

SEQ ID NO: 1955905 - RNA, 23 nt, Human
aaguguauuuuuuuacuaauaga

SEQ ID NO: 1955906 - RNA, 14 nt, Human
aagugugaauacug

SEQ ID NO: 1955907 - RNA, 15 nt, Human
aagugugaauacugc

SEQ ID NO: 1955908 - RNA, 16 nt, Human
aagugugaauacugcu

SEQ ID NO: 1955909 - RNA, 18 nt, Human
aagugugaauacugcuug

SEQ ID NO: 1955910 - RNA, 15 nt, Human
uaaaauugugaugug

SEQ ID NO: 1955911 - RNA, 19 nt, Human
uaaaauuguacaugaacau

SEQ ID NO: 1955912 - RNA, 16 nt, Human
uaaaauugugaugugu

SEQ ID NO: 1955913 - RNA, 15 nt, Human
uaaaauucucuucca

SEQ ID NO: 1955914 - RNA, 15 nt, Human
uaaaauguacaugua

SEQ ID NO: 1955915 - RNA, 17 nt, Human
uaaaauguacauguauu

SEQ ID NO: 1955916 - RNA, 18 nt, Human
uaaaauguacauguauua

SEQ ID NO: 1955917 - RNA, 22 nt, Human
uaaaauguacauguauuaaauu

SEQ ID NO: 1955918 - RNA, 14 nt, Human
uaaaauguacaugu

SEQ ID NO: 1955919 - RNA, 21 nt, Human
uaaaauguccaguaagaucac

SEQ ID NO: 1955920 - RNA, 22 nt, Human
uaaaauguccaguaagaucacu

SEQ ID NO: 1955921 - RNA, 19 nt, Human
uaaaauguccaguaagauc

SEQ ID NO: 1955922 - RNA, 20 nt, Human
uaaaauguccaguaagauca

SEQ ID NO: 1955923 - RNA, 20 nt, Human
aaguuugagaucagccuggg

SEQ ID NO: 1955924 - RNA, 12 nt, Human
aaguuugauaaa

SEQ ID NO: 1955925 - RNA, 17 nt, Human
aaguuugauaaauagug

SEQ ID NO: 1955926 - RNA, 20 nt, Human
aaguuugauaaauaguguua

SEQ ID NO: 1955927 - RNA, 21 nt, Human
aaguuugauaaauaguguuau

SEQ ID NO: 1955928 - RNA, 12 nt, Human
aaguuugaucuu

SEQ ID NO: 1955929 - RNA, 15 nt, Human
aaguuugaucuuccu

SEQ ID NO: 1955930 - RNA, 18 nt, Human
aaguuugaucuuccucug

SEQ ID NO: 1955931 - RNA, 9 nt, Human
uaaaauggu

SEQ ID NO: 1955932 - RNA, 23 nt, Human
aaguuugaucuuccucugcuaaa

SEQ ID NO: 1955933 - RNA, 13 nt, Human
uaaaauguaaaaa

SEQ ID NO: 1955934 - RNA, 21 nt, Human
aaguuucugccgcagcccugc

SEQ ID NO: 1955935 - RNA, 19 nt, Human
aaguuucugccgcagcccu

SEQ ID NO: 1955936 - RNA, 22 nt, Human
aaguuucuuugaaaauaguuau

SEQ ID NO: 1955937 - RNA, 19 nt, Human
aaguuauuuuuaauuuggu

SEQ ID NO: 1955938 - RNA, 15 nt, Human
aaguuauuucccuuu

SEQ ID NO: 1955939 - RNA, 14 nt, Human
aaguucccuacuuc

SEQ ID NO: 1955940 - RNA, 17 nt, Human
aaguucccuacuuccug

SEQ ID NO: 1955941 - RNA, 20 nt, Human
aaguucccuacuuccuguga

SEQ ID NO: 1955942 - RNA, 18 nt, Human
aaguaacuggugauauau

SEQ ID NO: 1955943 - RNA, 23 nt, Human
aagguuucagaaagaagugggga

SEQ ID NO: 1955944 - RNA, 21 nt, Human
aagguauuaagauuauaauug

SEQ ID NO: 1955945 - RNA, 22 nt, Human
aagguauuaagauuauaauugu

SEQ ID NO: 1955946 - RNA, 16 nt, Human
aagguauaucauucua

SEQ ID NO: 1955947 - RNA, 22 nt, Human
aagguauaucauucuaaagaua

SEQ ID NO: 1955948 - RNA, 23 nt, Human
aagguauaucauucuaaagauag

SEQ ID NO: 1955949 - RNA, 21 nt, Human
aagggguaggauuacuaggug

SEQ ID NO: 1955950 - RNA, 20 nt, Human
aagguagaaugaccuuguaa

SEQ ID NO: 1955951 - RNA, 15 nt, Human
aaggggguagggaaa

SEQ ID NO: 1955952 - RNA, 14 nt, Human
aagguagaauguuu

SEQ ID NO: 1955953 - RNA, 13 nt, Human
aagguagaauguu

SEQ ID NO: 1955954 - RNA, 22 nt, Human
aagguagaaugaccuuguaaug

SEQ ID NO: 1955955 - RNA, 22 nt, Human
aagguaggguaggcagccugag

SEQ ID NO: 1955956 - RNA, 15 nt, Human
aagguaguucaagaa

SEQ ID NO: 1955957 - RNA, 22 nt, Human
aagguaguucaagaaaugaaga

SEQ ID NO: 1955958 - RNA, 23 nt, Human
aagggggcugggacaugggaaag

SEQ ID NO: 1955959 - RNA, 12 nt, Human
aagggggcuggg

SEQ ID NO: 1955960 - RNA, 13 nt, Human
aaggggagaguaa

SEQ ID NO: 1955961 - RNA, 14 nt, Human
aaggcuuauaaaac

SEQ ID NO: 1955962 - RNA, 15 nt, Human
aaggcuuauaaaaca

SEQ ID NO: 1955963 - RNA, 17 nt, Human
aaggggacugccaccuc

SEQ ID NO: 1955964 - RNA, 19 nt, Human
aaggggacugccaccuccc

SEQ ID NO: 1955965 - RNA, 20 nt, Human
aaggggacaaguagccaccu

SEQ ID NO: 1955966 - RNA, 20 nt, Human
aaggcugucaauuacaggaa

SEQ ID NO: 1955967 - RNA, 12 nt, Human
aaggcuguauuc

SEQ ID NO: 1955968 - RNA, 16 nt, Human
aaggcuguauucagca

SEQ ID NO: 1955969 - RNA, 17 nt, Human
aaggcuguauucagcaa

SEQ ID NO: 1955970 - RNA, 18 nt, Human
aaggcugucucagauaaa

SEQ ID NO: 1955971 - RNA, 22 nt, Human
aaggcugggggaagaagcucuc

SEQ ID NO: 1955972 - RNA, 19 nt, Human
aaggcugggggaagaagcu

SEQ ID NO: 1955973 - RNA, 11 nt, Human
guuucagaaau

SEQ ID NO: 1955974 - RNA, 13 nt, Human
guuucagaaaugu

SEQ ID NO: 1955975 - RNA, 14 nt, Human
aaggcugggggaag

SEQ ID NO: 1955976 - RNA, 16 nt, Human
aaggcugggggaagaa

SEQ ID NO: 1955977 - RNA, 23 nt, Human
guuguuugauucagacagcugcc

SEQ ID NO: 1955978 - RNA, 13 nt, Human
guuguuuguaugu

SEQ ID NO: 1955979 - RNA, 13 nt, Human
aaggaaaaauuca

SEQ ID NO: 1955980 - RNA, 22 nt, Human
aaggaaacccagcucuggucca

SEQ ID NO: 1955981 - RNA, 17 nt, Human
aaggaaacccagcucug

SEQ ID NO: 1955982 - RNA, 21 nt, Human
guuuaagugacugauggcuaa

SEQ ID NO: 1955983 - RNA, 22 nt, Human
guuuaauaaagcgaaaaacuca

SEQ ID NO: 1955984 - RNA, 15 nt, Human
guuguuuuguacaga

SEQ ID NO: 1955985 - RNA, 17 nt, Human
guuguuuuguacagaug

SEQ ID NO: 1955986 - RNA, 14 nt, Human
guuguuuuuguaua

SEQ ID NO: 1955987 - RNA, 21 nt, Human
guuguuuuuguauauugguuu

SEQ ID NO: 1955988 - RNA, 17 nt, Human
guuguuuguauguauaa

SEQ ID NO: 1955989 - RNA, 14 nt, Human
guuuaugauuccac

SEQ ID NO: 1955990 - RNA, 19 nt, Human
guuuauguaaacaaaucuu

SEQ ID NO: 1955991 - RNA, 20 nt, Human
guuuauguaaacaaaucuuu

SEQ ID NO: 1955992 - RNA, 17 nt, Human
guuucaaacuuuacuau

SEQ ID NO: 1955993 - RNA, 18 nt, Human
guuuauucuugaugaaaa

SEQ ID NO: 1955994 - RNA, 16 nt, Human
guuuauucuugaugaa

SEQ ID NO: 1955995 - RNA, 17 nt, Human
guuuauucuugaugaaa

SEQ ID NO: 1955996 - RNA, 14 nt, Human
guuuauucaaacug

SEQ ID NO: 1955997 - RNA, 19 nt, Human
guuuauucaaacugaaaag

SEQ ID NO: 1955998 - RNA, 20 nt, Human
guuuauuccagagcugccag

SEQ ID NO: 1955999 - RNA, 15 nt, Human
guuuauuccagagcu

SEQ ID NO: 1956000 - RNA, 12 nt, Human
guuucaauaaag

SEQ ID NO: 1956001 - RNA, 14 nt, Human
guuucaauaaaguu

SEQ ID NO: 1956002 - RNA, 16 nt, Human
guuucaauaaaguuug

SEQ ID NO: 1956003 - RNA, 17 nt, Human
guuucaauaaaguuuga

SEQ ID NO: 1956004 - RNA, 18 nt, Human
guuucaauaaaguuugau

SEQ ID NO: 1956005 - RNA, 22 nt, Human
guuucaccauguuggccaggcu

SEQ ID NO: 1956006 - RNA, 15 nt, Human
guuuuaaagcuucca

SEQ ID NO: 1956007 - RNA, 19 nt, Human
guuuggacaaaauggaaua

SEQ ID NO: 1956008 - RNA, 20 nt, Human
guuugcuuuguaugcacuuu

SEQ ID NO: 1956009 - RNA, 13 nt, Human
guuuggagacaga

SEQ ID NO: 1956010 - RNA, 21 nt, Human
aaguaauaugcacacauuuuu

SEQ ID NO: 1956011 - RNA, 23 nt, Human
guuugcuccccuuccccuuccuu

SEQ ID NO: 1956012 - RNA, 20 nt, Human
guuugcugaacauuggagaa

SEQ ID NO: 1956013 - RNA, 14 nt, Human
guuugcuguugcug

SEQ ID NO: 1956014 - RNA, 17 nt, Human
aaguaauaugcacacau

SEQ ID NO: 1956015 - RNA, 18 nt, Human
aaguaauaugcacacauu

SEQ ID NO: 1956016 - RNA, 20 nt, Human
aaguaauaugcacacauuuu

SEQ ID NO: 1956017 - RNA, 14 nt, Human
guuuucuguucuuu

SEQ ID NO: 1956018 - RNA, 18 nt, Human
guuuuauuuauauuuauu

SEQ ID NO: 1956019 - RNA, 22 nt, Human
guuuuauuuauauuuauugacu

SEQ ID NO: 1956020 - RNA, 21 nt, Human
guuuuauuuucuaaaguacug

SEQ ID NO: 1956021 - RNA, 15 nt, Human
guuuucuguucuuuc

SEQ ID NO: 1956022 - RNA, 16 nt, Human
guuuucuguucuuucu

SEQ ID NO: 1956023 - RNA, 19 nt, Human
guuuucuguucuuucuggc

SEQ ID NO: 1956024 - RNA, 20 nt, Human
guuuuauuuucuaaaguacu

SEQ ID NO: 1956025 - RNA, 12 nt, Human
guuuugagcccu

SEQ ID NO: 1956026 - RNA, 21 nt, Human
guuuuaucguccagugacuuu

SEQ ID NO: 1956027 - RNA, 12 nt, Human
guuuuauuuaua

SEQ ID NO: 1956028 - RNA, 14 nt, Human
guuuuauuuauauu

SEQ ID NO: 1956029 - RNA, 17 nt, Human
guuuuauuuauauuuau

SEQ ID NO: 1956030 - RNA, 17 nt, Human
guuuuaacaagaagcaa

SEQ ID NO: 1956031 - RNA, 22 nt, Human
guuuuaaggaugcuuguacaua

SEQ ID NO: 1956032 - RNA, 13 nt, Human
aaguacuauguau

SEQ ID NO: 1956033 - RNA, 17 nt, Human
aaguacuauaauuuacc

SEQ ID NO: 1956034 - RNA, 14 nt, Human
aaguacuauaauuu

SEQ ID NO: 1956035 - RNA, 15 nt, Human
aaguaauuguuccag

SEQ ID NO: 1956036 - RNA, 15 nt, Human
aaguauuauaccuuu

SEQ ID NO: 1956037 - RNA, 20 nt, Human
aaguauuauaaacaagaaug

SEQ ID NO: 1956038 - RNA, 18 nt, Human
aaguacuucuccacccug

SEQ ID NO: 1956039 - RNA, 19 nt, Human
aaguacuucuccacccugc

SEQ ID NO: 1956040 - RNA, 20 nt, Human
aaguacuucuccacccugcu

SEQ ID NO: 1956041 - RNA, 18 nt, Human
aaguauugccaaacauua

SEQ ID NO: 1956042 - RNA, 17 nt, Human
aaguauuguacaaauaa

SEQ ID NO: 1956043 - RNA, 13 nt, Human
aaguauuuaagcc

SEQ ID NO: 1956044 - RNA, 19 nt, Human
aaguauuuaagccuaaaga

SEQ ID NO: 1956045 - RNA, 15 nt, Human
aaguauuuuccuguu

SEQ ID NO: 1956046 - RNA, 23 nt, Human
aaguauucuuauuuaaugaaaga

SEQ ID NO: 1956047 - RNA, 13 nt, Human
aaguauugccaaa

SEQ ID NO: 1956048 - RNA, 17 nt, Human
aaguauugccaaacauu

SEQ ID NO: 1956049 - RNA, 16 nt, Human
aaguauuauaccuuuu

SEQ ID NO: 1956050 - RNA, 19 nt, Human
aaguauuauaccuuuuuua

SEQ ID NO: 1956051 - RNA, 21 nt, Human
aaguauucuuauuuaaugaaa

SEQ ID NO: 1956052 - RNA, 21 nt, Human
aagucacuggccaguggcugg

SEQ ID NO: 1956053 - RNA, 22 nt, Human
aagucacugcacagugcaucuc

SEQ ID NO: 1956054 - RNA, 19 nt, Human
aagucaaacacuugugacu

SEQ ID NO: 1956055 - RNA, 20 nt, Human
aagucaaacacuugugacuu

SEQ ID NO: 1956056 - RNA, 16 nt, Human
aagucaaacacuugug

SEQ ID NO: 1956057 - RNA, 20 nt, Human
aagucagaaacuaaaacaaa

SEQ ID NO: 1956058 - RNA, 22 nt, Human
guucccuuuuuuggcugcugaa

SEQ ID NO: 1956059 - RNA, 21 nt, Human
guucccuuuuuuggcugcuga

SEQ ID NO: 1956060 - RNA, 21 nt, Human
guuccgaaaccaaagaagaaa

SEQ ID NO: 1956061 - RNA, 21 nt, Human
aagcuuuuaugugaaacaugu

SEQ ID NO: 1956062 - RNA, 19 nt, Human
aagcuuuuaugugaaacau

SEQ ID NO: 1956063 - RNA, 14 nt, Human
aagcuuuuccuaau

SEQ ID NO: 1956064 - RNA, 18 nt, Human
guucccccuguuucagag

SEQ ID NO: 1956065 - RNA, 15 nt, Human
guuccccaagacauu

SEQ ID NO: 1956066 - RNA, 19 nt, Human
aagcuguuugguuuuaaaa

SEQ ID NO: 1956067 - RNA, 20 nt, Human
aagcuguuugguuuuaaaau

SEQ ID NO: 1956068 - RNA, 21 nt, Human
aagcuguuugguuuuaaaaua

SEQ ID NO: 1956069 - RNA, 17 nt, Human
aagcuucccucccugcu

SEQ ID NO: 1956070 - RNA, 14 nt, Human
aagcuauaaauuau

SEQ ID NO: 1956071 - RNA, 16 nt, Human
aagcucacuugcuuua

SEQ ID NO: 1956072 - RNA, 17 nt, Human
aagcucugcuccucucc

SEQ ID NO: 1956073 - RNA, 22 nt, Human
guugacucuaguacugugaauc

SEQ ID NO: 1956074 - RNA, 19 nt, Human
guugauagcacagacccug

SEQ ID NO: 1956075 - RNA, 14 nt, Human
guugauagcacaga

SEQ ID NO: 1956076 - RNA, 15 nt, Human
guucuugguuuguaa

SEQ ID NO: 1956077 - RNA, 18 nt, Human
guucuugguuuguaaauu

SEQ ID NO: 1956078 - RNA, 12 nt, Human
guugacauuugu

SEQ ID NO: 1956079 - RNA, 21 nt, Human
guucuuggcaauaaauuuuga

SEQ ID NO: 1956080 - RNA, 22 nt, Human
guucuuggcaauaaauuuugaa

SEQ ID NO: 1956081 - RNA, 23 nt, Human
guucuuggcaauaaauuuugaaa

SEQ ID NO: 1956082 - RNA, 19 nt, Human
guugacucuaguacuguga

SEQ ID NO: 1956083 - RNA, 21 nt, Human
guugacucuaguacugugaau

SEQ ID NO: 1956084 - RNA, 20 nt, Human
guucuuggcaauaaauuuug

SEQ ID NO: 1956085 - RNA, 14 nt, Human
guucuugguuugua

SEQ ID NO: 1956086 - RNA, 14 nt, Human
guucuuaauucuua

SEQ ID NO: 1956087 - RNA, 17 nt, Human
guucuuaauucuuagcu

SEQ ID NO: 1956088 - RNA, 14 nt, Human
guucuuccaaagca

SEQ ID NO: 1956089 - RNA, 15 nt, Human
guucuuccaaagcag

SEQ ID NO: 1956090 - RNA, 19 nt, Human
guucuuccaguuacuuucc

SEQ ID NO: 1956091 - RNA, 18 nt, Human
guucucugcccuccaaga

SEQ ID NO: 1956092 - RNA, 17 nt, Human
guucucugcccuccaag

SEQ ID NO: 1956093 - RNA, 13 nt, Human
guucuuaauucuu

SEQ ID NO: 1956094 - RNA, 15 nt, Human
guucucucuucucca

SEQ ID NO: 1956095 - RNA, 12 nt, Human
guucucugagga

SEQ ID NO: 1956096 - RNA, 15 nt, Human
guucucugcccucca

SEQ ID NO: 1956097 - RNA, 14 nt, Human
guucucugaggaca

SEQ ID NO: 1956098 - RNA, 13 nt, Human
guucucugcccuc

SEQ ID NO: 1956099 - RNA, 19 nt, Human
guucuagcauggcugccaa

SEQ ID NO: 1956100 - RNA, 20 nt, Human
guuccgaaaccaaagaagaa

SEQ ID NO: 1956101 - RNA, 21 nt, Human
guucucucuacugguccucuu

SEQ ID NO: 1956102 - RNA, 13 nt, Human
guucucuccuucu

SEQ ID NO: 1956103 - RNA, 17 nt, Human
guucagguaacaggcag

SEQ ID NO: 1956104 - RNA, 18 nt, Human
guucagguaacaggcaga

SEQ ID NO: 1956105 - RNA, 15 nt, Human
aagccguggcuuccc

SEQ ID NO: 1956106 - RNA, 13 nt, Human
aagccguggcuuc

SEQ ID NO: 1956107 - RNA, 14 nt, Human
aagccguggcuucc

SEQ ID NO: 1956108 - RNA, 21 nt, Human
aagccgugauuuucauugcug

SEQ ID NO: 1956109 - RNA, 20 nt, Human
guucaggguuggccccugcc

SEQ ID NO: 1956110 - RNA, 19 nt, Human
guucagggaagauaaguug

SEQ ID NO: 1956111 - RNA, 23 nt, Human
guucagggaagauaaguuggaaa

SEQ ID NO: 1956112 - RNA, 21 nt, Human
guucaggguuggccccugccc

SEQ ID NO: 1956113 - RNA, 22 nt, Human
guucaggguuggccccugcccg

SEQ ID NO: 1956114 - RNA, 12 nt, Human
guucagcuuggg

SEQ ID NO: 1956115 - RNA, 23 nt, Human
guucagcuuguaaauagcucagg

SEQ ID NO: 1956116 - RNA, 18 nt, Human
guuauuuugauguaaaga

SEQ ID NO: 1956117 - RNA, 17 nt, Human
aagccuuaagcugcagg

SEQ ID NO: 1956118 - RNA, 14 nt, Human
aagccuuagggaag

SEQ ID NO: 1956119 - RNA, 15 nt, Human
aagcuagucaacagu

SEQ ID NO: 1956120 - RNA, 17 nt, Human
aagcuagucaacaguac

SEQ ID NO: 1956121 - RNA, 13 nt, Human
aagcuaguugaau

SEQ ID NO: 1956122 - RNA, 15 nt, Human
aagcuaguugaauac

SEQ ID NO: 1956123 - RNA, 17 nt, Human
aagcuaguugaauacuu

SEQ ID NO: 1956124 - RNA, 19 nt, Human
aagcuaguugaauacuuga

SEQ ID NO: 1956125 - RNA, 20 nt, Human
aagcuaguugaauacuugaa

SEQ ID NO: 1956126 - RNA, 21 nt, Human
aagcuaguugaauacuugaac

SEQ ID NO: 1956127 - RNA, 18 nt, Human
aagccuguuuaagagaca

SEQ ID NO: 1956128 - RNA, 15 nt, Human
aagccuguuuaagag

SEQ ID NO: 1956129 - RNA, 18 nt, Human
aagccuggucagcccaaa

SEQ ID NO: 1956130 - RNA, 15 nt, Human
aagccuccuccagcc

SEQ ID NO: 1956131 - RNA, 16 nt, Human
aagccucccacgacug

SEQ ID NO: 1956132 - RNA, 18 nt, Human
guuaaucauuagguguga

SEQ ID NO: 1956133 - RNA, 19 nt, Human
guuaauauuuauaggucac

SEQ ID NO: 1956134 - RNA, 23 nt, Human
guuaauuuaaguuuugacaagcu

SEQ ID NO: 1956135 - RNA, 13 nt, Human
guuaauuuaaguu

SEQ ID NO: 1956136 - RNA, 19 nt, Human
guuaauuuaaguuuugaca

SEQ ID NO: 1956137 - RNA, 12 nt, Human
guuaauuuaagu

SEQ ID NO: 1956138 - RNA, 17 nt, Human
guuaauugauagaauaa

SEQ ID NO: 1956139 - RNA, 23 nt, Human
guuacucuucaguuaagccuuug

SEQ ID NO: 1956140 - RNA, 15 nt, Human
guuacucuugggaca

SEQ ID NO: 1956141 - RNA, 12 nt, Human
guuaauuuggac

SEQ ID NO: 1956142 - RNA, 17 nt, Human
guuaauuuggaccauuu

SEQ ID NO: 1956143 - RNA, 20 nt, Human
guuaauuuggaccauuuucc

SEQ ID NO: 1956144 - RNA, 22 nt, Human
guuaauuuggaccauuuuccug

SEQ ID NO: 1956145 - RNA, 12 nt, Human
aagcccaaccuc

SEQ ID NO: 1956146 - RNA, 14 nt, Human
guuaauauggcuga

SEQ ID NO: 1956147 - RNA, 13 nt, Human
aagcccagcuuga

SEQ ID NO: 1956148 - RNA, 20 nt, Human
guuauuauauuuacaaaugg

SEQ ID NO: 1956149 - RNA, 22 nt, Human
guuauugguguaagguacuuuc

SEQ ID NO: 1956150 - RNA, 14 nt, Human
guuacuguaaaaug

SEQ ID NO: 1956151 - RNA, 17 nt, Human
guuacuguaaaaugcaa

SEQ ID NO: 1956152 - RNA, 19 nt, Human
guuacuguaaaaugcaaaa

SEQ ID NO: 1956153 - RNA, 12 nt, Human
guuagacugcca

SEQ ID NO: 1956154 - RNA, 14 nt, Human
guuagacugccagc

SEQ ID NO: 1956155 - RNA, 15 nt, Human
guuagacugccagcu

SEQ ID NO: 1956156 - RNA, 22 nt, Human
guuagacugccagcucuuccua

SEQ ID NO: 1956157 - RNA, 19 nt, Human
guuagagguucccuuugac

SEQ ID NO: 1956158 - RNA, 17 nt, Human
guuagacugccagcucu

SEQ ID NO: 1956159 - RNA, 19 nt, Human
guuauuauauuuacaaaug

SEQ ID NO: 1956160 - RNA, 12 nt, Human
aagcaugugaga

SEQ ID NO: 1956161 - RNA, 23 nt, Human
aagcaugcacaaauucugucucu

SEQ ID NO: 1956162 - RNA, 12 nt, Human
aagcaugaacag

SEQ ID NO: 1956163 - RNA, 20 nt, Human
aagcaugaacagugcaccug

SEQ ID NO: 1956164 - RNA, 18 nt, Human
aagcaugacagaaaauau

SEQ ID NO: 1956165 - RNA, 19 nt, Human
aagcaugacagaaaauaug

SEQ ID NO: 1956166 - RNA, 20 nt, Human
aagcaugacagaaaauaugu

SEQ ID NO: 1956167 - RNA, 22 nt, Human
aagcaugacagaaaauauguau

SEQ ID NO: 1956168 - RNA, 16 nt, Human
aagcaugccaauuucu

SEQ ID NO: 1956169 - RNA, 19 nt, Human
aagcaugccaauuucucuu

SEQ ID NO: 1956170 - RNA, 14 nt, Human
aagcauauaaaaug

SEQ ID NO: 1956171 - RNA, 15 nt, Human
aagcauauaaaaugg

SEQ ID NO: 1956172 - RNA, 16 nt, Human
aagcauauaaaauggc

SEQ ID NO: 1956173 - RNA, 17 nt, Human
aagcauauaaaauggca

SEQ ID NO: 1956174 - RNA, 22 nt, Human
aagcauauaaaauggcaacaaa

SEQ ID NO: 1956175 - RNA, 13 nt, Human
aagcauuuuguaa

SEQ ID NO: 1956176 - RNA, 12 nt, Human
aagcauuuugua

SEQ ID NO: 1956177 - RNA, 20 nt, Human
aagcauuugguuuuucacau

SEQ ID NO: 1956178 - RNA, 13 nt, Human
aagcauguuuugc

SEQ ID NO: 1956179 - RNA, 14 nt, Human
aagcauguuuugca

SEQ ID NO: 1956180 - RNA, 15 nt, Human
aagcauguuuugcau

SEQ ID NO: 1956181 - RNA, 17 nt, Human
aagcauguuuugcaugu

SEQ ID NO: 1956182 - RNA, 13 nt, Human
aagcauuuaaagg

SEQ ID NO: 1956183 - RNA, 17 nt, Human
aagccaaagcuaggccu

SEQ ID NO: 1956184 - RNA, 18 nt, Human
aagccaaagcuaggccug

SEQ ID NO: 1956185 - RNA, 20 nt, Human
aagccaaagcuaggccuggc

SEQ ID NO: 1956186 - RNA, 20 nt, Human
aagcacaugccucucucagg

SEQ ID NO: 1956187 - RNA, 19 nt, Human
aagcacaugccucucucag

SEQ ID NO: 1956188 - RNA, 16 nt, Human
aagcacaugccucucu

SEQ ID NO: 1956189 - RNA, 15 nt, Human
aagcacaugccucuc

SEQ ID NO: 1956190 - RNA, 23 nt, Human
aagcacaccaaucuuacuuugua

SEQ ID NO: 1956191 - RNA, 13 nt, Human
aagcacagucagg

SEQ ID NO: 1956192 - RNA, 14 nt, Human
aagcacaugccucu

SEQ ID NO: 1956193 - RNA, 12 nt, Human
guguuugaagca

SEQ ID NO: 1956194 - RNA, 19 nt, Human
guguuugcuccccuucccc

SEQ ID NO: 1956195 - RNA, 13 nt, Human
aagcacaaaggaa

SEQ ID NO: 1956196 - RNA, 19 nt, Human
aagcacacucauccccuca

SEQ ID NO: 1956197 - RNA, 18 nt, Human
aagcacaccaaucuuacu

SEQ ID NO: 1956198 - RNA, 19 nt, Human
aagcacaccaaucuuacuu

SEQ ID NO: 1956199 - RNA, 22 nt, Human
aagcacaccaaucuuacuuugu

SEQ ID NO: 1956200 - RNA, 16 nt, Human
aagcacacuugacauc

SEQ ID NO: 1956201 - RNA, 12 nt, Human
guguuucugggg

SEQ ID NO: 1956202 - RNA, 21 nt, Human
aagcacaugccucucucaggc

SEQ ID NO: 1956203 - RNA, 16 nt, Human
aagcaccaaaauaaga

SEQ ID NO: 1956204 - RNA, 17 nt, Human
aagcaccaaaauaagaa

SEQ ID NO: 1956205 - RNA, 19 nt, Human
aagcaccaaaauaagaaaa

SEQ ID NO: 1956206 - RNA, 21 nt, Human
aagcaccaaaauaagaaaaga

SEQ ID NO: 1956207 - RNA, 22 nt, Human
aagcaccaaaauaagaaaagau

SEQ ID NO: 1956208 - RNA, 15 nt, Human
aagcaccauccccuc

SEQ ID NO: 1956209 - RNA, 16 nt, Human
aagcaccauccccucc

SEQ ID NO: 1956210 - RNA, 13 nt, Human
aagcaccuccugc

SEQ ID NO: 1956211 - RNA, 14 nt, Human
aagcaccuccugcc

SEQ ID NO: 1956212 - RNA, 15 nt, Human
aagcaccuccugccu

SEQ ID NO: 1956213 - RNA, 16 nt, Human
aagcaccuccugccuc

SEQ ID NO: 1956214 - RNA, 17 nt, Human
aagcaccuccugccucg

SEQ ID NO: 1956215 - RNA, 16 nt, Human
aagcacuaaacaaaga

SEQ ID NO: 1956216 - RNA, 16 nt, Human
aagaggugugcaagag

SEQ ID NO: 1956217 - RNA, 18 nt, Human
aagaggugugcaagagag

SEQ ID NO: 1956218 - RNA, 17 nt, Human
aagaggugggagggccc

SEQ ID NO: 1956219 - RNA, 15 nt, Human
aagaggugggagggc

SEQ ID NO: 1956220 - RNA, 16 nt, Human
aagaggugggagggcc

SEQ ID NO: 1956221 - RNA, 17 nt, Human
aagauagcuucacccca

SEQ ID NO: 1956222 - RNA, 11 nt, Human
aagaggcaggg

SEQ ID NO: 1956223 - RNA, 18 nt, Human
guguaagaaauacagacu

SEQ ID NO: 1956224 - RNA, 14 nt, Human
aagaggcagggucu

SEQ ID NO: 1956225 - RNA, 19 nt, Human
aagaggcaguugcccagcc

SEQ ID NO: 1956226 - RNA, 22 nt, Human
aagaggcaguugcccagccucu

SEQ ID NO: 1956227 - RNA, 22 nt, Human
aagagggagggagggcuccaga

SEQ ID NO: 1956228 - RNA, 21 nt, Human
aagagggagggagggcuccag

SEQ ID NO: 1956229 - RNA, 15 nt, Human
gugcugcuaauucuu

SEQ ID NO: 1956230 - RNA, 17 nt, Human
gugcugcuaauucuuug

SEQ ID NO: 1956231 - RNA, 18 nt, Human
gugcugcuaauucuuugc

SEQ ID NO: 1956232 - RNA, 19 nt, Human
gugcugcuaauucuuugca

SEQ ID NO: 1956233 - RNA, 23 nt, Human
gugcugcccugcccaccuggccu

SEQ ID NO: 1956234 - RNA, 18 nt, Human
gugguugaauaugauuaa

SEQ ID NO: 1956235 - RNA, 16 nt, Human
gugguugaauaugauu

SEQ ID NO: 1956236 - RNA, 15 nt, Human
gugguuucagaaaug

SEQ ID NO: 1956237 - RNA, 22 nt, Human
gugguucacucuuggagccugc

SEQ ID NO: 1956238 - RNA, 23 nt, Human
gugguucacucuuggagccugca

SEQ ID NO: 1956239 - RNA, 20 nt, Human
aagaucaaaagguuaauaaa

SEQ ID NO: 1956240 - RNA, 23 nt, Human
aagaucaaaagguuaauaaagua

SEQ ID NO: 1956241 - RNA, 21 nt, Human
aagaucaaaaaggcuuauaaa

SEQ ID NO: 1956242 - RNA, 23 nt, Human
aagaucaaaaaggcuuauaaaac

SEQ ID NO: 1956243 - RNA, 16 nt, Human
aagauggcugugccuc

SEQ ID NO: 1956244 - RNA, 13 nt, Human
guguauguggggg

SEQ ID NO: 1956245 - RNA, 21 nt, Human
guguaugugggggucugugug

SEQ ID NO: 1956246 - RNA, 17 nt, Human
aagcaacccaaauguuc

SEQ ID NO: 1956247 - RNA, 22 nt, Human
aagcaacaauuuucagauuugc

SEQ ID NO: 1956248 - RNA, 15 nt, Human
aagcaaccaaaaaga

SEQ ID NO: 1956249 - RNA, 12 nt, Human
aagcaacaauuu

SEQ ID NO: 1956250 - RNA, 13 nt, Human
aagcaacaauuuu

SEQ ID NO: 1956251 - RNA, 17 nt, Human
aagcaacaauuuucaga

SEQ ID NO: 1956252 - RNA, 18 nt, Human
aagcaacaauuuucagau

SEQ ID NO: 1956253 - RNA, 20 nt, Human
aagcaacaauuuucagauuu

SEQ ID NO: 1956254 - RNA, 12 nt, Human
aagcaaaaggca

SEQ ID NO: 1956255 - RNA, 20 nt, Human
aagcaaaugugaaucauuuu

SEQ ID NO: 1956256 - RNA, 14 nt, Human
gugucaccugaaga

SEQ ID NO: 1956257 - RNA, 15 nt, Human
guguauguuuuucag

SEQ ID NO: 1956258 - RNA, 16 nt, Human
guguauguuuuucagu

SEQ ID NO: 1956259 - RNA, 21 nt, Human
guguauguuuuucaguucaaa

SEQ ID NO: 1956260 - RNA, 13 nt, Human
guguauguuuuuc

SEQ ID NO: 1956261 - RNA, 19 nt, Human
aagcaaccauauagaaagc

SEQ ID NO: 1956262 - RNA, 22 nt, Human
gugucaccugaagacucauucu

SEQ ID NO: 1956263 - RNA, 14 nt, Human
gugucagguggggc

SEQ ID NO: 1956264 - RNA, 18 nt, Human
gugucagguggggcagcu

SEQ ID NO: 1956265 - RNA, 23 nt, Human
gugugaaccaccacacccagccc

SEQ ID NO: 1956266 - RNA, 15 nt, Human
gugugaacuuggaag

SEQ ID NO: 1956267 - RNA, 17 nt, Human
gugugaacuuggaagca

SEQ ID NO: 1956268 - RNA, 19 nt, Human
gugucagguggggcagcuu

SEQ ID NO: 1956269 - RNA, 22 nt, Human
caaagccaaagcuaggccuggc

SEQ ID NO: 1956270 - RNA, 21 nt, Human
caaagccaccaacagccacuc

SEQ ID NO: 1956271 - RNA, 18 nt, Human
caaagcccuuccaugucg

SEQ ID NO: 1956272 - RNA, 14 nt, Human
caaagcgaauuuua

SEQ ID NO: 1956273 - RNA, 19 nt, Human
caaagcgaauuuuaaaaga

SEQ ID NO: 1956274 - RNA, 18 nt, Human
caaagccuccuccagccg

SEQ ID NO: 1956275 - RNA, 17 nt, Human
caaagccuccuccagcc

SEQ ID NO: 1956276 - RNA, 17 nt, Human
caaacugguuauuuaaa

SEQ ID NO: 1956277 - RNA, 16 nt, Human
caaacugguuauuuaa

SEQ ID NO: 1956278 - RNA, 17 nt, Human
caaacucaccugccccu

SEQ ID NO: 1956279 - RNA, 23 nt, Human
caaaggcacauggaauauauuuu

SEQ ID NO: 1956280 - RNA, 14 nt, Human
caaaggaagcacau

SEQ ID NO: 1956281 - RNA, 23 nt, Human
caaaggccuaauucuaugccugu

SEQ ID NO: 1956282 - RNA, 16 nt, Human
caaaggguaucaggug

SEQ ID NO: 1956283 - RNA, 18 nt, Human
caaaggguaucaggugcu

SEQ ID NO: 1956284 - RNA, 13 nt, Human
caaaggaagcaca

SEQ ID NO: 1956285 - RNA, 12 nt, Human
caaaggaagcac

SEQ ID NO: 1956286 - RNA, 13 nt, Human
caaagcuaggccu

SEQ ID NO: 1956287 - RNA, 14 nt, Human
caaagcuaggccug

SEQ ID NO: 1956288 - RNA, 19 nt, Human
caaagcuaggccuggccag

SEQ ID NO: 1956289 - RNA, 20 nt, Human
caaagcgaauuuuaaaagau

SEQ ID NO: 1956290 - RNA, 13 nt, Human
caaaccuaaguug

SEQ ID NO: 1956291 - RNA, 15 nt, Human
caaaccuaauugcac

SEQ ID NO: 1956292 - RNA, 20 nt, Human
caaacccuucagugccaaaa

SEQ ID NO: 1956293 - RNA, 14 nt, Human
caaacccuucagug

SEQ ID NO: 1956294 - RNA, 15 nt, Human
caaacacacagaagg

SEQ ID NO: 1956295 - RNA, 12 nt, Human
caaacacaggca

SEQ ID NO: 1956296 - RNA, 15 nt, Human
caaacacauacagga

SEQ ID NO: 1956297 - RNA, 16 nt, Human
caaaauuguuacaaau

SEQ ID NO: 1956298 - RNA, 19 nt, Human
caaaauuaagguguuugaa

SEQ ID NO: 1956299 - RNA, 20 nt, Human
caaaauuaagguguuugaaa

SEQ ID NO: 1956300 - RNA, 16 nt, Human
caaaauuaagguguuu

SEQ ID NO: 1956301 - RNA, 12 nt, Human
caaaauaaaacu

SEQ ID NO: 1956302 - RNA, 14 nt, Human
caaaauaaaacuuu

SEQ ID NO: 1956303 - RNA, 20 nt, Human
caaaaugggagaucuucuca

SEQ ID NO: 1956304 - RNA, 11 nt, Human
caaaauguaac

SEQ ID NO: 1956305 - RNA, 12 nt, Human
caaaauguaacu

SEQ ID NO: 1956306 - RNA, 13 nt, Human
caaaauguaacug

SEQ ID NO: 1956307 - RNA, 14 nt, Human
caaaauguaacugu

SEQ ID NO: 1956308 - RNA, 15 nt, Human
caaaauguaggguua

SEQ ID NO: 1956309 - RNA, 12 nt, Human
caaaaugugagu

SEQ ID NO: 1956310 - RNA, 19 nt, Human
caaaaugugagugguugaa

SEQ ID NO: 1956311 - RNA, 21 nt, Human
caaaaugugagugguugaaua

SEQ ID NO: 1956312 - RNA, 15 nt, Human
caaaauguaacuguu

SEQ ID NO: 1956313 - RNA, 16 nt, Human
caaaauguaacuguua

SEQ ID NO: 1956314 - RNA, 18 nt, Human
caaaauguaacuguuacc

SEQ ID NO: 1956315 - RNA, 19 nt, Human
caaaauguaacuguuacca

SEQ ID NO: 1956316 - RNA, 13 nt, Human
caaaugguacaaa

SEQ ID NO: 1956317 - RNA, 15 nt, Human
caaaugguacaaaac

SEQ ID NO: 1956318 - RNA, 24 nt, Human
caaaugguacaaaaccacagugua

SEQ ID NO: 1956319 - RNA, 13 nt, Human
caaauauuaaaaa

SEQ ID NO: 1956320 - RNA, 19 nt, Human
caaauauuaaaaagucuuu

SEQ ID NO: 1956321 - RNA, 22 nt, Human
caaauauuaaaaagucuuuuaa

SEQ ID NO: 1956322 - RNA, 23 nt, Human
caaauauuaaaaagucuuuuaaa

SEQ ID NO: 1956323 - RNA, 18 nt, Human
caaauacugaaauauuag

SEQ ID NO: 1956324 - RNA, 21 nt, Human
caaauacgugggcauucaaau

SEQ ID NO: 1956325 - RNA, 22 nt, Human
caaauacgugggcauucaaaug

SEQ ID NO: 1956326 - RNA, 20 nt, Human
caaauacgugggcauucaaa

SEQ ID NO: 1956327 - RNA, 22 nt, Human
caaagggggaggagaagaaaau

SEQ ID NO: 1956328 - RNA, 23 nt, Human
caaagugcugggauuacaggugu

SEQ ID NO: 1956329 - RNA, 19 nt, Human
caaagugcugggauuacag

SEQ ID NO: 1956330 - RNA, 19 nt, Human
caaaggguaucaggugcug

SEQ ID NO: 1956331 - RNA, 21 nt, Human
caaauuguaagcaugcacaaa

SEQ ID NO: 1956332 - RNA, 15 nt, Human
caaauuguaauuaau

SEQ ID NO: 1956333 - RNA, 16 nt, Human
caaauuguaauuaaua

SEQ ID NO: 1956334 - RNA, 18 nt, Human
caaauuguaauuaauaau

SEQ ID NO: 1956335 - RNA, 20 nt, Human
caaauuguaauuaauaauag

SEQ ID NO: 1956336 - RNA, 21 nt, Human
caaauuguaauuaauaauaga

SEQ ID NO: 1956337 - RNA, 19 nt, Human
caaauugucaccugcuucu

SEQ ID NO: 1956338 - RNA, 12 nt, Human
caaauuucuaaa

SEQ ID NO: 1956339 - RNA, 14 nt, Human
caaauuucuaaauc

SEQ ID NO: 1956340 - RNA, 11 nt, Human
caaauuucuaa

SEQ ID NO: 1956341 - RNA, 20 nt, Human
caaauugucaccugcuucuc

SEQ ID NO: 1956342 - RNA, 21 nt, Human
caaauugucaccugcuucucu

SEQ ID NO: 1956343 - RNA, 12 nt, Human
caaauguaaagu

SEQ ID NO: 1956344 - RNA, 12 nt, Human
caaauguaacua

SEQ ID NO: 1956345 - RNA, 19 nt, Human
caaauguaacuauguuuua

SEQ ID NO: 1956346 - RNA, 22 nt, Human
caaauguaauguggcuucugga

SEQ ID NO: 1956347 - RNA, 15 nt, Human
caaaugucuauaaac

SEQ ID NO: 1956348 - RNA, 14 nt, Human
caaaugucuauaaa

SEQ ID NO: 1956349 - RNA, 19 nt, Human
caaauuaugcuaagaauuu

SEQ ID NO: 1956350 - RNA, 20 nt, Human
caaauuaugcuaagaauuuu

SEQ ID NO: 1956351 - RNA, 21 nt, Human
caaauuaugcuaagaauuuuu

SEQ ID NO: 1956352 - RNA, 18 nt, Human
caaauuauaauguauuca

SEQ ID NO: 1956353 - RNA, 20 nt, Human
caaauuauaauguauucaua

SEQ ID NO: 1956354 - RNA, 13 nt, Human
caaauuauaaugu

SEQ ID NO: 1956355 - RNA, 14 nt, Human
caaauuauaaugua

SEQ ID NO: 1956356 - RNA, 15 nt, Human
caaauuauaauguau

SEQ ID NO: 1956357 - RNA, 17 nt, Human
caaauuauaauguauuc

SEQ ID NO: 1956358 - RNA, 13 nt, Human
caaaaaggcuuau

SEQ ID NO: 1956359 - RNA, 14 nt, Human
caaaaagcuucugu

SEQ ID NO: 1956360 - RNA, 15 nt, Human
caaaaagcuucugug

SEQ ID NO: 1956361 - RNA, 21 nt, Human
caaaaaucugaagauuguuua

SEQ ID NO: 1956362 - RNA, 19 nt, Human
caaaaauguuaagcaucua

SEQ ID NO: 1956363 - RNA, 15 nt, Human
caaaaauccaaauau

SEQ ID NO: 1956364 - RNA, 20 nt, Human
caaaaauccaaauauuguua

SEQ ID NO: 1956365 - RNA, 15 nt, Human
caaaaaucugaagau

SEQ ID NO: 1956366 - RNA, 17 nt, Human
caaaaaucugaagauug

SEQ ID NO: 1956367 - RNA, 18 nt, Human
caaaaaucugaagauugu

SEQ ID NO: 1956368 - RNA, 20 nt, Human
caaaaaucugaagauuguuu

SEQ ID NO: 1956369 - RNA, 16 nt, Human
caaaaauucucaguuc

SEQ ID NO: 1956370 - RNA, 12 nt, Human
caaaacaaaggc

SEQ ID NO: 1956371 - RNA, 15 nt, Human
caaaacaaaggccua

SEQ ID NO: 1956372 - RNA, 16 nt, Human
caaaacaaaggccuaa

SEQ ID NO: 1956373 - RNA, 13 nt, Human
caaaacccagcug

SEQ ID NO: 1956374 - RNA, 14 nt, Human
caaaacccagcugc

SEQ ID NO: 1956375 - RNA, 15 nt, Human
caaaacccagcugca

SEQ ID NO: 1956376 - RNA, 18 nt, Human
caaaacccagcugcaccc

SEQ ID NO: 1956377 - RNA, 21 nt, Human
caaaacccagcugcaccccuu

SEQ ID NO: 1956378 - RNA, 20 nt, Human
caaaacaccugacagccccu

SEQ ID NO: 1956379 - RNA, 17 nt, Human
caaaaccaaaaguuauu

SEQ ID NO: 1956380 - RNA, 18 nt, Human
caaaaccaaaaguuauua

SEQ ID NO: 1956381 - RNA, 23 nt, Human
caaaaccaaaaguuauuaaaauu

SEQ ID NO: 1956382 - RNA, 22 nt, Human
caaaacaaaggccuaauucuau

SEQ ID NO: 1956383 - RNA, 23 nt, Human
caaaacuucagacauagaauuaa

SEQ ID NO: 1956384 - RNA, 17 nt, Human
caaaauaaaaaugaggu

SEQ ID NO: 1956385 - RNA, 12 nt, Human
caaaagaaaaac

SEQ ID NO: 1956386 - RNA, 21 nt, Human
caaaacucuccucugcugcug

SEQ ID NO: 1956387 - RNA, 20 nt, Human
caaaacucuccucugcugcu

SEQ ID NO: 1956388 - RNA, 22 nt, Human
caaaacucuccucugcugcugg

SEQ ID NO: 1956389 - RNA, 22 nt, Human
caaaacugccucaggaggcagg

SEQ ID NO: 1956390 - RNA, 15 nt, Human
caaaaacauguaugu

SEQ ID NO: 1956391 - RNA, 22 nt, Human
caaaaacauguaugugcauuuc

SEQ ID NO: 1956392 - RNA, 23 nt, Human
caaaaacauguaugugcauuuca

SEQ ID NO: 1956393 - RNA, 13 nt, Human
caaaaaggcagga

SEQ ID NO: 1956394 - RNA, 19 nt, Human
caaaaagauaccuuaaaau

SEQ ID NO: 1956395 - RNA, 20 nt, Human
caaaaagauaccuuaaaauu

SEQ ID NO: 1956396 - RNA, 22 nt, Human
caaaaagauaccuuaaaauuug

SEQ ID NO: 1956397 - RNA, 23 nt, Human
caaaaagauaccuuaaaauuuga

SEQ ID NO: 1956398 - RNA, 18 nt, Human
caaaaagauaccuuaaaa

SEQ ID NO: 1956399 - RNA, 22 nt, Human
caaaaagaaaaaaaaaaagaaa

SEQ ID NO: 1956400 - RNA, 20 nt, Human
caaaaacauggccuuugcuu

SEQ ID NO: 1956401 - RNA, 18 nt, Human
auuuuggagagauaggaa

SEQ ID NO: 1956402 - RNA, 19 nt, Human
auuuuggagagauaggaag

SEQ ID NO: 1956403 - RNA, 17 nt, Human
auuuuggagagauagga

SEQ ID NO: 1956404 - RNA, 21 nt, Human
auuuuggccaugaaagcaugg

SEQ ID NO: 1956405 - RNA, 21 nt, Human
auuuugggguacccacugcuc

SEQ ID NO: 1956406 - RNA, 13 nt, Human
auuuuccuuuaau

SEQ ID NO: 1956407 - RNA, 16 nt, Human
auuuucuaaaguacug

SEQ ID NO: 1956408 - RNA, 20 nt, Human
auuuucuaaaguacugagca

SEQ ID NO: 1956409 - RNA, 15 nt, Human
auuuucuaaaguacu

SEQ ID NO: 1956410 - RNA, 23 nt, Human
auuuuccuuuaauaugaaauuuu

SEQ ID NO: 1956411 - RNA, 17 nt, Human
auuuuggugucuuucuc

SEQ ID NO: 1956412 - RNA, 10 nt, Human
auuuuggucu

SEQ ID NO: 1956413 - RNA, 16 nt, Human
caaaaaaugcuugcuu

SEQ ID NO: 1956414 - RNA, 22 nt, Human
auuuugggguacccacugcucu

SEQ ID NO: 1956415 - RNA, 23 nt, Human
auuuugggguacccacugcucug

SEQ ID NO: 1956416 - RNA, 20 nt, Human
auuuuggagagauaggaagg

SEQ ID NO: 1956417 - RNA, 15 nt, Human
caaccuccugggcua

SEQ ID NO: 1956418 - RNA, 13 nt, Human
caaccucgcucca

SEQ ID NO: 1956419 - RNA, 16 nt, Human
caaccucgcuccaacu

SEQ ID NO: 1956420 - RNA, 17 nt, Human
caaccucgcuccaacuc

SEQ ID NO: 1956421 - RNA, 20 nt, Human
caaccucgcuccaacuccaa

SEQ ID NO: 1956422 - RNA, 21 nt, Human
caaccucgcuccaacuccaac

SEQ ID NO: 1956423 - RNA, 14 nt, Human
caaccucuuccucc

SEQ ID NO: 1956424 - RNA, 19 nt, Human
caaccucuagaauuuuaag

SEQ ID NO: 1956425 - RNA, 14 nt, Human
caaccuccugggcu

SEQ ID NO: 1956426 - RNA, 21 nt, Human
caaccgggaugggagccgggc

SEQ ID NO: 1956427 - RNA, 14 nt, Human
caacgucugugcca

SEQ ID NO: 1956428 - RNA, 13 nt, Human
caacgucugugcc

SEQ ID NO: 1956429 - RNA, 15 nt, Human
caacugaccagccuc

SEQ ID NO: 1956430 - RNA, 17 nt, Human
caacugaccagccucca

SEQ ID NO: 1956431 - RNA, 20 nt, Human
caaccuguucugcuuuccuc

SEQ ID NO: 1956432 - RNA, 19 nt, Human
caaccuucgccaccugggu

SEQ ID NO: 1956433 - RNA, 14 nt, Human
caaccuucaagcug

SEQ ID NO: 1956434 - RNA, 20 nt, Human
caacacugggaaacagaggc

SEQ ID NO: 1956435 - RNA, 22 nt, Human
caaccccuucgcuccugugucu

SEQ ID NO: 1956436 - RNA, 22 nt, Human
caacacucauugaccugaggcc

SEQ ID NO: 1956437 - RNA, 20 nt, Human
caacacucauugaccugagg

SEQ ID NO: 1956438 - RNA, 18 nt, Human
caacacucauugaccuga

SEQ ID NO: 1956439 - RNA, 22 nt, Human
caacacucacauuuauucugcu

SEQ ID NO: 1956440 - RNA, 17 nt, Human
caacccuggcacccagg

SEQ ID NO: 1956441 - RNA, 13 nt, Human
caacccucagagc

SEQ ID NO: 1956442 - RNA, 17 nt, Human
caagacgcugugcugcc

SEQ ID NO: 1956443 - RNA, 16 nt, Human
caagacgcugugcugc

SEQ ID NO: 1956444 - RNA, 18 nt, Human
caagaccuucuccuucac

SEQ ID NO: 1956445 - RNA, 17 nt, Human
caagaccuucuccuuca

SEQ ID NO: 1956446 - RNA, 16 nt, Human
caagaccuucuccuuc

SEQ ID NO: 1956447 - RNA, 14 nt, Human
caagaccuucuccu

SEQ ID NO: 1956448 - RNA, 20 nt, Human
caagaacuuuccaggaaggc

SEQ ID NO: 1956449 - RNA, 13 nt, Human
caagaacuuguuu

SEQ ID NO: 1956450 - RNA, 14 nt, Human
caagaacuuguuua

SEQ ID NO: 1956451 - RNA, 15 nt, Human
caagaacuuguuuaa

SEQ ID NO: 1956452 - RNA, 17 nt, Human
caagaacuuguuuaaua

SEQ ID NO: 1956453 - RNA, 19 nt, Human
caacugaccagccuccaug

SEQ ID NO: 1956454 - RNA, 15 nt, Human
caacuuuuuuuucuu

SEQ ID NO: 1956455 - RNA, 17 nt, Human
caacuuuuuuuucuuuu

SEQ ID NO: 1956456 - RNA, 16 nt, Human
caacuuuuuuuuuccc

SEQ ID NO: 1956457 - RNA, 18 nt, Human
caagacucuuuggacacu

SEQ ID NO: 1956458 - RNA, 13 nt, Human
caagagcccaggc

SEQ ID NO: 1956459 - RNA, 15 nt, Human
caagagcccaggccu

SEQ ID NO: 1956460 - RNA, 14 nt, Human
caagagcccaggcc

SEQ ID NO: 1956461 - RNA, 23 nt, Human
caagacgcugugcugcccugccc

SEQ ID NO: 1956462 - RNA, 18 nt, Human
caagacgcugugcugccc

SEQ ID NO: 1956463 - RNA, 19 nt, Human
caagacgcugugcugcccu

SEQ ID NO: 1956464 - RNA, 16 nt, Human
caagaggcugcagcca

SEQ ID NO: 1956465 - RNA, 16 nt, Human
caagagcccaggccuc

SEQ ID NO: 1956466 - RNA, 13 nt, Human
caagagggcacug

SEQ ID NO: 1956467 - RNA, 15 nt, Human
caagcaccuccugcc

SEQ ID NO: 1956468 - RNA, 14 nt, Human
caagagggcacugg

SEQ ID NO: 1956469 - RNA, 15 nt, Human
caagagggcacuggu

SEQ ID NO: 1956470 - RNA, 16 nt, Human
caagcaccuccugccu

SEQ ID NO: 1956471 - RNA, 17 nt, Human
caagcaccuccugccuc

SEQ ID NO: 1956472 - RNA, 14 nt, Human
caacugaucuguua

SEQ ID NO: 1956473 - RNA, 23 nt, Human
caaggcugucaauuacaggaagu

SEQ ID NO: 1956474 - RNA, 21 nt, Human
caaggcugucaauuacaggaa

SEQ ID NO: 1956475 - RNA, 15 nt, Human
caaggcugcagugag

SEQ ID NO: 1956476 - RNA, 12 nt, Human
caaggcugcagu

SEQ ID NO: 1956477 - RNA, 17 nt, Human
caaggggcccaaauucu

SEQ ID NO: 1956478 - RNA, 18 nt, Human
caaggggcccaaauucuu

SEQ ID NO: 1956479 - RNA, 14 nt, Human
caaggucauuuuuu

SEQ ID NO: 1956480 - RNA, 20 nt, Human
caaggucauuuuuuuuaaga

SEQ ID NO: 1956481 - RNA, 18 nt, Human
caaggguagggugggccu

SEQ ID NO: 1956482 - RNA, 20 nt, Human
caagggguccccuccaggag

SEQ ID NO: 1956483 - RNA, 11 nt, Human
caagucccugu

SEQ ID NO: 1956484 - RNA, 20 nt, Human
caagucccuguaauuguugu

SEQ ID NO: 1956485 - RNA, 14 nt, Human
caaguccucuuuuc

SEQ ID NO: 1956486 - RNA, 16 nt, Human
caaguccgcagaagcc

SEQ ID NO: 1956487 - RNA, 19 nt, Human
caaguccgcagaagcccug

SEQ ID NO: 1956488 - RNA, 14 nt, Human
caaguuaaauaaau

SEQ ID NO: 1956489 - RNA, 14 nt, Human
caagugugaauacu

SEQ ID NO: 1956490 - RNA, 15 nt, Human
caagugugaauacug

SEQ ID NO: 1956491 - RNA, 16 nt, Human
caagugugaauacugc

SEQ ID NO: 1956492 - RNA, 18 nt, Human
caaguggagccugacagc

SEQ ID NO: 1956493 - RNA, 21 nt, Human
caaguggagccugacagccag

SEQ ID NO: 1956494 - RNA, 20 nt, Human
caaguggcaaagcuguucuu

SEQ ID NO: 1956495 - RNA, 23 nt, Human
caaguggcaaagcuguucuuccu

SEQ ID NO: 1956496 - RNA, 19 nt, Human
caaguggcucccacacccu

SEQ ID NO: 1956497 - RNA, 17 nt, Human
caaguggcauaaagcau

SEQ ID NO: 1956498 - RNA, 18 nt, Human
caaguggcauaaagcaua

SEQ ID NO: 1956499 - RNA, 18 nt, Human
caagugagagcugggugu

SEQ ID NO: 1956500 - RNA, 17 nt, Human
caagugauucucaugcc

SEQ ID NO: 1956501 - RNA, 18 nt, Human
caagugauucucaugccu

SEQ ID NO: 1956502 - RNA, 20 nt, Human
caagugauucucaugccuca

SEQ ID NO: 1956503 - RNA, 21 nt, Human
caagugauucucaugccucag

SEQ ID NO: 1956504 - RNA, 21 nt, Human
caaguccucuuuucugagagg

SEQ ID NO: 1956505 - RNA, 14 nt, Human
caagugagagcugg

SEQ ID NO: 1956506 - RNA, 15 nt, Human
caagugagagcuggg

SEQ ID NO: 1956507 - RNA, 17 nt, Human
caagugagagcugggug

SEQ ID NO: 1956508 - RNA, 18 nt, Human
caagccguggcuucccgc

SEQ ID NO: 1956509 - RNA, 12 nt, Human
caagccagcaag

SEQ ID NO: 1956510 - RNA, 19 nt, Human
caagcgauucuucugcuuc

SEQ ID NO: 1956511 - RNA, 15 nt, Human
caagccuggaaaaaa

SEQ ID NO: 1956512 - RNA, 14 nt, Human
caagcgcccuggcc

SEQ ID NO: 1956513 - RNA, 14 nt, Human
caagccuggcaagg

SEQ ID NO: 1956514 - RNA, 15 nt, Human
caagcgcccuggccc

SEQ ID NO: 1956515 - RNA, 16 nt, Human
caagcgcccuggcccc

SEQ ID NO: 1956516 - RNA, 17 nt, Human
caagcuggcuuacacug

SEQ ID NO: 1956517 - RNA, 20 nt, Human
caagcgauucuucugcuuca

SEQ ID NO: 1956518 - RNA, 22 nt, Human
caagcgauucuucugcuucagc

SEQ ID NO: 1956519 - RNA, 14 nt, Human
caagcaggacaugg

SEQ ID NO: 1956520 - RNA, 18 nt, Human
caagcaggacauggacaa

SEQ ID NO: 1956521 - RNA, 12 nt, Human
caagcaggaggc

SEQ ID NO: 1956522 - RNA, 13 nt, Human
caagcaggaggcu

SEQ ID NO: 1956523 - RNA, 22 nt, Human
caagccagcgggaauggcagcu

SEQ ID NO: 1956524 - RNA, 17 nt, Human
caagccguggcuucccg

SEQ ID NO: 1956525 - RNA, 22 nt, Human
caagccaccaacauacucccau

SEQ ID NO: 1956526 - RNA, 21 nt, Human
caagccaccagaugugacagu

SEQ ID NO: 1956527 - RNA, 17 nt, Human
caagcuggucccacuca

SEQ ID NO: 1956528 - RNA, 19 nt, Human
caagcuggucccacucagu

SEQ ID NO: 1956529 - RNA, 15 nt, Human
caaggacugcaggga

SEQ ID NO: 1956530 - RNA, 18 nt, Human
caaggacagaaggcuccu

SEQ ID NO: 1956531 - RNA, 21 nt, Human
caaggacagaaggcuccugcc

SEQ ID NO: 1956532 - RNA, 22 nt, Human
caaggacugcagggacugccag

SEQ ID NO: 1956533 - RNA, 14 nt, Human
caaggagccaaaca

SEQ ID NO: 1956534 - RNA, 17 nt, Human
caaggcugauuaaacca

SEQ ID NO: 1956535 - RNA, 20 nt, Human
caaggagggugagugcaagg

SEQ ID NO: 1956536 - RNA, 19 nt, Human
caaggagggugagugcaag

SEQ ID NO: 1956537 - RNA, 14 nt, Human
caauaggaaaaacu

SEQ ID NO: 1956538 - RNA, 14 nt, Human
caauguucucucuu

SEQ ID NO: 1956539 - RNA, 15 nt, Human
caaugacuuacugua

SEQ ID NO: 1956540 - RNA, 15 nt, Human
caaucuuacuuugua

SEQ ID NO: 1956541 - RNA, 14 nt, Human
caaucuuacuuugu

SEQ ID NO: 1956542 - RNA, 21 nt, Human
caaugaccuuucaauaggaaa

SEQ ID NO: 1956543 - RNA, 17 nt, Human
caaugacuuacuguaca

SEQ ID NO: 1956544 - RNA, 18 nt, Human
caaugacuuacuguacau

SEQ ID NO: 1956545 - RNA, 23 nt, Human
caaugaccuuucaauaggaaaaa

SEQ ID NO: 1956546 - RNA, 19 nt, Human
caaucuggggaaauaauaa

SEQ ID NO: 1956547 - RNA, 20 nt, Human
caaucuggauucauauuuaa

SEQ ID NO: 1956548 - RNA, 16 nt, Human
caaucuggauucauau

SEQ ID NO: 1956549 - RNA, 18 nt, Human
caauauucucuguacaua

SEQ ID NO: 1956550 - RNA, 19 nt, Human
caauauucucuguacauau

SEQ ID NO: 1956551 - RNA, 22 nt, Human
caauauucucuguacauauuag

SEQ ID NO: 1956552 - RNA, 16 nt, Human
caauauauuuuguaug

SEQ ID NO: 1956553 - RNA, 22 nt, Human
caauauauuuuguaugcaagca

SEQ ID NO: 1956554 - RNA, 12 nt, Human
caauauucucug

SEQ ID NO: 1956555 - RNA, 15 nt, Human
caauauucucuguac

SEQ ID NO: 1956556 - RNA, 16 nt, Human
caauauucucuguaca

SEQ ID NO: 1956557 - RNA, 17 nt, Human
caauauucucuguacau

SEQ ID NO: 1956558 - RNA, 14 nt, Human
caauauaagagcuu

SEQ ID NO: 1956559 - RNA, 17 nt, Human
caauauucgcuguguca

SEQ ID NO: 1956560 - RNA, 13 nt, Human
caauauauuuugu

SEQ ID NO: 1956561 - RNA, 14 nt, Human
caauauauuuugua

SEQ ID NO: 1956562 - RNA, 15 nt, Human
caauauauuuuguau

SEQ ID NO: 1956563 - RNA, 18 nt, Human
caauaauuuguggugauu

SEQ ID NO: 1956564 - RNA, 20 nt, Human
caauaauuuguggugauuug

SEQ ID NO: 1956565 - RNA, 21 nt, Human
caauaauuauuugucucagau

SEQ ID NO: 1956566 - RNA, 16 nt, Human
caaguuaguucaaucu

SEQ ID NO: 1956567 - RNA, 13 nt, Human
caauaggaaaaac

SEQ ID NO: 1956568 - RNA, 12 nt, Human
caauaggaaaaa

SEQ ID NO: 1956569 - RNA, 21 nt, Human
caauagcccaggauauauuuu

SEQ ID NO: 1956570 - RNA, 18 nt, Human
caagugugggggguccuu

SEQ ID NO: 1956571 - RNA, 19 nt, Human
caauguagaggggaaaaga

SEQ ID NO: 1956572 - RNA, 18 nt, Human
caaugucaaugaacaagc

SEQ ID NO: 1956573 - RNA, 15 nt, Human
caaugguaauuauaa

SEQ ID NO: 1956574 - RNA, 16 nt, Human
caaugguaauuauaaa

SEQ ID NO: 1956575 - RNA, 14 nt, Human
caaugguaguuucu

SEQ ID NO: 1956576 - RNA, 16 nt, Human
caaugguaguuucugu

SEQ ID NO: 1956577 - RNA, 17 nt, Human
caaugguaguuucugug

SEQ ID NO: 1956578 - RNA, 20 nt, Human
caaugguaguuucugugguu

SEQ ID NO: 1956579 - RNA, 23 nt, Human
caauggugaacugucauuacaga

SEQ ID NO: 1956580 - RNA, 21 nt, Human
caauggugucaguauccaggc

SEQ ID NO: 1956581 - RNA, 21 nt, Human
caaugcacuuuguucuggcuc

SEQ ID NO: 1956582 - RNA, 20 nt, Human
caaugcacuuuguucuggcu

SEQ ID NO: 1956583 - RNA, 22 nt, Human
caaugcacuuuguucuggcucu

SEQ ID NO: 1956584 - RNA, 19 nt, Human
caaugagaucauugugaag

SEQ ID NO: 1956585 - RNA, 21 nt, Human
caaugagacucuaggguccag

SEQ ID NO: 1956586 - RNA, 17 nt, Human
caaugcacuuuguucug

SEQ ID NO: 1956587 - RNA, 16 nt, Human
caauuacaggaaguac

SEQ ID NO: 1956588 - RNA, 23 nt, Human
caauucucauuugucacacacuu

SEQ ID NO: 1956589 - RNA, 13 nt, Human
caauucuccugcc

SEQ ID NO: 1956590 - RNA, 19 nt, Human
caauucucccgggacucug

SEQ ID NO: 1956591 - RNA, 14 nt, Human
caauucuccugccu

SEQ ID NO: 1956592 - RNA, 15 nt, Human
caauucuccugccuc

SEQ ID NO: 1956593 - RNA, 16 nt, Human
caauucuccugccuca

SEQ ID NO: 1956594 - RNA, 20 nt, Human
caauucucccgggacucugc

SEQ ID NO: 1956595 - RNA, 17 nt, Human
caaugugauaaaacccc

SEQ ID NO: 1956596 - RNA, 15 nt, Human
caaugugauaaaacc

SEQ ID NO: 1956597 - RNA, 16 nt, Human
caaugugacuuugaaa

SEQ ID NO: 1956598 - RNA, 18 nt, Human
caaugugauauaaacagc

SEQ ID NO: 1956599 - RNA, 20 nt, Human
caaugugauauaaacagcuu

SEQ ID NO: 1956600 - RNA, 22 nt, Human
caaugugauauaaacagcuucu

SEQ ID NO: 1956601 - RNA, 22 nt, Human
cacaguccuuaccagcagagca

SEQ ID NO: 1956602 - RNA, 21 nt, Human
cacaguccuuaccagcagagc

SEQ ID NO: 1956603 - RNA, 15 nt, Human
cacaguccuuaccag

SEQ ID NO: 1956604 - RNA, 13 nt, Human
cacaguccuuacc

SEQ ID NO: 1956605 - RNA, 19 nt, Human
cacagugaucaaguuauuu

SEQ ID NO: 1956606 - RNA, 14 nt, Human
cacagugcaucuca

SEQ ID NO: 1956607 - RNA, 22 nt, Human
cacaggcagggcaggaccagcc

SEQ ID NO: 1956608 - RNA, 22 nt, Human
cacagugagucgaggacaggga

SEQ ID NO: 1956609 - RNA, 21 nt, Human
cacagugagucgaggacaggg

SEQ ID NO: 1956610 - RNA, 22 nt, Human
cacaguguaccauuaaaauaug

SEQ ID NO: 1956611 - RNA, 17 nt, Human
cacaguguaccauuaaa

SEQ ID NO: 1956612 - RNA, 18 nt, Human
cacaguguaccauuaaaa

SEQ ID NO: 1956613 - RNA, 19 nt, Human
cacaguguaccauuaaaau

SEQ ID NO: 1956614 - RNA, 21 nt, Human
cacaguguaccauuaaaauau

SEQ ID NO: 1956615 - RNA, 15 nt, Human
cacaguguaccauua

SEQ ID NO: 1956616 - RNA, 15 nt, Human
cacaguucucuccuu

SEQ ID NO: 1956617 - RNA, 14 nt, Human
cacaguucucuccu

SEQ ID NO: 1956618 - RNA, 21 nt, Human
cacaguguguggucaacauuu

SEQ ID NO: 1956619 - RNA, 14 nt, Human
cacagugugauuuu

SEQ ID NO: 1956620 - RNA, 23 nt, Human
cacaguguguggucaacauuucu

SEQ ID NO: 1956621 - RNA, 11 nt, Human
cacaggcaggu

SEQ ID NO: 1956622 - RNA, 14 nt, Human
cacaggcaggucca

SEQ ID NO: 1956623 - RNA, 15 nt, Human
cacaggcagguccag

SEQ ID NO: 1956624 - RNA, 19 nt, Human
cacaggagggagggggaag

SEQ ID NO: 1956625 - RNA, 21 nt, Human
cacaggagggagggggaaggc

SEQ ID NO: 1956626 - RNA, 14 nt, Human
cacaggagggaggg

SEQ ID NO: 1956627 - RNA, 19 nt, Human
cacaggagaggauggccca

SEQ ID NO: 1956628 - RNA, 23 nt, Human
cacagcugggguggggaccucag

SEQ ID NO: 1956629 - RNA, 22 nt, Human
cacagcugggguggggaccuca

SEQ ID NO: 1956630 - RNA, 21 nt, Human
cacagcuucauuuccuguguc

SEQ ID NO: 1956631 - RNA, 22 nt, Human
cacagcuucauuuccugugucu

SEQ ID NO: 1956632 - RNA, 21 nt, Human
cacauaccaacucaacuuuuu

SEQ ID NO: 1956633 - RNA, 21 nt, Human
cacauagaaaguaaauaaaag

SEQ ID NO: 1956634 - RNA, 15 nt, Human
cacauagacugugcg

SEQ ID NO: 1956635 - RNA, 21 nt, Human
cacauagugaugguuccccug

SEQ ID NO: 1956636 - RNA, 16 nt, Human
cacauagacugugcgc

SEQ ID NO: 1956637 - RNA, 16 nt, Human
uuauggcuuuugugca

SEQ ID NO: 1956638 - RNA, 14 nt, Human
uuauggcacaucag

SEQ ID NO: 1956639 - RNA, 17 nt, Human
uuauguugcauagaaua

SEQ ID NO: 1956640 - RNA, 14 nt, Human
uuauggcugcauag

SEQ ID NO: 1956641 - RNA, 18 nt, Human
uuauguuguuuuguacag

SEQ ID NO: 1956642 - RNA, 18 nt, Human
uuauggcuuuugugcauu

SEQ ID NO: 1956643 - RNA, 17 nt, Human
uuauggauaugaaaaau

SEQ ID NO: 1956644 - RNA, 17 nt, Human
uuauggcuuuugugcau

SEQ ID NO: 1956645 - RNA, 20 nt, Human
uuauggaacacucugagacu

SEQ ID NO: 1956646 - RNA, 18 nt, Human
uuauggaacacucugaga

SEQ ID NO: 1956647 - RNA, 21 nt, Human
uuauggacaaugacccagugg

SEQ ID NO: 1956648 - RNA, 17 nt, Human
uuauggaacacucugag

SEQ ID NO: 1956649 - RNA, 18 nt, Human
uuaucuugaaggaaaaau

SEQ ID NO: 1956650 - RNA, 12 nt, Human
uuauuaaucacu

SEQ ID NO: 1956651 - RNA, 13 nt, Human
uuauuaaucacug

SEQ ID NO: 1956652 - RNA, 18 nt, Human
uuauuaagguuacagauu

SEQ ID NO: 1956653 - RNA, 20 nt, Human
uuauuaaauuuuuuuguaug

SEQ ID NO: 1956654 - RNA, 21 nt, Human
uuauuaaauuuuuuuguauga

SEQ ID NO: 1956655 - RNA, 18 nt, Human
uuauguuuuuguacucug

SEQ ID NO: 1956656 - RNA, 17 nt, Human
uuauguuuuuguacucu

SEQ ID NO: 1956657 - RNA, 22 nt, Human
uuauuaaauuuuuuuguaugaa

SEQ ID NO: 1956658 - RNA, 19 nt, Human
uuauuaacuuaauaaucaa

SEQ ID NO: 1956659 - RNA, 14 nt, Human
uuauuaacuuaaua

SEQ ID NO: 1956660 - RNA, 17 nt, Human
uuauuaacuuaauaauc

SEQ ID NO: 1956661 - RNA, 21 nt, Human
uuauuaaaugcccagccccuu

SEQ ID NO: 1956662 - RNA, 19 nt, Human
uuauuaaaugcccagcccc

SEQ ID NO: 1956663 - RNA, 23 nt, Human
uuauuaaaaaucucaaauuucua

SEQ ID NO: 1956664 - RNA, 18 nt, Human
uuauguuuugguccacuu

SEQ ID NO: 1956665 - RNA, 20 nt, Human
uuauguuuugguccacuuuu

SEQ ID NO: 1956666 - RNA, 23 nt, Human
uuauguuuugguccacuuuucca

SEQ ID NO: 1956667 - RNA, 11 nt, Human
uuauguuugcc

SEQ ID NO: 1956668 - RNA, 20 nt, Human
uuauguuugccacuuugcaa

SEQ ID NO: 1956669 - RNA, 16 nt, Human
uuaucuugaauaaugu

SEQ ID NO: 1956670 - RNA, 14 nt, Human
uuaucuugaauaau

SEQ ID NO: 1956671 - RNA, 17 nt, Human
uuaucuugaaggaaaaa

SEQ ID NO: 1956672 - RNA, 19 nt, Human
uuaucucagauauuugcac

SEQ ID NO: 1956673 - RNA, 18 nt, Human
uuaucucagauauuugca

SEQ ID NO: 1956674 - RNA, 14 nt, Human
uuaucuagauacug

SEQ ID NO: 1956675 - RNA, 14 nt, Human
uuaucuaccaacuu

SEQ ID NO: 1956676 - RNA, 17 nt, Human
uuaucuaccaacuuuca

SEQ ID NO: 1956677 - RNA, 18 nt, Human
uuaucuaccaacuuucaa

SEQ ID NO: 1956678 - RNA, 20 nt, Human
uuaucuaccaacuuucaaga

SEQ ID NO: 1956679 - RNA, 17 nt, Human
uuaucguccagugacuu

SEQ ID NO: 1956680 - RNA, 18 nt, Human
uuaucguccagugacuuu

SEQ ID NO: 1956681 - RNA, 19 nt, Human
uuaucgcccuggcaggcag

SEQ ID NO: 1956682 - RNA, 20 nt, Human
uuaucgcccuggcaggcagg

SEQ ID NO: 1956683 - RNA, 19 nt, Human
uuauauuucaaguacacug

SEQ ID NO: 1956684 - RNA, 14 nt, Human
uuaucccuuaagaa

SEQ ID NO: 1956685 - RNA, 15 nt, Human
uuaucccuuaagaau

SEQ ID NO: 1956686 - RNA, 16 nt, Human
uuaucccuuaagaaug

SEQ ID NO: 1956687 - RNA, 16 nt, Human
uuauauuuacaaaugg

SEQ ID NO: 1956688 - RNA, 24 nt, Human
uuauauuguaagaaauacuguaca

SEQ ID NO: 1956689 - RNA, 16 nt, Human
uuauauuguaagaaau

SEQ ID NO: 1956690 - RNA, 22 nt, Human
uuauauuguaagaaauacugua

SEQ ID NO: 1956691 - RNA, 14 nt, Human
uuauauuguaagaa

SEQ ID NO: 1956692 - RNA, 15 nt, Human
uuauauuuauugacu

SEQ ID NO: 1956693 - RNA, 11 nt, Human
uuauauuucca

SEQ ID NO: 1956694 - RNA, 20 nt, Human
uuauauuuauugacucuuga

SEQ ID NO: 1956695 - RNA, 10 nt, Human
uuauauuuca

SEQ ID NO: 1956696 - RNA, 11 nt, Human
uuauauuucaa

SEQ ID NO: 1956697 - RNA, 18 nt, Human
uuauauuucaaguacacu

SEQ ID NO: 1956698 - RNA, 22 nt, Human
uuauacagaccgaacuguugua

SEQ ID NO: 1956699 - RNA, 19 nt, Human
uuauaucuauauuuuacau

SEQ ID NO: 1956700 - RNA, 23 nt, Human
uuauaucuauauuuuacauaaau

SEQ ID NO: 1956701 - RNA, 18 nt, Human
uuauauccaguaacacau

SEQ ID NO: 1956702 - RNA, 17 nt, Human
uuauauccauuuuuauc

SEQ ID NO: 1956703 - RNA, 17 nt, Human
uuauaucagacugcuuu

SEQ ID NO: 1956704 - RNA, 22 nt, Human
uuauaucagacugcuuugagaa

SEQ ID NO: 1956705 - RNA, 11 nt, Human
uuauacauaaa

SEQ ID NO: 1956706 - RNA, 13 nt, Human
uuauacauaaaca

SEQ ID NO: 1956707 - RNA, 21 nt, Human
uuauaugaacauacaaaugca

SEQ ID NO: 1956708 - RNA, 13 nt, Human
uuauaugaacaua

SEQ ID NO: 1956709 - RNA, 15 nt, Human
uuauaugaacauaca

SEQ ID NO: 1956710 - RNA, 17 nt, Human
uuauaugaacauacaaa

SEQ ID NO: 1956711 - RNA, 23 nt, Human
uuauaucuccuuuguauucuguc

SEQ ID NO: 1956712 - RNA, 21 nt, Human
uuauauguauguguuuagaau

SEQ ID NO: 1956713 - RNA, 19 nt, Human
uuauauguauguguuuaga

SEQ ID NO: 1956714 - RNA, 20 nt, Human
uuauauguauguguuuagaa

SEQ ID NO: 1956715 - RNA, 12 nt, Human
uuauauguaugu

SEQ ID NO: 1956716 - RNA, 14 nt, Human
uuauauguaugugu

SEQ ID NO: 1956717 - RNA, 15 nt, Human
uuauauguauguguu

SEQ ID NO: 1956718 - RNA, 16 nt, Human
uuauauguauguguuu

SEQ ID NO: 1956719 - RNA, 17 nt, Human
uuauauguauguguuua

SEQ ID NO: 1956720 - RNA, 16 nt, Human
uuauauuaugaagcuu

SEQ ID NO: 1956721 - RNA, 15 nt, Human
ugugaaaagaaaaau

SEQ ID NO: 1956722 - RNA, 13 nt, Human
ugugaaaagaaaa

SEQ ID NO: 1956723 - RNA, 17 nt, Human
ugugaaaagaaaaauga

SEQ ID NO: 1956724 - RNA, 21 nt, Human
ugugaaaagaaaaaugagccu

SEQ ID NO: 1956725 - RNA, 19 nt, Human
ugucuuaauggaugaaauc

SEQ ID NO: 1956726 - RNA, 19 nt, Human
uuagugaccucagcuuuga

SEQ ID NO: 1956727 - RNA, 14 nt, Human
uuagucuuuauacu

SEQ ID NO: 1956728 - RNA, 16 nt, Human
uuagugagacauauuu

SEQ ID NO: 1956729 - RNA, 16 nt, Human
uuaguggacccugaaa

SEQ ID NO: 1956730 - RNA, 19 nt, Human
uuaguggacccugaaaugu

SEQ ID NO: 1956731 - RNA, 21 nt, Human
uuaguggacccugaaaugugu

SEQ ID NO: 1956732 - RNA, 13 nt, Human
uuauaagaaaaau

SEQ ID NO: 1956733 - RNA, 20 nt, Human
uuauaagaaaaaugugaauu

SEQ ID NO: 1956734 - RNA, 21 nt, Human
uuauaauuuuaaauguuuuuu

SEQ ID NO: 1956735 - RNA, 17 nt, Human
uuauaauuuuaaauguu

SEQ ID NO: 1956736 - RNA, 12 nt, Human
uuauaauuuuaa

SEQ ID NO: 1956737 - RNA, 14 nt, Human
uuauaauuguugca

SEQ ID NO: 1956738 - RNA, 15 nt, Human
uuauaauuguugcau

SEQ ID NO: 1956739 - RNA, 12 nt, Human
uuauaauuuaaa

SEQ ID NO: 1956740 - RNA, 15 nt, Human
uuauaaugaaugaaa

SEQ ID NO: 1956741 - RNA, 14 nt, Human
uuauaaugaaugac

SEQ ID NO: 1956742 - RNA, 19 nt, Human
uuauaauguauucauauuu

SEQ ID NO: 1956743 - RNA, 22 nt, Human
uuauaauguauucauauuugua

SEQ ID NO: 1956744 - RNA, 12 nt, Human
uuauaauguauu

SEQ ID NO: 1956745 - RNA, 13 nt, Human
uuauaauguauuc

SEQ ID NO: 1956746 - RNA, 15 nt, Human
uuauaauaauguuaa

SEQ ID NO: 1956747 - RNA, 18 nt, Human
uuauaauaauguuaacau

SEQ ID NO: 1956748 - RNA, 14 nt, Human
uuauaaucaccagg

SEQ ID NO: 1956749 - RNA, 17 nt, Human
uuccaaccauuuaucuu

SEQ ID NO: 1956750 - RNA, 18 nt, Human
uuccaaccauuuaucuug

SEQ ID NO: 1956751 - RNA, 19 nt, Human
uuccaaccauuuaucuuga

SEQ ID NO: 1956752 - RNA, 16 nt, Human
uuccaaaguacacugu

SEQ ID NO: 1956753 - RNA, 20 nt, Human
uuccaaagcagagagcauua

SEQ ID NO: 1956754 - RNA, 13 nt, Human
uuccaaaguacac

SEQ ID NO: 1956755 - RNA, 15 nt, Human
uuccauggacuuugu

SEQ ID NO: 1956756 - RNA, 14 nt, Human
uuccauggacuuug

SEQ ID NO: 1956757 - RNA, 16 nt, Human
uuccauauuagaaaac

SEQ ID NO: 1956758 - RNA, 17 nt, Human
uuccauauuagaaaacu

SEQ ID NO: 1956759 - RNA, 18 nt, Human
uuccauauuagaaaacuu

SEQ ID NO: 1956760 - RNA, 21 nt, Human
uuccauauuagaaaacuuugu

SEQ ID NO: 1956761 - RNA, 18 nt, Human
uuccauauuuuuuuccuu

SEQ ID NO: 1956762 - RNA, 23 nt, Human
uuccauauuuuuuuccuuacaua

SEQ ID NO: 1956763 - RNA, 13 nt, Human
uuccagagcauuc

SEQ ID NO: 1956764 - RNA, 11 nt, Human
uuccagagcau

SEQ ID NO: 1956765 - RNA, 21 nt, Human
uuccagagcauuccagucagg

SEQ ID NO: 1956766 - RNA, 15 nt, Human
uuccagagcugccag

SEQ ID NO: 1956767 - RNA, 19 nt, Human
uuccaacccucaucaccaa

SEQ ID NO: 1956768 - RNA, 20 nt, Human
uuccaaccauuuaucuugaa

SEQ ID NO: 1956769 - RNA, 21 nt, Human
uuccaaccauuuaucuugaag

SEQ ID NO: 1956770 - RNA, 14 nt, Human
uuccagaaucugua

SEQ ID NO: 1956771 - RNA, 22 nt, Human
uucagcuuguaaauagcucagg

SEQ ID NO: 1956772 - RNA, 13 nt, Human
uucagcuugggga

SEQ ID NO: 1956773 - RNA, 14 nt, Human
uucaguggcagcug

SEQ ID NO: 1956774 - RNA, 22 nt, Human
uucagcuccagcucaccagccc

SEQ ID NO: 1956775 - RNA, 12 nt, Human
uucagcuccagc

SEQ ID NO: 1956776 - RNA, 15 nt, Human
uucagcuccagcuca

SEQ ID NO: 1956777 - RNA, 13 nt, Human
uucaguguacaug

SEQ ID NO: 1956778 - RNA, 12 nt, Human
uucaguguacau

SEQ ID NO: 1956779 - RNA, 17 nt, Human
uucaguggcagcugcuu

SEQ ID NO: 1956780 - RNA, 15 nt, Human
uucaguggcagcugc

SEQ ID NO: 1956781 - RNA, 16 nt, Human
uucaguggcagcugcu

SEQ ID NO: 1956782 - RNA, 12 nt, Human
uucauccuuuca

SEQ ID NO: 1956783 - RNA, 15 nt, Human
uucauccuuucacuu

SEQ ID NO: 1956784 - RNA, 18 nt, Human
uucaucccuucucuucca

SEQ ID NO: 1956785 - RNA, 12 nt, Human
uucauccuuccc

SEQ ID NO: 1956786 - RNA, 17 nt, Human
uucauccuucccacucu

SEQ ID NO: 1956787 - RNA, 16 nt, Human
uucaucccuucucuuc

SEQ ID NO: 1956788 - RNA, 20 nt, Human
uucauccuuucacuucuuuc

SEQ ID NO: 1956789 - RNA, 20 nt, Human
uucaucugagagaggcuaaa

SEQ ID NO: 1956790 - RNA, 19 nt, Human
uucauccuccucagaucuu

SEQ ID NO: 1956791 - RNA, 15 nt, Human
uucauccuccucaga

SEQ ID NO: 1956792 - RNA, 15 nt, Human
uucauaaccuagccu

SEQ ID NO: 1956793 - RNA, 20 nt, Human
uucauaaauaaaguuuguug

SEQ ID NO: 1956794 - RNA, 16 nt, Human
uucaguuuuuguguuu

SEQ ID NO: 1956795 - RNA, 13 nt, Human
uucaguucaaagu

SEQ ID NO: 1956796 - RNA, 16 nt, Human
uucaguucaaagucau

SEQ ID NO: 1956797 - RNA, 17 nt, Human
uucaguucaaagucaug

SEQ ID NO: 1956798 - RNA, 22 nt, Human
uucaguucaaagucaugauguu

SEQ ID NO: 1956799 - RNA, 23 nt, Human
uucaguuauuauauuuacaaaug

SEQ ID NO: 1956800 - RNA, 10 nt, Human
uucaguguuu

SEQ ID NO: 1956801 - RNA, 13 nt, Human
uucaguguuucug

SEQ ID NO: 1956802 - RNA, 21 nt, Human
uucaguguuucuggggagcug

SEQ ID NO: 1956803 - RNA, 14 nt, Human
uuauuugaaugacu

SEQ ID NO: 1956804 - RNA, 23 nt, Human
uuauuagcagcugacuuucaaag

SEQ ID NO: 1956805 - RNA, 21 nt, Human
uuauuagcagcugacuuucaa

SEQ ID NO: 1956806 - RNA, 13 nt, Human
uuauuuuaaaaga

SEQ ID NO: 1956807 - RNA, 15 nt, Human
uuauuugucagugua

SEQ ID NO: 1956808 - RNA, 19 nt, Human
uuauuugugauguacugua

SEQ ID NO: 1956809 - RNA, 17 nt, Human
uuauuuuaauucaguug

SEQ ID NO: 1956810 - RNA, 18 nt, Human
uuauuuuauuaugcauga

SEQ ID NO: 1956811 - RNA, 18 nt, Human
uucaaaugcuguaacuuu

SEQ ID NO: 1956812 - RNA, 17 nt, Human
uucaaauggaguuggag

SEQ ID NO: 1956813 - RNA, 22 nt, Human
uuauuuuggaaaauaaauuauu

SEQ ID NO: 1956814 - RNA, 21 nt, Human
uuauuuuggagagauaggaag

SEQ ID NO: 1956815 - RNA, 18 nt, Human
uucaaauguauuacagug

SEQ ID NO: 1956816 - RNA, 18 nt, Human
uucaaauguguuuugguc

SEQ ID NO: 1956817 - RNA, 21 nt, Human
uucaaauguguuuugguccug

SEQ ID NO: 1956818 - RNA, 21 nt, Human
uucaacagguuuuccugaaga

SEQ ID NO: 1956819 - RNA, 17 nt, Human
uucaacaguuucaaaau

SEQ ID NO: 1956820 - RNA, 15 nt, Human
uucaaccauucccca

SEQ ID NO: 1956821 - RNA, 16 nt, Human
uucaauaaaguuugau

SEQ ID NO: 1956822 - RNA, 18 nt, Human
uucaauaaaguuugaucu

SEQ ID NO: 1956823 - RNA, 19 nt, Human
uucaauaaaguuugaucuu

SEQ ID NO: 1956824 - RNA, 21 nt, Human
uucaauaaaguuugaucuucc

SEQ ID NO: 1956825 - RNA, 14 nt, Human
uucagcucacugca

SEQ ID NO: 1956826 - RNA, 17 nt, Human
uucagacagcugccugg

SEQ ID NO: 1956827 - RNA, 16 nt, Human
uucagacagcugccug

SEQ ID NO: 1956828 - RNA, 15 nt, Human
uucagacagcugccu

SEQ ID NO: 1956829 - RNA, 14 nt, Human
uucagacagcugcc

SEQ ID NO: 1956830 - RNA, 17 nt, Human
uucacggaagagccuug

SEQ ID NO: 1956831 - RNA, 22 nt, Human
uucaccuuuguccccaccgcag

SEQ ID NO: 1956832 - RNA, 13 nt, Human
uucacggaagagc

SEQ ID NO: 1956833 - RNA, 22 nt, Human
uucacaagacccaaaaggcaga

SEQ ID NO: 1956834 - RNA, 22 nt, Human
uucacaaauauuaaaaagucuu

SEQ ID NO: 1956835 - RNA, 21 nt, Human
uucacaaccuucuguggcuca

SEQ ID NO: 1956836 - RNA, 13 nt, Human
uucacccuuuucu

SEQ ID NO: 1956837 - RNA, 20 nt, Human
uucaccuuuguccccaccgc

SEQ ID NO: 1956838 - RNA, 19 nt, Human
uucaccuuuguccccaccg

SEQ ID NO: 1956839 - RNA, 14 nt, Human
uucaccuuuguccc

SEQ ID NO: 1956840 - RNA, 22 nt, Human
uucaauaggaaaaacugauuuu

SEQ ID NO: 1956841 - RNA, 18 nt, Human
uucaauaguaauauaaua

SEQ ID NO: 1956842 - RNA, 21 nt, Human
uucaauaggaaaaacugauuu

SEQ ID NO: 1956843 - RNA, 16 nt, Human
uucaauauauuuguau

SEQ ID NO: 1956844 - RNA, 19 nt, Human
uucacaaauauuaaaaagu

SEQ ID NO: 1956845 - RNA, 20 nt, Human
uucacaaauauuaaaaaguc

SEQ ID NO: 1956846 - RNA, 11 nt, Human
uucacaaauau

SEQ ID NO: 1956847 - RNA, 12 nt, Human
uucacaaauauu

SEQ ID NO: 1956848 - RNA, 14 nt, Human
uucacaaauauuaa

SEQ ID NO: 1956849 - RNA, 15 nt, Human
uucacaaauauuaaa

SEQ ID NO: 1956850 - RNA, 13 nt, Human
uugauuugauuuu

SEQ ID NO: 1956851 - RNA, 19 nt, Human
uugauuugucacugcuuca

SEQ ID NO: 1956852 - RNA, 13 nt, Human
uugauuugagauu

SEQ ID NO: 1956853 - RNA, 18 nt, Human
uugauuuuccaucuaaaa

SEQ ID NO: 1956854 - RNA, 11 nt, Human
uugcaaagcaa

SEQ ID NO: 1956855 - RNA, 12 nt, Human
uugcaaagcaaa

SEQ ID NO: 1956856 - RNA, 15 nt, Human
uugauuuuaaaaugu

SEQ ID NO: 1956857 - RNA, 18 nt, Human
uugauuuuaaaauguaca

SEQ ID NO: 1956858 - RNA, 19 nt, Human
uugauuuuaaaauguacau

SEQ ID NO: 1956859 - RNA, 22 nt, Human
uugauuuuaaaauguacaugua

SEQ ID NO: 1956860 - RNA, 21 nt, Human
uugcaaaguaucccuacugua

SEQ ID NO: 1956861 - RNA, 22 nt, Human
uugcaaaggagcucacuguggu

SEQ ID NO: 1956862 - RNA, 12 nt, Human
uugauugcuuuu

SEQ ID NO: 1956863 - RNA, 13 nt, Human
uugauugcuuuuu

SEQ ID NO: 1956864 - RNA, 14 nt, Human
uugauucucuccau

SEQ ID NO: 1956865 - RNA, 16 nt, Human
uugaugaucuuugcag

SEQ ID NO: 1956866 - RNA, 17 nt, Human
uugaugacccccaacca

SEQ ID NO: 1956867 - RNA, 17 nt, Human
uugaugcaauccuuaca

SEQ ID NO: 1956868 - RNA, 19 nt, Human
uugaugcaauccuuacaaa

SEQ ID NO: 1956869 - RNA, 20 nt, Human
uugaugcaauccuuacaaau

SEQ ID NO: 1956870 - RNA, 22 nt, Human
uugaugcaauccuuacaaauga

SEQ ID NO: 1956871 - RNA, 19 nt, Human
uugaugcauuaaaagaaaa

SEQ ID NO: 1956872 - RNA, 20 nt, Human
uugaugcauuaaaagaaaau

SEQ ID NO: 1956873 - RNA, 13 nt, Human
uugauucucucca

SEQ ID NO: 1956874 - RNA, 16 nt, Human
uugaggguugggcugg

SEQ ID NO: 1956875 - RNA, 13 nt, Human
uugaggguugggc

SEQ ID NO: 1956876 - RNA, 14 nt, Human
uugagccuaaaaau

SEQ ID NO: 1956877 - RNA, 17 nt, Human
uugagccuaaaaauaaa

SEQ ID NO: 1956878 - RNA, 21 nt, Human
uugagccuaaaaauaaagcac

SEQ ID NO: 1956879 - RNA, 11 nt, Human
uugagccuggg

SEQ ID NO: 1956880 - RNA, 18 nt, Human
uugagcccuuguuucagg

SEQ ID NO: 1956881 - RNA, 20 nt, Human
uugacuguuauuuguugaga

SEQ ID NO: 1956882 - RNA, 23 nt, Human
uugauauccucuuugagugaagc

SEQ ID NO: 1956883 - RNA, 12 nt, Human
uugauaguggga

SEQ ID NO: 1956884 - RNA, 23 nt, Human
uugauagcacagacccugcccug

SEQ ID NO: 1956885 - RNA, 14 nt, Human
uugaauuguaagga

SEQ ID NO: 1956886 - RNA, 17 nt, Human
uugaacuguuagaaugu

SEQ ID NO: 1956887 - RNA, 18 nt, Human
uugaacuguuagaaugua

SEQ ID NO: 1956888 - RNA, 23 nt, Human
uugaauuuauuuuuaagaaagaa

SEQ ID NO: 1956889 - RNA, 14 nt, Human
uugaacuguuagaa

SEQ ID NO: 1956890 - RNA, 15 nt, Human
uugaacuguuagaau

SEQ ID NO: 1956891 - RNA, 13 nt, Human
uugaacuuugacc

SEQ ID NO: 1956892 - RNA, 18 nt, Human
uugaacuggguacuugug

SEQ ID NO: 1956893 - RNA, 17 nt, Human
uugaacuccugaccuca

SEQ ID NO: 1956894 - RNA, 15 nt, Human
uugaacucugagaga

SEQ ID NO: 1956895 - RNA, 12 nt, Human
uugaauuuuaca

SEQ ID NO: 1956896 - RNA, 24 nt, Human
uugaauuuauuuuuaagaaagaaa

SEQ ID NO: 1956897 - RNA, 11 nt, Human
uugaauuuuca

SEQ ID NO: 1956898 - RNA, 12 nt, Human
uugaauuuucau

SEQ ID NO: 1956899 - RNA, 13 nt, Human
uugaauuuucauu

SEQ ID NO: 1956900 - RNA, 14 nt, Human
uugaauuuucauuu

SEQ ID NO: 1956901 - RNA, 15 nt, Human
uugaauuuucauuuu

SEQ ID NO: 1956902 - RNA, 16 nt, Human
uugaauuuucauuuua

SEQ ID NO: 1956903 - RNA, 17 nt, Human
uugaauuuucauuuuac

SEQ ID NO: 1956904 - RNA, 23 nt, Human
uugaauuuucauuuuacaguuac

SEQ ID NO: 1956905 - RNA, 19 nt, Human
uugacaaagucaagccaca

SEQ ID NO: 1956906 - RNA, 20 nt, Human
uugacaaagucaagccacau

SEQ ID NO: 1956907 - RNA, 14 nt, Human
uugaccucugcagc

SEQ ID NO: 1956908 - RNA, 15 nt, Human
uugaccucugcagca

SEQ ID NO: 1956909 - RNA, 12 nt, Human
uugacccugcac

SEQ ID NO: 1956910 - RNA, 15 nt, Human
uugacccugcacccu

SEQ ID NO: 1956911 - RNA, 17 nt, Human
uugacccugcacccucc

SEQ ID NO: 1956912 - RNA, 15 nt, Human
uugaccgacagcuuu

SEQ ID NO: 1956913 - RNA, 15 nt, Human
uugacaagcuggcuu

SEQ ID NO: 1956914 - RNA, 20 nt, Human
uugacaaacuucuuucacuc

SEQ ID NO: 1956915 - RNA, 21 nt, Human
uugaccucaggugauccaccc

SEQ ID NO: 1956916 - RNA, 17 nt, Human
uugacccacaagaaaug

SEQ ID NO: 1956917 - RNA, 17 nt, Human
uugaccgugaggccaga

SEQ ID NO: 1956918 - RNA, 14 nt, Human
uugacccacaagaa

SEQ ID NO: 1956919 - RNA, 14 nt, Human
uugacaagcuggcu

SEQ ID NO: 1956920 - RNA, 19 nt, Human
uugacgccaucccagcccc

SEQ ID NO: 1956921 - RNA, 18 nt, Human
uugacgccaucccagccc

SEQ ID NO: 1956922 - RNA, 17 nt, Human
uugacgccaucccagcc

SEQ ID NO: 1956923 - RNA, 16 nt, Human
uugaccucugcagcaa

SEQ ID NO: 1956924 - RNA, 21 nt, Human
uugacucuaguacugugaauc

SEQ ID NO: 1956925 - RNA, 23 nt, Human
uugaaaacacuguucucugcccu

SEQ ID NO: 1956926 - RNA, 21 nt, Human
uucuuuccaaaguacacuguu

SEQ ID NO: 1956927 - RNA, 20 nt, Human
uugaaaaaccauuuugcugu

SEQ ID NO: 1956928 - RNA, 14 nt, Human
uugaaaagaggugu

SEQ ID NO: 1956929 - RNA, 21 nt, Human
uugaaaagaggugugcaagag

SEQ ID NO: 1956930 - RNA, 13 nt, Human
uugaaaagagaca

SEQ ID NO: 1956931 - RNA, 13 nt, Human
uugaaaagaggug

SEQ ID NO: 1956932 - RNA, 15 nt, Human
uugaaaacagaaauu

SEQ ID NO: 1956933 - RNA, 15 nt, Human
uugaacuccuggccu

SEQ ID NO: 1956934 - RNA, 16 nt, Human
uugaacuccuggccuc

SEQ ID NO: 1956935 - RNA, 17 nt, Human
uugaaaaguaauauuua

SEQ ID NO: 1956936 - RNA, 22 nt, Human
uugaaaaguaauauuuauuaaa

SEQ ID NO: 1956937 - RNA, 13 nt, Human
uucuuguuuugcu

SEQ ID NO: 1956938 - RNA, 16 nt, Human
uucuuguuuugcuucc

SEQ ID NO: 1956939 - RNA, 12 nt, Human
uucuuucagcca

SEQ ID NO: 1956940 - RNA, 13 nt, Human
uucuuuaaacugu

SEQ ID NO: 1956941 - RNA, 14 nt, Human
uucuuuccaaagua

SEQ ID NO: 1956942 - RNA, 13 nt, Human
uucuuccucccuc

SEQ ID NO: 1956943 - RNA, 15 nt, Human
uucuuccucauuccc

SEQ ID NO: 1956944 - RNA, 21 nt, Human
uucuuguguguuuauugucaa

SEQ ID NO: 1956945 - RNA, 17 nt, Human
uucuucccuuaucccug

SEQ ID NO: 1956946 - RNA, 19 nt, Human
uucuucccaacuugccuuu

SEQ ID NO: 1956947 - RNA, 21 nt, Human
uucuucccaacuugccuuuga

SEQ ID NO: 1956948 - RNA, 21 nt, Human
uucuucccacccccuugcccu

SEQ ID NO: 1956949 - RNA, 11 nt, Human
uucuuccaguu

SEQ ID NO: 1956950 - RNA, 12 nt, Human
uucuuccaguua

SEQ ID NO: 1956951 - RNA, 22 nt, Human
uucuuccaguuacuuuccaauu

SEQ ID NO: 1956952 - RNA, 21 nt, Human
uucuuauacauuugauaaagu

SEQ ID NO: 1956953 - RNA, 21 nt, Human
uucuuccacaagagcccaggc

SEQ ID NO: 1956954 - RNA, 14 nt, Human
uucuuccaaagcag

SEQ ID NO: 1956955 - RNA, 14 nt, Human
uucuguguuuacag

SEQ ID NO: 1956956 - RNA, 17 nt, Human
uucuguguuuacagaga

SEQ ID NO: 1956957 - RNA, 22 nt, Human
uucugucuucauccccucagaa

SEQ ID NO: 1956958 - RNA, 21 nt, Human
uucugucuucauccccucaga

SEQ ID NO: 1956959 - RNA, 18 nt, Human
uucuguauuuuguuuuug

SEQ ID NO: 1956960 - RNA, 16 nt, Human
uucuguauuugaaagu

SEQ ID NO: 1956961 - RNA, 17 nt, Human
uucuguauuugaaagug

SEQ ID NO: 1956962 - RNA, 19 nt, Human
uucuguauuugaaagugcc

SEQ ID NO: 1956963 - RNA, 22 nt, Human
uucugucaaagucagaacaaau

SEQ ID NO: 1956964 - RNA, 23 nt, Human
uucugucaaagucagaacaaauu

SEQ ID NO: 1956965 - RNA, 14 nt, Human
uucuggaugggaca

SEQ ID NO: 1956966 - RNA, 14 nt, Human
uucuguauuugaaa

SEQ ID NO: 1956967 - RNA, 15 nt, Human
uucuguauuugaaag

SEQ ID NO: 1956968 - RNA, 14 nt, Human
uucugucucucccu

SEQ ID NO: 1956969 - RNA, 19 nt, Human
uucuguccuacucuguguc

SEQ ID NO: 1956970 - RNA, 17 nt, Human
uucugcuggcaucaaga

SEQ ID NO: 1956971 - RNA, 14 nt, Human
uucugcuucagccu

SEQ ID NO: 1956972 - RNA, 15 nt, Human
uucugcuucagccuc

SEQ ID NO: 1956973 - RNA, 16 nt, Human
uucugcuucagccucc

SEQ ID NO: 1956974 - RNA, 19 nt, Human
uucugcuucagccucccga

SEQ ID NO: 1956975 - RNA, 22 nt, Human
uucuggaaucauuguccagagc

SEQ ID NO: 1956976 - RNA, 15 nt, Human
uucuggacucuggac

SEQ ID NO: 1956977 - RNA, 18 nt, Human
uucugcuuuccucuuccu

SEQ ID NO: 1956978 - RNA, 13 nt, Human
uucugcuuuagac

SEQ ID NO: 1956979 - RNA, 17 nt, Human
uucugcuuuagacuuga

SEQ ID NO: 1956980 - RNA, 19 nt, Human
uucugcuuuagacuugaaa

SEQ ID NO: 1956981 - RNA, 11 nt, Human
uucugcuuugu

SEQ ID NO: 1956982 - RNA, 12 nt, Human
uucugcuuuguu

SEQ ID NO: 1956983 - RNA, 19 nt, Human
uucugcuuuguugugugcc

SEQ ID NO: 1956984 - RNA, 20 nt, Human
uucugcuuuguugugugccu

SEQ ID NO: 1956985 - RNA, 22 nt, Human
uucugcuuuguugugugccucu

SEQ ID NO: 1956986 - RNA, 23 nt, Human
uucugcuuuguugugugccucua

SEQ ID NO: 1956987 - RNA, 16 nt, Human
uucucuccagccccug

SEQ ID NO: 1956988 - RNA, 15 nt, Human
uucucuccagccccu

SEQ ID NO: 1956989 - RNA, 14 nt, Human
uucucuccuguacc

SEQ ID NO: 1956990 - RNA, 18 nt, Human
uucucuccuguaccucuu

SEQ ID NO: 1956991 - RNA, 14 nt, Human
uucucuccagcccc

SEQ ID NO: 1956992 - RNA, 13 nt, Human
uucucuccagccc

SEQ ID NO: 1956993 - RNA, 13 nt, Human
uucucugaggaca

SEQ ID NO: 1956994 - RNA, 16 nt, Human
uucucugaggacaaga

SEQ ID NO: 1956995 - RNA, 20 nt, Human
uucucugaggacaagagaaa

SEQ ID NO: 1956996 - RNA, 19 nt, Human
uucucuccuguaccucuug

SEQ ID NO: 1956997 - RNA, 12 nt, Human
uucucugcccuc

SEQ ID NO: 1956998 - RNA, 11 nt, Human
uucucugcccu

SEQ ID NO: 1956999 - RNA, 14 nt, Human
uucucugaggacac

SEQ ID NO: 1957000 - RNA, 20 nt, Human
uucucugaggacacuaacca

SEQ ID NO: 1957001 - RNA, 15 nt, Human
uucuccaccugccag

SEQ ID NO: 1957002 - RNA, 14 nt, Human
uucuccaccugcca

SEQ ID NO: 1957003 - RNA, 12 nt, Human
uucuccaccugc

SEQ ID NO: 1957004 - RNA, 21 nt, Human
uucuccaccucccacaaagga

SEQ ID NO: 1957005 - RNA, 18 nt, Human
uucuccaccugccaggga

SEQ ID NO: 1957006 - RNA, 16 nt, Human
uucuccaccugccagg

SEQ ID NO: 1957007 - RNA, 20 nt, Human
uucuccaccugccagggaca

SEQ ID NO: 1957008 - RNA, 12 nt, Human
uucuccacugga

SEQ ID NO: 1957009 - RNA, 15 nt, Human
uucucauuacuuguu

SEQ ID NO: 1957010 - RNA, 21 nt, Human
uucucauuacuuguugccuau

SEQ ID NO: 1957011 - RNA, 20 nt, Human
uucucauuugccaauaauaa

SEQ ID NO: 1957012 - RNA, 16 nt, Human
uucuccacccugcucu

SEQ ID NO: 1957013 - RNA, 16 nt, Human
uucuaugaaagacuca

SEQ ID NO: 1957014 - RNA, 22 nt, Human
uucucauguugaaacuuuaaga

SEQ ID NO: 1957015 - RNA, 13 nt, Human
uucugauuucuuu

SEQ ID NO: 1957016 - RNA, 20 nt, Human
uucugauuucuuuucaccau

SEQ ID NO: 1957017 - RNA, 19 nt, Human
uucugauccuaguuccacc

SEQ ID NO: 1957018 - RNA, 15 nt, Human
uucugaucacugaaa

SEQ ID NO: 1957019 - RNA, 19 nt, Human
uucugaucacugaaauaaa

SEQ ID NO: 1957020 - RNA, 20 nt, Human
uucugaucacugaaauaaaa

SEQ ID NO: 1957021 - RNA, 14 nt, Human
uucugaucuucacu

SEQ ID NO: 1957022 - RNA, 19 nt, Human
uucugcucacauaucuguc

SEQ ID NO: 1957023 - RNA, 16 nt, Human
uucugcuaaauuucaa

SEQ ID NO: 1957024 - RNA, 18 nt, Human
uucugauaaccauagcau

SEQ ID NO: 1957025 - RNA, 13 nt, Human
uucugagagcugu

SEQ ID NO: 1957026 - RNA, 19 nt, Human
uucugagagcugugcauca

SEQ ID NO: 1957027 - RNA, 21 nt, Human
uucucugcccagcuuuucauu

SEQ ID NO: 1957028 - RNA, 21 nt, Human
uucugaggccugaauccaaaa

SEQ ID NO: 1957029 - RNA, 21 nt, Human
uucugacccugcuucaaauau

SEQ ID NO: 1957030 - RNA, 18 nt, Human
uucugacccugcuucaaa

SEQ ID NO: 1957031 - RNA, 22 nt, Human
uucugacccaugcugcccugug

SEQ ID NO: 1957032 - RNA, 23 nt, Human
uucugacccaugcugcccuguga

SEQ ID NO: 1957033 - RNA, 17 nt, Human
uucucugcccuccaaga

SEQ ID NO: 1957034 - RNA, 16 nt, Human
uucucugcccuccaag

SEQ ID NO: 1957035 - RNA, 16 nt, Human
uucuacuuccaagacu

SEQ ID NO: 1957036 - RNA, 22 nt, Human
uucuacucgaguuacagacaaa

SEQ ID NO: 1957037 - RNA, 14 nt, Human
uucuauagcuuuuc

SEQ ID NO: 1957038 - RNA, 20 nt, Human
uucuauagcaucacuuaaaa

SEQ ID NO: 1957039 - RNA, 22 nt, Human
uucuauagcaucacuuaaaaca

SEQ ID NO: 1957040 - RNA, 16 nt, Human
uucuauaauuuuacaa

SEQ ID NO: 1957041 - RNA, 19 nt, Human
uucuauagcaucacuuaaa

SEQ ID NO: 1957042 - RNA, 13 nt, Human
uucuacgccaggg

SEQ ID NO: 1957043 - RNA, 20 nt, Human
uucuaccggcuuugccaugu

SEQ ID NO: 1957044 - RNA, 13 nt, Human
uucuacuauuuau

SEQ ID NO: 1957045 - RNA, 14 nt, Human
uucuacccaggugc

SEQ ID NO: 1957046 - RNA, 20 nt, Human
uucuacccagcgagcccugg

SEQ ID NO: 1957047 - RNA, 21 nt, Human
uucuacccagcgagcccuggu

SEQ ID NO: 1957048 - RNA, 18 nt, Human
uucguacauaauacugaa

SEQ ID NO: 1957049 - RNA, 18 nt, Human
uucgugacaauguuuaca

SEQ ID NO: 1957050 - RNA, 23 nt, Human
uucuaaugugugaaucagagcac

SEQ ID NO: 1957051 - RNA, 19 nt, Human
uucgugacaauguuuacaa

SEQ ID NO: 1957052 - RNA, 18 nt, Human
uucuaauuggcuuuacua

SEQ ID NO: 1957053 - RNA, 16 nt, Human
uucuaauuagauuaac

SEQ ID NO: 1957054 - RNA, 17 nt, Human
uucuaauuccuguuugu

SEQ ID NO: 1957055 - RNA, 20 nt, Human
uucuaauuggcuuuacuauu

SEQ ID NO: 1957056 - RNA, 12 nt, Human
uucuacccagcg

SEQ ID NO: 1957057 - RNA, 19 nt, Human
uucuacccagcgagcccug

SEQ ID NO: 1957058 - RNA, 21 nt, Human
uuccugcaggccaggccagcu

SEQ ID NO: 1957059 - RNA, 20 nt, Human
uuccugauugguuucucuuc

SEQ ID NO: 1957060 - RNA, 16 nt, Human
uuccugauugguuucu

SEQ ID NO: 1957061 - RNA, 19 nt, Human
uuccugauugguuucucuu

SEQ ID NO: 1957062 - RNA, 22 nt, Human
uuccugauagcauaugacaaau

SEQ ID NO: 1957063 - RNA, 22 nt, Human
uuccugaguuaggcuuucucuu

SEQ ID NO: 1957064 - RNA, 20 nt, Human
uuccugauagcauaugacaa

SEQ ID NO: 1957065 - RNA, 23 nt, Human
uuccugaugcuucuucagagacu

SEQ ID NO: 1957066 - RNA, 15 nt, Human
uuccugaggcugggc

SEQ ID NO: 1957067 - RNA, 19 nt, Human
uuccugacgagauaagcag

SEQ ID NO: 1957068 - RNA, 21 nt, Human
uuccugaggaagagggacugu

SEQ ID NO: 1957069 - RNA, 20 nt, Human
uuccugaguuaggcuuucuc

SEQ ID NO: 1957070 - RNA, 20 nt, Human
uuccugaggcugggcucccu

SEQ ID NO: 1957071 - RNA, 16 nt, Human
uuccauggccucuuca

SEQ ID NO: 1957072 - RNA, 12 nt, Human
uuccauggccuc

SEQ ID NO: 1957073 - RNA, 14 nt, Human
uuccauguaugcau

SEQ ID NO: 1957074 - RNA, 21 nt, Human
uuccuugaguugauucagcuc

SEQ ID NO: 1957075 - RNA, 13 nt, Human
uuccuugcauaca

SEQ ID NO: 1957076 - RNA, 17 nt, Human
uuccuugcauacaaaca

SEQ ID NO: 1957077 - RNA, 14 nt, Human
uuccuugccagucu

SEQ ID NO: 1957078 - RNA, 15 nt, Human
uuccuugccagucuu

SEQ ID NO: 1957079 - RNA, 16 nt, Human
uuccugcuuccucaga

SEQ ID NO: 1957080 - RNA, 17 nt, Human
uuccugcuuccucagag

SEQ ID NO: 1957081 - RNA, 18 nt, Human
uuccugcuuccucagagg

SEQ ID NO: 1957082 - RNA, 18 nt, Human
uucggugagcuacaaaug

SEQ ID NO: 1957083 - RNA, 15 nt, Human
uucgguacccaccac

SEQ ID NO: 1957084 - RNA, 16 nt, Human
uuuauugacucuugag

SEQ ID NO: 1957085 - RNA, 12 nt, Human
uuuauucuugau

SEQ ID NO: 1957086 - RNA, 16 nt, Human
uuuauuuacugcuagu

SEQ ID NO: 1957087 - RNA, 19 nt, Human
uuuauuuaguuccuugagu

SEQ ID NO: 1957088 - RNA, 18 nt, Human
uuuauugaggaaaaauau

SEQ ID NO: 1957089 - RNA, 20 nt, Human
uuuauugaggaaaaauaugu

SEQ ID NO: 1957090 - RNA, 18 nt, Human
uuucaacucauugcauca

SEQ ID NO: 1957091 - RNA, 21 nt, Human
uuucaacgcagcccugcuuug

SEQ ID NO: 1957092 - RNA, 13 nt, Human
uuucaacucauug

SEQ ID NO: 1957093 - RNA, 16 nt, Human
uuucaacucauugcau

SEQ ID NO: 1957094 - RNA, 15 nt, Human
uuucaacgcagcccu

SEQ ID NO: 1957095 - RNA, 15 nt, Human
uuucaaccucuagaa

SEQ ID NO: 1957096 - RNA, 22 nt, Human
uuucaaccucuagaauuuuaag

SEQ ID NO: 1957097 - RNA, 16 nt, Human
uuucaacgcagcccug

SEQ ID NO: 1957098 - RNA, 20 nt, Human
uuucaacgcagcccugcuuu

SEQ ID NO: 1957099 - RNA, 16 nt, Human
uuucaagaacuuguuu

SEQ ID NO: 1957100 - RNA, 13 nt, Human
uuucaagaacuug

SEQ ID NO: 1957101 - RNA, 18 nt, Human
uuucaagacugaauucca

SEQ ID NO: 1957102 - RNA, 18 nt, Human
uuucaagcuuauuuugga

SEQ ID NO: 1957103 - RNA, 20 nt, Human
uuucaagcgucacuuuauuu

SEQ ID NO: 1957104 - RNA, 14 nt, Human
uuucaagcuuauuu

SEQ ID NO: 1957105 - RNA, 17 nt, Human
uuuauaaggacuuccug

SEQ ID NO: 1957106 - RNA, 14 nt, Human
uuuauggcuuuugu

SEQ ID NO: 1957107 - RNA, 16 nt, Human
uuuauggcuuuugugc

SEQ ID NO: 1957108 - RNA, 13 nt, Human
uuuauuaugcaug

SEQ ID NO: 1957109 - RNA, 13 nt, Human
uuuauuauggcac

SEQ ID NO: 1957110 - RNA, 14 nt, Human
uuucaguguacaug

SEQ ID NO: 1957111 - RNA, 13 nt, Human
uuucaguguacau

SEQ ID NO: 1957112 - RNA, 11 nt, Human
uuucagugagg

SEQ ID NO: 1957113 - RNA, 20 nt, Human
uuucaguuauugucccuggc

SEQ ID NO: 1957114 - RNA, 13 nt, Human
uuucaguucaaag

SEQ ID NO: 1957115 - RNA, 14 nt, Human
uuucaguucaaagu

SEQ ID NO: 1957116 - RNA, 17 nt, Human
uuucaguucaaagucau

SEQ ID NO: 1957117 - RNA, 15 nt, Human
uuucagauuugcaca

SEQ ID NO: 1957118 - RNA, 16 nt, Human
uuucagauuugcacaa

SEQ ID NO: 1957119 - RNA, 17 nt, Human
uuucagauuugcacaaa

SEQ ID NO: 1957120 - RNA, 19 nt, Human
uuucagauuugcacaaaaa

SEQ ID NO: 1957121 - RNA, 22 nt, Human
uuucagauuugcacaaaaagau

SEQ ID NO: 1957122 - RNA, 14 nt, Human
uuucauuuagguga

SEQ ID NO: 1957123 - RNA, 18 nt, Human
uuucauuuaggugaggaa

SEQ ID NO: 1957124 - RNA, 15 nt, Human
uuucaaguauuuaag

SEQ ID NO: 1957125 - RNA, 16 nt, Human
uuucaaguauuuaagc

SEQ ID NO: 1957126 - RNA, 17 nt, Human
uuucaaguauuuaagcc

SEQ ID NO: 1957127 - RNA, 23 nt, Human
uuucaaguauuuaagccuaaaga

SEQ ID NO: 1957128 - RNA, 19 nt, Human
uuucaagggcuuuccugug

SEQ ID NO: 1957129 - RNA, 18 nt, Human
uuucaaguacacugaauu

SEQ ID NO: 1957130 - RNA, 13 nt, Human
uuucaauaaaguu

SEQ ID NO: 1957131 - RNA, 14 nt, Human
uuucaauaaaguuu

SEQ ID NO: 1957132 - RNA, 15 nt, Human
uuucaauaaaguuug

SEQ ID NO: 1957133 - RNA, 18 nt, Human
uuucaauaaaguuugauc

SEQ ID NO: 1957134 - RNA, 21 nt, Human
uuucaauaaaguuugaucuuc

SEQ ID NO: 1957135 - RNA, 19 nt, Human
uuucaauaggaaaaacuga

SEQ ID NO: 1957136 - RNA, 17 nt, Human
uuucaauaggaaaaacu

SEQ ID NO: 1957137 - RNA, 14 nt, Human
uuucaauaggaaaa

SEQ ID NO: 1957138 - RNA, 12 nt, Human
uuucaauaggaa

SEQ ID NO: 1957139 - RNA, 12 nt, Human
uuucacaaauau

SEQ ID NO: 1957140 - RNA, 13 nt, Human
uuucacaaauauu

SEQ ID NO: 1957141 - RNA, 16 nt, Human
uuucacaaauauuaaa

SEQ ID NO: 1957142 - RNA, 17 nt, Human
uuucacaaauauuaaaa

SEQ ID NO: 1957143 - RNA, 18 nt, Human
uuucacaaauauuaaaaa

SEQ ID NO: 1957144 - RNA, 20 nt, Human
uuucacaaauauuaaaaagu

SEQ ID NO: 1957145 - RNA, 22 nt, Human
uuucacaaccuucuguggcuca

SEQ ID NO: 1957146 - RNA, 16 nt, Human
uuucacaaccuucugu

SEQ ID NO: 1957147 - RNA, 22 nt, Human
uuucacaaauauuaaaaagucu

SEQ ID NO: 1957148 - RNA, 23 nt, Human
uuuauaaaaauaaaaaacacugg

SEQ ID NO: 1957149 - RNA, 21 nt, Human
uuuauaaaaauaaaaaacacu

SEQ ID NO: 1957150 - RNA, 14 nt, Human
uuuaguuuugcuuu

SEQ ID NO: 1957151 - RNA, 13 nt, Human
uuuaguuuuauuu

SEQ ID NO: 1957152 - RNA, 17 nt, Human
uuuaguuuuauuuucua

SEQ ID NO: 1957153 - RNA, 19 nt, Human
uuuaguuuuauuuucuaaa

SEQ ID NO: 1957154 - RNA, 12 nt, Human
uuuaguuuuucu

SEQ ID NO: 1957155 - RNA, 12 nt, Human
uuuagacagagu

SEQ ID NO: 1957156 - RNA, 18 nt, Human
uuuagaauggugauuuua

SEQ ID NO: 1957157 - RNA, 20 nt, Human
uuuagaauggugauuuuaaa

SEQ ID NO: 1957158 - RNA, 21 nt, Human
uuuagaauggugauuuuaaau

SEQ ID NO: 1957159 - RNA, 11 nt, Human
uuuagaauuga

SEQ ID NO: 1957160 - RNA, 13 nt, Human
uuuagaauugaag

SEQ ID NO: 1957161 - RNA, 15 nt, Human
uuuagaauugaaggu

SEQ ID NO: 1957162 - RNA, 17 nt, Human
uuuagaauugaagguuu

SEQ ID NO: 1957163 - RNA, 18 nt, Human
uuuagaauugaagguuuu

SEQ ID NO: 1957164 - RNA, 21 nt, Human
uuuagaauugaagguuuuuga

SEQ ID NO: 1957165 - RNA, 22 nt, Human
uuuacuucuuauacauuugaua

SEQ ID NO: 1957166 - RNA, 19 nt, Human
uuuacuucuuauacauuug

SEQ ID NO: 1957167 - RNA, 14 nt, Human
uuuagaaauauaau

SEQ ID NO: 1957168 - RNA, 17 nt, Human
uuuacaguguuucuggc

SEQ ID NO: 1957169 - RNA, 15 nt, Human
uuuacagcugccugc

SEQ ID NO: 1957170 - RNA, 16 nt, Human
uuuacagcugccugca

SEQ ID NO: 1957171 - RNA, 21 nt, Human
uuuaauagguuuggacaaaau

SEQ ID NO: 1957172 - RNA, 22 nt, Human
uuuacacggagcggauugcaaa

SEQ ID NO: 1957173 - RNA, 15 nt, Human
uuuaacuuguaauaa

SEQ ID NO: 1957174 - RNA, 17 nt, Human
uuuaacuuaguuuugca

SEQ ID NO: 1957175 - RNA, 20 nt, Human
uuuaacuuaguuuugcauag

SEQ ID NO: 1957176 - RNA, 18 nt, Human
uuuaagaaaaaggaugca

SEQ ID NO: 1957177 - RNA, 22 nt, Human
uuuaagaaaaaggaugcacaga

SEQ ID NO: 1957178 - RNA, 12 nt, Human
uuuaagaaagaa

SEQ ID NO: 1957179 - RNA, 19 nt, Human
uuuaagacauuuuuggaag

SEQ ID NO: 1957180 - RNA, 17 nt, Human
uuuaagaacuaaaaugu

SEQ ID NO: 1957181 - RNA, 17 nt, Human
uuuaagacacuuccguc

SEQ ID NO: 1957182 - RNA, 20 nt, Human
uuuaagacgaaacauuuguu

SEQ ID NO: 1957183 - RNA, 18 nt, Human
uuuaaguguacuggauuu

SEQ ID NO: 1957184 - RNA, 12 nt, Human
uuuaaguuugca

SEQ ID NO: 1957185 - RNA, 14 nt, Human
uuuaaguuugcacu

SEQ ID NO: 1957186 - RNA, 18 nt, Human
uuuaaguuugcacucaaa

SEQ ID NO: 1957187 - RNA, 19 nt, Human
uuuaaguuugcacucaaau

SEQ ID NO: 1957188 - RNA, 23 nt, Human
uuuaaguuugcacucaaaucuua

SEQ ID NO: 1957189 - RNA, 13 nt, Human
uuuaaguuuugac

SEQ ID NO: 1957190 - RNA, 18 nt, Human
uuuaaguuuugacaagcu

SEQ ID NO: 1957191 - RNA, 19 nt, Human
uuuaauaaagcgaaaaacu

SEQ ID NO: 1957192 - RNA, 21 nt, Human
uuuaauaaagcgaaaaacuca

SEQ ID NO: 1957193 - RNA, 16 nt, Human
uuuaauaaaauaauaa

SEQ ID NO: 1957194 - RNA, 14 nt, Human
uuuaacagggucuc

SEQ ID NO: 1957195 - RNA, 23 nt, Human
uuuaacagggucucuagugcugu

SEQ ID NO: 1957196 - RNA, 18 nt, Human
uuuaacagaaauguacag

SEQ ID NO: 1957197 - RNA, 23 nt, Human
uuuaacaacuaugauuuggaaaa

SEQ ID NO: 1957198 - RNA, 18 nt, Human
uuguuuggagacagaguc

SEQ ID NO: 1957199 - RNA, 21 nt, Human
uuuaacauauaauuucuuuaa

SEQ ID NO: 1957200 - RNA, 19 nt, Human
uuuaacucuauaauguguu

SEQ ID NO: 1957201 - RNA, 19 nt, Human
uuguuaguaugaggcauuu

SEQ ID NO: 1957202 - RNA, 21 nt, Human
uuguuaguaugaggcauuugu

SEQ ID NO: 1957203 - RNA, 15 nt, Human
uuguuacucuuggga

SEQ ID NO: 1957204 - RNA, 14 nt, Human
uuguuacauuuuua

SEQ ID NO: 1957205 - RNA, 13 nt, Human
uuguuaauuugga

SEQ ID NO: 1957206 - RNA, 17 nt, Human
uuguuaaguccuuggcu

SEQ ID NO: 1957207 - RNA, 21 nt, Human
uuguguuuauucuugaugaaa

SEQ ID NO: 1957208 - RNA, 16 nt, Human
uuguguuuauucuuga

SEQ ID NO: 1957209 - RNA, 18 nt, Human
uuguguuuauucuugaug

SEQ ID NO: 1957210 - RNA, 22 nt, Human
uuguuaggccaaagacaaauag

SEQ ID NO: 1957211 - RNA, 22 nt, Human
uuguuagcauuuucaaugugau

SEQ ID NO: 1957212 - RNA, 20 nt, Human
uuguuaggccaaagacaaau

SEQ ID NO: 1957213 - RNA, 21 nt, Human
uuguuaggccaaagacaaaua

SEQ ID NO: 1957214 - RNA, 20 nt, Human
uuguuagugugucuuagugu

SEQ ID NO: 1957215 - RNA, 22 nt, Human
uuguuaguaugaggcauuuguu

SEQ ID NO: 1957216 - RNA, 14 nt, Human
uuguugugugccuc

SEQ ID NO: 1957217 - RNA, 15 nt, Human
uuguuguuuguaugu

SEQ ID NO: 1957218 - RNA, 20 nt, Human
uuguuucuuucucugaggac

SEQ ID NO: 1957219 - RNA, 14 nt, Human
uuguuucuuugaau

SEQ ID NO: 1957220 - RNA, 20 nt, Human
uuguuucuuugaauuuucau

SEQ ID NO: 1957221 - RNA, 23 nt, Human
uuguuugaugcauuaaaagaaaa

SEQ ID NO: 1957222 - RNA, 20 nt, Human
uuguuucagggcuguggccu

SEQ ID NO: 1957223 - RNA, 15 nt, Human
uuguuuccuuucacu

SEQ ID NO: 1957224 - RNA, 17 nt, Human
uuguggacacagcucuu

SEQ ID NO: 1957225 - RNA, 16 nt, Human
uuguggacacagcucu

SEQ ID NO: 1957226 - RNA, 21 nt, Human
uuguggaaaaugaaaauuagg

SEQ ID NO: 1957227 - RNA, 20 nt, Human
uuguggauuuaacagaaaug

SEQ ID NO: 1957228 - RNA, 21 nt, Human
uuguggauuuaacagaaaugu

SEQ ID NO: 1957229 - RNA, 22 nt, Human
uuguggauuuaacagaaaugua

SEQ ID NO: 1957230 - RNA, 23 nt, Human
uuguggauuuaacagaaauguac

SEQ ID NO: 1957231 - RNA, 12 nt, Human
uuguguugaaga

SEQ ID NO: 1957232 - RNA, 13 nt, Human
uuguguugaagag

SEQ ID NO: 1957233 - RNA, 18 nt, Human
uuguguugaagagcagcu

SEQ ID NO: 1957234 - RNA, 20 nt, Human
uuguguugaagagguuuuaa

SEQ ID NO: 1957235 - RNA, 21 nt, Human
uuguguuuauauauaagccaa

SEQ ID NO: 1957236 - RNA, 14 nt, Human
uuguguuuauucuu

SEQ ID NO: 1957237 - RNA, 17 nt, Human
uugugcauuaucuagau

SEQ ID NO: 1957238 - RNA, 15 nt, Human
uugugcacaggcaga

SEQ ID NO: 1957239 - RNA, 22 nt, Human
uugugcauuaucuagauacugu

SEQ ID NO: 1957240 - RNA, 23 nt, Human
uugugcauuaucuagauacugua

SEQ ID NO: 1957241 - RNA, 17 nt, Human
uugugcaguaacuuggg

SEQ ID NO: 1957242 - RNA, 20 nt, Human
uugugcaguaacuugggagu

SEQ ID NO: 1957243 - RNA, 12 nt, Human
uugugcauuugg

SEQ ID NO: 1957244 - RNA, 18 nt, Human
uugugccuaauguguuug

SEQ ID NO: 1957245 - RNA, 15 nt, Human
uugugccuaaugugu

SEQ ID NO: 1957246 - RNA, 12 nt, Human
uugugccccugc

SEQ ID NO: 1957247 - RNA, 16 nt, Human
uugugccagaaugcuu

SEQ ID NO: 1957248 - RNA, 21 nt, Human
uugugccagaaugcuuuagga

SEQ ID NO: 1957249 - RNA, 17 nt, Human
uugugccuuaaagacaa

SEQ ID NO: 1957250 - RNA, 15 nt, Human
uuguaaauuaacuuu

SEQ ID NO: 1957251 - RNA, 16 nt, Human
uuguaaauuaacuuuu

SEQ ID NO: 1957252 - RNA, 18 nt, Human
uuguaaauuaacuuuuau

SEQ ID NO: 1957253 - RNA, 23 nt, Human
uuguaaauuaacuuuuauaaacu

SEQ ID NO: 1957254 - RNA, 18 nt, Human
uuguacauaaugcgugca

SEQ ID NO: 1957255 - RNA, 15 nt, Human
uuguaaauucugauu

SEQ ID NO: 1957256 - RNA, 14 nt, Human
uuguacauaaugcg

SEQ ID NO: 1957257 - RNA, 12 nt, Human
uuguaaauucug

SEQ ID NO: 1957258 - RNA, 13 nt, Human
uuguaaauucuga

SEQ ID NO: 1957259 - RNA, 14 nt, Human
uuguaaauucugau

SEQ ID NO: 1957260 - RNA, 17 nt, Human
uuguaaaagcauuuugu

SEQ ID NO: 1957261 - RNA, 18 nt, Human
uuguaaaagcauuuugua

SEQ ID NO: 1957262 - RNA, 19 nt, Human
uuguaaaagcauuuuguaa

SEQ ID NO: 1957263 - RNA, 20 nt, Human
uuguaaaagcauuuuguaau

SEQ ID NO: 1957264 - RNA, 17 nt, Human
uuguaaauagcucaggu

SEQ ID NO: 1957265 - RNA, 16 nt, Human
uuguaaaugugguaaa

SEQ ID NO: 1957266 - RNA, 21 nt, Human
uuguaaaugugguaaagaguu

SEQ ID NO: 1957267 - RNA, 22 nt, Human
uuguaaaaauuaaaaguuaugg

SEQ ID NO: 1957268 - RNA, 16 nt, Human
uuggucugugagaugc

SEQ ID NO: 1957269 - RNA, 13 nt, Human
uuggucuguguga

SEQ ID NO: 1957270 - RNA, 13 nt, Human
uugguacuguaau

SEQ ID NO: 1957271 - RNA, 17 nt, Human
uugguauauccuuuucu

SEQ ID NO: 1957272 - RNA, 13 nt, Human
uugguauccuuau

SEQ ID NO: 1957273 - RNA, 14 nt, Human
uugguccacuuuuc

SEQ ID NO: 1957274 - RNA, 17 nt, Human
uugguccacuuuuccag

SEQ ID NO: 1957275 - RNA, 16 nt, Human
uugcacucaaaucuua

SEQ ID NO: 1957276 - RNA, 21 nt, Human
uugcacuauugagucuucaug

SEQ ID NO: 1957277 - RNA, 17 nt, Human
uugcacucaaaucuuaa

SEQ ID NO: 1957278 - RNA, 18 nt, Human
uugcacucaaaucuuaag

SEQ ID NO: 1957279 - RNA, 20 nt, Human
uugcacucaaaucuuaagaa

SEQ ID NO: 1957280 - RNA, 21 nt, Human
uugcacucaaaucuuaagaaa

SEQ ID NO: 1957281 - RNA, 22 nt, Human
uuggguucaagcgauucuucug

SEQ ID NO: 1957282 - RNA, 13 nt, Human
uugguaccuugca

SEQ ID NO: 1957283 - RNA, 14 nt, Human
uugguaccuugcac

SEQ ID NO: 1957284 - RNA, 16 nt, Human
uugguaccuugcacac

SEQ ID NO: 1957285 - RNA, 17 nt, Human
uugguaccuugcacaca

SEQ ID NO: 1957286 - RNA, 21 nt, Human
uugucugccccaaguuuugug

SEQ ID NO: 1957287 - RNA, 19 nt, Human
uugugaaacagacuuguau

SEQ ID NO: 1957288 - RNA, 19 nt, Human
uugugaaagaggucccaag

SEQ ID NO: 1957289 - RNA, 16 nt, Human
uugugaaaauaauuga

SEQ ID NO: 1957290 - RNA, 20 nt, Human
uugugaaaggaaagaggcuc

SEQ ID NO: 1957291 - RNA, 16 nt, Human
uugugauuuuuguaau

SEQ ID NO: 1957292 - RNA, 17 nt, Human
uugugauuuuuguaauu

SEQ ID NO: 1957293 - RNA, 12 nt, Human
uugugauuuuug

SEQ ID NO: 1957294 - RNA, 14 nt, Human
uugugaaaugaugg

SEQ ID NO: 1957295 - RNA, 15 nt, Human
uugucuuaaaaagug

SEQ ID NO: 1957296 - RNA, 21 nt, Human
uugucugaagucacugcacag

SEQ ID NO: 1957297 - RNA, 17 nt, Human
uugucugccccaaguuu

SEQ ID NO: 1957298 - RNA, 18 nt, Human
uugucugccccaaguuuu

SEQ ID NO: 1957299 - RNA, 20 nt, Human
uugucugccccaaguuuugu

SEQ ID NO: 1957300 - RNA, 20 nt, Human
uugucugaagucacugcaca

SEQ ID NO: 1957301 - RNA, 11 nt, Human
uugucucagau

SEQ ID NO: 1957302 - RNA, 19 nt, Human
uuguauucucuccuguacc

SEQ ID NO: 1957303 - RNA, 16 nt, Human
uugucuaagaaacauu

SEQ ID NO: 1957304 - RNA, 17 nt, Human
uugucuaagaaacauug

SEQ ID NO: 1957305 - RNA, 18 nt, Human
uugucuaagaaacauugg

SEQ ID NO: 1957306 - RNA, 20 nt, Human
uugucuaagaaacauuggaa

SEQ ID NO: 1957307 - RNA, 23 nt, Human
uugucuaagaaacauuggaagca

SEQ ID NO: 1957308 - RNA, 15 nt, Human
uuguauucucuccug

SEQ ID NO: 1957309 - RNA, 16 nt, Human
uuguauucucuccugu

SEQ ID NO: 1957310 - RNA, 21 nt, Human
uuguauucagaguugaugguu

SEQ ID NO: 1957311 - RNA, 20 nt, Human
uuguauggggaggcaagugu

SEQ ID NO: 1957312 - RNA, 13 nt, Human
uuguacaugaaca

SEQ ID NO: 1957313 - RNA, 18 nt, Human
uuguacgacgucagaugu

SEQ ID NO: 1957314 - RNA, 21 nt, Human
uuguacgacgucagauguuua

SEQ ID NO: 1957315 - RNA, 13 nt, Human
uuuuuuuugacaa

SEQ ID NO: 1957316 - RNA, 13 nt, Human
uuuuuuuucccau

SEQ ID NO: 1957317 - RNA, 15 nt, Human
uuuugaccuuugaua

SEQ ID NO: 1957318 - RNA, 21 nt, Human
uuuugaagauucuauguuaau

SEQ ID NO: 1957319 - RNA, 17 nt, Human
uuuugaacucuucucau

SEQ ID NO: 1957320 - RNA, 18 nt, Human
uuuugaagugagaaaaug

SEQ ID NO: 1957321 - RNA, 19 nt, Human
uuuugaagugagaaaauga

SEQ ID NO: 1957322 - RNA, 12 nt, Human
uuuuuaagaaaa

SEQ ID NO: 1957323 - RNA, 23 nt, Human
uuuuuaagaaaaaggaugcacag

SEQ ID NO: 1957324 - RNA, 16 nt, Human
uuuuuaagugcugcau

SEQ ID NO: 1957325 - RNA, 17 nt, Human
uuuuuaagugcugcauu

SEQ ID NO: 1957326 - RNA, 18 nt, Human
uuuuuaagugcugcauuu

SEQ ID NO: 1957327 - RNA, 19 nt, Human
uuuuuaagugcugcauuua

SEQ ID NO: 1957328 - RNA, 22 nt, Human
uuuuuaagugcugcauuuaaaa

SEQ ID NO: 1957329 - RNA, 23 nt, Human
uuuuuaagugcugcauuuaaaag

SEQ ID NO: 1957330 - RNA, 20 nt, Human
uuuuuaaugcuaaucuugug

SEQ ID NO: 1957331 - RNA, 22 nt, Human
uuuuuaaucuacugcauuuagg

SEQ ID NO: 1957332 - RNA, 21 nt, Human
uuuuuaaugcuaaucuuguga

SEQ ID NO: 1957333 - RNA, 13 nt, Human
uuuuuaaucuuua

SEQ ID NO: 1957334 - RNA, 17 nt, Human
uuuuuaaccucuguuca

SEQ ID NO: 1957335 - RNA, 16 nt, Human
uuuuuaagugaaauuu

SEQ ID NO: 1957336 - RNA, 13 nt, Human
uuuuucaguucaa

SEQ ID NO: 1957337 - RNA, 14 nt, Human
uuuuucaguucaaa

SEQ ID NO: 1957338 - RNA, 16 nt, Human
uuuuucaguucaaagu

SEQ ID NO: 1957339 - RNA, 12 nt, Human
uuuuucauauuu

SEQ ID NO: 1957340 - RNA, 13 nt, Human
uuuuuuacaaagg

SEQ ID NO: 1957341 - RNA, 18 nt, Human
uuuuuuaaucuacugcau

SEQ ID NO: 1957342 - RNA, 12 nt, Human
uuuuuuaaucua

SEQ ID NO: 1957343 - RNA, 15 nt, Human
uuuuucccauuuaga

SEQ ID NO: 1957344 - RNA, 16 nt, Human
uuuuucccauuuagaa

SEQ ID NO: 1957345 - RNA, 14 nt, Human
uuuuuuugaaacuu

SEQ ID NO: 1957346 - RNA, 12 nt, Human
uuuuuuuccuua

SEQ ID NO: 1957347 - RNA, 11 nt, Human
uuuuuuuccuu

SEQ ID NO: 1957348 - RNA, 12 nt, Human
uuuuuuuuaaga

SEQ ID NO: 1957349 - RNA, 14 nt, Human
uuuuuuuguacgac

SEQ ID NO: 1957350 - RNA, 13 nt, Human
uuuuuuccacuua

SEQ ID NO: 1957351 - RNA, 12 nt, Human
uuuuuuccuguu

SEQ ID NO: 1957352 - RNA, 13 nt, Human
uuuuuuguuuguu

SEQ ID NO: 1957353 - RNA, 11 nt, Human
uuuuuuuacua

SEQ ID NO: 1957354 - RNA, 20 nt, Human
uuuuuuccuuacauaaacau

SEQ ID NO: 1957355 - RNA, 14 nt, Human
uuuuuuccuuacau

SEQ ID NO: 1957356 - RNA, 12 nt, Human
uuuuuuuaagug

SEQ ID NO: 1957357 - RNA, 14 nt, Human
uuuuaaaauccacu

SEQ ID NO: 1957358 - RNA, 12 nt, Human
uuuuaaaauacu

SEQ ID NO: 1957359 - RNA, 19 nt, Human
uuuuaaaauacuguagaua

SEQ ID NO: 1957360 - RNA, 23 nt, Human
uuuuaaaauccacuuuaucuuga

SEQ ID NO: 1957361 - RNA, 13 nt, Human
uuuuaaaaucuua

SEQ ID NO: 1957362 - RNA, 12 nt, Human
uuuuaaaaucuu

SEQ ID NO: 1957363 - RNA, 20 nt, Human
uuuuaaacccuauugguaaa

SEQ ID NO: 1957364 - RNA, 22 nt, Human
uuuguuaguaugaggcauuugu

SEQ ID NO: 1957365 - RNA, 16 nt, Human
uuuguuacucuuggga

SEQ ID NO: 1957366 - RNA, 20 nt, Human
uuuguuaauuuggaccauuu

SEQ ID NO: 1957367 - RNA, 19 nt, Human
uuuguguguucacuaaacu

SEQ ID NO: 1957368 - RNA, 23 nt, Human
uuuguguguucacuaaacucuga

SEQ ID NO: 1957369 - RNA, 15 nt, Human
uuuguugucagcuga

SEQ ID NO: 1957370 - RNA, 20 nt, Human
uuuguugccagauuucagaa

SEQ ID NO: 1957371 - RNA, 23 nt, Human
uuuguugcacugaaguuugauaa

SEQ ID NO: 1957372 - RNA, 19 nt, Human
uuuguugccagauuucaga

SEQ ID NO: 1957373 - RNA, 16 nt, Human
uuuguugauucucucc

SEQ ID NO: 1957374 - RNA, 10 nt, Human
uuuguugcac

SEQ ID NO: 1957375 - RNA, 17 nt, Human
uuuguugcacugaaguu

SEQ ID NO: 1957376 - RNA, 18 nt, Human
uuuguugcacugaaguuu

SEQ ID NO: 1957377 - RNA, 21 nt, Human
uuuguugcacugaaguuugau

SEQ ID NO: 1957378 - RNA, 22 nt, Human
uuuguugcacugaaguuugaua

SEQ ID NO: 1957379 - RNA, 14 nt, Human
uuuguauuuuuagu

SEQ ID NO: 1957380 - RNA, 18 nt, Human
uuuguguguuacaaugua

SEQ ID NO: 1957381 - RNA, 20 nt, Human
uuuguguggagucauuucug

SEQ ID NO: 1957382 - RNA, 18 nt, Human
uuugugugcuaaacgugu

SEQ ID NO: 1957383 - RNA, 13 nt, Human
uuuguauuuauuc

SEQ ID NO: 1957384 - RNA, 16 nt, Human
uuuguauuuauucuuu

SEQ ID NO: 1957385 - RNA, 17 nt, Human
uuuguauucugucuuca

SEQ ID NO: 1957386 - RNA, 13 nt, Human
uuuguauuguccu

SEQ ID NO: 1957387 - RNA, 15 nt, Human
uuuguauuguccuau

SEQ ID NO: 1957388 - RNA, 22 nt, Human
uuuguauuguccuauuaguguu

SEQ ID NO: 1957389 - RNA, 12 nt, Human
uuuguauucugu

SEQ ID NO: 1957390 - RNA, 17 nt, Human
uuuggucuacacugugc

SEQ ID NO: 1957391 - RNA, 17 nt, Human
uuuggaccauuuuccug

SEQ ID NO: 1957392 - RNA, 15 nt, Human
uuuggucaacacuaa

SEQ ID NO: 1957393 - RNA, 20 nt, Human
uuuggucaguuggguuuuua

SEQ ID NO: 1957394 - RNA, 18 nt, Human
uuugguccacuuuuccag

SEQ ID NO: 1957395 - RNA, 19 nt, Human
uuugguccacuuuuccagu

SEQ ID NO: 1957396 - RNA, 18 nt, Human
uuugcauaacguauaaaa

SEQ ID NO: 1957397 - RNA, 19 nt, Human
uuuggacaaaauggaauac

SEQ ID NO: 1957398 - RNA, 15 nt, Human
uuuggaaaucucuuu

SEQ ID NO: 1957399 - RNA, 20 nt, Human
uuuggacacauuuaaggugu

SEQ ID NO: 1957400 - RNA, 13 nt, Human
uuuggacccugag

SEQ ID NO: 1957401 - RNA, 12 nt, Human
uuuggaaaauaa

SEQ ID NO: 1957402 - RNA, 16 nt, Human
uuugcauucuuauuca

SEQ ID NO: 1957403 - RNA, 18 nt, Human
uuugcauucuuauucauc

SEQ ID NO: 1957404 - RNA, 13 nt, Human
uuugcauuucaga

SEQ ID NO: 1957405 - RNA, 16 nt, Human
uuuggaaagacuggac

SEQ ID NO: 1957406 - RNA, 16 nt, Human
uuuggaaaguagaaaa

SEQ ID NO: 1957407 - RNA, 13 nt, Human
uuucccuuugcca

SEQ ID NO: 1957408 - RNA, 17 nt, Human
uuuccgccacaucccuc

SEQ ID NO: 1957409 - RNA, 18 nt, Human
uuucccuuuagcuguguu

SEQ ID NO: 1957410 - RNA, 19 nt, Human
uuucccuuuagcuguguua

SEQ ID NO: 1957411 - RNA, 21 nt, Human
uuucccuuuagcuguguuauu

SEQ ID NO: 1957412 - RNA, 15 nt, Human
uuuccguuaaaauac

SEQ ID NO: 1957413 - RNA, 17 nt, Human
uuuccguuaaaauacca

SEQ ID NO: 1957414 - RNA, 13 nt, Human
uuugagugccuua

SEQ ID NO: 1957415 - RNA, 14 nt, Human
uuuccaauauguga

SEQ ID NO: 1957416 - RNA, 15 nt, Human
uuuccaauaugugau

SEQ ID NO: 1957417 - RNA, 17 nt, Human
uuuccaauaugugauuu

SEQ ID NO: 1957418 - RNA, 14 nt, Human
uuuccaauucuccu

SEQ ID NO: 1957419 - RNA, 15 nt, Human
uuuccaauucuccuu

SEQ ID NO: 1957420 - RNA, 17 nt, Human
uuuccaauucuccuuua

SEQ ID NO: 1957421 - RNA, 16 nt, Human
uuugcacucaaaucuu

SEQ ID NO: 1957422 - RNA, 19 nt, Human
uuugcacucaaaucuuaag

SEQ ID NO: 1957423 - RNA, 21 nt, Human
uuugcacucaaaucuuaagaa

SEQ ID NO: 1957424 - RNA, 15 nt, Human
uuugcacucuuguuu

SEQ ID NO: 1957425 - RNA, 23 nt, Human
uuugcacucuuguuucucccgug

SEQ ID NO: 1957426 - RNA, 21 nt, Human
uuugagugccuuacacaaugg

SEQ ID NO: 1957427 - RNA, 23 nt, Human
uuuccguuugauuugucacugcu

SEQ ID NO: 1957428 - RNA, 15 nt, Human
uuuuauaccuguuua

SEQ ID NO: 1957429 - RNA, 16 nt, Human
uuuuauaccuguuuaa

SEQ ID NO: 1957430 - RNA, 17 nt, Human
uuuuauaccuguuuaaa

SEQ ID NO: 1957431 - RNA, 13 nt, Human
uuuuauacauaaa

SEQ ID NO: 1957432 - RNA, 21 nt, Human
uuuuauacauaaacaagacca

SEQ ID NO: 1957433 - RNA, 19 nt, Human
uuuuauagaaaaacaaauc

SEQ ID NO: 1957434 - RNA, 11 nt, Human
uuuuauauuuc

SEQ ID NO: 1957435 - RNA, 15 nt, Human
uuuuauauuucaagu

SEQ ID NO: 1957436 - RNA, 17 nt, Human
uuuucaaaauaaaaaug

SEQ ID NO: 1957437 - RNA, 17 nt, Human
uuuuauuuuuagaauuu

SEQ ID NO: 1957438 - RNA, 21 nt, Human
uuuuauuuuucucaugaugag

SEQ ID NO: 1957439 - RNA, 18 nt, Human
uuuuauuuuuagacagag

SEQ ID NO: 1957440 - RNA, 19 nt, Human
uuuuaucgucacugcuuaa

SEQ ID NO: 1957441 - RNA, 18 nt, Human
uuuuauauuucaaguaca

SEQ ID NO: 1957442 - RNA, 14 nt, Human
uuuuaugaagaaaa

SEQ ID NO: 1957443 - RNA, 15 nt, Human
uuuuacuaauagaca

SEQ ID NO: 1957444 - RNA, 19 nt, Human
uuuuacguccaucucuugu

SEQ ID NO: 1957445 - RNA, 19 nt, Human
uuuuacccuauaucuauaa

SEQ ID NO: 1957446 - RNA, 21 nt, Human
uuuuaaaguaacccuacaaaa

SEQ ID NO: 1957447 - RNA, 19 nt, Human
uuuuacaaaaaagaaaaga

SEQ ID NO: 1957448 - RNA, 18 nt, Human
uuuuacaaaggcuguauu

SEQ ID NO: 1957449 - RNA, 17 nt, Human
uuuuacaauaaaaucuu

SEQ ID NO: 1957450 - RNA, 23 nt, Human
uuuuacaaaggcuguauucagca

SEQ ID NO: 1957451 - RNA, 15 nt, Human
uuuucuucacugucc

SEQ ID NO: 1957452 - RNA, 17 nt, Human
uuuucuuaaccaucuuu

SEQ ID NO: 1957453 - RNA, 13 nt, Human
uuuucuucucccu

SEQ ID NO: 1957454 - RNA, 22 nt, Human
uuuucuuguguguuuauuguca

SEQ ID NO: 1957455 - RNA, 13 nt, Human
uuuucuucaucaa

SEQ ID NO: 1957456 - RNA, 16 nt, Human
uuuucuuucagccaag

SEQ ID NO: 1957457 - RNA, 22 nt, Human
uuuucuuuacaaacaaaagcau

SEQ ID NO: 1957458 - RNA, 23 nt, Human
uuuucuacucgaguuacagacaa

SEQ ID NO: 1957459 - RNA, 22 nt, Human
uuuucuacucgaguuacagaca

SEQ ID NO: 1957460 - RNA, 20 nt, Human
uuuucuacucgaguuacaga

SEQ ID NO: 1957461 - RNA, 13 nt, Human
uuuucuacucgag

SEQ ID NO: 1957462 - RNA, 16 nt, Human
uuuucccucagaaaau

SEQ ID NO: 1957463 - RNA, 15 nt, Human
uuuucccugaaguua

SEQ ID NO: 1957464 - RNA, 21 nt, Human
uuuucccugaaguuaugugua

SEQ ID NO: 1957465 - RNA, 18 nt, Human
uuuuccgcauucuuugua

SEQ ID NO: 1957466 - RNA, 22 nt, Human
uuuucccugaaguuauguguau

SEQ ID NO: 1957467 - RNA, 15 nt, Human
uuuucccaggaaaga

SEQ ID NO: 1957468 - RNA, 22 nt, Human
uuuucccuauuagagaagagau

SEQ ID NO: 1957469 - RNA, 18 nt, Human
uuuucccuauuagagaag

SEQ ID NO: 1957470 - RNA, 17 nt, Human
uuuucacccuucuacuc

SEQ ID NO: 1957471 - RNA, 16 nt, Human
uuuucacauuggaaac

SEQ ID NO: 1957472 - RNA, 23 nt, Human
uuuucaccauucguacauaauac

SEQ ID NO: 1957473 - RNA, 21 nt, Human
uuuucaaaauuguuacaaauu

SEQ ID NO: 1957474 - RNA, 18 nt, Human
uuuucaaauggaguugga

SEQ ID NO: 1957475 - RNA, 15 nt, Human
uuuucaaauguucuc

SEQ ID NO: 1957476 - RNA, 17 nt, Human
uuuucaaccucuagaau

SEQ ID NO: 1957477 - RNA, 15 nt, Human
uuuucacauccuuga

SEQ ID NO: 1957478 - RNA, 18 nt, Human
uuuucacauccuugacuu

SEQ ID NO: 1957479 - RNA, 12 nt, Human
ugcauuaucuag

SEQ ID NO: 1957480 - RNA, 17 nt, Human
ugcauuaucuagauacu

SEQ ID NO: 1957481 - RNA, 21 nt, Human
ugcauuauauuuguaaauuua

SEQ ID NO: 1957482 - RNA, 18 nt, Human
ugcauuaucuagauacug

SEQ ID NO: 1957483 - RNA, 14 nt, Human
ugcauuaaaagaaa

SEQ ID NO: 1957484 - RNA, 15 nt, Human
ugcauuaaaagaaaa

SEQ ID NO: 1957485 - RNA, 16 nt, Human
ugcauuaaaagaaaau

SEQ ID NO: 1957486 - RNA, 17 nt, Human
ugcauuaaaagaaaaua

SEQ ID NO: 1957487 - RNA, 19 nt, Human
ugcauuaaaagaaaauaaa

SEQ ID NO: 1957488 - RNA, 15 nt, Human
ugccaccacgcccgg

SEQ ID NO: 1957489 - RNA, 16 nt, Human
ugccacauuuucuuaa

SEQ ID NO: 1957490 - RNA, 14 nt, Human
ugcauccuccgccu

SEQ ID NO: 1957491 - RNA, 19 nt, Human
ugcagauaaacaguaguga

SEQ ID NO: 1957492 - RNA, 14 nt, Human
ugcagaguauuucu

SEQ ID NO: 1957493 - RNA, 19 nt, Human
ugcagaguauuucuaaagu

SEQ ID NO: 1957494 - RNA, 19 nt, Human
ugcagauacuacugaccag

SEQ ID NO: 1957495 - RNA, 23 nt, Human
ugcagauacuacugaccagacaa

SEQ ID NO: 1957496 - RNA, 14 nt, Human
ugcagaugccuggg

SEQ ID NO: 1957497 - RNA, 17 nt, Human
ugcaugguuuagaaagc

SEQ ID NO: 1957498 - RNA, 15 nt, Human
ugcauccuccgccuc

SEQ ID NO: 1957499 - RNA, 12 nt, Human
ugcauguaauca

SEQ ID NO: 1957500 - RNA, 13 nt, Human
ugcauguaaucaa

SEQ ID NO: 1957501 - RNA, 21 nt, Human
ugcauguaaucaacauggcua

SEQ ID NO: 1957502 - RNA, 15 nt, Human
ugcauguacuaucuu

SEQ ID NO: 1957503 - RNA, 16 nt, Human
ugcauguacuaucuua

SEQ ID NO: 1957504 - RNA, 15 nt, Human
ugcauguuugugauu

SEQ ID NO: 1957505 - RNA, 20 nt, Human
ugccaugaggaacaaggcaa

SEQ ID NO: 1957506 - RNA, 23 nt, Human
ugccaugaggaacaaggcaaggc

SEQ ID NO: 1957507 - RNA, 14 nt, Human
ugccaugugccagg

SEQ ID NO: 1957508 - RNA, 20 nt, Human
ugccaugucagcgcucuggu

SEQ ID NO: 1957509 - RNA, 18 nt, Human
ugccaugucagcgcucug

SEQ ID NO: 1957510 - RNA, 15 nt, Human
ugccaugugccaggu

SEQ ID NO: 1957511 - RNA, 20 nt, Human
ugccaugugcuucugccacc

SEQ ID NO: 1957512 - RNA, 13 nt, Human
ugcccacucccug

SEQ ID NO: 1957513 - RNA, 14 nt, Human
ugcccacuccugcu

SEQ ID NO: 1957514 - RNA, 18 nt, Human
ugcccacuccugcucugc

SEQ ID NO: 1957515 - RNA, 19 nt, Human
ugcccacuccugcucugcu

SEQ ID NO: 1957516 - RNA, 20 nt, Human
ugcccacuccugcucugcuc

SEQ ID NO: 1957517 - RNA, 19 nt, Human
ugcccaccuggccucugca

SEQ ID NO: 1957518 - RNA, 18 nt, Human
ugcccacgcuggagugca

SEQ ID NO: 1957519 - RNA, 12 nt, Human
ugccauguuggc

SEQ ID NO: 1957520 - RNA, 15 nt, Human
ugccauguuggccag

SEQ ID NO: 1957521 - RNA, 20 nt, Human
ugcccaccuggccucugcac

SEQ ID NO: 1957522 - RNA, 16 nt, Human
ugccauguuggccagg

SEQ ID NO: 1957523 - RNA, 17 nt, Human
ugccagguuuuuggucu

SEQ ID NO: 1957524 - RNA, 22 nt, Human
ugccaggugaaggaggcuccag

SEQ ID NO: 1957525 - RNA, 18 nt, Human
ugccaggucccuuucauu

SEQ ID NO: 1957526 - RNA, 22 nt, Human
ugccaggucccuuucauuugcu

SEQ ID NO: 1957527 - RNA, 15 nt, Human
ugccauccagguuca

SEQ ID NO: 1957528 - RNA, 22 nt, Human
ugccaucauguuuacagaggac

SEQ ID NO: 1957529 - RNA, 12 nt, Human
ugccauccaggu

SEQ ID NO: 1957530 - RNA, 19 nt, Human
ugccaggaagccagcaggc

SEQ ID NO: 1957531 - RNA, 18 nt, Human
ugccaggaagccagcagg

SEQ ID NO: 1957532 - RNA, 16 nt, Human
ugccaggaagccagca

SEQ ID NO: 1957533 - RNA, 12 nt, Human
ugccaggaagcc

SEQ ID NO: 1957534 - RNA, 17 nt, Human
ugcccagaaugaggcug

SEQ ID NO: 1957535 - RNA, 18 nt, Human
ugcccagaaugaggcugc

SEQ ID NO: 1957536 - RNA, 14 nt, Human
ugcccagaauacug

SEQ ID NO: 1957537 - RNA, 19 nt, Human
ugcccagaaugaggcugcu

SEQ ID NO: 1957538 - RNA, 19 nt, Human
ugcccagaauacugaugga

SEQ ID NO: 1957539 - RNA, 16 nt, Human
ugcccagaauacugau

SEQ ID NO: 1957540 - RNA, 18 nt, Human
ugcccagaauacugaugg

SEQ ID NO: 1957541 - RNA, 18 nt, Human
ugcccggggaaaggcaag

SEQ ID NO: 1957542 - RNA, 21 nt, Human
ugcccggggaaaggcaagguc

SEQ ID NO: 1957543 - RNA, 23 nt, Human
ugcccugcccaccuggccucugc

SEQ ID NO: 1957544 - RNA, 22 nt, Human
ugcccugcccaccuggccucug

SEQ ID NO: 1957545 - RNA, 17 nt, Human
ugcccuaaaguguauuu

SEQ ID NO: 1957546 - RNA, 19 nt, Human
ugcccuaaaguguauuuuu

SEQ ID NO: 1957547 - RNA, 21 nt, Human
ugcccugcccaccuggccucu

SEQ ID NO: 1957548 - RNA, 19 nt, Human
ugcccugcgggucacagga

SEQ ID NO: 1957549 - RNA, 18 nt, Human
ugcccugcugagucccag

SEQ ID NO: 1957550 - RNA, 22 nt, Human
ugcccugcugagucccaggcug

SEQ ID NO: 1957551 - RNA, 23 nt, Human
ugcccugcugagucccaggcuga

SEQ ID NO: 1957552 - RNA, 19 nt, Human
ugccgucuaccugaggggc

SEQ ID NO: 1957553 - RNA, 17 nt, Human
ugccgucuaccugaggg

SEQ ID NO: 1957554 - RNA, 21 nt, Human
ugccggucuugacagcucagu

SEQ ID NO: 1957555 - RNA, 16 nt, Human
ugccgucuaccugagg

SEQ ID NO: 1957556 - RNA, 15 nt, Human
ugccgucuaccugag

SEQ ID NO: 1957557 - RNA, 15 nt, Human
ugcccugguuuccug

SEQ ID NO: 1957558 - RNA, 20 nt, Human
ugcccuggugcugccacacu

SEQ ID NO: 1957559 - RNA, 18 nt, Human
ugcccuggugcugccaca

SEQ ID NO: 1957560 - RNA, 21 nt, Human
ugcccuggugcugccacacuu

SEQ ID NO: 1957561 - RNA, 18 nt, Human
ugcccuggauccaucagg

SEQ ID NO: 1957562 - RNA, 14 nt, Human
ugcccugcuguuua

SEQ ID NO: 1957563 - RNA, 13 nt, Human
ugcccugcuguuu

SEQ ID NO: 1957564 - RNA, 21 nt, Human
ugccucuucucuacucuaggg

SEQ ID NO: 1957565 - RNA, 13 nt, Human
ugccucuuccucc

SEQ ID NO: 1957566 - RNA, 21 nt, Human
ugccucuggcucuacacauau

SEQ ID NO: 1957567 - RNA, 13 nt, Human
ugccugcccaggc

SEQ ID NO: 1957568 - RNA, 17 nt, Human
ugccugguggcagcugc

SEQ ID NO: 1957569 - RNA, 18 nt, Human
ugccugguggcagcugcg

SEQ ID NO: 1957570 - RNA, 17 nt, Human
ugccugguccucacacu

SEQ ID NO: 1957571 - RNA, 19 nt, Human
ugccugguggcagcugcgg

SEQ ID NO: 1957572 - RNA, 13 nt, Human
ugccucugggacu

SEQ ID NO: 1957573 - RNA, 20 nt, Human
ugccucuggcucuacacaua

SEQ ID NO: 1957574 - RNA, 18 nt, Human
ugccucugccugucuccc

SEQ ID NO: 1957575 - RNA, 13 nt, Human
ugccucugccugu

SEQ ID NO: 1957576 - RNA, 14 nt, Human
ugccucugccuguc

SEQ ID NO: 1957577 - RNA, 20 nt, Human
ugccuccuuugugaggaagc

SEQ ID NO: 1957578 - RNA, 21 nt, Human
ugccuccuuugugaggaagcc

SEQ ID NO: 1957579 - RNA, 22 nt, Human
ugccuccuuugugaggaagccg

SEQ ID NO: 1957580 - RNA, 22 nt, Human
ugccuccgcgugaucaaagcca

SEQ ID NO: 1957581 - RNA, 22 nt, Human
ugcaacucugaaggguaauuau

SEQ ID NO: 1957582 - RNA, 22 nt, Human
ugcaaccugauugugucucuug

SEQ ID NO: 1957583 - RNA, 18 nt, Human
ugcaaccuucgccaccug

SEQ ID NO: 1957584 - RNA, 21 nt, Human
ugcaaccuucgccaccugggu

SEQ ID NO: 1957585 - RNA, 18 nt, Human
ugcaacuuuguauaaaag

SEQ ID NO: 1957586 - RNA, 18 nt, Human
ugcaacuuguaaaugugg

SEQ ID NO: 1957587 - RNA, 16 nt, Human
ugcaacuuguaaaugu

SEQ ID NO: 1957588 - RNA, 20 nt, Human
ugcaaccugauugugucucu

SEQ ID NO: 1957589 - RNA, 19 nt, Human
ugcaaccugauugugucuc

SEQ ID NO: 1957590 - RNA, 18 nt, Human
ugcaaccuccgccucuug

SEQ ID NO: 1957591 - RNA, 20 nt, Human
ugcaaccuccgccucuuggg

SEQ ID NO: 1957592 - RNA, 21 nt, Human
ugcaaccuccgccucuugggu

SEQ ID NO: 1957593 - RNA, 16 nt, Human
ugcaaccauuugaaac

SEQ ID NO: 1957594 - RNA, 13 nt, Human
ugcaaccuccgcc

SEQ ID NO: 1957595 - RNA, 14 nt, Human
ugcaaccuccgccu

SEQ ID NO: 1957596 - RNA, 19 nt, Human
ugcaacaggcugggcuuca

SEQ ID NO: 1957597 - RNA, 20 nt, Human
ugcaacaggcugggcuucag

SEQ ID NO: 1957598 - RNA, 13 nt, Human
ugcaaacauugga

SEQ ID NO: 1957599 - RNA, 20 nt, Human
ugcaaccaaacucccaucag

SEQ ID NO: 1957600 - RNA, 14 nt, Human
ugcaacaggcuggg

SEQ ID NO: 1957601 - RNA, 15 nt, Human
ugcaacaggcugggc

SEQ ID NO: 1957602 - RNA, 16 nt, Human
ugcaacaggcugggcu

SEQ ID NO: 1957603 - RNA, 17 nt, Human
ugcaacaggcugggcuu

SEQ ID NO: 1957604 - RNA, 23 nt, Human
ugcaaaauacaugaugauuucag

SEQ ID NO: 1957605 - RNA, 14 nt, Human
ugcaaaauuccuga

SEQ ID NO: 1957606 - RNA, 16 nt, Human
ugcaaacauuggaaga

SEQ ID NO: 1957607 - RNA, 12 nt, Human
ugaugugacauu

SEQ ID NO: 1957608 - RNA, 13 nt, Human
ugaugugacauuu

SEQ ID NO: 1957609 - RNA, 19 nt, Human
ugaugugcucaucagaaac

SEQ ID NO: 1957610 - RNA, 18 nt, Human
ugaugugcucaucagaaa

SEQ ID NO: 1957611 - RNA, 20 nt, Human
ugaugugccuaaauaaguua

SEQ ID NO: 1957612 - RNA, 16 nt, Human
ugaugugccugcuuca

SEQ ID NO: 1957613 - RNA, 14 nt, Human
ugaugugacauuug

SEQ ID NO: 1957614 - RNA, 15 nt, Human
ugaugugacauuugu

SEQ ID NO: 1957615 - RNA, 16 nt, Human
ugaugugacauuuguc

SEQ ID NO: 1957616 - RNA, 18 nt, Human
ugaugugacauuugucau

SEQ ID NO: 1957617 - RNA, 13 nt, Human
ugauuuuaaaugu

SEQ ID NO: 1957618 - RNA, 15 nt, Human
ugauuuuaaaugugu

SEQ ID NO: 1957619 - RNA, 17 nt, Human
ugauuuuaaauguguga

SEQ ID NO: 1957620 - RNA, 13 nt, Human
ugauuuucauugc

SEQ ID NO: 1957621 - RNA, 12 nt, Human
ugauuuuauucu

SEQ ID NO: 1957622 - RNA, 13 nt, Human
ugauuuuauucuu

SEQ ID NO: 1957623 - RNA, 14 nt, Human
ugauuuuauucuug

SEQ ID NO: 1957624 - RNA, 15 nt, Human
ugauuuuauucuuga

SEQ ID NO: 1957625 - RNA, 15 nt, Human
ugauuuucauugcug

SEQ ID NO: 1957626 - RNA, 16 nt, Human
ugauuuuauucuugau

SEQ ID NO: 1957627 - RNA, 17 nt, Human
ugauuuuccaucuaaaa

SEQ ID NO: 1957628 - RNA, 19 nt, Human
ugauuuuccaucuaaaaau

SEQ ID NO: 1957629 - RNA, 22 nt, Human
ugauuuuccaucuaaaaauaua

SEQ ID NO: 1957630 - RNA, 20 nt, Human
ugauuuuuuuuuccuucagu

SEQ ID NO: 1957631 - RNA, 19 nt, Human
ugauuuuuuuuuccuucag

SEQ ID NO: 1957632 - RNA, 17 nt, Human
ugauuuuuuuuuccuuc

SEQ ID NO: 1957633 - RNA, 16 nt, Human
ugauuuuuuuuuccuu

SEQ ID NO: 1957634 - RNA, 22 nt, Human
ugauuuuuuuucccauuuagaa

SEQ ID NO: 1957635 - RNA, 23 nt, Human
ugauuuuuuuucccauuuagaau

SEQ ID NO: 1957636 - RNA, 23 nt, Human
ugauuuuugagcccuuguuucag

SEQ ID NO: 1957637 - RNA, 21 nt, Human
ugauuuuugagcccuuguuuc

SEQ ID NO: 1957638 - RNA, 18 nt, Human
ugcaaaaagcuucugugg

SEQ ID NO: 1957639 - RNA, 21 nt, Human
ugcaaaaagcuagucaacagu

SEQ ID NO: 1957640 - RNA, 16 nt, Human
ugcaaaaagcuucugu

SEQ ID NO: 1957641 - RNA, 21 nt, Human
ugcaaaaaaucuuaauacugu

SEQ ID NO: 1957642 - RNA, 14 nt, Human
ugcaaaaaaucuua

SEQ ID NO: 1957643 - RNA, 16 nt, Human
ugcaaaaaaucuuaau

SEQ ID NO: 1957644 - RNA, 19 nt, Human
ugcaaaaaaucuuaauacu

SEQ ID NO: 1957645 - RNA, 17 nt, Human
ugcaaaaauccaaauau

SEQ ID NO: 1957646 - RNA, 18 nt, Human
ugcaaaaauccaaauauu

SEQ ID NO: 1957647 - RNA, 21 nt, Human
ugcaaaaauccaaauauuguu

SEQ ID NO: 1957648 - RNA, 22 nt, Human
ugcaaaaauccaaauauuguua

SEQ ID NO: 1957649 - RNA, 23 nt, Human
ugauuuuuuuuuccuucagugcc

SEQ ID NO: 1957650 - RNA, 22 nt, Human
ugauuuuuuuuuccuucagugc

SEQ ID NO: 1957651 - RNA, 16 nt, Human
ugauuuuuuuuuuuca

SEQ ID NO: 1957652 - RNA, 20 nt, Human
ugauuuuuuuuuuuaaucua

SEQ ID NO: 1957653 - RNA, 19 nt, Human
ugcacaaacagaggccgcc

SEQ ID NO: 1957654 - RNA, 17 nt, Human
ugcacaaacagaggccg

SEQ ID NO: 1957655 - RNA, 22 nt, Human
ugcaauuuuauaaggacuuccu

SEQ ID NO: 1957656 - RNA, 22 nt, Human
ugcaauuuuucuuucuuuuguu

SEQ ID NO: 1957657 - RNA, 20 nt, Human
ugcacaaacagaggccgcca

SEQ ID NO: 1957658 - RNA, 17 nt, Human
ugcacagaguuguuaca

SEQ ID NO: 1957659 - RNA, 15 nt, Human
ugcacaaagcccuuc

SEQ ID NO: 1957660 - RNA, 17 nt, Human
ugcacaaagcccuucca

SEQ ID NO: 1957661 - RNA, 18 nt, Human
ugcacagaguuguuacau

SEQ ID NO: 1957662 - RNA, 19 nt, Human
ugcacagaguuguuacauu

SEQ ID NO: 1957663 - RNA, 16 nt, Human
ugcacaaacagaggcc

SEQ ID NO: 1957664 - RNA, 15 nt, Human
ugcacaaacagaggc

SEQ ID NO: 1957665 - RNA, 16 nt, Human
ugcaaugacucaggac

SEQ ID NO: 1957666 - RNA, 22 nt, Human
ugcaauguagaggggaaaagag

SEQ ID NO: 1957667 - RNA, 13 nt, Human
ugcaauggcagcc

SEQ ID NO: 1957668 - RNA, 14 nt, Human
ugcaauggcagccu

SEQ ID NO: 1957669 - RNA, 15 nt, Human
ugcaauggcagccuu

SEQ ID NO: 1957670 - RNA, 16 nt, Human
ugcaauggcagccuug

SEQ ID NO: 1957671 - RNA, 23 nt, Human
ugcaaugaccuuucaauaggaaa

SEQ ID NO: 1957672 - RNA, 22 nt, Human
ugcaaugaccuuucaauaggaa

SEQ ID NO: 1957673 - RNA, 19 nt, Human
ugcaaugaccuuucaauag

SEQ ID NO: 1957674 - RNA, 17 nt, Human
ugcaaugaccuuucaau

SEQ ID NO: 1957675 - RNA, 16 nt, Human
ugcaaugaccuuucaa

SEQ ID NO: 1957676 - RNA, 13 nt, Human
ugcaaugaccuuu

SEQ ID NO: 1957677 - RNA, 16 nt, Human
ugcacugaaguuugau

SEQ ID NO: 1957678 - RNA, 19 nt, Human
ugcacugaaguuugauaaa

SEQ ID NO: 1957679 - RNA, 24 nt, Human
ugcacugaaguuugauaaauagug

SEQ ID NO: 1957680 - RNA, 23 nt, Human
ugcacucuuguuucucccgugcu

SEQ ID NO: 1957681 - RNA, 10 nt, Human
ugcacugaag

SEQ ID NO: 1957682 - RNA, 13 nt, Human
ugcacugaaguuu

SEQ ID NO: 1957683 - RNA, 12 nt, Human
ugcacucuucua

SEQ ID NO: 1957684 - RNA, 16 nt, Human
ugcacucucuuggcug

SEQ ID NO: 1957685 - RNA, 18 nt, Human
ugcacugacauuguuggc

SEQ ID NO: 1957686 - RNA, 21 nt, Human
ugcacugacauuguuggccaa

SEQ ID NO: 1957687 - RNA, 19 nt, Human
ugcagagguccacaacaca

SEQ ID NO: 1957688 - RNA, 20 nt, Human
ugcaccggcuggccuggccc

SEQ ID NO: 1957689 - RNA, 19 nt, Human
ugcaccggcuggccuggcc

SEQ ID NO: 1957690 - RNA, 18 nt, Human
ugcaccggcuggccuggc

SEQ ID NO: 1957691 - RNA, 16 nt, Human
ugcacagugcaucuca

SEQ ID NO: 1957692 - RNA, 17 nt, Human
ugcacagugcaucucag

SEQ ID NO: 1957693 - RNA, 21 nt, Human
ugcacaaauacggauccugca

SEQ ID NO: 1957694 - RNA, 20 nt, Human
ugcacagaguuguuacauuu

SEQ ID NO: 1957695 - RNA, 15 nt, Human
ugcacagugcaucuc

SEQ ID NO: 1957696 - RNA, 21 nt, Human
ugcaccggcuggccuggcccc

SEQ ID NO: 1957697 - RNA, 17 nt, Human
ugcaccuggaauauaua

SEQ ID NO: 1957698 - RNA, 20 nt, Human
ugcaccuggaauauauaacc

SEQ ID NO: 1957699 - RNA, 22 nt, Human
ugcaccuggaauauauaaccag

SEQ ID NO: 1957700 - RNA, 13 nt, Human
ugcaccugggaca

SEQ ID NO: 1957701 - RNA, 16 nt, Human
ugacgccaucccagcc

SEQ ID NO: 1957702 - RNA, 15 nt, Human
ugacgccaucccagc

SEQ ID NO: 1957703 - RNA, 14 nt, Human
ugacgccaucccag

SEQ ID NO: 1957704 - RNA, 13 nt, Human
ugacgccauccca

SEQ ID NO: 1957705 - RNA, 22 nt, Human
ugaccuuucaauaggaaaaacu

SEQ ID NO: 1957706 - RNA, 18 nt, Human
ugaccuuucaauaggaaa

SEQ ID NO: 1957707 - RNA, 20 nt, Human
ugacgccaucccagccccaa

SEQ ID NO: 1957708 - RNA, 19 nt, Human
ugacgccaucccagcccca

SEQ ID NO: 1957709 - RNA, 18 nt, Human
ugacgccaucccagcccc

SEQ ID NO: 1957710 - RNA, 17 nt, Human
ugacgccaucccagccc

SEQ ID NO: 1957711 - RNA, 12 nt, Human
ugacucugcucu

SEQ ID NO: 1957712 - RNA, 16 nt, Human
ugacucugcucuugca

SEQ ID NO: 1957713 - RNA, 13 nt, Human
ugacugaauuucu

SEQ ID NO: 1957714 - RNA, 22 nt, Human
ugacguacaaguaguucuguau

SEQ ID NO: 1957715 - RNA, 23 nt, Human
ugacguacaaguaguucuguauu

SEQ ID NO: 1957716 - RNA, 12 nt, Human
ugacgguuccua

SEQ ID NO: 1957717 - RNA, 18 nt, Human
ugacgguuccuacacagg

SEQ ID NO: 1957718 - RNA, 20 nt, Human
ugacgguuccuacacaggac

SEQ ID NO: 1957719 - RNA, 23 nt, Human
ugacgguuccuacacaggacagg

SEQ ID NO: 1957720 - RNA, 18 nt, Human
ugacguacaaguaguucu

SEQ ID NO: 1957721 - RNA, 19 nt, Human
ugacguacaaguaguucug

SEQ ID NO: 1957722 - RNA, 21 nt, Human
ugacguacaaguaguucugua

SEQ ID NO: 1957723 - RNA, 14 nt, Human
ugacugaauuucuu

SEQ ID NO: 1957724 - RNA, 15 nt, Human
ugacugaauuucuuu

SEQ ID NO: 1957725 - RNA, 19 nt, Human
ugacugaggcaguuugagg

SEQ ID NO: 1957726 - RNA, 13 nt, Human
ugacugaggcagu

SEQ ID NO: 1957727 - RNA, 18 nt, Human
ugacugaggcaguuugag

SEQ ID NO: 1957728 - RNA, 13 nt, Human
ugaccucugcagc

SEQ ID NO: 1957729 - RNA, 16 nt, Human
ugaccucugcagcaau

SEQ ID NO: 1957730 - RNA, 22 nt, Human
ugaccucaggugauccacccac

SEQ ID NO: 1957731 - RNA, 18 nt, Human
ugaccucaccuaggaagu

SEQ ID NO: 1957732 - RNA, 14 nt, Human
ugaccucacgugca

SEQ ID NO: 1957733 - RNA, 16 nt, Human
ugaccucacucagaag

SEQ ID NO: 1957734 - RNA, 16 nt, Human
ugaccuuucaauagga

SEQ ID NO: 1957735 - RNA, 15 nt, Human
ugaccuuucaauagg

SEQ ID NO: 1957736 - RNA, 14 nt, Human
ugaccuuucaauag

SEQ ID NO: 1957737 - RNA, 19 nt, Human
ugaccucuagcccugcccg

SEQ ID NO: 1957738 - RNA, 20 nt, Human
ugaccucuagcccugcccgg

SEQ ID NO: 1957739 - RNA, 18 nt, Human
ugaccucugcagcaauaa

SEQ ID NO: 1957740 - RNA, 21 nt, Human
ugaccucugcagcaauaaagc

SEQ ID NO: 1957741 - RNA, 23 nt, Human
ugaccucugcagcaauaaagcag

SEQ ID NO: 1957742 - RNA, 12 nt, Human
ugaccucugccu

SEQ ID NO: 1957743 - RNA, 22 nt, Human
ugaccauucuccaccugccagg

SEQ ID NO: 1957744 - RNA, 21 nt, Human
ugaccauucuccaccugccag

SEQ ID NO: 1957745 - RNA, 20 nt, Human
ugaccauucuccaccugcca

SEQ ID NO: 1957746 - RNA, 17 nt, Human
ucuugaauuguaaggaa

SEQ ID NO: 1957747 - RNA, 22 nt, Human
ucuugaauggcaauguuuugcu

SEQ ID NO: 1957748 - RNA, 23 nt, Human
ucuugaauggcaauguuuugcuu

SEQ ID NO: 1957749 - RNA, 16 nt, Human
ucuugaauaauguaag

SEQ ID NO: 1957750 - RNA, 16 nt, Human
ucuugaaccagaacca

SEQ ID NO: 1957751 - RNA, 15 nt, Human
ucuugaacuccuggc

SEQ ID NO: 1957752 - RNA, 22 nt, Human
ucuugaauguugaagaacucau

SEQ ID NO: 1957753 - RNA, 14 nt, Human
ugacccugcacccu

SEQ ID NO: 1957754 - RNA, 17 nt, Human
ugaccucaauuucaauu

SEQ ID NO: 1957755 - RNA, 23 nt, Human
ugaccucaauuucaauuuugucu

SEQ ID NO: 1957756 - RNA, 21 nt, Human
ugaccucaaaugaugugccug

SEQ ID NO: 1957757 - RNA, 14 nt, Human
ugagacagcucugc

SEQ ID NO: 1957758 - RNA, 16 nt, Human
ugagacagcucugcau

SEQ ID NO: 1957759 - RNA, 12 nt, Human
ugagacccuguc

SEQ ID NO: 1957760 - RNA, 13 nt, Human
ugagaaaucuaaa

SEQ ID NO: 1957761 - RNA, 17 nt, Human
ugagaaaucuaaaaaac

SEQ ID NO: 1957762 - RNA, 16 nt, Human
ugacuguacuccuccc

SEQ ID NO: 1957763 - RNA, 17 nt, Human
ugacuguacuccuccca

SEQ ID NO: 1957764 - RNA, 18 nt, Human
ugacuguacuccucccag

SEQ ID NO: 1957765 - RNA, 22 nt, Human
ugacuguacuccucccaggcgc

SEQ ID NO: 1957766 - RNA, 22 nt, Human
ugagaggcauccaguaucuuga

SEQ ID NO: 1957767 - RNA, 21 nt, Human
ugagacucuaggguccagugg

SEQ ID NO: 1957768 - RNA, 22 nt, Human
ugagacucuaggguccagugga

SEQ ID NO: 1957769 - RNA, 23 nt, Human
ugagaggcauccaguaucuugaa

SEQ ID NO: 1957770 - RNA, 12 nt, Human
ugagacucuguc

SEQ ID NO: 1957771 - RNA, 20 nt, Human
ugagaccgugaagauacuuu

SEQ ID NO: 1957772 - RNA, 23 nt, Human
ugagaccgugaagauacuuugua

SEQ ID NO: 1957773 - RNA, 13 nt, Human
ugagacucugucu

SEQ ID NO: 1957774 - RNA, 14 nt, Human
ugagacucugucuc

SEQ ID NO: 1957775 - RNA, 17 nt, Human
ugagaugagaggggaga

SEQ ID NO: 1957776 - RNA, 12 nt, Human
ugagaucuaaaa

SEQ ID NO: 1957777 - RNA, 15 nt, Human
ugagaucuaaaaaua

SEQ ID NO: 1957778 - RNA, 16 nt, Human
ugagaucuaaaaauaa

SEQ ID NO: 1957779 - RNA, 22 nt, Human
ugagaucuaaaaauaacuguaa

SEQ ID NO: 1957780 - RNA, 23 nt, Human
ugagaucuaaaaauaacuguaau

SEQ ID NO: 1957781 - RNA, 14 nt, Human
ugagaggggagagc

SEQ ID NO: 1957782 - RNA, 19 nt, Human
ugagaggggagagcugaac

SEQ ID NO: 1957783 - RNA, 21 nt, Human
ugagaggggagagcugaacag

SEQ ID NO: 1957784 - RNA, 17 nt, Human
ugagaggggaggccaag

SEQ ID NO: 1957785 - RNA, 17 nt, Human
ugagaguagagucacug

SEQ ID NO: 1957786 - RNA, 12 nt, Human
ugagaggggaag

SEQ ID NO: 1957787 - RNA, 16 nt, Human
ugagaggggaagcggc

SEQ ID NO: 1957788 - RNA, 13 nt, Human
ugagaggggagag

SEQ ID NO: 1957789 - RNA, 19 nt, Human
ugagaggggaacagacugg

SEQ ID NO: 1957790 - RNA, 15 nt, Human
ugagcaucaggccag

SEQ ID NO: 1957791 - RNA, 14 nt, Human
ugagcaucaggcca

SEQ ID NO: 1957792 - RNA, 12 nt, Human
ugagcccacugu

SEQ ID NO: 1957793 - RNA, 19 nt, Human
ugagcccacugugcguggg

SEQ ID NO: 1957794 - RNA, 13 nt, Human
ugagccccaaaag

SEQ ID NO: 1957795 - RNA, 21 nt, Human
ugagcccauguggagucagcc

SEQ ID NO: 1957796 - RNA, 22 nt, Human
ugagcccauguggagucagccu

SEQ ID NO: 1957797 - RNA, 13 nt, Human
ugagcaucaggcc

SEQ ID NO: 1957798 - RNA, 14 nt, Human
ugagaugcuagaac

SEQ ID NO: 1957799 - RNA, 16 nt, Human
ugagaugcuagaacuc

SEQ ID NO: 1957800 - RNA, 20 nt, Human
ugagaugcuagaacucccuu

SEQ ID NO: 1957801 - RNA, 13 nt, Human
ugagccucagcau

SEQ ID NO: 1957802 - RNA, 15 nt, Human
ugagccucagcaucc

SEQ ID NO: 1957803 - RNA, 13 nt, Human
ugagccuaaaaau

SEQ ID NO: 1957804 - RNA, 14 nt, Human
ugagccuaaaaaua

SEQ ID NO: 1957805 - RNA, 16 nt, Human
ugagccuaaaaauaaa

SEQ ID NO: 1957806 - RNA, 18 nt, Human
ugagccuaaaaauaaagc

SEQ ID NO: 1957807 - RNA, 20 nt, Human
ugagccuaaaaauaaagcac

SEQ ID NO: 1957808 - RNA, 20 nt, Human
ugagcucccacuucugccag

SEQ ID NO: 1957809 - RNA, 21 nt, Human
ugagcucccacuucugccaga

SEQ ID NO: 1957810 - RNA, 19 nt, Human
ugagcucccacuucugcca

SEQ ID NO: 1957811 - RNA, 15 nt, Human
ugauagcauaugaca

SEQ ID NO: 1957812 - RNA, 23 nt, Human
ugauagcauaugacaaauguuuc

SEQ ID NO: 1957813 - RNA, 17 nt, Human
ugauaaauuugacuguu

SEQ ID NO: 1957814 - RNA, 14 nt, Human
ugauagcauuguaa

SEQ ID NO: 1957815 - RNA, 16 nt, Human
ugauagcauuguaagc

SEQ ID NO: 1957816 - RNA, 21 nt, Human
ugauagccccucuccccgcag

SEQ ID NO: 1957817 - RNA, 23 nt, Human
ugauagcacagacccugcccugu

SEQ ID NO: 1957818 - RNA, 22 nt, Human
ugauagcacagacccugcccug

SEQ ID NO: 1957819 - RNA, 22 nt, Human
ugauagguuauuuugauguaaa

SEQ ID NO: 1957820 - RNA, 18 nt, Human
ugauagguauaaguggug

SEQ ID NO: 1957821 - RNA, 21 nt, Human
ugauagcacagacccugcccu

SEQ ID NO: 1957822 - RNA, 20 nt, Human
ugauagcacagacccugccc

SEQ ID NO: 1957823 - RNA, 18 nt, Human
ugauagcacagacccugc

SEQ ID NO: 1957824 - RNA, 17 nt, Human
ugauagcacagacccug

SEQ ID NO: 1957825 - RNA, 16 nt, Human
ugauagcacagacccu

SEQ ID NO: 1957826 - RNA, 15 nt, Human
ugauagcacagaccc

SEQ ID NO: 1957827 - RNA, 21 nt, Human
ugauaaauauucacacuugaa

SEQ ID NO: 1957828 - RNA, 17 nt, Human
ugauaaauaguguuauu

SEQ ID NO: 1957829 - RNA, 19 nt, Human
ugauaaauaguguuauuga

SEQ ID NO: 1957830 - RNA, 14 nt, Human
ugauaaauaguguu

SEQ ID NO: 1957831 - RNA, 23 nt, Human
ugaguugauagcacagacccugc

SEQ ID NO: 1957832 - RNA, 21 nt, Human
ugaguugauagcacagacccu

SEQ ID NO: 1957833 - RNA, 15 nt, Human
ugagucgaggacagg

SEQ ID NO: 1957834 - RNA, 16 nt, Human
ugagucgaggacaggg

SEQ ID NO: 1957835 - RNA, 19 nt, Human
ugaguugauucagcucugc

SEQ ID NO: 1957836 - RNA, 16 nt, Human
ugaguugauucagcuc

SEQ ID NO: 1957837 - RNA, 14 nt, Human
ugaguuggcuggga

SEQ ID NO: 1957838 - RNA, 16 nt, Human
ugaguuggcugggaau

SEQ ID NO: 1957839 - RNA, 18 nt, Human
ugagucgaggacagggag

SEQ ID NO: 1957840 - RNA, 17 nt, Human
ugaguuggcugggaaua

SEQ ID NO: 1957841 - RNA, 14 nt, Human
ugaggagaaugaaa

SEQ ID NO: 1957842 - RNA, 22 nt, Human
ugaguuguuaccccaagcgccc

SEQ ID NO: 1957843 - RNA, 14 nt, Human
ugaguuguuuuugu

SEQ ID NO: 1957844 - RNA, 15 nt, Human
ugaguuguuuuugua

SEQ ID NO: 1957845 - RNA, 16 nt, Human
ugaguuguuuuuguau

SEQ ID NO: 1957846 - RNA, 17 nt, Human
ugaguuguuuuuguaua

SEQ ID NO: 1957847 - RNA, 18 nt, Human
ugaguuguuuuuguauau

SEQ ID NO: 1957848 - RNA, 20 nt, Human
ugaguuguuuuuguauauug

SEQ ID NO: 1957849 - RNA, 12 nt, Human
ugauaaaaucau

SEQ ID NO: 1957850 - RNA, 13 nt, Human
ugauaaaaucaua

SEQ ID NO: 1957851 - RNA, 20 nt, Human
ugaggucuguucuuuccaaa

SEQ ID NO: 1957852 - RNA, 14 nt, Human
ugaggucuguucuu

SEQ ID NO: 1957853 - RNA, 15 nt, Human
ugaggucuguucuuu

SEQ ID NO: 1957854 - RNA, 16 nt, Human
ugaggcugcuuuccaa

SEQ ID NO: 1957855 - RNA, 20 nt, Human
ugaggcugcuuuccaaagcc

SEQ ID NO: 1957856 - RNA, 23 nt, Human
ugaggcugcuuuccaaagccaau

SEQ ID NO: 1957857 - RNA, 11 nt, Human
ugaggcugggc

SEQ ID NO: 1957858 - RNA, 23 nt, Human
ugaggacuuaaaauauuccugca

SEQ ID NO: 1957859 - RNA, 19 nt, Human
ugagguggaagagggcugc

SEQ ID NO: 1957860 - RNA, 15 nt, Human
ugaggugcuauguuc

SEQ ID NO: 1957861 - RNA, 16 nt, Human
ugaggugcuauguucu

SEQ ID NO: 1957862 - RNA, 21 nt, Human
ugaguccccuguuuguuucug

SEQ ID NO: 1957863 - RNA, 19 nt, Human
ugagguuucaaaccucccu

SEQ ID NO: 1957864 - RNA, 22 nt, Human
ugaguccuggcaugggaaugaa

SEQ ID NO: 1957865 - RNA, 19 nt, Human
ugaguccuggcaugggaau

SEQ ID NO: 1957866 - RNA, 14 nt, Human
ugagucgaggacag

SEQ ID NO: 1957867 - RNA, 23 nt, Human
ugaguccuccagaacucuuccuc

SEQ ID NO: 1957868 - RNA, 18 nt, Human
ugaguccuggcaugggaa

SEQ ID NO: 1957869 - RNA, 11 nt, Human
ugaguccuggc

SEQ ID NO: 1957870 - RNA, 12 nt, Human
ugaguccuccag

SEQ ID NO: 1957871 - RNA, 14 nt, Human
ugaguccuccagaa

SEQ ID NO: 1957872 - RNA, 15 nt, Human
ugaguccuccagaac

SEQ ID NO: 1957873 - RNA, 16 nt, Human
ugaguccuccagaacu

SEQ ID NO: 1957874 - RNA, 17 nt, Human
ugaguccuccagaacuc

SEQ ID NO: 1957875 - RNA, 22 nt, Human
ugaugaaaagcuuuguuuguuc

SEQ ID NO: 1957876 - RNA, 23 nt, Human
ugaugaaaagcuuuguuuguucu

SEQ ID NO: 1957877 - RNA, 14 nt, Human
ugaugaaaagcuuu

SEQ ID NO: 1957878 - RNA, 16 nt, Human
ugaugaaaagcuuugu

SEQ ID NO: 1957879 - RNA, 21 nt, Human
ugaucuuugcagacaggcaag

SEQ ID NO: 1957880 - RNA, 23 nt, Human
ugaucuuugcagacaggcaagca

SEQ ID NO: 1957881 - RNA, 21 nt, Human
ugaucugaugcaagcaagaaa

SEQ ID NO: 1957882 - RNA, 19 nt, Human
ugaucuuugcagacaggca

SEQ ID NO: 1957883 - RNA, 20 nt, Human
ugaucuuugcagacaggcaa

SEQ ID NO: 1957884 - RNA, 15 nt, Human
ugaugaaaauauuua

SEQ ID NO: 1957885 - RNA, 14 nt, Human
ugaugccaugagga

SEQ ID NO: 1957886 - RNA, 14 nt, Human
ugaugaaaauauuu

SEQ ID NO: 1957887 - RNA, 22 nt, Human
ugaugaucuuugcagacaggca

SEQ ID NO: 1957888 - RNA, 23 nt, Human
ugaugaucuuugcagacaggcaa

SEQ ID NO: 1957889 - RNA, 20 nt, Human
ugaugaugaaaugaggucag

SEQ ID NO: 1957890 - RNA, 21 nt, Human
ugaugguuguacauauaagug

SEQ ID NO: 1957891 - RNA, 18 nt, Human
ugaugguuuccaauuuca

SEQ ID NO: 1957892 - RNA, 13 nt, Human
ugauguacaugua

SEQ ID NO: 1957893 - RNA, 12 nt, Human
ugauguacugua

SEQ ID NO: 1957894 - RNA, 22 nt, Human
ugaugcuucuucagagacuccu

SEQ ID NO: 1957895 - RNA, 21 nt, Human
ugaugcuucuucagagacucc

SEQ ID NO: 1957896 - RNA, 19 nt, Human
ugaugcuucuucagagacu

SEQ ID NO: 1957897 - RNA, 18 nt, Human
ugaugcuggaacucuuga

SEQ ID NO: 1957898 - RNA, 22 nt, Human
ugaugcuggaacucuugacagc

SEQ ID NO: 1957899 - RNA, 22 nt, Human
ugaugcucuuucccacccagcc

SEQ ID NO: 1957900 - RNA, 15 nt, Human
ugaugcucuuuccca

SEQ ID NO: 1957901 - RNA, 19 nt, Human
ugaugcucuuucccaccca

SEQ ID NO: 1957902 - RNA, 19 nt, Human
ugaugcuaucaguuuuaua

SEQ ID NO: 1957903 - RNA, 20 nt, Human
ugaucugaugcaagcaagaa

SEQ ID NO: 1957904 - RNA, 21 nt, Human
ugaucuaggaagacuuuggaa

SEQ ID NO: 1957905 - RNA, 19 nt, Human
ugaucuaggaagacuuugg

SEQ ID NO: 1957906 - RNA, 21 nt, Human
ugauccacccaccucagccuc

SEQ ID NO: 1957907 - RNA, 22 nt, Human
ugauccacccaccucagccucc

SEQ ID NO: 1957908 - RNA, 13 nt, Human
ugaucauccacug

SEQ ID NO: 1957909 - RNA, 23 nt, Human
ugaucaguaguuugcauuucaga

SEQ ID NO: 1957910 - RNA, 21 nt, Human
ugaucaguaguuugcauuuca

SEQ ID NO: 1957911 - RNA, 22 nt, Human
ugaucaguaguuugcauuucag

SEQ ID NO: 1957912 - RNA, 24 nt, Human
ugaucauccacugugccaugugcc

SEQ ID NO: 1957913 - RNA, 17 nt, Human
ugauccaagcugguccc

SEQ ID NO: 1957914 - RNA, 21 nt, Human
ugauccaagcuggucccacuc

SEQ ID NO: 1957915 - RNA, 15 nt, Human
ugauccacccaccuc

SEQ ID NO: 1957916 - RNA, 16 nt, Human
ugauccacccaccuca

SEQ ID NO: 1957917 - RNA, 20 nt, Human
ugauccacccaccucagccu

SEQ ID NO: 1957918 - RNA, 17 nt, Human
ugauauauuuaaaaaca

SEQ ID NO: 1957919 - RNA, 15 nt, Human
ugauauaucucaaau

SEQ ID NO: 1957920 - RNA, 16 nt, Human
ugauauaucucaaauu

SEQ ID NO: 1957921 - RNA, 21 nt, Human
ugauauaucucaaauuguaau

SEQ ID NO: 1957922 - RNA, 13 nt, Human
ugauauaaacagc

SEQ ID NO: 1957923 - RNA, 15 nt, Human
ugauauaaacagcuu

SEQ ID NO: 1957924 - RNA, 24 nt, Human
ugauaguuguaccgcaaugugacu

SEQ ID NO: 1957925 - RNA, 23 nt, Human
ugauauaaguguguguuuuucau

SEQ ID NO: 1957926 - RNA, 17 nt, Human
ugauauaaguguguguu

SEQ ID NO: 1957927 - RNA, 22 nt, Human
ugaucacggcucacugcagccu

SEQ ID NO: 1957928 - RNA, 14 nt, Human
ugaucacugaaaua

SEQ ID NO: 1957929 - RNA, 16 nt, Human
ugaucacugaaauaaa

SEQ ID NO: 1957930 - RNA, 24 nt, Human
ugaucacuuucugaaauucacaaa

SEQ ID NO: 1957931 - RNA, 21 nt, Human
ugaucagaccaaacagugcug

SEQ ID NO: 1957932 - RNA, 19 nt, Human
uggaacagugcuacugaaa

SEQ ID NO: 1957933 - RNA, 12 nt, Human
uggaacagugcu

SEQ ID NO: 1957934 - RNA, 17 nt, Human
uggaacacucugagacu

SEQ ID NO: 1957935 - RNA, 15 nt, Human
uggaacacucugaga

SEQ ID NO: 1957936 - RNA, 19 nt, Human
uggaaaccugucugagguu

SEQ ID NO: 1957937 - RNA, 14 nt, Human
uggaaaaggcauau

SEQ ID NO: 1957938 - RNA, 13 nt, Human
ugcuucuucagag

SEQ ID NO: 1957939 - RNA, 18 nt, Human
ugcuugugaaaggaaaga

SEQ ID NO: 1957940 - RNA, 16 nt, Human
ugcuuguuaacugagu

SEQ ID NO: 1957941 - RNA, 14 nt, Human
ugcuuguuaacuga

SEQ ID NO: 1957942 - RNA, 22 nt, Human
ugcuuugaggcucaccagaauu

SEQ ID NO: 1957943 - RNA, 12 nt, Human
ugcuuugauaua

SEQ ID NO: 1957944 - RNA, 13 nt, Human
ugcuuugauauau

SEQ ID NO: 1957945 - RNA, 16 nt, Human
uggaaaagccaagagg

SEQ ID NO: 1957946 - RNA, 19 nt, Human
uggaaaagccaagaggcug

SEQ ID NO: 1957947 - RNA, 17 nt, Human
ugcuuuggaaaacccag

SEQ ID NO: 1957948 - RNA, 13 nt, Human
ugcuuuggaaauc

SEQ ID NO: 1957949 - RNA, 16 nt, Human
ugcuguuuugccagcc

SEQ ID NO: 1957950 - RNA, 12 nt, Human
ugcuuaaaugug

SEQ ID NO: 1957951 - RNA, 13 nt, Human
ugcuuaaauguga

SEQ ID NO: 1957952 - RNA, 14 nt, Human
ugcuuaaaugugaa

SEQ ID NO: 1957953 - RNA, 15 nt, Human
ugcuuaaaugugaau

SEQ ID NO: 1957954 - RNA, 16 nt, Human
ugcuuaaaugugaauu

SEQ ID NO: 1957955 - RNA, 17 nt, Human
ugcuuaaaugugaauua

SEQ ID NO: 1957956 - RNA, 20 nt, Human
ugcuuaaaugugaauuacua

SEQ ID NO: 1957957 - RNA, 23 nt, Human
ugcuuaaaugugaauuacuaacu

SEQ ID NO: 1957958 - RNA, 22 nt, Human
ugcuguuuugccagcccauuug

SEQ ID NO: 1957959 - RNA, 20 nt, Human
ugcuuaaccuuuuuauuuca

SEQ ID NO: 1957960 - RNA, 20 nt, Human
ugcuuaauuacaauauuucu

SEQ ID NO: 1957961 - RNA, 19 nt, Human
ugcuuaacuucacauauug

SEQ ID NO: 1957962 - RNA, 13 nt, Human
ugcuuaacuucac

SEQ ID NO: 1957963 - RNA, 14 nt, Human
ugcuuaacuucaca

SEQ ID NO: 1957964 - RNA, 17 nt, Human
ugcuuaacuucacauau

SEQ ID NO: 1957965 - RNA, 18 nt, Human
ugcuuaacuucacauauu

SEQ ID NO: 1957966 - RNA, 20 nt, Human
ugcuuaccuugguuggaagg

SEQ ID NO: 1957967 - RNA, 23 nt, Human
ugcuuccagugaggcucugcccu

SEQ ID NO: 1957968 - RNA, 22 nt, Human
ugcuuccagugaggcucugccc

SEQ ID NO: 1957969 - RNA, 13 nt, Human
ugcuuccuuucuu

SEQ ID NO: 1957970 - RNA, 18 nt, Human
ugcuuccuauaauuuuga

SEQ ID NO: 1957971 - RNA, 19 nt, Human
ugcuuccuauaauuuugau

SEQ ID NO: 1957972 - RNA, 21 nt, Human
uggacauuuggguugguucca

SEQ ID NO: 1957973 - RNA, 23 nt, Human
uggacguguuaugacuccagaau

SEQ ID NO: 1957974 - RNA, 19 nt, Human
uggacguguuaugacucca

SEQ ID NO: 1957975 - RNA, 20 nt, Human
uggacuaacuugucuuugga

SEQ ID NO: 1957976 - RNA, 19 nt, Human
uggacuaacuugucuuugg

SEQ ID NO: 1957977 - RNA, 18 nt, Human
uggacaggcauguucucu

SEQ ID NO: 1957978 - RNA, 22 nt, Human
uggacaggcauguucucugagg

SEQ ID NO: 1957979 - RNA, 18 nt, Human
uggacauuucuaauuccu

SEQ ID NO: 1957980 - RNA, 17 nt, Human
uggacaggcauguucuc

SEQ ID NO: 1957981 - RNA, 23 nt, Human
uggacaggcauguucucugagga

SEQ ID NO: 1957982 - RNA, 16 nt, Human
uggacauuuuaugucu

SEQ ID NO: 1957983 - RNA, 17 nt, Human
uggacauuuuaugucuu

SEQ ID NO: 1957984 - RNA, 11 nt, Human
uggacauuuua

SEQ ID NO: 1957985 - RNA, 13 nt, Human
uggacauuuuaug

SEQ ID NO: 1957986 - RNA, 15 nt, Human
uggagaggagcccug

SEQ ID NO: 1957987 - RNA, 16 nt, Human
uggagaggagcccugc

SEQ ID NO: 1957988 - RNA, 17 nt, Human
uggagaggagcccugcc

SEQ ID NO: 1957989 - RNA, 18 nt, Human
uggagaggagcccugccu

SEQ ID NO: 1957990 - RNA, 18 nt, Human
uggacucuggacuuucuc

SEQ ID NO: 1957991 - RNA, 23 nt, Human
uggaggggggaggugggauccuc

SEQ ID NO: 1957992 - RNA, 19 nt, Human
uggaucaaauccagccugc

SEQ ID NO: 1957993 - RNA, 18 nt, Human
uggauauauguuuuugaa

SEQ ID NO: 1957994 - RNA, 21 nt, Human
uggaugcagccucacaguccu

SEQ ID NO: 1957995 - RNA, 13 nt, Human
uggaugcagccuc

SEQ ID NO: 1957996 - RNA, 22 nt, Human
uggaugcagccucacaguccuu

SEQ ID NO: 1957997 - RNA, 21 nt, Human
uggcacuauaauguaagcucu

SEQ ID NO: 1957998 - RNA, 23 nt, Human
uggcaaggacgcuucacaggaca

SEQ ID NO: 1957999 - RNA, 17 nt, Human
uggauuuaacagaaaug

SEQ ID NO: 1958000 - RNA, 15 nt, Human
uggauuuaacagaaa

SEQ ID NO: 1958001 - RNA, 19 nt, Human
uggauugugccuaaugugu

SEQ ID NO: 1958002 - RNA, 20 nt, Human
uggauugugccuaauguguu

SEQ ID NO: 1958003 - RNA, 23 nt, Human
uggauugugccuaauguguuuga

SEQ ID NO: 1958004 - RNA, 22 nt, Human
uggcacugcuuccagugaggcu

SEQ ID NO: 1958005 - RNA, 22 nt, Human
uggcacuauaauguaagcucua

SEQ ID NO: 1958006 - RNA, 19 nt, Human
uggcacugcuuccagugag

SEQ ID NO: 1958007 - RNA, 13 nt, Human
ugggccugaguga

SEQ ID NO: 1958008 - RNA, 15 nt, Human
ugggcuucauccucc

SEQ ID NO: 1958009 - RNA, 22 nt, Human
ugggcuucauccuccucagauc

SEQ ID NO: 1958010 - RNA, 22 nt, Human
ugggcuucaguggcagcugcuu

SEQ ID NO: 1958011 - RNA, 21 nt, Human
ugggcuucaguggcagcugcu

SEQ ID NO: 1958012 - RNA, 22 nt, Human
ugggcuuggggaccagagcugc

SEQ ID NO: 1958013 - RNA, 21 nt, Human
ugggcuugucuguagauuuua

SEQ ID NO: 1958014 - RNA, 17 nt, Human
ugggcuugucuguagau

SEQ ID NO: 1958015 - RNA, 23 nt, Human
ugggcuuggggaccagagcugcc

SEQ ID NO: 1958016 - RNA, 13 nt, Human
uggggcagcuuga

SEQ ID NO: 1958017 - RNA, 18 nt, Human
uggggcacagggagaggc

SEQ ID NO: 1958018 - RNA, 18 nt, Human
uggggcagaaaucugagg

SEQ ID NO: 1958019 - RNA, 19 nt, Human
uggggcagaaaucugagga

SEQ ID NO: 1958020 - RNA, 16 nt, Human
uggggcagaggagaac

SEQ ID NO: 1958021 - RNA, 17 nt, Human
uggggcagaggagaacu

SEQ ID NO: 1958022 - RNA, 17 nt, Human
uggggccaggcuggguc

SEQ ID NO: 1958023 - RNA, 18 nt, Human
ugggggccccgucucagg

SEQ ID NO: 1958024 - RNA, 19 nt, Human
ugggggccccgucucaggu

SEQ ID NO: 1958025 - RNA, 16 nt, Human
ugggggccucagugcc

SEQ ID NO: 1958026 - RNA, 22 nt, Human
ugggggccccgucucaggucug

SEQ ID NO: 1958027 - RNA, 23 nt, Human
ugggggccccgucucaggucuga

SEQ ID NO: 1958028 - RNA, 17 nt, Human
uggggggcuucauacac

SEQ ID NO: 1958029 - RNA, 21 nt, Human
uggggggaacgcccacuuccc

SEQ ID NO: 1958030 - RNA, 19 nt, Human
uggggggcugaggugggag

SEQ ID NO: 1958031 - RNA, 13 nt, Human
uggggggaacgcc

SEQ ID NO: 1958032 - RNA, 19 nt, Human
uggggggaacgcccacuuc

SEQ ID NO: 1958033 - RNA, 20 nt, Human
uggggggaacgcccacuucc

SEQ ID NO: 1958034 - RNA, 13 nt, Human
ugggggggcagag

SEQ ID NO: 1958035 - RNA, 18 nt, Human
ugggccguagcuugucug

SEQ ID NO: 1958036 - RNA, 17 nt, Human
ugggcagagcagagacc

SEQ ID NO: 1958037 - RNA, 15 nt, Human
ugggcagagcagaga

SEQ ID NO: 1958038 - RNA, 14 nt, Human
ugggcagagcagag

SEQ ID NO: 1958039 - RNA, 14 nt, Human
ugggacagggagga

SEQ ID NO: 1958040 - RNA, 19 nt, Human
ugggacagggagcagcccc

SEQ ID NO: 1958041 - RNA, 16 nt, Human
ugggaggaucucuuga

SEQ ID NO: 1958042 - RNA, 15 nt, Human
ugggacacccuguga

SEQ ID NO: 1958043 - RNA, 14 nt, Human
ugggacacccugug

SEQ ID NO: 1958044 - RNA, 21 nt, Human
ugggaaugaaugucaguguga

SEQ ID NO: 1958045 - RNA, 16 nt, Human
ugggaaugaaugucag

SEQ ID NO: 1958046 - RNA, 18 nt, Human
ugggaugauuggaggggg

SEQ ID NO: 1958047 - RNA, 14 nt, Human
ugggaugauugaag

SEQ ID NO: 1958048 - RNA, 16 nt, Human
ugggaugauugaagaa

SEQ ID NO: 1958049 - RNA, 17 nt, Human
ugggaugauugaagaaa

SEQ ID NO: 1958050 - RNA, 18 nt, Human
ugggaugauugaagaaac

SEQ ID NO: 1958051 - RNA, 23 nt, Human
ugggaugauugaagaaacagcua

SEQ ID NO: 1958052 - RNA, 16 nt, Human
ugggauaggggcagag

SEQ ID NO: 1958053 - RNA, 14 nt, Human
ugggaaugaagcaa

SEQ ID NO: 1958054 - RNA, 18 nt, Human
uggcuuuucacugcuggc

SEQ ID NO: 1958055 - RNA, 19 nt, Human
uggcuuuucacugcuggcu

SEQ ID NO: 1958056 - RNA, 21 nt, Human
uggcuuuucacugcuggcugc

SEQ ID NO: 1958057 - RNA, 22 nt, Human
uggcuuuucacugcuggcugcc

SEQ ID NO: 1958058 - RNA, 16 nt, Human
uggcuuuucacugcug

SEQ ID NO: 1958059 - RNA, 13 nt, Human
uggcuuggcccug

SEQ ID NO: 1958060 - RNA, 16 nt, Human
uggcuuggcccuggca

SEQ ID NO: 1958061 - RNA, 19 nt, Human
uggcuuggcccuggcagcc

SEQ ID NO: 1958062 - RNA, 17 nt, Human
uggcugggacugggaac

SEQ ID NO: 1958063 - RNA, 18 nt, Human
uggcugggacugggaaca

SEQ ID NO: 1958064 - RNA, 22 nt, Human
uggcuuccuaaaauucagugga

SEQ ID NO: 1958065 - RNA, 22 nt, Human
uggcuucccgcucagcccuccc

SEQ ID NO: 1958066 - RNA, 20 nt, Human
uggcuugccauuuuucaaaa

SEQ ID NO: 1958067 - RNA, 23 nt, Human
uggcuuggauuaauauucauagu

SEQ ID NO: 1958068 - RNA, 18 nt, Human
uggcuucccgcucagccc

SEQ ID NO: 1958069 - RNA, 19 nt, Human
uggcuucccgcucagcccu

SEQ ID NO: 1958070 - RNA, 20 nt, Human
uggcuucccgcucagcccuc

SEQ ID NO: 1958071 - RNA, 21 nt, Human
uggcuucccgcucagcccucc

SEQ ID NO: 1958072 - RNA, 23 nt, Human
uggccuucggccuccauccugag

SEQ ID NO: 1958073 - RNA, 13 nt, Human
uggccucugcacu

SEQ ID NO: 1958074 - RNA, 18 nt, Human
uggccucugcaaaggaaa

SEQ ID NO: 1958075 - RNA, 17 nt, Human
uggcuccacacacacaa

SEQ ID NO: 1958076 - RNA, 22 nt, Human
uggccuucggccuccauccuga

SEQ ID NO: 1958077 - RNA, 20 nt, Human
uggccuucggccuccauccu

SEQ ID NO: 1958078 - RNA, 15 nt, Human
uggcuccaggccagg

SEQ ID NO: 1958079 - RNA, 13 nt, Human
uggcuccagccug

SEQ ID NO: 1958080 - RNA, 15 nt, Human
uggcuccagccugga

SEQ ID NO: 1958081 - RNA, 20 nt, Human
uggcuccauugguguugaca

SEQ ID NO: 1958082 - RNA, 18 nt, Human
uggcuccacacacacaaa

SEQ ID NO: 1958083 - RNA, 23 nt, Human
uggcuccacacacacaaaaaaag

SEQ ID NO: 1958084 - RNA, 17 nt, Human
uggcuccagcuggccgg

SEQ ID NO: 1958085 - RNA, 16 nt, Human
uggcugcugaaggcuc

SEQ ID NO: 1958086 - RNA, 14 nt, Human
uggcugcugaaggc

SEQ ID NO: 1958087 - RNA, 13 nt, Human
uggcugcugaagg

SEQ ID NO: 1958088 - RNA, 11 nt, Human
uggcugcugaa

SEQ ID NO: 1958089 - RNA, 14 nt, Human
uggcucccucacuc

SEQ ID NO: 1958090 - RNA, 16 nt, Human
uggcucccucacucuc

SEQ ID NO: 1958091 - RNA, 17 nt, Human
uggcucccucacucuca

SEQ ID NO: 1958092 - RNA, 18 nt, Human
uggcucccucacucucag

SEQ ID NO: 1958093 - RNA, 19 nt, Human
uggcucccucacucucagg

SEQ ID NO: 1958094 - RNA, 20 nt, Human
uggcucccucacucucagga

SEQ ID NO: 1958095 - RNA, 22 nt, Human
uggccccucagggucccuggug

SEQ ID NO: 1958096 - RNA, 21 nt, Human
uggccccucagggucccuggu

SEQ ID NO: 1958097 - RNA, 17 nt, Human
uggcccccacaugguga

SEQ ID NO: 1958098 - RNA, 14 nt, Human
uggccccugagauc

SEQ ID NO: 1958099 - RNA, 20 nt, Human
uggccuagcauacguacaca

SEQ ID NO: 1958100 - RNA, 20 nt, Human
uggccccucagggucccugg

SEQ ID NO: 1958101 - RNA, 13 nt, Human
uggccccucaggg

SEQ ID NO: 1958102 - RNA, 16 nt, Human
uggcagcugccacgcc

SEQ ID NO: 1958103 - RNA, 17 nt, Human
uggcagcugcgguccac

SEQ ID NO: 1958104 - RNA, 19 nt, Human
uggcagcugcgguccaccc

SEQ ID NO: 1958105 - RNA, 16 nt, Human
uggccucccugcucua

SEQ ID NO: 1958106 - RNA, 20 nt, Human
uggccucucacugccucccc

SEQ ID NO: 1958107 - RNA, 22 nt, Human
uggccucccaacucaccccagc

SEQ ID NO: 1958108 - RNA, 21 nt, Human
uggccucccaacucaccccag

SEQ ID NO: 1958109 - RNA, 20 nt, Human
uggccucccaacucacccca

SEQ ID NO: 1958110 - RNA, 19 nt, Human
uggccucccaacucacccc

SEQ ID NO: 1958111 - RNA, 18 nt, Human
uggccucaagugauucuc

SEQ ID NO: 1958112 - RNA, 23 nt, Human
uggccucaagugauucuccugcc

SEQ ID NO: 1958113 - RNA, 23 nt, Human
uggccuagcauacguacacauuu

SEQ ID NO: 1958114 - RNA, 14 nt, Human
uggccucccaacuc

SEQ ID NO: 1958115 - RNA, 11 nt, Human
uggccucccaa

SEQ ID NO: 1958116 - RNA, 14 nt, Human
ugucagugugacug

SEQ ID NO: 1958117 - RNA, 15 nt, Human
ugucagugugacuga

SEQ ID NO: 1958118 - RNA, 19 nt, Human
ugucagugugacugaucuc

SEQ ID NO: 1958119 - RNA, 16 nt, Human
ugucagugugacugau

SEQ ID NO: 1958120 - RNA, 17 nt, Human
ugucacagggacugaaa

SEQ ID NO: 1958121 - RNA, 13 nt, Human
ugucacaggcagg

SEQ ID NO: 1958122 - RNA, 18 nt, Human
ugucacaggguguucuuu

SEQ ID NO: 1958123 - RNA, 15 nt, Human
ugucacaggcagguc

SEQ ID NO: 1958124 - RNA, 16 nt, Human
ugucacaggcaggucc

SEQ ID NO: 1958125 - RNA, 17 nt, Human
ugucacaggcaggucca

SEQ ID NO: 1958126 - RNA, 21 nt, Human
ugucacaggcagguccagggu

SEQ ID NO: 1958127 - RNA, 15 nt, Human
uguauggccaggaag

SEQ ID NO: 1958128 - RNA, 13 nt, Human
uguauggggaggc

SEQ ID NO: 1958129 - RNA, 22 nt, Human
uguaugguccauagcacuguau

SEQ ID NO: 1958130 - RNA, 13 nt, Human
uguaugcuucaua

SEQ ID NO: 1958131 - RNA, 14 nt, Human
uguaugcuucauac

SEQ ID NO: 1958132 - RNA, 16 nt, Human
uguaugcuucauacag

SEQ ID NO: 1958133 - RNA, 19 nt, Human
uguaugcuucauacaggga

SEQ ID NO: 1958134 - RNA, 13 nt, Human
uguaugcgugugu

SEQ ID NO: 1958135 - RNA, 21 nt, Human
ugucaauuacaggaaguacug

SEQ ID NO: 1958136 - RNA, 13 nt, Human
ugucacacacuuu

SEQ ID NO: 1958137 - RNA, 14 nt, Human
ugucacaggcaggu

SEQ ID NO: 1958138 - RNA, 19 nt, Human
uguauuuuacuaauaaaau

SEQ ID NO: 1958139 - RNA, 12 nt, Human
uguauguauaau

SEQ ID NO: 1958140 - RNA, 13 nt, Human
uguaucugagcag

SEQ ID NO: 1958141 - RNA, 15 nt, Human
uguaucugaaaguca

SEQ ID NO: 1958142 - RNA, 12 nt, Human
uguaucugucuu

SEQ ID NO: 1958143 - RNA, 14 nt, Human
uguaucugucuuuc

SEQ ID NO: 1958144 - RNA, 15 nt, Human
uguaucugucuuucc

SEQ ID NO: 1958145 - RNA, 16 nt, Human
uguaucugucuuucca

SEQ ID NO: 1958146 - RNA, 19 nt, Human
uguaucugucuuuccacuc

SEQ ID NO: 1958147 - RNA, 20 nt, Human
uguaucugucuuuccacucu

SEQ ID NO: 1958148 - RNA, 22 nt, Human
uguaucugucuuuccacucugg

SEQ ID NO: 1958149 - RNA, 22 nt, Human
uguaugaaagauggcugugccu

SEQ ID NO: 1958150 - RNA, 13 nt, Human
uguaugaaaacau

SEQ ID NO: 1958151 - RNA, 19 nt, Human
uguaugaaaacauggaaca

SEQ ID NO: 1958152 - RNA, 23 nt, Human
uguauagccaaaugacugaaagc

SEQ ID NO: 1958153 - RNA, 18 nt, Human
uguauagcucuuuuccua

SEQ ID NO: 1958154 - RNA, 14 nt, Human
uguauaaggacagu

SEQ ID NO: 1958155 - RNA, 19 nt, Human
uguauaaaggugugcugug

SEQ ID NO: 1958156 - RNA, 14 nt, Human
uguauaaauuuauu

SEQ ID NO: 1958157 - RNA, 23 nt, Human
uguacagcaaggagauuuacaac

SEQ ID NO: 1958158 - RNA, 12 nt, Human
uguacagagccc

SEQ ID NO: 1958159 - RNA, 21 nt, Human
uguacagagcccacgccccca

SEQ ID NO: 1958160 - RNA, 22 nt, Human
uguacagcaaggagauuuacaa

SEQ ID NO: 1958161 - RNA, 21 nt, Human
uguacagagccguaaaaacug

SEQ ID NO: 1958162 - RNA, 22 nt, Human
uguacagagccguaaaaacuga

SEQ ID NO: 1958163 - RNA, 19 nt, Human
uguacagagugcuuuucug

SEQ ID NO: 1958164 - RNA, 21 nt, Human
ugucucaaaaaaagaaaaaga

SEQ ID NO: 1958165 - RNA, 17 nt, Human
ugucucaagagggcacu

SEQ ID NO: 1958166 - RNA, 18 nt, Human
ugucucaagagggcacug

SEQ ID NO: 1958167 - RNA, 23 nt, Human
ugucuaguuguuugauucagaca

SEQ ID NO: 1958168 - RNA, 15 nt, Human
ugucuaguuguuuga

SEQ ID NO: 1958169 - RNA, 15 nt, Human
ugucuagcacuuccu

SEQ ID NO: 1958170 - RNA, 16 nt, Human
ugucuagcacuuccuu

SEQ ID NO: 1958171 - RNA, 18 nt, Human
ugucuagcacuuccuugc

SEQ ID NO: 1958172 - RNA, 21 nt, Human
ugucuagcacuuccuugccag

SEQ ID NO: 1958173 - RNA, 14 nt, Human
ugucuaugggacuc

SEQ ID NO: 1958174 - RNA, 15 nt, Human
ugucuaugggacuca

SEQ ID NO: 1958175 - RNA, 16 nt, Human
ugucuaugggacucaa

SEQ ID NO: 1958176 - RNA, 23 nt, Human
ugucuuuggacccugaggcccag

SEQ ID NO: 1958177 - RNA, 16 nt, Human
ugucuuaauggaugaa

SEQ ID NO: 1958178 - RNA, 18 nt, Human
ugucuuaauggaugaaau

SEQ ID NO: 1958179 - RNA, 16 nt, Human
ugucuuuucuugcaug

SEQ ID NO: 1958180 - RNA, 16 nt, Human
ugucuguuguauucau

SEQ ID NO: 1958181 - RNA, 15 nt, Human
ugucugaguuuggua

SEQ ID NO: 1958182 - RNA, 20 nt, Human
ugucugaagucacugcacag

SEQ ID NO: 1958183 - RNA, 16 nt, Human
ugucugucugguccau

SEQ ID NO: 1958184 - RNA, 14 nt, Human
ugucuaaugaaacc

SEQ ID NO: 1958185 - RNA, 12 nt, Human
uguccugggagu

SEQ ID NO: 1958186 - RNA, 19 nt, Human
uguccugggagugagcugg

SEQ ID NO: 1958187 - RNA, 20 nt, Human
uguccugggagugagcuggu

SEQ ID NO: 1958188 - RNA, 22 nt, Human
uguccugccuaaggcugaacuu

SEQ ID NO: 1958189 - RNA, 19 nt, Human
uguccccgcacugggcuug

SEQ ID NO: 1958190 - RNA, 17 nt, Human
uguccccgcacugggcu

SEQ ID NO: 1958191 - RNA, 13 nt, Human
ugucaucucagcu

SEQ ID NO: 1958192 - RNA, 13 nt, Human
uguccccuauccu

SEQ ID NO: 1958193 - RNA, 14 nt, Human
ugucaucugagaau

SEQ ID NO: 1958194 - RNA, 13 nt, Human
ugucaucugagaa

SEQ ID NO: 1958195 - RNA, 16 nt, Human
uguccuauuaguguua

SEQ ID NO: 1958196 - RNA, 17 nt, Human
uguccuauuaguguuau

SEQ ID NO: 1958197 - RNA, 17 nt, Human
uguccuccaagccagcg

SEQ ID NO: 1958198 - RNA, 15 nt, Human
uguccuauuauauuc

SEQ ID NO: 1958199 - RNA, 15 nt, Human
ugguuccagccugcc

SEQ ID NO: 1958200 - RNA, 16 nt, Human
ugguuccagccugcca

SEQ ID NO: 1958201 - RNA, 17 nt, Human
ugguucauuuucagauu

SEQ ID NO: 1958202 - RNA, 19 nt, Human
uggugucgggcaugacacg

SEQ ID NO: 1958203 - RNA, 18 nt, Human
uggugucgggcaugacac

SEQ ID NO: 1958204 - RNA, 11 nt, Human
ugguuccccug

SEQ ID NO: 1958205 - RNA, 18 nt, Human
ugguuccccuguucacuc

SEQ ID NO: 1958206 - RNA, 19 nt, Human
ugguuccccuguucacucu

SEQ ID NO: 1958207 - RNA, 20 nt, Human
ugguuccccuguucacucua

SEQ ID NO: 1958208 - RNA, 20 nt, Human
ugguuccaagucuuugcuau

SEQ ID NO: 1958209 - RNA, 15 nt, Human
uggugucgggcauga

SEQ ID NO: 1958210 - RNA, 18 nt, Human
uggugucaguauccaggc

SEQ ID NO: 1958211 - RNA, 16 nt, Human
uggugucaccugaaga

SEQ ID NO: 1958212 - RNA, 14 nt, Human
ugguuccuggggca

SEQ ID NO: 1958213 - RNA, 18 nt, Human
ugguuccuggggcaucca

SEQ ID NO: 1958214 - RNA, 12 nt, Human
ugguuccucccc

SEQ ID NO: 1958215 - RNA, 18 nt, Human
ugguuccuccccuccucc

SEQ ID NO: 1958216 - RNA, 23 nt, Human
ugguuccuccccuccuccuggac

SEQ ID NO: 1958217 - RNA, 23 nt, Human
ugguuccccuguucacucuacuu

SEQ ID NO: 1958218 - RNA, 18 nt, Human
ugguugaugaucuuugca

SEQ ID NO: 1958219 - RNA, 16 nt, Human
ugguugagugggggga

SEQ ID NO: 1958220 - RNA, 12 nt, Human
ugguugaauaaa

SEQ ID NO: 1958221 - RNA, 12 nt, Human
ugguugaauaug

SEQ ID NO: 1958222 - RNA, 18 nt, Human
ugguugaauaaacuagau

SEQ ID NO: 1958223 - RNA, 20 nt, Human
uggugguugggacccagugg

SEQ ID NO: 1958224 - RNA, 23 nt, Human
uggugguugggacccaguggcag

SEQ ID NO: 1958225 - RNA, 18 nt, Human
ugguguaagguacuuuca

SEQ ID NO: 1958226 - RNA, 19 nt, Human
uggugguuuucuguucuuu

SEQ ID NO: 1958227 - RNA, 17 nt, Human
uggugguuucagaaaug

SEQ ID NO: 1958228 - RNA, 18 nt, Human
uggugguuucagaaaugu

SEQ ID NO: 1958229 - RNA, 17 nt, Human
ugguggggucuccucag

SEQ ID NO: 1958230 - RNA, 23 nt, Human
ugguggggucuccucaggaccag

SEQ ID NO: 1958231 - RNA, 17 nt, Human
uggugggcauucucucu

SEQ ID NO: 1958232 - RNA, 23 nt, Human
uggugggcuugucauagccagug

SEQ ID NO: 1958233 - RNA, 18 nt, Human
uggugggggccucggugu

SEQ ID NO: 1958234 - RNA, 16 nt, Human
uggugggggccucggu

SEQ ID NO: 1958235 - RNA, 13 nt, Human
ugguggcuggguu

SEQ ID NO: 1958236 - RNA, 21 nt, Human
ugguggcccgacagccuggca

SEQ ID NO: 1958237 - RNA, 20 nt, Human
uggugcaaugaccuuucaau

SEQ ID NO: 1958238 - RNA, 19 nt, Human
uggugcaaugaccuuucaa

SEQ ID NO: 1958239 - RNA, 14 nt, Human
uggugcaaugaccu

SEQ ID NO: 1958240 - RNA, 15 nt, Human
uggugauuuuaaaug

SEQ ID NO: 1958241 - RNA, 16 nt, Human
uggugauuuuaaaugu

SEQ ID NO: 1958242 - RNA, 18 nt, Human
uggugauuuuaaaugugu

SEQ ID NO: 1958243 - RNA, 19 nt, Human
uggugauuuuaaaugugug

SEQ ID NO: 1958244 - RNA, 20 nt, Human
ugguggcagugggagcugcc

SEQ ID NO: 1958245 - RNA, 19 nt, Human
ugguggcccgacagccugg

SEQ ID NO: 1958246 - RNA, 13 nt, Human
ugguggcaguggg

SEQ ID NO: 1958247 - RNA, 18 nt, Human
ugguggcagugggagcug

SEQ ID NO: 1958248 - RNA, 14 nt, Human
uggugagaggcauc

SEQ ID NO: 1958249 - RNA, 12 nt, Human
uggugauuuuaa

SEQ ID NO: 1958250 - RNA, 20 nt, Human
uggguacuuguggacacagc

SEQ ID NO: 1958251 - RNA, 23 nt, Human
uggguacuuguggacacagcucu

SEQ ID NO: 1958252 - RNA, 20 nt, Human
uguaaaaaggaauaugaaag

SEQ ID NO: 1958253 - RNA, 17 nt, Human
uguaaaagcauuuugua

SEQ ID NO: 1958254 - RNA, 18 nt, Human
uguaaaagcauuuuguaa

SEQ ID NO: 1958255 - RNA, 19 nt, Human
uguaaaagcauuuuguaau

SEQ ID NO: 1958256 - RNA, 12 nt, Human
uguaaaagcaag

SEQ ID NO: 1958257 - RNA, 12 nt, Human
uguaaaauggug

SEQ ID NO: 1958258 - RNA, 13 nt, Human
uguaaaaugcaaa

SEQ ID NO: 1958259 - RNA, 18 nt, Human
uguaaaaugcaaaaaauc

SEQ ID NO: 1958260 - RNA, 21 nt, Human
uguaaaaugcaaaaaaucuua

SEQ ID NO: 1958261 - RNA, 11 nt, Human
uguaaaauggu

SEQ ID NO: 1958262 - RNA, 21 nt, Human
ugguuuuuaaaaaacugcuga

SEQ ID NO: 1958263 - RNA, 19 nt, Human
ugguuuucuuguguguuua

SEQ ID NO: 1958264 - RNA, 22 nt, Human
ugguuuucuugggggaaaauac

SEQ ID NO: 1958265 - RNA, 20 nt, Human
ugguuguguguccccuugca

SEQ ID NO: 1958266 - RNA, 19 nt, Human
ugguuuuuauuucuccuuu

SEQ ID NO: 1958267 - RNA, 17 nt, Human
ugguuuuuauuucuccu

SEQ ID NO: 1958268 - RNA, 23 nt, Human
ugguuuuuaaaaaacugcugacu

SEQ ID NO: 1958269 - RNA, 20 nt, Human
ugguuguacauauaagugau

SEQ ID NO: 1958270 - RNA, 14 nt, Human
ugguuguaucugug

SEQ ID NO: 1958271 - RNA, 16 nt, Human
ugguuuucuguucuuu

SEQ ID NO: 1958272 - RNA, 18 nt, Human
ugguuggcugggaaaucg

SEQ ID NO: 1958273 - RNA, 14 nt, Human
ugguugggacccag

SEQ ID NO: 1958274 - RNA, 21 nt, Human
ugguugggacccaguggcagg

SEQ ID NO: 1958275 - RNA, 23 nt, Human
ugguugggacccaguggcagggc

SEQ ID NO: 1958276 - RNA, 13 nt, Human
ugguugcauccua

SEQ ID NO: 1958277 - RNA, 17 nt, Human
uguaaauuuaugugaug

SEQ ID NO: 1958278 - RNA, 14 nt, Human
uguaacaagccacc

SEQ ID NO: 1958279 - RNA, 17 nt, Human
uguaacaagccacccca

SEQ ID NO: 1958280 - RNA, 14 nt, Human
uguaacaagaaaau

SEQ ID NO: 1958281 - RNA, 13 nt, Human
uguaacaagaaaa

SEQ ID NO: 1958282 - RNA, 17 nt, Human
uguaacauucuauuuca

SEQ ID NO: 1958283 - RNA, 17 nt, Human
uguaaugaaaaccacau

SEQ ID NO: 1958284 - RNA, 12 nt, Human
uguaauaaugga

SEQ ID NO: 1958285 - RNA, 13 nt, Human
uguaaugaaaacc

SEQ ID NO: 1958286 - RNA, 12 nt, Human
uguaaugaaaac

SEQ ID NO: 1958287 - RNA, 11 nt, Human
uguaaugaaaa

SEQ ID NO: 1958288 - RNA, 19 nt, Human
uguaauaauaaagaauagc

SEQ ID NO: 1958289 - RNA, 11 nt, Human
uguacagagcc

SEQ ID NO: 1958290 - RNA, 14 nt, Human
uguacagacaacaa

SEQ ID NO: 1958291 - RNA, 16 nt, Human
ucccuaauaaagcugu

SEQ ID NO: 1958292 - RNA, 16 nt, Human
ucccuauuagagaaga

SEQ ID NO: 1958293 - RNA, 20 nt, Human
ucccucggaguucuucuuga

SEQ ID NO: 1958294 - RNA, 16 nt, Human
ucccucgucuuuccca

SEQ ID NO: 1958295 - RNA, 17 nt, Human
ucccucuacugggagcc

SEQ ID NO: 1958296 - RNA, 15 nt, Human
ucccucuacugggag

SEQ ID NO: 1958297 - RNA, 19 nt, Human
ucccuccugggaaugaagc

SEQ ID NO: 1958298 - RNA, 11 nt, Human
ucccuccuggg

SEQ ID NO: 1958299 - RNA, 20 nt, Human
uccccuguuuguuucugaaa

SEQ ID NO: 1958300 - RNA, 18 nt, Human
uccccuguuuguuucuga

SEQ ID NO: 1958301 - RNA, 18 nt, Human
uccagguuuaagcuguua

SEQ ID NO: 1958302 - RNA, 17 nt, Human
uccagguuuaagcuguu

SEQ ID NO: 1958303 - RNA, 21 nt, Human
uccccuguuuguuucugaaag

SEQ ID NO: 1958304 - RNA, 14 nt, Human
ucccgggacucugc

SEQ ID NO: 1958305 - RNA, 15 nt, Human
ucccuaauaaagcug

SEQ ID NO: 1958306 - RNA, 14 nt, Human
ucccuaauaaagcu

SEQ ID NO: 1958307 - RNA, 22 nt, Human
ucccuuccaguuuauuccagag

SEQ ID NO: 1958308 - RNA, 23 nt, Human
ucccuuccaguuuauuccagagc

SEQ ID NO: 1958309 - RNA, 23 nt, Human
ucccuugaggaaacaacagcuuu

SEQ ID NO: 1958310 - RNA, 18 nt, Human
uccgaccacuuccagggg

SEQ ID NO: 1958311 - RNA, 13 nt, Human
ucccuucccaccu

SEQ ID NO: 1958312 - RNA, 14 nt, Human
ucccuuccaccugc

SEQ ID NO: 1958313 - RNA, 15 nt, Human
ucccuuccaccugcu

SEQ ID NO: 1958314 - RNA, 17 nt, Human
ucccuuccaccugcucu

SEQ ID NO: 1958315 - RNA, 19 nt, Human
ucccuuccaccugcucugc

SEQ ID NO: 1958316 - RNA, 20 nt, Human
ucccuuccaccugcucugcu

SEQ ID NO: 1958317 - RNA, 21 nt, Human
ucccuuccaccugcucugcug

SEQ ID NO: 1958318 - RNA, 19 nt, Human
ucccuuccaguuuauucca

SEQ ID NO: 1958319 - RNA, 23 nt, Human
ucccugccugguccucacacuca

SEQ ID NO: 1958320 - RNA, 20 nt, Human
ucccugccccucccuucaac

SEQ ID NO: 1958321 - RNA, 15 nt, Human
ucccugcucacugca

SEQ ID NO: 1958322 - RNA, 22 nt, Human
ucccugcugucauugcuucuuc

SEQ ID NO: 1958323 - RNA, 23 nt, Human
ucccugcugucauugcuucuucu

SEQ ID NO: 1958324 - RNA, 14 nt, Human
ucccugcacuugca

SEQ ID NO: 1958325 - RNA, 19 nt, Human
ucccugccccucccuucaa

SEQ ID NO: 1958326 - RNA, 13 nt, Human
ucccugcacuugc

SEQ ID NO: 1958327 - RNA, 16 nt, Human
uccucugcugcuggcu

SEQ ID NO: 1958328 - RNA, 15 nt, Human
uccucugcugcuggc

SEQ ID NO: 1958329 - RNA, 14 nt, Human
uccucugcugcugg

SEQ ID NO: 1958330 - RNA, 12 nt, Human
uccucugcugcu

SEQ ID NO: 1958331 - RNA, 18 nt, Human
uccucuguacagagccca

SEQ ID NO: 1958332 - RNA, 17 nt, Human
uccucuguacagagccc

SEQ ID NO: 1958333 - RNA, 16 nt, Human
uccucuguacagagcc

SEQ ID NO: 1958334 - RNA, 21 nt, Human
uccucuuccugaauuuuauuu

SEQ ID NO: 1958335 - RNA, 19 nt, Human
uccuccuuuucacaguucu

SEQ ID NO: 1958336 - RNA, 15 nt, Human
uccucgcuucuuuca

SEQ ID NO: 1958337 - RNA, 20 nt, Human
uccucggcuggcuguccacc

SEQ ID NO: 1958338 - RNA, 14 nt, Human
uccucuaggagguc

SEQ ID NO: 1958339 - RNA, 10 nt, Human
uccuccagaa

SEQ ID NO: 1958340 - RNA, 11 nt, Human
uccuccagaac

SEQ ID NO: 1958341 - RNA, 12 nt, Human
uccuccagaacu

SEQ ID NO: 1958342 - RNA, 13 nt, Human
uccuccagaacuc

SEQ ID NO: 1958343 - RNA, 16 nt, Human
uccuccagaacucuuc

SEQ ID NO: 1958344 - RNA, 18 nt, Human
uccuccagaacucuuccu

SEQ ID NO: 1958345 - RNA, 21 nt, Human
uccuccagaacucuuccucca

SEQ ID NO: 1958346 - RNA, 17 nt, Human
uccucauguucugcuuu

SEQ ID NO: 1958347 - RNA, 20 nt, Human
uccuaauaaucauuggauuc

SEQ ID NO: 1958348 - RNA, 16 nt, Human
uccuaaucuucugaac

SEQ ID NO: 1958349 - RNA, 13 nt, Human
uccgaccagacac

SEQ ID NO: 1958350 - RNA, 17 nt, Human
uccgaccagacaccuug

SEQ ID NO: 1958351 - RNA, 18 nt, Human
uccuacccacccuccuuu

SEQ ID NO: 1958352 - RNA, 21 nt, Human
uccuaccacccgguccccacu

SEQ ID NO: 1958353 - RNA, 15 nt, Human
uccuacaagacacag

SEQ ID NO: 1958354 - RNA, 22 nt, Human
uccuaaugaaugcauaaaaugu

SEQ ID NO: 1958355 - RNA, 15 nt, Human
uccuaaucacucaga

SEQ ID NO: 1958356 - RNA, 16 nt, Human
uccuaaucacucagag

SEQ ID NO: 1958357 - RNA, 18 nt, Human
uccuaaucacucagagca

SEQ ID NO: 1958358 - RNA, 15 nt, Human
uccuaauuccacagc

SEQ ID NO: 1958359 - RNA, 14 nt, Human
uccuaauggugaug

SEQ ID NO: 1958360 - RNA, 17 nt, Human
uccuaauggugaugcag

SEQ ID NO: 1958361 - RNA, 16 nt, Human
uccuaauuccacagcu

SEQ ID NO: 1958362 - RNA, 17 nt, Human
uccuaauuccacagcug

SEQ ID NO: 1958363 - RNA, 18 nt, Human
uccuaauuccacagcugc

SEQ ID NO: 1958364 - RNA, 20 nt, Human
uccuaauggugaugcagucu

SEQ ID NO: 1958365 - RNA, 24 nt, Human
uccuaauggugaugcagucuuaga

SEQ ID NO: 1958366 - RNA, 22 nt, Human
uccuaguuccaccaucaagcca

SEQ ID NO: 1958367 - RNA, 18 nt, Human
uccuauauuguuuucagu

SEQ ID NO: 1958368 - RNA, 13 nt, Human
uccuauaccauuu

SEQ ID NO: 1958369 - RNA, 20 nt, Human
uccuauaccauuuccguaau

SEQ ID NO: 1958370 - RNA, 23 nt, Human
uccuauaauuuugauagugggac

SEQ ID NO: 1958371 - RNA, 17 nt, Human
uccucauuagcauuuug

SEQ ID NO: 1958372 - RNA, 21 nt, Human
uccuauauuguuuucagugua

SEQ ID NO: 1958373 - RNA, 12 nt, Human
uccuauuauauu

SEQ ID NO: 1958374 - RNA, 12 nt, Human
uccuauuagugu

SEQ ID NO: 1958375 - RNA, 13 nt, Human
uccuauuaguguu

SEQ ID NO: 1958376 - RNA, 14 nt, Human
uccuauuaguguua

SEQ ID NO: 1958377 - RNA, 17 nt, Human
uccuauuaguguuauau

SEQ ID NO: 1958378 - RNA, 19 nt, Human
uccuauuaguguuauauga

SEQ ID NO: 1958379 - RNA, 22 nt, Human
uccuguaccucuugagccuuga

SEQ ID NO: 1958380 - RNA, 20 nt, Human
uccuguaccucuugagccuu

SEQ ID NO: 1958381 - RNA, 22 nt, Human
uccuggcacugcuuccagugag

SEQ ID NO: 1958382 - RNA, 18 nt, Human
uccuggcacugcuuccag

SEQ ID NO: 1958383 - RNA, 20 nt, Human
uccuggcacccggccccugc

SEQ ID NO: 1958384 - RNA, 21 nt, Human
uccuggcacccggccccugcu

SEQ ID NO: 1958385 - RNA, 17 nt, Human
uccuggcacugcuucca

SEQ ID NO: 1958386 - RNA, 22 nt, Human
uccuggcacccggccccugcug

SEQ ID NO: 1958387 - RNA, 17 nt, Human
uccugccucagccuccc

SEQ ID NO: 1958388 - RNA, 16 nt, Human
uccugccucagccucc

SEQ ID NO: 1958389 - RNA, 13 nt, Human
uccugccucagcc

SEQ ID NO: 1958390 - RNA, 15 nt, Human
uccugccucagccuc

SEQ ID NO: 1958391 - RNA, 14 nt, Human
uccuggcacccggc

SEQ ID NO: 1958392 - RNA, 16 nt, Human
uccuggcacccggccc

SEQ ID NO: 1958393 - RNA, 19 nt, Human
uccuggcacccggccccug

SEQ ID NO: 1958394 - RNA, 13 nt, Human
uccugagccagau

SEQ ID NO: 1958395 - RNA, 16 nt, Human
uccucuugacccugca

SEQ ID NO: 1958396 - RNA, 17 nt, Human
uccucuugacccugcac

SEQ ID NO: 1958397 - RNA, 17 nt, Human
uccucuugcauuucacu

SEQ ID NO: 1958398 - RNA, 20 nt, Human
uccugccuaagugcagcccc

SEQ ID NO: 1958399 - RNA, 14 nt, Human
uccugagccagauu

SEQ ID NO: 1958400 - RNA, 14 nt, Human
uccugccucagccu

SEQ ID NO: 1958401 - RNA, 13 nt, Human
uccuuuuccagag

SEQ ID NO: 1958402 - RNA, 14 nt, Human
uccuuuuccagagc

SEQ ID NO: 1958403 - RNA, 15 nt, Human
uccuuuuccagagca

SEQ ID NO: 1958404 - RNA, 23 nt, Human
uccuuuuccagagcauuccaguc

SEQ ID NO: 1958405 - RNA, 18 nt, Human
uccuuuucgcaggauucu

SEQ ID NO: 1958406 - RNA, 15 nt, Human
ucgaacuccugaccu

SEQ ID NO: 1958407 - RNA, 20 nt, Human
ucgaaaguuaguaggauaug

SEQ ID NO: 1958408 - RNA, 23 nt, Human
uccuuuucacaguucucuccuuc

SEQ ID NO: 1958409 - RNA, 19 nt, Human
uccuuuuaaaacacuucca

SEQ ID NO: 1958410 - RNA, 20 nt, Human
uccuuggaaaucaaauguaa

SEQ ID NO: 1958411 - RNA, 22 nt, Human
uccuuggaaaucaaauguaaag

SEQ ID NO: 1958412 - RNA, 23 nt, Human
uccuuggaaaucaaauguaaagu

SEQ ID NO: 1958413 - RNA, 20 nt, Human
uccuucaccuuuguccccac

SEQ ID NO: 1958414 - RNA, 18 nt, Human
uccuucaccuuugucccc

SEQ ID NO: 1958415 - RNA, 19 nt, Human
uccuucacagaugggugcu

SEQ ID NO: 1958416 - RNA, 18 nt, Human
uccuucacagaugggugc

SEQ ID NO: 1958417 - RNA, 18 nt, Human
uccuuaccagcagagcac

SEQ ID NO: 1958418 - RNA, 17 nt, Human
uccuuaccagcagagca

SEQ ID NO: 1958419 - RNA, 16 nt, Human
uccuuaccagcagagc

SEQ ID NO: 1958420 - RNA, 13 nt, Human
uccuugauauuug

SEQ ID NO: 1958421 - RNA, 17 nt, Human
uccuugauauuuguauu

SEQ ID NO: 1958422 - RNA, 19 nt, Human
uccuugauauuuguauuua

SEQ ID NO: 1958423 - RNA, 19 nt, Human
uccuugaggggagccagga

SEQ ID NO: 1958424 - RNA, 22 nt, Human
uccuugaggggagccaggaggg

SEQ ID NO: 1958425 - RNA, 22 nt, Human
uccuucaccuuuguccccaccg

SEQ ID NO: 1958426 - RNA, 21 nt, Human
uccuucaccuuuguccccacc

SEQ ID NO: 1958427 - RNA, 21 nt, Human
ucuaucaaguauuauaccuuu

SEQ ID NO: 1958428 - RNA, 22 nt, Human
ucuaucaaguauuauaccuuuu

SEQ ID NO: 1958429 - RNA, 19 nt, Human
ucuagugcagcugaaauug

SEQ ID NO: 1958430 - RNA, 20 nt, Human
ucuagugcagcugaaauuga

SEQ ID NO: 1958431 - RNA, 15 nt, Human
ucuaucaaguauuau

SEQ ID NO: 1958432 - RNA, 22 nt, Human
ucuaugauuccagguggcauca

SEQ ID NO: 1958433 - RNA, 13 nt, Human
ucuaugccugucu

SEQ ID NO: 1958434 - RNA, 17 nt, Human
ucucaaauaacuaaaag

SEQ ID NO: 1958435 - RNA, 17 nt, Human
ucucaaagaccuggggc

SEQ ID NO: 1958436 - RNA, 19 nt, Human
ucucaaagccccauuaacu

SEQ ID NO: 1958437 - RNA, 21 nt, Human
ucucaaagccccauuaacugc

SEQ ID NO: 1958438 - RNA, 23 nt, Human
ucuaggacugaauuaugaaacuu

SEQ ID NO: 1958439 - RNA, 16 nt, Human
ucuaggacugaauuau

SEQ ID NO: 1958440 - RNA, 15 nt, Human
ucuaggaccuguguc

SEQ ID NO: 1958441 - RNA, 17 nt, Human
ucuagugcagcugaaau

SEQ ID NO: 1958442 - RNA, 13 nt, Human
ucuaauuccuguu

SEQ ID NO: 1958443 - RNA, 16 nt, Human
ucuaauuccuguuugu

SEQ ID NO: 1958444 - RNA, 11 nt, Human
ucuagaaagaa

SEQ ID NO: 1958445 - RNA, 13 nt, Human
ucuagaaagaaua

SEQ ID NO: 1958446 - RNA, 14 nt, Human
ucuaauauguaaca

SEQ ID NO: 1958447 - RNA, 14 nt, Human
ucuaaugugugaau

SEQ ID NO: 1958448 - RNA, 18 nt, Human
ucuaauguuuaagcagaa

SEQ ID NO: 1958449 - RNA, 11 nt, Human
ucuaauguuua

SEQ ID NO: 1958450 - RNA, 12 nt, Human
ucuaauguuuaa

SEQ ID NO: 1958451 - RNA, 16 nt, Human
ucgugauugauaagaa

SEQ ID NO: 1958452 - RNA, 22 nt, Human
ucggccucccaaagugcuggga

SEQ ID NO: 1958453 - RNA, 18 nt, Human
ucggccuccauccugagg

SEQ ID NO: 1958454 - RNA, 21 nt, Human
ucgugaugcuaugauguuagu

SEQ ID NO: 1958455 - RNA, 21 nt, Human
ucuaaaucuccaaaauaaaac

SEQ ID NO: 1958456 - RNA, 18 nt, Human
ucguuaggauacugccuc

SEQ ID NO: 1958457 - RNA, 22 nt, Human
ucuaaauaucccuuggacauuu

SEQ ID NO: 1958458 - RNA, 16 nt, Human
ucuaaccacagcuccu

SEQ ID NO: 1958459 - RNA, 17 nt, Human
ucuaaccacagcuccuu

SEQ ID NO: 1958460 - RNA, 19 nt, Human
ucuaaccacagcuccuuuu

SEQ ID NO: 1958461 - RNA, 20 nt, Human
ucuaaccacagcuccuuuuc

SEQ ID NO: 1958462 - RNA, 22 nt, Human
ucuaaccacagcuccuuuucca

SEQ ID NO: 1958463 - RNA, 16 nt, Human
ucuaauauauccacac

SEQ ID NO: 1958464 - RNA, 11 nt, Human
ucucugaaccc

SEQ ID NO: 1958465 - RNA, 16 nt, Human
ucucuaguuugauuaa

SEQ ID NO: 1958466 - RNA, 16 nt, Human
ucucuagugcugugaa

SEQ ID NO: 1958467 - RNA, 17 nt, Human
ucucuagugcugugaaa

SEQ ID NO: 1958468 - RNA, 19 nt, Human
ucucuagugcugugaaaaa

SEQ ID NO: 1958469 - RNA, 15 nt, Human
ucucuaguuugauua

SEQ ID NO: 1958470 - RNA, 14 nt, Human
ucucuagugcugug

SEQ ID NO: 1958471 - RNA, 14 nt, Human
ucucugcagguccc

SEQ ID NO: 1958472 - RNA, 13 nt, Human
ucucugcaggucc

SEQ ID NO: 1958473 - RNA, 15 nt, Human
ucucugauacagaaa

SEQ ID NO: 1958474 - RNA, 17 nt, Human
ucucugaggacacuaac

SEQ ID NO: 1958475 - RNA, 14 nt, Human
ucucugaggacacu

SEQ ID NO: 1958476 - RNA, 15 nt, Human
ucucugaaggaggcc

SEQ ID NO: 1958477 - RNA, 18 nt, Human
ucucugaaggaggccacc

SEQ ID NO: 1958478 - RNA, 20 nt, Human
ucucugaaggaggccaccuc

SEQ ID NO: 1958479 - RNA, 21 nt, Human
ucucugaaggaggccaccucc

SEQ ID NO: 1958480 - RNA, 23 nt, Human
ucucugaaggaggccaccuccua

SEQ ID NO: 1958481 - RNA, 14 nt, Human
ucucuguacauauu

SEQ ID NO: 1958482 - RNA, 18 nt, Human
ucucugcaggucccuaau

SEQ ID NO: 1958483 - RNA, 23 nt, Human
ucucugauacuuuuuugaaauca

SEQ ID NO: 1958484 - RNA, 16 nt, Human
ucucugcaggucccua

SEQ ID NO: 1958485 - RNA, 15 nt, Human
ucucugcaggucccu

SEQ ID NO: 1958486 - RNA, 19 nt, Human
ucucuaacuucaccauauu

SEQ ID NO: 1958487 - RNA, 11 nt, Human
ucucuaauaau

SEQ ID NO: 1958488 - RNA, 12 nt, Human
ucucuaauaaua

SEQ ID NO: 1958489 - RNA, 14 nt, Human
ucucuaauaauaaa

SEQ ID NO: 1958490 - RNA, 15 nt, Human
ucucuaauaauaaau

SEQ ID NO: 1958491 - RNA, 17 nt, Human
ucucuaauaauaaauag

SEQ ID NO: 1958492 - RNA, 18 nt, Human
ucucuaauaauaaauagu

SEQ ID NO: 1958493 - RNA, 22 nt, Human
ucucuaauaauaaauaguucuu

SEQ ID NO: 1958494 - RNA, 23 nt, Human
ucucuaauauccacuuguccaug

SEQ ID NO: 1958495 - RNA, 14 nt, Human
ucucuaacagugga

SEQ ID NO: 1958496 - RNA, 12 nt, Human
ucucuaacuuca

SEQ ID NO: 1958497 - RNA, 20 nt, Human
ucucuaacaguggacaaagu

SEQ ID NO: 1958498 - RNA, 22 nt, Human
ucucgugauugauaagaaccuu

SEQ ID NO: 1958499 - RNA, 14 nt, Human
ucucgugauugaua

SEQ ID NO: 1958500 - RNA, 24 nt, Human
ucucguauagaagucuucaugaaa

SEQ ID NO: 1958501 - RNA, 23 nt, Human
ucucguguuauuuuaaucucaga

SEQ ID NO: 1958502 - RNA, 19 nt, Human
ucuccuguaccucuugagc

SEQ ID NO: 1958503 - RNA, 14 nt, Human
ucucguauagaagu

SEQ ID NO: 1958504 - RNA, 16 nt, Human
ucuccuguaccucuug

SEQ ID NO: 1958505 - RNA, 17 nt, Human
ucuccuguaccucuuga

SEQ ID NO: 1958506 - RNA, 15 nt, Human
ucuccuguaccucuu

SEQ ID NO: 1958507 - RNA, 21 nt, Human
ucuccuggaaauauuaagaaa

SEQ ID NO: 1958508 - RNA, 21 nt, Human
ucuccuggaagugcuaauuuu

SEQ ID NO: 1958509 - RNA, 19 nt, Human
ucuccugccucagccuccc

SEQ ID NO: 1958510 - RNA, 17 nt, Human
ucuccugccucagccuc

SEQ ID NO: 1958511 - RNA, 15 nt, Human
ucuccugccucagcc

SEQ ID NO: 1958512 - RNA, 12 nt, Human
ucuccugccuca

SEQ ID NO: 1958513 - RNA, 18 nt, Human
ucucaaguuuaugucuca

SEQ ID NO: 1958514 - RNA, 19 nt, Human
ucucaagagggcacuggug

SEQ ID NO: 1958515 - RNA, 17 nt, Human
ucucaagagggcacugg

SEQ ID NO: 1958516 - RNA, 18 nt, Human
ucucaagagggcacuggu

SEQ ID NO: 1958517 - RNA, 23 nt, Human
ucucaaauuguaauuaauaauag

SEQ ID NO: 1958518 - RNA, 17 nt, Human
ucugcauucaggaucaa

SEQ ID NO: 1958519 - RNA, 20 nt, Human
ucugccacagggacuugccu

SEQ ID NO: 1958520 - RNA, 17 nt, Human
ucugccacccugcugag

SEQ ID NO: 1958521 - RNA, 20 nt, Human
ucugcacauaaacucuuuua

SEQ ID NO: 1958522 - RNA, 14 nt, Human
ucugacccacugcu

SEQ ID NO: 1958523 - RNA, 15 nt, Human
ucugacccacugcuu

SEQ ID NO: 1958524 - RNA, 23 nt, Human
ucugaggaauccagacccggcug

SEQ ID NO: 1958525 - RNA, 21 nt, Human
ucugaggaauggacauuucua

SEQ ID NO: 1958526 - RNA, 14 nt, Human
ucugaggcccugcc

SEQ ID NO: 1958527 - RNA, 14 nt, Human
ucugcaacucugaa

SEQ ID NO: 1958528 - RNA, 15 nt, Human
ucugcaacucugaag

SEQ ID NO: 1958529 - RNA, 11 nt, Human
ucugaggcuga

SEQ ID NO: 1958530 - RNA, 23 nt, Human
ucugaggcugaaauucagaauau

SEQ ID NO: 1958531 - RNA, 17 nt, Human
ucugaggccguugcuga

SEQ ID NO: 1958532 - RNA, 21 nt, Human
ucugaggccguugcugacuua

SEQ ID NO: 1958533 - RNA, 22 nt, Human
ucugaggccguugcugacuuag

SEQ ID NO: 1958534 - RNA, 21 nt, Human
ucugcaagaauugaagcagga

SEQ ID NO: 1958535 - RNA, 20 nt, Human
ucugcaagaauugaagcagg

SEQ ID NO: 1958536 - RNA, 19 nt, Human
ucugcacauaaacucuuuu

SEQ ID NO: 1958537 - RNA, 14 nt, Human
ucugcacacagcac

SEQ ID NO: 1958538 - RNA, 17 nt, Human
ucugaaauuuccuggga

SEQ ID NO: 1958539 - RNA, 18 nt, Human
ucugaaauuuccugggag

SEQ ID NO: 1958540 - RNA, 20 nt, Human
ucugaaauuuccugggagcu

SEQ ID NO: 1958541 - RNA, 16 nt, Human
ucugacacacagcucu

SEQ ID NO: 1958542 - RNA, 17 nt, Human
ucugacacacagcucug

SEQ ID NO: 1958543 - RNA, 18 nt, Human
ucugacacacagcucugu

SEQ ID NO: 1958544 - RNA, 19 nt, Human
ucugacacacagcucuguc

SEQ ID NO: 1958545 - RNA, 12 nt, Human
ucugacaggcaa

SEQ ID NO: 1958546 - RNA, 21 nt, Human
ucugacaggcaaugcuggcug

SEQ ID NO: 1958547 - RNA, 22 nt, Human
ucugacaggcaaugcuggcugu

SEQ ID NO: 1958548 - RNA, 15 nt, Human
ucugacauaaguauu

SEQ ID NO: 1958549 - RNA, 13 nt, Human
ucugacccacugc

SEQ ID NO: 1958550 - RNA, 13 nt, Human
ucucuuaucugug

SEQ ID NO: 1958551 - RNA, 14 nt, Human
ucucuuuuuuaagu

SEQ ID NO: 1958552 - RNA, 12 nt, Human
ucucuuagaaaa

SEQ ID NO: 1958553 - RNA, 16 nt, Human
ucucuuagaaaaggug

SEQ ID NO: 1958554 - RNA, 14 nt, Human
ucucuguuccauag

SEQ ID NO: 1958555 - RNA, 22 nt, Human
ucugaaaauugaugggauuugg

SEQ ID NO: 1958556 - RNA, 16 nt, Human
ucugaaaccaaaugua

SEQ ID NO: 1958557 - RNA, 18 nt, Human
ucugaaagagucuuucuu

SEQ ID NO: 1958558 - RNA, 22 nt, Human
ucugaaagagucuuucuucuuc

SEQ ID NO: 1958559 - RNA, 13 nt, Human
ucugaaaauguau

SEQ ID NO: 1958560 - RNA, 14 nt, Human
ucugaaaauugaug

SEQ ID NO: 1958561 - RNA, 15 nt, Human
ucucuuuuuuacaaa

SEQ ID NO: 1958562 - RNA, 16 nt, Human
ucucuuuuuuacaaag

SEQ ID NO: 1958563 - RNA, 17 nt, Human
ucucuuuuuuacaaagg

SEQ ID NO: 1958564 - RNA, 22 nt, Human
ucuuaaauauguggaguucauc

SEQ ID NO: 1958565 - RNA, 17 nt, Human
ucuuaaccagaucauug

SEQ ID NO: 1958566 - RNA, 16 nt, Human
ucuuaaccagaucauu

SEQ ID NO: 1958567 - RNA, 22 nt, Human
ucuuaaccagaucauugugaaa

SEQ ID NO: 1958568 - RNA, 12 nt, Human
ucuuaaccaucu

SEQ ID NO: 1958569 - RNA, 13 nt, Human
ucuuaagaaauaa

SEQ ID NO: 1958570 - RNA, 14 nt, Human
ucuuaagaaauaaa

SEQ ID NO: 1958571 - RNA, 16 nt, Human
ucuuaagaaauaaauc

SEQ ID NO: 1958572 - RNA, 9 nt, Human
ucugucugc

SEQ ID NO: 1958573 - RNA, 12 nt, Human
ucugucugcugg

SEQ ID NO: 1958574 - RNA, 13 nt, Human
ucugucugcuggu

SEQ ID NO: 1958575 - RNA, 22 nt, Human
ucugucugcuggucacuucuuc

SEQ ID NO: 1958576 - RNA, 13 nt, Human
ucugucuggucca

SEQ ID NO: 1958577 - RNA, 14 nt, Human
ucuguuuuuaaaaa

SEQ ID NO: 1958578 - RNA, 13 nt, Human
ucuuaaaaagugg

SEQ ID NO: 1958579 - RNA, 15 nt, Human
ucuguuuuuaaaaau

SEQ ID NO: 1958580 - RNA, 12 nt, Human
ucuuaaaaagua

SEQ ID NO: 1958581 - RNA, 13 nt, Human
ucuuaaaaaguaa

SEQ ID NO: 1958582 - RNA, 15 nt, Human
ucuucucauuacuug

SEQ ID NO: 1958583 - RNA, 17 nt, Human
ucuucucauuacuuguu

SEQ ID NO: 1958584 - RNA, 12 nt, Human
ucuucuccacug

SEQ ID NO: 1958585 - RNA, 12 nt, Human
ucuucuccccca

SEQ ID NO: 1958586 - RNA, 13 nt, Human
ucuucucccccau

SEQ ID NO: 1958587 - RNA, 16 nt, Human
ucuucucccccauccu

SEQ ID NO: 1958588 - RNA, 16 nt, Human
ucuucuuuuuuuguga

SEQ ID NO: 1958589 - RNA, 17 nt, Human
ucuucuuuuuuugugau

SEQ ID NO: 1958590 - RNA, 18 nt, Human
ucuucuuuuuuugugaug

SEQ ID NO: 1958591 - RNA, 14 nt, Human
ucuucuccuuucac

SEQ ID NO: 1958592 - RNA, 13 nt, Human
ucuucuccuuuca

SEQ ID NO: 1958593 - RNA, 16 nt, Human
ucuucuccccuuccau

SEQ ID NO: 1958594 - RNA, 21 nt, Human
ucuucuccccuuccauuucug

SEQ ID NO: 1958595 - RNA, 13 nt, Human
ucuugaaaaaugc

SEQ ID NO: 1958596 - RNA, 12 nt, Human
ucuugaacuccu

SEQ ID NO: 1958597 - RNA, 17 nt, Human
ucuugaacuccugaccu

SEQ ID NO: 1958598 - RNA, 19 nt, Human
ucuugaacuccugaccuca

SEQ ID NO: 1958599 - RNA, 18 nt, Human
ucuucagaucucuaacuu

SEQ ID NO: 1958600 - RNA, 23 nt, Human
ucuucagaucucuaacuucacca

SEQ ID NO: 1958601 - RNA, 17 nt, Human
ucuucagcacaaaagga

SEQ ID NO: 1958602 - RNA, 17 nt, Human
ucuuaggccaggcgugg

SEQ ID NO: 1958603 - RNA, 17 nt, Human
ucuuccuggauuauuca

SEQ ID NO: 1958604 - RNA, 13 nt, Human
ucuuccuggacag

SEQ ID NO: 1958605 - RNA, 19 nt, Human
ucuuccuggacaggccagg

SEQ ID NO: 1958606 - RNA, 12 nt, Human
ucuuccuggccg

SEQ ID NO: 1958607 - RNA, 20 nt, Human
ucuuccuggucgaaaguuag

SEQ ID NO: 1958608 - RNA, 21 nt, Human
ucuuccuggucgaaaguuagu

SEQ ID NO: 1958609 - RNA, 16 nt, Human
ucuuccuggugacccu

SEQ ID NO: 1958610 - RNA, 13 nt, Human
ucuucaugaaaug

SEQ ID NO: 1958611 - RNA, 14 nt, Human
ucuucaugaaaugc

SEQ ID NO: 1958612 - RNA, 16 nt, Human
ucuucaugaaaugcua

SEQ ID NO: 1958613 - RNA, 14 nt, Human
ucugccugcccagg

SEQ ID NO: 1958614 - RNA, 13 nt, Human
ucugccugcccag

SEQ ID NO: 1958615 - RNA, 22 nt, Human
ucugccagauguccuaauggug

SEQ ID NO: 1958616 - RNA, 23 nt, Human
ucugccagauguccuaaugguga

SEQ ID NO: 1958617 - RNA, 22 nt, Human
ucugcuccccuaaagccucaaa

SEQ ID NO: 1958618 - RNA, 16 nt, Human
ucugcucccccuuuuc

SEQ ID NO: 1958619 - RNA, 20 nt, Human
ucugcucccccuuuucccuc

SEQ ID NO: 1958620 - RNA, 15 nt, Human
ucugccugcccaggc

SEQ ID NO: 1958621 - RNA, 16 nt, Human
ucugccugcccaggcc

SEQ ID NO: 1958622 - RNA, 18 nt, Human
ucugcuccucuccccagc

SEQ ID NO: 1958623 - RNA, 21 nt, Human
ucugcuccucuccccagcaag

SEQ ID NO: 1958624 - RNA, 18 nt, Human
ucugcugacagacacagg

SEQ ID NO: 1958625 - RNA, 17 nt, Human
ucugcugacagacacag

SEQ ID NO: 1958626 - RNA, 23 nt, Human
ucuggaaucauuguccagagcug

SEQ ID NO: 1958627 - RNA, 21 nt, Human
ucuggacaggcauguucucug

SEQ ID NO: 1958628 - RNA, 16 nt, Human
ucuggaaugcaguggu

SEQ ID NO: 1958629 - RNA, 14 nt, Human
ucuggacaggcaug

SEQ ID NO: 1958630 - RNA, 19 nt, Human
ucuggaauaaggagaauga

SEQ ID NO: 1958631 - RNA, 15 nt, Human
ucuggaaugcagugg

SEQ ID NO: 1958632 - RNA, 20 nt, Human
ucugcuggucacuucuucug

SEQ ID NO: 1958633 - RNA, 21 nt, Human
ucugcuggucacuucuucugu

SEQ ID NO: 1958634 - RNA, 19 nt, Human
ucugcugacagacacaggc

SEQ ID NO: 1958635 - RNA, 20 nt, Human
ucugcugacagacacaggcc

SEQ ID NO: 1958636 - RNA, 21 nt, Human
ucugcugacagacacaggccc

SEQ ID NO: 1958637 - RNA, 22 nt, Human
ucugcugacagacacaggcccg

SEQ ID NO: 1958638 - RNA, 22 nt, Human
ucugcugauccucccaggcuuc

SEQ ID NO: 1958639 - RNA, 23 nt, Human
ucugcuggcaucaagagguggga

SEQ ID NO: 1958640 - RNA, 17 nt, Human
ucuggccuucggccucc

SEQ ID NO: 1958641 - RNA, 14 nt, Human
ucuggaccccaucu

SEQ ID NO: 1958642 - RNA, 17 nt, Human
ucuggaccccaucugug

SEQ ID NO: 1958643 - RNA, 18 nt, Human
ucuggaccccaucuguga

SEQ ID NO: 1958644 - RNA, 19 nt, Human
ucuggaccccaucugugaa

SEQ ID NO: 1958645 - RNA, 18 nt, Human
ucuggccuucggccucca

SEQ ID NO: 1958646 - RNA, 23 nt, Human
ucuggccuucggccuccauccug

SEQ ID NO: 1958647 - RNA, 19 nt, Human
ucuggcuaugcauuugaaa

SEQ ID NO: 1958648 - RNA, 22 nt, Human
ucuggcuaugcauuugaaaauu

SEQ ID NO: 1958649 - RNA, 15 nt, Human
ucuggcuccagcugg

SEQ ID NO: 1958650 - RNA, 21 nt, Human
ucuggaccccaucugugaaua

SEQ ID NO: 1958651 - RNA, 20 nt, Human
ucuggaccccaucugugaau

SEQ ID NO: 1958652 - RNA, 23 nt, Human
ucuggcucuuccaggcugggaga

SEQ ID NO: 1958653 - RNA, 18 nt, Human
ucuggcucuuccaggcug

SEQ ID NO: 1958654 - RNA, 14 nt, Human
ucuggcugcagagc

SEQ ID NO: 1958655 - RNA, 14 nt, Human
ucugggacacaguu

SEQ ID NO: 1958656 - RNA, 23 nt, Human
ucuggugacuuuccucuuugguc

SEQ ID NO: 1958657 - RNA, 22 nt, Human
ucugucucuggauuauauuaug

SEQ ID NO: 1958658 - RNA, 16 nt, Human
ucugucgcccagucug

SEQ ID NO: 1958659 - RNA, 14 nt, Human
ucugucgcccaguc

SEQ ID NO: 1958660 - RNA, 21 nt, Human
ucuguccugggagugagcugg

SEQ ID NO: 1958661 - RNA, 20 nt, Human
ucuguccuacucugugucag

SEQ ID NO: 1958662 - RNA, 15 nt, Human
ucuguccuacucugu

SEQ ID NO: 1958663 - RNA, 19 nt, Human
ucuguccuacucuguguca

SEQ ID NO: 1958664 - RNA, 14 nt, Human
ucuguccuacucug

SEQ ID NO: 1958665 - RNA, 20 nt, Human
ucugguuccuccccuccucc

SEQ ID NO: 1958666 - RNA, 21 nt, Human
ucugguuccuccccuccuccu

SEQ ID NO: 1958667 - RNA, 13 nt, Human
ucugguuccuccc

SEQ ID NO: 1958668 - RNA, 23 nt, Human
ucaaauauauucagccuggcuuc

SEQ ID NO: 1958669 - RNA, 22 nt, Human
ucaaauauauucagccuggcuu

SEQ ID NO: 1958670 - RNA, 21 nt, Human
ucaaauauauucagccuggcu

SEQ ID NO: 1958671 - RNA, 23 nt, Human
ucaaagaccuggggcugcuguga

SEQ ID NO: 1958672 - RNA, 23 nt, Human
ucaaagaaucaccuaauuaauuu

SEQ ID NO: 1958673 - RNA, 21 nt, Human
ucaaagaccuggggcugcugu

SEQ ID NO: 1958674 - RNA, 14 nt, Human
ucaaauccaggacc

SEQ ID NO: 1958675 - RNA, 18 nt, Human
ucaaaaaucaauaugcag

SEQ ID NO: 1958676 - RNA, 11 nt, Human
ucaaaaaucug

SEQ ID NO: 1958677 - RNA, 14 nt, Human
ucaaaaaacuugua

SEQ ID NO: 1958678 - RNA, 15 nt, Human
ucaaaaaacuuguaa

SEQ ID NO: 1958679 - RNA, 20 nt, Human
ucaaaaaucugaagauuguu

SEQ ID NO: 1958680 - RNA, 22 nt, Human
ucaaaacaaacagaugcucuga

SEQ ID NO: 1958681 - RNA, 17 nt, Human
ucaaaaaucugaagauu

SEQ ID NO: 1958682 - RNA, 18 nt, Human
ucaaaaaucugaagauug

SEQ ID NO: 1958683 - RNA, 13 nt, Human
ucaaaaaucugaa

SEQ ID NO: 1958684 - RNA, 14 nt, Human
ucaaaaaucugaag

SEQ ID NO: 1958685 - RNA, 15 nt, Human
ucaaaaaucugaaga

SEQ ID NO: 1958686 - RNA, 16 nt, Human
ucaaaaaucugaagau

SEQ ID NO: 1958687 - RNA, 16 nt, Human
ucaaaacaaaggccua

SEQ ID NO: 1958688 - RNA, 21 nt, Human
ucaaaugcucagaccagcucu

SEQ ID NO: 1958689 - RNA, 10 nt, Human
ucaaauuaau

SEQ ID NO: 1958690 - RNA, 13 nt, Human
ucaaauuaauugu

SEQ ID NO: 1958691 - RNA, 15 nt, Human
ucaaauuaauugugu

SEQ ID NO: 1958692 - RNA, 16 nt, Human
ucaaauuaauugugug

SEQ ID NO: 1958693 - RNA, 17 nt, Human
ucaaauuaauuguguga

SEQ ID NO: 1958694 - RNA, 18 nt, Human
ucaaauuaauugugugaa

SEQ ID NO: 1958695 - RNA, 19 nt, Human
ucaaaugcucagaccagcu

SEQ ID NO: 1958696 - RNA, 14 nt, Human
ucaaaugcucagac

SEQ ID NO: 1958697 - RNA, 22 nt, Human
ucaaaugaugugccugcuucag

SEQ ID NO: 1958698 - RNA, 17 nt, Human
ucaaaugcuagaaaaau

SEQ ID NO: 1958699 - RNA, 18 nt, Human
ucaaaugcuagaaaaauu

SEQ ID NO: 1958700 - RNA, 18 nt, Human
ucaaaugaugugccugcu

SEQ ID NO: 1958701 - RNA, 19 nt, Human
ucaaaugaugugccugcuu

SEQ ID NO: 1958702 - RNA, 22 nt, Human
ucaaauccaggacccugccagg

SEQ ID NO: 1958703 - RNA, 15 nt, Human
ucaaauccaggaccc

SEQ ID NO: 1958704 - RNA, 16 nt, Human
ucaaauccaggacccu

SEQ ID NO: 1958705 - RNA, 19 nt, Human
ucaaauccaggacccugcc

SEQ ID NO: 1958706 - RNA, 21 nt, Human
ucaaauccaggacccugccag

SEQ ID NO: 1958707 - RNA, 23 nt, Human
ucaaccccuucgcuccugugucu

SEQ ID NO: 1958708 - RNA, 16 nt, Human
ucaaauuguaauuaau

SEQ ID NO: 1958709 - RNA, 20 nt, Human
ucaaauuguaagcaugcaca

SEQ ID NO: 1958710 - RNA, 17 nt, Human
ucaaauuguaagcaugc

SEQ ID NO: 1958711 - RNA, 13 nt, Human
ucaaauuguaauu

SEQ ID NO: 1958712 - RNA, 15 nt, Human
ucaaaaaaagaaaaa

SEQ ID NO: 1958713 - RNA, 14 nt, Human
ucaaaaaaagaaaa

SEQ ID NO: 1958714 - RNA, 18 nt, Human
uauuuuuuuuaauuguau

SEQ ID NO: 1958715 - RNA, 19 nt, Human
uauuuuuuuuaauuguauu

SEQ ID NO: 1958716 - RNA, 16 nt, Human
uauuuuuuuuaauugu

SEQ ID NO: 1958717 - RNA, 14 nt, Human
uauuuuuuuacuaa

SEQ ID NO: 1958718 - RNA, 17 nt, Human
uauuuuuuucuuuucuu

SEQ ID NO: 1958719 - RNA, 13 nt, Human
uauuuuuuugaac

SEQ ID NO: 1958720 - RNA, 22 nt, Human
uauuuucccuauuagagaagag

SEQ ID NO: 1958721 - RNA, 14 nt, Human
uauuuuccugauag

SEQ ID NO: 1958722 - RNA, 18 nt, Human
uauuuuccugauagcaua

SEQ ID NO: 1958723 - RNA, 19 nt, Human
uauuuuccugauagcauau

SEQ ID NO: 1958724 - RNA, 14 nt, Human
uauuuucuaaagua

SEQ ID NO: 1958725 - RNA, 21 nt, Human
uauuuucucugauacuuuuuu

SEQ ID NO: 1958726 - RNA, 14 nt, Human
uauuuuauuaugca

SEQ ID NO: 1958727 - RNA, 17 nt, Human
uauuuuauuaugcauga

SEQ ID NO: 1958728 - RNA, 13 nt, Human
uauuuuauuaaua

SEQ ID NO: 1958729 - RNA, 20 nt, Human
uauuuuauuuuuagaauuuu

SEQ ID NO: 1958730 - RNA, 19 nt, Human
uauuuucaacgcagcccug

SEQ ID NO: 1958731 - RNA, 16 nt, Human
uauuuauaagaaaaau

SEQ ID NO: 1958732 - RNA, 20 nt, Human
uauuuauaagaaaaauguga

SEQ ID NO: 1958733 - RNA, 17 nt, Human
uauuuuauguugcauag

SEQ ID NO: 1958734 - RNA, 18 nt, Human
ucacauuuauucugcuca

SEQ ID NO: 1958735 - RNA, 19 nt, Human
ucacauuuauucugcucac

SEQ ID NO: 1958736 - RNA, 16 nt, Human
ucacagugugauuuug

SEQ ID NO: 1958737 - RNA, 17 nt, Human
ucacagugugauuuuga

SEQ ID NO: 1958738 - RNA, 17 nt, Human
ucacauuuauucugcuc

SEQ ID NO: 1958739 - RNA, 14 nt, Human
ucaccacagacuuu

SEQ ID NO: 1958740 - RNA, 22 nt, Human
ucacauuuuuauaccuguuuaa

SEQ ID NO: 1958741 - RNA, 20 nt, Human
ucaccaaaucagcugcuacu

SEQ ID NO: 1958742 - RNA, 19 nt, Human
ucaccaaaucagcugcuac

SEQ ID NO: 1958743 - RNA, 14 nt, Human
ucaccaaggcugau

SEQ ID NO: 1958744 - RNA, 20 nt, Human
ucacauuuuuauaccuguuu

SEQ ID NO: 1958745 - RNA, 17 nt, Human
ucacaccccaccugcgc

SEQ ID NO: 1958746 - RNA, 18 nt, Human
ucacaccccaccugcgcu

SEQ ID NO: 1958747 - RNA, 20 nt, Human
ucacaccccaccugcgcuuc

SEQ ID NO: 1958748 - RNA, 13 nt, Human
ucacaccccaccu

SEQ ID NO: 1958749 - RNA, 14 nt, Human
ucacaccccaccug

SEQ ID NO: 1958750 - RNA, 15 nt, Human
ucacaccccaccugc

SEQ ID NO: 1958751 - RNA, 16 nt, Human
ucacaccccaccugcg

SEQ ID NO: 1958752 - RNA, 12 nt, Human
ucacaccccacc

SEQ ID NO: 1958753 - RNA, 13 nt, Human
ucacaagacccaa

SEQ ID NO: 1958754 - RNA, 14 nt, Human
ucaauuacauguuu

SEQ ID NO: 1958755 - RNA, 20 nt, Human
ucaauuacaggaaguacugg

SEQ ID NO: 1958756 - RNA, 17 nt, Human
ucacaagacccaaaagg

SEQ ID NO: 1958757 - RNA, 18 nt, Human
ucacaagacccaaaaggc

SEQ ID NO: 1958758 - RNA, 16 nt, Human
ucacagucacauucca

SEQ ID NO: 1958759 - RNA, 19 nt, Human
ucacaguccuuaccagcag

SEQ ID NO: 1958760 - RNA, 23 nt, Human
ucacaguccuuaccagcagagca

SEQ ID NO: 1958761 - RNA, 22 nt, Human
ucacaguccuuaccagcagagc

SEQ ID NO: 1958762 - RNA, 16 nt, Human
ucacaggcagguccag

SEQ ID NO: 1958763 - RNA, 17 nt, Human
ucacaggcagguccagg

SEQ ID NO: 1958764 - RNA, 18 nt, Human
ucacaggcagguccaggg

SEQ ID NO: 1958765 - RNA, 19 nt, Human
ucacaggcagguccagggu

SEQ ID NO: 1958766 - RNA, 20 nt, Human
ucaagugauucuccugccuc

SEQ ID NO: 1958767 - RNA, 18 nt, Human
ucaagugauucuccugcc

SEQ ID NO: 1958768 - RNA, 21 nt, Human
ucaagugauucuccugccuca

SEQ ID NO: 1958769 - RNA, 14 nt, Human
ucaacgcagcccug

SEQ ID NO: 1958770 - RNA, 15 nt, Human
ucaacgcagcccugc

SEQ ID NO: 1958771 - RNA, 18 nt, Human
ucaacgcagcccugcuuu

SEQ ID NO: 1958772 - RNA, 13 nt, Human
ucaaguucacacc

SEQ ID NO: 1958773 - RNA, 16 nt, Human
ucaaguucacaccugc

SEQ ID NO: 1958774 - RNA, 17 nt, Human
ucaaugccccugaauuu

SEQ ID NO: 1958775 - RNA, 18 nt, Human
ucaaugccccugaauuua

SEQ ID NO: 1958776 - RNA, 20 nt, Human
ucaaugccccugaauuuaaa

SEQ ID NO: 1958777 - RNA, 21 nt, Human
ucaaugugauauaaacagcuu

SEQ ID NO: 1958778 - RNA, 23 nt, Human
ucaauuacaggaaguacuggaga

SEQ ID NO: 1958779 - RNA, 21 nt, Human
ucaauuacaggaaguacugga

SEQ ID NO: 1958780 - RNA, 13 nt, Human
ucaaugcagcccc

SEQ ID NO: 1958781 - RNA, 23 nt, Human
ucaauaauuuguggugauuugga

SEQ ID NO: 1958782 - RNA, 14 nt, Human
ucaauaacagccgc

SEQ ID NO: 1958783 - RNA, 16 nt, Human
ucaauaacagccgcuc

SEQ ID NO: 1958784 - RNA, 18 nt, Human
ucaauaacagccgcucca

SEQ ID NO: 1958785 - RNA, 20 nt, Human
ucaauaacagccgcuccaga

SEQ ID NO: 1958786 - RNA, 21 nt, Human
ucaauaacagccgcuccagag

SEQ ID NO: 1958787 - RNA, 24 nt, Human
ucaauaacagccgcuccagaguca

SEQ ID NO: 1958788 - RNA, 15 nt, Human
ucaauaaaguuugau

SEQ ID NO: 1958789 - RNA, 17 nt, Human
ucaauaaaguuugaucu

SEQ ID NO: 1958790 - RNA, 18 nt, Human
ucaauaaaguuugaucuu

SEQ ID NO: 1958791 - RNA, 19 nt, Human
ucaauaaaguuugaucuuc

SEQ ID NO: 1958792 - RNA, 12 nt, Human
ucaauaaaguuu

SEQ ID NO: 1958793 - RNA, 13 nt, Human
ucaauaaaguuug

SEQ ID NO: 1958794 - RNA, 14 nt, Human
ucaauaaaguuuga

SEQ ID NO: 1958795 - RNA, 21 nt, Human
uauugauaugcuuauacacuu

SEQ ID NO: 1958796 - RNA, 22 nt, Human
uauucuccuucugucaaaguca

SEQ ID NO: 1958797 - RNA, 18 nt, Human
uauucucuccuguaccuc

SEQ ID NO: 1958798 - RNA, 17 nt, Human
uauucucuccuguaccu

SEQ ID NO: 1958799 - RNA, 13 nt, Human
uauucucauucuu

SEQ ID NO: 1958800 - RNA, 14 nt, Human
uauugauugcuuuu

SEQ ID NO: 1958801 - RNA, 12 nt, Human
uauugaugaaaa

SEQ ID NO: 1958802 - RNA, 13 nt, Human
uauugaugaaaau

SEQ ID NO: 1958803 - RNA, 13 nt, Human
uauugauguuuuc

SEQ ID NO: 1958804 - RNA, 14 nt, Human
uauugauguuuuca

SEQ ID NO: 1958805 - RNA, 20 nt, Human
uauuggccauaagcaacaau

SEQ ID NO: 1958806 - RNA, 22 nt, Human
uauuggccauaagcaacaauuu

SEQ ID NO: 1958807 - RNA, 17 nt, Human
uauugcugauggugcaa

SEQ ID NO: 1958808 - RNA, 22 nt, Human
uauuggaaauuuguuauaauga

SEQ ID NO: 1958809 - RNA, 12 nt, Human
uauuguuuucag

SEQ ID NO: 1958810 - RNA, 20 nt, Human
uauuguuuucaguguacaug

SEQ ID NO: 1958811 - RNA, 18 nt, Human
uauuguuuucaguguaca

SEQ ID NO: 1958812 - RNA, 22 nt, Human
uauuguuuucaguguacaugga

SEQ ID NO: 1958813 - RNA, 19 nt, Human
uauuuaaaaacaaaaggca

SEQ ID NO: 1958814 - RNA, 13 nt, Human
uauuuaaaaacaa

SEQ ID NO: 1958815 - RNA, 15 nt, Human
uauuuaaaauguaaa

SEQ ID NO: 1958816 - RNA, 13 nt, Human
uauuuaaaaugua

SEQ ID NO: 1958817 - RNA, 24 nt, Human
uauuuauaaaaauaaaaaacacug

SEQ ID NO: 1958818 - RNA, 13 nt, Human
uauuuaaagaaau

SEQ ID NO: 1958819 - RNA, 19 nt, Human
uauuuaaagaaauauguau

SEQ ID NO: 1958820 - RNA, 19 nt, Human
uauuccugcccugcuguuu

SEQ ID NO: 1958821 - RNA, 17 nt, Human
uauuccugcauuuguga

SEQ ID NO: 1958822 - RNA, 19 nt, Human
uauuccugcauuugugaaa

SEQ ID NO: 1958823 - RNA, 20 nt, Human
uauuccugcauuugugaaau

SEQ ID NO: 1958824 - RNA, 21 nt, Human
uauuccugcauuugugaaaug

SEQ ID NO: 1958825 - RNA, 20 nt, Human
uauuccucuugcauuucacu

SEQ ID NO: 1958826 - RNA, 13 nt, Human
uauucuaauaagc

SEQ ID NO: 1958827 - RNA, 15 nt, Human
uauucuaauaagcua

SEQ ID NO: 1958828 - RNA, 17 nt, Human
uauucuaauaagcuagu

SEQ ID NO: 1958829 - RNA, 20 nt, Human
uauucuaauaagcuaguuga

SEQ ID NO: 1958830 - RNA, 12 nt, Human
uauucuauuuua

SEQ ID NO: 1958831 - RNA, 14 nt, Human
uauucuauuuuaca

SEQ ID NO: 1958832 - RNA, 15 nt, Human
uauucuauuuuacaa

SEQ ID NO: 1958833 - RNA, 17 nt, Human
uauucuauuuuacaacu

SEQ ID NO: 1958834 - RNA, 12 nt, Human
uauucccaugag

SEQ ID NO: 1958835 - RNA, 19 nt, Human
uauuccccacccuccccuu

SEQ ID NO: 1958836 - RNA, 22 nt, Human
uauuccccacccuccccuuccc

SEQ ID NO: 1958837 - RNA, 14 nt, Human
uauuccauauuaga

SEQ ID NO: 1958838 - RNA, 19 nt, Human
uauuccauauuagaaaacu

SEQ ID NO: 1958839 - RNA, 20 nt, Human
uauuccauauuagaaaacuu

SEQ ID NO: 1958840 - RNA, 23 nt, Human
uauuccauauuagaaaacuuugu

SEQ ID NO: 1958841 - RNA, 12 nt, Human
uauuccagagcu

SEQ ID NO: 1958842 - RNA, 17 nt, Human
uauuccagagcugccag

SEQ ID NO: 1958843 - RNA, 15 nt, Human
uauuacaauauuugu

SEQ ID NO: 1958844 - RNA, 19 nt, Human
uauuacaauauuugugugc

SEQ ID NO: 1958845 - RNA, 12 nt, Human
uauuacaauauu

SEQ ID NO: 1958846 - RNA, 13 nt, Human
uauuacaauauuu

SEQ ID NO: 1958847 - RNA, 14 nt, Human
uauuacaauauuug

SEQ ID NO: 1958848 - RNA, 11 nt, Human
uauuauuaaug

SEQ ID NO: 1958849 - RNA, 14 nt, Human
uauuauuaaugcuu

SEQ ID NO: 1958850 - RNA, 15 nt, Human
uauuauuaaugcuuu

SEQ ID NO: 1958851 - RNA, 16 nt, Human
uauuauuaaugcuuug

SEQ ID NO: 1958852 - RNA, 15 nt, Human
gggaguggccacaga

SEQ ID NO: 1958853 - RNA, 13 nt, Human
gggaguggccaca

SEQ ID NO: 1958854 - RNA, 23 nt, Human
uauguaaaaauaaccuugcagaa

SEQ ID NO: 1958855 - RNA, 20 nt, Human
uauguaaaugguaugucauu

SEQ ID NO: 1958856 - RNA, 15 nt, Human
uauguaaauaauucu

SEQ ID NO: 1958857 - RNA, 21 nt, Human
uauguaaaugguaugucauuc

SEQ ID NO: 1958858 - RNA, 16 nt, Human
uauguaaacaaaucuu

SEQ ID NO: 1958859 - RNA, 17 nt, Human
uauguaaacaaaucuuu

SEQ ID NO: 1958860 - RNA, 21 nt, Human
uauguaaacaaaucuuuccau

SEQ ID NO: 1958861 - RNA, 23 nt, Human
uauguaaacaaaucuuuccauau

SEQ ID NO: 1958862 - RNA, 13 nt, Human
uauguaaauaauu

SEQ ID NO: 1958863 - RNA, 14 nt, Human
uauguaaauaauuc

SEQ ID NO: 1958864 - RNA, 17 nt, Human
uauguaaauaauucuuu

SEQ ID NO: 1958865 - RNA, 15 nt, Human
uauguauaauucaaa

SEQ ID NO: 1958866 - RNA, 13 nt, Human
uauguauacaugu

SEQ ID NO: 1958867 - RNA, 14 nt, Human
uauguauacaugug

SEQ ID NO: 1958868 - RNA, 21 nt, Human
uauguauacaugugccaugcu

SEQ ID NO: 1958869 - RNA, 16 nt, Human
uauguaugguuugaaa

SEQ ID NO: 1958870 - RNA, 17 nt, Human
uauguaugguuugaaaa

SEQ ID NO: 1958871 - RNA, 13 nt, Human
uauguauguguuu

SEQ ID NO: 1958872 - RNA, 15 nt, Human
uauguauguguuuag

SEQ ID NO: 1958873 - RNA, 16 nt, Human
uauguauguguuuaga

SEQ ID NO: 1958874 - RNA, 17 nt, Human
uauguauguguuuagaa

SEQ ID NO: 1958875 - RNA, 20 nt, Human
uauguauguguuuagaauug

SEQ ID NO: 1958876 - RNA, 21 nt, Human
uauguauguguuuagaauuga

SEQ ID NO: 1958877 - RNA, 22 nt, Human
uauguauguguuuagaauugaa

SEQ ID NO: 1958878 - RNA, 14 nt, Human
uauguacuacauga

SEQ ID NO: 1958879 - RNA, 15 nt, Human
uauguagacaauaua

SEQ ID NO: 1958880 - RNA, 17 nt, Human
uauguacauuucuaagu

SEQ ID NO: 1958881 - RNA, 21 nt, Human
uauguacauuucuaagucaaa

SEQ ID NO: 1958882 - RNA, 13 nt, Human
uauguacauuucu

SEQ ID NO: 1958883 - RNA, 14 nt, Human
uauguacauuucua

SEQ ID NO: 1958884 - RNA, 15 nt, Human
uauguacauuucuaa

SEQ ID NO: 1958885 - RNA, 16 nt, Human
uauguacauuucuaag

SEQ ID NO: 1958886 - RNA, 16 nt, Human
uauguugcauagaaua

SEQ ID NO: 1958887 - RNA, 13 nt, Human
uauguugcccagg

SEQ ID NO: 1958888 - RNA, 16 nt, Human
uauguugcccaggcag

SEQ ID NO: 1958889 - RNA, 19 nt, Human
uauguugcccaggcagguc

SEQ ID NO: 1958890 - RNA, 23 nt, Human
uauguuuaaaguaauuguuccag

SEQ ID NO: 1958891 - RNA, 16 nt, Human
uauguuguuuuguaca

SEQ ID NO: 1958892 - RNA, 22 nt, Human
uauguuuaaaguaauuguucca

SEQ ID NO: 1958893 - RNA, 20 nt, Human
uauguugcccaggcaggucu

SEQ ID NO: 1958894 - RNA, 13 nt, Human
uauguugacauuu

SEQ ID NO: 1958895 - RNA, 14 nt, Human
uauguugacauuug

SEQ ID NO: 1958896 - RNA, 16 nt, Human
uaugucauuucauguc

SEQ ID NO: 1958897 - RNA, 12 nt, Human
uaugucauuuca

SEQ ID NO: 1958898 - RNA, 13 nt, Human
uaugucauuucau

SEQ ID NO: 1958899 - RNA, 15 nt, Human
uaugucauuucaugu

SEQ ID NO: 1958900 - RNA, 12 nt, Human
uauguugcauag

SEQ ID NO: 1958901 - RNA, 15 nt, Human
uauguugacauuugu

SEQ ID NO: 1958902 - RNA, 16 nt, Human
uauguugacauuuguu

SEQ ID NO: 1958903 - RNA, 14 nt, Human
uauguugauaaaag

SEQ ID NO: 1958904 - RNA, 22 nt, Human
uauguauuaacacuacucaaag

SEQ ID NO: 1958905 - RNA, 13 nt, Human
uauguauucugua

SEQ ID NO: 1958906 - RNA, 16 nt, Human
uauguauucuguaaaa

SEQ ID NO: 1958907 - RNA, 14 nt, Human
uauguauuaacacu

SEQ ID NO: 1958908 - RNA, 22 nt, Human
uauguuugccacuuugcaaagg

SEQ ID NO: 1958909 - RNA, 19 nt, Human
uauguuuguacaagauugu

SEQ ID NO: 1958910 - RNA, 12 nt, Human
uauuaaauuaug

SEQ ID NO: 1958911 - RNA, 12 nt, Human
uauuaaauuaca

SEQ ID NO: 1958912 - RNA, 14 nt, Human
uauuaaauuacauu

SEQ ID NO: 1958913 - RNA, 20 nt, Human
uauuaaauuacauuuguaau

SEQ ID NO: 1958914 - RNA, 22 nt, Human
uauuaaauuacauuuguaauuu

SEQ ID NO: 1958915 - RNA, 24 nt, Human
uauuaagaaagacuaucuaaaugu

SEQ ID NO: 1958916 - RNA, 23 nt, Human
uauuaaauuuuuuuguaugaaaa

SEQ ID NO: 1958917 - RNA, 17 nt, Human
uauuaaauuuuuuugua

SEQ ID NO: 1958918 - RNA, 18 nt, Human
uauuaaauuuuuuuguau

SEQ ID NO: 1958919 - RNA, 20 nt, Human
uauuaaauuuuuuuguauga

SEQ ID NO: 1958920 - RNA, 21 nt, Human
uauuaaauuuuuuuguaugaa

SEQ ID NO: 1958921 - RNA, 22 nt, Human
uauuaaauuuuuuuguaugaaa

SEQ ID NO: 1958922 - RNA, 18 nt, Human
uauuaagauuauaauugu

SEQ ID NO: 1958923 - RNA, 17 nt, Human
uauuaagauuauaauug

SEQ ID NO: 1958924 - RNA, 12 nt, Human
uauuaaucacug

SEQ ID NO: 1958925 - RNA, 13 nt, Human
uauuaaucacugu

SEQ ID NO: 1958926 - RNA, 14 nt, Human
uauuaaucacugug

SEQ ID NO: 1958927 - RNA, 15 nt, Human
uauuaaucacugugu

SEQ ID NO: 1958928 - RNA, 16 nt, Human
uauuaaucacugugua

SEQ ID NO: 1958929 - RNA, 17 nt, Human
uauuaaucacuguguau

SEQ ID NO: 1958930 - RNA, 19 nt, Human
uauuaaucacuguguauau

SEQ ID NO: 1958931 - RNA, 20 nt, Human
uauuaaucacuguguauauu

SEQ ID NO: 1958932 - RNA, 22 nt, Human
uauuaaucacuguguauauuug

SEQ ID NO: 1958933 - RNA, 23 nt, Human
uauuaaucacuguguauauuuga

SEQ ID NO: 1958934 - RNA, 17 nt, Human
uauuaaucagaagaaaa

SEQ ID NO: 1958935 - RNA, 18 nt, Human
uccaggagcagccacauu

SEQ ID NO: 1958936 - RNA, 17 nt, Human
uccaggagcagccacau

SEQ ID NO: 1958937 - RNA, 22 nt, Human
uccaggagcagccacauuccug

SEQ ID NO: 1958938 - RNA, 23 nt, Human
uccaggggugggacacccuguga

SEQ ID NO: 1958939 - RNA, 15 nt, Human
uccaggugcacaagc

SEQ ID NO: 1958940 - RNA, 22 nt, Human
uccaggugcacaagcuccaagc

SEQ ID NO: 1958941 - RNA, 21 nt, Human
uccaggugcacaagcuccaag

SEQ ID NO: 1958942 - RNA, 20 nt, Human
uccaggugcacaagcuccaa

SEQ ID NO: 1958943 - RNA, 18 nt, Human
uccaggugcacaagcucc

SEQ ID NO: 1958944 - RNA, 14 nt, Human
uccagguggcauca

SEQ ID NO: 1958945 - RNA, 11 nt, Human
uccaggguggu

SEQ ID NO: 1958946 - RNA, 15 nt, Human
uccagguucagcuug

SEQ ID NO: 1958947 - RNA, 16 nt, Human
uccagguucagcuugu

SEQ ID NO: 1958948 - RNA, 18 nt, Human
uccagcucaccagcccca

SEQ ID NO: 1958949 - RNA, 16 nt, Human
uccagcucaccagccc

SEQ ID NO: 1958950 - RNA, 17 nt, Human
uccagcucaccagcccc

SEQ ID NO: 1958951 - RNA, 16 nt, Human
uccaggagcagccaca

SEQ ID NO: 1958952 - RNA, 17 nt, Human
uccagcuguucagcugg

SEQ ID NO: 1958953 - RNA, 15 nt, Human
uccacuuggucugug

SEQ ID NO: 1958954 - RNA, 16 nt, Human
uccacuuggucuguga

SEQ ID NO: 1958955 - RNA, 15 nt, Human
uccaccuucccaugc

SEQ ID NO: 1958956 - RNA, 15 nt, Human
uccaccugccaggga

SEQ ID NO: 1958957 - RNA, 17 nt, Human
uccaccugccagggaca

SEQ ID NO: 1958958 - RNA, 21 nt, Human
uccaccugccagggacagagg

SEQ ID NO: 1958959 - RNA, 18 nt, Human
uccaccugccagggacag

SEQ ID NO: 1958960 - RNA, 18 nt, Human
uccaccugcucugcugau

SEQ ID NO: 1958961 - RNA, 14 nt, Human
uccaccugcucugc

SEQ ID NO: 1958962 - RNA, 15 nt, Human
uccaccugcucugcu

SEQ ID NO: 1958963 - RNA, 16 nt, Human
uccaccugcucugcug

SEQ ID NO: 1958964 - RNA, 17 nt, Human
uccaccugcucugcuga

SEQ ID NO: 1958965 - RNA, 17 nt, Human
uccacagaggacacaga

SEQ ID NO: 1958966 - RNA, 19 nt, Human
uccacagaggacacagaga

SEQ ID NO: 1958967 - RNA, 15 nt, Human
uccacagaggacaca

SEQ ID NO: 1958968 - RNA, 12 nt, Human
uccacccugcuc

SEQ ID NO: 1958969 - RNA, 18 nt, Human
uccacaagagcccaggcc

SEQ ID NO: 1958970 - RNA, 15 nt, Human
uccacaagagcccag

SEQ ID NO: 1958971 - RNA, 17 nt, Human
uccacaagagcccaggc

SEQ ID NO: 1958972 - RNA, 16 nt, Human
uccacaagagcccagg

SEQ ID NO: 1958973 - RNA, 13 nt, Human
uccacacacacaa

SEQ ID NO: 1958974 - RNA, 14 nt, Human
uccacacacacaaa

SEQ ID NO: 1958975 - RNA, 18 nt, Human
uccacacacacaaaaaaa

SEQ ID NO: 1958976 - RNA, 21 nt, Human
uccacacacacaaaaaaagac

SEQ ID NO: 1958977 - RNA, 18 nt, Human
uccacaaguuaaauaaau

SEQ ID NO: 1958978 - RNA, 17 nt, Human
uccacaaguuaaauaaa

SEQ ID NO: 1958979 - RNA, 20 nt, Human
uccaaaauaaaacuuuuuaa

SEQ ID NO: 1958980 - RNA, 18 nt, Human
uccaaaauaaaacuuuuu

SEQ ID NO: 1958981 - RNA, 18 nt, Human
uccaauuuacauacucug

SEQ ID NO: 1958982 - RNA, 17 nt, Human
uccaauuuacauacucu

SEQ ID NO: 1958983 - RNA, 13 nt, Human
uccaauucuccuu

SEQ ID NO: 1958984 - RNA, 15 nt, Human
uccaauucuccuuua

SEQ ID NO: 1958985 - RNA, 13 nt, Human
uccaauuuuccuu

SEQ ID NO: 1958986 - RNA, 15 nt, Human
uccaauuuuccuuca

SEQ ID NO: 1958987 - RNA, 21 nt, Human
ucaucaccaacgucugugcca

SEQ ID NO: 1958988 - RNA, 20 nt, Human
ucaucaccaacgucugugcc

SEQ ID NO: 1958989 - RNA, 19 nt, Human
ucaucaccaacgucugugc

SEQ ID NO: 1958990 - RNA, 15 nt, Human
ucauaggaaguuagc

SEQ ID NO: 1958991 - RNA, 15 nt, Human
ucauacucaccucac

SEQ ID NO: 1958992 - RNA, 21 nt, Human
ucauagcccucacccuggggc

SEQ ID NO: 1958993 - RNA, 16 nt, Human
ucauagcauugucuau

SEQ ID NO: 1958994 - RNA, 20 nt, Human
ucauagcauugucuauuuuu

SEQ ID NO: 1958995 - RNA, 22 nt, Human
ucauagcauugucuauuuuucu

SEQ ID NO: 1958996 - RNA, 21 nt, Human
ucaggugagaagcagaggaag

SEQ ID NO: 1958997 - RNA, 23 nt, Human
ucaggugccucaagagaaggcaa

SEQ ID NO: 1958998 - RNA, 13 nt, Human
ucaggugcugcca

SEQ ID NO: 1958999 - RNA, 14 nt, Human
ucaggugcugccau

SEQ ID NO: 1959000 - RNA, 15 nt, Human
ucaggugcugccauc

SEQ ID NO: 1959001 - RNA, 23 nt, Human
ucaucugagagaggcuaaaaugu

SEQ ID NO: 1959002 - RNA, 13 nt, Human
ucaucugagaaug

SEQ ID NO: 1959003 - RNA, 14 nt, Human
ucaucugagaauga

SEQ ID NO: 1959004 - RNA, 15 nt, Human
ucaucugagaaugaa

SEQ ID NO: 1959005 - RNA, 16 nt, Human
ucaucugagaaugaac

SEQ ID NO: 1959006 - RNA, 19 nt, Human
ucaucugagaaugaacaaa

SEQ ID NO: 1959007 - RNA, 11 nt, Human
ucaucugagag

SEQ ID NO: 1959008 - RNA, 20 nt, Human
ucaucagggaggaaaguuuc

SEQ ID NO: 1959009 - RNA, 15 nt, Human
ucaucagaacagcug

SEQ ID NO: 1959010 - RNA, 16 nt, Human
ucaucagaacagcugu

SEQ ID NO: 1959011 - RNA, 18 nt, Human
ucaucagaacagcuguug

SEQ ID NO: 1959012 - RNA, 21 nt, Human
ucaucagaacagcuguugacu

SEQ ID NO: 1959013 - RNA, 16 nt, Human
ucauaggaaguuagcc

SEQ ID NO: 1959014 - RNA, 13 nt, Human
ucaucagaacagc

SEQ ID NO: 1959015 - RNA, 19 nt, Human
ucaucuugaauuguaagga

SEQ ID NO: 1959016 - RNA, 23 nt, Human
ucaugcuccccugugccagccca

SEQ ID NO: 1959017 - RNA, 24 nt, Human
ucaugcuccccugugccagcccag

SEQ ID NO: 1959018 - RNA, 23 nt, Human
ucaucuuagguuggcaaaaaggc

SEQ ID NO: 1959019 - RNA, 17 nt, Human
ucauuguucaauuccca

SEQ ID NO: 1959020 - RNA, 12 nt, Human
ucauuucaccug

SEQ ID NO: 1959021 - RNA, 18 nt, Human
ucauuucaccugcugcuu

SEQ ID NO: 1959022 - RNA, 15 nt, Human
ucauuguuaaaguaa

SEQ ID NO: 1959023 - RNA, 18 nt, Human
ucauugugaaauuauuca

SEQ ID NO: 1959024 - RNA, 17 nt, Human
ucauugugaaauuauuc

SEQ ID NO: 1959025 - RNA, 15 nt, Human
ucauugugaaauuau

SEQ ID NO: 1959026 - RNA, 12 nt, Human
ucauugugaaau

SEQ ID NO: 1959027 - RNA, 13 nt, Human
ucauuuccugugu

SEQ ID NO: 1959028 - RNA, 16 nt, Human
ucauuuccugugucuu

SEQ ID NO: 1959029 - RNA, 18 nt, Human
ucauuucauccuuucacu

SEQ ID NO: 1959030 - RNA, 15 nt, Human
ucauuucauguccug

SEQ ID NO: 1959031 - RNA, 20 nt, Human
ucauuucauguccuguguca

SEQ ID NO: 1959032 - RNA, 23 nt, Human
ucauuucauguccugugucaguu

SEQ ID NO: 1959033 - RNA, 12 nt, Human
ucauuuccaugu

SEQ ID NO: 1959034 - RNA, 16 nt, Human
ucauuuccauguaugc

SEQ ID NO: 1959035 - RNA, 17 nt, Human
ucauuuccauguaugca

SEQ ID NO: 1959036 - RNA, 21 nt, Human
ucauuuccauguaugcauaau

SEQ ID NO: 1959037 - RNA, 21 nt, Human
ucauucaacccaccugcgucu

SEQ ID NO: 1959038 - RNA, 14 nt, Human
ucauuccagaggaa

SEQ ID NO: 1959039 - RNA, 22 nt, Human
ucauucaccaguacauucucag

SEQ ID NO: 1959040 - RNA, 17 nt, Human
ucauucaccaguacauu

SEQ ID NO: 1959041 - RNA, 23 nt, Human
ucauuccaccuucccaugcccug

SEQ ID NO: 1959042 - RNA, 14 nt, Human
ucauuaguuuugaa

SEQ ID NO: 1959043 - RNA, 23 nt, Human
ucauuaguuuugaagauucuaug

SEQ ID NO: 1959044 - RNA, 13 nt, Human
ucaugcugccccu

SEQ ID NO: 1959045 - RNA, 17 nt, Human
ucaugcugccccugccu

SEQ ID NO: 1959046 - RNA, 18 nt, Human
ucaugcugccccugccuu

SEQ ID NO: 1959047 - RNA, 16 nt, Human
ucauuauguuaauauu

SEQ ID NO: 1959048 - RNA, 17 nt, Human
ucauuauguuaauauuu

SEQ ID NO: 1959049 - RNA, 15 nt, Human
ucagauaugauucaa

SEQ ID NO: 1959050 - RNA, 17 nt, Human
ucagcauucucacuccu

SEQ ID NO: 1959051 - RNA, 20 nt, Human
ucagcauucucacuccuacc

SEQ ID NO: 1959052 - RNA, 19 nt, Human
ucagcauuaccucuuugga

SEQ ID NO: 1959053 - RNA, 20 nt, Human
ucagcauuaccucuuuggaa

SEQ ID NO: 1959054 - RNA, 20 nt, Human
ucagccucccgaguagcugg

SEQ ID NO: 1959055 - RNA, 18 nt, Human
ucagccucccgaguagcu

SEQ ID NO: 1959056 - RNA, 21 nt, Human
ucagccucccgaauagcuggg

SEQ ID NO: 1959057 - RNA, 22 nt, Human
ucagccucccgaauagcuggga

SEQ ID NO: 1959058 - RNA, 14 nt, Human
ucagccucccaaag

SEQ ID NO: 1959059 - RNA, 23 nt, Human
ucagcauucucacuccuaccugg

SEQ ID NO: 1959060 - RNA, 19 nt, Human
ucagccucccaaagugcug

SEQ ID NO: 1959061 - RNA, 21 nt, Human
ucagccucccaaagugcuggg

SEQ ID NO: 1959062 - RNA, 13 nt, Human
ucagccucgcagg

SEQ ID NO: 1959063 - RNA, 23 nt, Human
ucagccucgcaggccucccugcc

SEQ ID NO: 1959064 - RNA, 16 nt, Human
ucagcugaaccugggu

SEQ ID NO: 1959065 - RNA, 15 nt, Human
ucagcugaaccuggg

SEQ ID NO: 1959066 - RNA, 19 nt, Human
ucagccugcuccagcuguu

SEQ ID NO: 1959067 - RNA, 18 nt, Human
ucagccugcuccagcugu

SEQ ID NO: 1959068 - RNA, 22 nt, Human
ucagccuccugaguagcuggga

SEQ ID NO: 1959069 - RNA, 20 nt, Human
ucagccuccugaguagcugg

SEQ ID NO: 1959070 - RNA, 17 nt, Human
ucagcauuagugggaaa

SEQ ID NO: 1959071 - RNA, 23 nt, Human
ucagcauuagugggaaaaagugg

SEQ ID NO: 1959072 - RNA, 21 nt, Human
ucagccucccgaguagcuggg

SEQ ID NO: 1959073 - RNA, 22 nt, Human
ucagccucccgaguagcuggga

SEQ ID NO: 1959074 - RNA, 23 nt, Human
ucaggagcccugggaggcucugg

SEQ ID NO: 1959075 - RNA, 20 nt, Human
ucaggagcccugggaggcuc

SEQ ID NO: 1959076 - RNA, 18 nt, Human
ucaggagcuccauacaca

SEQ ID NO: 1959077 - RNA, 18 nt, Human
ucaggagcccugggaggc

SEQ ID NO: 1959078 - RNA, 19 nt, Human
ucaggagcccugggaggcu

SEQ ID NO: 1959079 - RNA, 14 nt, Human
ucagcugagccuuc

SEQ ID NO: 1959080 - RNA, 18 nt, Human
ucagcugagccuucugag

SEQ ID NO: 1959081 - RNA, 12 nt, Human
ucagcugagccu

SEQ ID NO: 1959082 - RNA, 21 nt, Human
ucagcugagccuucugagcug

SEQ ID NO: 1959083 - RNA, 12 nt, Human
ucaggcucccag

SEQ ID NO: 1959084 - RNA, 13 nt, Human
ucaggcucccagg

SEQ ID NO: 1959085 - RNA, 15 nt, Human
ucaggcucucugggc

SEQ ID NO: 1959086 - RNA, 17 nt, Human
ucaggcucucugggcug

SEQ ID NO: 1959087 - RNA, 17 nt, Human
ucaggauuuccucuuga

SEQ ID NO: 1959088 - RNA, 18 nt, Human
ucaggauuuccucuugaa

SEQ ID NO: 1959089 - RNA, 16 nt, Human
ucaggugagaagcaga

SEQ ID NO: 1959090 - RNA, 15 nt, Human
ucaggugagaagcag

SEQ ID NO: 1959091 - RNA, 16 nt, Human
ucagggccuggcucag

SEQ ID NO: 1959092 - RNA, 14 nt, Human
ucagggccuggcuc

SEQ ID NO: 1959093 - RNA, 14 nt, Human
ucagggcagauuuu

SEQ ID NO: 1959094 - RNA, 18 nt, Human
ucagggcagauuuuaguu

SEQ ID NO: 1959095 - RNA, 23 nt, Human
ucagggaaaagcagcucuccccu

SEQ ID NO: 1959096 - RNA, 19 nt, Human
ucagggaaaagcagcucuc

SEQ ID NO: 1959097 - RNA, 18 nt, Human
ucagggaaaagcagcucu

SEQ ID NO: 1959098 - RNA, 16 nt, Human
ucagggaaaagcagcu

SEQ ID NO: 1959099 - RNA, 23 nt, Human
ucaggcugucaguguuuggugca

SEQ ID NO: 1959100 - RNA, 21 nt, Human
ucagggagcagggaaggccug

SEQ ID NO: 1959101 - RNA, 23 nt, Human
ucagggagcagggaaggccugac

SEQ ID NO: 1959102 - RNA, 13 nt, Human
ucagggaaagcau

SEQ ID NO: 1959103 - RNA, 22 nt, Human
ucagggaaagcauuuaaagggu

SEQ ID NO: 1959104 - RNA, 22 nt, Human
ucagaguaauccaagcaaaugu

SEQ ID NO: 1959105 - RNA, 21 nt, Human
ucagaguaauccaagcaaaug

SEQ ID NO: 1959106 - RNA, 16 nt, Human
ucagagaaaugucugu

SEQ ID NO: 1959107 - RNA, 17 nt, Human
ucagagaaaugucuguc

SEQ ID NO: 1959108 - RNA, 12 nt, Human
ucagacuguaua

SEQ ID NO: 1959109 - RNA, 16 nt, Human
ucagacugcuuugaga

SEQ ID NO: 1959110 - RNA, 17 nt, Human
ucagacgacagccccug

SEQ ID NO: 1959111 - RNA, 13 nt, Human
ucagacagcugcc

SEQ ID NO: 1959112 - RNA, 14 nt, Human
ucagacagcugccu

SEQ ID NO: 1959113 - RNA, 15 nt, Human
ucagaaauguguuau

SEQ ID NO: 1959114 - RNA, 23 nt, Human
ucagaauucucuaguuugauuaa

SEQ ID NO: 1959115 - RNA, 16 nt, Human
ucagaauucucuaguu

SEQ ID NO: 1959116 - RNA, 20 nt, Human
ucacuuguuuuauuuaaccu

SEQ ID NO: 1959117 - RNA, 24 nt, Human
ucagaaacaaagcauuugacuuuc

SEQ ID NO: 1959118 - RNA, 14 nt, Human
ucacuuuauuucau

SEQ ID NO: 1959119 - RNA, 15 nt, Human
ucacuuuauuucauu

SEQ ID NO: 1959120 - RNA, 10 nt, Human
ucagaaaugu

SEQ ID NO: 1959121 - RNA, 16 nt, Human
ucagaaacaauuucug

SEQ ID NO: 1959122 - RNA, 16 nt, Human
ucagaaacuaaaacaa

SEQ ID NO: 1959123 - RNA, 11 nt, Human
ucacugcuuca

SEQ ID NO: 1959124 - RNA, 14 nt, Human
ucacugcuuaacuu

SEQ ID NO: 1959125 - RNA, 17 nt, Human
ucacugcuggcugccuu

SEQ ID NO: 1959126 - RNA, 18 nt, Human
ucacugcuggcugccuua

SEQ ID NO: 1959127 - RNA, 22 nt, Human
ucacugcuggcugccuuagaac

SEQ ID NO: 1959128 - RNA, 13 nt, Human
ucacugcuggcug

SEQ ID NO: 1959129 - RNA, 14 nt, Human
ucacugcuggcugc

SEQ ID NO: 1959130 - RNA, 15 nt, Human
ucacugcuggcugcc

SEQ ID NO: 1959131 - RNA, 16 nt, Human
ucacugcuggcugccu

SEQ ID NO: 1959132 - RNA, 12 nt, Human
ucacugcuggcu

SEQ ID NO: 1959133 - RNA, 17 nt, Human
ucacucuuauugcccac

SEQ ID NO: 1959134 - RNA, 13 nt, Human
ucaccagccccag

SEQ ID NO: 1959135 - RNA, 16 nt, Human
ucaccagccccagugc

SEQ ID NO: 1959136 - RNA, 18 nt, Human
ucacugcauccuccgccu

SEQ ID NO: 1959137 - RNA, 20 nt, Human
ucacucuuauugcccacgcu

SEQ ID NO: 1959138 - RNA, 19 nt, Human
ucacugcauccuccgccuc

SEQ ID NO: 1959139 - RNA, 19 nt, Human
ucacugcuaagaauauuug

SEQ ID NO: 1959140 - RNA, 13 nt, Human
ucacugccucccc

SEQ ID NO: 1959141 - RNA, 18 nt, Human
ucacugccaugccagcuu

SEQ ID NO: 1959142 - RNA, 23 nt, Human
gcuccuggggguucuuucuuccu

SEQ ID NO: 1959143 - RNA, 14 nt, Human
gcuccucccggugc

SEQ ID NO: 1959144 - RNA, 24 nt, Human
gcuccgcuuucuacccagcgagcc

SEQ ID NO: 1959145 - RNA, 22 nt, Human
gcuccggcguguguucaguguu

SEQ ID NO: 1959146 - RNA, 23 nt, Human
gcuccggcguguguucaguguua

SEQ ID NO: 1959147 - RNA, 21 nt, Human
gcuccgggacguggcaccucc

SEQ ID NO: 1959148 - RNA, 22 nt, Human
gcuccgggacguggcaccuccu

SEQ ID NO: 1959149 - RNA, 15 nt, Human
gcuccgggcuccgac

SEQ ID NO: 1959150 - RNA, 12 nt, Human
gcuccgucugac

SEQ ID NO: 1959151 - RNA, 12 nt, Human
gcuccugugucu

SEQ ID NO: 1959152 - RNA, 13 nt, Human
gcuccugugucuu

SEQ ID NO: 1959153 - RNA, 20 nt, Human
gcuccuuccucugaggcuga

SEQ ID NO: 1959154 - RNA, 22 nt, Human
gcuccuuccucugaggcugaaa

SEQ ID NO: 1959155 - RNA, 18 nt, Human
gcuccuuccucugaggcu

SEQ ID NO: 1959156 - RNA, 15 nt, Human
gcuccuucccuugcu

SEQ ID NO: 1959157 - RNA, 19 nt, Human
gcuccuucccuugcuacca

SEQ ID NO: 1959158 - RNA, 22 nt, Human
gcuccuucaacaaggcuugcug

SEQ ID NO: 1959159 - RNA, 19 nt, Human
gcuccuuaggguuuucucu

SEQ ID NO: 1959160 - RNA, 21 nt, Human
gcuccuuaggguuuucucucu

SEQ ID NO: 1959161 - RNA, 22 nt, Human
gcuccuuaggguuuucucucua

SEQ ID NO: 1959162 - RNA, 21 nt, Human
gcuccuucaacaaggcuugcu

SEQ ID NO: 1959163 - RNA, 13 nt, Human
gcuccuucugucc

SEQ ID NO: 1959164 - RNA, 17 nt, Human
gcuccuuuagcgcccag

SEQ ID NO: 1959165 - RNA, 19 nt, Human
gcucgagcaugccuggaug

SEQ ID NO: 1959166 - RNA, 21 nt, Human
gcucgagcaugccuggauggg

SEQ ID NO: 1959167 - RNA, 12 nt, Human
gcuccuuucuga

SEQ ID NO: 1959168 - RNA, 18 nt, Human
gcucauucagcaucugac

SEQ ID NO: 1959169 - RNA, 22 nt, Human
gcucauucagcaucugaccucu

SEQ ID NO: 1959170 - RNA, 16 nt, Human
gcucauucagcaucug

SEQ ID NO: 1959171 - RNA, 21 nt, Human
gcuccagcuguucagcugguu

SEQ ID NO: 1959172 - RNA, 14 nt, Human
gcuccaggagcagc

SEQ ID NO: 1959173 - RNA, 12 nt, Human
gcuccaggagca

SEQ ID NO: 1959174 - RNA, 11 nt, Human
gcuccaggagc

SEQ ID NO: 1959175 - RNA, 18 nt, Human
gcuccaggagcagccaca

SEQ ID NO: 1959176 - RNA, 17 nt, Human
gcuccaggagcagccac

SEQ ID NO: 1959177 - RNA, 16 nt, Human
gcuccaggagcagcca

SEQ ID NO: 1959178 - RNA, 15 nt, Human
gcuccaggagcagcc

SEQ ID NO: 1959179 - RNA, 17 nt, Human
gcuccaggccagggggc

SEQ ID NO: 1959180 - RNA, 12 nt, Human
gcuccaggcagc

SEQ ID NO: 1959181 - RNA, 15 nt, Human
gcuccaggcagcacc

SEQ ID NO: 1959182 - RNA, 20 nt, Human
gcuccaggcagcacccaggu

SEQ ID NO: 1959183 - RNA, 18 nt, Human
gcuccaggccagggggcc

SEQ ID NO: 1959184 - RNA, 22 nt, Human
gcuccaggcagcacccagguuu

SEQ ID NO: 1959185 - RNA, 12 nt, Human
gcuccaggcucc

SEQ ID NO: 1959186 - RNA, 20 nt, Human
gcucccuucccaccucucuc

SEQ ID NO: 1959187 - RNA, 18 nt, Human
gcucccuugaccugcuga

SEQ ID NO: 1959188 - RNA, 22 nt, Human
gcuccgacuugugcacaggcag

SEQ ID NO: 1959189 - RNA, 23 nt, Human
gcuccgacuugugcacaggcaga

SEQ ID NO: 1959190 - RNA, 18 nt, Human
gcuccgcuuucuacccag

SEQ ID NO: 1959191 - RNA, 21 nt, Human
gcuccgcuuucuacccagcga

SEQ ID NO: 1959192 - RNA, 22 nt, Human
gcuccgcuuucuacccagcgag

SEQ ID NO: 1959193 - RNA, 23 nt, Human
gcuccgcuuucuacccagcgagc

SEQ ID NO: 1959194 - RNA, 15 nt, Human
gcucccacaggcccu

SEQ ID NO: 1959195 - RNA, 18 nt, Human
gcuccaguccccagaacu

SEQ ID NO: 1959196 - RNA, 18 nt, Human
gcucaccucucccuugga

SEQ ID NO: 1959197 - RNA, 17 nt, Human
gcucaccucucccuugg

SEQ ID NO: 1959198 - RNA, 16 nt, Human
gcucaccucucccuug

SEQ ID NO: 1959199 - RNA, 14 nt, Human
gcucaccucucccu

SEQ ID NO: 1959200 - RNA, 15 nt, Human
gcucagcccucccug

SEQ ID NO: 1959201 - RNA, 16 nt, Human
gcucagcccucccugc

SEQ ID NO: 1959202 - RNA, 12 nt, Human
gcucagcccucc

SEQ ID NO: 1959203 - RNA, 22 nt, Human
gcucacagaacccuuggagcca

SEQ ID NO: 1959204 - RNA, 16 nt, Human
gcucacauaucuguca

SEQ ID NO: 1959205 - RNA, 12 nt, Human
gcucaccagccc

SEQ ID NO: 1959206 - RNA, 13 nt, Human
gcucaccagcccc

SEQ ID NO: 1959207 - RNA, 14 nt, Human
gcucaccagcccca

SEQ ID NO: 1959208 - RNA, 15 nt, Human
gcucaccagccccag

SEQ ID NO: 1959209 - RNA, 16 nt, Human
gcucagcggggacagc

SEQ ID NO: 1959210 - RNA, 17 nt, Human
gcucagcccucccugcc

SEQ ID NO: 1959211 - RNA, 18 nt, Human
gcucagcccucccugccc

SEQ ID NO: 1959212 - RNA, 19 nt, Human
gcucagcccucccugcccc

SEQ ID NO: 1959213 - RNA, 21 nt, Human
gcucagcccucccugccccuc

SEQ ID NO: 1959214 - RNA, 17 nt, Human
gcucagcggggacagcu

SEQ ID NO: 1959215 - RNA, 18 nt, Human
gcucagcggggacagcuc

SEQ ID NO: 1959216 - RNA, 19 nt, Human
gcucagcggggacagcucc

SEQ ID NO: 1959217 - RNA, 23 nt, Human
gcucagcggggacagcuccuucu

SEQ ID NO: 1959218 - RNA, 19 nt, Human
gcucagcugucaaggcuca

SEQ ID NO: 1959219 - RNA, 15 nt, Human
gcucaucagaaacaa

SEQ ID NO: 1959220 - RNA, 22 nt, Human
gcucaucagaaacaauuucugu

SEQ ID NO: 1959221 - RNA, 18 nt, Human
gcucauggacuucugcca

SEQ ID NO: 1959222 - RNA, 13 nt, Human
gcuaucuccccca

SEQ ID NO: 1959223 - RNA, 17 nt, Human
gcuaucguaaaauuaag

SEQ ID NO: 1959224 - RNA, 16 nt, Human
gcuaucguaaaauuaa

SEQ ID NO: 1959225 - RNA, 15 nt, Human
gcuaucguaaaauua

SEQ ID NO: 1959226 - RNA, 15 nt, Human
gcuaucucccccagc

SEQ ID NO: 1959227 - RNA, 14 nt, Human
gcuaucucccccag

SEQ ID NO: 1959228 - RNA, 16 nt, Human
gcucaagcccaggagg

SEQ ID NO: 1959229 - RNA, 17 nt, Human
gcucaagcccaggaggg

SEQ ID NO: 1959230 - RNA, 18 nt, Human
gcucaaguccucuuuucu

SEQ ID NO: 1959231 - RNA, 19 nt, Human
gcucaaguccucuuuucug

SEQ ID NO: 1959232 - RNA, 22 nt, Human
gcucaaguccucuuuucugaga

SEQ ID NO: 1959233 - RNA, 20 nt, Human
gcuauaacuauguugauaaa

SEQ ID NO: 1959234 - RNA, 22 nt, Human
gcggugcuaucucccccagccc

SEQ ID NO: 1959235 - RNA, 19 nt, Human
gcggugcuaucucccccag

SEQ ID NO: 1959236 - RNA, 21 nt, Human
gcuaguugggcuuccucauag

SEQ ID NO: 1959237 - RNA, 17 nt, Human
gcuauaaauuauauucc

SEQ ID NO: 1959238 - RNA, 13 nt, Human
gccugaggcuccu

SEQ ID NO: 1959239 - RNA, 12 nt, Human
gccugagcuggg

SEQ ID NO: 1959240 - RNA, 19 nt, Human
gcccaguuggguggaugcc

SEQ ID NO: 1959241 - RNA, 21 nt, Human
gcccaguuggguggaugccug

SEQ ID NO: 1959242 - RNA, 22 nt, Human
gcccaguuggguggaugccugg

SEQ ID NO: 1959243 - RNA, 16 nt, Human
gccugaagucacacag

SEQ ID NO: 1959244 - RNA, 17 nt, Human
gccugagcgacagugag

SEQ ID NO: 1959245 - RNA, 20 nt, Human
gccugagcgacagugagacu

SEQ ID NO: 1959246 - RNA, 17 nt, Human
gccugaagucacacagu

SEQ ID NO: 1959247 - RNA, 18 nt, Human
gccugaagucacacagug

SEQ ID NO: 1959248 - RNA, 18 nt, Human
gccuggauggggcugcac

SEQ ID NO: 1959249 - RNA, 16 nt, Human
gccuggauggggcugc

SEQ ID NO: 1959250 - RNA, 20 nt, Human
gccuggauggggcugcaccg

SEQ ID NO: 1959251 - RNA, 13 nt, Human
gccuggcacaggg

SEQ ID NO: 1959252 - RNA, 14 nt, Human
gccuggcacagggc

SEQ ID NO: 1959253 - RNA, 12 nt, Human
gccugcuccuuc

SEQ ID NO: 1959254 - RNA, 13 nt, Human
gccugcuccuucc

SEQ ID NO: 1959255 - RNA, 14 nt, Human
gccugcuccuuccc

SEQ ID NO: 1959256 - RNA, 15 nt, Human
gccugcuccuucccu

SEQ ID NO: 1959257 - RNA, 20 nt, Human
gccugcuccuucccuugcua

SEQ ID NO: 1959258 - RNA, 18 nt, Human
gccugcucuuuggccuga

SEQ ID NO: 1959259 - RNA, 17 nt, Human
gccuggaaaccugucug

SEQ ID NO: 1959260 - RNA, 18 nt, Human
gccuggaaaccugucuga

SEQ ID NO: 1959261 - RNA, 14 nt, Human
gccuggucagccca

SEQ ID NO: 1959262 - RNA, 15 nt, Human
gccuggucagcccaa

SEQ ID NO: 1959263 - RNA, 13 nt, Human
gccuggucagccc

SEQ ID NO: 1959264 - RNA, 21 nt, Human
gccugggccguagcuugucug

SEQ ID NO: 1959265 - RNA, 11 nt, Human
gccugggccug

SEQ ID NO: 1959266 - RNA, 13 nt, Human
gccugggccuggc

SEQ ID NO: 1959267 - RNA, 14 nt, Human
gccugggccuggcu

SEQ ID NO: 1959268 - RNA, 15 nt, Human
gccugggccuggcuc

SEQ ID NO: 1959269 - RNA, 16 nt, Human
gccugggccuggcucc

SEQ ID NO: 1959270 - RNA, 17 nt, Human
gccugggccuggcuccc

SEQ ID NO: 1959271 - RNA, 15 nt, Human
gccuguaauccuagc

SEQ ID NO: 1959272 - RNA, 20 nt, Human
gccuguaauccuagcacuuu

SEQ ID NO: 1959273 - RNA, 20 nt, Human
gccugucucggaaccuguga

SEQ ID NO: 1959274 - RNA, 14 nt, Human
gccuggccccucag

SEQ ID NO: 1959275 - RNA, 13 nt, Human
gccuggccccuca

SEQ ID NO: 1959276 - RNA, 12 nt, Human
gccuggcccaug

SEQ ID NO: 1959277 - RNA, 22 nt, Human
gccuggcccauguauggccagg

SEQ ID NO: 1959278 - RNA, 20 nt, Human
gccuggccagaugcaccagc

SEQ ID NO: 1959279 - RNA, 22 nt, Human
gccuggcagccgugccuucagc

SEQ ID NO: 1959280 - RNA, 16 nt, Human
gccuggccagaugcac

SEQ ID NO: 1959281 - RNA, 21 nt, Human
gccuggccagaugcaccagcc

SEQ ID NO: 1959282 - RNA, 22 nt, Human
gccuggccagaugcaccagccc

SEQ ID NO: 1959283 - RNA, 18 nt, Human
gccuggcacagggcagug

SEQ ID NO: 1959284 - RNA, 19 nt, Human
gccuggcacagggcagugg

SEQ ID NO: 1959285 - RNA, 12 nt, Human
gccuggcagccg

SEQ ID NO: 1959286 - RNA, 20 nt, Human
gccuggcagccgugccuuca

SEQ ID NO: 1959287 - RNA, 21 nt, Human
gccuggcagccgugccuucag

SEQ ID NO: 1959288 - RNA, 14 nt, Human
gcgaauuuuaaaag

SEQ ID NO: 1959289 - RNA, 14 nt, Human
gcgaaucauuuguu

SEQ ID NO: 1959290 - RNA, 15 nt, Human
gcgaauuuuaaaaga

SEQ ID NO: 1959291 - RNA, 16 nt, Human
gcgaauuuuaaaagau

SEQ ID NO: 1959292 - RNA, 15 nt, Human
gccuuucuguguuua

SEQ ID NO: 1959293 - RNA, 15 nt, Human
gccuuucauuuugcu

SEQ ID NO: 1959294 - RNA, 18 nt, Human
gccuuucauuuugcuuua

SEQ ID NO: 1959295 - RNA, 22 nt, Human
gccuuucauuuugcuuuaauuu

SEQ ID NO: 1959296 - RNA, 21 nt, Human
gcgacaaugcaaaccaucauu

SEQ ID NO: 1959297 - RNA, 20 nt, Human
gcgacaaugcaaaccaucau

SEQ ID NO: 1959298 - RNA, 13 nt, Human
gcgacaaugcaaa

SEQ ID NO: 1959299 - RNA, 12 nt, Human
gcgacaaugcaa

SEQ ID NO: 1959300 - RNA, 18 nt, Human
gcgcaggcuggcccugcc

SEQ ID NO: 1959301 - RNA, 19 nt, Human
gcgcaggcuggcccugccc

SEQ ID NO: 1959302 - RNA, 17 nt, Human
gcgcaggcuggcccugc

SEQ ID NO: 1959303 - RNA, 17 nt, Human
gccuuucuuuucuuucu

SEQ ID NO: 1959304 - RNA, 13 nt, Human
gcgacaacagauu

SEQ ID NO: 1959305 - RNA, 20 nt, Human
gcgcaggcuggcccugcccu

SEQ ID NO: 1959306 - RNA, 21 nt, Human
gcgcaggcuggcccugcccug

SEQ ID NO: 1959307 - RNA, 22 nt, Human
gcgcaggcuggcccugcccugg

SEQ ID NO: 1959308 - RNA, 15 nt, Human
gccuuacacaauggu

SEQ ID NO: 1959309 - RNA, 13 nt, Human
gccuuaaagacaa

SEQ ID NO: 1959310 - RNA, 22 nt, Human
gccuuaaagacaagacagcauu

SEQ ID NO: 1959311 - RNA, 14 nt, Human
gccuuaagcugcag

SEQ ID NO: 1959312 - RNA, 20 nt, Human
gccuuaagugaggaaaucaa

SEQ ID NO: 1959313 - RNA, 21 nt, Human
gccuuaagugaggaaaucaaa

SEQ ID NO: 1959314 - RNA, 16 nt, Human
gccugucuuaauuuuc

SEQ ID NO: 1959315 - RNA, 19 nt, Human
gccugucugugaagagcaa

SEQ ID NO: 1959316 - RNA, 17 nt, Human
gccugucuuaauuuucu

SEQ ID NO: 1959317 - RNA, 16 nt, Human
gccuuacacaaugguu

SEQ ID NO: 1959318 - RNA, 22 nt, Human
gccuuaagugaggaaaucaaag

SEQ ID NO: 1959319 - RNA, 15 nt, Human
gccuuguuuaauggu

SEQ ID NO: 1959320 - RNA, 23 nt, Human
gccuuguuuaaugguaguuuuac

SEQ ID NO: 1959321 - RNA, 17 nt, Human
gccuuggggucagguug

SEQ ID NO: 1959322 - RNA, 21 nt, Human
gcgcugccccuggcagccccu

SEQ ID NO: 1959323 - RNA, 18 nt, Human
gcgcugccccuggcagcc

SEQ ID NO: 1959324 - RNA, 16 nt, Human
gcggagaaaggaaggg

SEQ ID NO: 1959325 - RNA, 20 nt, Human
gcggacauccccugcuggcc

SEQ ID NO: 1959326 - RNA, 22 nt, Human
gcggacauccccugcuggccgg

SEQ ID NO: 1959327 - RNA, 19 nt, Human
gcggagacggagucccacc

SEQ ID NO: 1959328 - RNA, 14 nt, Human
gcggggacagcucc

SEQ ID NO: 1959329 - RNA, 19 nt, Human
gcggguuauaaugaaugac

SEQ ID NO: 1959330 - RNA, 15 nt, Human
gcggggacagcuccu

SEQ ID NO: 1959331 - RNA, 17 nt, Human
gcggggacagcuccuuc

SEQ ID NO: 1959332 - RNA, 18 nt, Human
gcggugcccaaccacacu

SEQ ID NO: 1959333 - RNA, 19 nt, Human
gcggugagaggggaacaga

SEQ ID NO: 1959334 - RNA, 13 nt, Human
gcgguccacccag

SEQ ID NO: 1959335 - RNA, 14 nt, Human
gcgguccacccagg

SEQ ID NO: 1959336 - RNA, 21 nt, Human
gcgccuuaaggauguucuagc

SEQ ID NO: 1959337 - RNA, 13 nt, Human
gcgcccuggcccc

SEQ ID NO: 1959338 - RNA, 14 nt, Human
gcgcccuggccccc

SEQ ID NO: 1959339 - RNA, 15 nt, Human
gcgcccuggccccca

SEQ ID NO: 1959340 - RNA, 16 nt, Human
gcgcccuggcccccac

SEQ ID NO: 1959341 - RNA, 12 nt, Human
gcgcccuggccc

SEQ ID NO: 1959342 - RNA, 23 nt, Human
gcgcccaguuggguggaugccug

SEQ ID NO: 1959343 - RNA, 13 nt, Human
gcgccccuucccc

SEQ ID NO: 1959344 - RNA, 22 nt, Human
gcgccccgaaaggucaccucac

SEQ ID NO: 1959345 - RNA, 23 nt, Human
gcgcauaggccugcuuugucucc

SEQ ID NO: 1959346 - RNA, 16 nt, Human
gcgcaguugcugucag

SEQ ID NO: 1959347 - RNA, 15 nt, Human
gcuggccuggccccu

SEQ ID NO: 1959348 - RNA, 14 nt, Human
gcuggccuggcccc

SEQ ID NO: 1959349 - RNA, 12 nt, Human
gcuggccuggcc

SEQ ID NO: 1959350 - RNA, 13 nt, Human
gcuggccuggccc

SEQ ID NO: 1959351 - RNA, 21 nt, Human
gcugggcucccuucccaccuc

SEQ ID NO: 1959352 - RNA, 19 nt, Human
gcugggaugauuggagggg

SEQ ID NO: 1959353 - RNA, 15 nt, Human
gcuggccggacaccc

SEQ ID NO: 1959354 - RNA, 22 nt, Human
gcugggcuuggcagcccggguc

SEQ ID NO: 1959355 - RNA, 13 nt, Human
gcugggcugggca

SEQ ID NO: 1959356 - RNA, 14 nt, Human
gcugggcugggcac

SEQ ID NO: 1959357 - RNA, 23 nt, Human
gcuggggaagaauuuacuuugga

SEQ ID NO: 1959358 - RNA, 13 nt, Human
gcuggggaagaau

SEQ ID NO: 1959359 - RNA, 21 nt, Human
gcugggcuucaguggcagcug

SEQ ID NO: 1959360 - RNA, 22 nt, Human
gcugggcuucaguggcagcugc

SEQ ID NO: 1959361 - RNA, 20 nt, Human
gcugggcuucaguggcagcu

SEQ ID NO: 1959362 - RNA, 14 nt, Human
gcuggggaugucuc

SEQ ID NO: 1959363 - RNA, 14 nt, Human
gcugggggccucag

SEQ ID NO: 1959364 - RNA, 15 nt, Human
gcugggggccucagu

SEQ ID NO: 1959365 - RNA, 22 nt, Human
gcuggucaaacaaacucucuga

SEQ ID NO: 1959366 - RNA, 18 nt, Human
gcugggggccucagugcc

SEQ ID NO: 1959367 - RNA, 15 nt, Human
gcuggggcagccucu

SEQ ID NO: 1959368 - RNA, 22 nt, Human
gcuggucguaaacaucucagag

SEQ ID NO: 1959369 - RNA, 14 nt, Human
gcuggucccacuca

SEQ ID NO: 1959370 - RNA, 14 nt, Human
gcuggucacuucuu

SEQ ID NO: 1959371 - RNA, 20 nt, Human
gcuggucacuucuucugucc

SEQ ID NO: 1959372 - RNA, 21 nt, Human
gcuggucacuucuucugucca

SEQ ID NO: 1959373 - RNA, 22 nt, Human
gcuggucacuucuucuguccaa

SEQ ID NO: 1959374 - RNA, 19 nt, Human
gcuggucucgaacuccuga

SEQ ID NO: 1959375 - RNA, 22 nt, Human
gcuggucucgaacuccugaccu

SEQ ID NO: 1959376 - RNA, 23 nt, Human
gcuggucucgaacuccugaccuu

SEQ ID NO: 1959377 - RNA, 23 nt, Human
gcuggucguaaacaucucagaga

SEQ ID NO: 1959378 - RNA, 15 nt, Human
gcugugucucccuuc

SEQ ID NO: 1959379 - RNA, 16 nt, Human
gcugugugcucuccaa

SEQ ID NO: 1959380 - RNA, 16 nt, Human
gcuguguggcagucug

SEQ ID NO: 1959381 - RNA, 23 nt, Human
gcuguuagggguuauugguguaa

SEQ ID NO: 1959382 - RNA, 17 nt, Human
gcuguuacaguuuucuu

SEQ ID NO: 1959383 - RNA, 19 nt, Human
gcuguuacaguuuucuuca

SEQ ID NO: 1959384 - RNA, 14 nt, Human
gcuguguguggcuu

SEQ ID NO: 1959385 - RNA, 17 nt, Human
gcuguguuugcuccccu

SEQ ID NO: 1959386 - RNA, 14 nt, Human
gcuguguuugcucc

SEQ ID NO: 1959387 - RNA, 16 nt, Human
gcuguguuugcucccc

SEQ ID NO: 1959388 - RNA, 15 nt, Human
gcugucauugcuucu

SEQ ID NO: 1959389 - RNA, 16 nt, Human
gcugucauugcuucuu

SEQ ID NO: 1959390 - RNA, 18 nt, Human
gcugucauugcuucuucu

SEQ ID NO: 1959391 - RNA, 20 nt, Human
gcugucauugcuucuucuga

SEQ ID NO: 1959392 - RNA, 14 nt, Human
gcuguccacccgcc

SEQ ID NO: 1959393 - RNA, 16 nt, Human
gcugucccuuuuccuu

SEQ ID NO: 1959394 - RNA, 23 nt, Human
gcugucccuuacgugaguccugg

SEQ ID NO: 1959395 - RNA, 17 nt, Human
gcugucagccauuccug

SEQ ID NO: 1959396 - RNA, 16 nt, Human
gcugucacugcugcuu

SEQ ID NO: 1959397 - RNA, 13 nt, Human
gcugucaucucag

SEQ ID NO: 1959398 - RNA, 15 nt, Human
gcugucaguguuugg

SEQ ID NO: 1959399 - RNA, 14 nt, Human
gcuggugucaccug

SEQ ID NO: 1959400 - RNA, 15 nt, Human
gcuggugucaccuga

SEQ ID NO: 1959401 - RNA, 13 nt, Human
gcuuguggcucca

SEQ ID NO: 1959402 - RNA, 19 nt, Human
gcuuguggcuccacacaca

SEQ ID NO: 1959403 - RNA, 22 nt, Human
gcuuguggcuccacacacacaa

SEQ ID NO: 1959404 - RNA, 13 nt, Human
gcuuguugacaga

SEQ ID NO: 1959405 - RNA, 14 nt, Human
gcuuuccaaagcca

SEQ ID NO: 1959406 - RNA, 14 nt, Human
gcuuuaaaauucuc

SEQ ID NO: 1959407 - RNA, 20 nt, Human
gcuuuaaaauucucuuccaa

SEQ ID NO: 1959408 - RNA, 15 nt, Human
gcuuuuaugugaaac

SEQ ID NO: 1959409 - RNA, 13 nt, Human
gcuuuuaugugaa

SEQ ID NO: 1959410 - RNA, 15 nt, Human
gcuuuuaguuuuucu

SEQ ID NO: 1959411 - RNA, 19 nt, Human
gcuuuuaguuuuucugucc

SEQ ID NO: 1959412 - RNA, 20 nt, Human
gcuuuuaguuuuucuguccc

SEQ ID NO: 1959413 - RNA, 17 nt, Human
gcuuuggucacuuuuag

SEQ ID NO: 1959414 - RNA, 18 nt, Human
gcuuugggcugcccuggu

SEQ ID NO: 1959415 - RNA, 19 nt, Human
gcuuugggcugcccuggug

SEQ ID NO: 1959416 - RNA, 21 nt, Human
gcuuuccauauuuuuuuccuu

SEQ ID NO: 1959417 - RNA, 14 nt, Human
gcuuuccauauuuu

SEQ ID NO: 1959418 - RNA, 16 nt, Human
gcuucucagcucgcug

SEQ ID NO: 1959419 - RNA, 16 nt, Human
gcuucuggaugggaca

SEQ ID NO: 1959420 - RNA, 19 nt, Human
gcuucuguugcugccucau

SEQ ID NO: 1959421 - RNA, 17 nt, Human
gcuucuguugcugccuc

SEQ ID NO: 1959422 - RNA, 18 nt, Human
gcuucuguugcugccuca

SEQ ID NO: 1959423 - RNA, 18 nt, Human
gcuucauuuccugugucu

SEQ ID NO: 1959424 - RNA, 16 nt, Human
gcuuccaauuuuccuu

SEQ ID NO: 1959425 - RNA, 22 nt, Human
gcuucucacugccaugccagcu

SEQ ID NO: 1959426 - RNA, 14 nt, Human
gcuuacguaguucu

SEQ ID NO: 1959427 - RNA, 15 nt, Human
gcuuacguaguucua

SEQ ID NO: 1959428 - RNA, 22 nt, Human
gcuuacguaguucuaccggcuu

SEQ ID NO: 1959429 - RNA, 15 nt, Human
gcuuagaaacuggaa

SEQ ID NO: 1959430 - RNA, 15 nt, Human
gcuuauauuugugua

SEQ ID NO: 1959431 - RNA, 10 nt, Human
gcuucauaca

SEQ ID NO: 1959432 - RNA, 11 nt, Human
gcuucauacac

SEQ ID NO: 1959433 - RNA, 22 nt, Human
gcuucauguucccaaaaucacc

SEQ ID NO: 1959434 - RNA, 19 nt, Human
gcuucaguggcagcugcuu

SEQ ID NO: 1959435 - RNA, 13 nt, Human
gcuuaucucaggg

SEQ ID NO: 1959436 - RNA, 20 nt, Human
gcuucaguggcagcugcuuu

SEQ ID NO: 1959437 - RNA, 21 nt, Human
gcucucaggccagcugcuugg

SEQ ID NO: 1959438 - RNA, 17 nt, Human
gcucucaugcugccccu

SEQ ID NO: 1959439 - RNA, 17 nt, Human
gcucgaugcagacaggg

SEQ ID NO: 1959440 - RNA, 19 nt, Human
gcuccuuucugaucuucac

SEQ ID NO: 1959441 - RNA, 16 nt, Human
gcucgaugcagacagg

SEQ ID NO: 1959442 - RNA, 15 nt, Human
gcucuccaagcccag

SEQ ID NO: 1959443 - RNA, 14 nt, Human
gcucuugaacuccu

SEQ ID NO: 1959444 - RNA, 16 nt, Human
gcucuugaacuccuga

SEQ ID NO: 1959445 - RNA, 19 nt, Human
gcucuugaacuccugaccu

SEQ ID NO: 1959446 - RNA, 21 nt, Human
gcucuugaacuccugaccuca

SEQ ID NO: 1959447 - RNA, 24 nt, Human
gcucuuuggccugaugaccaauuu

SEQ ID NO: 1959448 - RNA, 23 nt, Human
gcucuugggcaauauucucugua

SEQ ID NO: 1959449 - RNA, 19 nt, Human
gcucuugaugccuggcggg

SEQ ID NO: 1959450 - RNA, 19 nt, Human
gcucuuggcagguacucag

SEQ ID NO: 1959451 - RNA, 22 nt, Human
gcucuugcauaguaaauguagu

SEQ ID NO: 1959452 - RNA, 13 nt, Human
gcugacuuagaau

SEQ ID NO: 1959453 - RNA, 22 nt, Human
gcugacuguuuucucuugagag

SEQ ID NO: 1959454 - RNA, 20 nt, Human
gcugacagacacaggcccgg

SEQ ID NO: 1959455 - RNA, 17 nt, Human
gcugacagacacaggcc

SEQ ID NO: 1959456 - RNA, 18 nt, Human
gcugacagacacaggccc

SEQ ID NO: 1959457 - RNA, 19 nt, Human
gcugacagacacaggcccg

SEQ ID NO: 1959458 - RNA, 13 nt, Human
gcugccaccugcc

SEQ ID NO: 1959459 - RNA, 12 nt, Human
gcugccaccugc

SEQ ID NO: 1959460 - RNA, 20 nt, Human
gcugccaaugggagcucaug

SEQ ID NO: 1959461 - RNA, 15 nt, Human
gcugccacacuucag

SEQ ID NO: 1959462 - RNA, 17 nt, Human
gcugccacacuucaggc

SEQ ID NO: 1959463 - RNA, 18 nt, Human
gcugccacacuucaggcu

SEQ ID NO: 1959464 - RNA, 21 nt, Human
gcugccacacuucaggcucuu

SEQ ID NO: 1959465 - RNA, 22 nt, Human
gcugccacacuucaggcucuuc

SEQ ID NO: 1959466 - RNA, 23 nt, Human
gcugccacacuucaggcucuucu

SEQ ID NO: 1959467 - RNA, 18 nt, Human
gcugauuuuauucuugau

SEQ ID NO: 1959468 - RNA, 20 nt, Human
gcugauuuuauucuugauca

SEQ ID NO: 1959469 - RNA, 14 nt, Human
gcugcaguugccag

SEQ ID NO: 1959470 - RNA, 13 nt, Human
gcugcaguugcca

SEQ ID NO: 1959471 - RNA, 17 nt, Human
gcugcaguugccaguca

SEQ ID NO: 1959472 - RNA, 17 nt, Human
gcugcauuuaaaagaua

SEQ ID NO: 1959473 - RNA, 18 nt, Human
gcugcauuuaaaagauac

SEQ ID NO: 1959474 - RNA, 19 nt, Human
gcugcauuuaaaagauaca

SEQ ID NO: 1959475 - RNA, 14 nt, Human
gcugauuguauuua

SEQ ID NO: 1959476 - RNA, 21 nt, Human
gcugaugacccccccagcuuc

SEQ ID NO: 1959477 - RNA, 14 nt, Human
gcugaucuaaaaau

SEQ ID NO: 1959478 - RNA, 21 nt, Human
gcugauuaaaccaaggcuaga

SEQ ID NO: 1959479 - RNA, 12 nt, Human
gcugauuuuauu

SEQ ID NO: 1959480 - RNA, 16 nt, Human
gcugauuuuauucuug

SEQ ID NO: 1959481 - RNA, 17 nt, Human
gcugauuuuauucuuga

SEQ ID NO: 1959482 - RNA, 22 nt, Human
gcugcaaaggguaucaggugcu

SEQ ID NO: 1959483 - RNA, 23 nt, Human
gcugcaaaggguaucaggugcug

SEQ ID NO: 1959484 - RNA, 12 nt, Human
gcugcccugccc

SEQ ID NO: 1959485 - RNA, 14 nt, Human
gcugcccugcccac

SEQ ID NO: 1959486 - RNA, 13 nt, Human
gcugcccugccca

SEQ ID NO: 1959487 - RNA, 24 nt, Human
gcugcccugcccaccuggccucug

SEQ ID NO: 1959488 - RNA, 23 nt, Human
gcugcccugcccaccuggccucu

SEQ ID NO: 1959489 - RNA, 22 nt, Human
gcugcccugcccaccuggccuc

SEQ ID NO: 1959490 - RNA, 21 nt, Human
gcugcccugcccaccuggccu

SEQ ID NO: 1959491 - RNA, 20 nt, Human
gcugcccugcccaccuggcc

SEQ ID NO: 1959492 - RNA, 18 nt, Human
gcugcccugcccaccugg

SEQ ID NO: 1959493 - RNA, 16 nt, Human
gcugcccugcccaccu

SEQ ID NO: 1959494 - RNA, 20 nt, Human
gcugccuguucagcuccagc

SEQ ID NO: 1959495 - RNA, 22 nt, Human
gcugccuguucagcuccagcuc

SEQ ID NO: 1959496 - RNA, 20 nt, Human
gcugccuuagaaccuuucuu

SEQ ID NO: 1959497 - RNA, 17 nt, Human
gcugcccuggugcugcc

SEQ ID NO: 1959498 - RNA, 15 nt, Human
gcugccuuagaaccu

SEQ ID NO: 1959499 - RNA, 18 nt, Human
gcugccuguucagcucca

SEQ ID NO: 1959500 - RNA, 19 nt, Human
gcugccuguucagcuccag

SEQ ID NO: 1959501 - RNA, 12 nt, Human
gcugcccuggug

SEQ ID NO: 1959502 - RNA, 13 nt, Human
gcugcccuggugc

SEQ ID NO: 1959503 - RNA, 14 nt, Human
gcugcccuggugcu

SEQ ID NO: 1959504 - RNA, 15 nt, Human
gcugcccuggugcug

SEQ ID NO: 1959505 - RNA, 21 nt, Human
gcugccuucgguacccaccac

SEQ ID NO: 1959506 - RNA, 20 nt, Human
gcugccuucgguacccacca

SEQ ID NO: 1959507 - RNA, 14 nt, Human
gcugcgguccaccc

SEQ ID NO: 1959508 - RNA, 15 nt, Human
gcugcgguccaccca

SEQ ID NO: 1959509 - RNA, 22 nt, Human
gcugcgguccacccaggagccc

SEQ ID NO: 1959510 - RNA, 21 nt, Human
gcugcgguccacccaggagcc

SEQ ID NO: 1959511 - RNA, 22 nt, Human
gcugcuuuugucuaugggacuc

SEQ ID NO: 1959512 - RNA, 15 nt, Human
gcugcuuugauauau

SEQ ID NO: 1959513 - RNA, 16 nt, Human
gcugcuaauucuuugc

SEQ ID NO: 1959514 - RNA, 17 nt, Human
gcugcuaauucuuugca

SEQ ID NO: 1959515 - RNA, 14 nt, Human
gcugcuuuuuuuga

SEQ ID NO: 1959516 - RNA, 22 nt, Human
gcugcuuuuuuugaaacuuuga

SEQ ID NO: 1959517 - RNA, 23 nt, Human
gcuggaaugauuucagcucacug

SEQ ID NO: 1959518 - RNA, 21 nt, Human
gcuggaacucuugacagcuau

SEQ ID NO: 1959519 - RNA, 14 nt, Human
gcuggaacucuuga

SEQ ID NO: 1959520 - RNA, 16 nt, Human
gcuggaccuugaacug

SEQ ID NO: 1959521 - RNA, 15 nt, Human
gcuggaccuugaacu

SEQ ID NO: 1959522 - RNA, 14 nt, Human
gcuggcccugcccu

SEQ ID NO: 1959523 - RNA, 15 nt, Human
gcuggcccugcccug

SEQ ID NO: 1959524 - RNA, 16 nt, Human
gcuggcccugcccugg

SEQ ID NO: 1959525 - RNA, 19 nt, Human
gcuggcccuggcucccaca

SEQ ID NO: 1959526 - RNA, 14 nt, Human
gcuggccggacacc

SEQ ID NO: 1959527 - RNA, 15 nt, Human
ggcugggagcucugc

SEQ ID NO: 1959528 - RNA, 21 nt, Human
ggcugggcucccuucccaccu

SEQ ID NO: 1959529 - RNA, 20 nt, Human
ggcugggcucccuucccacc

SEQ ID NO: 1959530 - RNA, 14 nt, Human
ggcugggcacugcu

SEQ ID NO: 1959531 - RNA, 19 nt, Human
ggcugggcacugcucucac

SEQ ID NO: 1959532 - RNA, 20 nt, Human
ggcugggcacugcucucacc

SEQ ID NO: 1959533 - RNA, 16 nt, Human
ggcuggaguuggggca

SEQ ID NO: 1959534 - RNA, 11 nt, Human
ggcugggcuuc

SEQ ID NO: 1959535 - RNA, 21 nt, Human
ggcugggcuucaguggcagcu

SEQ ID NO: 1959536 - RNA, 22 nt, Human
ggcugggcuucaguggcagcug

SEQ ID NO: 1959537 - RNA, 14 nt, Human
ggcugggcugggca

SEQ ID NO: 1959538 - RNA, 15 nt, Human
ggcugggcugggcac

SEQ ID NO: 1959539 - RNA, 18 nt, Human
ggcugggcugggcacugc

SEQ ID NO: 1959540 - RNA, 16 nt, Human
ggcugggggaagaagc

SEQ ID NO: 1959541 - RNA, 12 nt, Human
ggcuggggcagc

SEQ ID NO: 1959542 - RNA, 14 nt, Human
ggcuggggcagccu

SEQ ID NO: 1959543 - RNA, 20 nt, Human
ggcuggggcagccucugggc

SEQ ID NO: 1959544 - RNA, 23 nt, Human
ggcuggggcagccucugggccca

SEQ ID NO: 1959545 - RNA, 14 nt, Human
ggcugggggccuca

SEQ ID NO: 1959546 - RNA, 18 nt, Human
ggcugggggaugggccug

SEQ ID NO: 1959547 - RNA, 19 nt, Human
ggcugggggaugggccuga

SEQ ID NO: 1959548 - RNA, 19 nt, Human
ggcugcuucaaggauccug

SEQ ID NO: 1959549 - RNA, 15 nt, Human
ggcugcuucaaggau

SEQ ID NO: 1959550 - RNA, 23 nt, Human
ggcucuggagcccacuguacuug

SEQ ID NO: 1959551 - RNA, 18 nt, Human
ggcuggacuuggagguag

SEQ ID NO: 1959552 - RNA, 18 nt, Human
ggcuggagcuagaauuug

SEQ ID NO: 1959553 - RNA, 13 nt, Human
ggcuggacuugga

SEQ ID NO: 1959554 - RNA, 20 nt, Human
ggcugcuucaaggauccuga

SEQ ID NO: 1959555 - RNA, 21 nt, Human
ggcugcuucaaggauccugag

SEQ ID NO: 1959556 - RNA, 15 nt, Human
ggcuugcacucucuu

SEQ ID NO: 1959557 - RNA, 12 nt, Human
ggcuucacagau

SEQ ID NO: 1959558 - RNA, 21 nt, Human
ggcuucacggaagagccuugc

SEQ ID NO: 1959559 - RNA, 20 nt, Human
ggcuucacggaagagccuug

SEQ ID NO: 1959560 - RNA, 15 nt, Human
ggcuuagucacugag

SEQ ID NO: 1959561 - RNA, 14 nt, Human
ggcuuaaaaaaaac

SEQ ID NO: 1959562 - RNA, 14 nt, Human
ggcuuagucacuga

SEQ ID NO: 1959563 - RNA, 18 nt, Human
ggcuuggggaccagagcu

SEQ ID NO: 1959564 - RNA, 17 nt, Human
ggcuuggggaccagagc

SEQ ID NO: 1959565 - RNA, 11 nt, Human
ggcuugcugcc

SEQ ID NO: 1959566 - RNA, 13 nt, Human
ggcuugcugcaga

SEQ ID NO: 1959567 - RNA, 12 nt, Human
ggcuuggcccug

SEQ ID NO: 1959568 - RNA, 13 nt, Human
ggcuuggcccugg

SEQ ID NO: 1959569 - RNA, 15 nt, Human
ggcuuggcccuggca

SEQ ID NO: 1959570 - RNA, 16 nt, Human
ggcuuggcccuggcag

SEQ ID NO: 1959571 - RNA, 14 nt, Human
ggcuguuggcuggg

SEQ ID NO: 1959572 - RNA, 15 nt, Human
ggcuguuggcugggg

SEQ ID NO: 1959573 - RNA, 16 nt, Human
ggcuguuggcuggggg

SEQ ID NO: 1959574 - RNA, 20 nt, Human
ggcuguuggcugggggccuc

SEQ ID NO: 1959575 - RNA, 15 nt, Human
ggcuuaaaacaacac

SEQ ID NO: 1959576 - RNA, 13 nt, Human
ggcugugccucug

SEQ ID NO: 1959577 - RNA, 16 nt, Human
ggcugugccucugccu

SEQ ID NO: 1959578 - RNA, 17 nt, Human
ggcugucuguuguauuc

SEQ ID NO: 1959579 - RNA, 21 nt, Human
ggcuguggccucccugcucua

SEQ ID NO: 1959580 - RNA, 20 nt, Human
gggacccaguggcagggcac

SEQ ID NO: 1959581 - RNA, 15 nt, Human
gggacccaguggcag

SEQ ID NO: 1959582 - RNA, 17 nt, Human
gggacccaguggcaggg

SEQ ID NO: 1959583 - RNA, 20 nt, Human
gggacgcggccggcggccuc

SEQ ID NO: 1959584 - RNA, 17 nt, Human
gggacucaaugcacuga

SEQ ID NO: 1959585 - RNA, 19 nt, Human
gggacucaaugcacugaca

SEQ ID NO: 1959586 - RNA, 18 nt, Human
gggacugccaccuccccu

SEQ ID NO: 1959587 - RNA, 22 nt, Human
gggacugccaccuccccuugcc

SEQ ID NO: 1959588 - RNA, 23 nt, Human
gggacugccagucccccugcccc

SEQ ID NO: 1959589 - RNA, 14 nt, Human
gggacugccaccuc

SEQ ID NO: 1959590 - RNA, 16 nt, Human
gggacugccaccuccc

SEQ ID NO: 1959591 - RNA, 21 nt, Human
gggacugaggggaggggagca

SEQ ID NO: 1959592 - RNA, 15 nt, Human
gggacugagaaauuu

SEQ ID NO: 1959593 - RNA, 23 nt, Human
gggacucaaugcacugacauugu

SEQ ID NO: 1959594 - RNA, 14 nt, Human
gggacacccagaaa

SEQ ID NO: 1959595 - RNA, 19 nt, Human
gggacacacuuagcuggag

SEQ ID NO: 1959596 - RNA, 20 nt, Human
gggacaccaagccuuggcuc

SEQ ID NO: 1959597 - RNA, 14 nt, Human
gggacacccuguga

SEQ ID NO: 1959598 - RNA, 19 nt, Human
gggaauguuugccucugcc

SEQ ID NO: 1959599 - RNA, 21 nt, Human
gggaauguuugccucugccuc

SEQ ID NO: 1959600 - RNA, 18 nt, Human
ggcuuugccauuaaaaug

SEQ ID NO: 1959601 - RNA, 13 nt, Human
ggcuuuucacugc

SEQ ID NO: 1959602 - RNA, 14 nt, Human
gggaaguuaaaggg

SEQ ID NO: 1959603 - RNA, 17 nt, Human
gggaaguuaaagggaag

SEQ ID NO: 1959604 - RNA, 22 nt, Human
gggaaguuaaagggaagaaaac

SEQ ID NO: 1959605 - RNA, 20 nt, Human
gggaggugggauccuccagg

SEQ ID NO: 1959606 - RNA, 18 nt, Human
gggaggcaaguguggggg

SEQ ID NO: 1959607 - RNA, 23 nt, Human
gggaggauugcuugagcucagga

SEQ ID NO: 1959608 - RNA, 21 nt, Human
gggagugaguugauagcacag

SEQ ID NO: 1959609 - RNA, 19 nt, Human
gggagguuuucucccccag

SEQ ID NO: 1959610 - RNA, 17 nt, Human
gggaguagacuugcuuu

SEQ ID NO: 1959611 - RNA, 17 nt, Human
gggagugacagaggcag

SEQ ID NO: 1959612 - RNA, 17 nt, Human
gggaggacgcucucugg

SEQ ID NO: 1959613 - RNA, 20 nt, Human
gggaggacgcucucuggccu

SEQ ID NO: 1959614 - RNA, 12 nt, Human
gggaggagaaga

SEQ ID NO: 1959615 - RNA, 23 nt, Human
gggaggagaagaaaauguucuuc

SEQ ID NO: 1959616 - RNA, 23 nt, Human
gggaggaucucuugagccuggga

SEQ ID NO: 1959617 - RNA, 21 nt, Human
gggaggauugcuugagcucag

SEQ ID NO: 1959618 - RNA, 22 nt, Human
gggaggauguucugggacacag

SEQ ID NO: 1959619 - RNA, 13 nt, Human
gggagcugccugu

SEQ ID NO: 1959620 - RNA, 21 nt, Human
gggagcugccuguucagcucc

SEQ ID NO: 1959621 - RNA, 22 nt, Human
gggagcugccuguucagcucca

SEQ ID NO: 1959622 - RNA, 11 nt, Human
gggagcuggag

SEQ ID NO: 1959623 - RNA, 22 nt, Human
gggagcuggcuccagccuggaa

SEQ ID NO: 1959624 - RNA, 12 nt, Human
gggagcucugca

SEQ ID NO: 1959625 - RNA, 20 nt, Human
gggagccgggcaaacuggcc

SEQ ID NO: 1959626 - RNA, 21 nt, Human
gggagccugaucaccugcccu

SEQ ID NO: 1959627 - RNA, 20 nt, Human
ggcuaguaucaaaagaaaga

SEQ ID NO: 1959628 - RNA, 20 nt, Human
ggcgggcacaccuccuccca

SEQ ID NO: 1959629 - RNA, 15 nt, Human
ggcgcgguggcucac

SEQ ID NO: 1959630 - RNA, 12 nt, Human
ggcgcuaacuug

SEQ ID NO: 1959631 - RNA, 23 nt, Human
ggcgcuaacuugcuuaaauguga

SEQ ID NO: 1959632 - RNA, 21 nt, Human
ggcgcuagaggccauggaggc

SEQ ID NO: 1959633 - RNA, 19 nt, Human
ggcgcuagcacagcucccu

SEQ ID NO: 1959634 - RNA, 22 nt, Human
ggcgcuagcacagcucccuucu

SEQ ID NO: 1959635 - RNA, 23 nt, Human
ggcgcucgaaguugaucucccca

SEQ ID NO: 1959636 - RNA, 11 nt, Human
ggcgcugcccc

SEQ ID NO: 1959637 - RNA, 17 nt, Human
ggcgcugccccuggcag

SEQ ID NO: 1959638 - RNA, 16 nt, Human
ggcuccaggagcagcc

SEQ ID NO: 1959639 - RNA, 14 nt, Human
ggcuccaggagcag

SEQ ID NO: 1959640 - RNA, 10 nt, Human
ggcuccagac

SEQ ID NO: 1959641 - RNA, 17 nt, Human
ggcuccaggagcagcca

SEQ ID NO: 1959642 - RNA, 18 nt, Human
ggcuccaggagcagccac

SEQ ID NO: 1959643 - RNA, 12 nt, Human
ggcuccaggcuc

SEQ ID NO: 1959644 - RNA, 13 nt, Human
ggcuccaggcucc

SEQ ID NO: 1959645 - RNA, 12 nt, Human
ggcuaugcauuu

SEQ ID NO: 1959646 - RNA, 13 nt, Human
ggcuaugcauuug

SEQ ID NO: 1959647 - RNA, 21 nt, Human
ggcucacacuuggcucugagg

SEQ ID NO: 1959648 - RNA, 14 nt, Human
ggcuaugcauuuga

SEQ ID NO: 1959649 - RNA, 16 nt, Human
ggcuccacuuggucug

SEQ ID NO: 1959650 - RNA, 9 nt, Human
ggcuccaga

SEQ ID NO: 1959651 - RNA, 13 nt, Human
ggcucaccagaau

SEQ ID NO: 1959652 - RNA, 12 nt, Human
ggcucugcccuu

SEQ ID NO: 1959653 - RNA, 19 nt, Human
ggcucugacaaagcuuccc

SEQ ID NO: 1959654 - RNA, 20 nt, Human
ggcucugacaaagcuucccg

SEQ ID NO: 1959655 - RNA, 16 nt, Human
ggcucucugggcugac

SEQ ID NO: 1959656 - RNA, 15 nt, Human
ggcucugccucccau

SEQ ID NO: 1959657 - RNA, 13 nt, Human
ggcucugccuccc

SEQ ID NO: 1959658 - RNA, 15 nt, Human
ggcucugcccuuggu

SEQ ID NO: 1959659 - RNA, 14 nt, Human
ggcucugcccuugg

SEQ ID NO: 1959660 - RNA, 16 nt, Human
ggcucugccucccauc

SEQ ID NO: 1959661 - RNA, 16 nt, Human
ggcucuggagcccacu

SEQ ID NO: 1959662 - RNA, 19 nt, Human
ggcucuggagcccacugua

SEQ ID NO: 1959663 - RNA, 17 nt, Human
ggcucuggagcccacug

SEQ ID NO: 1959664 - RNA, 20 nt, Human
ggcucucaggccagcugcuu

SEQ ID NO: 1959665 - RNA, 19 nt, Human
ggcucucaggccagcugcu

SEQ ID NO: 1959666 - RNA, 18 nt, Human
ggcucucaggccagcugc

SEQ ID NO: 1959667 - RNA, 17 nt, Human
ggcucucaggccagcug

SEQ ID NO: 1959668 - RNA, 16 nt, Human
ggcucucaggccagcu

SEQ ID NO: 1959669 - RNA, 15 nt, Human
ggcucucaggccagc

SEQ ID NO: 1959670 - RNA, 12 nt, Human
ggcuccccucuu

SEQ ID NO: 1959671 - RNA, 15 nt, Human
ggcuccccucuuccu

SEQ ID NO: 1959672 - RNA, 17 nt, Human
ggcuccccucuuccucu

SEQ ID NO: 1959673 - RNA, 18 nt, Human
ggcuccccucuuccucuu

SEQ ID NO: 1959674 - RNA, 19 nt, Human
ggcuccccucuuccucuug

SEQ ID NO: 1959675 - RNA, 14 nt, Human
ggcuccaggcuccu

SEQ ID NO: 1959676 - RNA, 15 nt, Human
ggcuccaggcuccuu

SEQ ID NO: 1959677 - RNA, 20 nt, Human
ggcucccaggagccugccca

SEQ ID NO: 1959678 - RNA, 21 nt, Human
ggcucccaggagccugcccag

SEQ ID NO: 1959679 - RNA, 22 nt, Human
ggcucccaggagccugcccagc

SEQ ID NO: 1959680 - RNA, 14 nt, Human
ggccuggccugagc

SEQ ID NO: 1959681 - RNA, 13 nt, Human
ggccuggccugag

SEQ ID NO: 1959682 - RNA, 10 nt, Human
ggccuggccu

SEQ ID NO: 1959683 - RNA, 23 nt, Human
ggccuggccccucagggucccug

SEQ ID NO: 1959684 - RNA, 18 nt, Human
ggccuggccccucagggu

SEQ ID NO: 1959685 - RNA, 17 nt, Human
ggccuggccccucaggg

SEQ ID NO: 1959686 - RNA, 15 nt, Human
ggccuggccccucag

SEQ ID NO: 1959687 - RNA, 14 nt, Human
ggccuggccccuca

SEQ ID NO: 1959688 - RNA, 19 nt, Human
ggccucugcacuccccugc

SEQ ID NO: 1959689 - RNA, 18 nt, Human
ggccucugcacuccccug

SEQ ID NO: 1959690 - RNA, 16 nt, Human
ggccugacucucagca

SEQ ID NO: 1959691 - RNA, 22 nt, Human
ggccucugcacuccccugcugg

SEQ ID NO: 1959692 - RNA, 18 nt, Human
ggccugagaggggaagcg

SEQ ID NO: 1959693 - RNA, 13 nt, Human
ggccuggccccuc

SEQ ID NO: 1959694 - RNA, 20 nt, Human
ggcgcaagggaggcccagcg

SEQ ID NO: 1959695 - RNA, 18 nt, Human
ggcgcaagggaggcccag

SEQ ID NO: 1959696 - RNA, 24 nt, Human
ggcgcagcauauucaggaagcuca

SEQ ID NO: 1959697 - RNA, 23 nt, Human
ggcgcagcauauucaggaagcuc

SEQ ID NO: 1959698 - RNA, 15 nt, Human
ggccuggcccaugua

SEQ ID NO: 1959699 - RNA, 16 nt, Human
ggccuggccugagcug

SEQ ID NO: 1959700 - RNA, 15 nt, Human
ggccuggccugagcu

SEQ ID NO: 1959701 - RNA, 23 nt, Human
ggccugggggcugggcagaggaa

SEQ ID NO: 1959702 - RNA, 15 nt, Human
ggccugggccuggcu

SEQ ID NO: 1959703 - RNA, 17 nt, Human
ggccugggccuggcucc

SEQ ID NO: 1959704 - RNA, 18 nt, Human
ggccugggccuggcuccc

SEQ ID NO: 1959705 - RNA, 11 nt, Human
ggccugggccc

SEQ ID NO: 1959706 - RNA, 12 nt, Human
ggccugggccug

SEQ ID NO: 1959707 - RNA, 20 nt, Human
ggccucucauuccagaggaa

SEQ ID NO: 1959708 - RNA, 14 nt, Human
ggccuccugugugu

SEQ ID NO: 1959709 - RNA, 20 nt, Human
ggccuagcauacguacacau

SEQ ID NO: 1959710 - RNA, 15 nt, Human
ggccuacuccugucu

SEQ ID NO: 1959711 - RNA, 17 nt, Human
ggccuacuccugucuuc

SEQ ID NO: 1959712 - RNA, 20 nt, Human
ggccuacuccugucuucugc

SEQ ID NO: 1959713 - RNA, 23 nt, Human
ggccuacuccugucuucugcuuu

SEQ ID NO: 1959714 - RNA, 22 nt, Human
ggccuagcauacguacacauuu

SEQ ID NO: 1959715 - RNA, 14 nt, Human
ggccucaagugauu

SEQ ID NO: 1959716 - RNA, 22 nt, Human
ggccucaagugauucuccugcc

SEQ ID NO: 1959717 - RNA, 12 nt, Human
ggccgggcagag

SEQ ID NO: 1959718 - RNA, 15 nt, Human
ggccgggagccugau

SEQ ID NO: 1959719 - RNA, 18 nt, Human
ggccggcuuucaggagcu

SEQ ID NO: 1959720 - RNA, 19 nt, Human
ggccggcuuucaggagcuc

SEQ ID NO: 1959721 - RNA, 18 nt, Human
ggccggcggccucagagu

SEQ ID NO: 1959722 - RNA, 12 nt, Human
ggccuacuccug

SEQ ID NO: 1959723 - RNA, 14 nt, Human
ggccuacuccuguc

SEQ ID NO: 1959724 - RNA, 16 nt, Human
ggccguugcugacuua

SEQ ID NO: 1959725 - RNA, 19 nt, Human
ggcccagagggccugcaag

SEQ ID NO: 1959726 - RNA, 17 nt, Human
ggcccagagggccugca

SEQ ID NO: 1959727 - RNA, 20 nt, Human
ggcccagagggccugcaagg

SEQ ID NO: 1959728 - RNA, 14 nt, Human
ggcccagagggccu

SEQ ID NO: 1959729 - RNA, 20 nt, Human
ggauucacaccccaccugcg

SEQ ID NO: 1959730 - RNA, 12 nt, Human
ggauucagccuu

SEQ ID NO: 1959731 - RNA, 13 nt, Human
ggauucagccuuc

SEQ ID NO: 1959732 - RNA, 16 nt, Human
ggauucagccuucuuu

SEQ ID NO: 1959733 - RNA, 23 nt, Human
ggauucagccuucuuuuucugga

SEQ ID NO: 1959734 - RNA, 17 nt, Human
ggauucacaccccaccu

SEQ ID NO: 1959735 - RNA, 19 nt, Human
ggauucacaccccaccugc

SEQ ID NO: 1959736 - RNA, 23 nt, Human
ggauuccuaaucacucagagcag

SEQ ID NO: 1959737 - RNA, 16 nt, Human
ggauucugagagcugu

SEQ ID NO: 1959738 - RNA, 20 nt, Human
ggauucugaggcccugccca

SEQ ID NO: 1959739 - RNA, 16 nt, Human
ggauucucaccagcug

SEQ ID NO: 1959740 - RNA, 19 nt, Human
ggauuagucccuggccucu

SEQ ID NO: 1959741 - RNA, 14 nt, Human
ggauuaguuuagaa

SEQ ID NO: 1959742 - RNA, 17 nt, Human
ggauuaguuuagaacag

SEQ ID NO: 1959743 - RNA, 18 nt, Human
ggauuaguuuagaacagg

SEQ ID NO: 1959744 - RNA, 12 nt, Human
ggauuauauuau

SEQ ID NO: 1959745 - RNA, 18 nt, Human
ggaugccugguggcagcu

SEQ ID NO: 1959746 - RNA, 19 nt, Human
ggaugccugguggcagcug

SEQ ID NO: 1959747 - RNA, 20 nt, Human
ggaugccugguggcagcugc

SEQ ID NO: 1959748 - RNA, 21 nt, Human
ggaugccugguggcagcugcg

SEQ ID NO: 1959749 - RNA, 18 nt, Human
ggaugcccaaagaugcag

SEQ ID NO: 1959750 - RNA, 18 nt, Human
ggaugaugacuauggaaa

SEQ ID NO: 1959751 - RNA, 19 nt, Human
ggaugcccaaagaugcagc

SEQ ID NO: 1959752 - RNA, 17 nt, Human
ggaugccccgucccccu

SEQ ID NO: 1959753 - RNA, 14 nt, Human
ggaugauugaagaa

SEQ ID NO: 1959754 - RNA, 13 nt, Human
ggaugccuggugg

SEQ ID NO: 1959755 - RNA, 17 nt, Human
ggaugccugguggcagc

SEQ ID NO: 1959756 - RNA, 22 nt, Human
ggaugaucuaggaagacuuugg

SEQ ID NO: 1959757 - RNA, 18 nt, Human
ggaugaucuaggaagacu

SEQ ID NO: 1959758 - RNA, 16 nt, Human
ggaugaucuaggaaga

SEQ ID NO: 1959759 - RNA, 23 nt, Human
ggagucccaccuuggcugcaggg

SEQ ID NO: 1959760 - RNA, 20 nt, Human
ggagucccacuccaagccag

SEQ ID NO: 1959761 - RNA, 21 nt, Human
ggauucuuccucccucccucu

SEQ ID NO: 1959762 - RNA, 21 nt, Human
ggauucugaggcccugcccaa

SEQ ID NO: 1959763 - RNA, 18 nt, Human
ggauucuuguuuugcuuc

SEQ ID NO: 1959764 - RNA, 19 nt, Human
ggauucuuguuuugcuucc

SEQ ID NO: 1959765 - RNA, 17 nt, Human
ggcaagcaccuccugcc

SEQ ID NO: 1959766 - RNA, 19 nt, Human
ggcaagaaaagaguuaagg

SEQ ID NO: 1959767 - RNA, 18 nt, Human
ggcaagcaccuccugccu

SEQ ID NO: 1959768 - RNA, 19 nt, Human
ggcaagcaccuccugccuc

SEQ ID NO: 1959769 - RNA, 23 nt, Human
ggcaaggacgcuucacaggacag

SEQ ID NO: 1959770 - RNA, 17 nt, Human
ggcaccagcagccugga

SEQ ID NO: 1959771 - RNA, 24 nt, Human
ggcaaggacgcuucacaggacagg

SEQ ID NO: 1959772 - RNA, 19 nt, Human
ggcaccaguagcaggcccg

SEQ ID NO: 1959773 - RNA, 20 nt, Human
ggcacccaccaucaugucug

SEQ ID NO: 1959774 - RNA, 18 nt, Human
ggcacccggccccugcug

SEQ ID NO: 1959775 - RNA, 19 nt, Human
ggcacccggccccugcugg

SEQ ID NO: 1959776 - RNA, 20 nt, Human
ggcacccggccccugcuggu

SEQ ID NO: 1959777 - RNA, 18 nt, Human
ggcacucagaagacacug

SEQ ID NO: 1959778 - RNA, 19 nt, Human
ggcacucagaagacacuga

SEQ ID NO: 1959779 - RNA, 20 nt, Human
ggcacucagaagacacugau

SEQ ID NO: 1959780 - RNA, 21 nt, Human
ggcagagguugcagugagccg

SEQ ID NO: 1959781 - RNA, 22 nt, Human
ggcagagcagagaccaucccug

SEQ ID NO: 1959782 - RNA, 20 nt, Human
ggcagagcccugcucccucc

SEQ ID NO: 1959783 - RNA, 14 nt, Human
ggcagagcccugcu

SEQ ID NO: 1959784 - RNA, 16 nt, Human
ggccaggcccucugcc

SEQ ID NO: 1959785 - RNA, 15 nt, Human
ggccaggcccucugc

SEQ ID NO: 1959786 - RNA, 17 nt, Human
ggccaggcccucugccc

SEQ ID NO: 1959787 - RNA, 14 nt, Human
ggccaggcccucug

SEQ ID NO: 1959788 - RNA, 13 nt, Human
ggccaggagccuc

SEQ ID NO: 1959789 - RNA, 11 nt, Human
ggccaggagcc

SEQ ID NO: 1959790 - RNA, 18 nt, Human
ggcccaccaggccccccu

SEQ ID NO: 1959791 - RNA, 20 nt, Human
ggcccacccaagcaggaggc

SEQ ID NO: 1959792 - RNA, 21 nt, Human
ggcccacccgguucaguguuu

SEQ ID NO: 1959793 - RNA, 12 nt, Human
ggcccacccugc

SEQ ID NO: 1959794 - RNA, 21 nt, Human
ggcccacccugcuuggcccag

SEQ ID NO: 1959795 - RNA, 22 nt, Human
ggcccacccugcuuggcccagg

SEQ ID NO: 1959796 - RNA, 23 nt, Human
ggcccacccugcuuggcccaggg

SEQ ID NO: 1959797 - RNA, 19 nt, Human
ggccagaaguagcuuugca

SEQ ID NO: 1959798 - RNA, 20 nt, Human
ggccaggaaguagcacaggc

SEQ ID NO: 1959799 - RNA, 21 nt, Human
ggccaggaaguagcacaggcu

SEQ ID NO: 1959800 - RNA, 22 nt, Human
ggccaggaaguagcacaggcug

SEQ ID NO: 1959801 - RNA, 23 nt, Human
ggccaggaaguagcacaggcuga

SEQ ID NO: 1959802 - RNA, 15 nt, Human
ggccagaaguagcuu

SEQ ID NO: 1959803 - RNA, 17 nt, Human
ggccagaaguagcuuug

SEQ ID NO: 1959804 - RNA, 20 nt, Human
ggccacugugaagagaacca

SEQ ID NO: 1959805 - RNA, 15 nt, Human
ggccaccucuuccug

SEQ ID NO: 1959806 - RNA, 16 nt, Human
ggccaccucuuccugg

SEQ ID NO: 1959807 - RNA, 19 nt, Human
ggccaccucuuccuggccg

SEQ ID NO: 1959808 - RNA, 20 nt, Human
ggccaccucuuccuggccgg

SEQ ID NO: 1959809 - RNA, 22 nt, Human
ggccaccucuuccuggccggug

SEQ ID NO: 1959810 - RNA, 16 nt, Human
ggccacaguuguuuga

SEQ ID NO: 1959811 - RNA, 14 nt, Human
ggccacaguuguuu

SEQ ID NO: 1959812 - RNA, 11 nt, Human
ggccaccuccu

SEQ ID NO: 1959813 - RNA, 21 nt, Human
ggccaccuccuaaaaggccca

SEQ ID NO: 1959814 - RNA, 22 nt, Human
ggccaccuccuaaaaggcccag

SEQ ID NO: 1959815 - RNA, 23 nt, Human
ggccaccuccuaaaaggcccaga

SEQ ID NO: 1959816 - RNA, 22 nt, Human
ggccacagaaaauucuucucca

SEQ ID NO: 1959817 - RNA, 20 nt, Human
ggcauguucucugaggacac

SEQ ID NO: 1959818 - RNA, 17 nt, Human
ggcagguuggugggggc

SEQ ID NO: 1959819 - RNA, 17 nt, Human
ggcagggucucacucug

SEQ ID NO: 1959820 - RNA, 18 nt, Human
ggcagggucucacucugu

SEQ ID NO: 1959821 - RNA, 12 nt, Human
ggcaggguccua

SEQ ID NO: 1959822 - RNA, 23 nt, Human
ggcagcugcgguccacccaggag

SEQ ID NO: 1959823 - RNA, 24 nt, Human
ggcagcugcgguccacccaggagc

SEQ ID NO: 1959824 - RNA, 21 nt, Human
ggcagaguugaagacagagcu

SEQ ID NO: 1959825 - RNA, 19 nt, Human
ggcagaguugaagacagag

SEQ ID NO: 1959826 - RNA, 17 nt, Human
ggcagaguugaagacag

SEQ ID NO: 1959827 - RNA, 13 nt, Human
ggcagaguuacuu

SEQ ID NO: 1959828 - RNA, 12 nt, Human
ggcagcugccac

SEQ ID NO: 1959829 - RNA, 14 nt, Human
ggcagaguuacuug

SEQ ID NO: 1959830 - RNA, 21 nt, Human
ggcagcugcgguccacccagg

SEQ ID NO: 1959831 - RNA, 22 nt, Human
ggcaugacacgaauauugcuga

SEQ ID NO: 1959832 - RNA, 23 nt, Human
ggcaugugaugagaggaaaucac

SEQ ID NO: 1959833 - RNA, 18 nt, Human
ggcaugugaugagaggaa

SEQ ID NO: 1959834 - RNA, 17 nt, Human
ggagguuggagggaaag

SEQ ID NO: 1959835 - RNA, 14 nt, Human
ggaggggccuggca

SEQ ID NO: 1959836 - RNA, 18 nt, Human
ggaggggccuggcagccg

SEQ ID NO: 1959837 - RNA, 21 nt, Human
ggaggggccuggcagccgugc

SEQ ID NO: 1959838 - RNA, 22 nt, Human
ggagucccaccuuggcugcagg

SEQ ID NO: 1959839 - RNA, 20 nt, Human
ggaguagugaagacuccaga

SEQ ID NO: 1959840 - RNA, 13 nt, Human
ggaggggccuggc

SEQ ID NO: 1959841 - RNA, 19 nt, Human
ggaggggagcaugggaagu

SEQ ID NO: 1959842 - RNA, 13 nt, Human
ggagggccugggc

SEQ ID NO: 1959843 - RNA, 16 nt, Human
ggagggccugggccug

SEQ ID NO: 1959844 - RNA, 22 nt, Human
ggagggccugggccuggcuccc

SEQ ID NO: 1959845 - RNA, 23 nt, Human
ggagggccugggccuggcucccu

SEQ ID NO: 1959846 - RNA, 16 nt, Human
ggagggagggcuccag

SEQ ID NO: 1959847 - RNA, 13 nt, Human
ggagggagggcuc

SEQ ID NO: 1959848 - RNA, 17 nt, Human
ggagggagggcuccaga

SEQ ID NO: 1959849 - RNA, 17 nt, Human
ggaggcaggaguuucgu

SEQ ID NO: 1959850 - RNA, 16 nt, Human
ggaggacgcucucugg

SEQ ID NO: 1959851 - RNA, 14 nt, Human
ggaggaccugcccg

SEQ ID NO: 1959852 - RNA, 18 nt, Human
ggaggauguucugggaca

SEQ ID NO: 1959853 - RNA, 21 nt, Human
ggaggauguucugggacacag

SEQ ID NO: 1959854 - RNA, 16 nt, Human
ggagccuacccacccc

SEQ ID NO: 1959855 - RNA, 20 nt, Human
ggagcccugggaggcucugg

SEQ ID NO: 1959856 - RNA, 14 nt, Human
ggagccuccugccc

SEQ ID NO: 1959857 - RNA, 19 nt, Human
ggagcccugggaggcucug

SEQ ID NO: 1959858 - RNA, 16 nt, Human
ggagcccugggaggcu

SEQ ID NO: 1959859 - RNA, 17 nt, Human
ggagccugcagagcugc

SEQ ID NO: 1959860 - RNA, 15 nt, Human
ggagccuccugcccu

SEQ ID NO: 1959861 - RNA, 13 nt, Human
ggagccugacagc

SEQ ID NO: 1959862 - RNA, 16 nt, Human
ggagccugacagccag

SEQ ID NO: 1959863 - RNA, 17 nt, Human
ggagccugacagccaga

SEQ ID NO: 1959864 - RNA, 19 nt, Human
ggagcggauugcaaagcaa

SEQ ID NO: 1959865 - RNA, 20 nt, Human
ggagcucacuguggugucug

SEQ ID NO: 1959866 - RNA, 23 nt, Human
ggagcucacuguggugucugugu

SEQ ID NO: 1959867 - RNA, 12 nt, Human
ggagcuauuuua

SEQ ID NO: 1959868 - RNA, 14 nt, Human
ggagcuagaauuug

SEQ ID NO: 1959869 - RNA, 16 nt, Human
ggacagaggggguggc

SEQ ID NO: 1959870 - RNA, 22 nt, Human
ggacacuuauccacgagagcgc

SEQ ID NO: 1959871 - RNA, 18 nt, Human
ggacagaaggcuccugcc

SEQ ID NO: 1959872 - RNA, 20 nt, Human
ggacagaaggcuccugcccc

SEQ ID NO: 1959873 - RNA, 21 nt, Human
gcuuuuaugugaaacauguuu

SEQ ID NO: 1959874 - RNA, 20 nt, Human
gcuuuuaugugaaacauguu

SEQ ID NO: 1959875 - RNA, 19 nt, Human
gcuuuuaugugaaacaugu

SEQ ID NO: 1959876 - RNA, 19 nt, Human
ggacacuuauccacgagag

SEQ ID NO: 1959877 - RNA, 21 nt, Human
ggacacuguaacgugugcugu

SEQ ID NO: 1959878 - RNA, 12 nt, Human
gcuuuucacugc

SEQ ID NO: 1959879 - RNA, 20 nt, Human
ggacagaggggguggccucc

SEQ ID NO: 1959880 - RNA, 15 nt, Human
ggacagccccuccuc

SEQ ID NO: 1959881 - RNA, 16 nt, Human
ggacagccccuccucc

SEQ ID NO: 1959882 - RNA, 11 nt, Human
ggacagcuccu

SEQ ID NO: 1959883 - RNA, 15 nt, Human
ggacagcuccuucug

SEQ ID NO: 1959884 - RNA, 16 nt, Human
ggacagcuccuucugu

SEQ ID NO: 1959885 - RNA, 17 nt, Human
ggacagcuccuucuguc

SEQ ID NO: 1959886 - RNA, 14 nt, Human
ggaccagagcugcc

SEQ ID NO: 1959887 - RNA, 16 nt, Human
ggaccagcccacgcug

SEQ ID NO: 1959888 - RNA, 12 nt, Human
ggaccagcccac

SEQ ID NO: 1959889 - RNA, 13 nt, Human
ggaccagcccacg

SEQ ID NO: 1959890 - RNA, 15 nt, Human
ggaccagcccacgcu

SEQ ID NO: 1959891 - RNA, 19 nt, Human
ggaccagagcugccaccug

SEQ ID NO: 1959892 - RNA, 15 nt, Human
ggacauuuuaugucu

SEQ ID NO: 1959893 - RNA, 15 nt, Human
ggaccagcacacucc

SEQ ID NO: 1959894 - RNA, 19 nt, Human
ggagaagaaagaacuaucu

SEQ ID NO: 1959895 - RNA, 18 nt, Human
ggagaacuugcugccucg

SEQ ID NO: 1959896 - RNA, 12 nt, Human
ggagaagaaaau

SEQ ID NO: 1959897 - RNA, 18 nt, Human
ggacugagaaauuuauaa

SEQ ID NO: 1959898 - RNA, 11 nt, Human
ggacugacuga

SEQ ID NO: 1959899 - RNA, 15 nt, Human
ggacugacugaggca

SEQ ID NO: 1959900 - RNA, 16 nt, Human
ggacugacugaggcag

SEQ ID NO: 1959901 - RNA, 17 nt, Human
ggacugacugaggcagu

SEQ ID NO: 1959902 - RNA, 15 nt, Human
ggagaaucacaggcu

SEQ ID NO: 1959903 - RNA, 16 nt, Human
ggagaaucacaggcug

SEQ ID NO: 1959904 - RNA, 17 nt, Human
ggagaaucacaggcugg

SEQ ID NO: 1959905 - RNA, 18 nt, Human
ggagaaucacaggcuggg

SEQ ID NO: 1959906 - RNA, 22 nt, Human
ggagaaucacaggcugggcugg

SEQ ID NO: 1959907 - RNA, 19 nt, Human
ggagaaucacaggcugggc

SEQ ID NO: 1959908 - RNA, 13 nt, Human
ggagaaucacagg

SEQ ID NO: 1959909 - RNA, 19 nt, Human
ggagaagucuucuauuuau

SEQ ID NO: 1959910 - RNA, 20 nt, Human
ggagaagucuucuauuuauu

SEQ ID NO: 1959911 - RNA, 18 nt, Human
ggacugaaaaccucuccu

SEQ ID NO: 1959912 - RNA, 17 nt, Human
ggacugaaaaccucucc

SEQ ID NO: 1959913 - RNA, 16 nt, Human
ggacugaaaaccucuc

SEQ ID NO: 1959914 - RNA, 17 nt, Human
ggacugaauuaugaaac

SEQ ID NO: 1959915 - RNA, 19 nt, Human
ggacugaauuaugaaacuu

SEQ ID NO: 1959916 - RNA, 14 nt, Human
ggacugagaaauuu

SEQ ID NO: 1959917 - RNA, 16 nt, Human
ggacgcucucuggccu

SEQ ID NO: 1959918 - RNA, 19 nt, Human
ggacgcucucuggccuucg

SEQ ID NO: 1959919 - RNA, 13 nt, Human
ggacgcucugcug

SEQ ID NO: 1959920 - RNA, 18 nt, Human
ggaccuugaacuggguac

SEQ ID NO: 1959921 - RNA, 16 nt, Human
ggaccaugcugucugg

SEQ ID NO: 1959922 - RNA, 19 nt, Human
ggaccaugcugucuggcac

SEQ ID NO: 1959923 - RNA, 20 nt, Human
ggaccaugcugucuggcaca

SEQ ID NO: 1959924 - RNA, 21 nt, Human
ggaccaugcugucuggcacag

SEQ ID NO: 1959925 - RNA, 22 nt, Human
ggaccaugcugucuggcacagc

SEQ ID NO: 1959926 - RNA, 23 nt, Human
ggaccaugcugucuggcacagcc

SEQ ID NO: 1959927 - RNA, 14 nt, Human
ggaccauuuuccug

SEQ ID NO: 1959928 - RNA, 16 nt, Human
ggaccauuuuccugca

SEQ ID NO: 1959929 - RNA, 17 nt, Human
ggaccaggguuggcacc

SEQ ID NO: 1959930 - RNA, 21 nt, Human
gccaaguccgcagaagcccug

SEQ ID NO: 1959931 - RNA, 20 nt, Human
gccaauaauaauaccucccu

SEQ ID NO: 1959932 - RNA, 15 nt, Human
gccaaucagaagcua

SEQ ID NO: 1959933 - RNA, 16 nt, Human
gccaauggagacuguc

SEQ ID NO: 1959934 - RNA, 19 nt, Human
gccaauggagacugucuca

SEQ ID NO: 1959935 - RNA, 21 nt, Human
gccaauggagacugucucaag

SEQ ID NO: 1959936 - RNA, 21 nt, Human
gccaaggcugggggaagaagc

SEQ ID NO: 1959937 - RNA, 12 nt, Human
gcauuugugaaa

SEQ ID NO: 1959938 - RNA, 19 nt, Human
gcauuugaggucuguucuu

SEQ ID NO: 1959939 - RNA, 20 nt, Human
gcauuugaggucuguucuuu

SEQ ID NO: 1959940 - RNA, 22 nt, Human
gcauuuggugguuucagaaaug

SEQ ID NO: 1959941 - RNA, 23 nt, Human
gcauuuggugguuucagaaaugu

SEQ ID NO: 1959942 - RNA, 23 nt, Human
gccaaggugggaggauugcuuga

SEQ ID NO: 1959943 - RNA, 15 nt, Human
gccaaggugggagga

SEQ ID NO: 1959944 - RNA, 14 nt, Human
gccaaggugggagg

SEQ ID NO: 1959945 - RNA, 23 nt, Human
gccacaaggaagaaauuaacuua

SEQ ID NO: 1959946 - RNA, 20 nt, Human
gccaauuucucuuaaguacu

SEQ ID NO: 1959947 - RNA, 20 nt, Human
gccaaugugaacagcggcug

SEQ ID NO: 1959948 - RNA, 22 nt, Human
gccacaagacccuugugguccc

SEQ ID NO: 1959949 - RNA, 15 nt, Human
gccacaaggaagaaa

SEQ ID NO: 1959950 - RNA, 17 nt, Human
gccacaaggaagaaauu

SEQ ID NO: 1959951 - RNA, 22 nt, Human
gccacaaggaagaaauuaacuu

SEQ ID NO: 1959952 - RNA, 16 nt, Human
gccacaagacccuugu

SEQ ID NO: 1959953 - RNA, 22 nt, Human
gccacacucugggcuccagagu

SEQ ID NO: 1959954 - RNA, 20 nt, Human
gccacacuucaggcucuucu

SEQ ID NO: 1959955 - RNA, 22 nt, Human
gccacacuucaggcucuucucc

SEQ ID NO: 1959956 - RNA, 13 nt, Human
gccacagagaaag

SEQ ID NO: 1959957 - RNA, 23 nt, Human
gccacacuucaggcucuucuccu

SEQ ID NO: 1959958 - RNA, 14 nt, Human
gccacagagaaagu

SEQ ID NO: 1959959 - RNA, 20 nt, Human
gccacagagaaaguacuucu

SEQ ID NO: 1959960 - RNA, 23 nt, Human
gccacagagaaaguacuucucca

SEQ ID NO: 1959961 - RNA, 17 nt, Human
gccagaggagagaggac

SEQ ID NO: 1959962 - RNA, 15 nt, Human
gccagaggagagagg

SEQ ID NO: 1959963 - RNA, 13 nt, Human
gccagaggagaga

SEQ ID NO: 1959964 - RNA, 12 nt, Human
gccagaggagag

SEQ ID NO: 1959965 - RNA, 22 nt, Human
gccagaggagagaggacccccu

SEQ ID NO: 1959966 - RNA, 19 nt, Human
gccagaggagagaggaccc

SEQ ID NO: 1959967 - RNA, 21 nt, Human
gccagagggagugacagaggc

SEQ ID NO: 1959968 - RNA, 22 nt, Human
gccagagggagugacagaggca

SEQ ID NO: 1959969 - RNA, 23 nt, Human
gccagagggagugacagaggcag

SEQ ID NO: 1959970 - RNA, 16 nt, Human
gccagaugcaccagcc

SEQ ID NO: 1959971 - RNA, 17 nt, Human
gccagaugcaccagccc

SEQ ID NO: 1959972 - RNA, 18 nt, Human
gccagaugcaccagcccu

SEQ ID NO: 1959973 - RNA, 16 nt, Human
gccagagacacaagcc

SEQ ID NO: 1959974 - RNA, 19 nt, Human
gccagagacacaagccuuc

SEQ ID NO: 1959975 - RNA, 17 nt, Human
gccagagacacaagccu

SEQ ID NO: 1959976 - RNA, 10 nt, Human
gccagaggag

SEQ ID NO: 1959977 - RNA, 20 nt, Human
gccagagacacaagccuucg

SEQ ID NO: 1959978 - RNA, 23 nt, Human
gccacauccacagucucccccac

SEQ ID NO: 1959979 - RNA, 14 nt, Human
gccacaucccccaa

SEQ ID NO: 1959980 - RNA, 12 nt, Human
gccacaguuguu

SEQ ID NO: 1959981 - RNA, 19 nt, Human
gccaccgccuccuacagcc

SEQ ID NO: 1959982 - RNA, 13 nt, Human
gccacaucccucu

SEQ ID NO: 1959983 - RNA, 17 nt, Human
gccaccgugccuggcca

SEQ ID NO: 1959984 - RNA, 22 nt, Human
gccaccgugccuggccacgccc

SEQ ID NO: 1959985 - RNA, 17 nt, Human
gccaccugccuguuggg

SEQ ID NO: 1959986 - RNA, 17 nt, Human
gccaccugaguuccuga

SEQ ID NO: 1959987 - RNA, 21 nt, Human
gccaccugaguuccugaggug

SEQ ID NO: 1959988 - RNA, 14 nt, Human
gccaccucuuccug

SEQ ID NO: 1959989 - RNA, 15 nt, Human
gccaccucuuccugg

SEQ ID NO: 1959990 - RNA, 18 nt, Human
gccaccucuuccuggccg

SEQ ID NO: 1959991 - RNA, 16 nt, Human
gccaccugaguuccug

SEQ ID NO: 1959992 - RNA, 23 nt, Human
gccaccuccuaaaaggcccagag

SEQ ID NO: 1959993 - RNA, 21 nt, Human
gccaccuccuaaaaggcccag

SEQ ID NO: 1959994 - RNA, 22 nt, Human
gccaccuccuaaaaggcccaga

SEQ ID NO: 1959995 - RNA, 18 nt, Human
gccaccuccccuugccag

SEQ ID NO: 1959996 - RNA, 20 nt, Human
gccaccuccccuugccagcu

SEQ ID NO: 1959997 - RNA, 21 nt, Human
gccaccuccccuugccagcug

SEQ ID NO: 1959998 - RNA, 22 nt, Human
gccaccuccccuugccagcugc

SEQ ID NO: 1959999 - RNA, 24 nt, Human
gccaccuccccuugccagcugcug

SEQ ID NO: 1960000 - RNA, 20 nt, Human
gccaccuccuaaaaggccca

SEQ ID NO: 1960001 - RNA, 20 nt, Human
gccaccugcggugcuaucuc

SEQ ID NO: 1960002 - RNA, 14 nt, Human
gccaccugcggugc

SEQ ID NO: 1960003 - RNA, 22 nt, Human
gccaccugcggugcuaucuccc

SEQ ID NO: 1960004 - RNA, 15 nt, Human
gccacgauugcagga

SEQ ID NO: 1960005 - RNA, 11 nt, Human
gccaccugggu

SEQ ID NO: 1960006 - RNA, 18 nt, Human
gccacggccaggccagag

SEQ ID NO: 1960007 - RNA, 17 nt, Human
gccacggccaggccaga

SEQ ID NO: 1960008 - RNA, 20 nt, Human
gccacgcccaacuaauuuuu

SEQ ID NO: 1960009 - RNA, 19 nt, Human
gccacggccaggccagagg

SEQ ID NO: 1960010 - RNA, 23 nt, Human
gccaugggacagggaggacgcuc

SEQ ID NO: 1960011 - RNA, 22 nt, Human
gccaugggacagggaggacgcu

SEQ ID NO: 1960012 - RNA, 10 nt, Human
gcccaaccuc

SEQ ID NO: 1960013 - RNA, 13 nt, Human
gcccaacaggggc

SEQ ID NO: 1960014 - RNA, 21 nt, Human
gcccaacaggggcuccaugcc

SEQ ID NO: 1960015 - RNA, 22 nt, Human
gcccaacaggggcuccaugcca

SEQ ID NO: 1960016 - RNA, 13 nt, Human
gcccaaccacacu

SEQ ID NO: 1960017 - RNA, 14 nt, Human
gcccaaccugcucu

SEQ ID NO: 1960018 - RNA, 15 nt, Human
gcccaaccucuuccu

SEQ ID NO: 1960019 - RNA, 21 nt, Human
gcccaaccucuuccuccugac

SEQ ID NO: 1960020 - RNA, 23 nt, Human
gcccaaccucuuccuccugacac

SEQ ID NO: 1960021 - RNA, 21 nt, Human
gcccaaaccaccagaagccca

SEQ ID NO: 1960022 - RNA, 22 nt, Human
gcccaaaccaccagaagcccag

SEQ ID NO: 1960023 - RNA, 23 nt, Human
gcccaaaccaccagaagcccaga

SEQ ID NO: 1960024 - RNA, 16 nt, Human
gcccaaaccuuucccc

SEQ ID NO: 1960025 - RNA, 19 nt, Human
gcccaaaccuuucccccau

SEQ ID NO: 1960026 - RNA, 20 nt, Human
gccaugagaauguuuuagca

SEQ ID NO: 1960027 - RNA, 22 nt, Human
gccaugagaauguuuuagcaca

SEQ ID NO: 1960028 - RNA, 18 nt, Human
gccaugaggaacaaggca

SEQ ID NO: 1960029 - RNA, 18 nt, Human
gccaugccagcuuaucuc

SEQ ID NO: 1960030 - RNA, 13 nt, Human
gccaugccagcuu

SEQ ID NO: 1960031 - RNA, 19 nt, Human
gccaugccagcuuaucuca

SEQ ID NO: 1960032 - RNA, 15 nt, Human
gccaugccaggaacc

SEQ ID NO: 1960033 - RNA, 12 nt, Human
gccaucucugcu

SEQ ID NO: 1960034 - RNA, 13 nt, Human
gccaucucugcuc

SEQ ID NO: 1960035 - RNA, 14 nt, Human
gccaucucugcucc

SEQ ID NO: 1960036 - RNA, 15 nt, Human
gccaucucugcucca

SEQ ID NO: 1960037 - RNA, 13 nt, Human
gccaggcugcucu

SEQ ID NO: 1960038 - RNA, 14 nt, Human
gccaggcugcucuu

SEQ ID NO: 1960039 - RNA, 13 nt, Human
gccaggcuggguc

SEQ ID NO: 1960040 - RNA, 22 nt, Human
gccaggcugcucuugaacuccu

SEQ ID NO: 1960041 - RNA, 21 nt, Human
gccagauuucacucuccuugg

SEQ ID NO: 1960042 - RNA, 18 nt, Human
gccagauuucacucuccu

SEQ ID NO: 1960043 - RNA, 16 nt, Human
gccagauuucacucuc

SEQ ID NO: 1960044 - RNA, 18 nt, Human
gccagggacagagggggu

SEQ ID NO: 1960045 - RNA, 16 nt, Human
gccagggacagagggg

SEQ ID NO: 1960046 - RNA, 13 nt, Human
gccagggacagag

SEQ ID NO: 1960047 - RNA, 22 nt, Human
gccaggcuggucucgaacuccu

SEQ ID NO: 1960048 - RNA, 23 nt, Human
gccagggacagaggggguggccu

SEQ ID NO: 1960049 - RNA, 19 nt, Human
gccagggaaagacuggcaa

SEQ ID NO: 1960050 - RNA, 20 nt, Human
gccagggaaagacuggcaag

SEQ ID NO: 1960051 - RNA, 16 nt, Human
gccagggaccccagaa

SEQ ID NO: 1960052 - RNA, 22 nt, Human
gccagggaccccagaaucaugu

SEQ ID NO: 1960053 - RNA, 18 nt, Human
gccagucaccccggccac

SEQ ID NO: 1960054 - RNA, 17 nt, Human
gccagucaccccggcca

SEQ ID NO: 1960055 - RNA, 20 nt, Human
gccagucaccccggccaccu

SEQ ID NO: 1960056 - RNA, 12 nt, Human
gccaguaaaugg

SEQ ID NO: 1960057 - RNA, 14 nt, Human
gccagguugcuaag

SEQ ID NO: 1960058 - RNA, 18 nt, Human
gccagguugcuaagaaac

SEQ ID NO: 1960059 - RNA, 17 nt, Human
gccagguuuuuggucug

SEQ ID NO: 1960060 - RNA, 18 nt, Human
gccagguggccacuccag

SEQ ID NO: 1960061 - RNA, 17 nt, Human
gccaggggaccuccugg

SEQ ID NO: 1960062 - RNA, 22 nt, Human
gccaggggagguuacagguacc

SEQ ID NO: 1960063 - RNA, 17 nt, Human
gcccagccccuucugac

SEQ ID NO: 1960064 - RNA, 16 nt, Human
gcccagccccuucuga

SEQ ID NO: 1960065 - RNA, 14 nt, Human
gcccagccccuucu

SEQ ID NO: 1960066 - RNA, 13 nt, Human
gcccagccccuuc

SEQ ID NO: 1960067 - RNA, 24 nt, Human
gcccagccccuucugacccaugcu

SEQ ID NO: 1960068 - RNA, 20 nt, Human
gcccagccccuucugaccca

SEQ ID NO: 1960069 - RNA, 19 nt, Human
gcccagcgcggacaucccc

SEQ ID NO: 1960070 - RNA, 17 nt, Human
gcccagcgcggacaucc

SEQ ID NO: 1960071 - RNA, 15 nt, Human
gcccagccucuuucc

SEQ ID NO: 1960072 - RNA, 21 nt, Human
gcccagccucuuucccuucca

SEQ ID NO: 1960073 - RNA, 21 nt, Human
gcccagcuugaaaccuucacu

SEQ ID NO: 1960074 - RNA, 21 nt, Human
gcccaggaaaggcuccaggag

SEQ ID NO: 1960075 - RNA, 20 nt, Human
gcccaggaaaggcuccagga

SEQ ID NO: 1960076 - RNA, 19 nt, Human
gcccaggaaaggcuccagg

SEQ ID NO: 1960077 - RNA, 18 nt, Human
gcccaggaaaggcuccag

SEQ ID NO: 1960078 - RNA, 22 nt, Human
gcccaggcuggcgugcaguggu

SEQ ID NO: 1960079 - RNA, 19 nt, Human
gcccaggcuggcgugcagu

SEQ ID NO: 1960080 - RNA, 20 nt, Human
gcccaggcuggcgugcagug

SEQ ID NO: 1960081 - RNA, 21 nt, Human
gcccaggcuuagucacugaga

SEQ ID NO: 1960082 - RNA, 19 nt, Human
gcccaggcuuagucacuga

SEQ ID NO: 1960083 - RNA, 23 nt, Human
gcccaggcuuagucacugagaca

SEQ ID NO: 1960084 - RNA, 19 nt, Human
gcccagucuggaaugcagu

SEQ ID NO: 1960085 - RNA, 20 nt, Human
gcccagucuggaaugcagug

SEQ ID NO: 1960086 - RNA, 15 nt, Human
gcccaguugggugga

SEQ ID NO: 1960087 - RNA, 16 nt, Human
gcccagaucagccaga

SEQ ID NO: 1960088 - RNA, 18 nt, Human
gcccagaucagccagaag

SEQ ID NO: 1960089 - RNA, 16 nt, Human
gcccagagucccccca

SEQ ID NO: 1960090 - RNA, 18 nt, Human
gcccagaguccccccacu

SEQ ID NO: 1960091 - RNA, 23 nt, Human
gcccagaguccccccacucccag

SEQ ID NO: 1960092 - RNA, 21 nt, Human
gcccagcaccacccuccuucc

SEQ ID NO: 1960093 - RNA, 21 nt, Human
gcccagagggccugcaaggga

SEQ ID NO: 1960094 - RNA, 20 nt, Human
gcccagagggccugcaaggg

SEQ ID NO: 1960095 - RNA, 22 nt, Human
gcccagagggccugcaagggag

SEQ ID NO: 1960096 - RNA, 11 nt, Human
gcccagccccu

SEQ ID NO: 1960097 - RNA, 16 nt, Human
gcccagcccaccccau

SEQ ID NO: 1960098 - RNA, 12 nt, Human
gcccagccccuu

SEQ ID NO: 1960099 - RNA, 9 nt, Human
gcccagccc

SEQ ID NO: 1960100 - RNA, 20 nt, Human
gcccaaugagacucuagggu

SEQ ID NO: 1960101 - RNA, 14 nt, Human
gcccagacccugga

SEQ ID NO: 1960102 - RNA, 17 nt, Human
gcccagacccuggagga

SEQ ID NO: 1960103 - RNA, 18 nt, Human
gcccagacccuggaggaa

SEQ ID NO: 1960104 - RNA, 21 nt, Human
gcccaaugcacuuuguucugg

SEQ ID NO: 1960105 - RNA, 19 nt, Human
gcccagagacccaagcugc

SEQ ID NO: 1960106 - RNA, 21 nt, Human
gcccagagagaagagccccac

SEQ ID NO: 1960107 - RNA, 22 nt, Human
gcccagagagaagagccccacu

SEQ ID NO: 1960108 - RNA, 17 nt, Human
gcccagagagaagagcc

SEQ ID NO: 1960109 - RNA, 19 nt, Human
gcccagagagaagagcccc

SEQ ID NO: 1960110 - RNA, 20 nt, Human
gcccagagagaagagcccca

SEQ ID NO: 1960111 - RNA, 19 nt, Human
gcccagagggccugcaagg

SEQ ID NO: 1960112 - RNA, 18 nt, Human
gcccagagggccugcaag

SEQ ID NO: 1960113 - RNA, 15 nt, Human
gcccagagggccugc

SEQ ID NO: 1960114 - RNA, 14 nt, Human
gcccagagggccug

SEQ ID NO: 1960115 - RNA, 12 nt, Human
gcccagagggcc

SEQ ID NO: 1960116 - RNA, 23 nt, Human
gcccagagagaagagccccacuc

SEQ ID NO: 1960117 - RNA, 21 nt, Human
gcauuccccaggaggccagcc

SEQ ID NO: 1960118 - RNA, 20 nt, Human
gcauuccccaggaggccagc

SEQ ID NO: 1960119 - RNA, 19 nt, Human
gcauuccccaggaggccag

SEQ ID NO: 1960120 - RNA, 18 nt, Human
gcauuccccaggaggcca

SEQ ID NO: 1960121 - RNA, 17 nt, Human
gcauuccccaggaggcc

SEQ ID NO: 1960122 - RNA, 16 nt, Human
gcauuccccaggaggc

SEQ ID NO: 1960123 - RNA, 15 nt, Human
gcauuccccaggagg

SEQ ID NO: 1960124 - RNA, 14 nt, Human
gcauuccccaggag

SEQ ID NO: 1960125 - RNA, 22 nt, Human
gcauuccccaggaggccagccu

SEQ ID NO: 1960126 - RNA, 18 nt, Human
gcauuugaggucuguucu

SEQ ID NO: 1960127 - RNA, 13 nt, Human
gcauuacaggcaa

SEQ ID NO: 1960128 - RNA, 19 nt, Human
gcauuaucuagauacugua

SEQ ID NO: 1960129 - RNA, 16 nt, Human
gcauuaccucuuugga

SEQ ID NO: 1960130 - RNA, 18 nt, Human
gcauuaccucuuuggaaa

SEQ ID NO: 1960131 - RNA, 22 nt, Human
gcauuaucuagauacuguauca

SEQ ID NO: 1960132 - RNA, 24 nt, Human
gcauuaucuagauacuguaucaug

SEQ ID NO: 1960133 - RNA, 15 nt, Human
gcaugccuggauggg

SEQ ID NO: 1960134 - RNA, 13 nt, Human
gcauguuacauaa

SEQ ID NO: 1960135 - RNA, 14 nt, Human
gcauguucucugag

SEQ ID NO: 1960136 - RNA, 17 nt, Human
gcaugacagaaaauaug

SEQ ID NO: 1960137 - RNA, 18 nt, Human
gcaugacagaaaauaugu

SEQ ID NO: 1960138 - RNA, 19 nt, Human
gcaugacagaaaauaugua

SEQ ID NO: 1960139 - RNA, 21 nt, Human
gcaugacagaaaauauguauu

SEQ ID NO: 1960140 - RNA, 14 nt, Human
gcaugccuggaugg

SEQ ID NO: 1960141 - RNA, 22 nt, Human
gcaugacacgaauauugcugau

SEQ ID NO: 1960142 - RNA, 15 nt, Human
gcaugacagaaaaua

SEQ ID NO: 1960143 - RNA, 21 nt, Human
gcaugacacgaauauugcuga

SEQ ID NO: 1960144 - RNA, 20 nt, Human
gcaugacacgaauauugcug

SEQ ID NO: 1960145 - RNA, 21 nt, Human
gcaugaaguaauaugcacaca

SEQ ID NO: 1960146 - RNA, 22 nt, Human
gcaugaaguaauaugcacacau

SEQ ID NO: 1960147 - RNA, 20 nt, Human
gcaugaaguaauaugcacac

SEQ ID NO: 1960148 - RNA, 17 nt, Human
gcaucuggguagcugua

SEQ ID NO: 1960149 - RNA, 15 nt, Human
gcaucucagcccaca

SEQ ID NO: 1960150 - RNA, 21 nt, Human
gcaucucacagcuaugcaaaa

SEQ ID NO: 1960151 - RNA, 23 nt, Human
gcaucuggaagagcuaggcaggg

SEQ ID NO: 1960152 - RNA, 12 nt, Human
gcaucaggccag

SEQ ID NO: 1960153 - RNA, 22 nt, Human
gcauacugccuuguuuaauggu

SEQ ID NO: 1960154 - RNA, 18 nt, Human
gcaucaggccaggcccuc

SEQ ID NO: 1960155 - RNA, 19 nt, Human
gcaucagcugcucagaucc

SEQ ID NO: 1960156 - RNA, 23 nt, Human
gcaucaggccaggcccucugccc

SEQ ID NO: 1960157 - RNA, 15 nt, Human
gcaucagugcccucc

SEQ ID NO: 1960158 - RNA, 13 nt, Human
gcaucucagccca

SEQ ID NO: 1960159 - RNA, 14 nt, Human
gcaucucagcccac

SEQ ID NO: 1960160 - RNA, 12 nt, Human
gcaucucagccc

SEQ ID NO: 1960161 - RNA, 23 nt, Human
gcaucagugcccuccaggauaga

SEQ ID NO: 1960162 - RNA, 15 nt, Human
gcaucauuccaggcc

SEQ ID NO: 1960163 - RNA, 17 nt, Human
gcaucauuccaggcccg

SEQ ID NO: 1960164 - RNA, 16 nt, Human
gcaucauucucuaaua

SEQ ID NO: 1960165 - RNA, 23 nt, Human
gcaggucccuaauaaagcugugu

SEQ ID NO: 1960166 - RNA, 21 nt, Human
gcaggucccuaauaaagcugu

SEQ ID NO: 1960167 - RNA, 20 nt, Human
gcaggucccuaauaaagcug

SEQ ID NO: 1960168 - RNA, 19 nt, Human
gcaggucccuaauaaagcu

SEQ ID NO: 1960169 - RNA, 18 nt, Human
gcaggucccuaauaaagc

SEQ ID NO: 1960170 - RNA, 17 nt, Human
gcaggucccuaauaaag

SEQ ID NO: 1960171 - RNA, 16 nt, Human
gcaggucccuaauaaa

SEQ ID NO: 1960172 - RNA, 11 nt, Human
gcagugggagc

SEQ ID NO: 1960173 - RNA, 16 nt, Human
gcagugggccuggcca

SEQ ID NO: 1960174 - RNA, 21 nt, Human
gcagugggacagggcauggcc

SEQ ID NO: 1960175 - RNA, 17 nt, Human
gcagugggccuggccag

SEQ ID NO: 1960176 - RNA, 18 nt, Human
gcaguggugcgaucuggg

SEQ ID NO: 1960177 - RNA, 19 nt, Human
gcaguggugcgaucugggu

SEQ ID NO: 1960178 - RNA, 19 nt, Human
gcauacguacacauuuuau

SEQ ID NO: 1960179 - RNA, 20 nt, Human
gcaguggugguuuucuguuc

SEQ ID NO: 1960180 - RNA, 21 nt, Human
gcaguggugguuuucuguucu

SEQ ID NO: 1960181 - RNA, 19 nt, Human
gcaguggugguuuucuguu

SEQ ID NO: 1960182 - RNA, 22 nt, Human
gcaguggugcgaucuggguuca

SEQ ID NO: 1960183 - RNA, 20 nt, Human
gcaguggugcgaucuggguu

SEQ ID NO: 1960184 - RNA, 21 nt, Human
gcaguggugcgaucuggguuc

SEQ ID NO: 1960185 - RNA, 15 nt, Human
gcaggucccuaauaa

SEQ ID NO: 1960186 - RNA, 14 nt, Human
gcaggucccuaaua

SEQ ID NO: 1960187 - RNA, 19 nt, Human
gcaggguccuagaaauucc

SEQ ID NO: 1960188 - RNA, 16 nt, Human
gcagggucucacucug

SEQ ID NO: 1960189 - RNA, 22 nt, Human
gcaggggaggguagagcggaga

SEQ ID NO: 1960190 - RNA, 21 nt, Human
gcaggggaggccaucuggaga

SEQ ID NO: 1960191 - RNA, 14 nt, Human
gcagggcuuuaaaa

SEQ ID NO: 1960192 - RNA, 18 nt, Human
gcaggggaggccaucugg

SEQ ID NO: 1960193 - RNA, 19 nt, Human
gcaggggaggccaucugga

SEQ ID NO: 1960194 - RNA, 17 nt, Human
gcagggcuuuaaaauuc

SEQ ID NO: 1960195 - RNA, 15 nt, Human
gcaggggaggccauc

SEQ ID NO: 1960196 - RNA, 17 nt, Human
gcaggggaggccaucug

SEQ ID NO: 1960197 - RNA, 22 nt, Human
gcaggcgcaagggaggcccagc

SEQ ID NO: 1960198 - RNA, 13 nt, Human
gcaggccucccug

SEQ ID NO: 1960199 - RNA, 17 nt, Human
gcaggccucccugccag

SEQ ID NO: 1960200 - RNA, 18 nt, Human
gcaggccucccugccagu

SEQ ID NO: 1960201 - RNA, 21 nt, Human
gcagggcaggaccagcccacg

SEQ ID NO: 1960202 - RNA, 17 nt, Human
gcagggcaggaccagcc

SEQ ID NO: 1960203 - RNA, 18 nt, Human
gcagggcaggaccagccc

SEQ ID NO: 1960204 - RNA, 19 nt, Human
gcagggcaggaccagccca

SEQ ID NO: 1960205 - RNA, 14 nt, Human
gcagggcaggacca

SEQ ID NO: 1960206 - RNA, 15 nt, Human
gcagggcaggaccag

SEQ ID NO: 1960207 - RNA, 16 nt, Human
gcagggcaggaccagc

SEQ ID NO: 1960208 - RNA, 16 nt, Human
gcagggcacagggccu

SEQ ID NO: 1960209 - RNA, 19 nt, Human
gcagggcacagggccuggc

SEQ ID NO: 1960210 - RNA, 22 nt, Human
gcagggcacagggccuggccca

SEQ ID NO: 1960211 - RNA, 12 nt, Human
gcagggcacagg

SEQ ID NO: 1960212 - RNA, 13 nt, Human
gcagggcacaggg

SEQ ID NO: 1960213 - RNA, 14 nt, Human
gcagggcacagggc

SEQ ID NO: 1960214 - RNA, 17 nt, Human
gcaggcagccaggccac

SEQ ID NO: 1960215 - RNA, 18 nt, Human
gcaggcagccaggccaca

SEQ ID NO: 1960216 - RNA, 13 nt, Human
gcaggcagccuug

SEQ ID NO: 1960217 - RNA, 12 nt, Human
gcaggcaggcug

SEQ ID NO: 1960218 - RNA, 16 nt, Human
gcaggccaggccagcu

SEQ ID NO: 1960219 - RNA, 15 nt, Human
gcaggccaggccagc

SEQ ID NO: 1960220 - RNA, 17 nt, Human
gcaggccaggccagcug

SEQ ID NO: 1960221 - RNA, 11 nt, Human
gcaggcccacc

SEQ ID NO: 1960222 - RNA, 14 nt, Human
gcaggcccacccug

SEQ ID NO: 1960223 - RNA, 15 nt, Human
gcaggcccacccugc

SEQ ID NO: 1960224 - RNA, 16 nt, Human
gcaggcccacccugcu

SEQ ID NO: 1960225 - RNA, 20 nt, Human
gcaggcccacccugcuuggc

SEQ ID NO: 1960226 - RNA, 14 nt, Human
gcaggcccauggga

SEQ ID NO: 1960227 - RNA, 17 nt, Human
gcaggcccaugggaggc

SEQ ID NO: 1960228 - RNA, 22 nt, Human
gcaggcccaugggaggcuggag

SEQ ID NO: 1960229 - RNA, 11 nt, Human
gcaggcagggg

SEQ ID NO: 1960230 - RNA, 17 nt, Human
gcaccacacucagcccu

SEQ ID NO: 1960231 - RNA, 15 nt, Human
gcaccacacucagcc

SEQ ID NO: 1960232 - RNA, 14 nt, Human
gcacagggccuggc

SEQ ID NO: 1960233 - RNA, 16 nt, Human
gcacagggccuggccc

SEQ ID NO: 1960234 - RNA, 17 nt, Human
gcacagggccuggccca

SEQ ID NO: 1960235 - RNA, 18 nt, Human
gcacagggccuggcccau

SEQ ID NO: 1960236 - RNA, 19 nt, Human
gcacagggccuggcccaug

SEQ ID NO: 1960237 - RNA, 13 nt, Human
gcacaggucaggc

SEQ ID NO: 1960238 - RNA, 19 nt, Human
gcaccaaaauaagaaaaga

SEQ ID NO: 1960239 - RNA, 20 nt, Human
gcaccaaaauaagaaaagau

SEQ ID NO: 1960240 - RNA, 15 nt, Human
gcaccaucucuccuc

SEQ ID NO: 1960241 - RNA, 14 nt, Human
gcaccaucucuccu

SEQ ID NO: 1960242 - RNA, 13 nt, Human
gcaccagcagccu

SEQ ID NO: 1960243 - RNA, 14 nt, Human
gcaccagcagccug

SEQ ID NO: 1960244 - RNA, 17 nt, Human
gcaccaucucuccuccu

SEQ ID NO: 1960245 - RNA, 20 nt, Human
gauugugucucuugguccug

SEQ ID NO: 1960246 - RNA, 21 nt, Human
gauugugugguguuuuggauu

SEQ ID NO: 1960247 - RNA, 22 nt, Human
gcacaggcugagugcaggccca

SEQ ID NO: 1960248 - RNA, 16 nt, Human
gcacagggagaggccg

SEQ ID NO: 1960249 - RNA, 23 nt, Human
gcacaggcugagugcaggcccac

SEQ ID NO: 1960250 - RNA, 16 nt, Human
gcacagggcaguggga

SEQ ID NO: 1960251 - RNA, 16 nt, Human
gcacagggcaugaaau

SEQ ID NO: 1960252 - RNA, 18 nt, Human
gcacagggcaugaaauga

SEQ ID NO: 1960253 - RNA, 22 nt, Human
gcacagggcaugaaaugaacac

SEQ ID NO: 1960254 - RNA, 23 nt, Human
gcacagggcaugaaaugaacaca

SEQ ID NO: 1960255 - RNA, 11 nt, Human
gcacagggccu

SEQ ID NO: 1960256 - RNA, 23 nt, Human
gcacagcuucauuuccugugucu

SEQ ID NO: 1960257 - RNA, 21 nt, Human
gcacagcuucauuuccugugu

SEQ ID NO: 1960258 - RNA, 19 nt, Human
gcacccucaggcagguggg

SEQ ID NO: 1960259 - RNA, 16 nt, Human
gcacccucaggcaggu

SEQ ID NO: 1960260 - RNA, 14 nt, Human
gcaccccuuccugg

SEQ ID NO: 1960261 - RNA, 15 nt, Human
gcaccccuuccuggg

SEQ ID NO: 1960262 - RNA, 23 nt, Human
gcaccccuuccugggcacacgcu

SEQ ID NO: 1960263 - RNA, 14 nt, Human
gcacgugugugcac

SEQ ID NO: 1960264 - RNA, 20 nt, Human
gcacuaaggugugcucugau

SEQ ID NO: 1960265 - RNA, 15 nt, Human
gcacuaagucucuuu

SEQ ID NO: 1960266 - RNA, 19 nt, Human
gcacuaagucucuuuuuua

SEQ ID NO: 1960267 - RNA, 20 nt, Human
gcacuaagucucuuuuuuac

SEQ ID NO: 1960268 - RNA, 22 nt, Human
gcacuaagucucuuuuuuacaa

SEQ ID NO: 1960269 - RNA, 23 nt, Human
gcacuaagucucuuuuuuacaaa

SEQ ID NO: 1960270 - RNA, 15 nt, Human
gcacugcuuccagug

SEQ ID NO: 1960271 - RNA, 14 nt, Human
gcacugcuuccagu

SEQ ID NO: 1960272 - RNA, 13 nt, Human
gcacugcuuccag

SEQ ID NO: 1960273 - RNA, 12 nt, Human
gcacugcuucca

SEQ ID NO: 1960274 - RNA, 15 nt, Human
gcacuauaauguaag

SEQ ID NO: 1960275 - RNA, 14 nt, Human
gcacuauaauguaa

SEQ ID NO: 1960276 - RNA, 20 nt, Human
gcacuauaauguaagcucua

SEQ ID NO: 1960277 - RNA, 22 nt, Human
gcacuauaauguaagcucuacu

SEQ ID NO: 1960278 - RNA, 12 nt, Human
gcacugggcuug

SEQ ID NO: 1960279 - RNA, 19 nt, Human
gcacuguuuuauuuuaauu

SEQ ID NO: 1960280 - RNA, 22 nt, Human
gcagaucucccacaugccaggg

SEQ ID NO: 1960281 - RNA, 23 nt, Human
gcagagguugcagugagccgaga

SEQ ID NO: 1960282 - RNA, 18 nt, Human
gcagagguugcagugagc

SEQ ID NO: 1960283 - RNA, 21 nt, Human
gcagagguccacaacacacag

SEQ ID NO: 1960284 - RNA, 18 nt, Human
gcagauguccuugaugcu

SEQ ID NO: 1960285 - RNA, 18 nt, Human
gcagauggagaccccuug

SEQ ID NO: 1960286 - RNA, 23 nt, Human
gcagaugaggugaaaaggccaag

SEQ ID NO: 1960287 - RNA, 17 nt, Human
gcagacucuacagaggc

SEQ ID NO: 1960288 - RNA, 18 nt, Human
gcagacucuacagaggcc

SEQ ID NO: 1960289 - RNA, 19 nt, Human
gcagacucuacagaggcca

SEQ ID NO: 1960290 - RNA, 22 nt, Human
gcagacucuacagaggccaugg

SEQ ID NO: 1960291 - RNA, 22 nt, Human
gcacuucgggaggucgaggcag

SEQ ID NO: 1960292 - RNA, 14 nt, Human
gcacuucugccuga

SEQ ID NO: 1960293 - RNA, 21 nt, Human
gcacuucugccugaggggcag

SEQ ID NO: 1960294 - RNA, 14 nt, Human
gcacuugcagacuc

SEQ ID NO: 1960295 - RNA, 16 nt, Human
gcacuugcagacucua

SEQ ID NO: 1960296 - RNA, 21 nt, Human
gcagagaccaucccugaaggc

SEQ ID NO: 1960297 - RNA, 20 nt, Human
gcagagaccaucccugaagg

SEQ ID NO: 1960298 - RNA, 22 nt, Human
gcagagaccaucccugaaggcc

SEQ ID NO: 1960299 - RNA, 20 nt, Human
gcagagaagugacgguuccu

SEQ ID NO: 1960300 - RNA, 19 nt, Human
gcagacuuuuaaagacuug

SEQ ID NO: 1960301 - RNA, 20 nt, Human
gcagacuuuuaaagacuugc

SEQ ID NO: 1960302 - RNA, 17 nt, Human
gcagacuuuuaaagacu

SEQ ID NO: 1960303 - RNA, 19 nt, Human
gcagcagggagggcuucug

SEQ ID NO: 1960304 - RNA, 18 nt, Human
gcagcagggagggcuucu

SEQ ID NO: 1960305 - RNA, 20 nt, Human
gcagcagggagggcuucugc

SEQ ID NO: 1960306 - RNA, 14 nt, Human
gcagcccugcuuug

SEQ ID NO: 1960307 - RNA, 24 nt, Human
gcagcccugcuuugggcugcccug

SEQ ID NO: 1960308 - RNA, 19 nt, Human
gcagccucacaguccuuac

SEQ ID NO: 1960309 - RNA, 17 nt, Human
gcagccucacaguccuu

SEQ ID NO: 1960310 - RNA, 15 nt, Human
gcagccucacagucc

SEQ ID NO: 1960311 - RNA, 18 nt, Human
gcagccgccuucacagca

SEQ ID NO: 1960312 - RNA, 19 nt, Human
gcagccgccuucacagcag

SEQ ID NO: 1960313 - RNA, 14 nt, Human
gcagccgccuucac

SEQ ID NO: 1960314 - RNA, 14 nt, Human
gcagcucagagagg

SEQ ID NO: 1960315 - RNA, 21 nt, Human
gcagcucaccucucccuugga

SEQ ID NO: 1960316 - RNA, 20 nt, Human
gcagcucaccucucccuugg

SEQ ID NO: 1960317 - RNA, 17 nt, Human
gcagcucaccucucccu

SEQ ID NO: 1960318 - RNA, 16 nt, Human
gcagcucaccucuccc

SEQ ID NO: 1960319 - RNA, 13 nt, Human
gcagccucugggc

SEQ ID NO: 1960320 - RNA, 17 nt, Human
gcagccuccgcuucccu

SEQ ID NO: 1960321 - RNA, 19 nt, Human
gcagccuccgcuucccugg

SEQ ID NO: 1960322 - RNA, 19 nt, Human
gcagcucagagaggguggg

SEQ ID NO: 1960323 - RNA, 18 nt, Human
gcagcucagagagggugg

SEQ ID NO: 1960324 - RNA, 20 nt, Human
gcagcucagaaccacagcaa

SEQ ID NO: 1960325 - RNA, 18 nt, Human
gcaggaaauggcugugga

SEQ ID NO: 1960326 - RNA, 21 nt, Human
gcaggaccuucgggcugugcc

SEQ ID NO: 1960327 - RNA, 13 nt, Human
gcaggacgacugu

SEQ ID NO: 1960328 - RNA, 19 nt, Human
gauguugaaaaaguucugc

SEQ ID NO: 1960329 - RNA, 21 nt, Human
gauguucuuucacccuuuucu

SEQ ID NO: 1960330 - RNA, 14 nt, Human
gauguuuuccauga

SEQ ID NO: 1960331 - RNA, 23 nt, Human
gauguuuuccaugaguccccugu

SEQ ID NO: 1960332 - RNA, 15 nt, Human
gauguuuuccaugag

SEQ ID NO: 1960333 - RNA, 12 nt, Human
gauuaaauucuu

SEQ ID NO: 1960334 - RNA, 19 nt, Human
gauuaaauucuugcaaagu

SEQ ID NO: 1960335 - RNA, 21 nt, Human
gauuaaccacuucagcugacu

SEQ ID NO: 1960336 - RNA, 19 nt, Human
gauuaaccacuucagcuga

SEQ ID NO: 1960337 - RNA, 18 nt, Human
gauuaaccacuucagcug

SEQ ID NO: 1960338 - RNA, 22 nt, Human
gauuaagaucucagugguuaag

SEQ ID NO: 1960339 - RNA, 12 nt, Human
gauuaacuugga

SEQ ID NO: 1960340 - RNA, 18 nt, Human
gauuaacuuggaugaguu

SEQ ID NO: 1960341 - RNA, 20 nt, Human
gauuaacugaaauaaaaaau

SEQ ID NO: 1960342 - RNA, 19 nt, Human
gauucaacagguuuuccug

SEQ ID NO: 1960343 - RNA, 10 nt, Human
gaugggccug

SEQ ID NO: 1960344 - RNA, 20 nt, Human
gauggugcaaugaccuuuca

SEQ ID NO: 1960345 - RNA, 12 nt, Human
gaugggccugag

SEQ ID NO: 1960346 - RNA, 13 nt, Human
gaugggccugagu

SEQ ID NO: 1960347 - RNA, 18 nt, Human
gaugggccugagugagag

SEQ ID NO: 1960348 - RNA, 23 nt, Human
gauggugcaaugaccuuucaaua

SEQ ID NO: 1960349 - RNA, 19 nt, Human
gaugugcuuguuaacugag

SEQ ID NO: 1960350 - RNA, 15 nt, Human
gaugugcugcagugc

SEQ ID NO: 1960351 - RNA, 15 nt, Human
gaugugcugcuuuga

SEQ ID NO: 1960352 - RNA, 12 nt, Human
gaugugccuaaa

SEQ ID NO: 1960353 - RNA, 21 nt, Human
gauguggaaaagccaagaggc

SEQ ID NO: 1960354 - RNA, 23 nt, Human
gauguggaaaagccaagaggcug

SEQ ID NO: 1960355 - RNA, 20 nt, Human
gaugugcuuguuaacugagu

SEQ ID NO: 1960356 - RNA, 13 nt, Human
gauguguaauuuu

SEQ ID NO: 1960357 - RNA, 17 nt, Human
gauguguaauuuuucug

SEQ ID NO: 1960358 - RNA, 19 nt, Human
gauguguaauuuuucugua

SEQ ID NO: 1960359 - RNA, 18 nt, Human
gauguguccucagggagc

SEQ ID NO: 1960360 - RNA, 20 nt, Human
gauguguaauuuuucuguau

SEQ ID NO: 1960361 - RNA, 13 nt, Human
gauguguccucag

SEQ ID NO: 1960362 - RNA, 21 nt, Human
gauguguccugauaagcugag

SEQ ID NO: 1960363 - RNA, 14 nt, Human
gauguucugggaca

SEQ ID NO: 1960364 - RNA, 16 nt, Human
gauguucugggacaca

SEQ ID NO: 1960365 - RNA, 16 nt, Human
gauuccuguuucaagu

SEQ ID NO: 1960366 - RNA, 16 nt, Human
gauucccuuguuauuc

SEQ ID NO: 1960367 - RNA, 19 nt, Human
gauucccuuguuauucaac

SEQ ID NO: 1960368 - RNA, 22 nt, Human
gauuccuaaucacucagagcag

SEQ ID NO: 1960369 - RNA, 13 nt, Human
gauucccuuguua

SEQ ID NO: 1960370 - RNA, 12 nt, Human
gauucagacagc

SEQ ID NO: 1960371 - RNA, 22 nt, Human
gauucccaagcucugcuccucu

SEQ ID NO: 1960372 - RNA, 19 nt, Human
gauucacaccccaccugcg

SEQ ID NO: 1960373 - RNA, 13 nt, Human
gauucacauguuu

SEQ ID NO: 1960374 - RNA, 16 nt, Human
gauucacauguuuuca

SEQ ID NO: 1960375 - RNA, 17 nt, Human
gauucacauguuuucaa

SEQ ID NO: 1960376 - RNA, 18 nt, Human
gauucacauguuuucaaa

SEQ ID NO: 1960377 - RNA, 19 nt, Human
gauucacauguuuucaaau

SEQ ID NO: 1960378 - RNA, 20 nt, Human
gauucacauguuuucaaaug

SEQ ID NO: 1960379 - RNA, 22 nt, Human
gauucacauguuuucaaaugga

SEQ ID NO: 1960380 - RNA, 17 nt, Human
gauugaagaaacagcua

SEQ ID NO: 1960381 - RNA, 17 nt, Human
gauugaaaauaaugcug

SEQ ID NO: 1960382 - RNA, 20 nt, Human
gauucuauguuaauauuuua

SEQ ID NO: 1960383 - RNA, 13 nt, Human
gauucuaggaccu

SEQ ID NO: 1960384 - RNA, 17 nt, Human
gauucuauguuaauauu

SEQ ID NO: 1960385 - RNA, 23 nt, Human
gauugacgggacuguugguauug

SEQ ID NO: 1960386 - RNA, 18 nt, Human
gauugcuuuuaaaauuuu

SEQ ID NO: 1960387 - RNA, 18 nt, Human
gauugcuugagcucagga

SEQ ID NO: 1960388 - RNA, 13 nt, Human
gauugcuuuuaaa

SEQ ID NO: 1960389 - RNA, 14 nt, Human
gauugcuuuuaaaa

SEQ ID NO: 1960390 - RNA, 16 nt, Human
gauugcuuuuaaaauu

SEQ ID NO: 1960391 - RNA, 15 nt, Human
gauuguccccgaccc

SEQ ID NO: 1960392 - RNA, 23 nt, Human
gauuguaauauguaaaugguaug

SEQ ID NO: 1960393 - RNA, 19 nt, Human
gauuggauuuuauguugac

SEQ ID NO: 1960394 - RNA, 20 nt, Human
gauuguccccgacccuugcc

SEQ ID NO: 1960395 - RNA, 20 nt, Human
gauugucaaugcuggagaaa

SEQ ID NO: 1960396 - RNA, 21 nt, Human
gauugucaaugcuggagaaaa

SEQ ID NO: 1960397 - RNA, 13 nt, Human
gauugugccccug

SEQ ID NO: 1960398 - RNA, 18 nt, Human
gauugugccuaauguguu

SEQ ID NO: 1960399 - RNA, 11 nt, Human
gauccuccagg

SEQ ID NO: 1960400 - RNA, 18 nt, Human
gauccuaguuccaccauc

SEQ ID NO: 1960401 - RNA, 15 nt, Human
gaucacgccacugca

SEQ ID NO: 1960402 - RNA, 23 nt, Human
gaucaaccccuucgcuccugugu

SEQ ID NO: 1960403 - RNA, 13 nt, Human
gaucacgccacug

SEQ ID NO: 1960404 - RNA, 14 nt, Human
gaucacgccacugc

SEQ ID NO: 1960405 - RNA, 19 nt, Human
gauccugagccagauuuca

SEQ ID NO: 1960406 - RNA, 15 nt, Human
gauccugagccagau

SEQ ID NO: 1960407 - RNA, 14 nt, Human
gauccugagccaga

SEQ ID NO: 1960408 - RNA, 13 nt, Human
gauccugagccag

SEQ ID NO: 1960409 - RNA, 12 nt, Human
gauccuccaggu

SEQ ID NO: 1960410 - RNA, 19 nt, Human
gauccucccaccucagccu

SEQ ID NO: 1960411 - RNA, 20 nt, Human
gauccucccaccucagccuc

SEQ ID NO: 1960412 - RNA, 21 nt, Human
gauccucccaccucagccucc

SEQ ID NO: 1960413 - RNA, 15 nt, Human
gauccuuuuggaguc

SEQ ID NO: 1960414 - RNA, 17 nt, Human
gauccuuuuggagucag

SEQ ID NO: 1960415 - RNA, 18 nt, Human
gauccucccaccucagcc

SEQ ID NO: 1960416 - RNA, 20 nt, Human
gauccuuguguuuaucagaa

SEQ ID NO: 1960417 - RNA, 15 nt, Human
gaugaaaaaauaaca

SEQ ID NO: 1960418 - RNA, 17 nt, Human
gaugaaaagcuuuguuu

SEQ ID NO: 1960419 - RNA, 16 nt, Human
gaucuuugcagacagg

SEQ ID NO: 1960420 - RNA, 20 nt, Human
gaugcauggagauagcccca

SEQ ID NO: 1960421 - RNA, 15 nt, Human
gaugcauuaaaagaa

SEQ ID NO: 1960422 - RNA, 16 nt, Human
gaugcauuaaaagaaa

SEQ ID NO: 1960423 - RNA, 17 nt, Human
gaugcauuaaaagaaaa

SEQ ID NO: 1960424 - RNA, 13 nt, Human
gaugcauggagau

SEQ ID NO: 1960425 - RNA, 17 nt, Human
gaugcaauguagagggg

SEQ ID NO: 1960426 - RNA, 18 nt, Human
gaugcaauccuuacaaau

SEQ ID NO: 1960427 - RNA, 19 nt, Human
gaugcaauccuuacaaaug

SEQ ID NO: 1960428 - RNA, 20 nt, Human
gaugcaauccuuacaaauga

SEQ ID NO: 1960429 - RNA, 14 nt, Human
gaugacuauggaaa

SEQ ID NO: 1960430 - RNA, 21 nt, Human
gaugacguacaaguaguucug

SEQ ID NO: 1960431 - RNA, 11 nt, Human
gaugagaaagg

SEQ ID NO: 1960432 - RNA, 22 nt, Human
gaugagaaagguugaagcacca

SEQ ID NO: 1960433 - RNA, 22 nt, Human
gaugggcaacccccagccugcu

SEQ ID NO: 1960434 - RNA, 22 nt, Human
gauggcacagggcaugaaauga

SEQ ID NO: 1960435 - RNA, 14 nt, Human
gaugcucacagggc

SEQ ID NO: 1960436 - RNA, 21 nt, Human
gaugccuggcgggguggggug

SEQ ID NO: 1960437 - RNA, 18 nt, Human
gaugccgagguaaaaguu

SEQ ID NO: 1960438 - RNA, 18 nt, Human
gaugcauuaaaagaaaau

SEQ ID NO: 1960439 - RNA, 18 nt, Human
gaggugggauccuccagg

SEQ ID NO: 1960440 - RNA, 20 nt, Human
gaggucccaagguucugggu

SEQ ID NO: 1960441 - RNA, 22 nt, Human
gaggugggauccuccaggugca

SEQ ID NO: 1960442 - RNA, 21 nt, Human
gaggugggauccuccaggugc

SEQ ID NO: 1960443 - RNA, 15 nt, Human
gaggggggagguggg

SEQ ID NO: 1960444 - RNA, 15 nt, Human
gaggggguggccucc

SEQ ID NO: 1960445 - RNA, 18 nt, Human
gagguccacaacacacag

SEQ ID NO: 1960446 - RNA, 22 nt, Human
gaggggggaggugggauccucc

SEQ ID NO: 1960447 - RNA, 19 nt, Human
gaguacuacaguccuccca

SEQ ID NO: 1960448 - RNA, 18 nt, Human
gaguacuacaguccuccc

SEQ ID NO: 1960449 - RNA, 17 nt, Human
gaguacguugugcauuu

SEQ ID NO: 1960450 - RNA, 18 nt, Human
gaguacguugugcauuug

SEQ ID NO: 1960451 - RNA, 15 nt, Human
gaguacuacaguccu

SEQ ID NO: 1960452 - RNA, 20 nt, Human
gaguacguugugcauuuggu

SEQ ID NO: 1960453 - RNA, 22 nt, Human
gagguuuguuuagaagaagugu

SEQ ID NO: 1960454 - RNA, 14 nt, Human
gagguucccuuuga

SEQ ID NO: 1960455 - RNA, 19 nt, Human
gagguucaaagauauuuug

SEQ ID NO: 1960456 - RNA, 21 nt, Human
gagguuacagguaccaguucu

SEQ ID NO: 1960457 - RNA, 19 nt, Human
gagguuuuaaaaaaauccc

SEQ ID NO: 1960458 - RNA, 15 nt, Human
gagguuuucuccccc

SEQ ID NO: 1960459 - RNA, 16 nt, Human
gagguuuucuccccca

SEQ ID NO: 1960460 - RNA, 16 nt, Human
gaguaaaaagaaaaca

SEQ ID NO: 1960461 - RNA, 16 nt, Human
gaguacguugugcauu

SEQ ID NO: 1960462 - RNA, 21 nt, Human
gagucugaaggcuggguucug

SEQ ID NO: 1960463 - RNA, 18 nt, Human
gagucucuucuccacugg

SEQ ID NO: 1960464 - RNA, 14 nt, Human
gagucucuucucca

SEQ ID NO: 1960465 - RNA, 15 nt, Human
gagucucuucuccac

SEQ ID NO: 1960466 - RNA, 16 nt, Human
gagucucuucuccacu

SEQ ID NO: 1960467 - RNA, 17 nt, Human
gagucucuucuccacug

SEQ ID NO: 1960468 - RNA, 22 nt, Human
gagucucacuguugcccaggcu

SEQ ID NO: 1960469 - RNA, 23 nt, Human
gagucucacuguugcccaggcug

SEQ ID NO: 1960470 - RNA, 23 nt, Human
gagucucgcuauugucaccaggg

SEQ ID NO: 1960471 - RNA, 12 nt, Human
gagucucuucuc

SEQ ID NO: 1960472 - RNA, 21 nt, Human
gagucucgcucuguugcccag

SEQ ID NO: 1960473 - RNA, 19 nt, Human
gagucucacuguugcccag

SEQ ID NO: 1960474 - RNA, 20 nt, Human
gagucucacuguugcccagg

SEQ ID NO: 1960475 - RNA, 21 nt, Human
gagucucacuguugcccaggc

SEQ ID NO: 1960476 - RNA, 17 nt, Human
gagucgaggacagggag

SEQ ID NO: 1960477 - RNA, 12 nt, Human
gaguccccuguu

SEQ ID NO: 1960478 - RNA, 22 nt, Human
gaguccccccacucccagcauc

SEQ ID NO: 1960479 - RNA, 18 nt, Human
gagucccaggcugagccu

SEQ ID NO: 1960480 - RNA, 19 nt, Human
gagucccaggcugagccuc

SEQ ID NO: 1960481 - RNA, 14 nt, Human
gagucccugccauc

SEQ ID NO: 1960482 - RNA, 23 nt, Human
gaguccccuguuuguuucugaaa

SEQ ID NO: 1960483 - RNA, 14 nt, Human
gaguccccuguuug

SEQ ID NO: 1960484 - RNA, 13 nt, Human
gaguauuuuugua

SEQ ID NO: 1960485 - RNA, 12 nt, Human
gaguagcuggga

SEQ ID NO: 1960486 - RNA, 14 nt, Human
gaguagcugggacu

SEQ ID NO: 1960487 - RNA, 19 nt, Human
gauagcacagacccugccc

SEQ ID NO: 1960488 - RNA, 12 nt, Human
gauagccaaggc

SEQ ID NO: 1960489 - RNA, 21 nt, Human
gauagaguaaaaagaaaacaa

SEQ ID NO: 1960490 - RNA, 16 nt, Human
gauagcauaugacaaa

SEQ ID NO: 1960491 - RNA, 15 nt, Human
gauagcauuguaagc

SEQ ID NO: 1960492 - RNA, 13 nt, Human
gauagccaaggcc

SEQ ID NO: 1960493 - RNA, 21 nt, Human
gauauaaguguguguuuuuca

SEQ ID NO: 1960494 - RNA, 17 nt, Human
gauauaaguguguguuu

SEQ ID NO: 1960495 - RNA, 13 nt, Human
gauauacuuguuu

SEQ ID NO: 1960496 - RNA, 15 nt, Human
gauauacuuguuuuu

SEQ ID NO: 1960497 - RNA, 17 nt, Human
gauauacuuguuuuugu

SEQ ID NO: 1960498 - RNA, 22 nt, Human
gauauacuuguuuuuguaaaga

SEQ ID NO: 1960499 - RNA, 23 nt, Human
gauauaugcucugcauguuacau

SEQ ID NO: 1960500 - RNA, 14 nt, Human
gauauagagucauu

SEQ ID NO: 1960501 - RNA, 19 nt, Human
gauauauguuuuugaaggc

SEQ ID NO: 1960502 - RNA, 23 nt, Human
gauauauuuaaaaacaaaaggca

SEQ ID NO: 1960503 - RNA, 20 nt, Human
gauauauuuuauuuuuagaa

SEQ ID NO: 1960504 - RNA, 21 nt, Human
gaucaaccccuucgcuccugu

SEQ ID NO: 1960505 - RNA, 22 nt, Human
gaucaaccccuucgcuccugug

SEQ ID NO: 1960506 - RNA, 16 nt, Human
gauaaaaaaacagcuu

SEQ ID NO: 1960507 - RNA, 21 nt, Human
gaguuuugggaaguuaaaggg

SEQ ID NO: 1960508 - RNA, 14 nt, Human
gauaauuaaccaag

SEQ ID NO: 1960509 - RNA, 17 nt, Human
gauacaaaagcauguga

SEQ ID NO: 1960510 - RNA, 13 nt, Human
gauacaaugcugu

SEQ ID NO: 1960511 - RNA, 18 nt, Human
gauacaaugcugugcccu

SEQ ID NO: 1960512 - RNA, 18 nt, Human
gauagcacagacccugcc

SEQ ID NO: 1960513 - RNA, 17 nt, Human
gauagcacagacccugc

SEQ ID NO: 1960514 - RNA, 15 nt, Human
gauagaguaaaaaga

SEQ ID NO: 1960515 - RNA, 20 nt, Human
gauagaguaaaaagaaaaca

SEQ ID NO: 1960516 - RNA, 21 nt, Human
gaguggccccaccuggcccuc

SEQ ID NO: 1960517 - RNA, 15 nt, Human
gaguggcuccucccg

SEQ ID NO: 1960518 - RNA, 13 nt, Human
gaguggcuccucc

SEQ ID NO: 1960519 - RNA, 23 nt, Human
gagugggggaucacagccucuga

SEQ ID NO: 1960520 - RNA, 12 nt, Human
gagugggcccaa

SEQ ID NO: 1960521 - RNA, 19 nt, Human
gagugaacaaauuuacaga

SEQ ID NO: 1960522 - RNA, 23 nt, Human
gagucugaggccguugcugacuu

SEQ ID NO: 1960523 - RNA, 20 nt, Human
gagucugagggcuuguaguu

SEQ ID NO: 1960524 - RNA, 12 nt, Human
gagucugaggcc

SEQ ID NO: 1960525 - RNA, 19 nt, Human
gagucugaggccguugcug

SEQ ID NO: 1960526 - RNA, 13 nt, Human
gaguggccccacc

SEQ ID NO: 1960527 - RNA, 17 nt, Human
gaguggccccaccuggc

SEQ ID NO: 1960528 - RNA, 19 nt, Human
gaguggccccaccuggccc

SEQ ID NO: 1960529 - RNA, 20 nt, Human
gaguggccccaccuggcccu

SEQ ID NO: 1960530 - RNA, 22 nt, Human
gagugaacaaauuuacagagac

SEQ ID NO: 1960531 - RNA, 23 nt, Human
gagugaacaaauuuacagagaca

SEQ ID NO: 1960532 - RNA, 15 nt, Human
gaguucauucauauu

SEQ ID NO: 1960533 - RNA, 23 nt, Human
gaguucaucuugaauuguaagga

SEQ ID NO: 1960534 - RNA, 11 nt, Human
gaguuaggaac

SEQ ID NO: 1960535 - RNA, 17 nt, Human
gagugugccugaagucc

SEQ ID NO: 1960536 - RNA, 14 nt, Human
gaguugaagacaga

SEQ ID NO: 1960537 - RNA, 12 nt, Human
gaguuuguuucu

SEQ ID NO: 1960538 - RNA, 14 nt, Human
gaguuuguuucuuu

SEQ ID NO: 1960539 - RNA, 18 nt, Human
gaguuuguuucuuugaau

SEQ ID NO: 1960540 - RNA, 21 nt, Human
gaguugaaaaucuuauaauuu

SEQ ID NO: 1960541 - RNA, 13 nt, Human
gaguuccuagcca

SEQ ID NO: 1960542 - RNA, 17 nt, Human
gaguuccuaccauggag

SEQ ID NO: 1960543 - RNA, 16 nt, Human
gaguucauucauauua

SEQ ID NO: 1960544 - RNA, 18 nt, Human
gaguucauucauauuaca

SEQ ID NO: 1960545 - RNA, 11 nt, Human
gagcccacgcc

SEQ ID NO: 1960546 - RNA, 22 nt, Human
gagccacugcaccgggccacag

SEQ ID NO: 1960547 - RNA, 12 nt, Human
gagcccaggccu

SEQ ID NO: 1960548 - RNA, 16 nt, Human
gagcccacgcccccac

SEQ ID NO: 1960549 - RNA, 15 nt, Human
gagcccacgccccca

SEQ ID NO: 1960550 - RNA, 12 nt, Human
gagcccacgccc

SEQ ID NO: 1960551 - RNA, 14 nt, Human
gagcccaggccucc

SEQ ID NO: 1960552 - RNA, 13 nt, Human
gagcccaggccuc

SEQ ID NO: 1960553 - RNA, 18 nt, Human
gagcagccacauuccuga

SEQ ID NO: 1960554 - RNA, 22 nt, Human
gagcagaugaggugaaaaggcc

SEQ ID NO: 1960555 - RNA, 21 nt, Human
gagcagcaaggucuugcucuc

SEQ ID NO: 1960556 - RNA, 17 nt, Human
gagcagcacccauccac

SEQ ID NO: 1960557 - RNA, 14 nt, Human
gagcagaaauucug

SEQ ID NO: 1960558 - RNA, 17 nt, Human
gagcagaaauucuguuu

SEQ ID NO: 1960559 - RNA, 20 nt, Human
gagcagacacccuuggagcu

SEQ ID NO: 1960560 - RNA, 14 nt, Human
gagccaccgugccu

SEQ ID NO: 1960561 - RNA, 20 nt, Human
gagccaccgugccuggccac

SEQ ID NO: 1960562 - RNA, 16 nt, Human
gagaucagccugggca

SEQ ID NO: 1960563 - RNA, 14 nt, Human
gagaucagccuggg

SEQ ID NO: 1960564 - RNA, 13 nt, Human
gagaucagccugg

SEQ ID NO: 1960565 - RNA, 18 nt, Human
gagauccuuguguuuauc

SEQ ID NO: 1960566 - RNA, 15 nt, Human
gagaucuaaaaauaa

SEQ ID NO: 1960567 - RNA, 20 nt, Human
gagaucaaccccuucgcucc

SEQ ID NO: 1960568 - RNA, 19 nt, Human
gagcaaaaucgaugcagug

SEQ ID NO: 1960569 - RNA, 18 nt, Human
gagcaaaaugcauguaau

SEQ ID NO: 1960570 - RNA, 20 nt, Human
gagcaaaaugcauguaauca

SEQ ID NO: 1960571 - RNA, 23 nt, Human
gagcaagacgcugugcugcccug

SEQ ID NO: 1960572 - RNA, 22 nt, Human
gagcaagacgcugugcugcccu

SEQ ID NO: 1960573 - RNA, 18 nt, Human
gagcaagacgcugugcug

SEQ ID NO: 1960574 - RNA, 21 nt, Human
gagcaagacgcugugcugccc

SEQ ID NO: 1960575 - RNA, 17 nt, Human
gagcaccuuagacaguc

SEQ ID NO: 1960576 - RNA, 19 nt, Human
gagcaccuuagacaguccc

SEQ ID NO: 1960577 - RNA, 23 nt, Human
gagcuacacaggggaaaagagga

SEQ ID NO: 1960578 - RNA, 17 nt, Human
gagcguucaccagugac

SEQ ID NO: 1960579 - RNA, 14 nt, Human
gagcuacaaaugca

SEQ ID NO: 1960580 - RNA, 17 nt, Human
gagcuccccccaggucu

SEQ ID NO: 1960581 - RNA, 11 nt, Human
gagcugccagu

SEQ ID NO: 1960582 - RNA, 21 nt, Human
gagcugccaguggggccugag

SEQ ID NO: 1960583 - RNA, 16 nt, Human
gagcugccaccugccu

SEQ ID NO: 1960584 - RNA, 15 nt, Human
gagcugccaccugcc

SEQ ID NO: 1960585 - RNA, 13 nt, Human
gagcugccaccug

SEQ ID NO: 1960586 - RNA, 16 nt, Human
gagcugcaccagguag

SEQ ID NO: 1960587 - RNA, 16 nt, Human
gagcucugcagagcag

SEQ ID NO: 1960588 - RNA, 14 nt, Human
gagcuucuggcacu

SEQ ID NO: 1960589 - RNA, 18 nt, Human
gagcuucuguugcugccu

SEQ ID NO: 1960590 - RNA, 12 nt, Human
gagcuuagaaac

SEQ ID NO: 1960591 - RNA, 15 nt, Human
gagcuuaacagugug

SEQ ID NO: 1960592 - RNA, 14 nt, Human
gagccuccugcccu

SEQ ID NO: 1960593 - RNA, 20 nt, Human
gagccucagcauccuggcac

SEQ ID NO: 1960594 - RNA, 21 nt, Human
gagccucagcauccuggcacc

SEQ ID NO: 1960595 - RNA, 15 nt, Human
gagcccugguggcag

SEQ ID NO: 1960596 - RNA, 16 nt, Human
gagcccugguggcagu

SEQ ID NO: 1960597 - RNA, 19 nt, Human
gagccucagcauccuggca

SEQ ID NO: 1960598 - RNA, 17 nt, Human
gagcccugguggcagug

SEQ ID NO: 1960599 - RNA, 15 nt, Human
gagccugcagagcug

SEQ ID NO: 1960600 - RNA, 12 nt, Human
gagccugcagag

SEQ ID NO: 1960601 - RNA, 22 nt, Human
gagccuccugcccuuaccugcc

SEQ ID NO: 1960602 - RNA, 20 nt, Human
gagccuccugcccuuaccug

SEQ ID NO: 1960603 - RNA, 12 nt, Human
gagcuacaaaug

SEQ ID NO: 1960604 - RNA, 13 nt, Human
gagcuacaaaugc

SEQ ID NO: 1960605 - RNA, 10 nt, Human
gagccuggca

SEQ ID NO: 1960606 - RNA, 15 nt, Human
gagccuggcaagaau

SEQ ID NO: 1960607 - RNA, 21 nt, Human
gagccugggaggucaaggcug

SEQ ID NO: 1960608 - RNA, 13 nt, Human
gagccugggaggu

SEQ ID NO: 1960609 - RNA, 15 nt, Human
gaggaugucugggcc

SEQ ID NO: 1960610 - RNA, 12 nt, Human
gaggauguucug

SEQ ID NO: 1960611 - RNA, 14 nt, Human
gaggauggcccagg

SEQ ID NO: 1960612 - RNA, 17 nt, Human
gaggauguucugggaca

SEQ ID NO: 1960613 - RNA, 20 nt, Human
gaggauguucugggacacag

SEQ ID NO: 1960614 - RNA, 16 nt, Human
gaggauugcuugagcu

SEQ ID NO: 1960615 - RNA, 14 nt, Human
gaggauuaguuuag

SEQ ID NO: 1960616 - RNA, 23 nt, Human
gaggaguuugggguaugggagag

SEQ ID NO: 1960617 - RNA, 13 nt, Human
gaggcagccccau

SEQ ID NO: 1960618 - RNA, 23 nt, Human
gaggcagccccauucugccugcc

SEQ ID NO: 1960619 - RNA, 22 nt, Human
gaggcagccccauucugccugc

SEQ ID NO: 1960620 - RNA, 12 nt, Human
gaggccagccuu

SEQ ID NO: 1960621 - RNA, 13 nt, Human
gaggccagccuug

SEQ ID NO: 1960622 - RNA, 22 nt, Human
gaggaaggaaacccagcucugg

SEQ ID NO: 1960623 - RNA, 21 nt, Human
gagcuucuguugcugccucau

SEQ ID NO: 1960624 - RNA, 20 nt, Human
gagcuuccaauuuuccuuca

SEQ ID NO: 1960625 - RNA, 19 nt, Human
gaggaaggaacagcaaugg

SEQ ID NO: 1960626 - RNA, 14 nt, Human
gaggaauccagacc

SEQ ID NO: 1960627 - RNA, 15 nt, Human
gaggaauccagaccc

SEQ ID NO: 1960628 - RNA, 18 nt, Human
gaggaauggacauuucua

SEQ ID NO: 1960629 - RNA, 18 nt, Human
gaggacaagagaaaaaag

SEQ ID NO: 1960630 - RNA, 13 nt, Human
gaggacacagaga

SEQ ID NO: 1960631 - RNA, 13 nt, Human
gaggacagggagg

SEQ ID NO: 1960632 - RNA, 13 nt, Human
gaggacacucccg

SEQ ID NO: 1960633 - RNA, 22 nt, Human
gaggacagggaggugaccccag

SEQ ID NO: 1960634 - RNA, 23 nt, Human
gaggacagggaggugaccccagg

SEQ ID NO: 1960635 - RNA, 13 nt, Human
gaggagcccugcc

SEQ ID NO: 1960636 - RNA, 15 nt, Human
gaggagcccugccuc

SEQ ID NO: 1960637 - RNA, 18 nt, Human
gaggagcccugccucucc

SEQ ID NO: 1960638 - RNA, 21 nt, Human
gaggaggccuugggcucugcu

SEQ ID NO: 1960639 - RNA, 22 nt, Human
gaggaggccuugggcucugcug

SEQ ID NO: 1960640 - RNA, 15 nt, Human
gaggcugggcucccu

SEQ ID NO: 1960641 - RNA, 21 nt, Human
gaggcugggacgcucugcugu

SEQ ID NO: 1960642 - RNA, 17 nt, Human
gaggcuuauauuugugu

SEQ ID NO: 1960643 - RNA, 18 nt, Human
gaggcugggacgcucugc

SEQ ID NO: 1960644 - RNA, 19 nt, Human
gaggcugggacgcucugcu

SEQ ID NO: 1960645 - RNA, 20 nt, Human
gaggcugggacgcucugcug

SEQ ID NO: 1960646 - RNA, 13 nt, Human
gaggcuaaaaugu

SEQ ID NO: 1960647 - RNA, 14 nt, Human
gaggcuaaaauguu

SEQ ID NO: 1960648 - RNA, 16 nt, Human
gaggcuaaaauguuuu

SEQ ID NO: 1960649 - RNA, 18 nt, Human
gaggcuaaaauguuuuca

SEQ ID NO: 1960650 - RNA, 14 nt, Human
gaggcugggcuccc

SEQ ID NO: 1960651 - RNA, 13 nt, Human
gaggcugggcucc

SEQ ID NO: 1960652 - RNA, 21 nt, Human
gaggcggagagugcugacugu

SEQ ID NO: 1960653 - RNA, 14 nt, Human
gaggccuucucuga

SEQ ID NO: 1960654 - RNA, 23 nt, Human
gaggcccuucucuccagccccug

SEQ ID NO: 1960655 - RNA, 14 nt, Human
gaggcccuucucuc

SEQ ID NO: 1960656 - RNA, 24 nt, Human
gaggcccuucucuccagccccugg

SEQ ID NO: 1960657 - RNA, 18 nt, Human
gaggcccugcccaaugag

SEQ ID NO: 1960658 - RNA, 13 nt, Human
gaggcccggccuc

SEQ ID NO: 1960659 - RNA, 16 nt, Human
gagggcacugguggcc

SEQ ID NO: 1960660 - RNA, 18 nt, Human
gagggcacugguggcccg

SEQ ID NO: 1960661 - RNA, 22 nt, Human
gaggggccucuuaugggcuggg

SEQ ID NO: 1960662 - RNA, 13 nt, Human
gaggggccuggca

SEQ ID NO: 1960663 - RNA, 14 nt, Human
gaggggccuggcag

SEQ ID NO: 1960664 - RNA, 18 nt, Human
gaggggccuggcagccgu

SEQ ID NO: 1960665 - RNA, 20 nt, Human
gaggggccuggcagccgugc

SEQ ID NO: 1960666 - RNA, 22 nt, Human
gagggcacagaaaauggaagac

SEQ ID NO: 1960667 - RNA, 14 nt, Human
gagggcacagaaaa

SEQ ID NO: 1960668 - RNA, 23 nt, Human
gagggcacagaaaauggaagaca

SEQ ID NO: 1960669 - RNA, 12 nt, Human
gagggcacuggu

SEQ ID NO: 1960670 - RNA, 14 nt, Human
gagggagguaagga

SEQ ID NO: 1960671 - RNA, 13 nt, Human
gagggagugacag

SEQ ID NO: 1960672 - RNA, 14 nt, Human
gagggagugacaga

SEQ ID NO: 1960673 - RNA, 16 nt, Human
gagggagggcuccaga

SEQ ID NO: 1960674 - RNA, 16 nt, Human
gagggagugacagagg

SEQ ID NO: 1960675 - RNA, 22 nt, Human
gagggaaagccuuaagcugcag

SEQ ID NO: 1960676 - RNA, 16 nt, Human
gagggacagucucacc

SEQ ID NO: 1960677 - RNA, 23 nt, Human
gagggacagucucaccauuuccc

SEQ ID NO: 1960678 - RNA, 15 nt, Human
gagggagggcuccag

SEQ ID NO: 1960679 - RNA, 15 nt, Human
gagggagggagggcu

SEQ ID NO: 1960680 - RNA, 14 nt, Human
gagggagggagggc

SEQ ID NO: 1960681 - RNA, 15 nt, Human
gagggaccucuccca

SEQ ID NO: 1960682 - RNA, 14 nt, Human
gagggaccucuccc

SEQ ID NO: 1960683 - RNA, 13 nt, Human
gagggaccucucc

SEQ ID NO: 1960684 - RNA, 18 nt, Human
gagggaccucucccaggg

SEQ ID NO: 1960685 - RNA, 17 nt, Human
gagggaccucucccagg

SEQ ID NO: 1960686 - RNA, 16 nt, Human
cucagauauuugcacc

SEQ ID NO: 1960687 - RNA, 20 nt, Human
cucagaucccacuuuugcca

SEQ ID NO: 1960688 - RNA, 22 nt, Human
cucagaucccacuuuugccaga

SEQ ID NO: 1960689 - RNA, 14 nt, Human
cucagagagggugg

SEQ ID NO: 1960690 - RNA, 13 nt, Human
cucagagugcaag

SEQ ID NO: 1960691 - RNA, 18 nt, Human
cucagagagggugggagu

SEQ ID NO: 1960692 - RNA, 21 nt, Human
cucacuguugcccaggcuggc

SEQ ID NO: 1960693 - RNA, 22 nt, Human
cucacuguugcccaggcuggcg

SEQ ID NO: 1960694 - RNA, 13 nt, Human
cucacugccuccc

SEQ ID NO: 1960695 - RNA, 22 nt, Human
cucacugccaugccagcuuauc

SEQ ID NO: 1960696 - RNA, 19 nt, Human
cucacugccaugccagcuu

SEQ ID NO: 1960697 - RNA, 20 nt, Human
cucacuguugcccaggcugg

SEQ ID NO: 1960698 - RNA, 13 nt, Human
cucagcaccacuc

SEQ ID NO: 1960699 - RNA, 14 nt, Human
cucagcaccacuca

SEQ ID NO: 1960700 - RNA, 16 nt, Human
cucagcaccacucaag

SEQ ID NO: 1960701 - RNA, 13 nt, Human
cucagcaaggcca

SEQ ID NO: 1960702 - RNA, 15 nt, Human
cucagcaaggccacc

SEQ ID NO: 1960703 - RNA, 16 nt, Human
cucagcaaggccaccu

SEQ ID NO: 1960704 - RNA, 17 nt, Human
cucagcaaggccaccuc

SEQ ID NO: 1960705 - RNA, 18 nt, Human
cucagcaaggccaccucu

SEQ ID NO: 1960706 - RNA, 21 nt, Human
cucagcaaggccaccucuucc

SEQ ID NO: 1960707 - RNA, 22 nt, Human
cucagcaaggccaccucuuccu

SEQ ID NO: 1960708 - RNA, 15 nt, Human
cucagaucuucugug

SEQ ID NO: 1960709 - RNA, 15 nt, Human
cucagauuguaauau

SEQ ID NO: 1960710 - RNA, 22 nt, Human
cucagauuguaauauguaaaug

SEQ ID NO: 1960711 - RNA, 16 nt, Human
cucagcauccuggcac

SEQ ID NO: 1960712 - RNA, 17 nt, Human
cucagcauccuggcacc

SEQ ID NO: 1960713 - RNA, 17 nt, Human
cucagcaccacucaaga

SEQ ID NO: 1960714 - RNA, 18 nt, Human
cucagcaccacucaagac

SEQ ID NO: 1960715 - RNA, 21 nt, Human
cucagcaccacucaagaccaa

SEQ ID NO: 1960716 - RNA, 22 nt, Human
cucagcaccacucaagaccaaa

SEQ ID NO: 1960717 - RNA, 13 nt, Human
cucacuccuugaa

SEQ ID NO: 1960718 - RNA, 16 nt, Human
cucacuccuaccuggu

SEQ ID NO: 1960719 - RNA, 17 nt, Human
cucacuccuaccuggua

SEQ ID NO: 1960720 - RNA, 19 nt, Human
cucacuccuaccugguaau

SEQ ID NO: 1960721 - RNA, 11 nt, Human
cucacucuguc

SEQ ID NO: 1960722 - RNA, 12 nt, Human
cucacucugucg

SEQ ID NO: 1960723 - RNA, 10 nt, Human
cucacucuca

SEQ ID NO: 1960724 - RNA, 12 nt, Human
cucacucucagg

SEQ ID NO: 1960725 - RNA, 13 nt, Human
cucacucucagga

SEQ ID NO: 1960726 - RNA, 14 nt, Human
cucacucucaggaa

SEQ ID NO: 1960727 - RNA, 21 nt, Human
cucacucucaggaaaugcuga

SEQ ID NO: 1960728 - RNA, 22 nt, Human
cucacucugucgcccagucugg

SEQ ID NO: 1960729 - RNA, 13 nt, Human
cucacucugucgc

SEQ ID NO: 1960730 - RNA, 21 nt, Human
cucacucugucgcccagucug

SEQ ID NO: 1960731 - RNA, 12 nt, Human
cucacugcagcc

SEQ ID NO: 1960732 - RNA, 13 nt, Human
cucacugcagccu

SEQ ID NO: 1960733 - RNA, 15 nt, Human
cucaccccagcccca

SEQ ID NO: 1960734 - RNA, 20 nt, Human
cucaccauuuccccagggca

SEQ ID NO: 1960735 - RNA, 21 nt, Human
cucaccauuuccccagggcac

SEQ ID NO: 1960736 - RNA, 16 nt, Human
cucaccauuuccccag

SEQ ID NO: 1960737 - RNA, 18 nt, Human
cucaccauuuccccaggg

SEQ ID NO: 1960738 - RNA, 19 nt, Human
cucaccauuuccccagggc

SEQ ID NO: 1960739 - RNA, 19 nt, Human
cucacuauguugcccaggc

SEQ ID NO: 1960740 - RNA, 20 nt, Human
cucacuauguugcccaggca

SEQ ID NO: 1960741 - RNA, 21 nt, Human
cucacuauguugcccaggcag

SEQ ID NO: 1960742 - RNA, 22 nt, Human
cucacuauguugcccaggcagg

SEQ ID NO: 1960743 - RNA, 23 nt, Human
cucacuauguugcccaggcaggu

SEQ ID NO: 1960744 - RNA, 20 nt, Human
cucacucagaaguccagagu

SEQ ID NO: 1960745 - RNA, 21 nt, Human
cucacucagaaguccagaguc

SEQ ID NO: 1960746 - RNA, 13 nt, Human
cucacuccuaccu

SEQ ID NO: 1960747 - RNA, 15 nt, Human
cucacuccuaccugg

SEQ ID NO: 1960748 - RNA, 18 nt, Human
cucacucagcaccacuca

SEQ ID NO: 1960749 - RNA, 13 nt, Human
cucacucagcacc

SEQ ID NO: 1960750 - RNA, 14 nt, Human
cucacucagcacca

SEQ ID NO: 1960751 - RNA, 15 nt, Human
cucacucagcaccac

SEQ ID NO: 1960752 - RNA, 16 nt, Human
cucacucagcaccacu

SEQ ID NO: 1960753 - RNA, 23 nt, Human
cuauuccccacccuccccuuccc

SEQ ID NO: 1960754 - RNA, 14 nt, Human
cuauuguagagcca

SEQ ID NO: 1960755 - RNA, 19 nt, Human
cuauugucaccagggcugg

SEQ ID NO: 1960756 - RNA, 17 nt, Human
cuauuaguguuauauga

SEQ ID NO: 1960757 - RNA, 22 nt, Human
cuauuuaugugauccuuuugga

SEQ ID NO: 1960758 - RNA, 15 nt, Human
cuauuuagacaugua

SEQ ID NO: 1960759 - RNA, 15 nt, Human
cuauuuagaugcaua

SEQ ID NO: 1960760 - RNA, 16 nt, Human
cucaaaugcucagacc

SEQ ID NO: 1960761 - RNA, 15 nt, Human
cucaaaucugaggga

SEQ ID NO: 1960762 - RNA, 15 nt, Human
cucaaaucuuaagaa

SEQ ID NO: 1960763 - RNA, 16 nt, Human
cucaaaucuuaagaaa

SEQ ID NO: 1960764 - RNA, 23 nt, Human
cucaaauacgugggcauucaaau

SEQ ID NO: 1960765 - RNA, 13 nt, Human
cucaaauccagga

SEQ ID NO: 1960766 - RNA, 14 nt, Human
cucaaauccaggac

SEQ ID NO: 1960767 - RNA, 23 nt, Human
cucaaauccaggacccugccagg

SEQ ID NO: 1960768 - RNA, 15 nt, Human
cucaaauccaggacc

SEQ ID NO: 1960769 - RNA, 16 nt, Human
cucaaauccaggaccc

SEQ ID NO: 1960770 - RNA, 20 nt, Human
cucaaauccaggacccugcc

SEQ ID NO: 1960771 - RNA, 22 nt, Human
cucaaauccaggacccugccag

SEQ ID NO: 1960772 - RNA, 23 nt, Human
cuauuucaucagaacagcuguug

SEQ ID NO: 1960773 - RNA, 11 nt, Human
cuauuucagaa

SEQ ID NO: 1960774 - RNA, 12 nt, Human
cuauuucagaag

SEQ ID NO: 1960775 - RNA, 19 nt, Human
cuauuucagaaguuuaaau

SEQ ID NO: 1960776 - RNA, 16 nt, Human
cuauuucccccuuucu

SEQ ID NO: 1960777 - RNA, 18 nt, Human
cuauuucccccuuucuuc

SEQ ID NO: 1960778 - RNA, 19 nt, Human
cuauuucccccuuucuucc

SEQ ID NO: 1960779 - RNA, 21 nt, Human
cuauuucccccuuucuuccuc

SEQ ID NO: 1960780 - RNA, 22 nt, Human
cucaaaugcucagaccagcucu

SEQ ID NO: 1960781 - RNA, 14 nt, Human
cucaaauuuugagu

SEQ ID NO: 1960782 - RNA, 19 nt, Human
cucaaaugcucagaccagc

SEQ ID NO: 1960783 - RNA, 20 nt, Human
cucaaaugaugugccugcuu

SEQ ID NO: 1960784 - RNA, 20 nt, Human
cucaacaaggcaaaaacaaa

SEQ ID NO: 1960785 - RNA, 21 nt, Human
cucaacaccucugcacaagcu

SEQ ID NO: 1960786 - RNA, 13 nt, Human
cucaaccuccugg

SEQ ID NO: 1960787 - RNA, 15 nt, Human
cucaaccuccugggc

SEQ ID NO: 1960788 - RNA, 17 nt, Human
cucaaccuccugggcua

SEQ ID NO: 1960789 - RNA, 17 nt, Human
cucaccagccccagugc

SEQ ID NO: 1960790 - RNA, 18 nt, Human
cucaccagccccagugcc

SEQ ID NO: 1960791 - RNA, 13 nt, Human
cucaccagcugug

SEQ ID NO: 1960792 - RNA, 13 nt, Human
cucaccagcccca

SEQ ID NO: 1960793 - RNA, 16 nt, Human
cucaccagaauuauuu

SEQ ID NO: 1960794 - RNA, 14 nt, Human
cucaccagccccag

SEQ ID NO: 1960795 - RNA, 15 nt, Human
cucaccagccccagu

SEQ ID NO: 1960796 - RNA, 23 nt, Human
cucacaguccuuaccagcagagc

SEQ ID NO: 1960797 - RNA, 22 nt, Human
cucacaguccuuaccagcagag

SEQ ID NO: 1960798 - RNA, 19 nt, Human
cucacaguccuuaccagca

SEQ ID NO: 1960799 - RNA, 17 nt, Human
cucacaguccuuaccag

SEQ ID NO: 1960800 - RNA, 15 nt, Human
cucacauuuauucug

SEQ ID NO: 1960801 - RNA, 19 nt, Human
cucacauuuauucugcuca

SEQ ID NO: 1960802 - RNA, 22 nt, Human
cucacauuuauucugcucacau

SEQ ID NO: 1960803 - RNA, 14 nt, Human
cucacauuuuuaua

SEQ ID NO: 1960804 - RNA, 22 nt, Human
cucacagcuaugcaaaaagcua

SEQ ID NO: 1960805 - RNA, 15 nt, Human
cucacagcuaugcaa

SEQ ID NO: 1960806 - RNA, 16 nt, Human
cucacagcuaugcaaa

SEQ ID NO: 1960807 - RNA, 12 nt, Human
cucacagccagc

SEQ ID NO: 1960808 - RNA, 15 nt, Human
cucacaguccuuacc

SEQ ID NO: 1960809 - RNA, 24 nt, Human
cucacacaugagcaucaggccagg

SEQ ID NO: 1960810 - RNA, 22 nt, Human
cucacacaugagcaucaggcca

SEQ ID NO: 1960811 - RNA, 17 nt, Human
cucaagugauucuccug

SEQ ID NO: 1960812 - RNA, 21 nt, Human
cucaaguccucuuuucugaga

SEQ ID NO: 1960813 - RNA, 21 nt, Human
cucaagaccaaauggaaacag

SEQ ID NO: 1960814 - RNA, 18 nt, Human
cucaagaccaaauggaaa

SEQ ID NO: 1960815 - RNA, 14 nt, Human
cuaggugacagagu

SEQ ID NO: 1960816 - RNA, 18 nt, Human
cuaggugacagagugaga

SEQ ID NO: 1960817 - RNA, 20 nt, Human
cuagguagcccccucuuccc

SEQ ID NO: 1960818 - RNA, 16 nt, Human
cuagguagagucugag

SEQ ID NO: 1960819 - RNA, 17 nt, Human
cuagguagagucugagg

SEQ ID NO: 1960820 - RNA, 19 nt, Human
cuagguagcccccucuucc

SEQ ID NO: 1960821 - RNA, 24 nt, Human
cuaggugacagagugagacucugu

SEQ ID NO: 1960822 - RNA, 12 nt, Human
cuaggucugaua

SEQ ID NO: 1960823 - RNA, 22 nt, Human
cuagguaaauuacaguuccuag

SEQ ID NO: 1960824 - RNA, 23 nt, Human
cgcccaguuggguggaugccugg

SEQ ID NO: 1960825 - RNA, 15 nt, Human
cgccaugcuccuggc

SEQ ID NO: 1960826 - RNA, 20 nt, Human
cgccaucccagccccaauga

SEQ ID NO: 1960827 - RNA, 22 nt, Human
cgcccaguuggguggaugccug

SEQ ID NO: 1960828 - RNA, 17 nt, Human
cgccaucccagccccaa

SEQ ID NO: 1960829 - RNA, 19 nt, Human
cgccagggaccccagaauc

SEQ ID NO: 1960830 - RNA, 16 nt, Human
cuaguaauauauuuaa

SEQ ID NO: 1960831 - RNA, 20 nt, Human
cuaguaauauauuuaaaggg

SEQ ID NO: 1960832 - RNA, 16 nt, Human
cuaguaauaaagacuc

SEQ ID NO: 1960833 - RNA, 12 nt, Human
cuaguaauauau

SEQ ID NO: 1960834 - RNA, 13 nt, Human
cuauagaaagugu

SEQ ID NO: 1960835 - RNA, 14 nt, Human
cuauagaaaguguu

SEQ ID NO: 1960836 - RNA, 15 nt, Human
cuauagaaaguguuc

SEQ ID NO: 1960837 - RNA, 16 nt, Human
cuauagaaaguguucu

SEQ ID NO: 1960838 - RNA, 17 nt, Human
cuauagaaaguguucug

SEQ ID NO: 1960839 - RNA, 19 nt, Human
cuauagaaaguguucuguu

SEQ ID NO: 1960840 - RNA, 20 nt, Human
cuauagaaaguguucuguua

SEQ ID NO: 1960841 - RNA, 22 nt, Human
cuauagaaaguguucuguuaca

SEQ ID NO: 1960842 - RNA, 20 nt, Human
cuauagcaucacuuaaaaca

SEQ ID NO: 1960843 - RNA, 15 nt, Human
cuauagcaucacuua

SEQ ID NO: 1960844 - RNA, 17 nt, Human
cuauagcaucacuuaaa

SEQ ID NO: 1960845 - RNA, 22 nt, Human
cuauaauuuaccugaagucuuu

SEQ ID NO: 1960846 - RNA, 14 nt, Human
cuauaauuuuacaa

SEQ ID NO: 1960847 - RNA, 14 nt, Human
cuauaauuuugaua

SEQ ID NO: 1960848 - RNA, 16 nt, Human
cuauaauuuugauagu

SEQ ID NO: 1960849 - RNA, 20 nt, Human
cuauaauuuugauaguggga

SEQ ID NO: 1960850 - RNA, 23 nt, Human
cuauaauuuugauagugggacca

SEQ ID NO: 1960851 - RNA, 21 nt, Human
cuauaauguaagcucuacuga

SEQ ID NO: 1960852 - RNA, 16 nt, Human
cuauaauguaagcucu

SEQ ID NO: 1960853 - RNA, 17 nt, Human
cuauaagccaaaauuaa

SEQ ID NO: 1960854 - RNA, 15 nt, Human
cuauaauaaagaagu

SEQ ID NO: 1960855 - RNA, 22 nt, Human
cuagugcugugaaaaaaaaaau

SEQ ID NO: 1960856 - RNA, 13 nt, Human
cuagugcugugaa

SEQ ID NO: 1960857 - RNA, 14 nt, Human
cuagugcugugaaa

SEQ ID NO: 1960858 - RNA, 17 nt, Human
cuagugcugugaaaaaa

SEQ ID NO: 1960859 - RNA, 17 nt, Human
cuauauuuuacauaaau

SEQ ID NO: 1960860 - RNA, 17 nt, Human
cuauagccuaggugaca

SEQ ID NO: 1960861 - RNA, 18 nt, Human
cuaugggacucaaugcac

SEQ ID NO: 1960862 - RNA, 22 nt, Human
cuaugggacucaaugcacugac

SEQ ID NO: 1960863 - RNA, 23 nt, Human
cuaugggacucaaugcacugaca

SEQ ID NO: 1960864 - RNA, 22 nt, Human
cuaugguguaaucaugaaggag

SEQ ID NO: 1960865 - RNA, 11 nt, Human
cuauggucuua

SEQ ID NO: 1960866 - RNA, 17 nt, Human
cuauggucuuauauuua

SEQ ID NO: 1960867 - RNA, 15 nt, Human
cuauuagagaagaga

SEQ ID NO: 1960868 - RNA, 18 nt, Human
cuauuacgaaguucaaga

SEQ ID NO: 1960869 - RNA, 14 nt, Human
cuauuaguguuaua

SEQ ID NO: 1960870 - RNA, 15 nt, Human
cuauuaguguuauau

SEQ ID NO: 1960871 - RNA, 16 nt, Human
cuauuaguguuauaug

SEQ ID NO: 1960872 - RNA, 21 nt, Human
cuauuagcuuacugauuaacu

SEQ ID NO: 1960873 - RNA, 22 nt, Human
cuauuacgaaguucaagaucaa

SEQ ID NO: 1960874 - RNA, 23 nt, Human
cuauuacgaaguucaagaucaaa

SEQ ID NO: 1960875 - RNA, 13 nt, Human
cuauggccugugg

SEQ ID NO: 1960876 - RNA, 14 nt, Human
cuauggccugugcg

SEQ ID NO: 1960877 - RNA, 21 nt, Human
cuauggacagcauugccagua

SEQ ID NO: 1960878 - RNA, 16 nt, Human
cuaucuguuuacagug

SEQ ID NO: 1960879 - RNA, 13 nt, Human
cuaugagggccuu

SEQ ID NO: 1960880 - RNA, 15 nt, Human
cuaugagggccuuga

SEQ ID NO: 1960881 - RNA, 17 nt, Human
cuaugagggccuugagu

SEQ ID NO: 1960882 - RNA, 20 nt, Human
cuaugcagagguccacaaca

SEQ ID NO: 1960883 - RNA, 15 nt, Human
cucauacccaccccc

SEQ ID NO: 1960884 - RNA, 14 nt, Human
cucauacucaccuc

SEQ ID NO: 1960885 - RNA, 22 nt, Human
cucauacucaccucaccccacu

SEQ ID NO: 1960886 - RNA, 21 nt, Human
cucauaguaugguggcugggu

SEQ ID NO: 1960887 - RNA, 20 nt, Human
cucauagcccucacccuggg

SEQ ID NO: 1960888 - RNA, 21 nt, Human
cucauagcccucacccugggg

SEQ ID NO: 1960889 - RNA, 13 nt, Human
cucauagcccuca

SEQ ID NO: 1960890 - RNA, 17 nt, Human
cucauagcccucacccu

SEQ ID NO: 1960891 - RNA, 21 nt, Human
cucauacccacccccacccaa

SEQ ID NO: 1960892 - RNA, 19 nt, Human
cucauacccacccccaccc

SEQ ID NO: 1960893 - RNA, 18 nt, Human
cucauacccacccccacc

SEQ ID NO: 1960894 - RNA, 16 nt, Human
cucauacccaccccca

SEQ ID NO: 1960895 - RNA, 20 nt, Human
cucaggugauccacccaccu

SEQ ID NO: 1960896 - RNA, 18 nt, Human
cucaggugauccacccac

SEQ ID NO: 1960897 - RNA, 19 nt, Human
cucaggugauccacccacc

SEQ ID NO: 1960898 - RNA, 22 nt, Human
cucaucaccaacgucugugcca

SEQ ID NO: 1960899 - RNA, 20 nt, Human
cucaucagaaacaauuucug

SEQ ID NO: 1960900 - RNA, 21 nt, Human
cucaucaccaacgucugugcc

SEQ ID NO: 1960901 - RNA, 20 nt, Human
cucauauccccuauuuaaca

SEQ ID NO: 1960902 - RNA, 23 nt, Human
cucauaguaugguggcuggguug

SEQ ID NO: 1960903 - RNA, 15 nt, Human
cucauccucauaccc

SEQ ID NO: 1960904 - RNA, 18 nt, Human
cucagggagcagggaagg

SEQ ID NO: 1960905 - RNA, 19 nt, Human
cucagggagcagggaaggc

SEQ ID NO: 1960906 - RNA, 21 nt, Human
cucagggagcagggaaggccu

SEQ ID NO: 1960907 - RNA, 22 nt, Human
cucagggagcagggaaggccug

SEQ ID NO: 1960908 - RNA, 23 nt, Human
cucagggagcagggaaggccuga

SEQ ID NO: 1960909 - RNA, 23 nt, Human
cucaggaguuugagaccaaccug

SEQ ID NO: 1960910 - RNA, 18 nt, Human
cucaggaguuugagacca

SEQ ID NO: 1960911 - RNA, 19 nt, Human
cucagcccacauagugaug

SEQ ID NO: 1960912 - RNA, 21 nt, Human
cucagcccacauagugauggu

SEQ ID NO: 1960913 - RNA, 18 nt, Human
cucagcauccuggcaccc

SEQ ID NO: 1960914 - RNA, 13 nt, Human
cucagggccuggc

SEQ ID NO: 1960915 - RNA, 15 nt, Human
cucagggccuggcuc

SEQ ID NO: 1960916 - RNA, 14 nt, Human
cucagggccuggcu

SEQ ID NO: 1960917 - RNA, 15 nt, Human
cucagggccuggucg

SEQ ID NO: 1960918 - RNA, 16 nt, Human
cucagggccuggcuca

SEQ ID NO: 1960919 - RNA, 20 nt, Human
cucaggugagaagcagagga

SEQ ID NO: 1960920 - RNA, 19 nt, Human
cucaggugagaagcagagg

SEQ ID NO: 1960921 - RNA, 16 nt, Human
cucaggugagaagcag

SEQ ID NO: 1960922 - RNA, 18 nt, Human
cucagggucccugguggc

SEQ ID NO: 1960923 - RNA, 17 nt, Human
cucagggucccuggugg

SEQ ID NO: 1960924 - RNA, 16 nt, Human
cucagggucccuggug

SEQ ID NO: 1960925 - RNA, 15 nt, Human
cucagggucccuggu

SEQ ID NO: 1960926 - RNA, 13 nt, Human
cuccaccugccag

SEQ ID NO: 1960927 - RNA, 12 nt, Human
cuccaccugcca

SEQ ID NO: 1960928 - RNA, 14 nt, Human
cuccaccugccagg

SEQ ID NO: 1960929 - RNA, 13 nt, Human
cuccaccugcucu

SEQ ID NO: 1960930 - RNA, 15 nt, Human
cuccagccccuggau

SEQ ID NO: 1960931 - RNA, 17 nt, Human
cuccagccccuggaugc

SEQ ID NO: 1960932 - RNA, 16 nt, Human
cuccagccccuggaug

SEQ ID NO: 1960933 - RNA, 20 nt, Human
cuccagccccuggaugcagc

SEQ ID NO: 1960934 - RNA, 12 nt, Human
cuccagccuggg

SEQ ID NO: 1960935 - RNA, 14 nt, Human
cuccagcucaccag

SEQ ID NO: 1960936 - RNA, 17 nt, Human
cuccaggagcagccaca

SEQ ID NO: 1960937 - RNA, 16 nt, Human
cuccaggagcagccac

SEQ ID NO: 1960938 - RNA, 15 nt, Human
cuccaggagcagcca

SEQ ID NO: 1960939 - RNA, 14 nt, Human
cuccaggagcagcc

SEQ ID NO: 1960940 - RNA, 13 nt, Human
cuccaggagcagc

SEQ ID NO: 1960941 - RNA, 11 nt, Human
cuccaggagca

SEQ ID NO: 1960942 - RNA, 23 nt, Human
cuccaggagcagccacauuccug

SEQ ID NO: 1960943 - RNA, 18 nt, Human
cuccaggagcagccacau

SEQ ID NO: 1960944 - RNA, 11 nt, Human
cuccaggcagc

SEQ ID NO: 1960945 - RNA, 12 nt, Human
cuccaggcagca

SEQ ID NO: 1960946 - RNA, 12 nt, Human
cuccauccugag

SEQ ID NO: 1960947 - RNA, 15 nt, Human
cuccacccugcucuc

SEQ ID NO: 1960948 - RNA, 23 nt, Human
cuccaccaagccuggucagccca

SEQ ID NO: 1960949 - RNA, 13 nt, Human
cuccacccugcuc

SEQ ID NO: 1960950 - RNA, 14 nt, Human
cuccacacacacaa

SEQ ID NO: 1960951 - RNA, 15 nt, Human
cuccacacacacaaa

SEQ ID NO: 1960952 - RNA, 21 nt, Human
cuccacacacacaaaaaaaga

SEQ ID NO: 1960953 - RNA, 13 nt, Human
cuccacacccgcg

SEQ ID NO: 1960954 - RNA, 19 nt, Human
cuccacacccgcgccccgc

SEQ ID NO: 1960955 - RNA, 23 nt, Human
cuccaauuuuuuaagugaaaaua

SEQ ID NO: 1960956 - RNA, 15 nt, Human
cuccaauuuuuuaag

SEQ ID NO: 1960957 - RNA, 21 nt, Human
cuccaaugcuguuaucccugc

SEQ ID NO: 1960958 - RNA, 22 nt, Human
cuccaaucccaccaacccucag

SEQ ID NO: 1960959 - RNA, 17 nt, Human
cucauguugaaacuuua

SEQ ID NO: 1960960 - RNA, 17 nt, Human
cucauuugucacacacu

SEQ ID NO: 1960961 - RNA, 19 nt, Human
cucauuacuuguugccuau

SEQ ID NO: 1960962 - RNA, 15 nt, Human
cuccaaaauaaaacu

SEQ ID NO: 1960963 - RNA, 16 nt, Human
cuccaaaauaaaacuu

SEQ ID NO: 1960964 - RNA, 18 nt, Human
cucauuugucacacacuu

SEQ ID NO: 1960965 - RNA, 12 nt, Human
cuccucaggacc

SEQ ID NO: 1960966 - RNA, 13 nt, Human
cuccucaggacca

SEQ ID NO: 1960967 - RNA, 15 nt, Human
cuccuccagagucag

SEQ ID NO: 1960968 - RNA, 13 nt, Human
cuccuccagaguc

SEQ ID NO: 1960969 - RNA, 15 nt, Human
cuccuccagccgcca

SEQ ID NO: 1960970 - RNA, 19 nt, Human
cuccuccuggacuccugca

SEQ ID NO: 1960971 - RNA, 14 nt, Human
cuccuccuggacuc

SEQ ID NO: 1960972 - RNA, 15 nt, Human
cuccuccuggacucc

SEQ ID NO: 1960973 - RNA, 12 nt, Human
cuccuccuagcc

SEQ ID NO: 1960974 - RNA, 22 nt, Human
cuccucccaggcgccccuuccc

SEQ ID NO: 1960975 - RNA, 23 nt, Human
cuccucccaggcgccccuucccc

SEQ ID NO: 1960976 - RNA, 17 nt, Human
cuccucccaggcgcccc

SEQ ID NO: 1960977 - RNA, 17 nt, Human
cuccucccacugcccac

SEQ ID NO: 1960978 - RNA, 18 nt, Human
cuccucccacugcccacu

SEQ ID NO: 1960979 - RNA, 12 nt, Human
cuccucccacug

SEQ ID NO: 1960980 - RNA, 13 nt, Human
cuccucccacugc

SEQ ID NO: 1960981 - RNA, 14 nt, Human
cuccucccacugcc

SEQ ID NO: 1960982 - RNA, 15 nt, Human
cuccucccacugccc

SEQ ID NO: 1960983 - RNA, 18 nt, Human
cuccucagaucuucugug

SEQ ID NO: 1960984 - RNA, 13 nt, Human
cuccuaugcuuua

SEQ ID NO: 1960985 - RNA, 18 nt, Human
cuccuaugcuuuagcuua

SEQ ID NO: 1960986 - RNA, 22 nt, Human
cuccuaucagaaguuucucagc

SEQ ID NO: 1960987 - RNA, 22 nt, Human
cuccgacuugugcacaggcaga

SEQ ID NO: 1960988 - RNA, 12 nt, Human
cucccuuucaac

SEQ ID NO: 1960989 - RNA, 19 nt, Human
cucccuuggggccuaugca

SEQ ID NO: 1960990 - RNA, 18 nt, Human
cuccccugugccagccca

SEQ ID NO: 1960991 - RNA, 23 nt, Human
cuccccugugccagcccagaggc

SEQ ID NO: 1960992 - RNA, 14 nt, Human
cuccccuuccauuu

SEQ ID NO: 1960993 - RNA, 16 nt, Human
cuccccuuccauuucu

SEQ ID NO: 1960994 - RNA, 12 nt, Human
cuccccuuccca

SEQ ID NO: 1960995 - RNA, 18 nt, Human
cuccccuucccagggcaa

SEQ ID NO: 1960996 - RNA, 12 nt, Human
cuccccuucccc

SEQ ID NO: 1960997 - RNA, 17 nt, Human
cuccccuuccccuuccu

SEQ ID NO: 1960998 - RNA, 19 nt, Human
cuccccuuccccuuccuuc

SEQ ID NO: 1960999 - RNA, 23 nt, Human
cuccccuuccccuuccuucuuug

SEQ ID NO: 1961000 - RNA, 14 nt, Human
cuccauccugaggc

SEQ ID NO: 1961001 - RNA, 13 nt, Human
cuccauccugagg

SEQ ID NO: 1961002 - RNA, 22 nt, Human
cuccccagcaagugagagcugg

SEQ ID NO: 1961003 - RNA, 23 nt, Human
cuccccagcaagugagagcuggg

SEQ ID NO: 1961004 - RNA, 12 nt, Human
cuccccuccucc

SEQ ID NO: 1961005 - RNA, 20 nt, Human
cuccccuccuccuggacucc

SEQ ID NO: 1961006 - RNA, 21 nt, Human
cuccccagcaagugagagcug

SEQ ID NO: 1961007 - RNA, 17 nt, Human
cucccugccccucccuu

SEQ ID NO: 1961008 - RNA, 18 nt, Human
cucccugccccucccuuc

SEQ ID NO: 1961009 - RNA, 20 nt, Human
cucccugccccucccuucaa

SEQ ID NO: 1961010 - RNA, 21 nt, Human
cucccugccccucccuucaac

SEQ ID NO: 1961011 - RNA, 12 nt, Human
cucccugccagu

SEQ ID NO: 1961012 - RNA, 22 nt, Human
cucccguguaggaaccugcaca

SEQ ID NO: 1961013 - RNA, 21 nt, Human
cucccguguaucuggacacug

SEQ ID NO: 1961014 - RNA, 17 nt, Human
cucccugccccccagcc

SEQ ID NO: 1961015 - RNA, 23 nt, Human
cucccugccccccagcccuccuu

SEQ ID NO: 1961016 - RNA, 13 nt, Human
cucccugccccuc

SEQ ID NO: 1961017 - RNA, 14 nt, Human
cucccugccccucc

SEQ ID NO: 1961018 - RNA, 19 nt, Human
cucccgaguagcugggacu

SEQ ID NO: 1961019 - RNA, 20 nt, Human
cucccgaguagcugggacua

SEQ ID NO: 1961020 - RNA, 17 nt, Human
cuccccuugccagcugc

SEQ ID NO: 1961021 - RNA, 13 nt, Human
cuccccuugccag

SEQ ID NO: 1961022 - RNA, 14 nt, Human
cuccccuugccagc

SEQ ID NO: 1961023 - RNA, 15 nt, Human
cuccccuugccagcu

SEQ ID NO: 1961024 - RNA, 16 nt, Human
cuccccuugccagcug

SEQ ID NO: 1961025 - RNA, 15 nt, Human
cucccggugcccaag

SEQ ID NO: 1961026 - RNA, 21 nt, Human
cucccggugcccaagaauaga

SEQ ID NO: 1961027 - RNA, 16 nt, Human
cucccgccuccaaccc

SEQ ID NO: 1961028 - RNA, 21 nt, Human
cucccgcccaaaccuuucccc

SEQ ID NO: 1961029 - RNA, 23 nt, Human
cucccgcccaaaccuuuccccca

SEQ ID NO: 1961030 - RNA, 14 nt, Human
cuccuucccuugcu

SEQ ID NO: 1961031 - RNA, 20 nt, Human
cuccuucccacucuucucau

SEQ ID NO: 1961032 - RNA, 15 nt, Human
cuccuucccacucuu

SEQ ID NO: 1961033 - RNA, 16 nt, Human
cuccuucccacucuuc

SEQ ID NO: 1961034 - RNA, 17 nt, Human
cuccuucccacucuucu

SEQ ID NO: 1961035 - RNA, 18 nt, Human
cuccuucccacucuucuc

SEQ ID NO: 1961036 - RNA, 19 nt, Human
cuccuucccacucuucuca

SEQ ID NO: 1961037 - RNA, 23 nt, Human
cuccuuauggguagggcucugac

SEQ ID NO: 1961038 - RNA, 22 nt, Human
cuccuucaacaaggcuugcugc

SEQ ID NO: 1961039 - RNA, 10 nt, Human
cuccuuccca

SEQ ID NO: 1961040 - RNA, 12 nt, Human
cuccuggacucc

SEQ ID NO: 1961041 - RNA, 17 nt, Human
cuccuuaucaaaggaca

SEQ ID NO: 1961042 - RNA, 22 nt, Human
cuccuuaucaaaggacaccauu

SEQ ID NO: 1961043 - RNA, 18 nt, Human
cuccuuaggguuuucucu

SEQ ID NO: 1961044 - RNA, 20 nt, Human
cuccuuaggguuuucucucu

SEQ ID NO: 1961045 - RNA, 14 nt, Human
cuccuggaaauauu

SEQ ID NO: 1961046 - RNA, 21 nt, Human
cuccugugugugcgccuacag

SEQ ID NO: 1961047 - RNA, 11 nt, Human
cuccuggacuc

SEQ ID NO: 1961048 - RNA, 23 nt, Human
cuccugugugugcgccuacagga

SEQ ID NO: 1961049 - RNA, 24 nt, Human
cuccugugugugcgccuacaggag

SEQ ID NO: 1961050 - RNA, 17 nt, Human
cuccugccucagccucc

SEQ ID NO: 1961051 - RNA, 16 nt, Human
cuccugccucagccuc

SEQ ID NO: 1961052 - RNA, 12 nt, Human
cuccugccucag

SEQ ID NO: 1961053 - RNA, 11 nt, Human
cuccugccuca

SEQ ID NO: 1961054 - RNA, 13 nt, Human
cuccucuccccag

SEQ ID NO: 1961055 - RNA, 15 nt, Human
cuccucuccccagca

SEQ ID NO: 1961056 - RNA, 22 nt, Human
cuccugccucgaacuggcugca

SEQ ID NO: 1961057 - RNA, 14 nt, Human
cuccugcucugcuc

SEQ ID NO: 1961058 - RNA, 15 nt, Human
cuccugcucugcucg

SEQ ID NO: 1961059 - RNA, 14 nt, Human
cuccugcugccagu

SEQ ID NO: 1961060 - RNA, 13 nt, Human
cuccugcugccag

SEQ ID NO: 1961061 - RNA, 12 nt, Human
cuccugcugcca

SEQ ID NO: 1961062 - RNA, 19 nt, Human
cuccugccucagccucccg

SEQ ID NO: 1961063 - RNA, 18 nt, Human
cuccugccucgaacuggc

SEQ ID NO: 1961064 - RNA, 20 nt, Human
cuccugccucgaacuggcug

SEQ ID NO: 1961065 - RNA, 21 nt, Human
cuccugccucgaacuggcugc

SEQ ID NO: 1961066 - RNA, 22 nt, Human
cucgagcaugccuggauggggc

SEQ ID NO: 1961067 - RNA, 18 nt, Human
cucgcaggccucccugcc

SEQ ID NO: 1961068 - RNA, 15 nt, Human
cucgccuucaucucc

SEQ ID NO: 1961069 - RNA, 18 nt, Human
cucgccucggaucagcug

SEQ ID NO: 1961070 - RNA, 23 nt, Human
cucgcucugucgcccaggcugga

SEQ ID NO: 1961071 - RNA, 16 nt, Human
cucgcucuguugccca

SEQ ID NO: 1961072 - RNA, 20 nt, Human
cucgcucuguugcccaggcu

SEQ ID NO: 1961073 - RNA, 17 nt, Human
cucgcuccaacuccaac

SEQ ID NO: 1961074 - RNA, 24 nt, Human
cucgcuccaacuccaacauccacu

SEQ ID NO: 1961075 - RNA, 22 nt, Human
cucgcuauugucaccagggcug

SEQ ID NO: 1961076 - RNA, 16 nt, Human
cucgcuccaacuccaa

SEQ ID NO: 1961077 - RNA, 13 nt, Human
cuccuuccugugu

SEQ ID NO: 1961078 - RNA, 17 nt, Human
cuccuucccuugcuacc

SEQ ID NO: 1961079 - RNA, 20 nt, Human
cuccuuccuaguucaucccu

SEQ ID NO: 1961080 - RNA, 15 nt, Human
cuccuuccugugugu

SEQ ID NO: 1961081 - RNA, 23 nt, Human
cuccuuggugucgggcaugacac

SEQ ID NO: 1961082 - RNA, 19 nt, Human
cucgagcaugccuggaugg

SEQ ID NO: 1961083 - RNA, 16 nt, Human
cucgagcaugccugga

SEQ ID NO: 1961084 - RNA, 15 nt, Human
cucgagcaugccugg

SEQ ID NO: 1961085 - RNA, 13 nt, Human
cucgagcaugccu

SEQ ID NO: 1961086 - RNA, 21 nt, Human
cugaccagccuccaugcugcc

SEQ ID NO: 1961087 - RNA, 23 nt, Human
cugaccagccuccaugcugccuc

SEQ ID NO: 1961088 - RNA, 16 nt, Human
cugaauuaugaaacuu

SEQ ID NO: 1961089 - RNA, 14 nt, Human
cugaauuucuuuug

SEQ ID NO: 1961090 - RNA, 16 nt, Human
cugacagacacaggcc

SEQ ID NO: 1961091 - RNA, 17 nt, Human
cugaccagccuccaugc

SEQ ID NO: 1961092 - RNA, 17 nt, Human
cugacagacacaggccc

SEQ ID NO: 1961093 - RNA, 18 nt, Human
cugacagacacaggcccg

SEQ ID NO: 1961094 - RNA, 17 nt, Human
cugacuguacuccuccc

SEQ ID NO: 1961095 - RNA, 14 nt, Human
cugacugggccagg

SEQ ID NO: 1961096 - RNA, 15 nt, Human
cugacugggccaggg

SEQ ID NO: 1961097 - RNA, 14 nt, Human
cugacugggggcag

SEQ ID NO: 1961098 - RNA, 15 nt, Human
cugacugggggcaga

SEQ ID NO: 1961099 - RNA, 17 nt, Human
cugacugggggcagaca

SEQ ID NO: 1961100 - RNA, 18 nt, Human
cugacugucacaacuccu

SEQ ID NO: 1961101 - RNA, 14 nt, Human
cugacuacagggcc

SEQ ID NO: 1961102 - RNA, 15 nt, Human
cugacuacagggccg

SEQ ID NO: 1961103 - RNA, 13 nt, Human
cugacugacauga

SEQ ID NO: 1961104 - RNA, 11 nt, Human
cugacugaggc

SEQ ID NO: 1961105 - RNA, 14 nt, Human
cugacugaggcagu

SEQ ID NO: 1961106 - RNA, 17 nt, Human
cugacugaggcaguuug

SEQ ID NO: 1961107 - RNA, 17 nt, Human
cugacucccccaguccc

SEQ ID NO: 1961108 - RNA, 22 nt, Human
cugagacagcccgggcucugcc

SEQ ID NO: 1961109 - RNA, 21 nt, Human
cugagacagcccgggcucugc

SEQ ID NO: 1961110 - RNA, 19 nt, Human
cugagacagcccgggcucu

SEQ ID NO: 1961111 - RNA, 20 nt, Human
cugagacagcccgggcucug

SEQ ID NO: 1961112 - RNA, 15 nt, Human
cugagcaaauguggc

SEQ ID NO: 1961113 - RNA, 17 nt, Human
cugagcaaauguggcuc

SEQ ID NO: 1961114 - RNA, 20 nt, Human
cugagcaaauguggcuccug

SEQ ID NO: 1961115 - RNA, 21 nt, Human
cugagcaaauguggcuccugg

SEQ ID NO: 1961116 - RNA, 23 nt, Human
cugagauuauaggcaccuaccac

SEQ ID NO: 1961117 - RNA, 12 nt, Human
cugagcaggugu

SEQ ID NO: 1961118 - RNA, 17 nt, Human
cugagcagugauauucu

SEQ ID NO: 1961119 - RNA, 22 nt, Human
cugagcagugauauucuuuguu

SEQ ID NO: 1961120 - RNA, 14 nt, Human
cugagccagauuuc

SEQ ID NO: 1961121 - RNA, 13 nt, Human
cugagccagauuu

SEQ ID NO: 1961122 - RNA, 10 nt, Human
cugagcccac

SEQ ID NO: 1961123 - RNA, 11 nt, Human
cugagcccacu

SEQ ID NO: 1961124 - RNA, 12 nt, Human
cugagcccacug

SEQ ID NO: 1961125 - RNA, 13 nt, Human
cugagcccacugu

SEQ ID NO: 1961126 - RNA, 20 nt, Human
cugaagucuuuguacagaca

SEQ ID NO: 1961127 - RNA, 17 nt, Human
cugaagucuuuguacag

SEQ ID NO: 1961128 - RNA, 22 nt, Human
cugaagucccagauacuugggg

SEQ ID NO: 1961129 - RNA, 14 nt, Human
cugaagucaguucu

SEQ ID NO: 1961130 - RNA, 14 nt, Human
cugaagucuguauu

SEQ ID NO: 1961131 - RNA, 19 nt, Human
cugaaguucugccucugau

SEQ ID NO: 1961132 - RNA, 20 nt, Human
cugaaguucugccucugaug

SEQ ID NO: 1961133 - RNA, 23 nt, Human
cugaaguucugccucugauguau

SEQ ID NO: 1961134 - RNA, 13 nt, Human
cugaaguuugaua

SEQ ID NO: 1961135 - RNA, 21 nt, Human
cugaaguuugauaaauagugu

SEQ ID NO: 1961136 - RNA, 22 nt, Human
cugaaguuugauaaauaguguu

SEQ ID NO: 1961137 - RNA, 17 nt, Human
cugaaguucagcugcau

SEQ ID NO: 1961138 - RNA, 14 nt, Human
cugaaguuauauuu

SEQ ID NO: 1961139 - RNA, 17 nt, Human
cugaaguuauauuuccu

SEQ ID NO: 1961140 - RNA, 20 nt, Human
cugaaguuauauuuccuaua

SEQ ID NO: 1961141 - RNA, 14 nt, Human
cugaaguuaugugu

SEQ ID NO: 1961142 - RNA, 21 nt, Human
cugaagucacacagugagucg

SEQ ID NO: 1961143 - RNA, 13 nt, Human
cugaagucacugc

SEQ ID NO: 1961144 - RNA, 14 nt, Human
cugaagucacugca

SEQ ID NO: 1961145 - RNA, 15 nt, Human
cugaagucacugcac

SEQ ID NO: 1961146 - RNA, 18 nt, Human
cugaagucacacagugag

SEQ ID NO: 1961147 - RNA, 19 nt, Human
cugaagucacacagugagu

SEQ ID NO: 1961148 - RNA, 17 nt, Human
cugaagucacacaguga

SEQ ID NO: 1961149 - RNA, 13 nt, Human
cugaauuaugaaa

SEQ ID NO: 1961150 - RNA, 14 nt, Human
cugaauuaugaaac

SEQ ID NO: 1961151 - RNA, 15 nt, Human
cugaauuaugaaacu

SEQ ID NO: 1961152 - RNA, 12 nt, Human
cugaauuucuuu

SEQ ID NO: 1961153 - RNA, 12 nt, Human
cugaauuauuuu

SEQ ID NO: 1961154 - RNA, 20 nt, Human
cugaaugguuuucaaaauaa

SEQ ID NO: 1961155 - RNA, 19 nt, Human
cugaaugguuuucaaaaua

SEQ ID NO: 1961156 - RNA, 23 nt, Human
cugaauggcuugcaguuguuccu

SEQ ID NO: 1961157 - RNA, 20 nt, Human
cugaaauaaacgucuuaaau

SEQ ID NO: 1961158 - RNA, 13 nt, Human
cugaaauaaaagc

SEQ ID NO: 1961159 - RNA, 15 nt, Human
cugaaauaaaagcua

SEQ ID NO: 1961160 - RNA, 11 nt, Human
cugaaaugugu

SEQ ID NO: 1961161 - RNA, 13 nt, Human
cugaaaugugugu

SEQ ID NO: 1961162 - RNA, 16 nt, Human
cugaaaugugugugau

SEQ ID NO: 1961163 - RNA, 17 nt, Human
cugaaaugugugugaug

SEQ ID NO: 1961164 - RNA, 18 nt, Human
cugaaaugugugugaugu

SEQ ID NO: 1961165 - RNA, 19 nt, Human
cugaaaugugugugaugug

SEQ ID NO: 1961166 - RNA, 20 nt, Human
cugaaaugugugugauguga

SEQ ID NO: 1961167 - RNA, 22 nt, Human
cugaaaugugugugaugugaca

SEQ ID NO: 1961168 - RNA, 16 nt, Human
cugaaauguguuuccu

SEQ ID NO: 1961169 - RNA, 16 nt, Human
cugaaccccucccucc

SEQ ID NO: 1961170 - RNA, 17 nt, Human
cugaaccacuuguagau

SEQ ID NO: 1961171 - RNA, 18 nt, Human
cugaaccacuuguagauu

SEQ ID NO: 1961172 - RNA, 22 nt, Human
cugaaccacuuguagauuugau

SEQ ID NO: 1961173 - RNA, 13 nt, Human
cugaacacauuuc

SEQ ID NO: 1961174 - RNA, 14 nt, Human
cugaacacauuucu

SEQ ID NO: 1961175 - RNA, 17 nt, Human
cugaacacauuucuuuu

SEQ ID NO: 1961176 - RNA, 22 nt, Human
cugaacacauuucuuuuuaaaa

SEQ ID NO: 1961177 - RNA, 12 nt, Human
cugaacauugga

SEQ ID NO: 1961178 - RNA, 14 nt, Human
cugaacauugcaua

SEQ ID NO: 1961179 - RNA, 14 nt, Human
cugaacauuggaga

SEQ ID NO: 1961180 - RNA, 14 nt, Human
cugaaccacuugua

SEQ ID NO: 1961181 - RNA, 15 nt, Human
cugaaccacuuguag

SEQ ID NO: 1961182 - RNA, 23 nt, Human
cucuuuggucuacacugugcuga

SEQ ID NO: 1961183 - RNA, 22 nt, Human
cucuuuggucuacacugugcug

SEQ ID NO: 1961184 - RNA, 16 nt, Human
cucuucuccaggcugu

SEQ ID NO: 1961185 - RNA, 18 nt, Human
cucuucucauuacuuguu

SEQ ID NO: 1961186 - RNA, 23 nt, Human
cugaaagugaaaguccagaaacu

SEQ ID NO: 1961187 - RNA, 12 nt, Human
cugaaagugaug

SEQ ID NO: 1961188 - RNA, 19 nt, Human
cugaaagugaaaguccaga

SEQ ID NO: 1961189 - RNA, 22 nt, Human
cucuuuuaucuccugaaaaaag

SEQ ID NO: 1961190 - RNA, 16 nt, Human
cucuuuuccaaacaca

SEQ ID NO: 1961191 - RNA, 20 nt, Human
cucuuuuccaaacacaggca

SEQ ID NO: 1961192 - RNA, 23 nt, Human
cugaaagggacgcuacccgggaa

SEQ ID NO: 1961193 - RNA, 14 nt, Human
cucuuuucaaaaca

SEQ ID NO: 1961194 - RNA, 16 nt, Human
cucuuuuagauauugu

SEQ ID NO: 1961195 - RNA, 17 nt, Human
cucuuuuaucuccugaa

SEQ ID NO: 1961196 - RNA, 12 nt, Human
cucugaggacaa

SEQ ID NO: 1961197 - RNA, 23 nt, Human
cucugagacucgcgacaaugcaa

SEQ ID NO: 1961198 - RNA, 16 nt, Human
cucugaggacacuaac

SEQ ID NO: 1961199 - RNA, 22 nt, Human
cucugaguagggcaauggaaau

SEQ ID NO: 1961200 - RNA, 12 nt, Human
cucugaggacac

SEQ ID NO: 1961201 - RNA, 14 nt, Human
cucugaggacacua

SEQ ID NO: 1961202 - RNA, 21 nt, Human
cucugagacucgcgacaaugc

SEQ ID NO: 1961203 - RNA, 14 nt, Human
cucugaauuuuaaa

SEQ ID NO: 1961204 - RNA, 13 nt, Human
cucugacaaagcu

SEQ ID NO: 1961205 - RNA, 15 nt, Human
cucugaccccugccu

SEQ ID NO: 1961206 - RNA, 14 nt, Human
cucugacacacagc

SEQ ID NO: 1961207 - RNA, 21 nt, Human
cucugacaacagacuucugaa

SEQ ID NO: 1961208 - RNA, 22 nt, Human
cucugacaacagacuucugaaa

SEQ ID NO: 1961209 - RNA, 15 nt, Human
cucugacacacagcu

SEQ ID NO: 1961210 - RNA, 16 nt, Human
cucugacacacagcuc

SEQ ID NO: 1961211 - RNA, 17 nt, Human
cucugacacacagcucu

SEQ ID NO: 1961212 - RNA, 18 nt, Human
cucugacacacagcucug

SEQ ID NO: 1961213 - RNA, 23 nt, Human
cucugacagaagaaccccagggu

SEQ ID NO: 1961214 - RNA, 19 nt, Human
cucugacacacagcucugu

SEQ ID NO: 1961215 - RNA, 19 nt, Human
cucugaaggguaauuauau

SEQ ID NO: 1961216 - RNA, 19 nt, Human
cucugaauaagcacuuuuu

SEQ ID NO: 1961217 - RNA, 15 nt, Human
cucugaauuuaucuu

SEQ ID NO: 1961218 - RNA, 22 nt, Human
cucugaauuuaucuuugauaac

SEQ ID NO: 1961219 - RNA, 16 nt, Human
cucugacaacagacuu

SEQ ID NO: 1961220 - RNA, 21 nt, Human
cucugaauaagcacuuuuuaa

SEQ ID NO: 1961221 - RNA, 22 nt, Human
cucugaaggacauugcggacag

SEQ ID NO: 1961222 - RNA, 14 nt, Human
cucugaaggaggcc

SEQ ID NO: 1961223 - RNA, 15 nt, Human
cucugaaggaggcca

SEQ ID NO: 1961224 - RNA, 16 nt, Human
cucugaaggaggccac

SEQ ID NO: 1961225 - RNA, 17 nt, Human
cucugaaggaggccacc

SEQ ID NO: 1961226 - RNA, 18 nt, Human
cucugaaggaggccaccu

SEQ ID NO: 1961227 - RNA, 19 nt, Human
cucugaaggaggccaccuc

SEQ ID NO: 1961228 - RNA, 20 nt, Human
cucugaaggaggccaccucc

SEQ ID NO: 1961229 - RNA, 21 nt, Human
cucugaaggaggccaccuccu

SEQ ID NO: 1961230 - RNA, 17 nt, Human
cucugccucccaucacc

SEQ ID NO: 1961231 - RNA, 16 nt, Human
cucugccucccaucac

SEQ ID NO: 1961232 - RNA, 14 nt, Human
cucugccucccauc

SEQ ID NO: 1961233 - RNA, 13 nt, Human
cucugccucccau

SEQ ID NO: 1961234 - RNA, 22 nt, Human
cucugcccuaaugcgcaggcug

SEQ ID NO: 1961235 - RNA, 20 nt, Human
cucugcccuaaugcgcaggc

SEQ ID NO: 1961236 - RNA, 17 nt, Human
cucugcccacucccugc

SEQ ID NO: 1961237 - RNA, 16 nt, Human
cucugcccacucccug

SEQ ID NO: 1961238 - RNA, 15 nt, Human
cucugcccacucccu

SEQ ID NO: 1961239 - RNA, 13 nt, Human
cucugcccacucc

SEQ ID NO: 1961240 - RNA, 20 nt, Human
cucugcccacucccugcaac

SEQ ID NO: 1961241 - RNA, 18 nt, Human
cucugcccacucccugca

SEQ ID NO: 1961242 - RNA, 15 nt, Human
cucugcacaagcugc

SEQ ID NO: 1961243 - RNA, 14 nt, Human
cucugcacaagcug

SEQ ID NO: 1961244 - RNA, 20 nt, Human
cucugcaggucccuaauaaa

SEQ ID NO: 1961245 - RNA, 19 nt, Human
cucugcaggucccuaauaa

SEQ ID NO: 1961246 - RNA, 13 nt, Human
cucugcacaagcu

SEQ ID NO: 1961247 - RNA, 23 nt, Human
cucugaguuccggcaccaguagc

SEQ ID NO: 1961248 - RNA, 15 nt, Human
cucugauacagaaaa

SEQ ID NO: 1961249 - RNA, 20 nt, Human
cucugaguuccggcaccagu

SEQ ID NO: 1961250 - RNA, 21 nt, Human
cucugaguuccggcaccagua

SEQ ID NO: 1961251 - RNA, 19 nt, Human
cucugaguuccggcaccag

SEQ ID NO: 1961252 - RNA, 18 nt, Human
cucugcaggucccuaaua

SEQ ID NO: 1961253 - RNA, 14 nt, Human
cucugauacuuuuu

SEQ ID NO: 1961254 - RNA, 16 nt, Human
cucugauacuuuuuug

SEQ ID NO: 1961255 - RNA, 22 nt, Human
cucugcaggucccuaauaaagc

SEQ ID NO: 1961256 - RNA, 21 nt, Human
cucugcaggucccuaauaaag

SEQ ID NO: 1961257 - RNA, 18 nt, Human
cucugucgcccagucugg

SEQ ID NO: 1961258 - RNA, 19 nt, Human
cucugucgcccagucugga

SEQ ID NO: 1961259 - RNA, 16 nt, Human
cucugucgagccuggg

SEQ ID NO: 1961260 - RNA, 17 nt, Human
cucugucgcccagucug

SEQ ID NO: 1961261 - RNA, 18 nt, Human
cucugucgcccaggcugg

SEQ ID NO: 1961262 - RNA, 22 nt, Human
cucugucgcccaggcuggagug

SEQ ID NO: 1961263 - RNA, 13 nt, Human
cucugucgcccag

SEQ ID NO: 1961264 - RNA, 15 nt, Human
cucugucgcccaggc

SEQ ID NO: 1961265 - RNA, 14 nt, Human
cucugggaacuucu

SEQ ID NO: 1961266 - RNA, 14 nt, Human
cucuguccugggag

SEQ ID NO: 1961267 - RNA, 13 nt, Human
cucuguccuggga

SEQ ID NO: 1961268 - RNA, 15 nt, Human
cucuguccugggagu

SEQ ID NO: 1961269 - RNA, 22 nt, Human
cucuguccugggagugagcugg

SEQ ID NO: 1961270 - RNA, 21 nt, Human
cucuggccuucggccuccauc

SEQ ID NO: 1961271 - RNA, 22 nt, Human
cucuggccuucggccuccaucc

SEQ ID NO: 1961272 - RNA, 23 nt, Human
cucuggcagcucagagagggugg

SEQ ID NO: 1961273 - RNA, 22 nt, Human
cucuggcagcaccgccucuucc

SEQ ID NO: 1961274 - RNA, 23 nt, Human
cucuggcagcaccgccucuuccc

SEQ ID NO: 1961275 - RNA, 15 nt, Human
cucuggauucagccu

SEQ ID NO: 1961276 - RNA, 16 nt, Human
cucuggauucagccuu

SEQ ID NO: 1961277 - RNA, 17 nt, Human
cucuggauucagccuuc

SEQ ID NO: 1961278 - RNA, 18 nt, Human
cucuggauucagccuucu

SEQ ID NO: 1961279 - RNA, 20 nt, Human
cucuggauucagccuucuuu

SEQ ID NO: 1961280 - RNA, 21 nt, Human
cucuggauucagccuucuuuu

SEQ ID NO: 1961281 - RNA, 13 nt, Human
cucuggcagcacc

SEQ ID NO: 1961282 - RNA, 14 nt, Human
cucuggcagcaccg

SEQ ID NO: 1961283 - RNA, 16 nt, Human
cucuggcagcaccgcc

SEQ ID NO: 1961284 - RNA, 20 nt, Human
cucuggauuauauuaugaag

SEQ ID NO: 1961285 - RNA, 19 nt, Human
cucuggauuauauuaugaa

SEQ ID NO: 1961286 - RNA, 10 nt, Human
cucugccuga

SEQ ID NO: 1961287 - RNA, 21 nt, Human
cucugccucccaucacccgcu

SEQ ID NO: 1961288 - RNA, 19 nt, Human
cucugccucugacacacag

SEQ ID NO: 1961289 - RNA, 20 nt, Human
cucugccucugacacacagc

SEQ ID NO: 1961290 - RNA, 15 nt, Human
cucuuccuggacagg

SEQ ID NO: 1961291 - RNA, 19 nt, Human
cucuuccuggacaggccag

SEQ ID NO: 1961292 - RNA, 12 nt, Human
cucuucuccacu

SEQ ID NO: 1961293 - RNA, 13 nt, Human
cucuucuccacug

SEQ ID NO: 1961294 - RNA, 15 nt, Human
cucuucuccaggcug

SEQ ID NO: 1961295 - RNA, 13 nt, Human
cucuucuccaggc

SEQ ID NO: 1961296 - RNA, 12 nt, Human
cucuuccucuug

SEQ ID NO: 1961297 - RNA, 14 nt, Human
cucuuccucuugac

SEQ ID NO: 1961298 - RNA, 16 nt, Human
cucuuccucuugaccc

SEQ ID NO: 1961299 - RNA, 17 nt, Human
cucuuccucuugacccu

SEQ ID NO: 1961300 - RNA, 19 nt, Human
cucuuccucuugacccugc

SEQ ID NO: 1961301 - RNA, 23 nt, Human
cucuuccucuugacccugcaccc

SEQ ID NO: 1961302 - RNA, 23 nt, Human
cucuuccuccugacaccccacuu

SEQ ID NO: 1961303 - RNA, 21 nt, Human
cucuucccgccgcccagccca

SEQ ID NO: 1961304 - RNA, 23 nt, Human
cucuucccgccgcccagcccacc

SEQ ID NO: 1961305 - RNA, 20 nt, Human
cucugugucagguggggcag

SEQ ID NO: 1961306 - RNA, 21 nt, Human
cucugugucagguggggcagc

SEQ ID NO: 1961307 - RNA, 22 nt, Human
cucugugucagguggggcagcu

SEQ ID NO: 1961308 - RNA, 23 nt, Human
cucugugucagguggggcagcuu

SEQ ID NO: 1961309 - RNA, 22 nt, Human
cucuguugcccaggcuggagug

SEQ ID NO: 1961310 - RNA, 17 nt, Human
cucuguugcccaggcug

SEQ ID NO: 1961311 - RNA, 22 nt, Human
cugccuccagaauggucuuucu

SEQ ID NO: 1961312 - RNA, 14 nt, Human
cugccuccagaaug

SEQ ID NO: 1961313 - RNA, 18 nt, Human
cugccucucugcaggucc

SEQ ID NO: 1961314 - RNA, 17 nt, Human
cugccucucugcagguc

SEQ ID NO: 1961315 - RNA, 16 nt, Human
cugccucucugcaggu

SEQ ID NO: 1961316 - RNA, 15 nt, Human
cugccucucugcagg

SEQ ID NO: 1961317 - RNA, 15 nt, Human
cugccucagccuccc

SEQ ID NO: 1961318 - RNA, 17 nt, Human
cugccucagccucccga

SEQ ID NO: 1961319 - RNA, 19 nt, Human
cugccucagccucccaaag

SEQ ID NO: 1961320 - RNA, 21 nt, Human
cugccuaggauucacacccca

SEQ ID NO: 1961321 - RNA, 23 nt, Human
cugccuaggauucacaccccacc

SEQ ID NO: 1961322 - RNA, 22 nt, Human
cugccgcagcccugcagagggc

SEQ ID NO: 1961323 - RNA, 21 nt, Human
cugccgcagcccugcagaggg

SEQ ID NO: 1961324 - RNA, 20 nt, Human
cugccgcagcccugcagagg

SEQ ID NO: 1961325 - RNA, 19 nt, Human
cugccgcagcccugcagag

SEQ ID NO: 1961326 - RNA, 23 nt, Human
cugccgcagcccugcagagggca

SEQ ID NO: 1961327 - RNA, 20 nt, Human
cugccgccgcuagguagagu

SEQ ID NO: 1961328 - RNA, 12 nt, Human
cugccccugccu

SEQ ID NO: 1961329 - RNA, 22 nt, Human
cugccccugccuuggggucagg

SEQ ID NO: 1961330 - RNA, 22 nt, Human
cugccccugcuacugccaaccu

SEQ ID NO: 1961331 - RNA, 18 nt, Human
cugccccugcuacugcca

SEQ ID NO: 1961332 - RNA, 13 nt, Human
cugccgcagcccu

SEQ ID NO: 1961333 - RNA, 12 nt, Human
cugccgcagccc

SEQ ID NO: 1961334 - RNA, 21 nt, Human
cugccccuccucucugcccua

SEQ ID NO: 1961335 - RNA, 20 nt, Human
cugccccuccucucugcccu

SEQ ID NO: 1961336 - RNA, 13 nt, Human
cugccccugcccc

SEQ ID NO: 1961337 - RNA, 18 nt, Human
cugccuggacuagaggga

SEQ ID NO: 1961338 - RNA, 18 nt, Human
cugccuucgguacccacc

SEQ ID NO: 1961339 - RNA, 19 nt, Human
cugccuucgguacccacca

SEQ ID NO: 1961340 - RNA, 20 nt, Human
cugccuucgguacccaccac

SEQ ID NO: 1961341 - RNA, 17 nt, Human
cugccucugacacacag

SEQ ID NO: 1961342 - RNA, 18 nt, Human
cugccucugacacacagc

SEQ ID NO: 1961343 - RNA, 21 nt, Human
cugccucugacacacagcucu

SEQ ID NO: 1961344 - RNA, 21 nt, Human
cugccugcccugucaggaggc

SEQ ID NO: 1961345 - RNA, 11 nt, Human
cugccugcccu

SEQ ID NO: 1961346 - RNA, 21 nt, Human
cugccugcccaggccccugcc

SEQ ID NO: 1961347 - RNA, 22 nt, Human
cugccugcccaggccccugcca

SEQ ID NO: 1961348 - RNA, 21 nt, Human
cugccuuuggcacucugacuu

SEQ ID NO: 1961349 - RNA, 13 nt, Human
cugccuuuuguuc

SEQ ID NO: 1961350 - RNA, 19 nt, Human
cugcgguccacccaggagc

SEQ ID NO: 1961351 - RNA, 20 nt, Human
cugcgguccacccaggagcc

SEQ ID NO: 1961352 - RNA, 22 nt, Human
cugcgggcuggguguggucucc

SEQ ID NO: 1961353 - RNA, 18 nt, Human
cugcgguccacccaggag

SEQ ID NO: 1961354 - RNA, 19 nt, Human
cugccaaugggagcucaug

SEQ ID NO: 1961355 - RNA, 18 nt, Human
cugccaaugggagcucau

SEQ ID NO: 1961356 - RNA, 18 nt, Human
cugccacaaggaagaaau

SEQ ID NO: 1961357 - RNA, 19 nt, Human
cugccacaaggaagaaauu

SEQ ID NO: 1961358 - RNA, 22 nt, Human
cugcaugcgggcuuccuccugg

SEQ ID NO: 1961359 - RNA, 18 nt, Human
cugcaugcgggcuuccuc

SEQ ID NO: 1961360 - RNA, 16 nt, Human
cugcaucguuucaucu

SEQ ID NO: 1961361 - RNA, 20 nt, Human
cugcauccuccgccucccgg

SEQ ID NO: 1961362 - RNA, 19 nt, Human
cugcauccuccgccucccg

SEQ ID NO: 1961363 - RNA, 22 nt, Human
cugcaucguuucaucuuccaac

SEQ ID NO: 1961364 - RNA, 22 nt, Human
cugcaguugccagucaccccgg

SEQ ID NO: 1961365 - RNA, 21 nt, Human
cugcaguugccagucaccccg

SEQ ID NO: 1961366 - RNA, 17 nt, Human
cugcaguugccagucac

SEQ ID NO: 1961367 - RNA, 19 nt, Human
cugcaguugccagucaccc

SEQ ID NO: 1961368 - RNA, 17 nt, Human
cugcagaacagcuucau

SEQ ID NO: 1961369 - RNA, 23 nt, Human
cugcacuugggggcucagcaagg

SEQ ID NO: 1961370 - RNA, 24 nt, Human
cugcacuugggggcucagcaaggc

SEQ ID NO: 1961371 - RNA, 23 nt, Human
cugcacuugcagacucuacagag

SEQ ID NO: 1961372 - RNA, 15 nt, Human
cugcacuugggggcu

SEQ ID NO: 1961373 - RNA, 19 nt, Human
cugcacuugggggcucagc

SEQ ID NO: 1961374 - RNA, 20 nt, Human
cugcacuugggggcucagca

SEQ ID NO: 1961375 - RNA, 21 nt, Human
cugcacuugggggcucagcaa

SEQ ID NO: 1961376 - RNA, 16 nt, Human
cugcccacucccugca

SEQ ID NO: 1961377 - RNA, 15 nt, Human
cugcccacucccugc

SEQ ID NO: 1961378 - RNA, 14 nt, Human
cugcccacucccug

SEQ ID NO: 1961379 - RNA, 22 nt, Human
cugcccaccuggccucugcacu

SEQ ID NO: 1961380 - RNA, 20 nt, Human
cugcccaccuggccucugca

SEQ ID NO: 1961381 - RNA, 19 nt, Human
cugcccaccuggccucugc

SEQ ID NO: 1961382 - RNA, 18 nt, Human
cugcccaccuggccucug

SEQ ID NO: 1961383 - RNA, 17 nt, Human
cugcccaccuggccucu

SEQ ID NO: 1961384 - RNA, 22 nt, Human
cugcccagaucagccagaagcc

SEQ ID NO: 1961385 - RNA, 17 nt, Human
cugcccagcccccuggu

SEQ ID NO: 1961386 - RNA, 18 nt, Human
cugcccacucccugcaac

SEQ ID NO: 1961387 - RNA, 16 nt, Human
cugcccacuggccggc

SEQ ID NO: 1961388 - RNA, 17 nt, Human
cugcccagccuccaagc

SEQ ID NO: 1961389 - RNA, 18 nt, Human
cugcccagaucagccaga

SEQ ID NO: 1961390 - RNA, 20 nt, Human
cugcccagaucagccagaag

SEQ ID NO: 1961391 - RNA, 21 nt, Human
cugcccagaucagccagaagc

SEQ ID NO: 1961392 - RNA, 15 nt, Human
cugcccaccuggccu

SEQ ID NO: 1961393 - RNA, 14 nt, Human
cugcccaccuggcc

SEQ ID NO: 1961394 - RNA, 13 nt, Human
cugcccaccuggc

SEQ ID NO: 1961395 - RNA, 15 nt, Human
cugccaugccagcuu

SEQ ID NO: 1961396 - RNA, 14 nt, Human
cugccaugccagcu

SEQ ID NO: 1961397 - RNA, 16 nt, Human
cugccacucaggccca

SEQ ID NO: 1961398 - RNA, 23 nt, Human
cugccacucaggcccaaagccuc

SEQ ID NO: 1961399 - RNA, 13 nt, Human
cugccaggcaugg

SEQ ID NO: 1961400 - RNA, 11 nt, Human
cugccaggcau

SEQ ID NO: 1961401 - RNA, 20 nt, Human
cugauuuuuuuuuccuucag

SEQ ID NO: 1961402 - RNA, 19 nt, Human
cugauuuuuuuuuccuuca

SEQ ID NO: 1961403 - RNA, 18 nt, Human
cugauuuuuuuuuccuuc

SEQ ID NO: 1961404 - RNA, 16 nt, Human
cugauuuuuuuuuccu

SEQ ID NO: 1961405 - RNA, 16 nt, Human
cugauuuuauucuuga

SEQ ID NO: 1961406 - RNA, 17 nt, Human
cugauuuuauucuugau

SEQ ID NO: 1961407 - RNA, 10 nt, Human
cugauuuuau

SEQ ID NO: 1961408 - RNA, 12 nt, Human
cugauuuuauuc

SEQ ID NO: 1961409 - RNA, 15 nt, Human
cugauuuuauucuug

SEQ ID NO: 1961410 - RNA, 16 nt, Human
cugauuuguuccuucu

SEQ ID NO: 1961411 - RNA, 22 nt, Human
cugauuuuuuuuuccuucagug

SEQ ID NO: 1961412 - RNA, 21 nt, Human
cugauuuuuuuuuccuucagu

SEQ ID NO: 1961413 - RNA, 18 nt, Human
cugauuuuauucuugauc

SEQ ID NO: 1961414 - RNA, 23 nt, Human
cugauuuuuuuuuccuucagugc

SEQ ID NO: 1961415 - RNA, 13 nt, Human
cugcaaagcccag

SEQ ID NO: 1961416 - RNA, 15 nt, Human
cugcaaagcccagcu

SEQ ID NO: 1961417 - RNA, 14 nt, Human
cugcaaaaccaggu

SEQ ID NO: 1961418 - RNA, 16 nt, Human
cugcaaaaccagguuu

SEQ ID NO: 1961419 - RNA, 21 nt, Human
cugauggugcaaugaccuuuc

SEQ ID NO: 1961420 - RNA, 20 nt, Human
cugauggugcaaugaccuuu

SEQ ID NO: 1961421 - RNA, 19 nt, Human
cugauggugcaaugaccuu

SEQ ID NO: 1961422 - RNA, 17 nt, Human
cugauggugcaaugacc

SEQ ID NO: 1961423 - RNA, 16 nt, Human
cugauugguuucucuu

SEQ ID NO: 1961424 - RNA, 18 nt, Human
cugauugguuucucuucu

SEQ ID NO: 1961425 - RNA, 19 nt, Human
cugauugguuucucuucuc

SEQ ID NO: 1961426 - RNA, 21 nt, Human
cugauugguuucucuucuccc

SEQ ID NO: 1961427 - RNA, 13 nt, Human
cugauuguauuua

SEQ ID NO: 1961428 - RNA, 17 nt, Human
cugauugugucucuugg

SEQ ID NO: 1961429 - RNA, 14 nt, Human
cugauuucuccugc

SEQ ID NO: 1961430 - RNA, 13 nt, Human
cugauuucuuuuc

SEQ ID NO: 1961431 - RNA, 21 nt, Human
cugauugugucucuugguccu

SEQ ID NO: 1961432 - RNA, 15 nt, Human
cugcacucucauugu

SEQ ID NO: 1961433 - RNA, 17 nt, Human
cugcacuccccugcugg

SEQ ID NO: 1961434 - RNA, 16 nt, Human
cugcacuccccugcug

SEQ ID NO: 1961435 - RNA, 18 nt, Human
cugcacuugcagacucua

SEQ ID NO: 1961436 - RNA, 14 nt, Human
cugcacugacucug

SEQ ID NO: 1961437 - RNA, 15 nt, Human
cugcacugacucugg

SEQ ID NO: 1961438 - RNA, 16 nt, Human
cugcacugacucugga

SEQ ID NO: 1961439 - RNA, 18 nt, Human
cugcacugacucuggaaa

SEQ ID NO: 1961440 - RNA, 22 nt, Human
cugcaccggcuggccuggcccc

SEQ ID NO: 1961441 - RNA, 16 nt, Human
cugcacccucaggcag

SEQ ID NO: 1961442 - RNA, 14 nt, Human
cugcacccucaggc

SEQ ID NO: 1961443 - RNA, 13 nt, Human
cugcacccucagg

SEQ ID NO: 1961444 - RNA, 15 nt, Human
cugcacuccccugcu

SEQ ID NO: 1961445 - RNA, 17 nt, Human
cugcaccccuuccuggg

SEQ ID NO: 1961446 - RNA, 19 nt, Human
cugcaccccuuccugggca

SEQ ID NO: 1961447 - RNA, 20 nt, Human
cugcaccccuuccugggcac

SEQ ID NO: 1961448 - RNA, 21 nt, Human
cugcaccccuuccugggcaca

SEQ ID NO: 1961449 - RNA, 23 nt, Human
cugcaccggcuggccuggccccu

SEQ ID NO: 1961450 - RNA, 12 nt, Human
cugcaccgggcc

SEQ ID NO: 1961451 - RNA, 22 nt, Human
cugcacaagcugcacccucagg

SEQ ID NO: 1961452 - RNA, 13 nt, Human
cugcacacagcac

SEQ ID NO: 1961453 - RNA, 18 nt, Human
cugcaauaaggggagagu

SEQ ID NO: 1961454 - RNA, 13 nt, Human
cugcaaagcaugu

SEQ ID NO: 1961455 - RNA, 15 nt, Human
cugcacaugauuuca

SEQ ID NO: 1961456 - RNA, 16 nt, Human
cugcacaugauuucac

SEQ ID NO: 1961457 - RNA, 17 nt, Human
cugcacaugauuucaca

SEQ ID NO: 1961458 - RNA, 18 nt, Human
cugcacaugauuucacaa

SEQ ID NO: 1961459 - RNA, 14 nt, Human
cugcaccccuuccu

SEQ ID NO: 1961460 - RNA, 15 nt, Human
cugcaccccuuccug

SEQ ID NO: 1961461 - RNA, 16 nt, Human
cugcaccccuuccugg

SEQ ID NO: 1961462 - RNA, 21 nt, Human
cugcacaugauuucacaaaua

SEQ ID NO: 1961463 - RNA, 22 nt, Human
cugcacaugauuucacaaauau

SEQ ID NO: 1961464 - RNA, 14 nt, Human
cugcacacagcacg

SEQ ID NO: 1961465 - RNA, 20 nt, Human
cugcacacgcuccuuccucu

SEQ ID NO: 1961466 - RNA, 22 nt, Human
cugcacacgcuccuuccucuga

SEQ ID NO: 1961467 - RNA, 22 nt, Human
cugcacagugcaucucagccca

SEQ ID NO: 1961468 - RNA, 22 nt, Human
cugaguugaagucaugcucccc

SEQ ID NO: 1961469 - RNA, 14 nt, Human
cugaguugaagagg

SEQ ID NO: 1961470 - RNA, 17 nt, Human
cugaguugaagagggga

SEQ ID NO: 1961471 - RNA, 19 nt, Human
cugaguuaggcuuucucuu

SEQ ID NO: 1961472 - RNA, 19 nt, Human
cugaguuccggcaccagua

SEQ ID NO: 1961473 - RNA, 13 nt, Human
cugaguuccugag

SEQ ID NO: 1961474 - RNA, 16 nt, Human
cugaguuguuacccca

SEQ ID NO: 1961475 - RNA, 17 nt, Human
cugaguuguuaccccaa

SEQ ID NO: 1961476 - RNA, 22 nt, Human
cugauaaauauucacacuugaa

SEQ ID NO: 1961477 - RNA, 15 nt, Human
cugaguuccuagcca

SEQ ID NO: 1961478 - RNA, 16 nt, Human
cugaguuccuagccac

SEQ ID NO: 1961479 - RNA, 17 nt, Human
cugaguuccuagccacc

SEQ ID NO: 1961480 - RNA, 18 nt, Human
cugaguuccuagccaccg

SEQ ID NO: 1961481 - RNA, 20 nt, Human
cugagucuguucugguaauc

SEQ ID NO: 1961482 - RNA, 19 nt, Human
cugagucugaaggcugggu

SEQ ID NO: 1961483 - RNA, 18 nt, Human
cugagucugaaggcuggg

SEQ ID NO: 1961484 - RNA, 20 nt, Human
cugagucccaggcugagccu

SEQ ID NO: 1961485 - RNA, 17 nt, Human
cugagucugaaggcugg

SEQ ID NO: 1961486 - RNA, 22 nt, Human
cugauacagaaaaguugaauuu

SEQ ID NO: 1961487 - RNA, 14 nt, Human
cugauauauuuaaa

SEQ ID NO: 1961488 - RNA, 15 nt, Human
cugaucaccugcccu

SEQ ID NO: 1961489 - RNA, 15 nt, Human
cugaucacugaaaua

SEQ ID NO: 1961490 - RNA, 16 nt, Human
cugauauugaaguaaa

SEQ ID NO: 1961491 - RNA, 13 nt, Human
cugauauguuugu

SEQ ID NO: 1961492 - RNA, 20 nt, Human
cugauauucaaauggacaaa

SEQ ID NO: 1961493 - RNA, 14 nt, Human
cugauauugaagua

SEQ ID NO: 1961494 - RNA, 16 nt, Human
cugauggugcaaugac

SEQ ID NO: 1961495 - RNA, 15 nt, Human
cugauggugcaauga

SEQ ID NO: 1961496 - RNA, 21 nt, Human
cugaucccuuccaccugcucu

SEQ ID NO: 1961497 - RNA, 14 nt, Human
cugauggugcaaug

SEQ ID NO: 1961498 - RNA, 21 nt, Human
cugauccuaguuccaccauca

SEQ ID NO: 1961499 - RNA, 20 nt, Human
cugauccuaguuccaccauc

SEQ ID NO: 1961500 - RNA, 17 nt, Human
cugaucccugaucccuu

SEQ ID NO: 1961501 - RNA, 20 nt, Human
cugaucccugaucccuucca

SEQ ID NO: 1961502 - RNA, 14 nt, Human
cugaucccuuccac

SEQ ID NO: 1961503 - RNA, 18 nt, Human
cugaucccuuccaccugc

SEQ ID NO: 1961504 - RNA, 15 nt, Human
cugaggcuccacuug

SEQ ID NO: 1961505 - RNA, 21 nt, Human
cugaggcuccacuuggucugu

SEQ ID NO: 1961506 - RNA, 14 nt, Human
cugagcccccagcu

SEQ ID NO: 1961507 - RNA, 15 nt, Human
cugagcccccagcuu

SEQ ID NO: 1961508 - RNA, 17 nt, Human
cugagcccccagcuucc

SEQ ID NO: 1961509 - RNA, 18 nt, Human
cugagcccccagcuucca

SEQ ID NO: 1961510 - RNA, 22 nt, Human
cugagcccccagcuuccagcag

SEQ ID NO: 1961511 - RNA, 23 nt, Human
cugagcccccagcuuccagcagg

SEQ ID NO: 1961512 - RNA, 24 nt, Human
cugaggcccuucucuccagccccu

SEQ ID NO: 1961513 - RNA, 20 nt, Human
cugaggccguugcugacuua

SEQ ID NO: 1961514 - RNA, 22 nt, Human
cugaggcugggcucccuuccca

SEQ ID NO: 1961515 - RNA, 17 nt, Human
cugaggcugggcucccu

SEQ ID NO: 1961516 - RNA, 16 nt, Human
cugaggcugggcuccc

SEQ ID NO: 1961517 - RNA, 15 nt, Human
cugaggcugggcucc

SEQ ID NO: 1961518 - RNA, 13 nt, Human
cugaggcugggcu

SEQ ID NO: 1961519 - RNA, 16 nt, Human
gaacuuggcgcugccc

SEQ ID NO: 1961520 - RNA, 15 nt, Human
gaacuuggcgcugcc

SEQ ID NO: 1961521 - RNA, 13 nt, Human
gaacuuggcgcug

SEQ ID NO: 1961522 - RNA, 14 nt, Human
gaacuugcugccuc

SEQ ID NO: 1961523 - RNA, 12 nt, Human
gaacuugcugcc

SEQ ID NO: 1961524 - RNA, 13 nt, Human
gaacuugcugccu

SEQ ID NO: 1961525 - RNA, 23 nt, Human
gaacuugguucccauuugcuccu

SEQ ID NO: 1961526 - RNA, 21 nt, Human
gaacuuguaaaggaauuuaaa

SEQ ID NO: 1961527 - RNA, 16 nt, Human
gaagaaacagcuauga

SEQ ID NO: 1961528 - RNA, 20 nt, Human
gaagaaacagcuaugagagg

SEQ ID NO: 1961529 - RNA, 19 nt, Human
gaagaaaacacuguuauca

SEQ ID NO: 1961530 - RNA, 17 nt, Human
gaagaaaacacuguuau

SEQ ID NO: 1961531 - RNA, 18 nt, Human
gaagaaaacacuguuauc

SEQ ID NO: 1961532 - RNA, 13 nt, Human
gaacuuggaagca

SEQ ID NO: 1961533 - RNA, 15 nt, Human
gaacuuggaagcaca

SEQ ID NO: 1961534 - RNA, 12 nt, Human
gaagaaaauacu

SEQ ID NO: 1961535 - RNA, 13 nt, Human
gaagaaaauacuu

SEQ ID NO: 1961536 - RNA, 17 nt, Human
gaagaaaauacuuaaau

SEQ ID NO: 1961537 - RNA, 21 nt, Human
gaagaaaauguucuuccaguu

SEQ ID NO: 1961538 - RNA, 19 nt, Human
gaagaaaauacuuaaaugu

SEQ ID NO: 1961539 - RNA, 20 nt, Human
gaagaaaauacuuaaauguu

SEQ ID NO: 1961540 - RNA, 19 nt, Human
gaacuugagccugucaaga

SEQ ID NO: 1961541 - RNA, 15 nt, Human
gaacucccuuucaac

SEQ ID NO: 1961542 - RNA, 22 nt, Human
gaacuggguacuuguggacaca

SEQ ID NO: 1961543 - RNA, 22 nt, Human
gaacucaucuagguaaauuaca

SEQ ID NO: 1961544 - RNA, 14 nt, Human
gaacucccuuucaa

SEQ ID NO: 1961545 - RNA, 16 nt, Human
gaacucaugugauuua

SEQ ID NO: 1961546 - RNA, 13 nt, Human
gaacuauuagagc

SEQ ID NO: 1961547 - RNA, 14 nt, Human
gaacuaucuucauc

SEQ ID NO: 1961548 - RNA, 16 nt, Human
gaacuaucuucaucug

SEQ ID NO: 1961549 - RNA, 13 nt, Human
gaacguucucuuu

SEQ ID NO: 1961550 - RNA, 12 nt, Human
gaacuaucuuca

SEQ ID NO: 1961551 - RNA, 13 nt, Human
gaacuaucuucau

SEQ ID NO: 1961552 - RNA, 20 nt, Human
gaacuaggaaggcacuucug

SEQ ID NO: 1961553 - RNA, 23 nt, Human
gaacguagucggcacagccuggu

SEQ ID NO: 1961554 - RNA, 17 nt, Human
gaaccugcacacgagca

SEQ ID NO: 1961555 - RNA, 23 nt, Human
gaaccugggaaagagauuuaaac

SEQ ID NO: 1961556 - RNA, 22 nt, Human
gaaccugggaaagagauuuaaa

SEQ ID NO: 1961557 - RNA, 19 nt, Human
gaaccugugagcugcacca

SEQ ID NO: 1961558 - RNA, 16 nt, Human
gaaccuguccuaagga

SEQ ID NO: 1961559 - RNA, 17 nt, Human
gaaccugugagcugcac

SEQ ID NO: 1961560 - RNA, 21 nt, Human
gaaccuucuggccucccacag

SEQ ID NO: 1961561 - RNA, 18 nt, Human
gaaccuucuggccuccca

SEQ ID NO: 1961562 - RNA, 15 nt, Human
gaaccuuccuuccug

SEQ ID NO: 1961563 - RNA, 19 nt, Human
gaaccuuccuuccugcuug

SEQ ID NO: 1961564 - RNA, 22 nt, Human
gaacagaacucgguguccccac

SEQ ID NO: 1961565 - RNA, 15 nt, Human
gaacagacuggaagc

SEQ ID NO: 1961566 - RNA, 16 nt, Human
gaacagacuggaagca

SEQ ID NO: 1961567 - RNA, 21 nt, Human
gaaccacaucuugcucugcug

SEQ ID NO: 1961568 - RNA, 12 nt, Human
gaaccugacccc

SEQ ID NO: 1961569 - RNA, 11 nt, Human
gaaccugaccc

SEQ ID NO: 1961570 - RNA, 16 nt, Human
gaaccaccacacccag

SEQ ID NO: 1961571 - RNA, 17 nt, Human
gaaccaccacacccagc

SEQ ID NO: 1961572 - RNA, 18 nt, Human
gaaacauuggaagcaggu

SEQ ID NO: 1961573 - RNA, 20 nt, Human
gaaacaugacucguauaugu

SEQ ID NO: 1961574 - RNA, 21 nt, Human
gaaacauguugccaaaauggu

SEQ ID NO: 1961575 - RNA, 23 nt, Human
gaaacauguugccaaaauggugg

SEQ ID NO: 1961576 - RNA, 13 nt, Human
gaaacauugcuuu

SEQ ID NO: 1961577 - RNA, 16 nt, Human
gaaacauugcuuuuaa

SEQ ID NO: 1961578 - RNA, 17 nt, Human
gaaacauugcuuuuaaa

SEQ ID NO: 1961579 - RNA, 18 nt, Human
gaaacauugcuuuuaaaa

SEQ ID NO: 1961580 - RNA, 21 nt, Human
gaaacauugcuuuuaaaacua

SEQ ID NO: 1961581 - RNA, 13 nt, Human
gaaacauuggaag

SEQ ID NO: 1961582 - RNA, 14 nt, Human
gaaacauuggaagc

SEQ ID NO: 1961583 - RNA, 15 nt, Human
gaaacaucauagaaa

SEQ ID NO: 1961584 - RNA, 18 nt, Human
gaaauaauuuuauuccag

SEQ ID NO: 1961585 - RNA, 13 nt, Human
gaaauaauaaaaa

SEQ ID NO: 1961586 - RNA, 15 nt, Human
gaaauaauaaaaaau

SEQ ID NO: 1961587 - RNA, 19 nt, Human
gaaauaauaaaaaauuuca

SEQ ID NO: 1961588 - RNA, 20 nt, Human
gaaauaauaaaaaauuucag

SEQ ID NO: 1961589 - RNA, 17 nt, Human
gaaauaacacagcaguu

SEQ ID NO: 1961590 - RNA, 20 nt, Human
gaaauacuagauuugggaga

SEQ ID NO: 1961591 - RNA, 18 nt, Human
gaaauagacagcaugaga

SEQ ID NO: 1961592 - RNA, 17 nt, Human
gaaauacagacuggaug

SEQ ID NO: 1961593 - RNA, 19 nt, Human
gaaauacagauaaaugauu

SEQ ID NO: 1961594 - RNA, 22 nt, Human
gaaauacagauaaaugauucaa

SEQ ID NO: 1961595 - RNA, 13 nt, Human
gaaauaguucugu

SEQ ID NO: 1961596 - RNA, 17 nt, Human
gaaauaguucugugacu

SEQ ID NO: 1961597 - RNA, 23 nt, Human
gaaauaguucugugacuaggaaa

SEQ ID NO: 1961598 - RNA, 13 nt, Human
gaaauauaauuga

SEQ ID NO: 1961599 - RNA, 19 nt, Human
gaaauagucauuugugaau

SEQ ID NO: 1961600 - RNA, 20 nt, Human
gaaauagucauuugugaauu

SEQ ID NO: 1961601 - RNA, 22 nt, Human
gaaauaguguggaaauuaagaa

SEQ ID NO: 1961602 - RNA, 21 nt, Human
gaaauaucugaaaauguaugu

SEQ ID NO: 1961603 - RNA, 16 nt, Human
gaaauauguauucugu

SEQ ID NO: 1961604 - RNA, 20 nt, Human
gaaauauguauucuguaaaa

SEQ ID NO: 1961605 - RNA, 17 nt, Human
gaaauuuguuauaauga

SEQ ID NO: 1961606 - RNA, 21 nt, Human
gaaauugguaccuugcacaca

SEQ ID NO: 1961607 - RNA, 15 nt, Human
gaaauugaaaaguua

SEQ ID NO: 1961608 - RNA, 17 nt, Human
gaaauugaaaaguuauu

SEQ ID NO: 1961609 - RNA, 18 nt, Human
gaaauucuguuuuuaaaa

SEQ ID NO: 1961610 - RNA, 13 nt, Human
gaaauucuguuuu

SEQ ID NO: 1961611 - RNA, 14 nt, Human
gaaauucuguuuuu

SEQ ID NO: 1961612 - RNA, 15 nt, Human
gaaauucuguuuuua

SEQ ID NO: 1961613 - RNA, 16 nt, Human
gaaauucuguuuuuaa

SEQ ID NO: 1961614 - RNA, 12 nt, Human
gaaauucuguuu

SEQ ID NO: 1961615 - RNA, 19 nt, Human
gaaauugcauuuccugaca

SEQ ID NO: 1961616 - RNA, 17 nt, Human
gaaauugagcugcuuuu

SEQ ID NO: 1961617 - RNA, 23 nt, Human
gaaauugagcugcuuuuuuugaa

SEQ ID NO: 1961618 - RNA, 16 nt, Human
gaaauugguaccuugc

SEQ ID NO: 1961619 - RNA, 20 nt, Human
gaaauugguaccuugcacac

SEQ ID NO: 1961620 - RNA, 17 nt, Human
gaaaugguauccagaau

SEQ ID NO: 1961621 - RNA, 20 nt, Human
gaaaugggcagagcagagac

SEQ ID NO: 1961622 - RNA, 14 nt, Human
gaaaugggcagagc

SEQ ID NO: 1961623 - RNA, 23 nt, Human
gaaauuaacuuacccuguauauc

SEQ ID NO: 1961624 - RNA, 13 nt, Human
gaaauuaagaaga

SEQ ID NO: 1961625 - RNA, 15 nt, Human
gaaauuaagaagaaa

SEQ ID NO: 1961626 - RNA, 16 nt, Human
gaaauuaagaagaaac

SEQ ID NO: 1961627 - RNA, 16 nt, Human
gaaauguuugcugaac

SEQ ID NO: 1961628 - RNA, 19 nt, Human
gaaucauuguccagagcug

SEQ ID NO: 1961629 - RNA, 17 nt, Human
gaauccaaaagaaaaac

SEQ ID NO: 1961630 - RNA, 16 nt, Human
gaauccaaaagaaaaa

SEQ ID NO: 1961631 - RNA, 21 nt, Human
gaaucauuguccagagcugcu

SEQ ID NO: 1961632 - RNA, 14 nt, Human
gaaucauuuguuca

SEQ ID NO: 1961633 - RNA, 23 nt, Human
gaaucauuuguucaaagcuguug

SEQ ID NO: 1961634 - RNA, 17 nt, Human
gaaucccuguguuaauu

SEQ ID NO: 1961635 - RNA, 15 nt, Human
gaauagcugggacua

SEQ ID NO: 1961636 - RNA, 14 nt, Human
gaauagcugaugug

SEQ ID NO: 1961637 - RNA, 11 nt, Human
gaaucacaggc

SEQ ID NO: 1961638 - RNA, 12 nt, Human
gaaucacaggcu

SEQ ID NO: 1961639 - RNA, 23 nt, Human
gaaucaccuaauuaauuucagua

SEQ ID NO: 1961640 - RNA, 14 nt, Human
gaaucacaggcugg

SEQ ID NO: 1961641 - RNA, 15 nt, Human
gaaucacaggcuggg

SEQ ID NO: 1961642 - RNA, 17 nt, Human
gaaucacaggcugggcu

SEQ ID NO: 1961643 - RNA, 18 nt, Human
gaaucacaggcugggcug

SEQ ID NO: 1961644 - RNA, 22 nt, Human
gaaucacaggcugggcugggca

SEQ ID NO: 1961645 - RNA, 18 nt, Human
gaaucaccuaauuaauuu

SEQ ID NO: 1961646 - RNA, 19 nt, Human
gaaucaccuaauuaauuuc

SEQ ID NO: 1961647 - RNA, 20 nt, Human
gaaucaccuaauuaauuuca

SEQ ID NO: 1961648 - RNA, 14 nt, Human
gaauagcugggacu

SEQ ID NO: 1961649 - RNA, 15 nt, Human
gaauagaugcugacu

SEQ ID NO: 1961650 - RNA, 18 nt, Human
gaauagaagcuaagguuu

SEQ ID NO: 1961651 - RNA, 14 nt, Human
gaaugaaagggccc

SEQ ID NO: 1961652 - RNA, 14 nt, Human
gaaugccuccugca

SEQ ID NO: 1961653 - RNA, 19 nt, Human
gaaugaaagggcccagaga

SEQ ID NO: 1961654 - RNA, 17 nt, Human
gaaucuguaugauucua

SEQ ID NO: 1961655 - RNA, 18 nt, Human
gaaucuguaugauucuau

SEQ ID NO: 1961656 - RNA, 16 nt, Human
gaaucuguaugauucu

SEQ ID NO: 1961657 - RNA, 17 nt, Human
gaaucucaacaugucuc

SEQ ID NO: 1961658 - RNA, 21 nt, Human
gaaucucaacaugucuccuac

SEQ ID NO: 1961659 - RNA, 16 nt, Human
gaaucucaaauaacua

SEQ ID NO: 1961660 - RNA, 12 nt, Human
gaaguuucugcc

SEQ ID NO: 1961661 - RNA, 12 nt, Human
gaauaaaauuuu

SEQ ID NO: 1961662 - RNA, 19 nt, Human
gaagguuuuuguaaagauu

SEQ ID NO: 1961663 - RNA, 14 nt, Human
gaagguuuuugaua

SEQ ID NO: 1961664 - RNA, 22 nt, Human
gaagguuggugaauuucacaag

SEQ ID NO: 1961665 - RNA, 18 nt, Human
gaauaaaggcagcuguug

SEQ ID NO: 1961666 - RNA, 14 nt, Human
gaauaaaggcagcu

SEQ ID NO: 1961667 - RNA, 14 nt, Human
gaauaaagacaccu

SEQ ID NO: 1961668 - RNA, 12 nt, Human
gaauaaacuaga

SEQ ID NO: 1961669 - RNA, 14 nt, Human
gaauaaacaccacu

SEQ ID NO: 1961670 - RNA, 16 nt, Human
gaauaaacuagauuac

SEQ ID NO: 1961671 - RNA, 19 nt, Human
gaauaaacuagauuacauu

SEQ ID NO: 1961672 - RNA, 14 nt, Human
gaauaacauguaau

SEQ ID NO: 1961673 - RNA, 21 nt, Human
gaauaagccauucugacucau

SEQ ID NO: 1961674 - RNA, 22 nt, Human
gaauaagccauucugacucaua

SEQ ID NO: 1961675 - RNA, 15 nt, Human
gaauaaauugcuccu

SEQ ID NO: 1961676 - RNA, 20 nt, Human
gaauaagugccaggauggaa

SEQ ID NO: 1961677 - RNA, 20 nt, Human
gaauaauccuaaacauauga

SEQ ID NO: 1961678 - RNA, 12 nt, Human
gaauacuugaac

SEQ ID NO: 1961679 - RNA, 14 nt, Human
gaauacuugaacca

SEQ ID NO: 1961680 - RNA, 15 nt, Human
gaauacuugaaccau

SEQ ID NO: 1961681 - RNA, 22 nt, Human
gaauacuugaaccauaaaaugu

SEQ ID NO: 1961682 - RNA, 16 nt, Human
gaauacugauggaauu

SEQ ID NO: 1961683 - RNA, 15 nt, Human
gaauacugauggaau

SEQ ID NO: 1961684 - RNA, 13 nt, Human
gaauacugcuuga

SEQ ID NO: 1961685 - RNA, 14 nt, Human
gaauacugcuugaa

SEQ ID NO: 1961686 - RNA, 17 nt, Human
gaauacugcuugaauaa

SEQ ID NO: 1961687 - RNA, 24 nt, Human
gaauacuuugcagcacagcugaga

SEQ ID NO: 1961688 - RNA, 17 nt, Human
gaauagaagcuaagguu

SEQ ID NO: 1961689 - RNA, 14 nt, Human
gaauaauuacagug

SEQ ID NO: 1961690 - RNA, 14 nt, Human
gaauacuuuauaaa

SEQ ID NO: 1961691 - RNA, 23 nt, Human
gaagcccaggaaaggcuccagga

SEQ ID NO: 1961692 - RNA, 22 nt, Human
gaagcccaggaaaggcuccagg

SEQ ID NO: 1961693 - RNA, 21 nt, Human
gaagcccaggaaaggcuccag

SEQ ID NO: 1961694 - RNA, 20 nt, Human
gaagcccaggaaaggcucca

SEQ ID NO: 1961695 - RNA, 20 nt, Human
gaagcggcccuaagggagug

SEQ ID NO: 1961696 - RNA, 13 nt, Human
gaaggaaaaauuc

SEQ ID NO: 1961697 - RNA, 15 nt, Human
gaaggaaaaauucaa

SEQ ID NO: 1961698 - RNA, 11 nt, Human
gaaggaaaaau

SEQ ID NO: 1961699 - RNA, 18 nt, Human
gaagcuuuuaugugaaac

SEQ ID NO: 1961700 - RNA, 10 nt, Human
gaagccuuug

SEQ ID NO: 1961701 - RNA, 11 nt, Human
gaagccuuugu

SEQ ID NO: 1961702 - RNA, 10 nt, Human
gaagcccaga

SEQ ID NO: 1961703 - RNA, 12 nt, Human
gaagcccagaau

SEQ ID NO: 1961704 - RNA, 14 nt, Human
gaagccagggcccg

SEQ ID NO: 1961705 - RNA, 18 nt, Human
gaagccagcugccuagga

SEQ ID NO: 1961706 - RNA, 23 nt, Human
gaagccagcugccuaggauucac

SEQ ID NO: 1961707 - RNA, 23 nt, Human
gaagccagcaggcucucaggcca

SEQ ID NO: 1961708 - RNA, 16 nt, Human
gaagccagcaggcucu

SEQ ID NO: 1961709 - RNA, 15 nt, Human
gaagccagcaggcuc

SEQ ID NO: 1961710 - RNA, 22 nt, Human
gaagccacgguguucugugaua

SEQ ID NO: 1961711 - RNA, 14 nt, Human
gaagaagcucucuc

SEQ ID NO: 1961712 - RNA, 14 nt, Human
gaagacuccagaaa

SEQ ID NO: 1961713 - RNA, 15 nt, Human
gaagacuccagaaau

SEQ ID NO: 1961714 - RNA, 19 nt, Human
gaagacucauucuucugua

SEQ ID NO: 1961715 - RNA, 21 nt, Human
gaagacucauucuucuguacg

SEQ ID NO: 1961716 - RNA, 12 nt, Human
gaaggauacaaa

SEQ ID NO: 1961717 - RNA, 19 nt, Human
gaaggauacaaaagcaugu

SEQ ID NO: 1961718 - RNA, 21 nt, Human
gaaggauacaaaagcauguga

SEQ ID NO: 1961719 - RNA, 18 nt, Human
gaaggaaacccagcucug

SEQ ID NO: 1961720 - RNA, 23 nt, Human
gaaggacccggaggggccuggca

SEQ ID NO: 1961721 - RNA, 17 nt, Human
gaaggaaacccagcucu

SEQ ID NO: 1961722 - RNA, 14 nt, Human
gaaggaaacccagc

SEQ ID NO: 1961723 - RNA, 16 nt, Human
gaaggaccuucacucu

SEQ ID NO: 1961724 - RNA, 24 nt, Human
gaaggaccuucacucuaagauguu

SEQ ID NO: 1961725 - RNA, 15 nt, Human
gaaggccccgcccag

SEQ ID NO: 1961726 - RNA, 14 nt, Human
gaaggccccgccca

SEQ ID NO: 1961727 - RNA, 16 nt, Human
gaaggccccgcccagg

SEQ ID NO: 1961728 - RNA, 14 nt, Human
gaagggguuuucuu

SEQ ID NO: 1961729 - RNA, 15 nt, Human
gaagguagaauguuu

SEQ ID NO: 1961730 - RNA, 16 nt, Human
gaagguagaauguuuu

SEQ ID NO: 1961731 - RNA, 17 nt, Human
gaagguagaauguuuuc

SEQ ID NO: 1961732 - RNA, 20 nt, Human
gaagguagaauguuuucaaa

SEQ ID NO: 1961733 - RNA, 13 nt, Human
gaagguaaaaagu

SEQ ID NO: 1961734 - RNA, 18 nt, Human
gaaggcagaaagcaaaau

SEQ ID NO: 1961735 - RNA, 15 nt, Human
gaaggcagaaagcaa

SEQ ID NO: 1961736 - RNA, 13 nt, Human
gaaggcagggagg

SEQ ID NO: 1961737 - RNA, 14 nt, Human
gaaggcagggaggg

SEQ ID NO: 1961738 - RNA, 14 nt, Human
gaaggcccagcacc

SEQ ID NO: 1961739 - RNA, 22 nt, Human
gaaggcccagcaccacccuccu

SEQ ID NO: 1961740 - RNA, 23 nt, Human
gaaggcccagcaccacccuccuu

SEQ ID NO: 1961741 - RNA, 15 nt, Human
cuuuuuugaaaucag

SEQ ID NO: 1961742 - RNA, 22 nt, Human
cuuuuuucucugauacagaaaa

SEQ ID NO: 1961743 - RNA, 15 nt, Human
cuuuuuuggcugcug

SEQ ID NO: 1961744 - RNA, 14 nt, Human
cuuuuuuggcugcu

SEQ ID NO: 1961745 - RNA, 23 nt, Human
gaaaaaggaugcacagaguuguu

SEQ ID NO: 1961746 - RNA, 17 nt, Human
gaaaaaggaugcacaga

SEQ ID NO: 1961747 - RNA, 21 nt, Human
cuuuugagugccuuacacaau

SEQ ID NO: 1961748 - RNA, 16 nt, Human
cuuuugagcauuuaga

SEQ ID NO: 1961749 - RNA, 20 nt, Human
cuuuuuucucugauacagaa

SEQ ID NO: 1961750 - RNA, 14 nt, Human
cuuuuuucuaaagu

SEQ ID NO: 1961751 - RNA, 14 nt, Human
cuuuugauaagaaa

SEQ ID NO: 1961752 - RNA, 15 nt, Human
cuuuuuucacuacau

SEQ ID NO: 1961753 - RNA, 16 nt, Human
gaaaacguggcugcuu

SEQ ID NO: 1961754 - RNA, 15 nt, Human
gaaaacguggcugcu

SEQ ID NO: 1961755 - RNA, 18 nt, Human
gaaaacguggcugcuuca

SEQ ID NO: 1961756 - RNA, 21 nt, Human
gaaaaccaagccguggcuucc

SEQ ID NO: 1961757 - RNA, 13 nt, Human
gaaaaccaaacaa

SEQ ID NO: 1961758 - RNA, 18 nt, Human
gaaaaccaagccguggcu

SEQ ID NO: 1961759 - RNA, 19 nt, Human
gaaaaccaagccguggcuu

SEQ ID NO: 1961760 - RNA, 14 nt, Human
gaaaacaugcuaca

SEQ ID NO: 1961761 - RNA, 15 nt, Human
gaaaacaugcuacac

SEQ ID NO: 1961762 - RNA, 12 nt, Human
gaaaacaugcua

SEQ ID NO: 1961763 - RNA, 14 nt, Human
gaaaacacauuuuu

SEQ ID NO: 1961764 - RNA, 14 nt, Human
gaaaacaucuccuu

SEQ ID NO: 1961765 - RNA, 15 nt, Human
gaaaacaucuccuua

SEQ ID NO: 1961766 - RNA, 19 nt, Human
gaaaacaucuccuuagaaa

SEQ ID NO: 1961767 - RNA, 13 nt, Human
gaaaacacauuuu

SEQ ID NO: 1961768 - RNA, 22 nt, Human
gaaaacaauaacgauaaaagac

SEQ ID NO: 1961769 - RNA, 14 nt, Human
gaaaaucagccugc

SEQ ID NO: 1961770 - RNA, 13 nt, Human
gaaaauauguauu

SEQ ID NO: 1961771 - RNA, 18 nt, Human
gaaaauauguauuaacac

SEQ ID NO: 1961772 - RNA, 19 nt, Human
gaaaauauguauuaacacu

SEQ ID NO: 1961773 - RNA, 18 nt, Human
gaaaaucagccugcucca

SEQ ID NO: 1961774 - RNA, 16 nt, Human
gaaaaucagccugcuc

SEQ ID NO: 1961775 - RNA, 19 nt, Human
gaaaaucuuauaauuuaaa

SEQ ID NO: 1961776 - RNA, 11 nt, Human
gaaaauaauug

SEQ ID NO: 1961777 - RNA, 15 nt, Human
gaaaauaauugacag

SEQ ID NO: 1961778 - RNA, 19 nt, Human
gaaaauaagccaugagaau

SEQ ID NO: 1961779 - RNA, 20 nt, Human
gaaaauaauugacaggcgaa

SEQ ID NO: 1961780 - RNA, 13 nt, Human
gaaaagcugcuga

SEQ ID NO: 1961781 - RNA, 17 nt, Human
gaaaagcugcugacagu

SEQ ID NO: 1961782 - RNA, 19 nt, Human
gaaaauaacgauaaaagac

SEQ ID NO: 1961783 - RNA, 12 nt, Human
gaaacagaggcu

SEQ ID NO: 1961784 - RNA, 21 nt, Human
gaaacagaggaccagcacacu

SEQ ID NO: 1961785 - RNA, 23 nt, Human
gaaacagaggaccagcacacucc

SEQ ID NO: 1961786 - RNA, 22 nt, Human
gaaacagacuuguauauucuau

SEQ ID NO: 1961787 - RNA, 16 nt, Human
gaaacacuuugcauaa

SEQ ID NO: 1961788 - RNA, 15 nt, Human
gaaacagcucgacuu

SEQ ID NO: 1961789 - RNA, 20 nt, Human
gaaacagcucgacuuuaaaa

SEQ ID NO: 1961790 - RNA, 18 nt, Human
gaaacagcuaaugggaca

SEQ ID NO: 1961791 - RNA, 17 nt, Human
gaaaauaugucccagaa

SEQ ID NO: 1961792 - RNA, 15 nt, Human
gaaacacauaauuaa

SEQ ID NO: 1961793 - RNA, 19 nt, Human
gaaacacauaauuaacacu

SEQ ID NO: 1961794 - RNA, 20 nt, Human
gaaacacauaauuaacacuu

SEQ ID NO: 1961795 - RNA, 16 nt, Human
gaaacaccaaaaaaau

SEQ ID NO: 1961796 - RNA, 23 nt, Human
gaaacaccaaaaaaauccagaaa

SEQ ID NO: 1961797 - RNA, 20 nt, Human
gaaaaucuuauaauuuaaaa

SEQ ID NO: 1961798 - RNA, 22 nt, Human
gaaacacugggcuucuagaacc

SEQ ID NO: 1961799 - RNA, 17 nt, Human
gaaacacccacaggcau

SEQ ID NO: 1961800 - RNA, 15 nt, Human
gaaacacuaaauguu

SEQ ID NO: 1961801 - RNA, 16 nt, Human
gaaacacuaaauguua

SEQ ID NO: 1961802 - RNA, 17 nt, Human
gaaacacuaaauguuaa

SEQ ID NO: 1961803 - RNA, 18 nt, Human
gaaacacuaaauguuaaa

SEQ ID NO: 1961804 - RNA, 19 nt, Human
gaaacacuaaauguuaaag

SEQ ID NO: 1961805 - RNA, 23 nt, Human
gaaacacuaaauguuaaagaugu

SEQ ID NO: 1961806 - RNA, 16 nt, Human
cuuuggacccugaggc

SEQ ID NO: 1961807 - RNA, 15 nt, Human
cuuuggacccugagg

SEQ ID NO: 1961808 - RNA, 18 nt, Human
cuuuggacccugaggccc

SEQ ID NO: 1961809 - RNA, 17 nt, Human
cuuuggacccugaggcc

SEQ ID NO: 1961810 - RNA, 19 nt, Human
cuuuggacccugaggccca

SEQ ID NO: 1961811 - RNA, 16 nt, Human
cuuuggcuuaauucca

SEQ ID NO: 1961812 - RNA, 21 nt, Human
cuuuggcuuaauuccaaucau

SEQ ID NO: 1961813 - RNA, 16 nt, Human
cuuucccaucuuccaa

SEQ ID NO: 1961814 - RNA, 19 nt, Human
cuuucccacccagccuggg

SEQ ID NO: 1961815 - RNA, 17 nt, Human
cuuucccacccagccug

SEQ ID NO: 1961816 - RNA, 18 nt, Human
cuuucccacccagccugg

SEQ ID NO: 1961817 - RNA, 12 nt, Human
cuuugcucuggu

SEQ ID NO: 1961818 - RNA, 14 nt, Human
cuuugugauuuuug

SEQ ID NO: 1961819 - RNA, 13 nt, Human
cuuuguccuccug

SEQ ID NO: 1961820 - RNA, 15 nt, Human
cuuuguccuccugcu

SEQ ID NO: 1961821 - RNA, 16 nt, Human
cuuuguccuccugcug

SEQ ID NO: 1961822 - RNA, 17 nt, Human
cuuuguccuccugcugc

SEQ ID NO: 1961823 - RNA, 18 nt, Human
cuuuguccuccugcugcc

SEQ ID NO: 1961824 - RNA, 22 nt, Human
cuuuguccccaccgcagacagg

SEQ ID NO: 1961825 - RNA, 18 nt, Human
cuuuguccccaccgcaga

SEQ ID NO: 1961826 - RNA, 13 nt, Human
cuuugggaggcca

SEQ ID NO: 1961827 - RNA, 17 nt, Human
cuuugugauuuuuguaa

SEQ ID NO: 1961828 - RNA, 18 nt, Human
cuuugugauuuuuguaau

SEQ ID NO: 1961829 - RNA, 19 nt, Human
cuuugugauuuuuguaauu

SEQ ID NO: 1961830 - RNA, 19 nt, Human
cuuugucuaagaaacauug

SEQ ID NO: 1961831 - RNA, 17 nt, Human
cuuugucuaagaaacau

SEQ ID NO: 1961832 - RNA, 18 nt, Human
cuuugucuaagaaacauu

SEQ ID NO: 1961833 - RNA, 21 nt, Human
cuuuguccuccugcugccagu

SEQ ID NO: 1961834 - RNA, 15 nt, Human
cuuuguucuggcucu

SEQ ID NO: 1961835 - RNA, 14 nt, Human
cuuuguucuggcuc

SEQ ID NO: 1961836 - RNA, 20 nt, Human
cuuuuacguccaucucuugu

SEQ ID NO: 1961837 - RNA, 15 nt, Human
cuuuuacccuuuuuc

SEQ ID NO: 1961838 - RNA, 21 nt, Human
cuuuguuuguucuuguuuuua

SEQ ID NO: 1961839 - RNA, 11 nt, Human
cuuuuaauuuu

SEQ ID NO: 1961840 - RNA, 13 nt, Human
cuuuguuuguucu

SEQ ID NO: 1961841 - RNA, 14 nt, Human
cuuuguuuguucuu

SEQ ID NO: 1961842 - RNA, 15 nt, Human
cuuuguuuguucuug

SEQ ID NO: 1961843 - RNA, 20 nt, Human
cuuuguuuguugucagcuga

SEQ ID NO: 1961844 - RNA, 18 nt, Human
cuuuguuuguugucagcu

SEQ ID NO: 1961845 - RNA, 22 nt, Human
cuuuucauaaccuagccuuaga

SEQ ID NO: 1961846 - RNA, 17 nt, Human
cuuuucacugcuggcug

SEQ ID NO: 1961847 - RNA, 18 nt, Human
cuuuucacugcuggcugc

SEQ ID NO: 1961848 - RNA, 20 nt, Human
cuuuucacugcuggcugccu

SEQ ID NO: 1961849 - RNA, 20 nt, Human
cuuuucauaaccuagccuua

SEQ ID NO: 1961850 - RNA, 14 nt, Human
cuuuucauugcugu

SEQ ID NO: 1961851 - RNA, 22 nt, Human
cuuuucccucggaguucuucuu

SEQ ID NO: 1961852 - RNA, 23 nt, Human
cuuuucuugcaugaggcuagugu

SEQ ID NO: 1961853 - RNA, 18 nt, Human
cuuuucuugcaugaggcu

SEQ ID NO: 1961854 - RNA, 16 nt, Human
cuuuucuuucagccaa

SEQ ID NO: 1961855 - RNA, 23 nt, Human
cuuuucuguccgagcuuugaaaa

SEQ ID NO: 1961856 - RNA, 18 nt, Human
cuuuucuguccgagcuuu

SEQ ID NO: 1961857 - RNA, 12 nt, Human
cuuggagggcau

SEQ ID NO: 1961858 - RNA, 23 nt, Human
cuuggagggcaugaagacagaua

SEQ ID NO: 1961859 - RNA, 22 nt, Human
cuuggaggaaggaaacccagcu

SEQ ID NO: 1961860 - RNA, 17 nt, Human
cuuggagguagcuuuga

SEQ ID NO: 1961861 - RNA, 16 nt, Human
cuuggcugcagggagu

SEQ ID NO: 1961862 - RNA, 14 nt, Human
cuuggcugcaggga

SEQ ID NO: 1961863 - RNA, 17 nt, Human
cuuggcugcagggaguc

SEQ ID NO: 1961864 - RNA, 13 nt, Human
cuugggaauuuua

SEQ ID NO: 1961865 - RNA, 15 nt, Human
cuugggacauccugu

SEQ ID NO: 1961866 - RNA, 20 nt, Human
cuuggggacaggggcaggag

SEQ ID NO: 1961867 - RNA, 22 nt, Human
cuugggcuucauccuccucaga

SEQ ID NO: 1961868 - RNA, 21 nt, Human
cuuggggaccagagcugccac

SEQ ID NO: 1961869 - RNA, 20 nt, Human
cuuggggaccagagcugcca

SEQ ID NO: 1961870 - RNA, 14 nt, Human
cuugggccacugug

SEQ ID NO: 1961871 - RNA, 14 nt, Human
cuugggcagaucuc

SEQ ID NO: 1961872 - RNA, 19 nt, Human
cuugggcagaucucccaca

SEQ ID NO: 1961873 - RNA, 23 nt, Human
cuugggcagaucucccacaugcc

SEQ ID NO: 1961874 - RNA, 13 nt, Human
cuugggcuucauc

SEQ ID NO: 1961875 - RNA, 15 nt, Human
cuuggggggcugagg

SEQ ID NO: 1961876 - RNA, 22 nt, Human
cuuggggaccagagcugccacc

SEQ ID NO: 1961877 - RNA, 22 nt, Human
cuuggggacaaccuuggcuugg

SEQ ID NO: 1961878 - RNA, 22 nt, Human
cuuggggggcugaggugggagg

SEQ ID NO: 1961879 - RNA, 16 nt, Human
cuuggggggcugaggu

SEQ ID NO: 1961880 - RNA, 19 nt, Human
cuuguaaaggaauuuaaaa

SEQ ID NO: 1961881 - RNA, 13 nt, Human
cuugcucugcuga

SEQ ID NO: 1961882 - RNA, 14 nt, Human
cuugcucugcugac

SEQ ID NO: 1961883 - RNA, 15 nt, Human
cuugcccacuccugc

SEQ ID NO: 1961884 - RNA, 16 nt, Human
cuugcccacuccugcu

SEQ ID NO: 1961885 - RNA, 22 nt, Human
cuugcccacuccugcucugcuc

SEQ ID NO: 1961886 - RNA, 23 nt, Human
cuugcccacuccugcucugcucg

SEQ ID NO: 1961887 - RNA, 17 nt, Human
cuucuccacccugcucu

SEQ ID NO: 1961888 - RNA, 18 nt, Human
cuucuccacccugcucuc

SEQ ID NO: 1961889 - RNA, 21 nt, Human
cuucuccacccugcucuccga

SEQ ID NO: 1961890 - RNA, 13 nt, Human
cuugccacugccu

SEQ ID NO: 1961891 - RNA, 12 nt, Human
cuugccagcugc

SEQ ID NO: 1961892 - RNA, 16 nt, Human
cuugccagcugcugag

SEQ ID NO: 1961893 - RNA, 18 nt, Human
cuugccagcugcugagcc

SEQ ID NO: 1961894 - RNA, 19 nt, Human
cuugccagcugcugagccg

SEQ ID NO: 1961895 - RNA, 21 nt, Human
cuugccagcugcugagccgca

SEQ ID NO: 1961896 - RNA, 22 nt, Human
cuugccagcugcugagccgcag

SEQ ID NO: 1961897 - RNA, 14 nt, Human
cuugccacugccuc

SEQ ID NO: 1961898 - RNA, 15 nt, Human
cuugccacugccucu

SEQ ID NO: 1961899 - RNA, 20 nt, Human
cuugcuucaaccccaugaga

SEQ ID NO: 1961900 - RNA, 14 nt, Human
cuugcuuaaaugug

SEQ ID NO: 1961901 - RNA, 15 nt, Human
cuugcuuaaauguga

SEQ ID NO: 1961902 - RNA, 16 nt, Human
cuugcuuaaaugugaa

SEQ ID NO: 1961903 - RNA, 22 nt, Human
cuugcuuaaaugugaauuacua

SEQ ID NO: 1961904 - RNA, 13 nt, Human
cuugcuuaaaugu

SEQ ID NO: 1961905 - RNA, 16 nt, Human
cuugcucugcugacag

SEQ ID NO: 1961906 - RNA, 17 nt, Human
cuugcucugcugacaga

SEQ ID NO: 1961907 - RNA, 15 nt, Human
cuugcugugacuuau

SEQ ID NO: 1961908 - RNA, 16 nt, Human
cuuggaaaugggagac

SEQ ID NO: 1961909 - RNA, 20 nt, Human
cuuggaaaucaaauguaaag

SEQ ID NO: 1961910 - RNA, 13 nt, Human
cuuggaggaagga

SEQ ID NO: 1961911 - RNA, 13 nt, Human
cuuggaagcuccg

SEQ ID NO: 1961912 - RNA, 21 nt, Human
cuuggaaaucaaauguaaagu

SEQ ID NO: 1961913 - RNA, 21 nt, Human
cuuguguguuuauugucaaag

SEQ ID NO: 1961914 - RNA, 22 nt, Human
cuuguugguucaccauugagac

SEQ ID NO: 1961915 - RNA, 21 nt, Human
cuuguuguuuguaacaagaaa

SEQ ID NO: 1961916 - RNA, 16 nt, Human
cuuguuuaaugguagu

SEQ ID NO: 1961917 - RNA, 20 nt, Human
cuugggggcucagcaaggcc

SEQ ID NO: 1961918 - RNA, 21 nt, Human
cuugggggcucagcaaggcca

SEQ ID NO: 1961919 - RNA, 15 nt, Human
cuugggggcucagca

SEQ ID NO: 1961920 - RNA, 17 nt, Human
cuugggggcucagcaag

SEQ ID NO: 1961921 - RNA, 22 nt, Human
cuuguggcuccacacacacaaa

SEQ ID NO: 1961922 - RNA, 20 nt, Human
cuuguguguuuauugucaaa

SEQ ID NO: 1961923 - RNA, 18 nt, Human
cuuuagaaacacauaauu

SEQ ID NO: 1961924 - RNA, 15 nt, Human
cuuuagaaaaggcau

SEQ ID NO: 1961925 - RNA, 20 nt, Human
cuuuagaaacacauaauuaa

SEQ ID NO: 1961926 - RNA, 20 nt, Human
cuuuacuugucuuucugggg

SEQ ID NO: 1961927 - RNA, 14 nt, Human
cuuuagaaaaggca

SEQ ID NO: 1961928 - RNA, 14 nt, Human
cuuuaaacugucgu

SEQ ID NO: 1961929 - RNA, 20 nt, Human
cuuuaaacugucgugucaua

SEQ ID NO: 1961930 - RNA, 16 nt, Human
cuuuacuugucuuucu

SEQ ID NO: 1961931 - RNA, 18 nt, Human
cuuuacuugucuuucugg

SEQ ID NO: 1961932 - RNA, 14 nt, Human
cuuguuuucuggga

SEQ ID NO: 1961933 - RNA, 23 nt, Human
cuuguuuugcuuccccucccccc

SEQ ID NO: 1961934 - RNA, 13 nt, Human
cuuguuuugcuuc

SEQ ID NO: 1961935 - RNA, 14 nt, Human
cuuguuuugcuucc

SEQ ID NO: 1961936 - RNA, 15 nt, Human
cuuguuuugcuuccc

SEQ ID NO: 1961937 - RNA, 17 nt, Human
cuuguuuugcuuccccu

SEQ ID NO: 1961938 - RNA, 12 nt, Human
cuuguuuuuaag

SEQ ID NO: 1961939 - RNA, 14 nt, Human
cuuguuuuuaaguu

SEQ ID NO: 1961940 - RNA, 16 nt, Human
cuuguuuuuaaguuug

SEQ ID NO: 1961941 - RNA, 20 nt, Human
cuuguuuuuaaguuugcacu

SEQ ID NO: 1961942 - RNA, 19 nt, Human
cuuguuuuuuuuuuccacu

SEQ ID NO: 1961943 - RNA, 20 nt, Human
cuuguuuuuuuuuuccacuu

SEQ ID NO: 1961944 - RNA, 14 nt, Human
cuuguuuuuguaaa

SEQ ID NO: 1961945 - RNA, 15 nt, Human
cuuguuuuuguaaag

SEQ ID NO: 1961946 - RNA, 16 nt, Human
cuuguuuuuguaaaga

SEQ ID NO: 1961947 - RNA, 20 nt, Human
cuuguuuuuguaaagaaaaa

SEQ ID NO: 1961948 - RNA, 21 nt, Human
cuuguuuuuguaaagaaaaau

SEQ ID NO: 1961949 - RNA, 22 nt, Human
cuuguuuuuguaaagaaaaaua

SEQ ID NO: 1961950 - RNA, 23 nt, Human
cuuguuuuuguaaagaaaaauau

SEQ ID NO: 1961951 - RNA, 17 nt, Human
cuuguuuuuguuuuugu

SEQ ID NO: 1961952 - RNA, 21 nt, Human
cuuguuuuuuuuuuccacuua

SEQ ID NO: 1961953 - RNA, 23 nt, Human
cuuguuuuuguuuuuguuuuguu

SEQ ID NO: 1961954 - RNA, 15 nt, Human
cuuguuguuuaaugu

SEQ ID NO: 1961955 - RNA, 19 nt, Human
cuuuaguuauaaaggaauc

SEQ ID NO: 1961956 - RNA, 12 nt, Human
cuuuauuauuua

SEQ ID NO: 1961957 - RNA, 13 nt, Human
cuuuauuauuuau

SEQ ID NO: 1961958 - RNA, 14 nt, Human
cuuuauuauuuauu

SEQ ID NO: 1961959 - RNA, 20 nt, Human
cuuuauucuggcagaggagg

SEQ ID NO: 1961960 - RNA, 19 nt, Human
cuuuauugccaaaacccag

SEQ ID NO: 1961961 - RNA, 21 nt, Human
cuuuauugccaaaacccagcu

SEQ ID NO: 1961962 - RNA, 22 nt, Human
cuuuauugccaaaacccagcug

SEQ ID NO: 1961963 - RNA, 23 nt, Human
cuuuauugccaaaacccagcugc

SEQ ID NO: 1961964 - RNA, 21 nt, Human
cuuuauuuucuauaauuuaaa

SEQ ID NO: 1961965 - RNA, 20 nt, Human
cuuuauuuguacuuuuuccu

SEQ ID NO: 1961966 - RNA, 23 nt, Human
cuuuauuuguguucuuuuuuccc

SEQ ID NO: 1961967 - RNA, 17 nt, Human
cuuuccaauucuccuuu

SEQ ID NO: 1961968 - RNA, 18 nt, Human
cuuuccaauucuccuuua

SEQ ID NO: 1961969 - RNA, 15 nt, Human
cuuuccaauucuccu

SEQ ID NO: 1961970 - RNA, 16 nt, Human
cuuuccaauucuccuu

SEQ ID NO: 1961971 - RNA, 22 nt, Human
cuuuccaaaugcccagcuuaaa

SEQ ID NO: 1961972 - RNA, 19 nt, Human
cuuuccaaaugcccagcuu

SEQ ID NO: 1961973 - RNA, 18 nt, Human
cuuuccaaaugcccagcu

SEQ ID NO: 1961974 - RNA, 21 nt, Human
cuuucauuuugcuuuaauuuu

SEQ ID NO: 1961975 - RNA, 20 nt, Human
cuuuccaaagccaaugugaa

SEQ ID NO: 1961976 - RNA, 14 nt, Human
cuuucauuugcuuu

SEQ ID NO: 1961977 - RNA, 18 nt, Human
cuuucauuugcuuuggaa

SEQ ID NO: 1961978 - RNA, 14 nt, Human
cuuucauuuugcuu

SEQ ID NO: 1961979 - RNA, 15 nt, Human
cuuucauuuugcuuu

SEQ ID NO: 1961980 - RNA, 16 nt, Human
cuuucauuuugcuuua

SEQ ID NO: 1961981 - RNA, 17 nt, Human
cuuucauuuugcuuuaa

SEQ ID NO: 1961982 - RNA, 19 nt, Human
cuuucauuuugcuuuaauu

SEQ ID NO: 1961983 - RNA, 16 nt, Human
cuuucauauuuuaaac

SEQ ID NO: 1961984 - RNA, 19 nt, Human
cuuucauauuuuaaacaga

SEQ ID NO: 1961985 - RNA, 23 nt, Human
cuuucauauuuuaaacagaggau

SEQ ID NO: 1961986 - RNA, 14 nt, Human
cuuucauuugcuau

SEQ ID NO: 1961987 - RNA, 14 nt, Human
cuguugaccaggca

SEQ ID NO: 1961988 - RNA, 15 nt, Human
cuguugaccaggcac

SEQ ID NO: 1961989 - RNA, 17 nt, Human
cuguugaccaggcaccu

SEQ ID NO: 1961990 - RNA, 11 nt, Human
cuguugacucu

SEQ ID NO: 1961991 - RNA, 19 nt, Human
cuguugacucuaguacugu

SEQ ID NO: 1961992 - RNA, 22 nt, Human
cuguugacucuaguacugugaa

SEQ ID NO: 1961993 - RNA, 23 nt, Human
cuguugaugggaugauugaagaa

SEQ ID NO: 1961994 - RNA, 23 nt, Human
cuguucuuucuggcuaugcauuu

SEQ ID NO: 1961995 - RNA, 12 nt, Human
cuguucuuccug

SEQ ID NO: 1961996 - RNA, 13 nt, Human
cuguucuuccugg

SEQ ID NO: 1961997 - RNA, 12 nt, Human
cuguugcccagg

SEQ ID NO: 1961998 - RNA, 13 nt, Human
cuguugcccaggc

SEQ ID NO: 1961999 - RNA, 14 nt, Human
cuguugcccaggcu

SEQ ID NO: 1962000 - RNA, 15 nt, Human
cuguugcccaggcug

SEQ ID NO: 1962001 - RNA, 16 nt, Human
cuguugcccaggcugg

SEQ ID NO: 1962002 - RNA, 15 nt, Human
cuguucuuuccaaag

SEQ ID NO: 1962003 - RNA, 16 nt, Human
cuguucuuuccaaagu

SEQ ID NO: 1962004 - RNA, 19 nt, Human
cuguucuuuccaaaguaca

SEQ ID NO: 1962005 - RNA, 21 nt, Human
cuguucuuuccaaaguacacu

SEQ ID NO: 1962006 - RNA, 13 nt, Human
cuguucuuucugg

SEQ ID NO: 1962007 - RNA, 14 nt, Human
cuguucuuucuggc

SEQ ID NO: 1962008 - RNA, 21 nt, Human
cuguucuuucuggcuaugcau

SEQ ID NO: 1962009 - RNA, 16 nt, Human
cuguuaauaguucagg

SEQ ID NO: 1962010 - RNA, 21 nt, Human
cuguuaaggcauccacuucac

SEQ ID NO: 1962011 - RNA, 11 nt, Human
cuguuacaaaa

SEQ ID NO: 1962012 - RNA, 13 nt, Human
cuguuacaaaaug

SEQ ID NO: 1962013 - RNA, 15 nt, Human
cuguuacaaaaugua

SEQ ID NO: 1962014 - RNA, 16 nt, Human
cuguuuuuaaaaauua

SEQ ID NO: 1962015 - RNA, 14 nt, Human
cuguuuuuaaaaau

SEQ ID NO: 1962016 - RNA, 17 nt, Human
cuuaaaaaguggaaaaa

SEQ ID NO: 1962017 - RNA, 16 nt, Human
cuuaaaaaguggaaaa

SEQ ID NO: 1962018 - RNA, 12 nt, Human
cuuaaaaacuca

SEQ ID NO: 1962019 - RNA, 22 nt, Human
cuguuuuacaaaaaagaaaaga

SEQ ID NO: 1962020 - RNA, 21 nt, Human
cuguuugguuuuaaaauacug

SEQ ID NO: 1962021 - RNA, 21 nt, Human
cuguuugggaagagcuuagaa

SEQ ID NO: 1962022 - RNA, 20 nt, Human
cuguuugggaagagcuuaga

SEQ ID NO: 1962023 - RNA, 22 nt, Human
cuguuugggaagagcuuagaaa

SEQ ID NO: 1962024 - RNA, 17 nt, Human
cuguuugguuuuaaaau

SEQ ID NO: 1962025 - RNA, 14 nt, Human
cuguuuagauaaua

SEQ ID NO: 1962026 - RNA, 17 nt, Human
cuguuuagauaauacac

SEQ ID NO: 1962027 - RNA, 18 nt, Human
cuguugcccaggcuggcg

SEQ ID NO: 1962028 - RNA, 17 nt, Human
cuguugcccaggcuggc

SEQ ID NO: 1962029 - RNA, 15 nt, Human
cuguuucaaacuuua

SEQ ID NO: 1962030 - RNA, 17 nt, Human
cuguuucaaacuuuacu

SEQ ID NO: 1962031 - RNA, 19 nt, Human
cuguuuagauuugccauag

SEQ ID NO: 1962032 - RNA, 21 nt, Human
cuguuuagauuugccauagag

SEQ ID NO: 1962033 - RNA, 22 nt, Human
cuguuuagauuugccauagagu

SEQ ID NO: 1962034 - RNA, 18 nt, Human
cuguuuagauaauacacc

SEQ ID NO: 1962035 - RNA, 19 nt, Human
cuguuugcuaagugaggau

SEQ ID NO: 1962036 - RNA, 17 nt, Human
cuguuugcuaagugagg

SEQ ID NO: 1962037 - RNA, 22 nt, Human
cuguuugcuguugcugauuuua

SEQ ID NO: 1962038 - RNA, 15 nt, Human
cuguuugcuguugcu

SEQ ID NO: 1962039 - RNA, 16 nt, Human
cuguuucagaggcuca

SEQ ID NO: 1962040 - RNA, 21 nt, Human
cuguuucaaguucacaccugc

SEQ ID NO: 1962041 - RNA, 21 nt, Human
cuuaauaaucaagagccuuaa

SEQ ID NO: 1962042 - RNA, 17 nt, Human
cuuaauacuguuauucu

SEQ ID NO: 1962043 - RNA, 19 nt, Human
cuuaauacuguuauucuuu

SEQ ID NO: 1962044 - RNA, 21 nt, Human
cuuaauacuguuauucuuugc

SEQ ID NO: 1962045 - RNA, 13 nt, Human
cuuaauaaucaag

SEQ ID NO: 1962046 - RNA, 14 nt, Human
cuuaauaaucaaga

SEQ ID NO: 1962047 - RNA, 15 nt, Human
cuuaauaaucaagag

SEQ ID NO: 1962048 - RNA, 20 nt, Human
cuuaauaaucaagagccuua

SEQ ID NO: 1962049 - RNA, 22 nt, Human
cuuaagcugcaggauucucacc

SEQ ID NO: 1962050 - RNA, 12 nt, Human
cuuaagcugcag

SEQ ID NO: 1962051 - RNA, 13 nt, Human
cuuaagcugcagg

SEQ ID NO: 1962052 - RNA, 14 nt, Human
cuuaagcugcagga

SEQ ID NO: 1962053 - RNA, 15 nt, Human
cuuaagcugcaggau

SEQ ID NO: 1962054 - RNA, 11 nt, Human
cuuaaaaagua

SEQ ID NO: 1962055 - RNA, 14 nt, Human
cuuaaaaaguaacu

SEQ ID NO: 1962056 - RNA, 15 nt, Human
cuuaacauagccaaa

SEQ ID NO: 1962057 - RNA, 19 nt, Human
cuuaacauagccaaaaugu

SEQ ID NO: 1962058 - RNA, 20 nt, Human
cuuaacauagccaaaaugug

SEQ ID NO: 1962059 - RNA, 17 nt, Human
cuuaaccagaucauugu

SEQ ID NO: 1962060 - RNA, 12 nt, Human
cuuaaccaucuu

SEQ ID NO: 1962061 - RNA, 18 nt, Human
cuuaagaauuuugagcag

SEQ ID NO: 1962062 - RNA, 19 nt, Human
cuuaagaaugaguuucuua

SEQ ID NO: 1962063 - RNA, 22 nt, Human
cuuaagaaugaguuucuuagac

SEQ ID NO: 1962064 - RNA, 20 nt, Human
cuuaauucuuagcucauucu

SEQ ID NO: 1962065 - RNA, 16 nt, Human
cuuaauuauugauguu

SEQ ID NO: 1962066 - RNA, 10 nt, Human
cuuaauuauu

SEQ ID NO: 1962067 - RNA, 20 nt, Human
cuuaauauauagcauuuaug

SEQ ID NO: 1962068 - RNA, 19 nt, Human
cuuaauauauagcauuuau

SEQ ID NO: 1962069 - RNA, 19 nt, Human
cuuagaauuaguggcacuu

SEQ ID NO: 1962070 - RNA, 19 nt, Human
cuuagaaucccuguguuaa

SEQ ID NO: 1962071 - RNA, 20 nt, Human
cuuagaaucccuguguuaau

SEQ ID NO: 1962072 - RNA, 16 nt, Human
cuuagaauuauuugca

SEQ ID NO: 1962073 - RNA, 18 nt, Human
cuuagaauuauuugcacu

SEQ ID NO: 1962074 - RNA, 15 nt, Human
cuuagaaucccugug

SEQ ID NO: 1962075 - RNA, 18 nt, Human
cuuagaaucccuguguua

SEQ ID NO: 1962076 - RNA, 18 nt, Human
cuuagaaguuuguuguga

SEQ ID NO: 1962077 - RNA, 21 nt, Human
cuuagacuuuuccaauaugug

SEQ ID NO: 1962078 - RNA, 22 nt, Human
cuuagacuuuuccaauauguga

SEQ ID NO: 1962079 - RNA, 21 nt, Human
cuuagguuggcaaaaaggcag

SEQ ID NO: 1962080 - RNA, 23 nt, Human
cuuagguuggcaaaaaggcagga

SEQ ID NO: 1962081 - RNA, 14 nt, Human
cuuagagcuuuuuu

SEQ ID NO: 1962082 - RNA, 21 nt, Human
cuuagaggcaugggcuugcug

SEQ ID NO: 1962083 - RNA, 23 nt, Human
cuuaguaagcggcucaagcccag

SEQ ID NO: 1962084 - RNA, 20 nt, Human
cuuagaaaaaccaccaccau

SEQ ID NO: 1962085 - RNA, 13 nt, Human
cuuacuguacaug

SEQ ID NO: 1962086 - RNA, 22 nt, Human
cuuagaaaacaauggaaugaga

SEQ ID NO: 1962087 - RNA, 21 nt, Human
cuuagaaaaggugauaaaauc

SEQ ID NO: 1962088 - RNA, 22 nt, Human
cuuagaaaaggugauaaaauca

SEQ ID NO: 1962089 - RNA, 23 nt, Human
cuuagaaaaggugauaaaaucau

SEQ ID NO: 1962090 - RNA, 16 nt, Human
cuuagaaauugcauuu

SEQ ID NO: 1962091 - RNA, 17 nt, Human
cuuagaagucacacagu

SEQ ID NO: 1962092 - RNA, 20 nt, Human
cuuagaagucacacaguauu

SEQ ID NO: 1962093 - RNA, 20 nt, Human
cuuaccugccaggaagccag

SEQ ID NO: 1962094 - RNA, 19 nt, Human
cuuaccuugaacugaaggc

SEQ ID NO: 1962095 - RNA, 18 nt, Human
cuuaccuugguuggaagg

SEQ ID NO: 1962096 - RNA, 15 nt, Human
cuuacugauuaacuc

SEQ ID NO: 1962097 - RNA, 20 nt, Human
cuucaaggauccugagccag

SEQ ID NO: 1962098 - RNA, 19 nt, Human
cuucaaggauccugagcca

SEQ ID NO: 1962099 - RNA, 18 nt, Human
cuucaaggauccugagcc

SEQ ID NO: 1962100 - RNA, 17 nt, Human
cuucaaggauccugagc

SEQ ID NO: 1962101 - RNA, 20 nt, Human
cuucaacugaccagccucca

SEQ ID NO: 1962102 - RNA, 23 nt, Human
cuucaacugaccagccuccaugc

SEQ ID NO: 1962103 - RNA, 17 nt, Human
cuucaacugaccagccu

SEQ ID NO: 1962104 - RNA, 16 nt, Human
cuucaacucccugccc

SEQ ID NO: 1962105 - RNA, 22 nt, Human
cuucaacaaggcuugcugcaga

SEQ ID NO: 1962106 - RNA, 22 nt, Human
cuuagucacugagacagcccgg

SEQ ID NO: 1962107 - RNA, 17 nt, Human
cuuagucaaauguaaug

SEQ ID NO: 1962108 - RNA, 20 nt, Human
cuuagucacugagacagccc

SEQ ID NO: 1962109 - RNA, 21 nt, Human
cuuagucacugagacagcccg

SEQ ID NO: 1962110 - RNA, 15 nt, Human
cuucaaauauuuccc

SEQ ID NO: 1962111 - RNA, 12 nt, Human
cuucaacaaggc

SEQ ID NO: 1962112 - RNA, 19 nt, Human
cuucaacaaggcuugcugc

SEQ ID NO: 1962113 - RNA, 21 nt, Human
cuucaacaaggcuugcugcag

SEQ ID NO: 1962114 - RNA, 23 nt, Human
cuucaaggauccugagccagauu

SEQ ID NO: 1962115 - RNA, 22 nt, Human
cuucaaggauccugagccagau

SEQ ID NO: 1962116 - RNA, 21 nt, Human
cuucaaggauccugagccaga

SEQ ID NO: 1962117 - RNA, 14 nt, Human
cuucacauauugau

SEQ ID NO: 1962118 - RNA, 23 nt, Human
cuucacauauugauuuccguuaa

SEQ ID NO: 1962119 - RNA, 19 nt, Human
cuucagcugacuuuucugu

SEQ ID NO: 1962120 - RNA, 15 nt, Human
cuucagcugacuuuu

SEQ ID NO: 1962121 - RNA, 14 nt, Human
cuucaguaagccgu

SEQ ID NO: 1962122 - RNA, 21 nt, Human
cuucaggaaagcagcaguuuu

SEQ ID NO: 1962123 - RNA, 16 nt, Human
cuucagccucccgagu

SEQ ID NO: 1962124 - RNA, 20 nt, Human
cuucagccucccgaguagcu

SEQ ID NO: 1962125 - RNA, 15 nt, Human
cuucagccugaaaga

SEQ ID NO: 1962126 - RNA, 15 nt, Human
cuucagccucccaca

SEQ ID NO: 1962127 - RNA, 17 nt, Human
cuucagccucccacagu

SEQ ID NO: 1962128 - RNA, 14 nt, Human
cuucagccucccga

SEQ ID NO: 1962129 - RNA, 13 nt, Human
cuucagccuccca

SEQ ID NO: 1962130 - RNA, 14 nt, Human
cuucagccucccac

SEQ ID NO: 1962131 - RNA, 15 nt, Human
cuuccacaagagccc

SEQ ID NO: 1962132 - RNA, 14 nt, Human
cuuccacaagagcc

SEQ ID NO: 1962133 - RNA, 13 nt, Human
cuuccacaagagc

SEQ ID NO: 1962134 - RNA, 12 nt, Human
cuuccaaagcag

SEQ ID NO: 1962135 - RNA, 20 nt, Human
cuucauguucccacuucaaa

SEQ ID NO: 1962136 - RNA, 15 nt, Human
cuucauguucccacu

SEQ ID NO: 1962137 - RNA, 14 nt, Human
cuucagugccaaaa

SEQ ID NO: 1962138 - RNA, 15 nt, Human
cuucaguaagccgug

SEQ ID NO: 1962139 - RNA, 15 nt, Human
cuuccugugugucca

SEQ ID NO: 1962140 - RNA, 23 nt, Human
cuuccuguguguccaaaacugcc

SEQ ID NO: 1962141 - RNA, 17 nt, Human
cuucgcuccugugucuu

SEQ ID NO: 1962142 - RNA, 15 nt, Human
cuucgccaccugggu

SEQ ID NO: 1962143 - RNA, 22 nt, Human
cuucgccaagguuguagcaugg

SEQ ID NO: 1962144 - RNA, 14 nt, Human
cuucgccaccuggg

SEQ ID NO: 1962145 - RNA, 21 nt, Human
cuucgauacaccgggccugga

SEQ ID NO: 1962146 - RNA, 16 nt, Human
cuucgauacaccgggc

SEQ ID NO: 1962147 - RNA, 13 nt, Human
cuuccuuucuuga

SEQ ID NO: 1962148 - RNA, 16 nt, Human
cuucgggcugugcccg

SEQ ID NO: 1962149 - RNA, 16 nt, Human
cuucgguacccaccac

SEQ ID NO: 1962150 - RNA, 19 nt, Human
cuucgguacccaccacaca

SEQ ID NO: 1962151 - RNA, 19 nt, Human
cuucgugacaauguuuaca

SEQ ID NO: 1962152 - RNA, 20 nt, Human
cuucggccuccauccugagg

SEQ ID NO: 1962153 - RNA, 19 nt, Human
cuucgggaggucgaggcag

SEQ ID NO: 1962154 - RNA, 16 nt, Human
cuucggaggaccaggg

SEQ ID NO: 1962155 - RNA, 17 nt, Human
cuucggaggaccagggc

SEQ ID NO: 1962156 - RNA, 14 nt, Human
cuucucauuacuug

SEQ ID NO: 1962157 - RNA, 22 nt, Human
cuucucauuacuuguugccuau

SEQ ID NO: 1962158 - RNA, 17 nt, Human
cuucucaucuugacaga

SEQ ID NO: 1962159 - RNA, 20 nt, Human
cuucucaucuugacagagcc

SEQ ID NO: 1962160 - RNA, 23 nt, Human
cuucucaucuugacagagccugc

SEQ ID NO: 1962161 - RNA, 21 nt, Human
cuucucacugccaugccagcu

SEQ ID NO: 1962162 - RNA, 16 nt, Human
cuucucacugccaugc

SEQ ID NO: 1962163 - RNA, 11 nt, Human
cuuccccauac

SEQ ID NO: 1962164 - RNA, 16 nt, Human
cuuccccauacaaaua

SEQ ID NO: 1962165 - RNA, 12 nt, Human
cuucccccucca

SEQ ID NO: 1962166 - RNA, 15 nt, Human
cuucccccuccaauc

SEQ ID NO: 1962167 - RNA, 12 nt, Human
cuucccauucca

SEQ ID NO: 1962168 - RNA, 16 nt, Human
cuucccauuccauggc

SEQ ID NO: 1962169 - RNA, 12 nt, Human
cuuccagauccu

SEQ ID NO: 1962170 - RNA, 16 nt, Human
cuuccugugacuucag

SEQ ID NO: 1962171 - RNA, 13 nt, Human
cuuccugugacuu

SEQ ID NO: 1962172 - RNA, 14 nt, Human
cuuccucagagggc

SEQ ID NO: 1962173 - RNA, 19 nt, Human
cuuccugcuuccucagagg

SEQ ID NO: 1962174 - RNA, 18 nt, Human
cuuccugcuuccucagag

SEQ ID NO: 1962175 - RNA, 18 nt, Human
cuuccuauaauuuugaua

SEQ ID NO: 1962176 - RNA, 20 nt, Human
cuuccuauaauuuugauagu

SEQ ID NO: 1962177 - RNA, 14 nt, Human
cuuccuauuucaga

SEQ ID NO: 1962178 - RNA, 21 nt, Human
cuuccuauaauuuugauagug

SEQ ID NO: 1962179 - RNA, 16 nt, Human
cuuccuauuucagaag

SEQ ID NO: 1962180 - RNA, 22 nt, Human
cuucccuggguuagacugccag

SEQ ID NO: 1962181 - RNA, 23 nt, Human
cuucccuggguuagacugccagc

SEQ ID NO: 1962182 - RNA, 18 nt, Human
cuucccugguaagaaaaa

SEQ ID NO: 1962183 - RNA, 12 nt, Human
cuucccugguuc

SEQ ID NO: 1962184 - RNA, 13 nt, Human
cuucccugguuca

SEQ ID NO: 1962185 - RNA, 17 nt, Human
cuuccuaguucaucccu

SEQ ID NO: 1962186 - RNA, 24 nt, Human
cuuccuaguucaucccuucucuuc

SEQ ID NO: 1962187 - RNA, 23 nt, Human
cuucccugaacuuccugcuuccu

SEQ ID NO: 1962188 - RNA, 17 nt, Human
cugucugugaagagcaa

SEQ ID NO: 1962189 - RNA, 19 nt, Human
cugucugucccaguuaacu

SEQ ID NO: 1962190 - RNA, 16 nt, Human
cugucugucuggucca

SEQ ID NO: 1962191 - RNA, 12 nt, Human
cugucugcucca

SEQ ID NO: 1962192 - RNA, 14 nt, Human
cugucugcuccagc

SEQ ID NO: 1962193 - RNA, 19 nt, Human
cugucugcuggucacuucu

SEQ ID NO: 1962194 - RNA, 17 nt, Human
cugucugcuccagcucu

SEQ ID NO: 1962195 - RNA, 19 nt, Human
cugucugcuccagcucugg

SEQ ID NO: 1962196 - RNA, 13 nt, Human
cugucuggcacag

SEQ ID NO: 1962197 - RNA, 15 nt, Human
cugucuggcacagcc

SEQ ID NO: 1962198 - RNA, 18 nt, Human
cugucuggcacagccugc

SEQ ID NO: 1962199 - RNA, 23 nt, Human
cugucauuugagcagggcucagc

SEQ ID NO: 1962200 - RNA, 18 nt, Human
cugucugagguugggaga

SEQ ID NO: 1962201 - RNA, 18 nt, Human
cugucaauuacaggaagu

SEQ ID NO: 1962202 - RNA, 21 nt, Human
cugucauuugagcagggcuca

SEQ ID NO: 1962203 - RNA, 22 nt, Human
cugucauuugagcagggcucag

SEQ ID NO: 1962204 - RNA, 11 nt, Human
cugucuuucca

SEQ ID NO: 1962205 - RNA, 13 nt, Human
cugucuuuccacu

SEQ ID NO: 1962206 - RNA, 15 nt, Human
cugucuuuccacucu

SEQ ID NO: 1962207 - RNA, 16 nt, Human
cugucuuuccacucug

SEQ ID NO: 1962208 - RNA, 17 nt, Human
cugucuuuccacucugg

SEQ ID NO: 1962209 - RNA, 18 nt, Human
cugucuuuccacucugga

SEQ ID NO: 1962210 - RNA, 19 nt, Human
cugucuuuccacucuggau

SEQ ID NO: 1962211 - RNA, 23 nt, Human
cugucuucugcuuuguugugugc

SEQ ID NO: 1962212 - RNA, 16 nt, Human
cugucuucugcuuugu

SEQ ID NO: 1962213 - RNA, 18 nt, Human
cugucuucugcuuuguug

SEQ ID NO: 1962214 - RNA, 14 nt, Human
cugucuuucuugcu

SEQ ID NO: 1962215 - RNA, 15 nt, Human
cugucuuucuugcuc

SEQ ID NO: 1962216 - RNA, 17 nt, Human
cugucuuucuugcuccc

SEQ ID NO: 1962217 - RNA, 18 nt, Human
cugucuuucuugcucccu

SEQ ID NO: 1962218 - RNA, 20 nt, Human
cugucuuucuugcucccuga

SEQ ID NO: 1962219 - RNA, 22 nt, Human
cugucuuucuugcucccugacu

SEQ ID NO: 1962220 - RNA, 23 nt, Human
cugucuuucuugcucccugacug

SEQ ID NO: 1962221 - RNA, 15 nt, Human
cugugaaaggaaaga

SEQ ID NO: 1962222 - RNA, 21 nt, Human
cugucuuuuuucuaaaguaaa

SEQ ID NO: 1962223 - RNA, 18 nt, Human
cugucuucaguaagccgu

SEQ ID NO: 1962224 - RNA, 14 nt, Human
cugucuuaauuuuc

SEQ ID NO: 1962225 - RNA, 18 nt, Human
cugucuguuguauucauu

SEQ ID NO: 1962226 - RNA, 19 nt, Human
cugucuguuguauucauug

SEQ ID NO: 1962227 - RNA, 20 nt, Human
cugucuucauccccucagaa

SEQ ID NO: 1962228 - RNA, 13 nt, Human
cugucuucugcuu

SEQ ID NO: 1962229 - RNA, 14 nt, Human
cugucuucugcuuu

SEQ ID NO: 1962230 - RNA, 15 nt, Human
cugucuucugcuuug

SEQ ID NO: 1962231 - RNA, 23 nt, Human
cugugcagaagggagcuggcucc

SEQ ID NO: 1962232 - RNA, 14 nt, Human
cugugccaugugcc

SEQ ID NO: 1962233 - RNA, 14 nt, Human
cugugccagcccag

SEQ ID NO: 1962234 - RNA, 16 nt, Human
cugugccagcccagag

SEQ ID NO: 1962235 - RNA, 14 nt, Human
cugugccaggugaa

SEQ ID NO: 1962236 - RNA, 19 nt, Human
cugugcccuaaaguguauu

SEQ ID NO: 1962237 - RNA, 18 nt, Human
cugugccccuggccuugg

SEQ ID NO: 1962238 - RNA, 22 nt, Human
cugugccccuggccuugggauc

SEQ ID NO: 1962239 - RNA, 15 nt, Human
cugugccccuggccu

SEQ ID NO: 1962240 - RNA, 17 nt, Human
cugugcccacccuccac

SEQ ID NO: 1962241 - RNA, 23 nt, Human
cugugcccacccuccacucuccu

SEQ ID NO: 1962242 - RNA, 19 nt, Human
cugugcccagaauacugau

SEQ ID NO: 1962243 - RNA, 22 nt, Human
cugugccauuuuguauuuuacu

SEQ ID NO: 1962244 - RNA, 15 nt, Human
cugugccaugugcca

SEQ ID NO: 1962245 - RNA, 17 nt, Human
cugucuuuucuuugcca

SEQ ID NO: 1962246 - RNA, 21 nt, Human
cugucuuuucuuugccaucuc

SEQ ID NO: 1962247 - RNA, 19 nt, Human
cugugaaaaaaaaaaugcu

SEQ ID NO: 1962248 - RNA, 22 nt, Human
cugugaaaggaaagagggaggu

SEQ ID NO: 1962249 - RNA, 16 nt, Human
cugugaaaggaaagag

SEQ ID NO: 1962250 - RNA, 13 nt, Human
cugugagcugcac

SEQ ID NO: 1962251 - RNA, 21 nt, Human
cugugauggggcccugccucc

SEQ ID NO: 1962252 - RNA, 16 nt, Human
cugugauggggcccug

SEQ ID NO: 1962253 - RNA, 23 nt, Human
cugugauggggcccugccuccuu

SEQ ID NO: 1962254 - RNA, 15 nt, Human
cugugauggggcccu

SEQ ID NO: 1962255 - RNA, 15 nt, Human
cuguguguccaaaac

SEQ ID NO: 1962256 - RNA, 19 nt, Human
cuguguguccaaaacugcc

SEQ ID NO: 1962257 - RNA, 21 nt, Human
cuguguguccaaaacugccuc

SEQ ID NO: 1962258 - RNA, 22 nt, Human
cuguguguccaaaacugccuca

SEQ ID NO: 1962259 - RNA, 14 nt, Human
cugugugcucagga

SEQ ID NO: 1962260 - RNA, 20 nt, Human
cugugucuuuuuucacuaca

SEQ ID NO: 1962261 - RNA, 17 nt, Human
cugugguuggcugggaa

SEQ ID NO: 1962262 - RNA, 18 nt, Human
cugugguuggcugggaaa

SEQ ID NO: 1962263 - RNA, 19 nt, Human
cugugguuggcugggaaau

SEQ ID NO: 1962264 - RNA, 20 nt, Human
cugugguuugggggagaaga

SEQ ID NO: 1962265 - RNA, 21 nt, Human
cuguguguguguauguggggg

SEQ ID NO: 1962266 - RNA, 15 nt, Human
cuguguuaauuuaag

SEQ ID NO: 1962267 - RNA, 16 nt, Human
cuguguuaauuuaagu

SEQ ID NO: 1962268 - RNA, 21 nt, Human
cuguguuaauuuaaguuuuga

SEQ ID NO: 1962269 - RNA, 21 nt, Human
cuguguuauuauagagcagaa

SEQ ID NO: 1962270 - RNA, 22 nt, Human
cuguguuauuauagagcagaaa

SEQ ID NO: 1962271 - RNA, 23 nt, Human
cuguguuauuauagagcagaaau

SEQ ID NO: 1962272 - RNA, 18 nt, Human
cuguguguguguaugugg

SEQ ID NO: 1962273 - RNA, 20 nt, Human
cuguguguguguaugugggg

SEQ ID NO: 1962274 - RNA, 18 nt, Human
cuguguguuuaugugugu

SEQ ID NO: 1962275 - RNA, 20 nt, Human
cuguguguuuaugugugugu

SEQ ID NO: 1962276 - RNA, 15 nt, Human
cuguguguguguaug

SEQ ID NO: 1962277 - RNA, 16 nt, Human
cuguguguguguaugu

SEQ ID NO: 1962278 - RNA, 14 nt, Human
cuguguguguguau

SEQ ID NO: 1962279 - RNA, 18 nt, Human
cugugugugcgccuacag

SEQ ID NO: 1962280 - RNA, 24 nt, Human
cuguggaucaaauccagccugcug

SEQ ID NO: 1962281 - RNA, 14 nt, Human
cuguggaucaaauc

SEQ ID NO: 1962282 - RNA, 23 nt, Human
cuguggagacugcuccugagccc

SEQ ID NO: 1962283 - RNA, 12 nt, Human
cugugccucugc

SEQ ID NO: 1962284 - RNA, 13 nt, Human
cugugccucugcc

SEQ ID NO: 1962285 - RNA, 14 nt, Human
cugugccucugccu

SEQ ID NO: 1962286 - RNA, 15 nt, Human
cugugccucugccug

SEQ ID NO: 1962287 - RNA, 16 nt, Human
cugugccucugccugu

SEQ ID NO: 1962288 - RNA, 17 nt, Human
cugugccucugccuguc

SEQ ID NO: 1962289 - RNA, 14 nt, Human
cuguggagacugcu

SEQ ID NO: 1962290 - RNA, 17 nt, Human
cuguggagacugcuccu

SEQ ID NO: 1962291 - RNA, 19 nt, Human
cuguggagacugcuccuga

SEQ ID NO: 1962292 - RNA, 21 nt, Human
cuguggagacugcuccugagc

SEQ ID NO: 1962293 - RNA, 22 nt, Human
cuguggagacugcuccugagcc

SEQ ID NO: 1962294 - RNA, 22 nt, Human
cuguggguuucuaaagcugcca

SEQ ID NO: 1962295 - RNA, 19 nt, Human
cuguggucggugccagagg

SEQ ID NO: 1962296 - RNA, 21 nt, Human
cuguggguuucuaaagcugcc

SEQ ID NO: 1962297 - RNA, 17 nt, Human
cugugggcacaggucag

SEQ ID NO: 1962298 - RNA, 18 nt, Human
cugugggcaaaagagugu

SEQ ID NO: 1962299 - RNA, 21 nt, Human
cugugggcacaggucaggcua

SEQ ID NO: 1962300 - RNA, 19 nt, Human
cuguggccucccugcucua

SEQ ID NO: 1962301 - RNA, 14 nt, Human
cuguggccugccag

SEQ ID NO: 1962302 - RNA, 16 nt, Human
cuguggccugccaguc

SEQ ID NO: 1962303 - RNA, 20 nt, Human
cugggcuuuuguuuugcuuu

SEQ ID NO: 1962304 - RNA, 21 nt, Human
cugggcuuuuguuuugcuuuu

SEQ ID NO: 1962305 - RNA, 16 nt, Human
cugggggccucuucug

SEQ ID NO: 1962306 - RNA, 14 nt, Human
cugggggcugggca

SEQ ID NO: 1962307 - RNA, 18 nt, Human
cugggggcugggcagagg

SEQ ID NO: 1962308 - RNA, 18 nt, Human
cugggcuugucuguagau

SEQ ID NO: 1962309 - RNA, 22 nt, Human
cugggcuuggggaccagagcug

SEQ ID NO: 1962310 - RNA, 15 nt, Human
cugggcuucaguggc

SEQ ID NO: 1962311 - RNA, 13 nt, Human
cugggcugggcac

SEQ ID NO: 1962312 - RNA, 22 nt, Human
cugggcugggcacugcucucac

SEQ ID NO: 1962313 - RNA, 12 nt, Human
cugggcugggca

SEQ ID NO: 1962314 - RNA, 17 nt, Human
cugguaagaaaaagcaa

SEQ ID NO: 1962315 - RNA, 18 nt, Human
cugguaagaaaaagcaaa

SEQ ID NO: 1962316 - RNA, 23 nt, Human
cugguaagaaaaagcaaaaggca

SEQ ID NO: 1962317 - RNA, 19 nt, Human
cugguaucuaauucuuuaa

SEQ ID NO: 1962318 - RNA, 16 nt, Human
cugggucgcccuggac

SEQ ID NO: 1962319 - RNA, 15 nt, Human
cugggucgcccugga

SEQ ID NO: 1962320 - RNA, 13 nt, Human
cugguaaaaugaa

SEQ ID NO: 1962321 - RNA, 15 nt, Human
cugguaaaaugaaga

SEQ ID NO: 1962322 - RNA, 20 nt, Human
cuggguuuucuuaaccaucu

SEQ ID NO: 1962323 - RNA, 16 nt, Human
cugguaaaaugaagaa

SEQ ID NO: 1962324 - RNA, 17 nt, Human
cugguaaaaugaagaau

SEQ ID NO: 1962325 - RNA, 19 nt, Human
cugguaaaaugaagaauuu

SEQ ID NO: 1962326 - RNA, 22 nt, Human
cugguaaaaugaagaauuuaaa

SEQ ID NO: 1962327 - RNA, 14 nt, Human
cugguaagaaaaag

SEQ ID NO: 1962328 - RNA, 20 nt, Human
cuggggguucuuucuuccuc

SEQ ID NO: 1962329 - RNA, 23 nt, Human
cuggggguucuuucuuccucugc

SEQ ID NO: 1962330 - RNA, 13 nt, Human
cugggucgcccug

SEQ ID NO: 1962331 - RNA, 16 nt, Human
cuggguccccagcccu

SEQ ID NO: 1962332 - RNA, 23 nt, Human
cugggccccugccucucugcagg

SEQ ID NO: 1962333 - RNA, 20 nt, Human
cugggccccugccucucugc

SEQ ID NO: 1962334 - RNA, 19 nt, Human
cugggccccugccucucug

SEQ ID NO: 1962335 - RNA, 23 nt, Human
cugcuccaaccgggaugggagcc

SEQ ID NO: 1962336 - RNA, 18 nt, Human
cugggauuacaggcguga

SEQ ID NO: 1962337 - RNA, 21 nt, Human
cugggauuacaagcgugagcc

SEQ ID NO: 1962338 - RNA, 17 nt, Human
cugggcccgauuuggua

SEQ ID NO: 1962339 - RNA, 12 nt, Human
cugggccuggcu

SEQ ID NO: 1962340 - RNA, 14 nt, Human
cugggccuggcucc

SEQ ID NO: 1962341 - RNA, 20 nt, Human
cugggccuggcucccucacu

SEQ ID NO: 1962342 - RNA, 22 nt, Human
cugggccuggcucccucacucu

SEQ ID NO: 1962343 - RNA, 23 nt, Human
cugggccuggcucccucacucuc

SEQ ID NO: 1962344 - RNA, 20 nt, Human
cugggcugacugggccaggg

SEQ ID NO: 1962345 - RNA, 12 nt, Human
cuggugguucac

SEQ ID NO: 1962346 - RNA, 20 nt, Human
cuggugguucacucuuggag

SEQ ID NO: 1962347 - RNA, 21 nt, Human
cuggugguucacucuuggagc

SEQ ID NO: 1962348 - RNA, 23 nt, Human
cuggugguucacucuuggagccu

SEQ ID NO: 1962349 - RNA, 18 nt, Human
cugguggcagcucaccuc

SEQ ID NO: 1962350 - RNA, 17 nt, Human
cugguggcagcucaccu

SEQ ID NO: 1962351 - RNA, 20 nt, Human
cugguggcagcucaccucuc

SEQ ID NO: 1962352 - RNA, 15 nt, Human
cugguggcagcugcg

SEQ ID NO: 1962353 - RNA, 14 nt, Human
cugguggcaguggg

SEQ ID NO: 1962354 - RNA, 18 nt, Human
cugguggcagugggagcu

SEQ ID NO: 1962355 - RNA, 22 nt, Human
cuguacagagcccacgccccca

SEQ ID NO: 1962356 - RNA, 18 nt, Human
cuguacagagcccacgcc

SEQ ID NO: 1962357 - RNA, 15 nt, Human
cuguacagagcccac

SEQ ID NO: 1962358 - RNA, 14 nt, Human
cuguacagagccca

SEQ ID NO: 1962359 - RNA, 14 nt, Human
cuguaauuugugau

SEQ ID NO: 1962360 - RNA, 15 nt, Human
cuguaauuugugaua

SEQ ID NO: 1962361 - RNA, 17 nt, Human
cuguaauuauuugaaug

SEQ ID NO: 1962362 - RNA, 16 nt, Human
cuguaauuauuugaau

SEQ ID NO: 1962363 - RNA, 21 nt, Human
cugguuagagguucccuuuga

SEQ ID NO: 1962364 - RNA, 22 nt, Human
cugguuagagguucccuuugac

SEQ ID NO: 1962365 - RNA, 19 nt, Human
cuguaauccuagcacuuug

SEQ ID NO: 1962366 - RNA, 21 nt, Human
cuguaucccaugagccucagc

SEQ ID NO: 1962367 - RNA, 22 nt, Human
cuguaucccaugagccucagca

SEQ ID NO: 1962368 - RNA, 17 nt, Human
cuguauuagucacagag

SEQ ID NO: 1962369 - RNA, 19 nt, Human
cuguauuagucacagagau

SEQ ID NO: 1962370 - RNA, 18 nt, Human
cuguauucccauaucaaa

SEQ ID NO: 1962371 - RNA, 12 nt, Human
cuguauucagca

SEQ ID NO: 1962372 - RNA, 20 nt, Human
cuguaucccaugagccucag

SEQ ID NO: 1962373 - RNA, 19 nt, Human
cuguauaaaggugugcugu

SEQ ID NO: 1962374 - RNA, 20 nt, Human
cuguauaaaggugugcugug

SEQ ID NO: 1962375 - RNA, 21 nt, Human
cuguauaaaggugugcugugu

SEQ ID NO: 1962376 - RNA, 13 nt, Human
cugucaauuacag

SEQ ID NO: 1962377 - RNA, 16 nt, Human
cugucaauuacaggaa

SEQ ID NO: 1962378 - RNA, 15 nt, Human
cugucaauuacagga

SEQ ID NO: 1962379 - RNA, 20 nt, Human
cuguauuuuguuuuugucuu

SEQ ID NO: 1962380 - RNA, 14 nt, Human
cuguauuguaacua

SEQ ID NO: 1962381 - RNA, 17 nt, Human
cuguacaugaaaacaca

SEQ ID NO: 1962382 - RNA, 20 nt, Human
cuguacaugaaaacacauuu

SEQ ID NO: 1962383 - RNA, 21 nt, Human
cuguacaugaaaacacauuuu

SEQ ID NO: 1962384 - RNA, 14 nt, Human
cuguacgucugaca

SEQ ID NO: 1962385 - RNA, 15 nt, Human
cuguacgucugacag

SEQ ID NO: 1962386 - RNA, 16 nt, Human
cuguacgucugacagg

SEQ ID NO: 1962387 - RNA, 18 nt, Human
cuguacgucugacaggca

SEQ ID NO: 1962388 - RNA, 14 nt, Human
cuguacuccuccca

SEQ ID NO: 1962389 - RNA, 19 nt, Human
cuguacgucugacaggcaa

SEQ ID NO: 1962390 - RNA, 20 nt, Human
cuguacgucugacaggcaau

SEQ ID NO: 1962391 - RNA, 15 nt, Human
cuguacuccucccag

SEQ ID NO: 1962392 - RNA, 16 nt, Human
cuguacuccucccagg

SEQ ID NO: 1962393 - RNA, 19 nt, Human
cuguacuccucccaggcgc

SEQ ID NO: 1962394 - RNA, 21 nt, Human
cuguacuccucccaggcgccc

SEQ ID NO: 1962395 - RNA, 15 nt, Human
ccuaaaauaagaaua

SEQ ID NO: 1962396 - RNA, 13 nt, Human
ccuaaaaggccca

SEQ ID NO: 1962397 - RNA, 14 nt, Human
ccuaaaaggcccag

SEQ ID NO: 1962398 - RNA, 15 nt, Human
ccuaaaaggcccaga

SEQ ID NO: 1962399 - RNA, 17 nt, Human
ccuaaaaggcccagaga

SEQ ID NO: 1962400 - RNA, 18 nt, Human
ccuaaaagcacacucauc

SEQ ID NO: 1962401 - RNA, 17 nt, Human
ccuaaaagcacacucau

SEQ ID NO: 1962402 - RNA, 18 nt, Human
ccguguaggaaccugcac

SEQ ID NO: 1962403 - RNA, 18 nt, Human
ccuaaauauauuuuaaga

SEQ ID NO: 1962404 - RNA, 14 nt, Human
ccuaaaguguauuu

SEQ ID NO: 1962405 - RNA, 16 nt, Human
ccuaaauauauuuuaa

SEQ ID NO: 1962406 - RNA, 15 nt, Human
ccuaaaauucagugg

SEQ ID NO: 1962407 - RNA, 15 nt, Human
ccuacaagacacagu

SEQ ID NO: 1962408 - RNA, 11 nt, Human
ccuacacagga

SEQ ID NO: 1962409 - RNA, 15 nt, Human
ccuacacaggacagg

SEQ ID NO: 1962410 - RNA, 17 nt, Human
ccuacacaggacagggg

SEQ ID NO: 1962411 - RNA, 23 nt, Human
ccuacacaggacagggguuccuu

SEQ ID NO: 1962412 - RNA, 23 nt, Human
ccuaguuccaccaucaagccacc

SEQ ID NO: 1962413 - RNA, 21 nt, Human
ccuaguuccaccaucaagcca

SEQ ID NO: 1962414 - RNA, 13 nt, Human
ccuaguuccacca

SEQ ID NO: 1962415 - RNA, 18 nt, Human
ccuaguucaucccuucuc

SEQ ID NO: 1962416 - RNA, 21 nt, Human
ccuaguucaucccuucucuuc

SEQ ID NO: 1962417 - RNA, 22 nt, Human
ccuaguucaucccuucucuucc

SEQ ID NO: 1962418 - RNA, 14 nt, Human
ccuauaaaucuaau

SEQ ID NO: 1962419 - RNA, 18 nt, Human
ccuauaaaucuaaugaca

SEQ ID NO: 1962420 - RNA, 18 nt, Human
ccuauaacacugugaaga

SEQ ID NO: 1962421 - RNA, 20 nt, Human
ccuauaacacugugaagagc

SEQ ID NO: 1962422 - RNA, 12 nt, Human
ccuauaccauuu

SEQ ID NO: 1962423 - RNA, 23 nt, Human
ccuauaccauuuccguaauucuu

SEQ ID NO: 1962424 - RNA, 22 nt, Human
ccuauauuguuuucaguguaca

SEQ ID NO: 1962425 - RNA, 18 nt, Human
ccuauauuguuuucagug

SEQ ID NO: 1962426 - RNA, 13 nt, Human
ccuacuuccugug

SEQ ID NO: 1962427 - RNA, 21 nt, Human
ccuacuuccccuuccuaauuc

SEQ ID NO: 1962428 - RNA, 19 nt, Human
ccuaccuaacccagaaaau

SEQ ID NO: 1962429 - RNA, 15 nt, Human
ccuacuuccugugac

SEQ ID NO: 1962430 - RNA, 22 nt, Human
ccuagggcauuguaucugucuu

SEQ ID NO: 1962431 - RNA, 17 nt, Human
ccuacuuuuaaagaauu

SEQ ID NO: 1962432 - RNA, 22 nt, Human
ccuaccgagucucuucuccacu

SEQ ID NO: 1962433 - RNA, 23 nt, Human
ccuaccgagucucuucuccacug

SEQ ID NO: 1962434 - RNA, 20 nt, Human
ccuaccacccgguccccacu

SEQ ID NO: 1962435 - RNA, 15 nt, Human
ccggcuuucaggagc

SEQ ID NO: 1962436 - RNA, 20 nt, Human
ccgggaagggggcugggaca

SEQ ID NO: 1962437 - RNA, 18 nt, Human
ccggcuggccuggccccu

SEQ ID NO: 1962438 - RNA, 17 nt, Human
ccggcuggccuggcccc

SEQ ID NO: 1962439 - RNA, 19 nt, Human
ccgcuuucuacccagcgag

SEQ ID NO: 1962440 - RNA, 15 nt, Human
ccggcuggccuggcc

SEQ ID NO: 1962441 - RNA, 12 nt, Human
ccgcuuucuacc

SEQ ID NO: 1962442 - RNA, 15 nt, Human
ccgcucagcccuccc

SEQ ID NO: 1962443 - RNA, 19 nt, Human
ccgcucagcccucccugcc

SEQ ID NO: 1962444 - RNA, 21 nt, Human
ccgcucagcccucccugcccc

SEQ ID NO: 1962445 - RNA, 22 nt, Human
ccgcucagcccucccugccccu

SEQ ID NO: 1962446 - RNA, 11 nt, Human
ccgcuccagag

SEQ ID NO: 1962447 - RNA, 12 nt, Human
ccgcuccagagu

SEQ ID NO: 1962448 - RNA, 15 nt, Human
ccgcuccagagucag

SEQ ID NO: 1962449 - RNA, 15 nt, Human
ccggggaaaggcaag

SEQ ID NO: 1962450 - RNA, 13 nt, Human
ccgggucuuccua

SEQ ID NO: 1962451 - RNA, 21 nt, Human
ccgggucuuccuacucuucuc

SEQ ID NO: 1962452 - RNA, 12 nt, Human
ccggguuccagc

SEQ ID NO: 1962453 - RNA, 15 nt, Human
ccggguuccagcacc

SEQ ID NO: 1962454 - RNA, 22 nt, Human
ccgggcucugccucccaucacc

SEQ ID NO: 1962455 - RNA, 13 nt, Human
ccgggcugggagc

SEQ ID NO: 1962456 - RNA, 18 nt, Human
ccgggcugggagcucugc

SEQ ID NO: 1962457 - RNA, 19 nt, Human
ccgggcugggagcucugca

SEQ ID NO: 1962458 - RNA, 16 nt, Human
ccgggcguggugguga

SEQ ID NO: 1962459 - RNA, 19 nt, Human
ccgggacguggcaccuccu

SEQ ID NO: 1962460 - RNA, 20 nt, Human
ccgggcuacccgugagcccu

SEQ ID NO: 1962461 - RNA, 20 nt, Human
ccgggcgcgguggcucacgc

SEQ ID NO: 1962462 - RNA, 16 nt, Human
cccugguuuccugccc

SEQ ID NO: 1962463 - RNA, 17 nt, Human
cccugguuuccugcccu

SEQ ID NO: 1962464 - RNA, 20 nt, Human
cccugguggcagcucaccuc

SEQ ID NO: 1962465 - RNA, 14 nt, Human
ccgaggccuucucu

SEQ ID NO: 1962466 - RNA, 18 nt, Human
cccugguuuccugcccug

SEQ ID NO: 1962467 - RNA, 19 nt, Human
cccugguuuccugcccugg

SEQ ID NO: 1962468 - RNA, 14 nt, Human
ccgcaagcaccauc

SEQ ID NO: 1962469 - RNA, 12 nt, Human
ccgauuuuucca

SEQ ID NO: 1962470 - RNA, 20 nt, Human
ccgaguagcugggacuacag

SEQ ID NO: 1962471 - RNA, 17 nt, Human
ccgaguagcugggacua

SEQ ID NO: 1962472 - RNA, 23 nt, Human
ccgcuaagagggagggagggcuc

SEQ ID NO: 1962473 - RNA, 11 nt, Human
ccgcucagccc

SEQ ID NO: 1962474 - RNA, 12 nt, Human
ccgcucagcccu

SEQ ID NO: 1962475 - RNA, 13 nt, Human
ccgcucagcccuc

SEQ ID NO: 1962476 - RNA, 22 nt, Human
ccgcgugaucaaagccacacuc

SEQ ID NO: 1962477 - RNA, 19 nt, Human
ccgcgucgcccucccaggc

SEQ ID NO: 1962478 - RNA, 16 nt, Human
ccgcgggcacugccgc

SEQ ID NO: 1962479 - RNA, 17 nt, Human
ccgcgucgcccucccag

SEQ ID NO: 1962480 - RNA, 21 nt, Human
ccgcuaagagggagggagggc

SEQ ID NO: 1962481 - RNA, 17 nt, Human
ccgcgcgcgccccgaaa

SEQ ID NO: 1962482 - RNA, 14 nt, Human
ccgcacugggcuug

SEQ ID NO: 1962483 - RNA, 19 nt, Human
ccgcacugggcuuggggac

SEQ ID NO: 1962484 - RNA, 17 nt, Human
ccucccgaauagcuggg

SEQ ID NO: 1962485 - RNA, 18 nt, Human
ccucucauuccagaggaa

SEQ ID NO: 1962486 - RNA, 16 nt, Human
ccucuaggaggucucu

SEQ ID NO: 1962487 - RNA, 11 nt, Human
ccucuagcuga

SEQ ID NO: 1962488 - RNA, 12 nt, Human
ccucuagcugaa

SEQ ID NO: 1962489 - RNA, 23 nt, Human
ccucuagcugaauugagccuaaa

SEQ ID NO: 1962490 - RNA, 14 nt, Human
ccuccuguggccug

SEQ ID NO: 1962491 - RNA, 17 nt, Human
ccuccuguggccugcca

SEQ ID NO: 1962492 - RNA, 12 nt, Human
ccuccuucccac

SEQ ID NO: 1962493 - RNA, 14 nt, Human
ccucgguguggaga

SEQ ID NO: 1962494 - RNA, 16 nt, Human
ccucggugccuuccuc

SEQ ID NO: 1962495 - RNA, 15 nt, Human
ccucguuggaagagg

SEQ ID NO: 1962496 - RNA, 20 nt, Human
ccucguuggaagaggaacag

SEQ ID NO: 1962497 - RNA, 18 nt, Human
ccucgguguggagaagcg

SEQ ID NO: 1962498 - RNA, 13 nt, Human
ccucuagcccugc

SEQ ID NO: 1962499 - RNA, 17 nt, Human
ccucuagcccugcccgg

SEQ ID NO: 1962500 - RNA, 18 nt, Human
ccucuagcccugcccgga

SEQ ID NO: 1962501 - RNA, 10 nt, Human
ccucuagcug

SEQ ID NO: 1962502 - RNA, 19 nt, Human
ccucuagaauuuuaagccu

SEQ ID NO: 1962503 - RNA, 23 nt, Human
ccuccugccucgaacuggcugca

SEQ ID NO: 1962504 - RNA, 17 nt, Human
ccuccugacaccccacu

SEQ ID NO: 1962505 - RNA, 14 nt, Human
ccuccugggcuaag

SEQ ID NO: 1962506 - RNA, 14 nt, Human
ccuccugcugccag

SEQ ID NO: 1962507 - RNA, 16 nt, Human
ccuccugcugccagua

SEQ ID NO: 1962508 - RNA, 19 nt, Human
ccuccugcugccaguacca

SEQ ID NO: 1962509 - RNA, 15 nt, Human
ccuccugacacccca

SEQ ID NO: 1962510 - RNA, 10 nt, Human
ccucccuccc

SEQ ID NO: 1962511 - RNA, 18 nt, Human
ccucccugccccucccuu

SEQ ID NO: 1962512 - RNA, 21 nt, Human
ccucccugccccucccuucaa

SEQ ID NO: 1962513 - RNA, 14 nt, Human
ccuccucagaucuu

SEQ ID NO: 1962514 - RNA, 22 nt, Human
ccucccugcugucauugcuucu

SEQ ID NO: 1962515 - RNA, 14 nt, Human
ccucccugcuguca

SEQ ID NO: 1962516 - RNA, 13 nt, Human
ccucccugccccu

SEQ ID NO: 1962517 - RNA, 22 nt, Human
ccucccugccccucccuucaac

SEQ ID NO: 1962518 - RNA, 24 nt, Human
ccucccugccccucccuucaacca

SEQ ID NO: 1962519 - RNA, 19 nt, Human
ccucccgaguagcugggac

SEQ ID NO: 1962520 - RNA, 14 nt, Human
ccucccggcccugc

SEQ ID NO: 1962521 - RNA, 15 nt, Human
ccucccggcccugcc

SEQ ID NO: 1962522 - RNA, 20 nt, Human
ccucccgaguagcugggacu

SEQ ID NO: 1962523 - RNA, 21 nt, Human
ccucccgaguagcugggacua

SEQ ID NO: 1962524 - RNA, 18 nt, Human
ccucccccagccacuccc

SEQ ID NO: 1962525 - RNA, 14 nt, Human
ccuccccuucccag

SEQ ID NO: 1962526 - RNA, 14 nt, Human
ccuccccuugccag

SEQ ID NO: 1962527 - RNA, 22 nt, Human
ccuccccuugccagcugcugag

SEQ ID NO: 1962528 - RNA, 22 nt, Human
ccuccagagcugcggugucucc

SEQ ID NO: 1962529 - RNA, 21 nt, Human
ccuccaggugcacaagcucca

SEQ ID NO: 1962530 - RNA, 19 nt, Human
ccuccaggugcacaagcuc

SEQ ID NO: 1962531 - RNA, 22 nt, Human
ccuccagggcucaacacuguga

SEQ ID NO: 1962532 - RNA, 22 nt, Human
ccuccaggugcacaagcuccaa

SEQ ID NO: 1962533 - RNA, 14 nt, Human
ccuccauccugagg

SEQ ID NO: 1962534 - RNA, 18 nt, Human
ccuccaucuaaacugccc

SEQ ID NO: 1962535 - RNA, 23 nt, Human
ccuccaugugggcuaguugggcu

SEQ ID NO: 1962536 - RNA, 14 nt, Human
ccuccaugcugccu

SEQ ID NO: 1962537 - RNA, 15 nt, Human
ccucccaaagugcug

SEQ ID NO: 1962538 - RNA, 15 nt, Human
ccuccaugcugccuc

SEQ ID NO: 1962539 - RNA, 16 nt, Human
ccucccaaagugcugg

SEQ ID NO: 1962540 - RNA, 23 nt, Human
ccuccaaucccaccaacccucag

SEQ ID NO: 1962541 - RNA, 19 nt, Human
ccuccacacccgcgccccg

SEQ ID NO: 1962542 - RNA, 20 nt, Human
ccucauccucauacccaccc

SEQ ID NO: 1962543 - RNA, 13 nt, Human
ccucauccucaua

SEQ ID NO: 1962544 - RNA, 21 nt, Human
ccucaucuccccaucauuggu

SEQ ID NO: 1962545 - RNA, 13 nt, Human
ccucauacccacc

SEQ ID NO: 1962546 - RNA, 17 nt, Human
ccucauagcccucaccc

SEQ ID NO: 1962547 - RNA, 18 nt, Human
ccucauagcccucacccu

SEQ ID NO: 1962548 - RNA, 20 nt, Human
ccucauaguaugguggcugg

SEQ ID NO: 1962549 - RNA, 21 nt, Human
ccucauagcccucacccuggg

SEQ ID NO: 1962550 - RNA, 22 nt, Human
ccucauagcccucacccugggg

SEQ ID NO: 1962551 - RNA, 14 nt, Human
ccucaucaccaacg

SEQ ID NO: 1962552 - RNA, 13 nt, Human
ccucaucaccaac

SEQ ID NO: 1962553 - RNA, 21 nt, Human
ccucauaguaugguggcuggg

SEQ ID NO: 1962554 - RNA, 22 nt, Human
ccucauaguaugguggcugggu

SEQ ID NO: 1962555 - RNA, 20 nt, Human
ccucagucuggcccuuccuu

SEQ ID NO: 1962556 - RNA, 11 nt, Human
ccucagugcca

SEQ ID NO: 1962557 - RNA, 12 nt, Human
ccucauacccac

SEQ ID NO: 1962558 - RNA, 19 nt, Human
ccucagucuggcccuuccu

SEQ ID NO: 1962559 - RNA, 19 nt, Human
ccuaugcagagguccacaa

SEQ ID NO: 1962560 - RNA, 17 nt, Human
cccugguggcagcucac

SEQ ID NO: 1962561 - RNA, 16 nt, Human
cccugguggcagcuca

SEQ ID NO: 1962562 - RNA, 15 nt, Human
cccugguggcagcuc

SEQ ID NO: 1962563 - RNA, 20 nt, Human
cccugguaagaaaaagcaaa

SEQ ID NO: 1962564 - RNA, 23 nt, Human
cccuggguuagacugccagcucu

SEQ ID NO: 1962565 - RNA, 15 nt, Human
cccugguaagaaaaa

SEQ ID NO: 1962566 - RNA, 15 nt, Human
cccuggacugugugc

SEQ ID NO: 1962567 - RNA, 18 nt, Human
cccuggcuuuucacugcu

SEQ ID NO: 1962568 - RNA, 17 nt, Human
cccuggcuuuucacugc

SEQ ID NO: 1962569 - RNA, 19 nt, Human
cccuggcuuuucacugcug

SEQ ID NO: 1962570 - RNA, 22 nt, Human
cccuggcuuuucacugcuggcu

SEQ ID NO: 1962571 - RNA, 18 nt, Human
cccugggaggcagugaug

SEQ ID NO: 1962572 - RNA, 19 nt, Human
cccuggaccccagccucaa

SEQ ID NO: 1962573 - RNA, 17 nt, Human
cccugcccaccuggccu

SEQ ID NO: 1962574 - RNA, 14 nt, Human
cccugcccaccugg

SEQ ID NO: 1962575 - RNA, 13 nt, Human
cccugccagaccc

SEQ ID NO: 1962576 - RNA, 21 nt, Human
cccugccagacccccuggaga

SEQ ID NO: 1962577 - RNA, 13 nt, Human
cccugcccaccug

SEQ ID NO: 1962578 - RNA, 21 nt, Human
cccugcuggguguggcgcagc

SEQ ID NO: 1962579 - RNA, 16 nt, Human
cccugcuggguguggc

SEQ ID NO: 1962580 - RNA, 18 nt, Human
cccugcccaccuggccuc

SEQ ID NO: 1962581 - RNA, 22 nt, Human
cccugcuggguguggcgcagca

SEQ ID NO: 1962582 - RNA, 16 nt, Human
cccugcuggccggaca

SEQ ID NO: 1962583 - RNA, 18 nt, Human
cccugcuuugggcugccc

SEQ ID NO: 1962584 - RNA, 19 nt, Human
cccugcuuugggcugcccu

SEQ ID NO: 1962585 - RNA, 17 nt, Human
cccugcuuugggcugcc

SEQ ID NO: 1962586 - RNA, 20 nt, Human
cccugcuuugggcugcccug

SEQ ID NO: 1962587 - RNA, 14 nt, Human
cccuggaccccagc

SEQ ID NO: 1962588 - RNA, 15 nt, Human
cccuggaccccagcc

SEQ ID NO: 1962589 - RNA, 16 nt, Human
cccuggaccccagccu

SEQ ID NO: 1962590 - RNA, 17 nt, Human
cccuggaccccagccuc

SEQ ID NO: 1962591 - RNA, 18 nt, Human
cccuggaccccagccuca

SEQ ID NO: 1962592 - RNA, 19 nt, Human
cccuauaucuauaaacacu

SEQ ID NO: 1962593 - RNA, 13 nt, Human
cccuccaccugcu

SEQ ID NO: 1962594 - RNA, 23 nt, Human
cccuccacucuccucuuccaggc

SEQ ID NO: 1962595 - RNA, 15 nt, Human
cccucccccagccac

SEQ ID NO: 1962596 - RNA, 13 nt, Human
cccucccagggag

SEQ ID NO: 1962597 - RNA, 14 nt, Human
cccucccagggagc

SEQ ID NO: 1962598 - RNA, 18 nt, Human
cccucucugaaggaggcc

SEQ ID NO: 1962599 - RNA, 23 nt, Human
cccucucugaaggaggccaccuc

SEQ ID NO: 1962600 - RNA, 12 nt, Human
cccucuggggcu

SEQ ID NO: 1962601 - RNA, 23 nt, Human
cccugaggcccagagggccugca

SEQ ID NO: 1962602 - RNA, 20 nt, Human
cccugaggcccagagggccu

SEQ ID NO: 1962603 - RNA, 19 nt, Human
cccugaggcccagagggcc

SEQ ID NO: 1962604 - RNA, 18 nt, Human
cccugaggcccagagggc

SEQ ID NO: 1962605 - RNA, 17 nt, Human
cccugaggcccagaggg

SEQ ID NO: 1962606 - RNA, 16 nt, Human
cccugaggcccagagg

SEQ ID NO: 1962607 - RNA, 15 nt, Human
cccugaggcccagag

SEQ ID NO: 1962608 - RNA, 14 nt, Human
cccugaggcccaga

SEQ ID NO: 1962609 - RNA, 16 nt, Human
cccugaaagcccugag

SEQ ID NO: 1962610 - RNA, 21 nt, Human
cccugaaaccuaguacugccc

SEQ ID NO: 1962611 - RNA, 13 nt, Human
cccugaggcccag

SEQ ID NO: 1962612 - RNA, 15 nt, Human
cccugaaagcccuga

SEQ ID NO: 1962613 - RNA, 16 nt, Human
cccucuggggcuguuc

SEQ ID NO: 1962614 - RNA, 22 nt, Human
cccugcacuugcagacucuaca

SEQ ID NO: 1962615 - RNA, 19 nt, Human
cccugcacuugcagacucu

SEQ ID NO: 1962616 - RNA, 12 nt, Human
cccugcacuugc

SEQ ID NO: 1962617 - RNA, 13 nt, Human
cccugcacccucc

SEQ ID NO: 1962618 - RNA, 14 nt, Human
cccugcacccuccu

SEQ ID NO: 1962619 - RNA, 15 nt, Human
cccugcacccuccua

SEQ ID NO: 1962620 - RNA, 17 nt, Human
cccugcacccuccuagg

SEQ ID NO: 1962621 - RNA, 23 nt, Human
cccugcacaaagcccuuccaugu

SEQ ID NO: 1962622 - RNA, 16 nt, Human
cccugcaaagcccagc

SEQ ID NO: 1962623 - RNA, 17 nt, Human
cccugcaaagcccagcu

SEQ ID NO: 1962624 - RNA, 19 nt, Human
cccugcaaagcccagcuug

SEQ ID NO: 1962625 - RNA, 20 nt, Human
cccugcaaagcccagcuuga

SEQ ID NO: 1962626 - RNA, 15 nt, Human
cccugcaaagcccag

SEQ ID NO: 1962627 - RNA, 20 nt, Human
cccuacaguugaaaaacagc

SEQ ID NO: 1962628 - RNA, 23 nt, Human
cccuaaugcgcaggcuggcccug

SEQ ID NO: 1962629 - RNA, 21 nt, Human
cccuaaugcgcaggcuggccc

SEQ ID NO: 1962630 - RNA, 22 nt, Human
cccuaaugcgcaggcuggcccu

SEQ ID NO: 1962631 - RNA, 17 nt, Human
cccuaaugcgcaggcug

SEQ ID NO: 1962632 - RNA, 20 nt, Human
cccguguaggaaccugcaca

SEQ ID NO: 1962633 - RNA, 21 nt, Human
cccuaccgagucucuucucca

SEQ ID NO: 1962634 - RNA, 18 nt, Human
cccuaccgagucucuucu

SEQ ID NO: 1962635 - RNA, 15 nt, Human
cccgugggguuccuc

SEQ ID NO: 1962636 - RNA, 22 nt, Human
cccgucucugguuccuccccuc

SEQ ID NO: 1962637 - RNA, 12 nt, Human
cccgucucaggu

SEQ ID NO: 1962638 - RNA, 22 nt, Human
cccggggaaaggcaagguccgg

SEQ ID NO: 1962639 - RNA, 16 nt, Human
cccgggcucugccucc

SEQ ID NO: 1962640 - RNA, 18 nt, Human
cccggugcccaagaauag

SEQ ID NO: 1962641 - RNA, 14 nt, Human
cccagagggccugc

SEQ ID NO: 1962642 - RNA, 15 nt, Human
cccagagggccugca

SEQ ID NO: 1962643 - RNA, 21 nt, Human
cccgaggccuucucugaagga

SEQ ID NO: 1962644 - RNA, 14 nt, Human
cccagaacucugcc

SEQ ID NO: 1962645 - RNA, 17 nt, Human
cccagaacucugccugc

SEQ ID NO: 1962646 - RNA, 21 nt, Human
cccagaacucugccugcccuu

SEQ ID NO: 1962647 - RNA, 13 nt, Human
cccgaguagcugg

SEQ ID NO: 1962648 - RNA, 14 nt, Human
cccgaguagcuggg

SEQ ID NO: 1962649 - RNA, 15 nt, Human
cccgaguagcuggga

SEQ ID NO: 1962650 - RNA, 16 nt, Human
cccgaguagcugggac

SEQ ID NO: 1962651 - RNA, 17 nt, Human
cccgaguagcugggacu

SEQ ID NO: 1962652 - RNA, 18 nt, Human
cccgaguagcugggacua

SEQ ID NO: 1962653 - RNA, 21 nt, Human
cccgaguagcugggacuacag

SEQ ID NO: 1962654 - RNA, 20 nt, Human
cccgcugucagccauuccug

SEQ ID NO: 1962655 - RNA, 19 nt, Human
cccgcugucagccauuccu

SEQ ID NO: 1962656 - RNA, 14 nt, Human
cccgccuccaaccc

SEQ ID NO: 1962657 - RNA, 19 nt, Human
cccgccuccaaccccucgc

SEQ ID NO: 1962658 - RNA, 17 nt, Human
cccgccgcccagcccac

SEQ ID NO: 1962659 - RNA, 22 nt, Human
cccgaguagcugggacuacagg

SEQ ID NO: 1962660 - RNA, 15 nt, Human
cccgggcucugccuc

SEQ ID NO: 1962661 - RNA, 14 nt, Human
cccgggcucugccu

SEQ ID NO: 1962662 - RNA, 12 nt, Human
cccgggcucugc

SEQ ID NO: 1962663 - RNA, 16 nt, Human
cccaccugcagcuccc

SEQ ID NO: 1962664 - RNA, 19 nt, Human
cccaccucccccacuccca

SEQ ID NO: 1962665 - RNA, 22 nt, Human
cccaccucucucacuccuugaa

SEQ ID NO: 1962666 - RNA, 17 nt, Human
cccaccucagccucccg

SEQ ID NO: 1962667 - RNA, 23 nt, Human
cccaccgggcugggagcucugca

SEQ ID NO: 1962668 - RNA, 17 nt, Human
cccaccacacccucccu

SEQ ID NO: 1962669 - RNA, 20 nt, Human
cccaccgcagacaggaccag

SEQ ID NO: 1962670 - RNA, 19 nt, Human
cccaccgcagacaggacca

SEQ ID NO: 1962671 - RNA, 19 nt, Human
cccacgcuggagugcagug

SEQ ID NO: 1962672 - RNA, 20 nt, Human
cccacgcuggagugcaguga

SEQ ID NO: 1962673 - RNA, 21 nt, Human
cccacgcuggagugcagugag

SEQ ID NO: 1962674 - RNA, 23 nt, Human
cccacuugagaauuacccuuuug

SEQ ID NO: 1962675 - RNA, 12 nt, Human
cccacuucugcc

SEQ ID NO: 1962676 - RNA, 14 nt, Human
cccacuucugccag

SEQ ID NO: 1962677 - RNA, 17 nt, Human
cccacuugguuagauga

SEQ ID NO: 1962678 - RNA, 16 nt, Human
cccaccuggccucugc

SEQ ID NO: 1962679 - RNA, 21 nt, Human
cccacgacugcccggcagggu

SEQ ID NO: 1962680 - RNA, 20 nt, Human
cccacgacugcccggcaggg

SEQ ID NO: 1962681 - RNA, 21 nt, Human
cccaccuggccucugcacucc

SEQ ID NO: 1962682 - RNA, 19 nt, Human
cccaccuggccucugcacu

SEQ ID NO: 1962683 - RNA, 17 nt, Human
cccaccuggccucugca

SEQ ID NO: 1962684 - RNA, 13 nt, Human
cccacaagaaaug

SEQ ID NO: 1962685 - RNA, 20 nt, Human
cccaaugcacuuuguucugg

SEQ ID NO: 1962686 - RNA, 16 nt, Human
cccaaugcacuuuguu

SEQ ID NO: 1962687 - RNA, 20 nt, Human
cccacaagaaaugaaagcag

SEQ ID NO: 1962688 - RNA, 13 nt, Human
cccacacacagau

SEQ ID NO: 1962689 - RNA, 16 nt, Human
cccacaggaggugguc

SEQ ID NO: 1962690 - RNA, 21 nt, Human
cccacaggagguggucuggga

SEQ ID NO: 1962691 - RNA, 13 nt, Human
cccaccacacaac

SEQ ID NO: 1962692 - RNA, 14 nt, Human
cccaccacacaaca

SEQ ID NO: 1962693 - RNA, 20 nt, Human
cgagcaggcuucuucccccc

SEQ ID NO: 1962694 - RNA, 17 nt, Human
cgagcaugccuggaugg

SEQ ID NO: 1962695 - RNA, 16 nt, Human
cgagcaugccuggaug

SEQ ID NO: 1962696 - RNA, 13 nt, Human
cgagcaugccugg

SEQ ID NO: 1962697 - RNA, 14 nt, Human
cgagcaugccugga

SEQ ID NO: 1962698 - RNA, 18 nt, Human
cgagaucacgccacugca

SEQ ID NO: 1962699 - RNA, 20 nt, Human
cgagaucacgccacugcacu

SEQ ID NO: 1962700 - RNA, 20 nt, Human
cgagauugcaccacugcacu

SEQ ID NO: 1962701 - RNA, 21 nt, Human
cgagcagacacccuuggagcu

SEQ ID NO: 1962702 - RNA, 18 nt, Human
cgagauagccaaggccaa

SEQ ID NO: 1962703 - RNA, 17 nt, Human
cgagaucacgccacugc

SEQ ID NO: 1962704 - RNA, 13 nt, Human
cgaauagcuggga

SEQ ID NO: 1962705 - RNA, 14 nt, Human
cgaauagcugggac

SEQ ID NO: 1962706 - RNA, 18 nt, Human
cgacuugugcacaggcag

SEQ ID NO: 1962707 - RNA, 19 nt, Human
cgacuugugcacaggcaga

SEQ ID NO: 1962708 - RNA, 16 nt, Human
cgacuugcauuuuugc

SEQ ID NO: 1962709 - RNA, 22 nt, Human
cgaaacucuaaguguuugcugc

SEQ ID NO: 1962710 - RNA, 16 nt, Human
cgaaaccaaagaagaa

SEQ ID NO: 1962711 - RNA, 20 nt, Human
cgaaaacguggcugcuucaa

SEQ ID NO: 1962712 - RNA, 12 nt, Human
cgaaaaucauug

SEQ ID NO: 1962713 - RNA, 19 nt, Human
cgaaaacguggcugcuuca

SEQ ID NO: 1962714 - RNA, 18 nt, Human
cgaaaacguggcugcuuc

SEQ ID NO: 1962715 - RNA, 22 nt, Human
cgaaaaccaggccuuaucucca

SEQ ID NO: 1962716 - RNA, 13 nt, Human
cgaaaaccaggcc

SEQ ID NO: 1962717 - RNA, 12 nt, Human
ccuuuuuuuuga

SEQ ID NO: 1962718 - RNA, 15 nt, Human
cgaaaacguggcugc

SEQ ID NO: 1962719 - RNA, 16 nt, Human
ccuuuucacccuucua

SEQ ID NO: 1962720 - RNA, 20 nt, Human
ccuuuucacccuucuacucu

SEQ ID NO: 1962721 - RNA, 21 nt, Human
ccuuugacgccaucccagccc

SEQ ID NO: 1962722 - RNA, 20 nt, Human
ccuuugacgccaucccagcc

SEQ ID NO: 1962723 - RNA, 22 nt, Human
ccuuugacgccaucccagcccc

SEQ ID NO: 1962724 - RNA, 12 nt, Human
cgaaagaacagu

SEQ ID NO: 1962725 - RNA, 21 nt, Human
cgaaagaacaguccauugaaa

SEQ ID NO: 1962726 - RNA, 23 nt, Human
cgaaagaggcacccuuccaucug

SEQ ID NO: 1962727 - RNA, 12 nt, Human
cgaaagaggcac

SEQ ID NO: 1962728 - RNA, 19 nt, Human
cgaaagaggcacccuucca

SEQ ID NO: 1962729 - RNA, 20 nt, Human
cgaaagaggcacccuuccau

SEQ ID NO: 1962730 - RNA, 18 nt, Human
cgaaagaaaacucuauuu

SEQ ID NO: 1962731 - RNA, 22 nt, Human
cgaaagggacuuggaagcuccg

SEQ ID NO: 1962732 - RNA, 20 nt, Human
cgaaaggaugaaagugacca

SEQ ID NO: 1962733 - RNA, 19 nt, Human
cgaaagggacuuggaagcu

SEQ ID NO: 1962734 - RNA, 12 nt, Human
cgaacuggcugc

SEQ ID NO: 1962735 - RNA, 14 nt, Human
cgaacuggcugcaa

SEQ ID NO: 1962736 - RNA, 14 nt, Human
cgaacuccugaccu

SEQ ID NO: 1962737 - RNA, 18 nt, Human
cgaaguucaagaucaaaa

SEQ ID NO: 1962738 - RNA, 16 nt, Human
cgaaguucaagaucaa

SEQ ID NO: 1962739 - RNA, 17 nt, Human
cgaaguucaagaucaaa

SEQ ID NO: 1962740 - RNA, 16 nt, Human
cgaacuguuguauaaa

SEQ ID NO: 1962741 - RNA, 21 nt, Human
cgaacugggcauauuucuaau

SEQ ID NO: 1962742 - RNA, 17 nt, Human
cgccaugcuccuggccc

SEQ ID NO: 1962743 - RNA, 20 nt, Human
cgauuucuguuuagauaaua

SEQ ID NO: 1962744 - RNA, 19 nt, Human
cgcaagcaccauccccucc

SEQ ID NO: 1962745 - RNA, 21 nt, Human
cgcaagcaccauccccuccgg

SEQ ID NO: 1962746 - RNA, 17 nt, Human
cgcaccagcccagaagu

SEQ ID NO: 1962747 - RNA, 13 nt, Human
cgcacagcugcuc

SEQ ID NO: 1962748 - RNA, 18 nt, Human
cgagcaugccuggauggg

SEQ ID NO: 1962749 - RNA, 15 nt, Human
cgagcccugguggca

SEQ ID NO: 1962750 - RNA, 16 nt, Human
cgagcccugguggcag

SEQ ID NO: 1962751 - RNA, 16 nt, Human
cgcagacaggaccagg

SEQ ID NO: 1962752 - RNA, 15 nt, Human
cgcagacaggaccag

SEQ ID NO: 1962753 - RNA, 21 nt, Human
cgcagagaagugacgguuccu

SEQ ID NO: 1962754 - RNA, 14 nt, Human
cgcagcccugcaga

SEQ ID NO: 1962755 - RNA, 10 nt, Human
cgcagcccug

SEQ ID NO: 1962756 - RNA, 22 nt, Human
cgcagagaagugacgguuccua

SEQ ID NO: 1962757 - RNA, 21 nt, Human
cgccagauucuuuccugaggc

SEQ ID NO: 1962758 - RNA, 20 nt, Human
cgccagauucuuuccugagg

SEQ ID NO: 1962759 - RNA, 19 nt, Human
cgccagauucuuuccugag

SEQ ID NO: 1962760 - RNA, 17 nt, Human
cgccagauucuuuccug

SEQ ID NO: 1962761 - RNA, 22 nt, Human
cgccaggggaaaaucagccugc

SEQ ID NO: 1962762 - RNA, 16 nt, Human
cgccagggaccccaga

SEQ ID NO: 1962763 - RNA, 17 nt, Human
cgccagggaccccagaa

SEQ ID NO: 1962764 - RNA, 12 nt, Human
ccuucagugccu

SEQ ID NO: 1962765 - RNA, 19 nt, Human
ccuuaccugccaggaagcc

SEQ ID NO: 1962766 - RNA, 19 nt, Human
ccuuacccucauguucuua

SEQ ID NO: 1962767 - RNA, 17 nt, Human
ccuuagaagucacacag

SEQ ID NO: 1962768 - RNA, 23 nt, Human
ccuuacugaccucaccuaggaag

SEQ ID NO: 1962769 - RNA, 18 nt, Human
ccuuagaagucacacagu

SEQ ID NO: 1962770 - RNA, 20 nt, Human
ccuuaccagcagagcaccuu

SEQ ID NO: 1962771 - RNA, 20 nt, Human
ccuuaccacugcucugauga

SEQ ID NO: 1962772 - RNA, 15 nt, Human
ccuuacccucauguu

SEQ ID NO: 1962773 - RNA, 13 nt, Human
ccuuaccagcaga

SEQ ID NO: 1962774 - RNA, 17 nt, Human
ccuuaccacugcucuga

SEQ ID NO: 1962775 - RNA, 17 nt, Human
ccuuacaaaugauugcu

SEQ ID NO: 1962776 - RNA, 21 nt, Human
ccuuacaaaugauugcuuuua

SEQ ID NO: 1962777 - RNA, 23 nt, Human
ccuuacaaaugauugcuuuuaaa

SEQ ID NO: 1962778 - RNA, 20 nt, Human
ccuuacacaaugguuuucuu

SEQ ID NO: 1962779 - RNA, 14 nt, Human
ccuuacacaauggu

SEQ ID NO: 1962780 - RNA, 22 nt, Human
ccuuaagugaggaaaucaaagu

SEQ ID NO: 1962781 - RNA, 20 nt, Human
ccuuaagugaggaaaucaaa

SEQ ID NO: 1962782 - RNA, 19 nt, Human
ccuuaagugaggaaaucaa

SEQ ID NO: 1962783 - RNA, 15 nt, Human
ccuuaagaaugccaa

SEQ ID NO: 1962784 - RNA, 12 nt, Human
ccuuaagaauga

SEQ ID NO: 1962785 - RNA, 20 nt, Human
ccuuaagaaugaguuucuua

SEQ ID NO: 1962786 - RNA, 14 nt, Human
ccuuaagcugcagg

SEQ ID NO: 1962787 - RNA, 15 nt, Human
ccuuaagcugcagga

SEQ ID NO: 1962788 - RNA, 16 nt, Human
ccuguuuugagcccug

SEQ ID NO: 1962789 - RNA, 20 nt, Human
ccuuaaaacaucauuccuuu

SEQ ID NO: 1962790 - RNA, 17 nt, Human
ccuuaaaauuugaaaca

SEQ ID NO: 1962791 - RNA, 18 nt, Human
ccuuaaaauuugaaacau

SEQ ID NO: 1962792 - RNA, 15 nt, Human
ccuuaaaauuugaaa

SEQ ID NO: 1962793 - RNA, 16 nt, Human
ccuuaaaauuugaaac

SEQ ID NO: 1962794 - RNA, 20 nt, Human
ccuguguguccaaaacugcc

SEQ ID NO: 1962795 - RNA, 21 nt, Human
ccuguguguccaaaacugccu

SEQ ID NO: 1962796 - RNA, 20 nt, Human
ccugugugugcgccuacagg

SEQ ID NO: 1962797 - RNA, 21 nt, Human
ccugugugugcgccuacagga

SEQ ID NO: 1962798 - RNA, 22 nt, Human
ccugugucuugcaauggcagcc

SEQ ID NO: 1962799 - RNA, 17 nt, Human
ccugugucuugcaaugg

SEQ ID NO: 1962800 - RNA, 21 nt, Human
ccuguguccaugugaucucau

SEQ ID NO: 1962801 - RNA, 19 nt, Human
ccugugucuugcaauggca

SEQ ID NO: 1962802 - RNA, 21 nt, Human
ccugugucuugcaauggcagc

SEQ ID NO: 1962803 - RNA, 17 nt, Human
ccugugucaguuuaugu

SEQ ID NO: 1962804 - RNA, 22 nt, Human
ccugugucaguuuauguuuugg

SEQ ID NO: 1962805 - RNA, 16 nt, Human
ccuguuucugcagcca

SEQ ID NO: 1962806 - RNA, 18 nt, Human
ccuguuucagaggcucag

SEQ ID NO: 1962807 - RNA, 23 nt, Human
ccuguuucaaguucacaccugca

SEQ ID NO: 1962808 - RNA, 18 nt, Human
ccuguuuguuucugaaag

SEQ ID NO: 1962809 - RNA, 23 nt, Human
ccuguuugggaagagcuuagaaa

SEQ ID NO: 1962810 - RNA, 14 nt, Human
ccuguuuguuucug

SEQ ID NO: 1962811 - RNA, 22 nt, Human
ccuguuugggaagagcuuagaa

SEQ ID NO: 1962812 - RNA, 15 nt, Human
ccuguuuaagagaca

SEQ ID NO: 1962813 - RNA, 12 nt, Human
ccuguuuaagag

SEQ ID NO: 1962814 - RNA, 23 nt, Human
ccuguugggccaggagccuccug

SEQ ID NO: 1962815 - RNA, 13 nt, Human
ccuguguuaauuu

SEQ ID NO: 1962816 - RNA, 14 nt, Human
ccuguguuaauuua

SEQ ID NO: 1962817 - RNA, 17 nt, Human
ccuguguuaauuuaagu

SEQ ID NO: 1962818 - RNA, 23 nt, Human
ccuguguuaauuuaaguuuugac

SEQ ID NO: 1962819 - RNA, 12 nt, Human
ccuucagccuga

SEQ ID NO: 1962820 - RNA, 14 nt, Human
ccuucagugccaaa

SEQ ID NO: 1962821 - RNA, 19 nt, Human
ccuucauuuggcauucccc

SEQ ID NO: 1962822 - RNA, 10 nt, Human
ccuucagugc

SEQ ID NO: 1962823 - RNA, 11 nt, Human
ccuucagugcc

SEQ ID NO: 1962824 - RNA, 20 nt, Human
ccuucaccuuuguccccacc

SEQ ID NO: 1962825 - RNA, 19 nt, Human
ccuucaccuuuguccccac

SEQ ID NO: 1962826 - RNA, 17 nt, Human
ccuucacagaugggugc

SEQ ID NO: 1962827 - RNA, 14 nt, Human
ccuuagacaguccc

SEQ ID NO: 1962828 - RNA, 21 nt, Human
ccuucaccuuuguccccaccg

SEQ ID NO: 1962829 - RNA, 14 nt, Human
ccuucacuuaggaa

SEQ ID NO: 1962830 - RNA, 14 nt, Human
ccuucggccuccau

SEQ ID NO: 1962831 - RNA, 19 nt, Human
ccuucggccuccauccuga

SEQ ID NO: 1962832 - RNA, 20 nt, Human
ccuucggccuccauccugag

SEQ ID NO: 1962833 - RNA, 15 nt, Human
ccuuccaagagccug

SEQ ID NO: 1962834 - RNA, 16 nt, Human
ccuuccaagagccuga

SEQ ID NO: 1962835 - RNA, 17 nt, Human
ccuuccaagagccugag

SEQ ID NO: 1962836 - RNA, 22 nt, Human
ccuucauuuggcauuccccacu

SEQ ID NO: 1962837 - RNA, 21 nt, Human
ccuuccucuccacugccuucg

SEQ ID NO: 1962838 - RNA, 15 nt, Human
ccuuccucugagccu

SEQ ID NO: 1962839 - RNA, 16 nt, Human
ccuuccucugagccuu

SEQ ID NO: 1962840 - RNA, 20 nt, Human
ccuuccucugagccuuggga

SEQ ID NO: 1962841 - RNA, 13 nt, Human
ccuuccucugagg

SEQ ID NO: 1962842 - RNA, 22 nt, Human
ccuuggggucagguugacagga

SEQ ID NO: 1962843 - RNA, 22 nt, Human
ccuugguuaggcauugugggaa

SEQ ID NO: 1962844 - RNA, 21 nt, Human
ccuugguuaggcauuguggga

SEQ ID NO: 1962845 - RNA, 22 nt, Human
ccuuggugucgggcaugacacg

SEQ ID NO: 1962846 - RNA, 13 nt, Human
ccuugauuggaag

SEQ ID NO: 1962847 - RNA, 22 nt, Human
ccuugauuggaagggcuuuuca

SEQ ID NO: 1962848 - RNA, 19 nt, Human
ccuugauucccuuguuauu

SEQ ID NO: 1962849 - RNA, 20 nt, Human
ccuuggcuuggcccuggcag

SEQ ID NO: 1962850 - RNA, 21 nt, Human
ccuuggcuuggcccuggcagc

SEQ ID NO: 1962851 - RNA, 12 nt, Human
ccuugggacccc

SEQ ID NO: 1962852 - RNA, 19 nt, Human
ccuuggcuuggcccuggca

SEQ ID NO: 1962853 - RNA, 14 nt, Human
ccuugggauccagg

SEQ ID NO: 1962854 - RNA, 22 nt, Human
ccuuggcuuggcccuggcagcc

SEQ ID NO: 1962855 - RNA, 13 nt, Human
ccuuguuuaaugg

SEQ ID NO: 1962856 - RNA, 13 nt, Human
ccuuguuccaguu

SEQ ID NO: 1962857 - RNA, 17 nt, Human
ccuugucauuuuggucu

SEQ ID NO: 1962858 - RNA, 11 nt, Human
ccuuguuucag

SEQ ID NO: 1962859 - RNA, 16 nt, Human
ccuuucuacuuccaag

SEQ ID NO: 1962860 - RNA, 17 nt, Human
ccuuucuauaauuuuac

SEQ ID NO: 1962861 - RNA, 16 nt, Human
ccuuucuauaauuuua

SEQ ID NO: 1962862 - RNA, 18 nt, Human
ccuuugacgccaucccag

SEQ ID NO: 1962863 - RNA, 17 nt, Human
ccuuugacgccauccca

SEQ ID NO: 1962864 - RNA, 16 nt, Human
ccuuugacgccauccc

SEQ ID NO: 1962865 - RNA, 14 nt, Human
ccuucuguggcuca

SEQ ID NO: 1962866 - RNA, 21 nt, Human
ccuucuguggcucacagaacc

SEQ ID NO: 1962867 - RNA, 17 nt, Human
ccuucuguugaugcugu

SEQ ID NO: 1962868 - RNA, 21 nt, Human
ccuucuauagcaucacuuaaa

SEQ ID NO: 1962869 - RNA, 19 nt, Human
ccuucuauagcaucacuua

SEQ ID NO: 1962870 - RNA, 19 nt, Human
ccuucuccuucaccuuugu

SEQ ID NO: 1962871 - RNA, 15 nt, Human
ccuucuccuucaccu

SEQ ID NO: 1962872 - RNA, 15 nt, Human
ccuucggcgccuuaa

SEQ ID NO: 1962873 - RNA, 20 nt, Human
ccuugaguugauucagcucu

SEQ ID NO: 1962874 - RNA, 13 nt, Human
ccuugacuuuuua

SEQ ID NO: 1962875 - RNA, 16 nt, Human
ccuugaggggagccag

SEQ ID NO: 1962876 - RNA, 18 nt, Human
ccuugaggggagccagga

SEQ ID NO: 1962877 - RNA, 21 nt, Human
ccuugaggggagccaggaggg

SEQ ID NO: 1962878 - RNA, 22 nt, Human
ccuugaggggagccaggagggg

SEQ ID NO: 1962879 - RNA, 23 nt, Human
ccuugaccauucuccaccugcca

SEQ ID NO: 1962880 - RNA, 22 nt, Human
ccuugaccauucuccaccugcc

SEQ ID NO: 1962881 - RNA, 13 nt, Human
ccuugacucuuuc

SEQ ID NO: 1962882 - RNA, 20 nt, Human
ccuugaaaacuuuaugcuaa

SEQ ID NO: 1962883 - RNA, 13 nt, Human
ccuugaacuagga

SEQ ID NO: 1962884 - RNA, 22 nt, Human
ccugccaggaagccagcaggcu

SEQ ID NO: 1962885 - RNA, 21 nt, Human
ccugccaggaagccagcaggc

SEQ ID NO: 1962886 - RNA, 19 nt, Human
ccugccaggaagccagcag

SEQ ID NO: 1962887 - RNA, 18 nt, Human
ccugccaggaagccagca

SEQ ID NO: 1962888 - RNA, 11 nt, Human
ccugccaggga

SEQ ID NO: 1962889 - RNA, 16 nt, Human
ccugccaggcauggug

SEQ ID NO: 1962890 - RNA, 23 nt, Human
ccugccaggaagccagcaggcuc

SEQ ID NO: 1962891 - RNA, 15 nt, Human
ccugccagggacaga

SEQ ID NO: 1962892 - RNA, 14 nt, Human
ccugccagggacag

SEQ ID NO: 1962893 - RNA, 13 nt, Human
ccugccagggaca

SEQ ID NO: 1962894 - RNA, 12 nt, Human
ccugccagggac

SEQ ID NO: 1962895 - RNA, 16 nt, Human
ccugccagggacagag

SEQ ID NO: 1962896 - RNA, 22 nt, Human
ccugcaguuccccuggaagcag

SEQ ID NO: 1962897 - RNA, 13 nt, Human
ccugcaguucccc

SEQ ID NO: 1962898 - RNA, 22 nt, Human
ccugccacucaggcccaaagcc

SEQ ID NO: 1962899 - RNA, 23 nt, Human
ccugccacucaggcccaaagccu

SEQ ID NO: 1962900 - RNA, 14 nt, Human
ccugccagaccccc

SEQ ID NO: 1962901 - RNA, 14 nt, Human
ccugccacucaggc

SEQ ID NO: 1962902 - RNA, 17 nt, Human
ccugccaggaagccagc

SEQ ID NO: 1962903 - RNA, 15 nt, Human
ccugccaggaagcca

SEQ ID NO: 1962904 - RNA, 14 nt, Human
ccugccaggaagcc

SEQ ID NO: 1962905 - RNA, 13 nt, Human
ccugccaggaagc

SEQ ID NO: 1962906 - RNA, 14 nt, Human
ccugcaagaacaag

SEQ ID NO: 1962907 - RNA, 18 nt, Human
ccugcaggccaggccagc

SEQ ID NO: 1962908 - RNA, 12 nt, Human
ccugcaggccag

SEQ ID NO: 1962909 - RNA, 16 nt, Human
ccugcaggccaggcca

SEQ ID NO: 1962910 - RNA, 15 nt, Human
ccugcagggccaagc

SEQ ID NO: 1962911 - RNA, 18 nt, Human
ccugcaguacuuuaccuc

SEQ ID NO: 1962912 - RNA, 20 nt, Human
ccugcaguacuuuaccuccu

SEQ ID NO: 1962913 - RNA, 15 nt, Human
ccugauugugucucu

SEQ ID NO: 1962914 - RNA, 14 nt, Human
ccugaggcccuucu

SEQ ID NO: 1962915 - RNA, 22 nt, Human
ccugaugcuucuucagagacuc

SEQ ID NO: 1962916 - RNA, 21 nt, Human
ccugaugcuucuucagagacu

SEQ ID NO: 1962917 - RNA, 20 nt, Human
ccugaugcuucuucagagac

SEQ ID NO: 1962918 - RNA, 19 nt, Human
ccugaugcuucuucagaga

SEQ ID NO: 1962919 - RNA, 12 nt, Human
ccugaggcccuu

SEQ ID NO: 1962920 - RNA, 11 nt, Human
ccugaggcccu

SEQ ID NO: 1962921 - RNA, 19 nt, Human
ccugauugugucucuuggu

SEQ ID NO: 1962922 - RNA, 17 nt, Human
ccugauugugucucuug

SEQ ID NO: 1962923 - RNA, 18 nt, Human
ccugauugguuucucuuc

SEQ ID NO: 1962924 - RNA, 20 nt, Human
ccugauugguuucucuucuc

SEQ ID NO: 1962925 - RNA, 21 nt, Human
ccugcaaccugauugugucuc

SEQ ID NO: 1962926 - RNA, 22 nt, Human
ccugcaaccugauugugucucu

SEQ ID NO: 1962927 - RNA, 15 nt, Human
ccugaggcagguccc

SEQ ID NO: 1962928 - RNA, 11 nt, Human
ccugagcccca

SEQ ID NO: 1962929 - RNA, 12 nt, Human
ccugagcccacu

SEQ ID NO: 1962930 - RNA, 13 nt, Human
ccugagcccacug

SEQ ID NO: 1962931 - RNA, 15 nt, Human
ccugagcccacugug

SEQ ID NO: 1962932 - RNA, 16 nt, Human
ccugagcccacugugc

SEQ ID NO: 1962933 - RNA, 14 nt, Human
ccugagcuuucugc

SEQ ID NO: 1962934 - RNA, 12 nt, Human
ccugagccagau

SEQ ID NO: 1962935 - RNA, 20 nt, Human
ccugagccagauuucacucu

SEQ ID NO: 1962936 - RNA, 11 nt, Human
ccugagcccac

SEQ ID NO: 1962937 - RNA, 21 nt, Human
ccugaggcccagagggccugc

SEQ ID NO: 1962938 - RNA, 20 nt, Human
ccugaggacauggcuucuga

SEQ ID NO: 1962939 - RNA, 18 nt, Human
ccugaggacauggcuucu

SEQ ID NO: 1962940 - RNA, 19 nt, Human
ccugaggaagagggacugu

SEQ ID NO: 1962941 - RNA, 16 nt, Human
ccugagcuuucugcua

SEQ ID NO: 1962942 - RNA, 20 nt, Human
ccugacagccccucccuccu

SEQ ID NO: 1962943 - RNA, 14 nt, Human
ccugacagccagaa

SEQ ID NO: 1962944 - RNA, 20 nt, Human
ccugacagccagaacucugu

SEQ ID NO: 1962945 - RNA, 23 nt, Human
ccugacagagggauggaggaaga

SEQ ID NO: 1962946 - RNA, 13 nt, Human
ccugacagccaga

SEQ ID NO: 1962947 - RNA, 16 nt, Human
ccugacagaaggacuc

SEQ ID NO: 1962948 - RNA, 14 nt, Human
ccugacaccccacu

SEQ ID NO: 1962949 - RNA, 18 nt, Human
ccugacaccccacuuagc

SEQ ID NO: 1962950 - RNA, 23 nt, Human
ccugacaacacucauugaccuga

SEQ ID NO: 1962951 - RNA, 22 nt, Human
ccugcggugcuaucucccccag

SEQ ID NO: 1962952 - RNA, 21 nt, Human
ccugcucagcagugagagcag

SEQ ID NO: 1962953 - RNA, 22 nt, Human
ccugcucagcagugagagcaga

SEQ ID NO: 1962954 - RNA, 21 nt, Human
ccugcucuccgaccagacacc

SEQ ID NO: 1962955 - RNA, 13 nt, Human
ccugcuccuuccc

SEQ ID NO: 1962956 - RNA, 16 nt, Human
ccugcuccuucccuug

SEQ ID NO: 1962957 - RNA, 18 nt, Human
ccugcuccuucccuugcu

SEQ ID NO: 1962958 - RNA, 21 nt, Human
ccugcucgaugcucacagggc

SEQ ID NO: 1962959 - RNA, 22 nt, Human
ccugcucuccgaccagacaccu

SEQ ID NO: 1962960 - RNA, 16 nt, Human
ccugcucuccucuugc

SEQ ID NO: 1962961 - RNA, 18 nt, Human
ccugcucuccucuugcca

SEQ ID NO: 1962962 - RNA, 19 nt, Human
ccugcucuccucuugccac

SEQ ID NO: 1962963 - RNA, 21 nt, Human
ccugcucuccucuugccacug

SEQ ID NO: 1962964 - RNA, 22 nt, Human
ccugcucuccucuugccacugc

SEQ ID NO: 1962965 - RNA, 12 nt, Human
ccugcucugcuc

SEQ ID NO: 1962966 - RNA, 12 nt, Human
ccugcucugcug

SEQ ID NO: 1962967 - RNA, 13 nt, Human
ccugcucugcuga

SEQ ID NO: 1962968 - RNA, 15 nt, Human
ccugcucuuuggccu

SEQ ID NO: 1962969 - RNA, 15 nt, Human
ccuggaagcagugcc

SEQ ID NO: 1962970 - RNA, 16 nt, Human
ccuggaagcagugccc

SEQ ID NO: 1962971 - RNA, 17 nt, Human
ccuggaagcagugccca

SEQ ID NO: 1962972 - RNA, 18 nt, Human
ccuggaagcagugcccag

SEQ ID NO: 1962973 - RNA, 19 nt, Human
ccuggaagcagugcccagg

SEQ ID NO: 1962974 - RNA, 20 nt, Human
ccuggaagcagugcccaggu

SEQ ID NO: 1962975 - RNA, 23 nt, Human
ccuggaagcagugcccagguggc

SEQ ID NO: 1962976 - RNA, 14 nt, Human
ccugcuucaaauau

SEQ ID NO: 1962977 - RNA, 21 nt, Human
ccugcuguuuaucccuuaaga

SEQ ID NO: 1962978 - RNA, 17 nt, Human
ccugcuucagccuccca

SEQ ID NO: 1962979 - RNA, 20 nt, Human
ccugcuucagccucccacag

SEQ ID NO: 1962980 - RNA, 15 nt, Human
ccugcugagucccag

SEQ ID NO: 1962981 - RNA, 20 nt, Human
ccugcuuugggcugcccugg

SEQ ID NO: 1962982 - RNA, 19 nt, Human
ccugcuuugggcugcccug

SEQ ID NO: 1962983 - RNA, 23 nt, Human
ccugcuucagccucccacagugc

SEQ ID NO: 1962984 - RNA, 21 nt, Human
ccugcuuugggcugcccuggu

SEQ ID NO: 1962985 - RNA, 22 nt, Human
ccugcuuugggcugcccuggug

SEQ ID NO: 1962986 - RNA, 23 nt, Human
ccugcuuugggcugcccuggugc

SEQ ID NO: 1962987 - RNA, 22 nt, Human
ccugcuuugucuccucuauccu

SEQ ID NO: 1962988 - RNA, 18 nt, Human
ccugccugguccucacac

SEQ ID NO: 1962989 - RNA, 23 nt, Human
ccugccuguugggccaggagccu

SEQ ID NO: 1962990 - RNA, 14 nt, Human
ccugccuuaaguga

SEQ ID NO: 1962991 - RNA, 11 nt, Human
ccugccucagc

SEQ ID NO: 1962992 - RNA, 22 nt, Human
ccugccccucaacucuccucca

SEQ ID NO: 1962993 - RNA, 20 nt, Human
ccugcgccaccgcccagaga

SEQ ID NO: 1962994 - RNA, 17 nt, Human
ccugcgaggcuaugagu

SEQ ID NO: 1962995 - RNA, 21 nt, Human
ccugccuugcccacuccugcu

SEQ ID NO: 1962996 - RNA, 17 nt, Human
ccugcggugcuaucucc

SEQ ID NO: 1962997 - RNA, 16 nt, Human
ccugcggugcuaucuc

SEQ ID NO: 1962998 - RNA, 21 nt, Human
ccugcgcgggaccaucuggaa

SEQ ID NO: 1962999 - RNA, 18 nt, Human
ccugcgggucacaggagg

SEQ ID NO: 1963000 - RNA, 22 nt, Human
ccugcgggucacaggagggagg

SEQ ID NO: 1963001 - RNA, 21 nt, Human
ccuggcugggacugggaacag

SEQ ID NO: 1963002 - RNA, 18 nt, Human
ccuggcugggacugggaa

SEQ ID NO: 1963003 - RNA, 13 nt, Human
ccuggcuuccuua

SEQ ID NO: 1963004 - RNA, 15 nt, Human
ccuggcuuccuuacu

SEQ ID NO: 1963005 - RNA, 20 nt, Human
ccuggcuuuucacugcuggc

SEQ ID NO: 1963006 - RNA, 18 nt, Human
ccuggcuuuucacugcug

SEQ ID NO: 1963007 - RNA, 21 nt, Human
ccuggcuuuucacugcuggcu

SEQ ID NO: 1963008 - RNA, 22 nt, Human
ccuggcuuuucacugcuggcug

SEQ ID NO: 1963009 - RNA, 23 nt, Human
ccuggcuuuucacugcuggcugc

SEQ ID NO: 1963010 - RNA, 24 nt, Human
ccuggcuuuucacugcuggcugcc

SEQ ID NO: 1963011 - RNA, 18 nt, Human
ccuggggguucuuucuuc

SEQ ID NO: 1963012 - RNA, 21 nt, Human
ccuggggguucuuucuuccuc

SEQ ID NO: 1963013 - RNA, 22 nt, Human
ccuggggguucuuucuuccucu

SEQ ID NO: 1963014 - RNA, 23 nt, Human
ccuggggguucuuucuuccucug

SEQ ID NO: 1963015 - RNA, 15 nt, Human
ccuggguccccagcc

SEQ ID NO: 1963016 - RNA, 14 nt, Human
ccugguaagaaaaa

SEQ ID NO: 1963017 - RNA, 15 nt, Human
ccugguaagaaaaag

SEQ ID NO: 1963018 - RNA, 19 nt, Human
ccugguaagaaaaagcaaa

SEQ ID NO: 1963019 - RNA, 12 nt, Human
ccuggucagccc

SEQ ID NO: 1963020 - RNA, 14 nt, Human
ccuggucagcccaa

SEQ ID NO: 1963021 - RNA, 20 nt, Human
ccuggucagggugagcccau

SEQ ID NO: 1963022 - RNA, 22 nt, Human
ccuggucacaggacucugccuc

SEQ ID NO: 1963023 - RNA, 23 nt, Human
ccuggucacaggacucugccucc

SEQ ID NO: 1963024 - RNA, 21 nt, Human
ccuggucacaggacucugccu

SEQ ID NO: 1963025 - RNA, 16 nt, Human
ccuggcuccaggccag

SEQ ID NO: 1963026 - RNA, 17 nt, Human
ccuggcuccaggccagg

SEQ ID NO: 1963027 - RNA, 15 nt, Human
ccuggcuccaggcca

SEQ ID NO: 1963028 - RNA, 18 nt, Human
ccuggcugcagccugcgc

SEQ ID NO: 1963029 - RNA, 23 nt, Human
ccuggcucccacaggcccuuccu

SEQ ID NO: 1963030 - RNA, 17 nt, Human
ccuggcucccacaggcc

SEQ ID NO: 1963031 - RNA, 22 nt, Human
ccuggcugcggggcgggcacac

SEQ ID NO: 1963032 - RNA, 15 nt, Human
ccuggccagaugcac

SEQ ID NO: 1963033 - RNA, 21 nt, Human
ccuggcagccgugccuucagc

SEQ ID NO: 1963034 - RNA, 22 nt, Human
ccuggcagccgugccuucagcu

SEQ ID NO: 1963035 - RNA, 13 nt, Human
ccuggcagccccu

SEQ ID NO: 1963036 - RNA, 12 nt, Human
ccuggcagcccc

SEQ ID NO: 1963037 - RNA, 22 nt, Human
ccuggcacccggccccugcugg

SEQ ID NO: 1963038 - RNA, 22 nt, Human
ccuggcacuauaauguaagcuc

SEQ ID NO: 1963039 - RNA, 23 nt, Human
ccuggcacccggccccugcuggu

SEQ ID NO: 1963040 - RNA, 18 nt, Human
ccuggaauauauaaccag

SEQ ID NO: 1963041 - RNA, 17 nt, Human
ccuggaaggcccagcac

SEQ ID NO: 1963042 - RNA, 18 nt, Human
ccuggaaggcccagcacc

SEQ ID NO: 1963043 - RNA, 19 nt, Human
ccuggagacuaaccccacc

SEQ ID NO: 1963044 - RNA, 13 nt, Human
ccacguuucuaaa

SEQ ID NO: 1963045 - RNA, 17 nt, Human
ccacgugcguguuuucu

SEQ ID NO: 1963046 - RNA, 13 nt, Human
ccacguuuugaaa

SEQ ID NO: 1963047 - RNA, 13 nt, Human
ccacucccugcaa

SEQ ID NO: 1963048 - RNA, 12 nt, Human
ccacucccugca

SEQ ID NO: 1963049 - RNA, 17 nt, Human
ccacuccagaccccugg

SEQ ID NO: 1963050 - RNA, 19 nt, Human
ccacuccagaccccuggcu

SEQ ID NO: 1963051 - RNA, 18 nt, Human
ccacuaagaacaccugca

SEQ ID NO: 1963052 - RNA, 19 nt, Human
ccacuccccagccagccug

SEQ ID NO: 1963053 - RNA, 22 nt, Human
ccacuccccagccagccuggcu

SEQ ID NO: 1963054 - RNA, 16 nt, Human
ccacuccaagccagca

SEQ ID NO: 1963055 - RNA, 14 nt, Human
ccacuccaagccag

SEQ ID NO: 1963056 - RNA, 16 nt, Human
ccacuaccccuugauu

SEQ ID NO: 1963057 - RNA, 13 nt, Human
ccacucaagacca

SEQ ID NO: 1963058 - RNA, 15 nt, Human
ccacucaagaccaaa

SEQ ID NO: 1963059 - RNA, 17 nt, Human
ccacucaagaccaaaug

SEQ ID NO: 1963060 - RNA, 20 nt, Human
ccacucaagaccaaauggaa

SEQ ID NO: 1963061 - RNA, 23 nt, Human
ccacucaagaccaaauggaaaca

SEQ ID NO: 1963062 - RNA, 23 nt, Human
ccacuacggaauaguuggcuagg

SEQ ID NO: 1963063 - RNA, 18 nt, Human
ccacuacauucuguuaau

SEQ ID NO: 1963064 - RNA, 22 nt, Human
ccacuacggaauaguuggcuag

SEQ ID NO: 1963065 - RNA, 20 nt, Human
ccacugcacuccagccuggg

SEQ ID NO: 1963066 - RNA, 19 nt, Human
ccacugcacuccagccugg

SEQ ID NO: 1963067 - RNA, 15 nt, Human
ccacucccugcaacc

SEQ ID NO: 1963068 - RNA, 18 nt, Human
ccacugcacuccagccug

SEQ ID NO: 1963069 - RNA, 23 nt, Human
ccacugcacuccagccuggguga

SEQ ID NO: 1963070 - RNA, 15 nt, Human
ccacugcccacuggc

SEQ ID NO: 1963071 - RNA, 16 nt, Human
ccacugcccacuggcc

SEQ ID NO: 1963072 - RNA, 17 nt, Human
ccacugcccacuggccg

SEQ ID NO: 1963073 - RNA, 16 nt, Human
ccacugcgaccacaag

SEQ ID NO: 1963074 - RNA, 11 nt, Human
ccacugccucu

SEQ ID NO: 1963075 - RNA, 15 nt, Human
ccacccuccacucuc

SEQ ID NO: 1963076 - RNA, 19 nt, Human
ccacccgugguggcucaag

SEQ ID NO: 1963077 - RNA, 19 nt, Human
ccaccccucaacaccucug

SEQ ID NO: 1963078 - RNA, 16 nt, Human
ccacccgccccugccc

SEQ ID NO: 1963079 - RNA, 17 nt, Human
ccacccgguucaguguu

SEQ ID NO: 1963080 - RNA, 20 nt, Human
ccacccgguucaguguuucu

SEQ ID NO: 1963081 - RNA, 17 nt, Human
ccacccugaaagcccug

SEQ ID NO: 1963082 - RNA, 16 nt, Human
ccacccugaaagcccu

SEQ ID NO: 1963083 - RNA, 18 nt, Human
ccacccugaaagcccuga

SEQ ID NO: 1963084 - RNA, 12 nt, Human
ccaccucagccu

SEQ ID NO: 1963085 - RNA, 13 nt, Human
ccaccucagccuc

SEQ ID NO: 1963086 - RNA, 14 nt, Human
ccaccucagccucc

SEQ ID NO: 1963087 - RNA, 15 nt, Human
ccaccucagccuccc

SEQ ID NO: 1963088 - RNA, 12 nt, Human
ccacccaggagc

SEQ ID NO: 1963089 - RNA, 14 nt, Human
ccacccaggagccc

SEQ ID NO: 1963090 - RNA, 17 nt, Human
ccaccucccacaaagga

SEQ ID NO: 1963091 - RNA, 18 nt, Human
ccaccucccccacuccca

SEQ ID NO: 1963092 - RNA, 14 nt, Human
ccaccuccccuugc

SEQ ID NO: 1963093 - RNA, 15 nt, Human
ccaccuccccuugcc

SEQ ID NO: 1963094 - RNA, 17 nt, Human
ccaccuccccuugccag

SEQ ID NO: 1963095 - RNA, 18 nt, Human
ccaccuccccuugccagc

SEQ ID NO: 1963096 - RNA, 19 nt, Human
ccaccuccccuugccagcu

SEQ ID NO: 1963097 - RNA, 20 nt, Human
ccaccuccccuugccagcug

SEQ ID NO: 1963098 - RNA, 16 nt, Human
ccaccugccagggaca

SEQ ID NO: 1963099 - RNA, 14 nt, Human
ccaccugaguuccu

SEQ ID NO: 1963100 - RNA, 15 nt, Human
ccaccugaguuccug

SEQ ID NO: 1963101 - RNA, 14 nt, Human
ccaccugcccaacc

SEQ ID NO: 1963102 - RNA, 16 nt, Human
ccaccugaguuccuga

SEQ ID NO: 1963103 - RNA, 12 nt, Human
ccaccugcagcu

SEQ ID NO: 1963104 - RNA, 15 nt, Human
ccaccugcagcuccc

SEQ ID NO: 1963105 - RNA, 17 nt, Human
ccaccugcagcucccuc

SEQ ID NO: 1963106 - RNA, 20 nt, Human
ccaccugccuguugggccag

SEQ ID NO: 1963107 - RNA, 17 nt, Human
ccaccugccuguugggc

SEQ ID NO: 1963108 - RNA, 12 nt, Human
ccacggccaggc

SEQ ID NO: 1963109 - RNA, 13 nt, Human
ccacggccaggcc

SEQ ID NO: 1963110 - RNA, 14 nt, Human
ccacggccaggcca

SEQ ID NO: 1963111 - RNA, 15 nt, Human
ccacggccaggccag

SEQ ID NO: 1963112 - RNA, 23 nt, Human
ccacgucuauuucaucagaacag

SEQ ID NO: 1963113 - RNA, 16 nt, Human
ccaccuggccucugca

SEQ ID NO: 1963114 - RNA, 15 nt, Human
ccaccuggccucugc

SEQ ID NO: 1963115 - RNA, 22 nt, Human
ccaccugcggugcuaucucccc

SEQ ID NO: 1963116 - RNA, 14 nt, Human
ccaccugcucugcu

SEQ ID NO: 1963117 - RNA, 14 nt, Human
ccaccuggccucug

SEQ ID NO: 1963118 - RNA, 17 nt, Human
ccaccuggccucugcac

SEQ ID NO: 1963119 - RNA, 19 nt, Human
ccacccaagggccuggccu

SEQ ID NO: 1963120 - RNA, 17 nt, Human
ccacccaagggccuggc

SEQ ID NO: 1963121 - RNA, 16 nt, Human
ccacccaagggccugg

SEQ ID NO: 1963122 - RNA, 22 nt, Human
ccaccaagccuggucagcccaa

SEQ ID NO: 1963123 - RNA, 20 nt, Human
ccaccaacauacucccaucu

SEQ ID NO: 1963124 - RNA, 14 nt, Human
ccaccacacccagc

SEQ ID NO: 1963125 - RNA, 16 nt, Human
ccaccacacccagccc

SEQ ID NO: 1963126 - RNA, 16 nt, Human
ccacccaccucagccu

SEQ ID NO: 1963127 - RNA, 14 nt, Human
ccacccaccucagc

SEQ ID NO: 1963128 - RNA, 15 nt, Human
ccacccaccucagcc

SEQ ID NO: 1963129 - RNA, 21 nt, Human
ccacccaagggccuggccuga

SEQ ID NO: 1963130 - RNA, 20 nt, Human
ccacccaagggccuggccug

SEQ ID NO: 1963131 - RNA, 22 nt, Human
ccacccaagggccuggccugag

SEQ ID NO: 1963132 - RNA, 13 nt, Human
ccacccaccucag

SEQ ID NO: 1963133 - RNA, 22 nt, Human
ccacacugauccagcccugagu

SEQ ID NO: 1963134 - RNA, 19 nt, Human
ccacacugauccagcccug

SEQ ID NO: 1963135 - RNA, 19 nt, Human
ccacauagugaugguuccc

SEQ ID NO: 1963136 - RNA, 21 nt, Human
ccacauagugaugguuccccu

SEQ ID NO: 1963137 - RNA, 22 nt, Human
ccacauagugaugguuccccug

SEQ ID NO: 1963138 - RNA, 23 nt, Human
ccacauagugaugguuccccugu

SEQ ID NO: 1963139 - RNA, 14 nt, Human
ccacaucuugcucu

SEQ ID NO: 1963140 - RNA, 18 nt, Human
ccaccaacauacucccau

SEQ ID NO: 1963141 - RNA, 14 nt, Human
ccaccaacauacuc

SEQ ID NO: 1963142 - RNA, 16 nt, Human
ccacaugccaggggcc

SEQ ID NO: 1963143 - RNA, 16 nt, Human
ccacaucuugcucugc

SEQ ID NO: 1963144 - RNA, 22 nt, Human
ccacaucuugcucugcugacag

SEQ ID NO: 1963145 - RNA, 23 nt, Human
ccacaucuugcucugcugacaga

SEQ ID NO: 1963146 - RNA, 20 nt, Human
ccaaaccaccagaagcccag

SEQ ID NO: 1963147 - RNA, 16 nt, Human
ccaaacccacccuuuc

SEQ ID NO: 1963148 - RNA, 20 nt, Human
ccaaacccacccuuucuacu

SEQ ID NO: 1963149 - RNA, 16 nt, Human
ccaaacccccauucug

SEQ ID NO: 1963150 - RNA, 19 nt, Human
ccaaacccccauucugucc

SEQ ID NO: 1963151 - RNA, 12 nt, Human
ccacacccagcc

SEQ ID NO: 1963152 - RNA, 13 nt, Human
ccacacccagccc

SEQ ID NO: 1963153 - RNA, 14 nt, Human
ccacacccagccca

SEQ ID NO: 1963154 - RNA, 13 nt, Human
ccacacuccagcu

SEQ ID NO: 1963155 - RNA, 14 nt, Human
ccacacuccagcug

SEQ ID NO: 1963156 - RNA, 17 nt, Human
ccacacuccagcuggga

SEQ ID NO: 1963157 - RNA, 12 nt, Human
ccagauuucacu

SEQ ID NO: 1963158 - RNA, 22 nt, Human
ccagauuuaugcauauuauuuu

SEQ ID NO: 1963159 - RNA, 13 nt, Human
ccagauuuaugca

SEQ ID NO: 1963160 - RNA, 21 nt, Human
ccagauugcaacaggcugggc

SEQ ID NO: 1963161 - RNA, 23 nt, Human
ccagauucuuuccugaggcuggg

SEQ ID NO: 1963162 - RNA, 19 nt, Human
ccagauugcaacaggcugg

SEQ ID NO: 1963163 - RNA, 20 nt, Human
ccagauugcaacaggcuggg

SEQ ID NO: 1963164 - RNA, 22 nt, Human
ccagauucuuuccugaggcugg

SEQ ID NO: 1963165 - RNA, 21 nt, Human
ccagauucuuuccugaggcug

SEQ ID NO: 1963166 - RNA, 20 nt, Human
ccagauucuuuccugaggcu

SEQ ID NO: 1963167 - RNA, 19 nt, Human
ccagauucuuuccugaggc

SEQ ID NO: 1963168 - RNA, 18 nt, Human
ccagaugugacaguguug

SEQ ID NO: 1963169 - RNA, 18 nt, Human
ccagauucuuuccugagg

SEQ ID NO: 1963170 - RNA, 22 nt, Human
ccagauggcuggaaggggucca

SEQ ID NO: 1963171 - RNA, 23 nt, Human
ccagaugcaccagcccuuagcag

SEQ ID NO: 1963172 - RNA, 16 nt, Human
ccagagggccugcaag

SEQ ID NO: 1963173 - RNA, 15 nt, Human
ccagagggccugcaa

SEQ ID NO: 1963174 - RNA, 13 nt, Human
ccagagggccugc

SEQ ID NO: 1963175 - RNA, 22 nt, Human
ccagagggagugacagaggcag

SEQ ID NO: 1963176 - RNA, 23 nt, Human
ccagagggagugacagaggcagc

SEQ ID NO: 1963177 - RNA, 12 nt, Human
ccagacccccug

SEQ ID NO: 1963178 - RNA, 16 nt, Human
ccagacccccuggaga

SEQ ID NO: 1963179 - RNA, 20 nt, Human
ccagacaccuugacagggca

SEQ ID NO: 1963180 - RNA, 21 nt, Human
ccagagaggguggugaccucu

SEQ ID NO: 1963181 - RNA, 23 nt, Human
ccagagaggguggugaccucugc

SEQ ID NO: 1963182 - RNA, 18 nt, Human
ccagacccccuggagacu

SEQ ID NO: 1963183 - RNA, 14 nt, Human
ccagagaggguggu

SEQ ID NO: 1963184 - RNA, 20 nt, Human
ccacuguacuugcucuugau

SEQ ID NO: 1963185 - RNA, 17 nt, Human
ccagacaccuugacagg

SEQ ID NO: 1963186 - RNA, 19 nt, Human
ccagacaccuugacagggc

SEQ ID NO: 1963187 - RNA, 19 nt, Human
ccacuguacuugcucuuga

SEQ ID NO: 1963188 - RNA, 18 nt, Human
ccacuguacuugcucuug

SEQ ID NO: 1963189 - RNA, 17 nt, Human
ccacuguacuugcucuu

SEQ ID NO: 1963190 - RNA, 13 nt, Human
ccagagcugccac

SEQ ID NO: 1963191 - RNA, 12 nt, Human
ccagagcugcca

SEQ ID NO: 1963192 - RNA, 11 nt, Human
ccagagcugcc

SEQ ID NO: 1963193 - RNA, 19 nt, Human
ccagagcugccaccugccu

SEQ ID NO: 1963194 - RNA, 16 nt, Human
ccagagcugccaccug

SEQ ID NO: 1963195 - RNA, 15 nt, Human
ccagagcugccaccu

SEQ ID NO: 1963196 - RNA, 14 nt, Human
ccagagcugccacc

SEQ ID NO: 1963197 - RNA, 13 nt, Human
ccagagcugccag

SEQ ID NO: 1963198 - RNA, 14 nt, Human
ccagagcugccagu

SEQ ID NO: 1963199 - RNA, 23 nt, Human
ccagagcugcuuccccgucaccu

SEQ ID NO: 1963200 - RNA, 16 nt, Human
ccagagggagugacag

SEQ ID NO: 1963201 - RNA, 17 nt, Human
ccagagggagugacaga

SEQ ID NO: 1963202 - RNA, 18 nt, Human
ccagagggagugacagag

SEQ ID NO: 1963203 - RNA, 19 nt, Human
ccagagggagugacagagg

SEQ ID NO: 1963204 - RNA, 20 nt, Human
ccagagggagugacagaggc

SEQ ID NO: 1963205 - RNA, 21 nt, Human
ccagagggagugacagaggca

SEQ ID NO: 1963206 - RNA, 21 nt, Human
ccagaggagagaggacccccu

SEQ ID NO: 1963207 - RNA, 22 nt, Human
ccagaggagagaggacccccug

SEQ ID NO: 1963208 - RNA, 16 nt, Human
ccagcaagugagagcu

SEQ ID NO: 1963209 - RNA, 20 nt, Human
ccagcaagugagagcugggu

SEQ ID NO: 1963210 - RNA, 21 nt, Human
ccagcaagugagagcugggug

SEQ ID NO: 1963211 - RNA, 22 nt, Human
ccagcaagugagagcugggugu

SEQ ID NO: 1963212 - RNA, 19 nt, Human
ccagcaauucuccugccuc

SEQ ID NO: 1963213 - RNA, 20 nt, Human
ccagcaauucuccugccuca

SEQ ID NO: 1963214 - RNA, 21 nt, Human
ccagcaauucuccugccucag

SEQ ID NO: 1963215 - RNA, 16 nt, Human
ccagcaauucuccugc

SEQ ID NO: 1963216 - RNA, 18 nt, Human
ccagcaauucuccugccu

SEQ ID NO: 1963217 - RNA, 14 nt, Human
ccagauuucacucu

SEQ ID NO: 1963218 - RNA, 15 nt, Human
ccagcaagugagagc

SEQ ID NO: 1963219 - RNA, 19 nt, Human
ccagccgccaugcuccugg

SEQ ID NO: 1963220 - RNA, 18 nt, Human
ccagccgccaugcuccug

SEQ ID NO: 1963221 - RNA, 23 nt, Human
ccagccgagauagccaaggccaa

SEQ ID NO: 1963222 - RNA, 18 nt, Human
ccagcccuuccucugcuc

SEQ ID NO: 1963223 - RNA, 14 nt, Human
ccagccgccaugcu

SEQ ID NO: 1963224 - RNA, 21 nt, Human
ccagccuccaagcuccaucuc

SEQ ID NO: 1963225 - RNA, 23 nt, Human
ccagccucaaauccaggacccug

SEQ ID NO: 1963226 - RNA, 17 nt, Human
ccagccucaaauccagg

SEQ ID NO: 1963227 - RNA, 18 nt, Human
ccagccucaaauccagga

SEQ ID NO: 1963228 - RNA, 19 nt, Human
ccagccucaaauccaggac

SEQ ID NO: 1963229 - RNA, 20 nt, Human
ccagccucaaauccaggacc

SEQ ID NO: 1963230 - RNA, 16 nt, Human
ccagccccagugccca

SEQ ID NO: 1963231 - RNA, 16 nt, Human
ccagcccuuagcaggg

SEQ ID NO: 1963232 - RNA, 21 nt, Human
ccagcccuccuuaucaaagga

SEQ ID NO: 1963233 - RNA, 17 nt, Human
ccagcccuuagcaggga

SEQ ID NO: 1963234 - RNA, 13 nt, Human
ccagcccuuccuc

SEQ ID NO: 1963235 - RNA, 15 nt, Human
ccagcccuuccucug

SEQ ID NO: 1963236 - RNA, 17 nt, Human
ccagcccuuccucugcu

SEQ ID NO: 1963237 - RNA, 23 nt, Human
ccagccccaaaacucuccucugc

SEQ ID NO: 1963238 - RNA, 13 nt, Human
ccagccccagugc

SEQ ID NO: 1963239 - RNA, 15 nt, Human
ccagccccagugccc

SEQ ID NO: 1963240 - RNA, 19 nt, Human
ccagccccacccuguuuug

SEQ ID NO: 1963241 - RNA, 18 nt, Human
ccagcaucgcacucuggc

SEQ ID NO: 1963242 - RNA, 23 nt, Human
ccagcauaauacuugcuuuggaa

SEQ ID NO: 1963243 - RNA, 17 nt, Human
ccagcagucugccugga

SEQ ID NO: 1963244 - RNA, 19 nt, Human
ccagccaaagccuccucca

SEQ ID NO: 1963245 - RNA, 18 nt, Human
ccagccaaagccuccucc

SEQ ID NO: 1963246 - RNA, 15 nt, Human
ccagccaaagccucc

SEQ ID NO: 1963247 - RNA, 16 nt, Human
ccagccaaacacacag

SEQ ID NO: 1963248 - RNA, 18 nt, Human
ccagccaaacacacagaa

SEQ ID NO: 1963249 - RNA, 20 nt, Human
ccagccaaacacacagaagg

SEQ ID NO: 1963250 - RNA, 21 nt, Human
ccagccaaacacacagaaggg

SEQ ID NO: 1963251 - RNA, 14 nt, Human
ccagccagccuggc

SEQ ID NO: 1963252 - RNA, 16 nt, Human
ccagccagccuggcug

SEQ ID NO: 1963253 - RNA, 16 nt, Human
ccagccacuccccagc

SEQ ID NO: 1963254 - RNA, 22 nt, Human
ccagccacuccccagccagccu

SEQ ID NO: 1963255 - RNA, 19 nt, Human
ccauauucuguuggccagu

SEQ ID NO: 1963256 - RNA, 14 nt, Human
ccaucuaaacugcc

SEQ ID NO: 1963257 - RNA, 21 nt, Human
ccaugggaaaugucaacaagu

SEQ ID NO: 1963258 - RNA, 22 nt, Human
ccauggccggcuuucaggagcu

SEQ ID NO: 1963259 - RNA, 18 nt, Human
ccauggccggcuuucagg

SEQ ID NO: 1963260 - RNA, 21 nt, Human
ccauggccggcuuucaggagc

SEQ ID NO: 1963261 - RNA, 15 nt, Human
ccaucuaaacugccc

SEQ ID NO: 1963262 - RNA, 16 nt, Human
ccaucuaaacugcccc

SEQ ID NO: 1963263 - RNA, 15 nt, Human
ccaucuaaaaauaua

SEQ ID NO: 1963264 - RNA, 16 nt, Human
ccaugggacagggagg

SEQ ID NO: 1963265 - RNA, 19 nt, Human
ccaugggacagggaggacg

SEQ ID NO: 1963266 - RNA, 17 nt, Human
ccaugggaggcuggagu

SEQ ID NO: 1963267 - RNA, 17 nt, Human
ccauguuggccaggcug

SEQ ID NO: 1963268 - RNA, 16 nt, Human
ccauguuggccaggcu

SEQ ID NO: 1963269 - RNA, 18 nt, Human
ccauguuggccaggcugc

SEQ ID NO: 1963270 - RNA, 20 nt, Human
ccauguuggccaggcugcuc

SEQ ID NO: 1963271 - RNA, 21 nt, Human
ccauguuggccaggcugcucu

SEQ ID NO: 1963272 - RNA, 23 nt, Human
ccauguuggccaggcugcucuca

SEQ ID NO: 1963273 - RNA, 12 nt, Human
ccauguuucugu

SEQ ID NO: 1963274 - RNA, 18 nt, Human
ccauucuccaccugccag

SEQ ID NO: 1963275 - RNA, 18 nt, Human
cccaaaacucuccucugc

SEQ ID NO: 1963276 - RNA, 16 nt, Human
cccaaaacucuccucu

SEQ ID NO: 1963277 - RNA, 21 nt, Human
cccaaaacaccggguuccagc

SEQ ID NO: 1963278 - RNA, 20 nt, Human
cccaaaacucuccucugcug

SEQ ID NO: 1963279 - RNA, 13 nt, Human
cccaaagugcugg

SEQ ID NO: 1963280 - RNA, 15 nt, Human
cccaaagugcuggga

SEQ ID NO: 1963281 - RNA, 19 nt, Human
cccaaaacaccggguucca

SEQ ID NO: 1963282 - RNA, 14 nt, Human
ccauuuguguuuau

SEQ ID NO: 1963283 - RNA, 17 nt, Human
ccauuugggcagagagg

SEQ ID NO: 1963284 - RNA, 20 nt, Human
ccauucuccaccugccaggg

SEQ ID NO: 1963285 - RNA, 19 nt, Human
ccauucuccaccugccagg

SEQ ID NO: 1963286 - RNA, 15 nt, Human
cccaacccuggcacc

SEQ ID NO: 1963287 - RNA, 21 nt, Human
cccaaccucuuccuccugaca

SEQ ID NO: 1963288 - RNA, 23 nt, Human
cccaaccucuuccuccugacacc

SEQ ID NO: 1963289 - RNA, 14 nt, Human
cccaaccucuuccu

SEQ ID NO: 1963290 - RNA, 18 nt, Human
cccaaccucuuccuccug

SEQ ID NO: 1963291 - RNA, 19 nt, Human
cccaaccucuuccuccuga

SEQ ID NO: 1963292 - RNA, 22 nt, Human
cccaaugagacucuagggucca

SEQ ID NO: 1963293 - RNA, 23 nt, Human
cccaaucccagcuaccucaacca

SEQ ID NO: 1963294 - RNA, 12 nt, Human
cccaaucccuga

SEQ ID NO: 1963295 - RNA, 17 nt, Human
cccaaggcucugagcaa

SEQ ID NO: 1963296 - RNA, 19 nt, Human
cccaaggcccccugccugc

SEQ ID NO: 1963297 - RNA, 22 nt, Human
cccaaggcccccugccugcccu

SEQ ID NO: 1963298 - RNA, 22 nt, Human
cccaaauggaaaugggcagagc

SEQ ID NO: 1963299 - RNA, 18 nt, Human
cccaaauggaaaugggca

SEQ ID NO: 1963300 - RNA, 16 nt, Human
cccaaagugcugggau

SEQ ID NO: 1963301 - RNA, 13 nt, Human
ccaucuacccucc

SEQ ID NO: 1963302 - RNA, 20 nt, Human
ccagugccgagaaggaagcc

SEQ ID NO: 1963303 - RNA, 22 nt, Human
ccagugguuccuaauccucuag

SEQ ID NO: 1963304 - RNA, 15 nt, Human
ccagugaggcucugc

SEQ ID NO: 1963305 - RNA, 14 nt, Human
ccagugaggcucug

SEQ ID NO: 1963306 - RNA, 16 nt, Human
ccagugaggcucugcc

SEQ ID NO: 1963307 - RNA, 18 nt, Human
ccaguguccauggacuca

SEQ ID NO: 1963308 - RNA, 22 nt, Human
ccaguguuguggauuuaacaga

SEQ ID NO: 1963309 - RNA, 12 nt, Human
ccauaggucacc

SEQ ID NO: 1963310 - RNA, 14 nt, Human
ccauaggcccuuuc

SEQ ID NO: 1963311 - RNA, 12 nt, Human
ccauaggcccuu

SEQ ID NO: 1963312 - RNA, 23 nt, Human
ccauauucuguuggccaguguga

SEQ ID NO: 1963313 - RNA, 21 nt, Human
ccauaguaugggacuggccuc

SEQ ID NO: 1963314 - RNA, 15 nt, Human
ccauagcuguggugu

SEQ ID NO: 1963315 - RNA, 23 nt, Human
ccaguuacuuuccaauucuccuu

SEQ ID NO: 1963316 - RNA, 15 nt, Human
ccagccuccaugcug

SEQ ID NO: 1963317 - RNA, 16 nt, Human
ccagccuccaugcugc

SEQ ID NO: 1963318 - RNA, 15 nt, Human
ccaggccagcugccu

SEQ ID NO: 1963319 - RNA, 21 nt, Human
ccaggcauuccccaggaggcc

SEQ ID NO: 1963320 - RNA, 19 nt, Human
ccaggcauuccccaggagg

SEQ ID NO: 1963321 - RNA, 18 nt, Human
ccaggcauuccccaggag

SEQ ID NO: 1963322 - RNA, 17 nt, Human
ccaggcauuccccagga

SEQ ID NO: 1963323 - RNA, 16 nt, Human
ccaggagccccgaggc

SEQ ID NO: 1963324 - RNA, 19 nt, Human
ccaggagccccgaggccuu

SEQ ID NO: 1963325 - RNA, 12 nt, Human
ccaggagccucc

SEQ ID NO: 1963326 - RNA, 20 nt, Human
ccaggagccccgaggccuuc

SEQ ID NO: 1963327 - RNA, 16 nt, Human
ccaggagccugcccag

SEQ ID NO: 1963328 - RNA, 17 nt, Human
ccaggagccugcccagc

SEQ ID NO: 1963329 - RNA, 19 nt, Human
ccaggccagggggccaguc

SEQ ID NO: 1963330 - RNA, 21 nt, Human
ccaggcccucugcccacuccc

SEQ ID NO: 1963331 - RNA, 20 nt, Human
ccaggcccucugcccacucc

SEQ ID NO: 1963332 - RNA, 23 nt, Human
ccaggcccucugcccacucccug

SEQ ID NO: 1963333 - RNA, 22 nt, Human
ccaggcccucugcccacucccu

SEQ ID NO: 1963334 - RNA, 19 nt, Human
ccaggcgccccuucccccu

SEQ ID NO: 1963335 - RNA, 18 nt, Human
ccaggcgccccuuccccc

SEQ ID NO: 1963336 - RNA, 16 nt, Human
ccaggccuacuccugu

SEQ ID NO: 1963337 - RNA, 17 nt, Human
ccaggcuuagucacuga

SEQ ID NO: 1963338 - RNA, 24 nt, Human
ccaggcuguaucccaugagccuca

SEQ ID NO: 1963339 - RNA, 17 nt, Human
ccaggccuacuccuguc

SEQ ID NO: 1963340 - RNA, 16 nt, Human
ccaggcgcuagcacag

SEQ ID NO: 1963341 - RNA, 23 nt, Human
ccaggcgcuagcacagcucccuu

SEQ ID NO: 1963342 - RNA, 24 nt, Human
ccaggugcacaagcuccaagcucc

SEQ ID NO: 1963343 - RNA, 15 nt, Human
ccagguuccacagag

SEQ ID NO: 1963344 - RNA, 18 nt, Human
ccagguuccacagaggac

SEQ ID NO: 1963345 - RNA, 15 nt, Human
ccagguucagcuugu

SEQ ID NO: 1963346 - RNA, 17 nt, Human
ccagguuuuuggucuga

SEQ ID NO: 1963347 - RNA, 18 nt, Human
ccagucuggaaugcagug

SEQ ID NO: 1963348 - RNA, 19 nt, Human
ccagucuggaaugcagugg

SEQ ID NO: 1963349 - RNA, 20 nt, Human
ccagucuggaaugcaguggu

SEQ ID NO: 1963350 - RNA, 13 nt, Human
ccagggccagaag

SEQ ID NO: 1963351 - RNA, 21 nt, Human
ccagggcuggaaugauuucag

SEQ ID NO: 1963352 - RNA, 19 nt, Human
ccaggguuggcaccuuccc

SEQ ID NO: 1963353 - RNA, 21 nt, Human
ccaggguuggcaccuuccccc

SEQ ID NO: 1963354 - RNA, 18 nt, Human
ccaggugcacaagcucca

SEQ ID NO: 1963355 - RNA, 20 nt, Human
ccaggugcacaagcuccaag

SEQ ID NO: 1963356 - RNA, 19 nt, Human
ccaggugcacaagcuccaa

SEQ ID NO: 1963357 - RNA, 22 nt, Human
ccagggacagaggggguggccu

SEQ ID NO: 1963358 - RNA, 21 nt, Human
ccagggacagaggggguggcc

SEQ ID NO: 1963359 - RNA, 15 nt, Human
ccagggacagagggg

SEQ ID NO: 1963360 - RNA, 14 nt, Human
ccagggacagaggg

SEQ ID NO: 1963361 - RNA, 20 nt, Human
ccaggcuuagucacugagac

SEQ ID NO: 1963362 - RNA, 14 nt, Human
cauucuucccuuau

SEQ ID NO: 1963363 - RNA, 22 nt, Human
cauucuucugaucacugaaaua

SEQ ID NO: 1963364 - RNA, 23 nt, Human
cauucuucuguacgucugacagg

SEQ ID NO: 1963365 - RNA, 13 nt, Human
cauucuucugauc

SEQ ID NO: 1963366 - RNA, 19 nt, Human
cauucuucugaucacugaa

SEQ ID NO: 1963367 - RNA, 14 nt, Human
cauuccugaacagg

SEQ ID NO: 1963368 - RNA, 22 nt, Human
cauuccugaugcuucuucagag

SEQ ID NO: 1963369 - RNA, 19 nt, Human
cauuccugaugcuucuuca

SEQ ID NO: 1963370 - RNA, 16 nt, Human
cauuccugaugcuucu

SEQ ID NO: 1963371 - RNA, 14 nt, Human
cauuccugaugcuu

SEQ ID NO: 1963372 - RNA, 23 nt, Human
cauuccugaugcuucuucagaga

SEQ ID NO: 1963373 - RNA, 15 nt, Human
cauucugacucauau

SEQ ID NO: 1963374 - RNA, 12 nt, Human
cauucugccugc

SEQ ID NO: 1963375 - RNA, 13 nt, Human
cauucugccugcc

SEQ ID NO: 1963376 - RNA, 15 nt, Human
cauucugccugccca

SEQ ID NO: 1963377 - RNA, 16 nt, Human
cauucugccugcccag

SEQ ID NO: 1963378 - RNA, 17 nt, Human
cauucugccugcccagg

SEQ ID NO: 1963379 - RNA, 18 nt, Human
cauucugccugcccaggc

SEQ ID NO: 1963380 - RNA, 19 nt, Human
cauucugccugcccaggcc

SEQ ID NO: 1963381 - RNA, 20 nt, Human
cauucugccugcccaggccc

SEQ ID NO: 1963382 - RNA, 17 nt, Human
cauucuguuaaucauua

SEQ ID NO: 1963383 - RNA, 21 nt, Human
cauucuucccaacuugccuuu

SEQ ID NO: 1963384 - RNA, 13 nt, Human
cauucuggaauaa

SEQ ID NO: 1963385 - RNA, 11 nt, Human
cauucuguccu

SEQ ID NO: 1963386 - RNA, 20 nt, Human
cauuacaagccuggaaaaaa

SEQ ID NO: 1963387 - RNA, 21 nt, Human
cauuacaagccuggaaaaaaa

SEQ ID NO: 1963388 - RNA, 17 nt, Human
cauuaaggccacaucca

SEQ ID NO: 1963389 - RNA, 16 nt, Human
cauuaaaauaugcacu

SEQ ID NO: 1963390 - RNA, 18 nt, Human
cauuaaaauaugcacuaa

SEQ ID NO: 1963391 - RNA, 15 nt, Human
cauuaacugcuuccu

SEQ ID NO: 1963392 - RNA, 13 nt, Human
cauuaacugcuuc

SEQ ID NO: 1963393 - RNA, 20 nt, Human
cauucaaauguauuacagug

SEQ ID NO: 1963394 - RNA, 17 nt, Human
cauuacuuguugccuau

SEQ ID NO: 1963395 - RNA, 18 nt, Human
cauuacuuguugccuaua

SEQ ID NO: 1963396 - RNA, 20 nt, Human
cauuacuguuuaagacacuu

SEQ ID NO: 1963397 - RNA, 19 nt, Human
cauuccccaggaggccagc

SEQ ID NO: 1963398 - RNA, 18 nt, Human
cauuccccaggaggccag

SEQ ID NO: 1963399 - RNA, 20 nt, Human
cauuccccaggaggccagcc

SEQ ID NO: 1963400 - RNA, 13 nt, Human
cauuccccauggg

SEQ ID NO: 1963401 - RNA, 17 nt, Human
cauuccccgucucuggu

SEQ ID NO: 1963402 - RNA, 18 nt, Human
cauucccucgucuuuccc

SEQ ID NO: 1963403 - RNA, 19 nt, Human
cauucccucgucuuuccca

SEQ ID NO: 1963404 - RNA, 14 nt, Human
cauuccagaggaag

SEQ ID NO: 1963405 - RNA, 12 nt, Human
cauuccaggccc

SEQ ID NO: 1963406 - RNA, 17 nt, Human
cauuccaggcccgaagc

SEQ ID NO: 1963407 - RNA, 16 nt, Human
cauuccagucaggcuc

SEQ ID NO: 1963408 - RNA, 17 nt, Human
cauuccccaggaggcca

SEQ ID NO: 1963409 - RNA, 15 nt, Human
cauuccccaggaggc

SEQ ID NO: 1963410 - RNA, 13 nt, Human
cauuccccaggag

SEQ ID NO: 1963411 - RNA, 13 nt, Human
cauuccagaggaa

SEQ ID NO: 1963412 - RNA, 22 nt, Human
cauuccaccuucccaugcccug

SEQ ID NO: 1963413 - RNA, 17 nt, Human
cauuccaccuucccaug

SEQ ID NO: 1963414 - RNA, 19 nt, Human
cauucauauuacaauauuu

SEQ ID NO: 1963415 - RNA, 19 nt, Human
cauucauuuucuggguguu

SEQ ID NO: 1963416 - RNA, 21 nt, Human
cauucagauaugauucaaaug

SEQ ID NO: 1963417 - RNA, 17 nt, Human
cauucauauuacaauau

SEQ ID NO: 1963418 - RNA, 18 nt, Human
cauucauauuacaauauu

SEQ ID NO: 1963419 - RNA, 23 nt, Human
cauuuuaccuuugacaaagguaa

SEQ ID NO: 1963420 - RNA, 20 nt, Human
cauuuuacagagaaagaaau

SEQ ID NO: 1963421 - RNA, 19 nt, Human
cauuuuacaguuacuuuuc

SEQ ID NO: 1963422 - RNA, 23 nt, Human
cauuuuauuuuauuaugcaugaa

SEQ ID NO: 1963423 - RNA, 22 nt, Human
cauuuuauuuuauuaugcauga

SEQ ID NO: 1963424 - RNA, 22 nt, Human
cauuuuacaguuacuuuuccuu

SEQ ID NO: 1963425 - RNA, 20 nt, Human
cauuuuacccacacacagau

SEQ ID NO: 1963426 - RNA, 14 nt, Human
cauuugcuuuggaa

SEQ ID NO: 1963427 - RNA, 15 nt, Human
cauuugcuuuggaag

SEQ ID NO: 1963428 - RNA, 13 nt, Human
cauuugauuugua

SEQ ID NO: 1963429 - RNA, 18 nt, Human
cauuucuuuuuaaaaaaa

SEQ ID NO: 1963430 - RNA, 16 nt, Human
ccaaacccuucagugc

SEQ ID NO: 1963431 - RNA, 17 nt, Human
ccaaaccaccagaagcc

SEQ ID NO: 1963432 - RNA, 14 nt, Human
ccaaacacaggcaa

SEQ ID NO: 1963433 - RNA, 18 nt, Human
ccaaacauuaauguugau

SEQ ID NO: 1963434 - RNA, 21 nt, Human
ccaaacauuaauguugauuuc

SEQ ID NO: 1963435 - RNA, 22 nt, Human
ccaaacauuaauguugauuucu

SEQ ID NO: 1963436 - RNA, 18 nt, Human
ccaaacacacagaagggg

SEQ ID NO: 1963437 - RNA, 13 nt, Human
ccaaacacaggca

SEQ ID NO: 1963438 - RNA, 15 nt, Human
ccaaacauuaauguu

SEQ ID NO: 1963439 - RNA, 13 nt, Human
ccaaacacacaga

SEQ ID NO: 1963440 - RNA, 15 nt, Human
ccaaacacacagaag

SEQ ID NO: 1963441 - RNA, 17 nt, Human
ccaaacacacagaaggg

SEQ ID NO: 1963442 - RNA, 14 nt, Human
ccaaaauuaaggug

SEQ ID NO: 1963443 - RNA, 15 nt, Human
ccaaaauuaaggugu

SEQ ID NO: 1963444 - RNA, 16 nt, Human
cauuuuuagccugugu

SEQ ID NO: 1963445 - RNA, 20 nt, Human
ccaaaaugugagugguugaa

SEQ ID NO: 1963446 - RNA, 17 nt, Human
cauuuuuaguagagaca

SEQ ID NO: 1963447 - RNA, 15 nt, Human
cauuuucauuagcaa

SEQ ID NO: 1963448 - RNA, 19 nt, Human
cauuuucagauucaggcau

SEQ ID NO: 1963449 - RNA, 21 nt, Human
cauuuucagauucaggcauuu

SEQ ID NO: 1963450 - RNA, 17 nt, Human
cauuuucauuagcaaaa

SEQ ID NO: 1963451 - RNA, 21 nt, Human
cauuuuuaagugcugcauuua

SEQ ID NO: 1963452 - RNA, 12 nt, Human
cauuuucucuua

SEQ ID NO: 1963453 - RNA, 14 nt, Human
cauuuucucuuaga

SEQ ID NO: 1963454 - RNA, 15 nt, Human
cauuuucucuuagaa

SEQ ID NO: 1963455 - RNA, 16 nt, Human
cauuuucucuuagaaa

SEQ ID NO: 1963456 - RNA, 12 nt, Human
cauuuucucuuu

SEQ ID NO: 1963457 - RNA, 13 nt, Human
cauucuuuuugaa

SEQ ID NO: 1963458 - RNA, 14 nt, Human
cauucuuuuugaaa

SEQ ID NO: 1963459 - RNA, 16 nt, Human
cauucuuuuugaaaug

SEQ ID NO: 1963460 - RNA, 17 nt, Human
cauugaaaaauguccac

SEQ ID NO: 1963461 - RNA, 17 nt, Human
cauucuuuuugcucuaa

SEQ ID NO: 1963462 - RNA, 19 nt, Human
cauucuuuuugcucuaaaa

SEQ ID NO: 1963463 - RNA, 23 nt, Human
cauucuuuuugcucuaaaauauu

SEQ ID NO: 1963464 - RNA, 15 nt, Human
cauugaacucugaga

SEQ ID NO: 1963465 - RNA, 20 nt, Human
cauugauacaaucauagcau

SEQ ID NO: 1963466 - RNA, 18 nt, Human
cauugaccugaggcccuu

SEQ ID NO: 1963467 - RNA, 17 nt, Human
cauugaccugaggcccu

SEQ ID NO: 1963468 - RNA, 15 nt, Human
cauugaccugaggcc

SEQ ID NO: 1963469 - RNA, 14 nt, Human
cauugaccugaggc

SEQ ID NO: 1963470 - RNA, 13 nt, Human
cauugugggaagg

SEQ ID NO: 1963471 - RNA, 15 nt, Human
cauugugggaagggg

SEQ ID NO: 1963472 - RNA, 21 nt, Human
cauuguaagcguauggcuuua

SEQ ID NO: 1963473 - RNA, 13 nt, Human
cauuguaauguug

SEQ ID NO: 1963474 - RNA, 14 nt, Human
cauuguaauguugu

SEQ ID NO: 1963475 - RNA, 19 nt, Human
cauuguaauguugugaaua

SEQ ID NO: 1963476 - RNA, 23 nt, Human
cauuguaauguugugaauaauua

SEQ ID NO: 1963477 - RNA, 17 nt, Human
cauuguuuuucugauau

SEQ ID NO: 1963478 - RNA, 15 nt, Human
cauuuaaaaaaaauc

SEQ ID NO: 1963479 - RNA, 19 nt, Human
cauuuaaaacauuaaaaua

SEQ ID NO: 1963480 - RNA, 12 nt, Human
cauuuaaaacau

SEQ ID NO: 1963481 - RNA, 22 nt, Human
cauuuaauggggaggacaaaau

SEQ ID NO: 1963482 - RNA, 20 nt, Human
cauuuacugcauucuucuga

SEQ ID NO: 1963483 - RNA, 22 nt, Human
cauuuacugcauucuucugauc

SEQ ID NO: 1963484 - RNA, 17 nt, Human
cauuugaaaauuuugau

SEQ ID NO: 1963485 - RNA, 19 nt, Human
cauuugaaaauuuugaugu

SEQ ID NO: 1963486 - RNA, 23 nt, Human
caugggacagggaggacgcucuc

SEQ ID NO: 1963487 - RNA, 15 nt, Human
cauggcagcccucgg

SEQ ID NO: 1963488 - RNA, 18 nt, Human
caugggccuccugugugu

SEQ ID NO: 1963489 - RNA, 14 nt, Human
caugggcaggagac

SEQ ID NO: 1963490 - RNA, 14 nt, Human
caugggccaccacg

SEQ ID NO: 1963491 - RNA, 16 nt, Human
caugcuguucaugaaa

SEQ ID NO: 1963492 - RNA, 18 nt, Human
caugcuguucaugaaaga

SEQ ID NO: 1963493 - RNA, 16 nt, Human
caugcuuuccauauuu

SEQ ID NO: 1963494 - RNA, 17 nt, Human
caugcuuuccauauuuu

SEQ ID NO: 1963495 - RNA, 17 nt, Human
caugcuuugugaacaag

SEQ ID NO: 1963496 - RNA, 18 nt, Human
caugcuuguguuucuuag

SEQ ID NO: 1963497 - RNA, 19 nt, Human
caugcuuguguuucuuagu

SEQ ID NO: 1963498 - RNA, 15 nt, Human
cauggacuuccacug

SEQ ID NO: 1963499 - RNA, 22 nt, Human
cauggacuucugccagcauaau

SEQ ID NO: 1963500 - RNA, 13 nt, Human
cauggaccaugcu

SEQ ID NO: 1963501 - RNA, 14 nt, Human
cauggaccaugcug

SEQ ID NO: 1963502 - RNA, 20 nt, Human
cauggaccaugcugucuggc

SEQ ID NO: 1963503 - RNA, 17 nt, Human
caugcgggcuuccuccu

SEQ ID NO: 1963504 - RNA, 15 nt, Human
caugcugucccuuac

SEQ ID NO: 1963505 - RNA, 13 nt, Human
caugcugucccuu

SEQ ID NO: 1963506 - RNA, 15 nt, Human
caugcuguucaugaa

SEQ ID NO: 1963507 - RNA, 17 nt, Human
caugcugucccuuacgu

SEQ ID NO: 1963508 - RNA, 14 nt, Human
caugcagcaucuaa

SEQ ID NO: 1963509 - RNA, 17 nt, Human
caugcagaguauuucua

SEQ ID NO: 1963510 - RNA, 19 nt, Human
caugcagccacuuaggaca

SEQ ID NO: 1963511 - RNA, 20 nt, Human
cauguuuuucuucucccuca

SEQ ID NO: 1963512 - RNA, 19 nt, Human
cauguuuuucuucucccuc

SEQ ID NO: 1963513 - RNA, 12 nt, Human
cauguuugugau

SEQ ID NO: 1963514 - RNA, 14 nt, Human
cauguuugugauug

SEQ ID NO: 1963515 - RNA, 11 nt, Human
cauguuucuuu

SEQ ID NO: 1963516 - RNA, 20 nt, Human
cauguuucuuugaucaugaa

SEQ ID NO: 1963517 - RNA, 22 nt, Human
cauguuucuuugaucaugaaua

SEQ ID NO: 1963518 - RNA, 11 nt, Human
cauuaaaauau

SEQ ID NO: 1963519 - RNA, 14 nt, Human
cauuaaaauauaau

SEQ ID NO: 1963520 - RNA, 20 nt, Human
cauuaaaagaaaauaaaaaa

SEQ ID NO: 1963521 - RNA, 12 nt, Human
cauuaaaagaaa

SEQ ID NO: 1963522 - RNA, 13 nt, Human
cauuaaaagaaaa

SEQ ID NO: 1963523 - RNA, 14 nt, Human
cauuaaaagaaaau

SEQ ID NO: 1963524 - RNA, 17 nt, Human
cauuaaaagaaaauaaa

SEQ ID NO: 1963525 - RNA, 17 nt, Human
cauggucggaaaacaug

SEQ ID NO: 1963526 - RNA, 19 nt, Human
cauggucggaaaacaugcu

SEQ ID NO: 1963527 - RNA, 23 nt, Human
cauggucggaaaacaugcuacac

SEQ ID NO: 1963528 - RNA, 21 nt, Human
caugguggggucuccucagga

SEQ ID NO: 1963529 - RNA, 23 nt, Human
caugguggggucuccucaggacc

SEQ ID NO: 1963530 - RNA, 15 nt, Human
caugguggggucucc

SEQ ID NO: 1963531 - RNA, 18 nt, Human
caugguggggucuccuca

SEQ ID NO: 1963532 - RNA, 20 nt, Human
caugguggggucuccucagg

SEQ ID NO: 1963533 - RNA, 19 nt, Human
cauggugguugggacccag

SEQ ID NO: 1963534 - RNA, 22 nt, Human
cauggugguugggacccagugg

SEQ ID NO: 1963535 - RNA, 16 nt, Human
caugguuugacucugg

SEQ ID NO: 1963536 - RNA, 14 nt, Human
cauguaaaagccua

SEQ ID NO: 1963537 - RNA, 14 nt, Human
cauguacuaucuua

SEQ ID NO: 1963538 - RNA, 15 nt, Human
cauguacuaucuuau

SEQ ID NO: 1963539 - RNA, 21 nt, Human
cauguacuaucuuaucucaga

SEQ ID NO: 1963540 - RNA, 16 nt, Human
caugucuccuacugag

SEQ ID NO: 1963541 - RNA, 18 nt, Human
caugucuccuacugagga

SEQ ID NO: 1963542 - RNA, 20 nt, Human
caugucuccuacugaggaua

SEQ ID NO: 1963543 - RNA, 18 nt, Human
cauguguuggcagccucu

SEQ ID NO: 1963544 - RNA, 22 nt, Human
caugugccagguuuuuggucug

SEQ ID NO: 1963545 - RNA, 14 nt, Human
caugugcacaugca

SEQ ID NO: 1963546 - RNA, 18 nt, Human
caugugaucucauuguuc

SEQ ID NO: 1963547 - RNA, 21 nt, Human
caugugcaaacccacucagag

SEQ ID NO: 1963548 - RNA, 21 nt, Human
caugugaugagaggaaaucac

SEQ ID NO: 1963549 - RNA, 17 nt, Human
caugugaucucauuguu

SEQ ID NO: 1963550 - RNA, 20 nt, Human
caugugaugagaggaaauca

SEQ ID NO: 1963551 - RNA, 18 nt, Human
caugugaugagaggaaau

SEQ ID NO: 1963552 - RNA, 17 nt, Human
caugugaugagaggaaa

SEQ ID NO: 1963553 - RNA, 16 nt, Human
caugugaugagaggaa

SEQ ID NO: 1963554 - RNA, 15 nt, Human
caugugaugagagga

SEQ ID NO: 1963555 - RNA, 18 nt, Human
caugugagcugcugccau

SEQ ID NO: 1963556 - RNA, 20 nt, Human
caugugagcugcugccauga

SEQ ID NO: 1963557 - RNA, 14 nt, Human
caugucucgacuca

SEQ ID NO: 1963558 - RNA, 12 nt, Human
caugucuggcua

SEQ ID NO: 1963559 - RNA, 14 nt, Human
caugucuuauuuaa

SEQ ID NO: 1963560 - RNA, 15 nt, Human
caugucuuauuuaaa

SEQ ID NO: 1963561 - RNA, 19 nt, Human
caucaucuguaagcuguuu

SEQ ID NO: 1963562 - RNA, 13 nt, Human
caucaucuguaag

SEQ ID NO: 1963563 - RNA, 16 nt, Human
caucauccuaagcuau

SEQ ID NO: 1963564 - RNA, 14 nt, Human
caucauauuauaca

SEQ ID NO: 1963565 - RNA, 16 nt, Human
caucauauuauacaga

SEQ ID NO: 1963566 - RNA, 13 nt, Human
caucauagaaacu

SEQ ID NO: 1963567 - RNA, 13 nt, Human
caucaugucuggc

SEQ ID NO: 1963568 - RNA, 13 nt, Human
caucauguuuaca

SEQ ID NO: 1963569 - RNA, 19 nt, Human
caucauguuuacagaggac

SEQ ID NO: 1963570 - RNA, 21 nt, Human
caucauguuuacagaggacag

SEQ ID NO: 1963571 - RNA, 14 nt, Human
caucaugucuggcu

SEQ ID NO: 1963572 - RNA, 15 nt, Human
caucaugucuggcua

SEQ ID NO: 1963573 - RNA, 12 nt, Human
caucacccgcua

SEQ ID NO: 1963574 - RNA, 20 nt, Human
caucaccaacgucugugcca

SEQ ID NO: 1963575 - RNA, 12 nt, Human
caucagugccaa

SEQ ID NO: 1963576 - RNA, 15 nt, Human
caucaguacuuguuu

SEQ ID NO: 1963577 - RNA, 23 nt, Human
caucagguuaggcaguauaaaga

SEQ ID NO: 1963578 - RNA, 13 nt, Human
caucccuccuggg

SEQ ID NO: 1963579 - RNA, 15 nt, Human
caucccucuggggcu

SEQ ID NO: 1963580 - RNA, 15 nt, Human
caucccuucucuucc

SEQ ID NO: 1963581 - RNA, 16 nt, Human
caucccuucucuucca

SEQ ID NO: 1963582 - RNA, 18 nt, Human
caucccuucucuuccagg

SEQ ID NO: 1963583 - RNA, 22 nt, Human
caucccuucucuuccaggcagc

SEQ ID NO: 1963584 - RNA, 23 nt, Human
caucccuucucuuccaggcagcc

SEQ ID NO: 1963585 - RNA, 16 nt, Human
cauccgaccagguugu

SEQ ID NO: 1963586 - RNA, 20 nt, Human
cauccgaccagguugucacu

SEQ ID NO: 1963587 - RNA, 15 nt, Human
caucauuccuuuuua

SEQ ID NO: 1963588 - RNA, 19 nt, Human
caucauuccuuuuuauuua

SEQ ID NO: 1963589 - RNA, 20 nt, Human
caucauuccuuuuuauuuau

SEQ ID NO: 1963590 - RNA, 15 nt, Human
caucauuccaggccc

SEQ ID NO: 1963591 - RNA, 14 nt, Human
cauccacugugcca

SEQ ID NO: 1963592 - RNA, 17 nt, Human
cauccacugugccaugu

SEQ ID NO: 1963593 - RNA, 23 nt, Human
cauccacugugccaugugccagg

SEQ ID NO: 1963594 - RNA, 17 nt, Human
cauccagguucagcuug

SEQ ID NO: 1963595 - RNA, 22 nt, Human
caucauuccuuuuuauuuauau

SEQ ID NO: 1963596 - RNA, 12 nt, Human
cauccauccagg

SEQ ID NO: 1963597 - RNA, 14 nt, Human
caucaacaucuugg

SEQ ID NO: 1963598 - RNA, 16 nt, Human
caucaacuaaaguugu

SEQ ID NO: 1963599 - RNA, 19 nt, Human
caucaacuaaaguuguacu

SEQ ID NO: 1963600 - RNA, 22 nt, Human
caucaacuaaaguuguacuuua

SEQ ID NO: 1963601 - RNA, 23 nt, Human
caucaacuaaaguuguacuuuaa

SEQ ID NO: 1963602 - RNA, 16 nt, Human
cauauuuuaaacagag

SEQ ID NO: 1963603 - RNA, 17 nt, Human
cauauuuuaaacagagg

SEQ ID NO: 1963604 - RNA, 23 nt, Human
cauauuuggaauaaaaauuccag

SEQ ID NO: 1963605 - RNA, 17 nt, Human
cauauuuaauuugaagg

SEQ ID NO: 1963606 - RNA, 14 nt, Human
cauauuuguacuuu

SEQ ID NO: 1963607 - RNA, 18 nt, Human
cauauuuguacuuucugu

SEQ ID NO: 1963608 - RNA, 20 nt, Human
cauauuuguacuuucuguua

SEQ ID NO: 1963609 - RNA, 21 nt, Human
cauauuuguacuuucuguuaa

SEQ ID NO: 1963610 - RNA, 23 nt, Human
cauauuuguacuuucuguuaaaa

SEQ ID NO: 1963611 - RNA, 19 nt, Human
cauauuguuacugguacca

SEQ ID NO: 1963612 - RNA, 13 nt, Human
cauauuguuacug

SEQ ID NO: 1963613 - RNA, 20 nt, Human
cauauugguauauccuuuuc

SEQ ID NO: 1963614 - RNA, 21 nt, Human
cauauugauuuccguuaaaau

SEQ ID NO: 1963615 - RNA, 17 nt, Human
cauauugauuuccguua

SEQ ID NO: 1963616 - RNA, 22 nt, Human
cauauucuguuggccaguguga

SEQ ID NO: 1963617 - RNA, 14 nt, Human
cauaugacaaaugu

SEQ ID NO: 1963618 - RNA, 14 nt, Human
cauaugaacuuuca

SEQ ID NO: 1963619 - RNA, 17 nt, Human
cauaugacaaauguuuc

SEQ ID NO: 1963620 - RNA, 19 nt, Human
cauaugacaaauguuucua

SEQ ID NO: 1963621 - RNA, 21 nt, Human
cauauccuuuuagucugcaua

SEQ ID NO: 1963622 - RNA, 15 nt, Human
cauauagaaagcuuu

SEQ ID NO: 1963623 - RNA, 21 nt, Human
cauauauguguccauuuccuu

SEQ ID NO: 1963624 - RNA, 23 nt, Human
cauauaagauucauauuuacuuc

SEQ ID NO: 1963625 - RNA, 16 nt, Human
cauauaagugauugcu

SEQ ID NO: 1963626 - RNA, 17 nt, Human
cauauaagcccuugauu

SEQ ID NO: 1963627 - RNA, 18 nt, Human
cauagugaugguuccccu

SEQ ID NO: 1963628 - RNA, 19 nt, Human
cauagugaugguuccccug

SEQ ID NO: 1963629 - RNA, 20 nt, Human
cauagugacuuuucaaguau

SEQ ID NO: 1963630 - RNA, 17 nt, Human
cauauaaauugucuuaa

SEQ ID NO: 1963631 - RNA, 20 nt, Human
cauauaacuuauauuguaag

SEQ ID NO: 1963632 - RNA, 22 nt, Human
cauauaacuuauauuguaagaa

SEQ ID NO: 1963633 - RNA, 23 nt, Human
cauauaacuuauauuguaagaaa

SEQ ID NO: 1963634 - RNA, 21 nt, Human
cauauaaauugucuuaaugga

SEQ ID NO: 1963635 - RNA, 18 nt, Human
cagugcugggauuacagg

SEQ ID NO: 1963636 - RNA, 16 nt, Human
cagugcugaucuaaaa

SEQ ID NO: 1963637 - RNA, 15 nt, Human
cauaguaugguggcu

SEQ ID NO: 1963638 - RNA, 15 nt, Human
cauaguaaauguagu

SEQ ID NO: 1963639 - RNA, 19 nt, Human
cauaguaaauguaguucau

SEQ ID NO: 1963640 - RNA, 20 nt, Human
cauaguaaauguaguucaua

SEQ ID NO: 1963641 - RNA, 16 nt, Human
cauaguaugguggcug

SEQ ID NO: 1963642 - RNA, 17 nt, Human
cauaguaugguggcugg

SEQ ID NO: 1963643 - RNA, 20 nt, Human
cauaguagaacuuuauaaaa

SEQ ID NO: 1963644 - RNA, 15 nt, Human
caucuuugauguguu

SEQ ID NO: 1963645 - RNA, 16 nt, Human
caucuuugauguguug

SEQ ID NO: 1963646 - RNA, 18 nt, Human
caucuuugauguguuguu

SEQ ID NO: 1963647 - RNA, 12 nt, Human
caucuuugaugu

SEQ ID NO: 1963648 - RNA, 13 nt, Human
caucuuugaugug

SEQ ID NO: 1963649 - RNA, 14 nt, Human
caucuuugaugugu

SEQ ID NO: 1963650 - RNA, 13 nt, Human
caugaaaacacau

SEQ ID NO: 1963651 - RNA, 21 nt, Human
caucuuuuguuacucuuggga

SEQ ID NO: 1963652 - RNA, 23 nt, Human
caucuuuuguuacucuugggaca

SEQ ID NO: 1963653 - RNA, 14 nt, Human
caugaaaacacauu

SEQ ID NO: 1963654 - RNA, 15 nt, Human
caugaaaacacauuu

SEQ ID NO: 1963655 - RNA, 16 nt, Human
caugaaaacacauuuu

SEQ ID NO: 1963656 - RNA, 17 nt, Human
caugaaaacacauuuuu

SEQ ID NO: 1963657 - RNA, 14 nt, Human
caugaaagauucaa

SEQ ID NO: 1963658 - RNA, 12 nt, Human
caugaaagaaaa

SEQ ID NO: 1963659 - RNA, 19 nt, Human
caugaaaacacauuuuucu

SEQ ID NO: 1963660 - RNA, 21 nt, Human
caugaaaacacauuuuucuua

SEQ ID NO: 1963661 - RNA, 15 nt, Human
caugaaaauagcaau

SEQ ID NO: 1963662 - RNA, 12 nt, Human
caugaagacaga

SEQ ID NO: 1963663 - RNA, 13 nt, Human
caugaaaugaaca

SEQ ID NO: 1963664 - RNA, 15 nt, Human
caugaaaugaacaca

SEQ ID NO: 1963665 - RNA, 19 nt, Human
caugaaaugaacacaaauu

SEQ ID NO: 1963666 - RNA, 20 nt, Human
caugaaaugaacacaaauua

SEQ ID NO: 1963667 - RNA, 19 nt, Human
caugaaaugcuaugucauu

SEQ ID NO: 1963668 - RNA, 21 nt, Human
caugaaaugcuaugucauuuc

SEQ ID NO: 1963669 - RNA, 23 nt, Human
caugagcaucaggccaggcccuc

SEQ ID NO: 1963670 - RNA, 22 nt, Human
caugagcaucaggccaggcccu

SEQ ID NO: 1963671 - RNA, 21 nt, Human
caugagcaucaggccaggccc

SEQ ID NO: 1963672 - RNA, 20 nt, Human
caugagcaucaggccaggcc

SEQ ID NO: 1963673 - RNA, 18 nt, Human
caugagcaucaggccagg

SEQ ID NO: 1963674 - RNA, 17 nt, Human
caugagcaucaggccag

SEQ ID NO: 1963675 - RNA, 16 nt, Human
caugagcaucaggcca

SEQ ID NO: 1963676 - RNA, 15 nt, Human
caugagcaucaggcc

SEQ ID NO: 1963677 - RNA, 12 nt, Human
caugagccucag

SEQ ID NO: 1963678 - RNA, 15 nt, Human
caugagccucagcau

SEQ ID NO: 1963679 - RNA, 17 nt, Human
caugagccucagcaucc

SEQ ID NO: 1963680 - RNA, 18 nt, Human
caugagccucagcauccu

SEQ ID NO: 1963681 - RNA, 19 nt, Human
caugagccucagcauccug

SEQ ID NO: 1963682 - RNA, 20 nt, Human
caugagccucagcauccugg

SEQ ID NO: 1963683 - RNA, 21 nt, Human
caugagccucagcauccuggc

SEQ ID NO: 1963684 - RNA, 18 nt, Human
caugaagauguagaggag

SEQ ID NO: 1963685 - RNA, 19 nt, Human
caugaagauguagaggaga

SEQ ID NO: 1963686 - RNA, 23 nt, Human
caugacucguauaugucucaggu

SEQ ID NO: 1963687 - RNA, 18 nt, Human
caugacucuugacucuug

SEQ ID NO: 1963688 - RNA, 20 nt, Human
caugacucguauaugucuca

SEQ ID NO: 1963689 - RNA, 22 nt, Human
caugagaauguuuuagcacagc

SEQ ID NO: 1963690 - RNA, 13 nt, Human
caugagcaucagg

SEQ ID NO: 1963691 - RNA, 18 nt, Human
caugagauaauaugcaga

SEQ ID NO: 1963692 - RNA, 18 nt, Human
caugagacuauguaaaaa

SEQ ID NO: 1963693 - RNA, 21 nt, Human
caugaggaacaaggcaaggcu

SEQ ID NO: 1963694 - RNA, 20 nt, Human
caugaggaacaaggcaaggc

SEQ ID NO: 1963695 - RNA, 17 nt, Human
caugaggaacaaggcaa

SEQ ID NO: 1963696 - RNA, 16 nt, Human
caugaggaacaaggca

SEQ ID NO: 1963697 - RNA, 22 nt, Human
caugagccucagcauccuggca

SEQ ID NO: 1963698 - RNA, 23 nt, Human
caugagccucagcauccuggcac

SEQ ID NO: 1963699 - RNA, 23 nt, Human
caugaggaacaaggcaaggcugu

SEQ ID NO: 1963700 - RNA, 15 nt, Human
caugaggaaggaaca

SEQ ID NO: 1963701 - RNA, 16 nt, Human
caugagguacugagag

SEQ ID NO: 1963702 - RNA, 19 nt, Human
caugagggaagaauaaaga

SEQ ID NO: 1963703 - RNA, 15 nt, Human
caugagggaagaaua

SEQ ID NO: 1963704 - RNA, 19 nt, Human
caugagguacugagaguga

SEQ ID NO: 1963705 - RNA, 15 nt, Human
caugagguucucucu

SEQ ID NO: 1963706 - RNA, 13 nt, Human
caugaguccccug

SEQ ID NO: 1963707 - RNA, 15 nt, Human
caugaguccccuguu

SEQ ID NO: 1963708 - RNA, 14 nt, Human
caugaguccccugu

SEQ ID NO: 1963709 - RNA, 23 nt, Human
caugaguccccuguuuguuucug

SEQ ID NO: 1963710 - RNA, 16 nt, Human
caugcacucagcucuu

SEQ ID NO: 1963711 - RNA, 15 nt, Human
caugcacucagcucu

SEQ ID NO: 1963712 - RNA, 16 nt, Human
caugaugauuucagaa

SEQ ID NO: 1963713 - RNA, 19 nt, Human
caugaguuggcugggaaua

SEQ ID NO: 1963714 - RNA, 16 nt, Human
caucucuacaaaaagc

SEQ ID NO: 1963715 - RNA, 16 nt, Human
caucuccuuagaaaag

SEQ ID NO: 1963716 - RNA, 17 nt, Human
caucucccuuuuccaug

SEQ ID NO: 1963717 - RNA, 18 nt, Human
cauccuacaagacacagu

SEQ ID NO: 1963718 - RNA, 17 nt, Human
cauccuacaagacacag

SEQ ID NO: 1963719 - RNA, 19 nt, Human
cauccuacaagacacagug

SEQ ID NO: 1963720 - RNA, 17 nt, Human
caucugaccucuaccuu

SEQ ID NO: 1963721 - RNA, 13 nt, Human
caucucugcucca

SEQ ID NO: 1963722 - RNA, 12 nt, Human
caucucugcucc

SEQ ID NO: 1963723 - RNA, 15 nt, Human
caucucuccuccuuu

SEQ ID NO: 1963724 - RNA, 19 nt, Human
caucuugcucugcugacag

SEQ ID NO: 1963725 - RNA, 15 nt, Human
caucuugcucugcug

SEQ ID NO: 1963726 - RNA, 16 nt, Human
caucuugcucugcuga

SEQ ID NO: 1963727 - RNA, 17 nt, Human
caucuugcucugcugac

SEQ ID NO: 1963728 - RNA, 21 nt, Human
caucuugaauuguaaggaaug

SEQ ID NO: 1963729 - RNA, 16 nt, Human
caucuugaauuguaag

SEQ ID NO: 1963730 - RNA, 13 nt, Human
cagggaaagacug

SEQ ID NO: 1963731 - RNA, 19 nt, Human
cagggaacuaggaaggcac

SEQ ID NO: 1963732 - RNA, 19 nt, Human
cagggaagauaaguuggaa

SEQ ID NO: 1963733 - RNA, 16 nt, Human
cagggaagccuugugg

SEQ ID NO: 1963734 - RNA, 21 nt, Human
cagggaaaagcagcucucccc

SEQ ID NO: 1963735 - RNA, 20 nt, Human
cagggaaaagcagcucuccc

SEQ ID NO: 1963736 - RNA, 19 nt, Human
cagggaaaagcagcucucc

SEQ ID NO: 1963737 - RNA, 17 nt, Human
cagggaaaagcagcucu

SEQ ID NO: 1963738 - RNA, 16 nt, Human
cagggaaacagcuaau

SEQ ID NO: 1963739 - RNA, 22 nt, Human
cagggaaacagcuaaugggaca

SEQ ID NO: 1963740 - RNA, 20 nt, Human
cagggacagaggggguggcc

SEQ ID NO: 1963741 - RNA, 14 nt, Human
cagggacagagggg

SEQ ID NO: 1963742 - RNA, 13 nt, Human
cagggacagaggg

SEQ ID NO: 1963743 - RNA, 15 nt, Human
cagggaaggggacaa

SEQ ID NO: 1963744 - RNA, 17 nt, Human
cagggaaggggacaagg

SEQ ID NO: 1963745 - RNA, 15 nt, Human
cagggaaggccugac

SEQ ID NO: 1963746 - RNA, 16 nt, Human
cagggaaggccugacu

SEQ ID NO: 1963747 - RNA, 23 nt, Human
cagggaaggccugacuucugcug

SEQ ID NO: 1963748 - RNA, 15 nt, Human
cagggggcuuccuga

SEQ ID NO: 1963749 - RNA, 22 nt, Human
cagggggcuuccugaggggaga

SEQ ID NO: 1963750 - RNA, 12 nt, Human
cagggggcuucc

SEQ ID NO: 1963751 - RNA, 13 nt, Human
cagggggcuuccu

SEQ ID NO: 1963752 - RNA, 22 nt, Human
cagggggccagucccugaggca

SEQ ID NO: 1963753 - RNA, 16 nt, Human
cagggggagaaugggu

SEQ ID NO: 1963754 - RNA, 15 nt, Human
cagggccuggcucag

SEQ ID NO: 1963755 - RNA, 14 nt, Human
cagggccuggcuca

SEQ ID NO: 1963756 - RNA, 13 nt, Human
cagggccuggcuc

SEQ ID NO: 1963757 - RNA, 11 nt, Human
cagggccuggc

SEQ ID NO: 1963758 - RNA, 12 nt, Human
cagggccuggcc

SEQ ID NO: 1963759 - RNA, 13 nt, Human
cagggccuggccc

SEQ ID NO: 1963760 - RNA, 14 nt, Human
cagggccuggccca

SEQ ID NO: 1963761 - RNA, 19 nt, Human
cagggccuggcucaggugg

SEQ ID NO: 1963762 - RNA, 16 nt, Human
cagggccuggcucagg

SEQ ID NO: 1963763 - RNA, 15 nt, Human
cagggccuggcccau

SEQ ID NO: 1963764 - RNA, 16 nt, Human
cagggccuggcccaug

SEQ ID NO: 1963765 - RNA, 17 nt, Human
cagggccuggcccaugu

SEQ ID NO: 1963766 - RNA, 18 nt, Human
cagggccuggcccaugua

SEQ ID NO: 1963767 - RNA, 16 nt, Human
caggggagauccuugu

SEQ ID NO: 1963768 - RNA, 16 nt, Human
caggggaccuccuggg

SEQ ID NO: 1963769 - RNA, 14 nt, Human
caggggaggccauc

SEQ ID NO: 1963770 - RNA, 15 nt, Human
caggggcccugcagc

SEQ ID NO: 1963771 - RNA, 16 nt, Human
caggggcccugcagcu

SEQ ID NO: 1963772 - RNA, 17 nt, Human
caggggcccugcagcuc

SEQ ID NO: 1963773 - RNA, 18 nt, Human
caggggcccugcagcucu

SEQ ID NO: 1963774 - RNA, 19 nt, Human
caggggcccugcagcucuc

SEQ ID NO: 1963775 - RNA, 14 nt, Human
caggggcaggagga

SEQ ID NO: 1963776 - RNA, 17 nt, Human
caggggagggggcaaag

SEQ ID NO: 1963777 - RNA, 16 nt, Human
caggggaggccaucug

SEQ ID NO: 1963778 - RNA, 17 nt, Human
caggggaggccaucugg

SEQ ID NO: 1963779 - RNA, 21 nt, Human
caggggaggccaucuggagag

SEQ ID NO: 1963780 - RNA, 19 nt, Human
caggggaggguagagcgga

SEQ ID NO: 1963781 - RNA, 22 nt, Human
caggggccuuugggugcuguuu

SEQ ID NO: 1963782 - RNA, 18 nt, Human
caggggcuccaugccagc

SEQ ID NO: 1963783 - RNA, 17 nt, Human
caggggcuccaugccag

SEQ ID NO: 1963784 - RNA, 19 nt, Human
cagggccaaaagcuucccu

SEQ ID NO: 1963785 - RNA, 19 nt, Human
cagggccagaaguagcuuu

SEQ ID NO: 1963786 - RNA, 22 nt, Human
cagggcaggaccagcccacgcu

SEQ ID NO: 1963787 - RNA, 13 nt, Human
cagggcaggacca

SEQ ID NO: 1963788 - RNA, 16 nt, Human
cagggcaggaccagcc

SEQ ID NO: 1963789 - RNA, 17 nt, Human
cagggcaggaccagccc

SEQ ID NO: 1963790 - RNA, 18 nt, Human
cagggcaggaccagccca

SEQ ID NO: 1963791 - RNA, 19 nt, Human
cagggcaggaccagcccac

SEQ ID NO: 1963792 - RNA, 20 nt, Human
cagggcaggaccagcccacg

SEQ ID NO: 1963793 - RNA, 20 nt, Human
cagggcauggccagguggcc

SEQ ID NO: 1963794 - RNA, 14 nt, Human
cagggcaugaaaug

SEQ ID NO: 1963795 - RNA, 15 nt, Human
cagggcaugaaauga

SEQ ID NO: 1963796 - RNA, 23 nt, Human
cagggcaugaaaugaacacaaau

SEQ ID NO: 1963797 - RNA, 24 nt, Human
cagggcaugaaaugaacacaaauu

SEQ ID NO: 1963798 - RNA, 19 nt, Human
cagggcccgggaagcaaau

SEQ ID NO: 1963799 - RNA, 21 nt, Human
cagggcccccagcgagagucc

SEQ ID NO: 1963800 - RNA, 21 nt, Human
cagggccggucgggggggacc

SEQ ID NO: 1963801 - RNA, 19 nt, Human
cagggccgauggggcaguc

SEQ ID NO: 1963802 - RNA, 20 nt, Human
cagggcccgggaagcaaaug

SEQ ID NO: 1963803 - RNA, 23 nt, Human
cagggacugaaaaccucuccuca

SEQ ID NO: 1963804 - RNA, 21 nt, Human
cagggacugaaaaccucuccu

SEQ ID NO: 1963805 - RNA, 20 nt, Human
cagggacugaaaaccucucc

SEQ ID NO: 1963806 - RNA, 14 nt, Human
cagggaccccagaa

SEQ ID NO: 1963807 - RNA, 15 nt, Human
cagggaccccagaau

SEQ ID NO: 1963808 - RNA, 23 nt, Human
cagggacagaggggguggccucc

SEQ ID NO: 1963809 - RNA, 18 nt, Human
cagggauugauuuuaaaa

SEQ ID NO: 1963810 - RNA, 20 nt, Human
cagggauugauuuuaaaaug

SEQ ID NO: 1963811 - RNA, 21 nt, Human
cagggauugauuuuaaaaugu

SEQ ID NO: 1963812 - RNA, 22 nt, Human
cagggauugauuuuaaaaugua

SEQ ID NO: 1963813 - RNA, 16 nt, Human
cagggauugauuuuaa

SEQ ID NO: 1963814 - RNA, 22 nt, Human
cagggcaauaaaaugaccaugg

SEQ ID NO: 1963815 - RNA, 14 nt, Human
cagggcacaccggg

SEQ ID NO: 1963816 - RNA, 12 nt, Human
cagggcacaggg

SEQ ID NO: 1963817 - RNA, 14 nt, Human
cagggcacagggcc

SEQ ID NO: 1963818 - RNA, 15 nt, Human
cagggcacagggccu

SEQ ID NO: 1963819 - RNA, 16 nt, Human
cagggcacagggccug

SEQ ID NO: 1963820 - RNA, 22 nt, Human
cagggcacaccgggcacucaga

SEQ ID NO: 1963821 - RNA, 23 nt, Human
cagggcacaccgggcacucagaa

SEQ ID NO: 1963822 - RNA, 15 nt, Human
cagggcacaccgggc

SEQ ID NO: 1963823 - RNA, 17 nt, Human
cagggcacaccgggcac

SEQ ID NO: 1963824 - RNA, 19 nt, Human
cagggcacaccgggcacuc

SEQ ID NO: 1963825 - RNA, 21 nt, Human
cagggcacaccgggcacucag

SEQ ID NO: 1963826 - RNA, 12 nt, Human
cagggcacgugg

SEQ ID NO: 1963827 - RNA, 17 nt, Human
cagggcacagggccugg

SEQ ID NO: 1963828 - RNA, 18 nt, Human
cagggcacagggccuggc

SEQ ID NO: 1963829 - RNA, 19 nt, Human
cagggcacagggccuggcc

SEQ ID NO: 1963830 - RNA, 20 nt, Human
cagggcacagggccuggccc

SEQ ID NO: 1963831 - RNA, 21 nt, Human
cagggcacagggccuggccca

SEQ ID NO: 1963832 - RNA, 22 nt, Human
cagggcacagggccuggcccau

SEQ ID NO: 1963833 - RNA, 22 nt, Human
cagggcagauuuuaguuuuauu

SEQ ID NO: 1963834 - RNA, 22 nt, Human
caggcccucugcccacucccug

SEQ ID NO: 1963835 - RNA, 21 nt, Human
caggcccucugcccacucccu

SEQ ID NO: 1963836 - RNA, 18 nt, Human
caggcccuccucccuccc

SEQ ID NO: 1963837 - RNA, 20 nt, Human
caggcccuccucccucccag

SEQ ID NO: 1963838 - RNA, 23 nt, Human
caggcccuccucccucccagcuc

SEQ ID NO: 1963839 - RNA, 20 nt, Human
caggcccucugcccacuccc

SEQ ID NO: 1963840 - RNA, 19 nt, Human
caggcccucugcccacucc

SEQ ID NO: 1963841 - RNA, 17 nt, Human
caggcccucugcccacu

SEQ ID NO: 1963842 - RNA, 16 nt, Human
caggcccucugcccac

SEQ ID NO: 1963843 - RNA, 19 nt, Human
caggcccuuccucuccacu

SEQ ID NO: 1963844 - RNA, 20 nt, Human
caggcccuuccucuccacug

SEQ ID NO: 1963845 - RNA, 21 nt, Human
caggcccuuccucuccacugc

SEQ ID NO: 1963846 - RNA, 23 nt, Human
caggcccuuccucuccacugccu

SEQ ID NO: 1963847 - RNA, 16 nt, Human
caggcccuuccucucc

SEQ ID NO: 1963848 - RNA, 17 nt, Human
caggcccuuccucucca

SEQ ID NO: 1963849 - RNA, 15 nt, Human
caggcccuuccucuc

SEQ ID NO: 1963850 - RNA, 15 nt, Human
caggcccucugccca

SEQ ID NO: 1963851 - RNA, 14 nt, Human
caggcccucugccc

SEQ ID NO: 1963852 - RNA, 11 nt, Human
caggcccuccu

SEQ ID NO: 1963853 - RNA, 13 nt, Human
caggcccucugcc

SEQ ID NO: 1963854 - RNA, 22 nt, Human
caggcccggcuccaggcuccuu

SEQ ID NO: 1963855 - RNA, 23 nt, Human
caggccccucccucuccagcagg

SEQ ID NO: 1963856 - RNA, 18 nt, Human
caggcccgaaagaggcac

SEQ ID NO: 1963857 - RNA, 20 nt, Human
caggcccggcuccaggcucc

SEQ ID NO: 1963858 - RNA, 21 nt, Human
caggcccggcuccaggcuccu

SEQ ID NO: 1963859 - RNA, 17 nt, Human
caggcccggcuccaggc

SEQ ID NO: 1963860 - RNA, 16 nt, Human
caggcccggcuccagg

SEQ ID NO: 1963861 - RNA, 18 nt, Human
caggcccggcuccaggcu

SEQ ID NO: 1963862 - RNA, 19 nt, Human
caggcccggcuccaggcuc

SEQ ID NO: 1963863 - RNA, 20 nt, Human
caggcucucaggccagcugc

SEQ ID NO: 1963864 - RNA, 19 nt, Human
caggcucucaggccagcug

SEQ ID NO: 1963865 - RNA, 18 nt, Human
caggcucucaggccagcu

SEQ ID NO: 1963866 - RNA, 17 nt, Human
caggcucucaggccagc

SEQ ID NO: 1963867 - RNA, 14 nt, Human
caggcucucaacag

SEQ ID NO: 1963868 - RNA, 15 nt, Human
caggcucucugggcu

SEQ ID NO: 1963869 - RNA, 13 nt, Human
caggcucucaaca

SEQ ID NO: 1963870 - RNA, 16 nt, Human
caggcucucugggcug

SEQ ID NO: 1963871 - RNA, 23 nt, Human
caggcucucaggccagcugcuug

SEQ ID NO: 1963872 - RNA, 21 nt, Human
caggcucucaggccagcugcu

SEQ ID NO: 1963873 - RNA, 16 nt, Human
caggcucucaggccag

SEQ ID NO: 1963874 - RNA, 15 nt, Human
caggcucucaggcca

SEQ ID NO: 1963875 - RNA, 14 nt, Human
caggcucucaggcc

SEQ ID NO: 1963876 - RNA, 13 nt, Human
caggcucucaggc

SEQ ID NO: 1963877 - RNA, 12 nt, Human
caggcucucagg

SEQ ID NO: 1963878 - RNA, 20 nt, Human
caggcucgggcuccccagcc

SEQ ID NO: 1963879 - RNA, 21 nt, Human
caggcuccuuuagcgcccagu

SEQ ID NO: 1963880 - RNA, 14 nt, Human
caggcuccuuuagc

SEQ ID NO: 1963881 - RNA, 18 nt, Human
caggcuccugccaccacg

SEQ ID NO: 1963882 - RNA, 19 nt, Human
caggcuccuuuagcgccca

SEQ ID NO: 1963883 - RNA, 20 nt, Human
caggcuccuuuagcgcccag

SEQ ID NO: 1963884 - RNA, 13 nt, Human
caggcuccugcca

SEQ ID NO: 1963885 - RNA, 14 nt, Human
caggcuccugccac

SEQ ID NO: 1963886 - RNA, 15 nt, Human
caggcuccugccacc

SEQ ID NO: 1963887 - RNA, 16 nt, Human
caggcuccugccacca

SEQ ID NO: 1963888 - RNA, 23 nt, Human
caggcucccaggagccugcccag

SEQ ID NO: 1963889 - RNA, 24 nt, Human
caggcucccaggagccugcccagc

SEQ ID NO: 1963890 - RNA, 15 nt, Human
caggcucccaggagc

SEQ ID NO: 1963891 - RNA, 22 nt, Human
caggcucccaggagccugccca

SEQ ID NO: 1963892 - RNA, 18 nt, Human
caggcucuucuccuuuca

SEQ ID NO: 1963893 - RNA, 22 nt, Human
caggcucuucuccuuucacaac

SEQ ID NO: 1963894 - RNA, 12 nt, Human
caggcugagccu

SEQ ID NO: 1963895 - RNA, 14 nt, Human
caggcucuucuccu

SEQ ID NO: 1963896 - RNA, 15 nt, Human
caggcucuucuccuu

SEQ ID NO: 1963897 - RNA, 12 nt, Human
caggcucuucuc

SEQ ID NO: 1963898 - RNA, 13 nt, Human
caggcugagccuc

SEQ ID NO: 1963899 - RNA, 14 nt, Human
caggcugagccuca

SEQ ID NO: 1963900 - RNA, 15 nt, Human
caggcugagccucag

SEQ ID NO: 1963901 - RNA, 16 nt, Human
caggcugagccucagu

SEQ ID NO: 1963902 - RNA, 17 nt, Human
caggcugagccucaguc

SEQ ID NO: 1963903 - RNA, 21 nt, Human
caggcugagccucagucuccc

SEQ ID NO: 1963904 - RNA, 14 nt, Human
caggcugagugcag

SEQ ID NO: 1963905 - RNA, 13 nt, Human
caggcugagcuga

SEQ ID NO: 1963906 - RNA, 15 nt, Human
caggcugagugcagg

SEQ ID NO: 1963907 - RNA, 16 nt, Human
caggcugagugcaggc

SEQ ID NO: 1963908 - RNA, 17 nt, Human
caggcugagugcaggcc

SEQ ID NO: 1963909 - RNA, 18 nt, Human
caggcugagugcaggccc

SEQ ID NO: 1963910 - RNA, 19 nt, Human
caggcugagugcaggccca

SEQ ID NO: 1963911 - RNA, 20 nt, Human
caggcugagugcaggcccac

SEQ ID NO: 1963912 - RNA, 21 nt, Human
caggcugagugcaggcccacc

SEQ ID NO: 1963913 - RNA, 22 nt, Human
caggcugagugcaggcccaccc

SEQ ID NO: 1963914 - RNA, 23 nt, Human
caggcugagugcaggcccacccu

SEQ ID NO: 1963915 - RNA, 23 nt, Human
caggcugggucgcccuggacugu

SEQ ID NO: 1963916 - RNA, 21 nt, Human
caggcugggucgcccuggacu

SEQ ID NO: 1963917 - RNA, 23 nt, Human
caggcugggcuucaguggcagcu

SEQ ID NO: 1963918 - RNA, 12 nt, Human
caggcuggcccu

SEQ ID NO: 1963919 - RNA, 14 nt, Human
caggcuggcccugc

SEQ ID NO: 1963920 - RNA, 15 nt, Human
caggcuggcccugcc

SEQ ID NO: 1963921 - RNA, 16 nt, Human
caggcuggcccugccc

SEQ ID NO: 1963922 - RNA, 23 nt, Human
caggcugcucuugaacuccugac

SEQ ID NO: 1963923 - RNA, 12 nt, Human
caggcugcucuu

SEQ ID NO: 1963924 - RNA, 20 nt, Human
caggcugcucuugaacuccu

SEQ ID NO: 1963925 - RNA, 15 nt, Human
caggcugcucucaaa

SEQ ID NO: 1963926 - RNA, 22 nt, Human
caggcugcucucaaaccccuga

SEQ ID NO: 1963927 - RNA, 21 nt, Human
caggcuuagucacugagacag

SEQ ID NO: 1963928 - RNA, 20 nt, Human
caggcuuagucacugagaca

SEQ ID NO: 1963929 - RNA, 17 nt, Human
caggcuuagucacugag

SEQ ID NO: 1963930 - RNA, 16 nt, Human
caggcuuagucacuga

SEQ ID NO: 1963931 - RNA, 22 nt, Human
caggcuguaucccaugagccuc

SEQ ID NO: 1963932 - RNA, 23 nt, Human
caggcuguaucccaugagccuca

SEQ ID NO: 1963933 - RNA, 14 nt, Human
caggcugugaguuu

SEQ ID NO: 1963934 - RNA, 12 nt, Human
caggcuggucuc

SEQ ID NO: 1963935 - RNA, 19 nt, Human
caggcuggucucaaacucu

SEQ ID NO: 1963936 - RNA, 20 nt, Human
caggcuggucucgaacuccu

SEQ ID NO: 1963937 - RNA, 22 nt, Human
caggcuggucucgaacuccuga

SEQ ID NO: 1963938 - RNA, 14 nt, Human
caggcuguauccca

SEQ ID NO: 1963939 - RNA, 23 nt, Human
caggcuggucucgaacuccugac

SEQ ID NO: 1963940 - RNA, 20 nt, Human
caggcuguaucccaugagcc

SEQ ID NO: 1963941 - RNA, 21 nt, Human
caggcuguaucccaugagccu

SEQ ID NO: 1963942 - RNA, 23 nt, Human
caggcuuagucacugagacagcc

SEQ ID NO: 1963943 - RNA, 22 nt, Human
caggcuuagucacugagacagc

SEQ ID NO: 1963944 - RNA, 23 nt, Human
caggcuuuuuuaucaugugaaau

SEQ ID NO: 1963945 - RNA, 15 nt, Human
cagggaaaagcagcu

SEQ ID NO: 1963946 - RNA, 13 nt, Human
caggcuuucuaga

SEQ ID NO: 1963947 - RNA, 18 nt, Human
caggcuuucuagaaagaa

SEQ ID NO: 1963948 - RNA, 19 nt, Human
caggcuuuguacagagugc

SEQ ID NO: 1963949 - RNA, 18 nt, Human
caggauucuuccucccuc

SEQ ID NO: 1963950 - RNA, 17 nt, Human
caggauucuuccucccu

SEQ ID NO: 1963951 - RNA, 19 nt, Human
caggauucucaccagcugu

SEQ ID NO: 1963952 - RNA, 22 nt, Human
caggauucucaccagcuguguc

SEQ ID NO: 1963953 - RNA, 19 nt, Human
caggauguacaaggacagc

SEQ ID NO: 1963954 - RNA, 23 nt, Human
caggauggccgggcgcgguggcu

SEQ ID NO: 1963955 - RNA, 22 nt, Human
caggaugaugacuauggaaaga

SEQ ID NO: 1963956 - RNA, 20 nt, Human
caggaugaugacuauggaaa

SEQ ID NO: 1963957 - RNA, 18 nt, Human
caggaugaugacuaugga

SEQ ID NO: 1963958 - RNA, 21 nt, Human
caggauauucucacagcucca

SEQ ID NO: 1963959 - RNA, 16 nt, Human
caggauauauuuuauu

SEQ ID NO: 1963960 - RNA, 17 nt, Human
caggauauauuuuauuu

SEQ ID NO: 1963961 - RNA, 13 nt, Human
caggaucagucug

SEQ ID NO: 1963962 - RNA, 14 nt, Human
caggaucagucuga

SEQ ID NO: 1963963 - RNA, 17 nt, Human
caggcagccaggccaca

SEQ ID NO: 1963964 - RNA, 16 nt, Human
caggcagccaggccac

SEQ ID NO: 1963965 - RNA, 22 nt, Human
caggcagcugucacugcugcuu

SEQ ID NO: 1963966 - RNA, 20 nt, Human
caggcaggaaggcugagagg

SEQ ID NO: 1963967 - RNA, 16 nt, Human
caggcagggcaggacc

SEQ ID NO: 1963968 - RNA, 17 nt, Human
caggcagggcaggacca

SEQ ID NO: 1963969 - RNA, 18 nt, Human
caggcagggcaggaccag

SEQ ID NO: 1963970 - RNA, 22 nt, Human
caggcagggcaggaccagccca

SEQ ID NO: 1963971 - RNA, 12 nt, Human
caggcagggcag

SEQ ID NO: 1963972 - RNA, 14 nt, Human
caggcagggcagga

SEQ ID NO: 1963973 - RNA, 13 nt, Human
caggcagguccag

SEQ ID NO: 1963974 - RNA, 16 nt, Human
caggcaggggcccugc

SEQ ID NO: 1963975 - RNA, 17 nt, Human
caggcaggggcccugca

SEQ ID NO: 1963976 - RNA, 23 nt, Human
caggcaggggcccugcagcucuc

SEQ ID NO: 1963977 - RNA, 18 nt, Human
caggcaggggcccugcag

SEQ ID NO: 1963978 - RNA, 20 nt, Human
caggcaggggcccugcagcu

SEQ ID NO: 1963979 - RNA, 21 nt, Human
caggcaggggcccugcagcuc

SEQ ID NO: 1963980 - RNA, 22 nt, Human
caggcaggggcccugcagcucu

SEQ ID NO: 1963981 - RNA, 15 nt, Human
caggcagccaggcca

SEQ ID NO: 1963982 - RNA, 14 nt, Human
caggcagccaggcc

SEQ ID NO: 1963983 - RNA, 21 nt, Human
caggcaaggggaaucuggagg

SEQ ID NO: 1963984 - RNA, 14 nt, Human
caggcaagcaccuc

SEQ ID NO: 1963985 - RNA, 15 nt, Human
caggcaagcaccucc

SEQ ID NO: 1963986 - RNA, 16 nt, Human
caggcaagcaccuccu

SEQ ID NO: 1963987 - RNA, 21 nt, Human
caggcaagcaccuccugccuc

SEQ ID NO: 1963988 - RNA, 20 nt, Human
caggauucuuccucccuccc

SEQ ID NO: 1963989 - RNA, 21 nt, Human
caggcaaacauuuucucuuag

SEQ ID NO: 1963990 - RNA, 23 nt, Human
caggcaaacauuuucucuuagaa

SEQ ID NO: 1963991 - RNA, 21 nt, Human
caggcauuccccaggaggcca

SEQ ID NO: 1963992 - RNA, 20 nt, Human
caggcauuccccaggaggcc

SEQ ID NO: 1963993 - RNA, 19 nt, Human
caggcauuccccaggaggc

SEQ ID NO: 1963994 - RNA, 18 nt, Human
caggcauuccccaggagg

SEQ ID NO: 1963995 - RNA, 23 nt, Human
caggcauuccccaggaggccagc

SEQ ID NO: 1963996 - RNA, 22 nt, Human
caggcauuccccaggaggccag

SEQ ID NO: 1963997 - RNA, 24 nt, Human
caggcauuccccaggaggccagcc

SEQ ID NO: 1963998 - RNA, 17 nt, Human
caggcauuccccaggag

SEQ ID NO: 1963999 - RNA, 16 nt, Human
caggcauuccccagga

SEQ ID NO: 1964000 - RNA, 15 nt, Human
caggcauuccccagg

SEQ ID NO: 1964001 - RNA, 13 nt, Human
caggcauucccca

SEQ ID NO: 1964002 - RNA, 15 nt, Human
caggcauguucucug

SEQ ID NO: 1964003 - RNA, 18 nt, Human
caggcauguucucugagg

SEQ ID NO: 1964004 - RNA, 19 nt, Human
caggcauguucucugagga

SEQ ID NO: 1964005 - RNA, 20 nt, Human
caggcauguucucugaggac

SEQ ID NO: 1964006 - RNA, 14 nt, Human
caggcagguccagg

SEQ ID NO: 1964007 - RNA, 15 nt, Human
caggcagguccaggg

SEQ ID NO: 1964008 - RNA, 19 nt, Human
caggcagguccaggguuug

SEQ ID NO: 1964009 - RNA, 12 nt, Human
caggcaggucuu

SEQ ID NO: 1964010 - RNA, 13 nt, Human
caggcaggucuug

SEQ ID NO: 1964011 - RNA, 22 nt, Human
caggcaggucuugaacuccugg

SEQ ID NO: 1964012 - RNA, 15 nt, Human
caggcaggugggaug

SEQ ID NO: 1964013 - RNA, 23 nt, Human
caggcaggucuugaacuccuggc

SEQ ID NO: 1964014 - RNA, 17 nt, Human
caggcaugguggcccac

SEQ ID NO: 1964015 - RNA, 15 nt, Human
caggcaugggccacc

SEQ ID NO: 1964016 - RNA, 16 nt, Human
caggcaugggccacca

SEQ ID NO: 1964017 - RNA, 22 nt, Human
caggcaugucccaugugagcug

SEQ ID NO: 1964018 - RNA, 14 nt, Human
caggccccucccuc

SEQ ID NO: 1964019 - RNA, 17 nt, Human
caggccccucccucucc

SEQ ID NO: 1964020 - RNA, 13 nt, Human
caggcccggcucc

SEQ ID NO: 1964021 - RNA, 14 nt, Human
caggcccggcucca

SEQ ID NO: 1964022 - RNA, 15 nt, Human
caggcccggcuccag

SEQ ID NO: 1964023 - RNA, 15 nt, Human
caggccccugccacc

SEQ ID NO: 1964024 - RNA, 17 nt, Human
caggccccugccacccu

SEQ ID NO: 1964025 - RNA, 19 nt, Human
caggccccugccacccugg

SEQ ID NO: 1964026 - RNA, 20 nt, Human
caggccccugccacccuggg

SEQ ID NO: 1964027 - RNA, 22 nt, Human
caggccaggcccucugcccacu

SEQ ID NO: 1964028 - RNA, 21 nt, Human
caggccaggcccucugcccac

SEQ ID NO: 1964029 - RNA, 20 nt, Human
caggccacaagacccuugug

SEQ ID NO: 1964030 - RNA, 21 nt, Human
caggccagggggccagucccu

SEQ ID NO: 1964031 - RNA, 15 nt, Human
caggccacccugugc

SEQ ID NO: 1964032 - RNA, 18 nt, Human
caggccauuccccgucuc

SEQ ID NO: 1964033 - RNA, 18 nt, Human
caggccacaagacccuug

SEQ ID NO: 1964034 - RNA, 17 nt, Human
caggccacaagacccuu

SEQ ID NO: 1964035 - RNA, 13 nt, Human
caggccacaagac

SEQ ID NO: 1964036 - RNA, 23 nt, Human
caggccaaacucaccugccccuc

SEQ ID NO: 1964037 - RNA, 18 nt, Human
caggccaaacucaccugc

SEQ ID NO: 1964038 - RNA, 16 nt, Human
caggcauuuucccccu

SEQ ID NO: 1964039 - RNA, 21 nt, Human
caggcccccagaaccccuggc

SEQ ID NO: 1964040 - RNA, 13 nt, Human
caggccccugcca

SEQ ID NO: 1964041 - RNA, 14 nt, Human
caggccccccuguc

SEQ ID NO: 1964042 - RNA, 15 nt, Human
caggccccaggaaag

SEQ ID NO: 1964043 - RNA, 21 nt, Human
caggcccaugggaggcuggag

SEQ ID NO: 1964044 - RNA, 22 nt, Human
caggcccaugggaggcuggagu

SEQ ID NO: 1964045 - RNA, 21 nt, Human
caggccauuccccgucucugg

SEQ ID NO: 1964046 - RNA, 13 nt, Human
caggcccacccug

SEQ ID NO: 1964047 - RNA, 14 nt, Human
caggcccacccugc

SEQ ID NO: 1964048 - RNA, 15 nt, Human
caggcccacccugcu

SEQ ID NO: 1964049 - RNA, 23 nt, Human
caggcccacccugcuuggcccag

SEQ ID NO: 1964050 - RNA, 24 nt, Human
caggcccacccugcuuggcccagg

SEQ ID NO: 1964051 - RNA, 19 nt, Human
caggagcccugggaggcuc

SEQ ID NO: 1964052 - RNA, 18 nt, Human
caggagcccugggaggcu

SEQ ID NO: 1964053 - RNA, 16 nt, Human
caggagcccugggagg

SEQ ID NO: 1964054 - RNA, 14 nt, Human
caggagcccuggga

SEQ ID NO: 1964055 - RNA, 11 nt, Human
caggagcccug

SEQ ID NO: 1964056 - RNA, 23 nt, Human
caggagccccgaggccuucucug

SEQ ID NO: 1964057 - RNA, 20 nt, Human
caggagccccgaggccuucu

SEQ ID NO: 1964058 - RNA, 22 nt, Human
caggagccccgaggccuucucu

SEQ ID NO: 1964059 - RNA, 19 nt, Human
caggagcagccacauuccu

SEQ ID NO: 1964060 - RNA, 14 nt, Human
caggagcagccaca

SEQ ID NO: 1964061 - RNA, 13 nt, Human
caggagcagccac

SEQ ID NO: 1964062 - RNA, 12 nt, Human
caggagcagcca

SEQ ID NO: 1964063 - RNA, 15 nt, Human
caggagccccgaggc

SEQ ID NO: 1964064 - RNA, 16 nt, Human
caggagcaguaucaug

SEQ ID NO: 1964065 - RNA, 20 nt, Human
caggagcaguaucaugaagc

SEQ ID NO: 1964066 - RNA, 16 nt, Human
caggagccccgaggcc

SEQ ID NO: 1964067 - RNA, 18 nt, Human
caggagccccgaggccuu

SEQ ID NO: 1964068 - RNA, 21 nt, Human
caggagcccugggaggcucug

SEQ ID NO: 1964069 - RNA, 12 nt, Human
caggagcccauu

SEQ ID NO: 1964070 - RNA, 23 nt, Human
caggagcccauuuggagggccug

SEQ ID NO: 1964071 - RNA, 11 nt, Human
caggagcccau

SEQ ID NO: 1964072 - RNA, 17 nt, Human
caggagccuccugcccu

SEQ ID NO: 1964073 - RNA, 14 nt, Human
caggagccuccugc

SEQ ID NO: 1964074 - RNA, 20 nt, Human
caggagccuccugcccuuac

SEQ ID NO: 1964075 - RNA, 16 nt, Human
caggagccugcccagc

SEQ ID NO: 1964076 - RNA, 16 nt, Human
caggagcgcucccuug

SEQ ID NO: 1964077 - RNA, 22 nt, Human
caggagcgcucccuugaccugc

SEQ ID NO: 1964078 - RNA, 14 nt, Human
caggagucccugcc

SEQ ID NO: 1964079 - RNA, 15 nt, Human
caggagucccugcca

SEQ ID NO: 1964080 - RNA, 21 nt, Human
caggagucccugccaucaugu

SEQ ID NO: 1964081 - RNA, 12 nt, Human
caggagugagca

SEQ ID NO: 1964082 - RNA, 19 nt, Human
caggagcuccauacacacg

SEQ ID NO: 1964083 - RNA, 20 nt, Human
caggaguaaaagagucaagu

SEQ ID NO: 1964084 - RNA, 15 nt, Human
caggaguagugaaga

SEQ ID NO: 1964085 - RNA, 22 nt, Human
caggaguagugaagacuccaga

SEQ ID NO: 1964086 - RNA, 23 nt, Human
caggaguagugaagacuccagaa

SEQ ID NO: 1964087 - RNA, 12 nt, Human
caggacucugcc

SEQ ID NO: 1964088 - RNA, 13 nt, Human
caggacucugccu

SEQ ID NO: 1964089 - RNA, 15 nt, Human
caggacucugccucc

SEQ ID NO: 1964090 - RNA, 16 nt, Human
caggacucugccuccu

SEQ ID NO: 1964091 - RNA, 12 nt, Human
caggagaagaaa

SEQ ID NO: 1964092 - RNA, 16 nt, Human
caggagaagaaagaac

SEQ ID NO: 1964093 - RNA, 19 nt, Human
caggagaagaaagaacuau

SEQ ID NO: 1964094 - RNA, 21 nt, Human
caggagacuguggagacugcu

SEQ ID NO: 1964095 - RNA, 19 nt, Human
caggagaugcugugccccu

SEQ ID NO: 1964096 - RNA, 23 nt, Human
caggagaugcugugccccuggcc

SEQ ID NO: 1964097 - RNA, 16 nt, Human
caggagaugcugugcc

SEQ ID NO: 1964098 - RNA, 17 nt, Human
caggagaugcugugccc

SEQ ID NO: 1964099 - RNA, 18 nt, Human
caggagaggauggcccag

SEQ ID NO: 1964100 - RNA, 23 nt, Human
caggaguuugagaccaaccuggg

SEQ ID NO: 1964101 - RNA, 22 nt, Human
caggaguuugagaccaaccugg

SEQ ID NO: 1964102 - RNA, 13 nt, Human
caggauagacuuu

SEQ ID NO: 1964103 - RNA, 21 nt, Human
caggaguuugagaccaaccug

SEQ ID NO: 1964104 - RNA, 19 nt, Human
caggaguuucguuuucaaa

SEQ ID NO: 1964105 - RNA, 16 nt, Human
caggaguuggaagugu

SEQ ID NO: 1964106 - RNA, 13 nt, Human
cagguggggcagc

SEQ ID NO: 1964107 - RNA, 14 nt, Human
cagguggggcagcu

SEQ ID NO: 1964108 - RNA, 15 nt, Human
cagguggggcagcuu

SEQ ID NO: 1964109 - RNA, 16 nt, Human
cagguggggcagcuug

SEQ ID NO: 1964110 - RNA, 18 nt, Human
cagguggggucacucugg

SEQ ID NO: 1964111 - RNA, 17 nt, Human
cagguggggcagcuuga

SEQ ID NO: 1964112 - RNA, 22 nt, Human
cagguggggucacucuggcagc

SEQ ID NO: 1964113 - RNA, 21 nt, Human
cagguggggucacucuggcag

SEQ ID NO: 1964114 - RNA, 20 nt, Human
cagguggggucacucuggca

SEQ ID NO: 1964115 - RNA, 19 nt, Human
cagguggggucacucuggc

SEQ ID NO: 1964116 - RNA, 23 nt, Human
cagguggggucacucuggcagcu

SEQ ID NO: 1964117 - RNA, 18 nt, Human
caggugguuauggagagg

SEQ ID NO: 1964118 - RNA, 16 nt, Human
caggugggugucugcg

SEQ ID NO: 1964119 - RNA, 20 nt, Human
caggugguuauggagagggu

SEQ ID NO: 1964120 - RNA, 11 nt, Human
caggugucccu

SEQ ID NO: 1964121 - RNA, 14 nt, Human
caggugucccugca

SEQ ID NO: 1964122 - RNA, 13 nt, Human
caguaauaacucu

SEQ ID NO: 1964123 - RNA, 12 nt, Human
caguaauaacuc

SEQ ID NO: 1964124 - RNA, 19 nt, Human
caguaagaucacuguuuag

SEQ ID NO: 1964125 - RNA, 20 nt, Human
caguaagaucacuguuuaga

SEQ ID NO: 1964126 - RNA, 21 nt, Human
caguaagaucacuguuuagau

SEQ ID NO: 1964127 - RNA, 21 nt, Human
caguacaaugugacuuugaaa

SEQ ID NO: 1964128 - RNA, 23 nt, Human
caguaccauuuaauggggaggac

SEQ ID NO: 1964129 - RNA, 19 nt, Human
caguacccauggggcuagg

SEQ ID NO: 1964130 - RNA, 19 nt, Human
caguacauucucaguuuuu

SEQ ID NO: 1964131 - RNA, 21 nt, Human
caguacauucucaguuuuucu

SEQ ID NO: 1964132 - RNA, 23 nt, Human
caguaccuggguccccagcccuu

SEQ ID NO: 1964133 - RNA, 22 nt, Human
caguaccuggguccccagcccu

SEQ ID NO: 1964134 - RNA, 16 nt, Human
caguacccugguugug

SEQ ID NO: 1964135 - RNA, 17 nt, Human
caguacccugguugugu

SEQ ID NO: 1964136 - RNA, 12 nt, Human
cagguucagcuu

SEQ ID NO: 1964137 - RNA, 23 nt, Human
cagguuaggcaguauaaagaaua

SEQ ID NO: 1964138 - RNA, 22 nt, Human
cagguuaggcaguauaaagaau

SEQ ID NO: 1964139 - RNA, 19 nt, Human
cagguuccacagaggacac

SEQ ID NO: 1964140 - RNA, 15 nt, Human
cagguuccacagagg

SEQ ID NO: 1964141 - RNA, 13 nt, Human
cagguucagcuug

SEQ ID NO: 1964142 - RNA, 22 nt, Human
caguaaaugggggugcauuuga

SEQ ID NO: 1964143 - RNA, 13 nt, Human
caguaacacaggc

SEQ ID NO: 1964144 - RNA, 21 nt, Human
caguaaaugggggugcauuug

SEQ ID NO: 1964145 - RNA, 20 nt, Human
caguaaaugggggugcauuu

SEQ ID NO: 1964146 - RNA, 22 nt, Human
caguaacacauagacugugcgc

SEQ ID NO: 1964147 - RNA, 15 nt, Human
caguaagaucacugu

SEQ ID NO: 1964148 - RNA, 16 nt, Human
caguaagaucacuguu

SEQ ID NO: 1964149 - RNA, 17 nt, Human
caguaagaucacuguuu

SEQ ID NO: 1964150 - RNA, 15 nt, Human
caggugucccugcac

SEQ ID NO: 1964151 - RNA, 16 nt, Human
caggugucccugcacu

SEQ ID NO: 1964152 - RNA, 18 nt, Human
caggugucccugcacuug

SEQ ID NO: 1964153 - RNA, 19 nt, Human
caggugucccugcacuugc

SEQ ID NO: 1964154 - RNA, 12 nt, Human
caggugugaacc

SEQ ID NO: 1964155 - RNA, 12 nt, Human
cagguguucuuc

SEQ ID NO: 1964156 - RNA, 20 nt, Human
cagguguuuauaucuccuuu

SEQ ID NO: 1964157 - RNA, 16 nt, Human
cagguuaaauguuuug

SEQ ID NO: 1964158 - RNA, 20 nt, Human
cagguuaaauguuuuguaaa

SEQ ID NO: 1964159 - RNA, 13 nt, Human
cagguuaaauguu

SEQ ID NO: 1964160 - RNA, 14 nt, Human
cagguuaaauguuu

SEQ ID NO: 1964161 - RNA, 15 nt, Human
cagguuaaauguuuu

SEQ ID NO: 1964162 - RNA, 22 nt, Human
caggugugagucaccaagccca

SEQ ID NO: 1964163 - RNA, 23 nt, Human
caggugugagucaccaagcccag

SEQ ID NO: 1964164 - RNA, 21 nt, Human
caggugugagccaccacgccc

SEQ ID NO: 1964165 - RNA, 16 nt, Human
caggugugagggcagu

SEQ ID NO: 1964166 - RNA, 20 nt, Human
caggugugagggcagugcaa

SEQ ID NO: 1964167 - RNA, 16 nt, Human
caggugugaaccacca

SEQ ID NO: 1964168 - RNA, 19 nt, Human
caggugugaaccaccacac

SEQ ID NO: 1964169 - RNA, 22 nt, Human
caggugugaaccaccacaccca

SEQ ID NO: 1964170 - RNA, 23 nt, Human
caggugugaaccaccacacccag

SEQ ID NO: 1964171 - RNA, 20 nt, Human
caggugugagucaccaagcc

SEQ ID NO: 1964172 - RNA, 21 nt, Human
caggugugagucaccaagccc

SEQ ID NO: 1964173 - RNA, 16 nt, Human
caggugugagucacca

SEQ ID NO: 1964174 - RNA, 18 nt, Human
caggugugagccaccacg

SEQ ID NO: 1964175 - RNA, 21 nt, Human
caggggugggacacccuguga

SEQ ID NO: 1964176 - RNA, 20 nt, Human
caggggugggacacccugug

SEQ ID NO: 1964177 - RNA, 15 nt, Human
caggggugggacacc

SEQ ID NO: 1964178 - RNA, 14 nt, Human
caggggugggacac

SEQ ID NO: 1964179 - RNA, 16 nt, Human
caggguuuugccaugu

SEQ ID NO: 1964180 - RNA, 16 nt, Human
cagggucucacucugu

SEQ ID NO: 1964181 - RNA, 14 nt, Human
cagguaacaggcag

SEQ ID NO: 1964182 - RNA, 15 nt, Human
cagguaacaggcaga

SEQ ID NO: 1964183 - RNA, 16 nt, Human
cagguaacaggcagau

SEQ ID NO: 1964184 - RNA, 17 nt, Human
cagguaacaggcagaua

SEQ ID NO: 1964185 - RNA, 18 nt, Human
caggguccuguagcccua

SEQ ID NO: 1964186 - RNA, 23 nt, Human
cagggucccugguggcagcucac

SEQ ID NO: 1964187 - RNA, 21 nt, Human
cagggucucacuauguugccc

SEQ ID NO: 1964188 - RNA, 22 nt, Human
cagggucucacuauguugccca

SEQ ID NO: 1964189 - RNA, 23 nt, Human
cagggucucacuauguugcccag

SEQ ID NO: 1964190 - RNA, 15 nt, Human
cagggucucacucug

SEQ ID NO: 1964191 - RNA, 12 nt, Human
cagggguuccuu

SEQ ID NO: 1964192 - RNA, 19 nt, Human
cagggguuccuucugggca

SEQ ID NO: 1964193 - RNA, 20 nt, Human
cagggguuccuucugggcau

SEQ ID NO: 1964194 - RNA, 21 nt, Human
cagggguuccuucugggcauu

SEQ ID NO: 1964195 - RNA, 15 nt, Human
caggguacaaaaaau

SEQ ID NO: 1964196 - RNA, 20 nt, Human
caggguauuccagagugggg

SEQ ID NO: 1964197 - RNA, 21 nt, Human
caggguauuccagagugggga

SEQ ID NO: 1964198 - RNA, 22 nt, Human
cagggucccugguggcagcuca

SEQ ID NO: 1964199 - RNA, 19 nt, Human
cagggucccugguggcagc

SEQ ID NO: 1964200 - RNA, 18 nt, Human
cagggucccugguggcag

SEQ ID NO: 1964201 - RNA, 15 nt, Human
cagggucccuggugg

SEQ ID NO: 1964202 - RNA, 14 nt, Human
cagggucccuggug

SEQ ID NO: 1964203 - RNA, 12 nt, Human
cagggucccugg

SEQ ID NO: 1964204 - RNA, 18 nt, Human
cagguagaggugcaugcc

SEQ ID NO: 1964205 - RNA, 21 nt, Human
cagguagaacgccagggaccc

SEQ ID NO: 1964206 - RNA, 17 nt, Human
cagguagaacgccaggg

SEQ ID NO: 1964207 - RNA, 19 nt, Human
cagguagaacgccagggac

SEQ ID NO: 1964208 - RNA, 21 nt, Human
cagguagcauagcucuguaca

SEQ ID NO: 1964209 - RNA, 13 nt, Human
cagguaggaauau

SEQ ID NO: 1964210 - RNA, 15 nt, Human
cagguaggaauauua

SEQ ID NO: 1964211 - RNA, 20 nt, Human
cagguaggaauauuauauuu

SEQ ID NO: 1964212 - RNA, 23 nt, Human
cagguaggaauauuauauuugga

SEQ ID NO: 1964213 - RNA, 20 nt, Human
cagguaacaggcagauacag

SEQ ID NO: 1964214 - RNA, 21 nt, Human
cagguaacaggcagauacagg

SEQ ID NO: 1964215 - RNA, 17 nt, Human
cagguaaucgaccugcc

SEQ ID NO: 1964216 - RNA, 18 nt, Human
cagguaaucgaccugccu

SEQ ID NO: 1964217 - RNA, 19 nt, Human
cagguaaucgaccugccuc

SEQ ID NO: 1964218 - RNA, 20 nt, Human
cagguaaucgaccugccucg

SEQ ID NO: 1964219 - RNA, 12 nt, Human
cagguacuuugu

SEQ ID NO: 1964220 - RNA, 13 nt, Human
cagguacuuuguc

SEQ ID NO: 1964221 - RNA, 23 nt, Human
cagguacuuugucuaagaaacau

SEQ ID NO: 1964222 - RNA, 14 nt, Human
cagguaccaguucu

SEQ ID NO: 1964223 - RNA, 15 nt, Human
cagguaccaguucuu

SEQ ID NO: 1964224 - RNA, 13 nt, Human
cagguccccagac

SEQ ID NO: 1964225 - RNA, 18 nt, Human
cagguccccagcuuuggc

SEQ ID NO: 1964226 - RNA, 12 nt, Human
cagguccccaga

SEQ ID NO: 1964227 - RNA, 18 nt, Human
caggucccuaauaaagcu

SEQ ID NO: 1964228 - RNA, 17 nt, Human
caggucccuaauaaagc

SEQ ID NO: 1964229 - RNA, 16 nt, Human
caggucccuaauaaag

SEQ ID NO: 1964230 - RNA, 15 nt, Human
caggucccuaauaaa

SEQ ID NO: 1964231 - RNA, 14 nt, Human
caggucccuaauaa

SEQ ID NO: 1964232 - RNA, 13 nt, Human
caggucccuaaua

SEQ ID NO: 1964233 - RNA, 12 nt, Human
caggucccuaau

SEQ ID NO: 1964234 - RNA, 11 nt, Human
caggucccuaa

SEQ ID NO: 1964235 - RNA, 22 nt, Human
caggucccuaauaaagcugugu

SEQ ID NO: 1964236 - RNA, 21 nt, Human
caggucccuaauaaagcugug

SEQ ID NO: 1964237 - RNA, 20 nt, Human
caggucccuaauaaagcugu

SEQ ID NO: 1964238 - RNA, 19 nt, Human
caggucccuaauaaagcug

SEQ ID NO: 1964239 - RNA, 14 nt, Human
cagguccucccugc

SEQ ID NO: 1964240 - RNA, 17 nt, Human
cagguccugcucagcag

SEQ ID NO: 1964241 - RNA, 12 nt, Human
cagguccugcuc

SEQ ID NO: 1964242 - RNA, 13 nt, Human
cagguccugcuca

SEQ ID NO: 1964243 - RNA, 15 nt, Human
cagguccugcucagc

SEQ ID NO: 1964244 - RNA, 21 nt, Human
caggucuaccccucccggccc

SEQ ID NO: 1964245 - RNA, 18 nt, Human
caggucuugaacuccugg

SEQ ID NO: 1964246 - RNA, 19 nt, Human
caggucuugaacuccuggc

SEQ ID NO: 1964247 - RNA, 20 nt, Human
caggucuugaacuccuggcc

SEQ ID NO: 1964248 - RNA, 21 nt, Human
caggucuugaacuccuggccu

SEQ ID NO: 1964249 - RNA, 22 nt, Human
caggucuugaacuccuggccuc

SEQ ID NO: 1964250 - RNA, 23 nt, Human
caggucuugaacuccuggccuca

SEQ ID NO: 1964251 - RNA, 16 nt, Human
cagguggccacuccag

SEQ ID NO: 1964252 - RNA, 19 nt, Human
cagguggccacuccagacc

SEQ ID NO: 1964253 - RNA, 21 nt, Human
cagguggccacuccagacccc

SEQ ID NO: 1964254 - RNA, 15 nt, Human
cagguggccacucca

SEQ ID NO: 1964255 - RNA, 17 nt, Human
cagguggagguggcauc

SEQ ID NO: 1964256 - RNA, 20 nt, Human
cagguggagguggcaucccc

SEQ ID NO: 1964257 - RNA, 20 nt, Human
caggugagaagcagaggaag

SEQ ID NO: 1964258 - RNA, 13 nt, Human
caggugagaagca

SEQ ID NO: 1964259 - RNA, 21 nt, Human
caggugagaagcagaggaagg

SEQ ID NO: 1964260 - RNA, 14 nt, Human
caggugaaggaggc

SEQ ID NO: 1964261 - RNA, 18 nt, Human
caggugaaggaggcucca

SEQ ID NO: 1964262 - RNA, 19 nt, Human
caggugaaggaggcuccag

SEQ ID NO: 1964263 - RNA, 23 nt, Human
caggugaaggaggcuccaggcag

SEQ ID NO: 1964264 - RNA, 23 nt, Human
cagugccuuauggaacacucuga

SEQ ID NO: 1964265 - RNA, 16 nt, Human
cagugcgggugcagac

SEQ ID NO: 1964266 - RNA, 13 nt, Human
cagugcuacugaa

SEQ ID NO: 1964267 - RNA, 15 nt, Human
cagugcuacugaaag

SEQ ID NO: 1964268 - RNA, 22 nt, Human
cagugccuuauggaacacucug

SEQ ID NO: 1964269 - RNA, 21 nt, Human
cagugccuuauggaacacucu

SEQ ID NO: 1964270 - RNA, 20 nt, Human
cagugccuuauggaacacuc

SEQ ID NO: 1964271 - RNA, 19 nt, Human
cagugccuuauggaacacu

SEQ ID NO: 1964272 - RNA, 18 nt, Human
cagugccuuauggaacac

SEQ ID NO: 1964273 - RNA, 17 nt, Human
cagugccuuauggaaca

SEQ ID NO: 1964274 - RNA, 16 nt, Human
cagugccuuauggaac

SEQ ID NO: 1964275 - RNA, 15 nt, Human
cagugccuuauggaa

SEQ ID NO: 1964276 - RNA, 13 nt, Human
cagugccuuaugg

SEQ ID NO: 1964277 - RNA, 11 nt, Human
cagugccuuau

SEQ ID NO: 1964278 - RNA, 18 nt, Human
cagugccgagaaggaagc

SEQ ID NO: 1964279 - RNA, 15 nt, Human
cagugccgagaagga

SEQ ID NO: 1964280 - RNA, 15 nt, Human
cagugccuaaaauaa

SEQ ID NO: 1964281 - RNA, 19 nt, Human
cagugccuaaaauaagaau

SEQ ID NO: 1964282 - RNA, 19 nt, Human
cagugagucgaggacaggg

SEQ ID NO: 1964283 - RNA, 20 nt, Human
cagugagucgaggacaggga

SEQ ID NO: 1964284 - RNA, 22 nt, Human
cagugagucgaggacagggagg

SEQ ID NO: 1964285 - RNA, 23 nt, Human
cagugagucgaggacagggaggu

SEQ ID NO: 1964286 - RNA, 12 nt, Human
cagugauauucu

SEQ ID NO: 1964287 - RNA, 14 nt, Human
cagugauauucuuu

SEQ ID NO: 1964288 - RNA, 15 nt, Human
cagugauauucuuug

SEQ ID NO: 1964289 - RNA, 18 nt, Human
cagugauauucuuuguua

SEQ ID NO: 1964290 - RNA, 22 nt, Human
cagugccccgucuacagcuccc

SEQ ID NO: 1964291 - RNA, 15 nt, Human
cagugcccuccagga

SEQ ID NO: 1964292 - RNA, 17 nt, Human
cagugauuaccagggac

SEQ ID NO: 1964293 - RNA, 22 nt, Human
cagugauauucuuuguuaauuu

SEQ ID NO: 1964294 - RNA, 18 nt, Human
cagugauuaccagggacu

SEQ ID NO: 1964295 - RNA, 22 nt, Human
cagugaugugccuaaauaaguu

SEQ ID NO: 1964296 - RNA, 18 nt, Human
cagucuggaaugcagugg

SEQ ID NO: 1964297 - RNA, 21 nt, Human
caguccuuaccagcagagcac

SEQ ID NO: 1964298 - RNA, 20 nt, Human
caguccuuaccagcagagca

SEQ ID NO: 1964299 - RNA, 19 nt, Human
caguccuuaccagcagagc

SEQ ID NO: 1964300 - RNA, 18 nt, Human
caguccuuaccagcagag

SEQ ID NO: 1964301 - RNA, 15 nt, Human
caguccuuaccagca

SEQ ID NO: 1964302 - RNA, 17 nt, Human
caguccucccaucucac

SEQ ID NO: 1964303 - RNA, 16 nt, Human
caguccucccaucuca

SEQ ID NO: 1964304 - RNA, 22 nt, Human
cagucuuagaucauaguuuuau

SEQ ID NO: 1964305 - RNA, 16 nt, Human
cagucuuaugcuucca

SEQ ID NO: 1964306 - RNA, 17 nt, Human
cagucuuaugcuuccag

SEQ ID NO: 1964307 - RNA, 19 nt, Human
cagucuggaaugcaguggu

SEQ ID NO: 1964308 - RNA, 20 nt, Human
cagucuuaugcuuccagaaa

SEQ ID NO: 1964309 - RNA, 18 nt, Human
cagucuuaugcuuccaga

SEQ ID NO: 1964310 - RNA, 19 nt, Human
cagucuuaugcuuccagaa

SEQ ID NO: 1964311 - RNA, 22 nt, Human
cagucuuuaaucugagaggcca

SEQ ID NO: 1964312 - RNA, 20 nt, Human
cagucuuucaacucauugca

SEQ ID NO: 1964313 - RNA, 16 nt, Human
cagugaaagaaaauaa

SEQ ID NO: 1964314 - RNA, 20 nt, Human
cagugaaagaaaauaacaau

SEQ ID NO: 1964315 - RNA, 22 nt, Human
cagugaaaauaagccaugagaa

SEQ ID NO: 1964316 - RNA, 23 nt, Human
cagugaaaauaagccaugagaau

SEQ ID NO: 1964317 - RNA, 15 nt, Human
cagugagacagcucu

SEQ ID NO: 1964318 - RNA, 13 nt, Human
cagugagagcaga

SEQ ID NO: 1964319 - RNA, 15 nt, Human
cagugagagcagaug

SEQ ID NO: 1964320 - RNA, 20 nt, Human
cagugaccuggaaggcccag

SEQ ID NO: 1964321 - RNA, 23 nt, Human
cagugaccuggaaggcccagcac

SEQ ID NO: 1964322 - RNA, 20 nt, Human
cagugaggcucugcccuugg

SEQ ID NO: 1964323 - RNA, 19 nt, Human
cagugaggcucugcccuug

SEQ ID NO: 1964324 - RNA, 18 nt, Human
cagugaggcucugcccuu

SEQ ID NO: 1964325 - RNA, 17 nt, Human
cagugaggcucugcccu

SEQ ID NO: 1964326 - RNA, 23 nt, Human
cagugaggguaaguauuuuccug

SEQ ID NO: 1964327 - RNA, 21 nt, Human
cagugaggcucugcccuuggu

SEQ ID NO: 1964328 - RNA, 17 nt, Human
cagugagucgaggacag

SEQ ID NO: 1964329 - RNA, 18 nt, Human
cagugagucgaggacagg

SEQ ID NO: 1964330 - RNA, 16 nt, Human
cagugaggcucugccc

SEQ ID NO: 1964331 - RNA, 15 nt, Human
cagugaggcucugcc

SEQ ID NO: 1964332 - RNA, 14 nt, Human
cagugaggcucugc

SEQ ID NO: 1964333 - RNA, 13 nt, Human
cagugaggcucug

SEQ ID NO: 1964334 - RNA, 12 nt, Human
cagugaggcucu

SEQ ID NO: 1964335 - RNA, 23 nt, Human
cagugagcuggagauacuugguc

SEQ ID NO: 1964336 - RNA, 14 nt, Human
cagugagcuggaga

SEQ ID NO: 1964337 - RNA, 24 nt, Human
cagugagccgagauugcaccacug

SEQ ID NO: 1964338 - RNA, 16 nt, Human
cagucccugccaaugg

SEQ ID NO: 1964339 - RNA, 15 nt, Human
cagucccugccaaug

SEQ ID NO: 1964340 - RNA, 14 nt, Human
cagucccugccaau

SEQ ID NO: 1964341 - RNA, 13 nt, Human
cagucccugccaa

SEQ ID NO: 1964342 - RNA, 14 nt, Human
cagucccugaggca

SEQ ID NO: 1964343 - RNA, 22 nt, Human
caguccccuucccgugaccugg

SEQ ID NO: 1964344 - RNA, 14 nt, Human
caguccccuucccg

SEQ ID NO: 1964345 - RNA, 20 nt, Human
cagucccugaggcagguccc

SEQ ID NO: 1964346 - RNA, 23 nt, Human
cagucccugaggcagguccccag

SEQ ID NO: 1964347 - RNA, 12 nt, Human
cagucccugcca

SEQ ID NO: 1964348 - RNA, 15 nt, Human
caguccucccaucuc

SEQ ID NO: 1964349 - RNA, 14 nt, Human
caguccucccaucu

SEQ ID NO: 1964350 - RNA, 13 nt, Human
caguccucccauc

SEQ ID NO: 1964351 - RNA, 12 nt, Human
caguccucccau

SEQ ID NO: 1964352 - RNA, 17 nt, Human
cagucccugccaaugga

SEQ ID NO: 1964353 - RNA, 16 nt, Human
cagucccuuuaaagaa

SEQ ID NO: 1964354 - RNA, 13 nt, Human
caguccccagaac

SEQ ID NO: 1964355 - RNA, 15 nt, Human
caguccccagaacuc

SEQ ID NO: 1964356 - RNA, 19 nt, Human
caguccccagaacucugcc

SEQ ID NO: 1964357 - RNA, 20 nt, Human
caguccccagaacucugccu

SEQ ID NO: 1964358 - RNA, 21 nt, Human
caguccccagaacucugccug

SEQ ID NO: 1964359 - RNA, 23 nt, Human
caguccccgugaaggagagcccu

SEQ ID NO: 1964360 - RNA, 16 nt, Human
cagucccccugcccca

SEQ ID NO: 1964361 - RNA, 17 nt, Human
cagucccccugccccag

SEQ ID NO: 1964362 - RNA, 14 nt, Human
caguagcaggcccg

SEQ ID NO: 1964363 - RNA, 14 nt, Human
caguagcugggacc

SEQ ID NO: 1964364 - RNA, 19 nt, Human
caguagcugggaccacagg

SEQ ID NO: 1964365 - RNA, 20 nt, Human
caguagcugggaccacaggu

SEQ ID NO: 1964366 - RNA, 18 nt, Human
caguagcuuaagaaaaaa

SEQ ID NO: 1964367 - RNA, 22 nt, Human
caguaggacaaggugcaggcag

SEQ ID NO: 1964368 - RNA, 23 nt, Human
caguaggacaaggugcaggcagg

SEQ ID NO: 1964369 - RNA, 24 nt, Human
caguaggacaaggugcaggcaggc

SEQ ID NO: 1964370 - RNA, 13 nt, Human
caguagaaaauau

SEQ ID NO: 1964371 - RNA, 13 nt, Human
caguauaaagaau

SEQ ID NO: 1964372 - RNA, 20 nt, Human
caguaguuugcauuucagaa

SEQ ID NO: 1964373 - RNA, 15 nt, Human
caguaguuugcauuu

SEQ ID NO: 1964374 - RNA, 19 nt, Human
caguaguuugcauuucaga

SEQ ID NO: 1964375 - RNA, 21 nt, Human
caguaguuugcauuucagaaa

SEQ ID NO: 1964376 - RNA, 14 nt, Human
caguauaaagaaua

SEQ ID NO: 1964377 - RNA, 15 nt, Human
caguauaaagaauag

SEQ ID NO: 1964378 - RNA, 17 nt, Human
caguauaaagaauagga

SEQ ID NO: 1964379 - RNA, 18 nt, Human
caguauaaagaauaggac

SEQ ID NO: 1964380 - RNA, 21 nt, Human
caguauaaagaauaggacuug

SEQ ID NO: 1964381 - RNA, 12 nt, Human
caguagugauag

SEQ ID NO: 1964382 - RNA, 12 nt, Human
caguauggcagc

SEQ ID NO: 1964383 - RNA, 21 nt, Human
caguaucuugaagacuuuucu

SEQ ID NO: 1964384 - RNA, 18 nt, Human
caguaucuugaagacuuu

SEQ ID NO: 1964385 - RNA, 12 nt, Human
caguaucuugaa

SEQ ID NO: 1964386 - RNA, 15 nt, Human
caguaucucagggcc

SEQ ID NO: 1964387 - RNA, 14 nt, Human
caguaucaugaagc

SEQ ID NO: 1964388 - RNA, 15 nt, Human
caguaucaugaagcc

SEQ ID NO: 1964389 - RNA, 13 nt, Human
caguaucucaggg

SEQ ID NO: 1964390 - RNA, 17 nt, Human
cagucauucagauauga

SEQ ID NO: 1964391 - RNA, 19 nt, Human
cagucauuauguuaauauu

SEQ ID NO: 1964392 - RNA, 20 nt, Human
cagucauucagauaugauuc

SEQ ID NO: 1964393 - RNA, 22 nt, Human
caguccaagggguccccuccag

SEQ ID NO: 1964394 - RNA, 13 nt, Human
caguccaugaaga

SEQ ID NO: 1964395 - RNA, 14 nt, Human
caguccauugaaag

SEQ ID NO: 1964396 - RNA, 16 nt, Human
caguccauagcagaga

SEQ ID NO: 1964397 - RNA, 12 nt, Human
cagucccagcag

SEQ ID NO: 1964398 - RNA, 13 nt, Human
cagucccagcagc

SEQ ID NO: 1964399 - RNA, 14 nt, Human
cagucccagcagcc

SEQ ID NO: 1964400 - RNA, 15 nt, Human
cagucccagcagcca

SEQ ID NO: 1964401 - RNA, 17 nt, Human
cagucccagcagccagc

SEQ ID NO: 1964402 - RNA, 18 nt, Human
cagucccagcagccagcc

SEQ ID NO: 1964403 - RNA, 19 nt, Human
cagucccagcagccagcca

SEQ ID NO: 1964404 - RNA, 12 nt, Human
caguauguggaa

SEQ ID NO: 1964405 - RNA, 16 nt, Human
caguauuacuucugcu

SEQ ID NO: 1964406 - RNA, 18 nt, Human
caguauuacuucugcuac

SEQ ID NO: 1964407 - RNA, 19 nt, Human
caguauuacuucugcuaca

SEQ ID NO: 1964408 - RNA, 19 nt, Human
cagucaggcucucugggcu

SEQ ID NO: 1964409 - RNA, 22 nt, Human
cagucaggcucucugggcugac

SEQ ID NO: 1964410 - RNA, 15 nt, Human
cagucagguugaaga

SEQ ID NO: 1964411 - RNA, 22 nt, Human
cagucaucgaguggcccaacag

SEQ ID NO: 1964412 - RNA, 16 nt, Human
cagucaggcucucugg

SEQ ID NO: 1964413 - RNA, 18 nt, Human
cagucaggcucucugggc

SEQ ID NO: 1964414 - RNA, 22 nt, Human
caggaagcucagggccuggcuc

SEQ ID NO: 1964415 - RNA, 15 nt, Human
caggaaggcuaaagg

SEQ ID NO: 1964416 - RNA, 19 nt, Human
caggaaggcugagaggaga

SEQ ID NO: 1964417 - RNA, 16 nt, Human
caggaaguacuggaga

SEQ ID NO: 1964418 - RNA, 14 nt, Human
caggaaguacugga

SEQ ID NO: 1964419 - RNA, 12 nt, Human
caggaaguacug

SEQ ID NO: 1964420 - RNA, 15 nt, Human
caggaaguagaggag

SEQ ID NO: 1964421 - RNA, 20 nt, Human
caggaaguacuggagaaaau

SEQ ID NO: 1964422 - RNA, 18 nt, Human
caggaaguacuggagaaa

SEQ ID NO: 1964423 - RNA, 17 nt, Human
caggaaguacuggagaa

SEQ ID NO: 1964424 - RNA, 16 nt, Human
caggaaguagaggagg

SEQ ID NO: 1964425 - RNA, 15 nt, Human
caggaaguagcacag

SEQ ID NO: 1964426 - RNA, 16 nt, Human
caggaaguagcacagg

SEQ ID NO: 1964427 - RNA, 17 nt, Human
caggaaguagcacaggc

SEQ ID NO: 1964428 - RNA, 18 nt, Human
caggaaguagcacaggcu

SEQ ID NO: 1964429 - RNA, 20 nt, Human
caggaaguagcacaggcuga

SEQ ID NO: 1964430 - RNA, 21 nt, Human
caggaaguagcacaggcugag

SEQ ID NO: 1964431 - RNA, 22 nt, Human
caggaaguagcacaggcugagu

SEQ ID NO: 1964432 - RNA, 21 nt, Human
caggaaguccuuaucuagcug

SEQ ID NO: 1964433 - RNA, 21 nt, Human
caggaccuucgggcugugccc

SEQ ID NO: 1964434 - RNA, 22 nt, Human
caggaccuucgggcugugcccg

SEQ ID NO: 1964435 - RNA, 20 nt, Human
caggaccuucgggcugugcc

SEQ ID NO: 1964436 - RNA, 23 nt, Human
caggacgacuguuuucccaacac

SEQ ID NO: 1964437 - RNA, 19 nt, Human
caggaagcucagggccugg

SEQ ID NO: 1964438 - RNA, 18 nt, Human
caggaagcucagggccug

SEQ ID NO: 1964439 - RNA, 17 nt, Human
caggaagcucagggccu

SEQ ID NO: 1964440 - RNA, 16 nt, Human
caggaagcucagggcc

SEQ ID NO: 1964441 - RNA, 15 nt, Human
caggaagcucagggc

SEQ ID NO: 1964442 - RNA, 14 nt, Human
caggaagcucaggg

SEQ ID NO: 1964443 - RNA, 13 nt, Human
caggaagcucagg

SEQ ID NO: 1964444 - RNA, 21 nt, Human
caggaagcucagggccuggcu

SEQ ID NO: 1964445 - RNA, 20 nt, Human
caggaagcucagggccuggc

SEQ ID NO: 1964446 - RNA, 23 nt, Human
caggaagcucagggccuggcuca

SEQ ID NO: 1964447 - RNA, 18 nt, Human
caggaagccagcaggcuc

SEQ ID NO: 1964448 - RNA, 17 nt, Human
caggaagccagcaggcu

SEQ ID NO: 1964449 - RNA, 16 nt, Human
caggaagccagcaggc

SEQ ID NO: 1964450 - RNA, 14 nt, Human
caggaagccagcag

SEQ ID NO: 1964451 - RNA, 21 nt, Human
caggaagccagcaggcucuca

SEQ ID NO: 1964452 - RNA, 19 nt, Human
caggaagccagcaggcucu

SEQ ID NO: 1964453 - RNA, 22 nt, Human
caggaagccagcaggcucucag

SEQ ID NO: 1964454 - RNA, 23 nt, Human
caggaaccauaguugacaguucc

SEQ ID NO: 1964455 - RNA, 21 nt, Human
caggaaccuguccuaaggaac

SEQ ID NO: 1964456 - RNA, 14 nt, Human
caggaagcagcuuu

SEQ ID NO: 1964457 - RNA, 16 nt, Human
cagcuugcacauuugg

SEQ ID NO: 1964458 - RNA, 18 nt, Human
cagcuugcacauuuggua

SEQ ID NO: 1964459 - RNA, 17 nt, Human
cagcuuggcccuuuccu

SEQ ID NO: 1964460 - RNA, 13 nt, Human
cagcuuggcucag

SEQ ID NO: 1964461 - RNA, 13 nt, Human
cagcuugggcaga

SEQ ID NO: 1964462 - RNA, 17 nt, Human
cagcuugggcagaucuc

SEQ ID NO: 1964463 - RNA, 20 nt, Human
cagcuugggcagaucuccca

SEQ ID NO: 1964464 - RNA, 18 nt, Human
cagcuugaggguugggcu

SEQ ID NO: 1964465 - RNA, 19 nt, Human
cagcuugaggguugggcug

SEQ ID NO: 1964466 - RNA, 20 nt, Human
cagcuugaggguugggcugg

SEQ ID NO: 1964467 - RNA, 21 nt, Human
cagcuugaggguugggcuggu

SEQ ID NO: 1964468 - RNA, 21 nt, Human
cagcuugaccgugaggccaga

SEQ ID NO: 1964469 - RNA, 20 nt, Human
cagcuugaccgugaggccag

SEQ ID NO: 1964470 - RNA, 19 nt, Human
cagcuugaccgugaggcca

SEQ ID NO: 1964471 - RNA, 18 nt, Human
cagcuugaccgugaggcc

SEQ ID NO: 1964472 - RNA, 14 nt, Human
cagcuugaggguug

SEQ ID NO: 1964473 - RNA, 15 nt, Human
cagcuugaggguugg

SEQ ID NO: 1964474 - RNA, 20 nt, Human
cagcuucauuuccugugucu

SEQ ID NO: 1964475 - RNA, 21 nt, Human
cagcuucauuuccugugucuu

SEQ ID NO: 1964476 - RNA, 18 nt, Human
cagcuuccugucaagcaa

SEQ ID NO: 1964477 - RNA, 11 nt, Human
cagcuuccagc

SEQ ID NO: 1964478 - RNA, 12 nt, Human
cagcuuccagca

SEQ ID NO: 1964479 - RNA, 13 nt, Human
cagcuuccagcag

SEQ ID NO: 1964480 - RNA, 14 nt, Human
cagcuuccagcagg

SEQ ID NO: 1964481 - RNA, 15 nt, Human
cagcuuccagcagga

SEQ ID NO: 1964482 - RNA, 16 nt, Human
cagcuuccagcaggag

SEQ ID NO: 1964483 - RNA, 17 nt, Human
cagcuuccagcaggagg

SEQ ID NO: 1964484 - RNA, 17 nt, Human
cagcuuccccaguagcu

SEQ ID NO: 1964485 - RNA, 18 nt, Human
cagcuuccccaguagcug

SEQ ID NO: 1964486 - RNA, 13 nt, Human
caggaaaaagaac

SEQ ID NO: 1964487 - RNA, 16 nt, Human
caggaaaacacccagg

SEQ ID NO: 1964488 - RNA, 19 nt, Human
caggaaaacacccagggaa

SEQ ID NO: 1964489 - RNA, 15 nt, Human
cagcuuuucauugcu

SEQ ID NO: 1964490 - RNA, 20 nt, Human
cagcuuuucauugcugugac

SEQ ID NO: 1964491 - RNA, 23 nt, Human
cagcuuuucauugcugugacagu

SEQ ID NO: 1964492 - RNA, 17 nt, Human
cagcuuuuccugggaca

SEQ ID NO: 1964493 - RNA, 14 nt, Human
cagcuuugauauuu

SEQ ID NO: 1964494 - RNA, 13 nt, Human
cagcuuuccagua

SEQ ID NO: 1964495 - RNA, 13 nt, Human
cagcuuugacccg

SEQ ID NO: 1964496 - RNA, 23 nt, Human
cagcuuuguuuguugucagcuga

SEQ ID NO: 1964497 - RNA, 22 nt, Human
cagcuuuguuuguugucagcug

SEQ ID NO: 1964498 - RNA, 21 nt, Human
cagcuuuguuuguugucagcu

SEQ ID NO: 1964499 - RNA, 12 nt, Human
cagcuuuguuug

SEQ ID NO: 1964500 - RNA, 23 nt, Human
cagcuuuccucaaaacuucagac

SEQ ID NO: 1964501 - RNA, 23 nt, Human
cagcuuuccccaugucucgacuc

SEQ ID NO: 1964502 - RNA, 22 nt, Human
cagcuuuaaaaaauuaaucugg

SEQ ID NO: 1964503 - RNA, 21 nt, Human
cagcuuguaaauagcucaggu

SEQ ID NO: 1964504 - RNA, 22 nt, Human
cagcuuguaaauagcucaggug

SEQ ID NO: 1964505 - RNA, 18 nt, Human
cagcuuguaaauagcuca

SEQ ID NO: 1964506 - RNA, 19 nt, Human
cagcuuguaaauagcucag

SEQ ID NO: 1964507 - RNA, 20 nt, Human
cagcuuguaaauagcucagg

SEQ ID NO: 1964508 - RNA, 15 nt, Human
cagcugcucagaucc

SEQ ID NO: 1964509 - RNA, 17 nt, Human
cagcugcuacuacuccu

SEQ ID NO: 1964510 - RNA, 21 nt, Human
cagcugcucaauaaaguacaa

SEQ ID NO: 1964511 - RNA, 16 nt, Human
cagcugacuuucaaag

SEQ ID NO: 1964512 - RNA, 13 nt, Human
cagcugcugagcc

SEQ ID NO: 1964513 - RNA, 14 nt, Human
cagcugcugagccg

SEQ ID NO: 1964514 - RNA, 16 nt, Human
cagcugcugagccgca

SEQ ID NO: 1964515 - RNA, 17 nt, Human
cagcugcugagccgcag

SEQ ID NO: 1964516 - RNA, 18 nt, Human
cagcugcugagccgcaga

SEQ ID NO: 1964517 - RNA, 19 nt, Human
cagcugcugagccgcagag

SEQ ID NO: 1964518 - RNA, 20 nt, Human
cagcugcugagccgcagaga

SEQ ID NO: 1964519 - RNA, 22 nt, Human
cagcugcuugggcuucauccuc

SEQ ID NO: 1964520 - RNA, 21 nt, Human
cagcugcuugggcuucauccu

SEQ ID NO: 1964521 - RNA, 19 nt, Human
cagcugcuugggcuucauc

SEQ ID NO: 1964522 - RNA, 18 nt, Human
cagcugcuugggcuucau

SEQ ID NO: 1964523 - RNA, 16 nt, Human
cagcugcuugggcuuc

SEQ ID NO: 1964524 - RNA, 15 nt, Human
cagcugcuugggcuu

SEQ ID NO: 1964525 - RNA, 14 nt, Human
cagcugcuugggcu

SEQ ID NO: 1964526 - RNA, 13 nt, Human
cagcugcuugggc

SEQ ID NO: 1964527 - RNA, 13 nt, Human
cagcugaaauuga

SEQ ID NO: 1964528 - RNA, 16 nt, Human
cagcugaaauugaaaa

SEQ ID NO: 1964529 - RNA, 17 nt, Human
cagcugaaauugaaaag

SEQ ID NO: 1964530 - RNA, 20 nt, Human
cagcugaaauugaaaaguua

SEQ ID NO: 1964531 - RNA, 18 nt, Human
cagcucuuggcuccacug

SEQ ID NO: 1964532 - RNA, 17 nt, Human
cagcucuuggcuccacu

SEQ ID NO: 1964533 - RNA, 16 nt, Human
cagcucuuggcuccac

SEQ ID NO: 1964534 - RNA, 23 nt, Human
cagcugccugggaucccucaucc

SEQ ID NO: 1964535 - RNA, 18 nt, Human
cagcugccugggaucccu

SEQ ID NO: 1964536 - RNA, 18 nt, Human
cagcugcgguccacccag

SEQ ID NO: 1964537 - RNA, 15 nt, Human
cagcugccugggauc

SEQ ID NO: 1964538 - RNA, 19 nt, Human
cagcugcgguccacccagg

SEQ ID NO: 1964539 - RNA, 20 nt, Human
cagcugcgguccacccagga

SEQ ID NO: 1964540 - RNA, 21 nt, Human
cagcugcgguccacccaggag

SEQ ID NO: 1964541 - RNA, 22 nt, Human
cagcugcgguccacccaggagc

SEQ ID NO: 1964542 - RNA, 23 nt, Human
cagcugcgguccacccaggagcc

SEQ ID NO: 1964543 - RNA, 24 nt, Human
cagcugcgguccacccaggagccc

SEQ ID NO: 1964544 - RNA, 18 nt, Human
cagcugguugagguuuca

SEQ ID NO: 1964545 - RNA, 16 nt, Human
cagcuggguuggaaaa

SEQ ID NO: 1964546 - RNA, 17 nt, Human
cagcuggguuggaaaac

SEQ ID NO: 1964547 - RNA, 23 nt, Human
cagcugggguggggaccucaggc

SEQ ID NO: 1964548 - RNA, 22 nt, Human
cagcugggguggggaccucagg

SEQ ID NO: 1964549 - RNA, 21 nt, Human
cagcugggguggggaccucag

SEQ ID NO: 1964550 - RNA, 22 nt, Human
cagcuggggccaggcugggucg

SEQ ID NO: 1964551 - RNA, 21 nt, Human
cagcuggggccaggcuggguc

SEQ ID NO: 1964552 - RNA, 20 nt, Human
cagcuggggccaggcugggu

SEQ ID NO: 1964553 - RNA, 19 nt, Human
cagcuggggccaggcuggg

SEQ ID NO: 1964554 - RNA, 18 nt, Human
cagcuggggccaggcugg

SEQ ID NO: 1964555 - RNA, 23 nt, Human
cagcugggaucacauguggacuu

SEQ ID NO: 1964556 - RNA, 19 nt, Human
cagcuggccgggagccuga

SEQ ID NO: 1964557 - RNA, 23 nt, Human
cagcugcuuuugucuaugggacu

SEQ ID NO: 1964558 - RNA, 22 nt, Human
cagcugcuuuugucuaugggac

SEQ ID NO: 1964559 - RNA, 21 nt, Human
cagcucugguccauagagagc

SEQ ID NO: 1964560 - RNA, 18 nt, Human
cagcucugguccauagag

SEQ ID NO: 1964561 - RNA, 17 nt, Human
cagcucugguccauaga

SEQ ID NO: 1964562 - RNA, 16 nt, Human
cagcucugguccauag

SEQ ID NO: 1964563 - RNA, 18 nt, Human
cagcucuggcauggcuag

SEQ ID NO: 1964564 - RNA, 14 nt, Human
cagcucuggcaugg

SEQ ID NO: 1964565 - RNA, 13 nt, Human
cagcucuggucca

SEQ ID NO: 1964566 - RNA, 10 nt, Human
cagcucuggu

SEQ ID NO: 1964567 - RNA, 23 nt, Human
cagcucugguccauagagagcaa

SEQ ID NO: 1964568 - RNA, 22 nt, Human
cagcucugguccauagagagca

SEQ ID NO: 1964569 - RNA, 12 nt, Human
cagcucuguccu

SEQ ID NO: 1964570 - RNA, 13 nt, Human
cagcucuguccug

SEQ ID NO: 1964571 - RNA, 14 nt, Human
cagcucuguccugg

SEQ ID NO: 1964572 - RNA, 16 nt, Human
cagcucuguccuggga

SEQ ID NO: 1964573 - RNA, 17 nt, Human
cagcucuguccugggag

SEQ ID NO: 1964574 - RNA, 18 nt, Human
cagcucuguccugggagu

SEQ ID NO: 1964575 - RNA, 21 nt, Human
cagcucuuauauugccauuuc

SEQ ID NO: 1964576 - RNA, 10 nt, Human
cagcucuuau

SEQ ID NO: 1964577 - RNA, 23 nt, Human
cagcucuguccugggagugagcu

SEQ ID NO: 1964578 - RNA, 13 nt, Human
cagcucuucucca

SEQ ID NO: 1964579 - RNA, 14 nt, Human
cagcucuucuccag

SEQ ID NO: 1964580 - RNA, 15 nt, Human
cagcucuucuccagg

SEQ ID NO: 1964581 - RNA, 16 nt, Human
cagcucuucuccaggc

SEQ ID NO: 1964582 - RNA, 17 nt, Human
cagcucuucuccaggcu

SEQ ID NO: 1964583 - RNA, 18 nt, Human
cagcucuucuccaggcug

SEQ ID NO: 1964584 - RNA, 19 nt, Human
cagcucuucuccaggcugu

SEQ ID NO: 1964585 - RNA, 23 nt, Human
cagcucuucuccaggcuguaucc

SEQ ID NO: 1964586 - RNA, 13 nt, Human
cagcucuuccuag

SEQ ID NO: 1964587 - RNA, 19 nt, Human
cagcucuuccuagcuggag

SEQ ID NO: 1964588 - RNA, 20 nt, Human
cagcucuuccuagcuggaga

SEQ ID NO: 1964589 - RNA, 22 nt, Human
cagcucuuccuagcuggagagg

SEQ ID NO: 1964590 - RNA, 12 nt, Human
cagcucuuccug

SEQ ID NO: 1964591 - RNA, 13 nt, Human
cagcucuuccugg

SEQ ID NO: 1964592 - RNA, 23 nt, Human
cagcucuuccuggacaggccagg

SEQ ID NO: 1964593 - RNA, 12 nt, Human
cagcucuccccu

SEQ ID NO: 1964594 - RNA, 15 nt, Human
cagcucucaugcugc

SEQ ID NO: 1964595 - RNA, 19 nt, Human
cagcucucaugcugccccu

SEQ ID NO: 1964596 - RNA, 23 nt, Human
cagcucucaugcugccccugccu

SEQ ID NO: 1964597 - RNA, 13 nt, Human
cagcuccuuuucc

SEQ ID NO: 1964598 - RNA, 16 nt, Human
cagcuccuuuuccaga

SEQ ID NO: 1964599 - RNA, 20 nt, Human
cagcuccuuuuccagagcau

SEQ ID NO: 1964600 - RNA, 21 nt, Human
cagcuccuuuuccagagcauu

SEQ ID NO: 1964601 - RNA, 22 nt, Human
cagcucgcuggauggcggaagc

SEQ ID NO: 1964602 - RNA, 20 nt, Human
cagcucugcauacucauuag

SEQ ID NO: 1964603 - RNA, 21 nt, Human
cagcucugcaagaauugaagc

SEQ ID NO: 1964604 - RNA, 16 nt, Human
cagcucugcaagaauu

SEQ ID NO: 1964605 - RNA, 15 nt, Human
cagcucugcaagaau

SEQ ID NO: 1964606 - RNA, 15 nt, Human
cagcuccuuccuagc

SEQ ID NO: 1964607 - RNA, 20 nt, Human
cagcuccuuccuagccuugc

SEQ ID NO: 1964608 - RNA, 12 nt, Human
cagcucagugag

SEQ ID NO: 1964609 - RNA, 16 nt, Human
cagcuccuucuguccu

SEQ ID NO: 1964610 - RNA, 17 nt, Human
cagcuccuucuguccua

SEQ ID NO: 1964611 - RNA, 21 nt, Human
cagcuccuucuguccuacucu

SEQ ID NO: 1964612 - RNA, 23 nt, Human
cagcuccuucuguccuacucugu

SEQ ID NO: 1964613 - RNA, 20 nt, Human
cagcucagagagggugggag

SEQ ID NO: 1964614 - RNA, 19 nt, Human
cagcucagagaggguggga

SEQ ID NO: 1964615 - RNA, 17 nt, Human
cagcucagagagggugg

SEQ ID NO: 1964616 - RNA, 13 nt, Human
cagcucagagagg

SEQ ID NO: 1964617 - RNA, 20 nt, Human
cagcucaccucucccuugga

SEQ ID NO: 1964618 - RNA, 19 nt, Human
cagcucaccucucccuugg

SEQ ID NO: 1964619 - RNA, 12 nt, Human
cagcucacugca

SEQ ID NO: 1964620 - RNA, 14 nt, Human
cagcucacugcaac

SEQ ID NO: 1964621 - RNA, 12 nt, Human
cagcucagagag

SEQ ID NO: 1964622 - RNA, 21 nt, Human
cagcucacugcaaccuucgcc

SEQ ID NO: 1964623 - RNA, 13 nt, Human
cagcucagaacca

SEQ ID NO: 1964624 - RNA, 15 nt, Human
cagcucagaaccaca

SEQ ID NO: 1964625 - RNA, 17 nt, Human
cagcucagaaccacagc

SEQ ID NO: 1964626 - RNA, 15 nt, Human
cagcucacugcaacc

SEQ ID NO: 1964627 - RNA, 17 nt, Human
cagcucaccucucccuu

SEQ ID NO: 1964628 - RNA, 16 nt, Human
cagcucaccucucccu

SEQ ID NO: 1964629 - RNA, 15 nt, Human
cagcucaccucuccc

SEQ ID NO: 1964630 - RNA, 13 nt, Human
cagcucaccucuc

SEQ ID NO: 1964631 - RNA, 22 nt, Human
cagcucaccagccccagugccc

SEQ ID NO: 1964632 - RNA, 20 nt, Human
cagcucaccagccccagugc

SEQ ID NO: 1964633 - RNA, 21 nt, Human
cagcucaccagccccagugcc

SEQ ID NO: 1964634 - RNA, 17 nt, Human
cagcuaggaacaaaucu

SEQ ID NO: 1964635 - RNA, 18 nt, Human
cagcuaggaacaaaucuu

SEQ ID NO: 1964636 - RNA, 19 nt, Human
cagcuaggaacaaaucuuc

SEQ ID NO: 1964637 - RNA, 20 nt, Human
cagcuaggaacaaaucuucc

SEQ ID NO: 1964638 - RNA, 21 nt, Human
cagcuaggaacaaaucuuccu

SEQ ID NO: 1964639 - RNA, 14 nt, Human
cagcuaugagagga

SEQ ID NO: 1964640 - RNA, 13 nt, Human
cagcuaugcaaaa

SEQ ID NO: 1964641 - RNA, 13 nt, Human
cagcucaccagcc

SEQ ID NO: 1964642 - RNA, 15 nt, Human
cagcucaccagcccc

SEQ ID NO: 1964643 - RNA, 16 nt, Human
cagcucaccagcccca

SEQ ID NO: 1964644 - RNA, 17 nt, Human
cagcucaccagccccag

SEQ ID NO: 1964645 - RNA, 19 nt, Human
cagcucaccagccccagug

SEQ ID NO: 1964646 - RNA, 18 nt, Human
cagcuaacauggaaguac

SEQ ID NO: 1964647 - RNA, 19 nt, Human
cagcuaacauggaaguacu

SEQ ID NO: 1964648 - RNA, 13 nt, Human
cagcgcacagcug

SEQ ID NO: 1964649 - RNA, 14 nt, Human
cagcgcacagcugc

SEQ ID NO: 1964650 - RNA, 15 nt, Human
cagcgcacagcugcu

SEQ ID NO: 1964651 - RNA, 21 nt, Human
cagcgagcccugguggcagug

SEQ ID NO: 1964652 - RNA, 12 nt, Human
cagcgagggccc

SEQ ID NO: 1964653 - RNA, 13 nt, Human
cagcgagcccugg

SEQ ID NO: 1964654 - RNA, 16 nt, Human
cagcgagcccuggugg

SEQ ID NO: 1964655 - RNA, 17 nt, Human
cagcgagcccugguggc

SEQ ID NO: 1964656 - RNA, 19 nt, Human
cagcgagcccugguggcag

SEQ ID NO: 1964657 - RNA, 20 nt, Human
cagcgagcccugguggcagu

SEQ ID NO: 1964658 - RNA, 21 nt, Human
cagcuaccucaaccaaugcca

SEQ ID NO: 1964659 - RNA, 19 nt, Human
cagcuacuugggaggcuga

SEQ ID NO: 1964660 - RNA, 20 nt, Human
cagcuaacauggaaguacua

SEQ ID NO: 1964661 - RNA, 15 nt, Human
cagcuaaugggacac

SEQ ID NO: 1964662 - RNA, 16 nt, Human
cagcuaaugggacacu

SEQ ID NO: 1964663 - RNA, 19 nt, Human
cagcuaaucagcauucuca

SEQ ID NO: 1964664 - RNA, 14 nt, Human
cagccuggucgccu

SEQ ID NO: 1964665 - RNA, 19 nt, Human
cagccuggucgccuuccac

SEQ ID NO: 1964666 - RNA, 23 nt, Human
cagccuggucgccuuccaccucu

SEQ ID NO: 1964667 - RNA, 19 nt, Human
cagccugggcaaugugaua

SEQ ID NO: 1964668 - RNA, 16 nt, Human
cagccugggcaaugug

SEQ ID NO: 1964669 - RNA, 20 nt, Human
cagccuggcugggacuggga

SEQ ID NO: 1964670 - RNA, 20 nt, Human
cagccugggauaggggcaga

SEQ ID NO: 1964671 - RNA, 21 nt, Human
cagccugggauaggggcagag

SEQ ID NO: 1964672 - RNA, 21 nt, Human
cagccuugaccauucuccacc

SEQ ID NO: 1964673 - RNA, 20 nt, Human
cagccuugaccauucuccac

SEQ ID NO: 1964674 - RNA, 17 nt, Human
cagccuugaccauucuc

SEQ ID NO: 1964675 - RNA, 24 nt, Human
cagccuugaccauucuccaccugc

SEQ ID NO: 1964676 - RNA, 17 nt, Human
cagccuucuuuuucugg

SEQ ID NO: 1964677 - RNA, 18 nt, Human
cagccuucuuuuucugga

SEQ ID NO: 1964678 - RNA, 19 nt, Human
cagccuucuuuuucuggac

SEQ ID NO: 1964679 - RNA, 21 nt, Human
cagccuucuuuuucuggacuc

SEQ ID NO: 1964680 - RNA, 23 nt, Human
cagccuugaccauucuccaccug

SEQ ID NO: 1964681 - RNA, 22 nt, Human
cagccuugaccauucuccaccu

SEQ ID NO: 1964682 - RNA, 16 nt, Human
cagccuccgcuucccu

SEQ ID NO: 1964683 - RNA, 18 nt, Human
cagccuccgcuucccugg

SEQ ID NO: 1964684 - RNA, 20 nt, Human
cagccuccgcuucccugguu

SEQ ID NO: 1964685 - RNA, 21 nt, Human
cagccuccgcuucccugguuc

SEQ ID NO: 1964686 - RNA, 20 nt, Human
cagccugcuccagcuguuca

SEQ ID NO: 1964687 - RNA, 18 nt, Human
cagccucguuggaagagg

SEQ ID NO: 1964688 - RNA, 22 nt, Human
cagccucguuggaagaggaaca

SEQ ID NO: 1964689 - RNA, 23 nt, Human
cagccucguuggaagaggaacag

SEQ ID NO: 1964690 - RNA, 15 nt, Human
cagccuccugaguag

SEQ ID NO: 1964691 - RNA, 21 nt, Human
cagccucgcaggccucccugc

SEQ ID NO: 1964692 - RNA, 22 nt, Human
cagccucgcaggccucccugcc

SEQ ID NO: 1964693 - RNA, 19 nt, Human
cagccucgcaggccucccu

SEQ ID NO: 1964694 - RNA, 23 nt, Human
cagccucccgaauagcugggacu

SEQ ID NO: 1964695 - RNA, 19 nt, Human
cagccucccgaguagcugg

SEQ ID NO: 1964696 - RNA, 20 nt, Human
cagccucccgaguagcuggg

SEQ ID NO: 1964697 - RNA, 21 nt, Human
cagccucccgaguagcuggga

SEQ ID NO: 1964698 - RNA, 22 nt, Human
cagccucccgaguagcugggac

SEQ ID NO: 1964699 - RNA, 23 nt, Human
cagccucccgaguagcugggacu

SEQ ID NO: 1964700 - RNA, 16 nt, Human
cagccucccacagugc

SEQ ID NO: 1964701 - RNA, 19 nt, Human
cagccuggacccuguggau

SEQ ID NO: 1964702 - RNA, 15 nt, Human
cagccuggacccugu

SEQ ID NO: 1964703 - RNA, 19 nt, Human
cagccuggaaaccugucug

SEQ ID NO: 1964704 - RNA, 20 nt, Human
cagccuggaaaccugucuga

SEQ ID NO: 1964705 - RNA, 21 nt, Human
cagccuggcacagggcagugg

SEQ ID NO: 1964706 - RNA, 13 nt, Human
cagccuggcacag

SEQ ID NO: 1964707 - RNA, 20 nt, Human
cagccuggcacagggcagug

SEQ ID NO: 1964708 - RNA, 10 nt, Human
cagccuggca

SEQ ID NO: 1964709 - RNA, 14 nt, Human
cagccuggcuggga

SEQ ID NO: 1964710 - RNA, 16 nt, Human
cagcccgggcucugcc

SEQ ID NO: 1964711 - RNA, 15 nt, Human
cagcccgggcucugc

SEQ ID NO: 1964712 - RNA, 14 nt, Human
cagcccgggcucug

SEQ ID NO: 1964713 - RNA, 13 nt, Human
cagcccgggcucu

SEQ ID NO: 1964714 - RNA, 17 nt, Human
cagcccgauccuccccu

SEQ ID NO: 1964715 - RNA, 19 nt, Human
cagcccgauccuccccugg

SEQ ID NO: 1964716 - RNA, 20 nt, Human
cagcccgauccuccccugga

SEQ ID NO: 1964717 - RNA, 22 nt, Human
cagcccgauccuccccuggacu

SEQ ID NO: 1964718 - RNA, 23 nt, Human
cagcccgauccuccccuggacuc

SEQ ID NO: 1964719 - RNA, 24 nt, Human
cagcccgauccuccccuggacucc

SEQ ID NO: 1964720 - RNA, 14 nt, Human
cagcccgcaucagc

SEQ ID NO: 1964721 - RNA, 21 nt, Human
cagcccgcaucagcugcucag

SEQ ID NO: 1964722 - RNA, 22 nt, Human
cagcccgcaucagcugcucaga

SEQ ID NO: 1964723 - RNA, 21 nt, Human
cagccccuucugacccaugcu

SEQ ID NO: 1964724 - RNA, 19 nt, Human
cagccccuucugacccaug

SEQ ID NO: 1964725 - RNA, 17 nt, Human
cagccccuucugaccca

SEQ ID NO: 1964726 - RNA, 16 nt, Human
cagccccuucugaccc

SEQ ID NO: 1964727 - RNA, 23 nt, Human
cagccccuucugacccaugcugc

SEQ ID NO: 1964728 - RNA, 22 nt, Human
cagccccuucugacccaugcug

SEQ ID NO: 1964729 - RNA, 24 nt, Human
cagccccuucugacccaugcugcc

SEQ ID NO: 1964730 - RNA, 20 nt, Human
cagcccgggcucugccuccc

SEQ ID NO: 1964731 - RNA, 19 nt, Human
cagcccgggcucugccucc

SEQ ID NO: 1964732 - RNA, 18 nt, Human
cagcccgggcucugccuc

SEQ ID NO: 1964733 - RNA, 17 nt, Human
cagcccgggcucugccu

SEQ ID NO: 1964734 - RNA, 22 nt, Human
cagcccgggcucugccucccau

SEQ ID NO: 1964735 - RNA, 21 nt, Human
cagcccgggcucugccuccca

SEQ ID NO: 1964736 - RNA, 23 nt, Human
cagcccuccaucuaaacugcccc

SEQ ID NO: 1964737 - RNA, 13 nt, Human
cagcccucccugc

SEQ ID NO: 1964738 - RNA, 15 nt, Human
cagcccucccugccc

SEQ ID NO: 1964739 - RNA, 18 nt, Human
cagcccucauuggcucuu

SEQ ID NO: 1964740 - RNA, 22 nt, Human
cagcccuccaucuaaacugccc

SEQ ID NO: 1964741 - RNA, 13 nt, Human
cagccccagugcc

SEQ ID NO: 1964742 - RNA, 14 nt, Human
cagccccagugccc

SEQ ID NO: 1964743 - RNA, 15 nt, Human
cagccccagugccca

SEQ ID NO: 1964744 - RNA, 16 nt, Human
cagccccagugcccac

SEQ ID NO: 1964745 - RNA, 21 nt, Human
cagccccaucccaaacccuuc

SEQ ID NO: 1964746 - RNA, 11 nt, Human
cagccccaucc

SEQ ID NO: 1964747 - RNA, 17 nt, Human
cagccccagugcccaca

SEQ ID NO: 1964748 - RNA, 18 nt, Human
cagccccagugcccacag

SEQ ID NO: 1964749 - RNA, 14 nt, Human
cagccccacccugu

SEQ ID NO: 1964750 - RNA, 17 nt, Human
cagccccacccuguuuu

SEQ ID NO: 1964751 - RNA, 21 nt, Human
cagccccuguucuggcagagu

SEQ ID NO: 1964752 - RNA, 20 nt, Human
cagccccuguucuggcagag

SEQ ID NO: 1964753 - RNA, 16 nt, Human
cagccccauucugccu

SEQ ID NO: 1964754 - RNA, 17 nt, Human
cagccccauucugccug

SEQ ID NO: 1964755 - RNA, 23 nt, Human
cagccccuggaugcagccucaca

SEQ ID NO: 1964756 - RNA, 18 nt, Human
cagccccauucugccugc

SEQ ID NO: 1964757 - RNA, 14 nt, Human
cagccccauccucu

SEQ ID NO: 1964758 - RNA, 13 nt, Human
cagccccauccuc

SEQ ID NO: 1964759 - RNA, 12 nt, Human
cagccccauccu

SEQ ID NO: 1964760 - RNA, 22 nt, Human
cagccccaucccaaacccuuca

SEQ ID NO: 1964761 - RNA, 22 nt, Human
cagccccauccucuguacagag

SEQ ID NO: 1964762 - RNA, 16 nt, Human
cagccccauccucugu

SEQ ID NO: 1964763 - RNA, 13 nt, Human
cagccccauucug

SEQ ID NO: 1964764 - RNA, 14 nt, Human
cagccccauucugc

SEQ ID NO: 1964765 - RNA, 19 nt, Human
cagccucccaaagugcugg

SEQ ID NO: 1964766 - RNA, 20 nt, Human
cagccucccaaagugcuggg

SEQ ID NO: 1964767 - RNA, 21 nt, Human
cagccucccaaagugcuggga

SEQ ID NO: 1964768 - RNA, 23 nt, Human
cagccucccaaagugcugggauu

SEQ ID NO: 1964769 - RNA, 15 nt, Human
cagccuccaugcugc

SEQ ID NO: 1964770 - RNA, 17 nt, Human
cagccuccaugcugccu

SEQ ID NO: 1964771 - RNA, 20 nt, Human
cagccuccaugcugccucca

SEQ ID NO: 1964772 - RNA, 14 nt, Human
cagccuccaugcug

SEQ ID NO: 1964773 - RNA, 13 nt, Human
cagccucccacag

SEQ ID NO: 1964774 - RNA, 15 nt, Human
cagccucccacagug

SEQ ID NO: 1964775 - RNA, 20 nt, Human
cagccucccgaauagcuggg

SEQ ID NO: 1964776 - RNA, 21 nt, Human
cagccucccgaauagcuggga

SEQ ID NO: 1964777 - RNA, 22 nt, Human
cagccucccgaauagcugggac

SEQ ID NO: 1964778 - RNA, 20 nt, Human
cagccucacaguccuuacca

SEQ ID NO: 1964779 - RNA, 15 nt, Human
cagccucacaguccu

SEQ ID NO: 1964780 - RNA, 14 nt, Human
cagccucacagucc

SEQ ID NO: 1964781 - RNA, 14 nt, Human
cagccuccaagcuc

SEQ ID NO: 1964782 - RNA, 20 nt, Human
cagccuccaagcuccaucuc

SEQ ID NO: 1964783 - RNA, 19 nt, Human
cagccucaaccuccugggc

SEQ ID NO: 1964784 - RNA, 20 nt, Human
cagccucaaccuccugggcu

SEQ ID NO: 1964785 - RNA, 21 nt, Human
cagccucaaccuccugggcua

SEQ ID NO: 1964786 - RNA, 18 nt, Human
cagccucaaauccaggac

SEQ ID NO: 1964787 - RNA, 19 nt, Human
cagccucaaauccaggacc

SEQ ID NO: 1964788 - RNA, 20 nt, Human
cagccucaaauccaggaccc

SEQ ID NO: 1964789 - RNA, 21 nt, Human
cagccucaaauccaggacccu

SEQ ID NO: 1964790 - RNA, 17 nt, Human
cagccucaaccuccugg

SEQ ID NO: 1964791 - RNA, 18 nt, Human
cagccucaaccuccuggg

SEQ ID NO: 1964792 - RNA, 17 nt, Human
cagccucaaauccagga

SEQ ID NO: 1964793 - RNA, 16 nt, Human
cagcccugcagagggc

SEQ ID NO: 1964794 - RNA, 15 nt, Human
cagcccugcagaggg

SEQ ID NO: 1964795 - RNA, 14 nt, Human
cagcccugcagagg

SEQ ID NO: 1964796 - RNA, 13 nt, Human
cagcccugcagag

SEQ ID NO: 1964797 - RNA, 20 nt, Human
cagcccugcagagggcacag

SEQ ID NO: 1964798 - RNA, 18 nt, Human
cagcccugcagagggcac

SEQ ID NO: 1964799 - RNA, 18 nt, Human
cagcccucggcgcuccgg

SEQ ID NO: 1964800 - RNA, 21 nt, Human
cagcccucggcgcuccgggac

SEQ ID NO: 1964801 - RNA, 18 nt, Human
cagcccugaguuccuagc

SEQ ID NO: 1964802 - RNA, 19 nt, Human
cagcccugaguuccuagcc

SEQ ID NO: 1964803 - RNA, 21 nt, Human
cagcccugaguuccuagccac

SEQ ID NO: 1964804 - RNA, 16 nt, Human
cagcccucccugcccc

SEQ ID NO: 1964805 - RNA, 17 nt, Human
cagcccucccugccccu

SEQ ID NO: 1964806 - RNA, 18 nt, Human
cagcccucccugccccuc

SEQ ID NO: 1964807 - RNA, 22 nt, Human
cagcccucccugccccucccuu

SEQ ID NO: 1964808 - RNA, 21 nt, Human
cagccguguaaccauggaccc

SEQ ID NO: 1964809 - RNA, 14 nt, Human
cagccuaagagacu

SEQ ID NO: 1964810 - RNA, 9 nt, Human
cagccgugc

SEQ ID NO: 1964811 - RNA, 14 nt, Human
cagccgugccuuca

SEQ ID NO: 1964812 - RNA, 16 nt, Human
cagccgugccuucagc

SEQ ID NO: 1964813 - RNA, 18 nt, Human
cagccgugccuucagcuc

SEQ ID NO: 1964814 - RNA, 20 nt, Human
cagccgugccuucagcucua

SEQ ID NO: 1964815 - RNA, 11 nt, Human
cagcccugcuu

SEQ ID NO: 1964816 - RNA, 13 nt, Human
cagcccugcuuug

SEQ ID NO: 1964817 - RNA, 19 nt, Human
cagcccugcuuugggcugc

SEQ ID NO: 1964818 - RNA, 20 nt, Human
cagcccugcuuugggcugcc

SEQ ID NO: 1964819 - RNA, 21 nt, Human
cagcccugcuuugggcugccc

SEQ ID NO: 1964820 - RNA, 22 nt, Human
cagcccugcuuugggcugcccu

SEQ ID NO: 1964821 - RNA, 23 nt, Human
cagcccugcuuugggcugcccug

SEQ ID NO: 1964822 - RNA, 14 nt, Human
cagcucaccagccc

SEQ ID NO: 1964823 - RNA, 18 nt, Human
cagccuccaugcugccuc

SEQ ID NO: 1964824 - RNA, 18 nt, Human
cagcagggagggcuucug

SEQ ID NO: 1964825 - RNA, 14 nt, Human
cagcaggcccaugg

SEQ ID NO: 1964826 - RNA, 22 nt, Human
cagcaggcucucaggccagcug

SEQ ID NO: 1964827 - RNA, 20 nt, Human
cagcaggcucucaggccagc

SEQ ID NO: 1964828 - RNA, 19 nt, Human
cagcaggcucucaggccag

SEQ ID NO: 1964829 - RNA, 18 nt, Human
cagcaggcucucaggcca

SEQ ID NO: 1964830 - RNA, 17 nt, Human
cagcaggcucucaggcc

SEQ ID NO: 1964831 - RNA, 16 nt, Human
cagcaggcucucaggc

SEQ ID NO: 1964832 - RNA, 11 nt, Human
cagcagggcag

SEQ ID NO: 1964833 - RNA, 15 nt, Human
cagcagggcaguagc

SEQ ID NO: 1964834 - RNA, 20 nt, Human
cagcagggagggcuucugcc

SEQ ID NO: 1964835 - RNA, 14 nt, Human
cagcauccuggcac

SEQ ID NO: 1964836 - RNA, 15 nt, Human
cagcauccuggcacc

SEQ ID NO: 1964837 - RNA, 16 nt, Human
cagcauccuggcaccc

SEQ ID NO: 1964838 - RNA, 17 nt, Human
cagcauccuggcacccg

SEQ ID NO: 1964839 - RNA, 18 nt, Human
cagcagccuggacccugu

SEQ ID NO: 1964840 - RNA, 15 nt, Human
cagcagccuggaccc

SEQ ID NO: 1964841 - RNA, 14 nt, Human
cagcagccuggacc

SEQ ID NO: 1964842 - RNA, 12 nt, Human
cagcagccugga

SEQ ID NO: 1964843 - RNA, 22 nt, Human
cagcagccuggacccuguggau

SEQ ID NO: 1964844 - RNA, 19 nt, Human
cagcagccuggacccugug

SEQ ID NO: 1964845 - RNA, 15 nt, Human
cagcaggcucucagg

SEQ ID NO: 1964846 - RNA, 14 nt, Human
cagcaggcucucag

SEQ ID NO: 1964847 - RNA, 12 nt, Human
cagcaggcucuc

SEQ ID NO: 1964848 - RNA, 11 nt, Human
cagcaggccca

SEQ ID NO: 1964849 - RNA, 19 nt, Human
cagcaggcagccuuggcgg

SEQ ID NO: 1964850 - RNA, 11 nt, Human
cagcaggcagc

SEQ ID NO: 1964851 - RNA, 12 nt, Human
cagcaggcagcc

SEQ ID NO: 1964852 - RNA, 13 nt, Human
cagcaggcagccu

SEQ ID NO: 1964853 - RNA, 15 nt, Human
cagcaggcagccuug

SEQ ID NO: 1964854 - RNA, 11 nt, Human
cagcaggaggg

SEQ ID NO: 1964855 - RNA, 23 nt, Human
cagcaggagggacagucucacca

SEQ ID NO: 1964856 - RNA, 12 nt, Human
cagcaggaggga

SEQ ID NO: 1964857 - RNA, 15 nt, Human
cagcaggagggacag

SEQ ID NO: 1964858 - RNA, 19 nt, Human
cagcaggagggacagucuc

SEQ ID NO: 1964859 - RNA, 22 nt, Human
cagcaggagggacagucucacc

SEQ ID NO: 1964860 - RNA, 18 nt, Human
cagccaacuauggccugu

SEQ ID NO: 1964861 - RNA, 23 nt, Human
cagccaaacacacagaaggggac

SEQ ID NO: 1964862 - RNA, 21 nt, Human
cagccaaagccuccuccagcc

SEQ ID NO: 1964863 - RNA, 18 nt, Human
cagccaaagccuccucca

SEQ ID NO: 1964864 - RNA, 22 nt, Human
cagcauuuguguguuacaaugu

SEQ ID NO: 1964865 - RNA, 16 nt, Human
cagcauuuguguguua

SEQ ID NO: 1964866 - RNA, 12 nt, Human
cagcauuucaag

SEQ ID NO: 1964867 - RNA, 16 nt, Human
cagccaaacacacaga

SEQ ID NO: 1964868 - RNA, 18 nt, Human
cagccaaacacacagaag

SEQ ID NO: 1964869 - RNA, 19 nt, Human
cagccaaacacacagaagg

SEQ ID NO: 1964870 - RNA, 16 nt, Human
cagccaaagccuccuc

SEQ ID NO: 1964871 - RNA, 15 nt, Human
cagccaaagccuccu

SEQ ID NO: 1964872 - RNA, 15 nt, Human
cagcauucucacucc

SEQ ID NO: 1964873 - RNA, 14 nt, Human
cagcauucucacuc

SEQ ID NO: 1964874 - RNA, 18 nt, Human
cagcauuaccucuuugga

SEQ ID NO: 1964875 - RNA, 19 nt, Human
cagcauuaccucuuuggaa

SEQ ID NO: 1964876 - RNA, 16 nt, Human
cagcauuagugggaaa

SEQ ID NO: 1964877 - RNA, 14 nt, Human
cagcaucuggaaga

SEQ ID NO: 1964878 - RNA, 24 nt, Human
cagcaucuggaagagcuaggcagg

SEQ ID NO: 1964879 - RNA, 18 nt, Human
cagcaucgcacucuggca

SEQ ID NO: 1964880 - RNA, 19 nt, Human
cagcaucgcacucuggcag

SEQ ID NO: 1964881 - RNA, 21 nt, Human
cagcaucgcacucuggcagca

SEQ ID NO: 1964882 - RNA, 21 nt, Human
cagcauccuggcacccggccc

SEQ ID NO: 1964883 - RNA, 19 nt, Human
cagcauccuggcacccggc

SEQ ID NO: 1964884 - RNA, 20 nt, Human
cagcauccuggcacccggcc

SEQ ID NO: 1964885 - RNA, 20 nt, Human
cagccauaggcccuuucagu

SEQ ID NO: 1964886 - RNA, 21 nt, Human
cagccauaggcccuuucagug

SEQ ID NO: 1964887 - RNA, 18 nt, Human
cagccauaggcccuuuca

SEQ ID NO: 1964888 - RNA, 13 nt, Human
cagccaguaaaug

SEQ ID NO: 1964889 - RNA, 22 nt, Human
cagccaguaaaugggggugcau

SEQ ID NO: 1964890 - RNA, 23 nt, Human
cagccacggccaggccagaggga

SEQ ID NO: 1964891 - RNA, 14 nt, Human
cagccacucagaaa

SEQ ID NO: 1964892 - RNA, 14 nt, Human
cagccacuccccag

SEQ ID NO: 1964893 - RNA, 16 nt, Human
cagccacuccccagcc

SEQ ID NO: 1964894 - RNA, 17 nt, Human
cagccacuccccagcca

SEQ ID NO: 1964895 - RNA, 20 nt, Human
cagccacuccccagccagcc

SEQ ID NO: 1964896 - RNA, 16 nt, Human
cagccacuuaggacaa

SEQ ID NO: 1964897 - RNA, 12 nt, Human
cagccagaacuc

SEQ ID NO: 1964898 - RNA, 16 nt, Human
cagccagaacucugug

SEQ ID NO: 1964899 - RNA, 18 nt, Human
cagccagaacucuguguc

SEQ ID NO: 1964900 - RNA, 14 nt, Human
cagccacggccagg

SEQ ID NO: 1964901 - RNA, 15 nt, Human
cagccacggccaggc

SEQ ID NO: 1964902 - RNA, 16 nt, Human
cagccacggccaggcc

SEQ ID NO: 1964903 - RNA, 17 nt, Human
cagccacggccaggcca

SEQ ID NO: 1964904 - RNA, 18 nt, Human
cagccacggccaggccag

SEQ ID NO: 1964905 - RNA, 19 nt, Human
cagccacggccaggccaga

SEQ ID NO: 1964906 - RNA, 21 nt, Human
cagccacggccaggccagagg

SEQ ID NO: 1964907 - RNA, 22 nt, Human
cagccacggccaggccagaggg

SEQ ID NO: 1964908 - RNA, 14 nt, Human
cagccacauuccug

SEQ ID NO: 1964909 - RNA, 15 nt, Human
cagccaauauuuaaa

SEQ ID NO: 1964910 - RNA, 17 nt, Human
cagccacauuccugaug

SEQ ID NO: 1964911 - RNA, 15 nt, Human
cagccacauuccuga

SEQ ID NO: 1964912 - RNA, 19 nt, Human
cagccacauuccugaugcu

SEQ ID NO: 1964913 - RNA, 21 nt, Human
cagccaccgaagccgccugug

SEQ ID NO: 1964914 - RNA, 16 nt, Human
cagcccaaaccaccag

SEQ ID NO: 1964915 - RNA, 19 nt, Human
cagcccaaaccaccagaag

SEQ ID NO: 1964916 - RNA, 20 nt, Human
cagcccaaaccaccagaagc

SEQ ID NO: 1964917 - RNA, 21 nt, Human
cagcccaaaccaccagaagcc

SEQ ID NO: 1964918 - RNA, 23 nt, Human
cagcccaaaccaccagaagccca

SEQ ID NO: 1964919 - RNA, 14 nt, Human
cagccaucaacuaa

SEQ ID NO: 1964920 - RNA, 15 nt, Human
cagcccaccccucaa

SEQ ID NO: 1964921 - RNA, 17 nt, Human
cagcccaccccauggcc

SEQ ID NO: 1964922 - RNA, 19 nt, Human
cagcccacauagugauggu

SEQ ID NO: 1964923 - RNA, 11 nt, Human
cagcccacccc

SEQ ID NO: 1964924 - RNA, 16 nt, Human
cagcccaaucccugau

SEQ ID NO: 1964925 - RNA, 17 nt, Human
cagcccaaucccugauc

SEQ ID NO: 1964926 - RNA, 23 nt, Human
cagccagaagccacccaaagcag

SEQ ID NO: 1964927 - RNA, 16 nt, Human
cagcccaccuggcuuu

SEQ ID NO: 1964928 - RNA, 15 nt, Human
cagcccacuucugcc

SEQ ID NO: 1964929 - RNA, 13 nt, Human
cagcccacgcuga

SEQ ID NO: 1964930 - RNA, 15 nt, Human
cagcccacgcugacu

SEQ ID NO: 1964931 - RNA, 22 nt, Human
cagcccacgcugacuacagggc

SEQ ID NO: 1964932 - RNA, 21 nt, Human
cagccccaaaacucuccucug

SEQ ID NO: 1964933 - RNA, 20 nt, Human
cagccccaaaacucuccucu

SEQ ID NO: 1964934 - RNA, 22 nt, Human
cagccccaaaacucuccucugc

SEQ ID NO: 1964935 - RNA, 22 nt, Human
cagccccaaauugucaccugcu

SEQ ID NO: 1964936 - RNA, 17 nt, Human
cagcccauuugggcaga

SEQ ID NO: 1964937 - RNA, 22 nt, Human
cagcccauuugggcagagaggc

SEQ ID NO: 1964938 - RNA, 17 nt, Human
cagcccagaagugcaga

SEQ ID NO: 1964939 - RNA, 18 nt, Human
cagcccacuucugccaua

SEQ ID NO: 1964940 - RNA, 20 nt, Human
cagcccagaagugcagaacu

SEQ ID NO: 1964941 - RNA, 22 nt, Human
cagcccagaggccgagagcuau

SEQ ID NO: 1964942 - RNA, 23 nt, Human
cagcccagcuuggcccuuuccuu

SEQ ID NO: 1964943 - RNA, 18 nt, Human
cagaugggugcuuggagg

SEQ ID NO: 1964944 - RNA, 12 nt, Human
cagaugccuggg

SEQ ID NO: 1964945 - RNA, 15 nt, Human
cagaugcugugcaaa

SEQ ID NO: 1964946 - RNA, 12 nt, Human
cagaugcucuga

SEQ ID NO: 1964947 - RNA, 13 nt, Human
cagaugcucugag

SEQ ID NO: 1964948 - RNA, 14 nt, Human
cagaugcucugaga

SEQ ID NO: 1964949 - RNA, 17 nt, Human
cagauguuuaaaacacc

SEQ ID NO: 1964950 - RNA, 21 nt, Human
cagauucguggucuuuuccuc

SEQ ID NO: 1964951 - RNA, 20 nt, Human
cagauucuaggaccuguguc

SEQ ID NO: 1964952 - RNA, 19 nt, Human
cagauucguggucuuuucc

SEQ ID NO: 1964953 - RNA, 13 nt, Human
cagauucaggcau

SEQ ID NO: 1964954 - RNA, 14 nt, Human
cagauucaggcauu

SEQ ID NO: 1964955 - RNA, 15 nt, Human
cagauucaggcauuu

SEQ ID NO: 1964956 - RNA, 15 nt, Human
cagauguuuaaaaca

SEQ ID NO: 1964957 - RNA, 16 nt, Human
cagauguuuaaaacac

SEQ ID NO: 1964958 - RNA, 22 nt, Human
cagaugugggccaccauugcaa

SEQ ID NO: 1964959 - RNA, 23 nt, Human
cagaugugggccaccauugcaac

SEQ ID NO: 1964960 - RNA, 14 nt, Human
cagauguuuaaaac

SEQ ID NO: 1964961 - RNA, 23 nt, Human
cagaugggugcuuggaggaagga

SEQ ID NO: 1964962 - RNA, 19 nt, Human
cagauguccuaauggugau

SEQ ID NO: 1964963 - RNA, 22 nt, Human
cagauguccuaauggugaugca

SEQ ID NO: 1964964 - RNA, 16 nt, Human
cagcaacgaucacaaa

SEQ ID NO: 1964965 - RNA, 18 nt, Human
cagcaacgaucacaaaug

SEQ ID NO: 1964966 - RNA, 19 nt, Human
cagcaacgaucacaaauga

SEQ ID NO: 1964967 - RNA, 20 nt, Human
cagcaacgaucacaaaugac

SEQ ID NO: 1964968 - RNA, 21 nt, Human
cagcaacgaucacaaaugacu

SEQ ID NO: 1964969 - RNA, 22 nt, Human
cagcaacgaucacaaaugacuu

SEQ ID NO: 1964970 - RNA, 23 nt, Human
cagcaacgaucacaaaugacuuu

SEQ ID NO: 1964971 - RNA, 18 nt, Human
cagcaaaagaugcuucuc

SEQ ID NO: 1964972 - RNA, 21 nt, Human
cagcaaaccuaauugcacaac

SEQ ID NO: 1964973 - RNA, 12 nt, Human
cagauuuuaguu

SEQ ID NO: 1964974 - RNA, 13 nt, Human
cagauuuuaguuu

SEQ ID NO: 1964975 - RNA, 15 nt, Human
cagauuuuaguuuua

SEQ ID NO: 1964976 - RNA, 17 nt, Human
cagauuuuaguuuuauu

SEQ ID NO: 1964977 - RNA, 22 nt, Human
cagauuuuaguuuuauuuucua

SEQ ID NO: 1964978 - RNA, 14 nt, Human
cagauucuuuccug

SEQ ID NO: 1964979 - RNA, 22 nt, Human
cagauuuuuuacagcugccugc

SEQ ID NO: 1964980 - RNA, 17 nt, Human
cagauuuuggccaugaa

SEQ ID NO: 1964981 - RNA, 19 nt, Human
cagauuuuuuacagcugcc

SEQ ID NO: 1964982 - RNA, 19 nt, Human
cagcacuuucuucuuccca

SEQ ID NO: 1964983 - RNA, 15 nt, Human
cagcagaaaugccuu

SEQ ID NO: 1964984 - RNA, 17 nt, Human
cagcagaaaugccuuac

SEQ ID NO: 1964985 - RNA, 23 nt, Human
cagcagaauugaccgacagcuuu

SEQ ID NO: 1964986 - RNA, 19 nt, Human
cagcagaaaugccuuaccc

SEQ ID NO: 1964987 - RNA, 22 nt, Human
cagcagaaaugccuuacccuca

SEQ ID NO: 1964988 - RNA, 13 nt, Human
cagcagagcaccu

SEQ ID NO: 1964989 - RNA, 11 nt, Human
cagcagagcac

SEQ ID NO: 1964990 - RNA, 13 nt, Human
cagcagccccugc

SEQ ID NO: 1964991 - RNA, 16 nt, Human
cagcagccccugcaca

SEQ ID NO: 1964992 - RNA, 23 nt, Human
cagcagccccugcacaaagcccu

SEQ ID NO: 1964993 - RNA, 12 nt, Human
cagcagccagcc

SEQ ID NO: 1964994 - RNA, 13 nt, Human
cagcagccagcca

SEQ ID NO: 1964995 - RNA, 14 nt, Human
cagcagccagccaa

SEQ ID NO: 1964996 - RNA, 16 nt, Human
cagcagccagccaaac

SEQ ID NO: 1964997 - RNA, 23 nt, Human
cagcagccagccaaacacacaga

SEQ ID NO: 1964998 - RNA, 18 nt, Human
cagcacaaccuucaagcu

SEQ ID NO: 1964999 - RNA, 21 nt, Human
cagcacaaccuucaagcugcu

SEQ ID NO: 1965000 - RNA, 15 nt, Human
cagcaauucuccugc

SEQ ID NO: 1965001 - RNA, 16 nt, Human
cagcaauucuccugcc

SEQ ID NO: 1965002 - RNA, 17 nt, Human
cagcaauucuccugccu

SEQ ID NO: 1965003 - RNA, 18 nt, Human
cagcaauucuccugccuc

SEQ ID NO: 1965004 - RNA, 19 nt, Human
cagcaauucuccugccuca

SEQ ID NO: 1965005 - RNA, 20 nt, Human
cagcaauucuccugccucag

SEQ ID NO: 1965006 - RNA, 22 nt, Human
cagcaauaaagcagcguuucua

SEQ ID NO: 1965007 - RNA, 20 nt, Human
cagcaaguuagagaaucugg

SEQ ID NO: 1965008 - RNA, 15 nt, Human
cagcaagugugaaua

SEQ ID NO: 1965009 - RNA, 13 nt, Human
cagcaauaaagca

SEQ ID NO: 1965010 - RNA, 21 nt, Human
cagcaauaaagcagcguuucu

SEQ ID NO: 1965011 - RNA, 19 nt, Human
cagcaagugagagcugggu

SEQ ID NO: 1965012 - RNA, 21 nt, Human
cagcaagugagagcugggugu

SEQ ID NO: 1965013 - RNA, 18 nt, Human
cagcaaggagauuuacaa

SEQ ID NO: 1965014 - RNA, 17 nt, Human
cagcaaggagauuuaca

SEQ ID NO: 1965015 - RNA, 20 nt, Human
cagcaagccgaauagcugau

SEQ ID NO: 1965016 - RNA, 18 nt, Human
cagcaaggcgcuaacuug

SEQ ID NO: 1965017 - RNA, 19 nt, Human
cagcaaggcgcuaacuugc

SEQ ID NO: 1965018 - RNA, 20 nt, Human
cagcaaggcgcuaacuugcu

SEQ ID NO: 1965019 - RNA, 21 nt, Human
cagcaaggccaccucuuccug

SEQ ID NO: 1965020 - RNA, 23 nt, Human
cagcaaggccaccucuuccuggc

SEQ ID NO: 1965021 - RNA, 13 nt, Human
cagcaaggccacc

SEQ ID NO: 1965022 - RNA, 14 nt, Human
cagcaaggccaccu

SEQ ID NO: 1965023 - RNA, 15 nt, Human
cagcaaggccaccuc

SEQ ID NO: 1965024 - RNA, 16 nt, Human
cagcaaggccaccucu

SEQ ID NO: 1965025 - RNA, 17 nt, Human
cagcaaggccaccucuu

SEQ ID NO: 1965026 - RNA, 19 nt, Human
cagcaaggccaccucuucc

SEQ ID NO: 1965027 - RNA, 20 nt, Human
cagcaaggccaccucuuccu

SEQ ID NO: 1965028 - RNA, 14 nt, Human
cagcaagugagagc

SEQ ID NO: 1965029 - RNA, 15 nt, Human
cagcaagugagagcu

SEQ ID NO: 1965030 - RNA, 16 nt, Human
cagcaagugagagcug

SEQ ID NO: 1965031 - RNA, 17 nt, Human
cagcaagugagagcugg

SEQ ID NO: 1965032 - RNA, 12 nt, Human
cagcaagugaga

SEQ ID NO: 1965033 - RNA, 15 nt, Human
cagcaaggucuugcu

SEQ ID NO: 1965034 - RNA, 16 nt, Human
cagcaaggucuugcuc

SEQ ID NO: 1965035 - RNA, 18 nt, Human
cagcaaggucuugcucuc

SEQ ID NO: 1965036 - RNA, 16 nt, Human
cagacaacaaaccugu

SEQ ID NO: 1965037 - RNA, 15 nt, Human
cagaauucucuaguu

SEQ ID NO: 1965038 - RNA, 18 nt, Human
cagaauucucuaguuuga

SEQ ID NO: 1965039 - RNA, 11 nt, Human
cagaauucuca

SEQ ID NO: 1965040 - RNA, 13 nt, Human
cagaauuggaaaa

SEQ ID NO: 1965041 - RNA, 14 nt, Human
cagaauuggaaaag

SEQ ID NO: 1965042 - RNA, 17 nt, Human
cagaauuggaaaagacu

SEQ ID NO: 1965043 - RNA, 14 nt, Human
cagaauuucccaaa

SEQ ID NO: 1965044 - RNA, 13 nt, Human
cagaauggcauuu

SEQ ID NO: 1965045 - RNA, 14 nt, Human
cagaaugaggcugc

SEQ ID NO: 1965046 - RNA, 15 nt, Human
cagaaugaggcugcu

SEQ ID NO: 1965047 - RNA, 15 nt, Human
cagaaucucgcucug

SEQ ID NO: 1965048 - RNA, 16 nt, Human
cagaaucucugaauuu

SEQ ID NO: 1965049 - RNA, 12 nt, Human
cagaaucuguau

SEQ ID NO: 1965050 - RNA, 16 nt, Human
cagaaucuguaugauu

SEQ ID NO: 1965051 - RNA, 18 nt, Human
cagaaucuguaugauucu

SEQ ID NO: 1965052 - RNA, 20 nt, Human
cagaauuucccaaagcagug

SEQ ID NO: 1965053 - RNA, 19 nt, Human
cagaauuucccaaagcagu

SEQ ID NO: 1965054 - RNA, 18 nt, Human
cagaauuucccaaagcag

SEQ ID NO: 1965055 - RNA, 17 nt, Human
cagaauuucccaaagca

SEQ ID NO: 1965056 - RNA, 12 nt, Human
cagacaaagcgu

SEQ ID NO: 1965057 - RNA, 24 nt, Human
cagaauuucccaaagcagugcaug

SEQ ID NO: 1965058 - RNA, 20 nt, Human
cagacaacaaaccuguuucu

SEQ ID NO: 1965059 - RNA, 22 nt, Human
cagacaaagcgugguggacaug

SEQ ID NO: 1965060 - RNA, 15 nt, Human
cagacaagcuguuga

SEQ ID NO: 1965061 - RNA, 19 nt, Human
cagacaagcuguugaccag

SEQ ID NO: 1965062 - RNA, 14 nt, Human
cagacaaucuucug

SEQ ID NO: 1965063 - RNA, 15 nt, Human
cagacaaucuucugu

SEQ ID NO: 1965064 - RNA, 23 nt, Human
cagacacauguccaagaagccca

SEQ ID NO: 1965065 - RNA, 22 nt, Human
cagacacauguccaagaagccc

SEQ ID NO: 1965066 - RNA, 21 nt, Human
cagacacauguccaagaagcc

SEQ ID NO: 1965067 - RNA, 17 nt, Human
cagacacauguccaaga

SEQ ID NO: 1965068 - RNA, 14 nt, Human
cagacacaugucca

SEQ ID NO: 1965069 - RNA, 13 nt, Human
cagacacaggccc

SEQ ID NO: 1965070 - RNA, 14 nt, Human
cagacacaggcccg

SEQ ID NO: 1965071 - RNA, 15 nt, Human
cagacacaggcccgg

SEQ ID NO: 1965072 - RNA, 17 nt, Human
cagacacaggcccggcu

SEQ ID NO: 1965073 - RNA, 18 nt, Human
cagacacaggcccggcuc

SEQ ID NO: 1965074 - RNA, 21 nt, Human
cagacacaggcccggcuccag

SEQ ID NO: 1965075 - RNA, 22 nt, Human
cagacacaggcccggcuccagg

SEQ ID NO: 1965076 - RNA, 23 nt, Human
cagacacaggcccggcuccaggc

SEQ ID NO: 1965077 - RNA, 22 nt, Human
cagacaugguggggucuccuca

SEQ ID NO: 1965078 - RNA, 23 nt, Human
cagacaugguggggucuccucag

SEQ ID NO: 1965079 - RNA, 17 nt, Human
cagacaugguggggucu

SEQ ID NO: 1965080 - RNA, 17 nt, Human
cagacauagaauuaaca

SEQ ID NO: 1965081 - RNA, 19 nt, Human
cagacauagaauuaacaca

SEQ ID NO: 1965082 - RNA, 19 nt, Human
cagacauacuaaccagcag

SEQ ID NO: 1965083 - RNA, 20 nt, Human
cagacaguuaagagaaauga

SEQ ID NO: 1965084 - RNA, 15 nt, Human
cagacacccuuggag

SEQ ID NO: 1965085 - RNA, 19 nt, Human
cagacaccuugacagggca

SEQ ID NO: 1965086 - RNA, 20 nt, Human
cagacaccuugacagggcac

SEQ ID NO: 1965087 - RNA, 22 nt, Human
cagacaccuugacagggcacac

SEQ ID NO: 1965088 - RNA, 23 nt, Human
cagacucaaaugcucagaccagc

SEQ ID NO: 1965089 - RNA, 22 nt, Human
cagacucaaaugcucagaccag

SEQ ID NO: 1965090 - RNA, 19 nt, Human
cagacgcucauucagcauc

SEQ ID NO: 1965091 - RNA, 20 nt, Human
cagacgcucauucagcaucu

SEQ ID NO: 1965092 - RNA, 21 nt, Human
cagacgcucauucagcaucug

SEQ ID NO: 1965093 - RNA, 22 nt, Human
cagacgcucauucagcaucuga

SEQ ID NO: 1965094 - RNA, 17 nt, Human
cagacuuuuaaagacuu

SEQ ID NO: 1965095 - RNA, 17 nt, Human
cagacuuguauauucua

SEQ ID NO: 1965096 - RNA, 23 nt, Human
cagacuuguauauucuauuuuac

SEQ ID NO: 1965097 - RNA, 15 nt, Human
cagacuuguauauuc

SEQ ID NO: 1965098 - RNA, 16 nt, Human
cagacuuguauauucu

SEQ ID NO: 1965099 - RNA, 19 nt, Human
cagagaaaguacuucucca

SEQ ID NO: 1965100 - RNA, 23 nt, Human
cagagaaaguacuucuccacccu

SEQ ID NO: 1965101 - RNA, 20 nt, Human
cagacuuuuuuuaaauagua

SEQ ID NO: 1965102 - RNA, 19 nt, Human
cagacuuuuaaagacuugc

SEQ ID NO: 1965103 - RNA, 21 nt, Human
cagacuuuuuuaaacaucaaa

SEQ ID NO: 1965104 - RNA, 14 nt, Human
cagacccugcccug

SEQ ID NO: 1965105 - RNA, 13 nt, Human
cagacccugcccu

SEQ ID NO: 1965106 - RNA, 12 nt, Human
cagacccugccc

SEQ ID NO: 1965107 - RNA, 16 nt, Human
cagacccggcugcgug

SEQ ID NO: 1965108 - RNA, 12 nt, Human
cagacccggcug

SEQ ID NO: 1965109 - RNA, 14 nt, Human
cagacccggcugcg

SEQ ID NO: 1965110 - RNA, 23 nt, Human
cagaccccuggcuuuucacugcu

SEQ ID NO: 1965111 - RNA, 21 nt, Human
cagaccccuggcuuuucacug

SEQ ID NO: 1965112 - RNA, 22 nt, Human
cagaccccuggcuuuucacugc

SEQ ID NO: 1965113 - RNA, 21 nt, Human
cagacccugcccugugggccc

SEQ ID NO: 1965114 - RNA, 17 nt, Human
cagacccugcccugugg

SEQ ID NO: 1965115 - RNA, 16 nt, Human
cagacccugcccugug

SEQ ID NO: 1965116 - RNA, 15 nt, Human
cagacccugcccugu

SEQ ID NO: 1965117 - RNA, 22 nt, Human
cagacccugcccugugggcccc

SEQ ID NO: 1965118 - RNA, 14 nt, Human
cagacccuggagga

SEQ ID NO: 1965119 - RNA, 21 nt, Human
cagaccgaacuguuguauaaa

SEQ ID NO: 1965120 - RNA, 20 nt, Human
cagaccgcgggcacugccgc

SEQ ID NO: 1965121 - RNA, 15 nt, Human
cagacccccuggaga

SEQ ID NO: 1965122 - RNA, 13 nt, Human
cagaccccuggcu

SEQ ID NO: 1965123 - RNA, 14 nt, Human
cagaccccuggcuu

SEQ ID NO: 1965124 - RNA, 15 nt, Human
cagaccccuggcuuu

SEQ ID NO: 1965125 - RNA, 16 nt, Human
cagaccccuggcuuuu

SEQ ID NO: 1965126 - RNA, 18 nt, Human
cagaccccuggcuuuuca

SEQ ID NO: 1965127 - RNA, 20 nt, Human
cagaccacaaaacuuuucua

SEQ ID NO: 1965128 - RNA, 14 nt, Human
cagaccacaaaacu

SEQ ID NO: 1965129 - RNA, 13 nt, Human
cagaccagcucuu

SEQ ID NO: 1965130 - RNA, 11 nt, Human
cagaagcccag

SEQ ID NO: 1965131 - RNA, 19 nt, Human
cagaagccacccaaagcag

SEQ ID NO: 1965132 - RNA, 18 nt, Human
cagaagccacccaaagca

SEQ ID NO: 1965133 - RNA, 12 nt, Human
cagaagcccaga

SEQ ID NO: 1965134 - RNA, 14 nt, Human
cagaagcccagaau

SEQ ID NO: 1965135 - RNA, 23 nt, Human
cagaagcccugauguguccucag

SEQ ID NO: 1965136 - RNA, 19 nt, Human
cagaagcaacccaaauguu

SEQ ID NO: 1965137 - RNA, 20 nt, Human
cagaagcaacccaaauguuc

SEQ ID NO: 1965138 - RNA, 20 nt, Human
cagaagauagcuucacccca

SEQ ID NO: 1965139 - RNA, 21 nt, Human
cagaagacacugaugggcaac

SEQ ID NO: 1965140 - RNA, 18 nt, Human
cagaacucggugucccca

SEQ ID NO: 1965141 - RNA, 19 nt, Human
cagaacucgguguccccac

SEQ ID NO: 1965142 - RNA, 21 nt, Human
cagaacucgguguccccacca

SEQ ID NO: 1965143 - RNA, 22 nt, Human
cagaacucgguguccccaccau

SEQ ID NO: 1965144 - RNA, 13 nt, Human
cagaacucuuccu

SEQ ID NO: 1965145 - RNA, 14 nt, Human
cagaacucuuccuc

SEQ ID NO: 1965146 - RNA, 15 nt, Human
cagaacucuuccucc

SEQ ID NO: 1965147 - RNA, 16 nt, Human
cagaacucuuccucca

SEQ ID NO: 1965148 - RNA, 15 nt, Human
cagaacucugccugc

SEQ ID NO: 1965149 - RNA, 16 nt, Human
cagaacucugccugcc

SEQ ID NO: 1965150 - RNA, 17 nt, Human
cagaacucugccugccc

SEQ ID NO: 1965151 - RNA, 18 nt, Human
cagaacucugccugcccu

SEQ ID NO: 1965152 - RNA, 22 nt, Human
cagaacucugccugcccuuugu

SEQ ID NO: 1965153 - RNA, 13 nt, Human
cagaacucugugu

SEQ ID NO: 1965154 - RNA, 14 nt, Human
cagaacucuguguc

SEQ ID NO: 1965155 - RNA, 18 nt, Human
cagaacuuagcaauuucc

SEQ ID NO: 1965156 - RNA, 19 nt, Human
cagaacugcagucacugca

SEQ ID NO: 1965157 - RNA, 18 nt, Human
cagaacuugaagccugcu

SEQ ID NO: 1965158 - RNA, 19 nt, Human
cagaacuugaagccugcuc

SEQ ID NO: 1965159 - RNA, 20 nt, Human
cagaacuugaagccugcucc

SEQ ID NO: 1965160 - RNA, 21 nt, Human
cagaacuugaagccugcuccu

SEQ ID NO: 1965161 - RNA, 22 nt, Human
cagaacuugaagccugcuccuu

SEQ ID NO: 1965162 - RNA, 22 nt, Human
cagaacucuuccuccaaggaca

SEQ ID NO: 1965163 - RNA, 23 nt, Human
cagaaccccuggcuccaggccag

SEQ ID NO: 1965164 - RNA, 22 nt, Human
cagaacccuuggagccaaugga

SEQ ID NO: 1965165 - RNA, 16 nt, Human
cagaaccagucuuuca

SEQ ID NO: 1965166 - RNA, 17 nt, Human
cagaaccagucuuucaa

SEQ ID NO: 1965167 - RNA, 18 nt, Human
cagaaggaagacuucauc

SEQ ID NO: 1965168 - RNA, 17 nt, Human
cagaaggaagacuucau

SEQ ID NO: 1965169 - RNA, 16 nt, Human
cagaaggaagacuuca

SEQ ID NO: 1965170 - RNA, 19 nt, Human
cagaaggaagacuucaucc

SEQ ID NO: 1965171 - RNA, 12 nt, Human
cagaaggcuccu

SEQ ID NO: 1965172 - RNA, 14 nt, Human
cagaaggcuccugc

SEQ ID NO: 1965173 - RNA, 15 nt, Human
cagaaggcuccugcc

SEQ ID NO: 1965174 - RNA, 16 nt, Human
cagaaggcuccugccc

SEQ ID NO: 1965175 - RNA, 18 nt, Human
cagaaucucaaauaacua

SEQ ID NO: 1965176 - RNA, 17 nt, Human
cagaaucucaaauaacu

SEQ ID NO: 1965177 - RNA, 16 nt, Human
cagaaguagcuuugca

SEQ ID NO: 1965178 - RNA, 13 nt, Human
cagaaguagggga

SEQ ID NO: 1965179 - RNA, 18 nt, Human
cagaaguaggggaagaau

SEQ ID NO: 1965180 - RNA, 22 nt, Human
cagaaguaggggaagaauaauu

SEQ ID NO: 1965181 - RNA, 23 nt, Human
cagaaguaggggaagaauaauuu

SEQ ID NO: 1965182 - RNA, 23 nt, Human
cagaaggggacugccaccucccc

SEQ ID NO: 1965183 - RNA, 19 nt, Human
cagaaggggacugccaccu

SEQ ID NO: 1965184 - RNA, 20 nt, Human
cagaaggggacugccaccuc

SEQ ID NO: 1965185 - RNA, 21 nt, Human
cagaaggggacugccaccucc

SEQ ID NO: 1965186 - RNA, 22 nt, Human
cagaaggggacugccaccuccc

SEQ ID NO: 1965187 - RNA, 15 nt, Human
cagaaggucuguuuu

SEQ ID NO: 1965188 - RNA, 17 nt, Human
cagaaggcuccugcccc

SEQ ID NO: 1965189 - RNA, 19 nt, Human
cagaaggcuccugccccca

SEQ ID NO: 1965190 - RNA, 19 nt, Human
cagaagggagcuggcucca

SEQ ID NO: 1965191 - RNA, 20 nt, Human
cagaagggagcuggcuccag

SEQ ID NO: 1965192 - RNA, 21 nt, Human
cagaagggagcuggcuccagc

SEQ ID NO: 1965193 - RNA, 15 nt, Human
cagaaggggacugcc

SEQ ID NO: 1965194 - RNA, 16 nt, Human
cagaaggggacugcca

SEQ ID NO: 1965195 - RNA, 17 nt, Human
cagaaggggacugccac

SEQ ID NO: 1965196 - RNA, 23 nt, Human
cacuuuguucuggcucuuccagg

SEQ ID NO: 1965197 - RNA, 16 nt, Human
cacuuuguucuggcuc

SEQ ID NO: 1965198 - RNA, 14 nt, Human
cacuuuguucuggc

SEQ ID NO: 1965199 - RNA, 13 nt, Human
cacuuuguucugg

SEQ ID NO: 1965200 - RNA, 13 nt, Human
cacuuugggaggc

SEQ ID NO: 1965201 - RNA, 12 nt, Human
cacuuugggagg

SEQ ID NO: 1965202 - RNA, 16 nt, Human
cacuuugggaggccaa

SEQ ID NO: 1965203 - RNA, 22 nt, Human
cacuuucuagccagaggagaga

SEQ ID NO: 1965204 - RNA, 22 nt, Human
cacuuggguccaggccuacucc

SEQ ID NO: 1965205 - RNA, 12 nt, Human
cacuuugcauaa

SEQ ID NO: 1965206 - RNA, 11 nt, Human
cagaaaaaagg

SEQ ID NO: 1965207 - RNA, 12 nt, Human
cagaaaaaaggu

SEQ ID NO: 1965208 - RNA, 22 nt, Human
cagaaaaaagguucuuugugua

SEQ ID NO: 1965209 - RNA, 20 nt, Human
cacuuuuucuuuacaaacaa

SEQ ID NO: 1965210 - RNA, 21 nt, Human
cacuuuuucuuuacaaacaaa

SEQ ID NO: 1965211 - RNA, 18 nt, Human
cacuuuuauuuagcacca

SEQ ID NO: 1965212 - RNA, 11 nt, Human
cacuuuuccag

SEQ ID NO: 1965213 - RNA, 17 nt, Human
cacuuuuccaguauuuu

SEQ ID NO: 1965214 - RNA, 15 nt, Human
cacuuuuccaguauu

SEQ ID NO: 1965215 - RNA, 16 nt, Human
cacuuuuccaguauuu

SEQ ID NO: 1965216 - RNA, 22 nt, Human
cacuuuuguucuugguuuguaa

SEQ ID NO: 1965217 - RNA, 12 nt, Human
cacuuuugccag

SEQ ID NO: 1965218 - RNA, 17 nt, Human
cacuuuuuaaaaaacuu

SEQ ID NO: 1965219 - RNA, 20 nt, Human
cacuuuuuaaaaaacuuucu

SEQ ID NO: 1965220 - RNA, 14 nt, Human
cacuuuuguucuug

SEQ ID NO: 1965221 - RNA, 15 nt, Human
cagaaacacccacag

SEQ ID NO: 1965222 - RNA, 11 nt, Human
cagaaaaugag

SEQ ID NO: 1965223 - RNA, 23 nt, Human
cagaaaauggaagacagcucuua

SEQ ID NO: 1965224 - RNA, 22 nt, Human
cagaaaauggaagacagcucuu

SEQ ID NO: 1965225 - RNA, 21 nt, Human
cagaaaauggaagacagcucu

SEQ ID NO: 1965226 - RNA, 20 nt, Human
cagaaaauggaagacagcuc

SEQ ID NO: 1965227 - RNA, 16 nt, Human
cagaaaauggaagaca

SEQ ID NO: 1965228 - RNA, 17 nt, Human
cagaaaaguugaauuuu

SEQ ID NO: 1965229 - RNA, 20 nt, Human
cagaaaaguugaauuuuaca

SEQ ID NO: 1965230 - RNA, 22 nt, Human
cagaaaaguugaauuuuacaug

SEQ ID NO: 1965231 - RNA, 14 nt, Human
cagaaaauauguau

SEQ ID NO: 1965232 - RNA, 15 nt, Human
cagaaaauauguauu

SEQ ID NO: 1965233 - RNA, 16 nt, Human
cagaaaauauguauua

SEQ ID NO: 1965234 - RNA, 20 nt, Human
cagaaaauauguauuaacac

SEQ ID NO: 1965235 - RNA, 21 nt, Human
cagaaaauauguauuaacacu

SEQ ID NO: 1965236 - RNA, 22 nt, Human
cagaaaauauguauuaacacua

SEQ ID NO: 1965237 - RNA, 23 nt, Human
cagaacagugauuaccagggacu

SEQ ID NO: 1965238 - RNA, 19 nt, Human
cagaaagcagaacagugau

SEQ ID NO: 1965239 - RNA, 19 nt, Human
cagaaacuguucccaccug

SEQ ID NO: 1965240 - RNA, 17 nt, Human
cagaaacgccacauccc

SEQ ID NO: 1965241 - RNA, 16 nt, Human
cagaaacuuguucuuc

SEQ ID NO: 1965242 - RNA, 18 nt, Human
cagaaagcagaacaguga

SEQ ID NO: 1965243 - RNA, 24 nt, Human
cagaaagaaguggggacagagcag

SEQ ID NO: 1965244 - RNA, 18 nt, Human
cagaaacuuguucuucca

SEQ ID NO: 1965245 - RNA, 19 nt, Human
cagaaacacccacaggcau

SEQ ID NO: 1965246 - RNA, 17 nt, Human
cagaaacacccacaggc

SEQ ID NO: 1965247 - RNA, 18 nt, Human
cagaaacacccacaggca

SEQ ID NO: 1965248 - RNA, 12 nt, Human
cagaggccuccu

SEQ ID NO: 1965249 - RNA, 13 nt, Human
cagaggccuccug

SEQ ID NO: 1965250 - RNA, 23 nt, Human
cagaggccccaauaccccaugga

SEQ ID NO: 1965251 - RNA, 21 nt, Human
cagaggcucagauuguaauau

SEQ ID NO: 1965252 - RNA, 13 nt, Human
cagaggcugccuc

SEQ ID NO: 1965253 - RNA, 16 nt, Human
cagaggccuccugugg

SEQ ID NO: 1965254 - RNA, 21 nt, Human
cagaggccuccuguggccugc

SEQ ID NO: 1965255 - RNA, 23 nt, Human
cagaggcgcaugaauuugugaag

SEQ ID NO: 1965256 - RNA, 23 nt, Human
cagaggcugccucucccaucacu

SEQ ID NO: 1965257 - RNA, 14 nt, Human
cagagggagugaca

SEQ ID NO: 1965258 - RNA, 16 nt, Human
cagagggagugacaga

SEQ ID NO: 1965259 - RNA, 18 nt, Human
cagagggagugacagagg

SEQ ID NO: 1965260 - RNA, 19 nt, Human
cagagggagugacagaggc

SEQ ID NO: 1965261 - RNA, 23 nt, Human
cagaggcagccccauucugccug

SEQ ID NO: 1965262 - RNA, 19 nt, Human
cagaggccaugggccuccu

SEQ ID NO: 1965263 - RNA, 16 nt, Human
cagaggccaugggccu

SEQ ID NO: 1965264 - RNA, 20 nt, Human
cagaggccaugggccuccug

SEQ ID NO: 1965265 - RNA, 21 nt, Human
cagaggccaugggccuccugu

SEQ ID NO: 1965266 - RNA, 11 nt, Human
cagaggcccca

SEQ ID NO: 1965267 - RNA, 22 nt, Human
cagaggccccaauaccccaugg

SEQ ID NO: 1965268 - RNA, 12 nt, Human
cagaggcagccc

SEQ ID NO: 1965269 - RNA, 13 nt, Human
cagaggcagcccc

SEQ ID NO: 1965270 - RNA, 14 nt, Human
cagaggcagcccca

SEQ ID NO: 1965271 - RNA, 15 nt, Human
cagaggcagccccau

SEQ ID NO: 1965272 - RNA, 18 nt, Human
cagaggcagccccauucu

SEQ ID NO: 1965273 - RNA, 19 nt, Human
cagaggcagccccauucug

SEQ ID NO: 1965274 - RNA, 20 nt, Human
cagaggcagccccauucugc

SEQ ID NO: 1965275 - RNA, 22 nt, Human
cagaggcagccccauucugccu

SEQ ID NO: 1965276 - RNA, 13 nt, Human
cagagucucacug

SEQ ID NO: 1965277 - RNA, 13 nt, Human
cagagucccccca

SEQ ID NO: 1965278 - RNA, 14 nt, Human
cagaguccccccac

SEQ ID NO: 1965279 - RNA, 15 nt, Human
cagaguccccccacu

SEQ ID NO: 1965280 - RNA, 22 nt, Human
cagaguccccccacucccagca

SEQ ID NO: 1965281 - RNA, 23 nt, Human
cagagggccauugaacucugaga

SEQ ID NO: 1965282 - RNA, 17 nt, Human
cagagucucacuguugc

SEQ ID NO: 1965283 - RNA, 19 nt, Human
cagagucucacuguugccc

SEQ ID NO: 1965284 - RNA, 20 nt, Human
cagagucucacuguugccca

SEQ ID NO: 1965285 - RNA, 21 nt, Human
cagagucucacuguugcccag

SEQ ID NO: 1965286 - RNA, 19 nt, Human
cagagggccugcaagggag

SEQ ID NO: 1965287 - RNA, 15 nt, Human
cagagggccugcaag

SEQ ID NO: 1965288 - RNA, 20 nt, Human
cagagggagugacagaggca

SEQ ID NO: 1965289 - RNA, 21 nt, Human
cagagggagugacagaggcag

SEQ ID NO: 1965290 - RNA, 22 nt, Human
cagagggagugacagaggcagc

SEQ ID NO: 1965291 - RNA, 23 nt, Human
cagagggagugacagaggcagcc

SEQ ID NO: 1965292 - RNA, 20 nt, Human
cagagucuagcguagugcag

SEQ ID NO: 1965293 - RNA, 22 nt, Human
cagagucucacuguugcccagg

SEQ ID NO: 1965294 - RNA, 23 nt, Human
cagagucucacuguugcccaggc

SEQ ID NO: 1965295 - RNA, 16 nt, Human
cagagugagacucugu

SEQ ID NO: 1965296 - RNA, 17 nt, Human
cagagugagacucuguc

SEQ ID NO: 1965297 - RNA, 18 nt, Human
cagagugagacucugucu

SEQ ID NO: 1965298 - RNA, 20 nt, Human
cagagugcaagccccugcuc

SEQ ID NO: 1965299 - RNA, 15 nt, Human
cagagugcuuuucug

SEQ ID NO: 1965300 - RNA, 23 nt, Human
cagagugcaagccccugcuccag

SEQ ID NO: 1965301 - RNA, 18 nt, Human
cagagugcaagccccugc

SEQ ID NO: 1965302 - RNA, 19 nt, Human
cagagugagacucugucuc

SEQ ID NO: 1965303 - RNA, 20 nt, Human
cagagugagacucugucuca

SEQ ID NO: 1965304 - RNA, 16 nt, Human
cagaguugaagacaga

SEQ ID NO: 1965305 - RNA, 15 nt, Human
cagaguugaagacag

SEQ ID NO: 1965306 - RNA, 14 nt, Human
cagaguugaagaca

SEQ ID NO: 1965307 - RNA, 12 nt, Human
cagaguuacuug

SEQ ID NO: 1965308 - RNA, 20 nt, Human
cagaguugaagacagagcua

SEQ ID NO: 1965309 - RNA, 19 nt, Human
cagaguugaagacagagcu

SEQ ID NO: 1965310 - RNA, 18 nt, Human
cagaguugaagacagagc

SEQ ID NO: 1965311 - RNA, 17 nt, Human
cagaguugaagacagag

SEQ ID NO: 1965312 - RNA, 14 nt, Human
cagaguuguuacau

SEQ ID NO: 1965313 - RNA, 22 nt, Human
cagaguugaagacagagcuaca

SEQ ID NO: 1965314 - RNA, 23 nt, Human
cagauaaauaguuuaugauucca

SEQ ID NO: 1965315 - RNA, 22 nt, Human
cagauaaagguucaugcaaacu

SEQ ID NO: 1965316 - RNA, 14 nt, Human
cagauaaacaguag

SEQ ID NO: 1965317 - RNA, 21 nt, Human
cagauaaaccuagauaaagag

SEQ ID NO: 1965318 - RNA, 12 nt, Human
cagauaaagauu

SEQ ID NO: 1965319 - RNA, 16 nt, Human
cagauaaagauugugu

SEQ ID NO: 1965320 - RNA, 15 nt, Human
cagaguuguuacauu

SEQ ID NO: 1965321 - RNA, 18 nt, Human
cagaguuguuacauuuuu

SEQ ID NO: 1965322 - RNA, 19 nt, Human
cagaguuguuacauuuuua

SEQ ID NO: 1965323 - RNA, 23 nt, Human
cagauaaaugauucaaaaaguca

SEQ ID NO: 1965324 - RNA, 17 nt, Human
cagauaaagauugugug

SEQ ID NO: 1965325 - RNA, 21 nt, Human
cagauaaaugauucaaaaagu

SEQ ID NO: 1965326 - RNA, 20 nt, Human
cagaucucuaacuucaccau

SEQ ID NO: 1965327 - RNA, 13 nt, Human
cagaucucccaca

SEQ ID NO: 1965328 - RNA, 23 nt, Human
cagaucucccacaugccaggggc

SEQ ID NO: 1965329 - RNA, 23 nt, Human
cagauccuggguacugaaagccu

SEQ ID NO: 1965330 - RNA, 20 nt, Human
cagauacaggaaaagcugcu

SEQ ID NO: 1965331 - RNA, 21 nt, Human
cagauacaggaaaagcugcug

SEQ ID NO: 1965332 - RNA, 22 nt, Human
cagauacaggaaaagcugcuga

SEQ ID NO: 1965333 - RNA, 19 nt, Human
cagaugaggugaaaaggcc

SEQ ID NO: 1965334 - RNA, 23 nt, Human
cagaugaccccugcccagaucag

SEQ ID NO: 1965335 - RNA, 16 nt, Human
cagaugaccccugccc

SEQ ID NO: 1965336 - RNA, 17 nt, Human
cagaugaccccugccca

SEQ ID NO: 1965337 - RNA, 18 nt, Human
cagaugaccccugcccag

SEQ ID NO: 1965338 - RNA, 19 nt, Human
cagaugaccccugcccaga

SEQ ID NO: 1965339 - RNA, 17 nt, Human
cagaugcagcucuuccu

SEQ ID NO: 1965340 - RNA, 18 nt, Human
cagaugcagcucuuccug

SEQ ID NO: 1965341 - RNA, 19 nt, Human
cagaugcagcucuuccugg

SEQ ID NO: 1965342 - RNA, 23 nt, Human
cagaugcagcucuuccuggacag

SEQ ID NO: 1965343 - RNA, 13 nt, Human
cagaugcagcucu

SEQ ID NO: 1965344 - RNA, 14 nt, Human
cagaugcagcucuu

SEQ ID NO: 1965345 - RNA, 15 nt, Human
cagaugcagcucuuc

SEQ ID NO: 1965346 - RNA, 12 nt, Human
cagaugcagcuc

SEQ ID NO: 1965347 - RNA, 17 nt, Human
cagaugcaccagcccuu

SEQ ID NO: 1965348 - RNA, 22 nt, Human
cagaugcaccagcccuuagcag

SEQ ID NO: 1965349 - RNA, 14 nt, Human
cagaugcaaugacu

SEQ ID NO: 1965350 - RNA, 13 nt, Human
cagaugcaccagc

SEQ ID NO: 1965351 - RNA, 14 nt, Human
cagaugcaccagcc

SEQ ID NO: 1965352 - RNA, 16 nt, Human
cagaugcaccagcccu

SEQ ID NO: 1965353 - RNA, 19 nt, Human
cagagacuccugcaggcag

SEQ ID NO: 1965354 - RNA, 18 nt, Human
cagagacuccugcaggca

SEQ ID NO: 1965355 - RNA, 17 nt, Human
cagagacuccugcaggc

SEQ ID NO: 1965356 - RNA, 16 nt, Human
cagagacuccugcagg

SEQ ID NO: 1965357 - RNA, 15 nt, Human
cagagacuccugcag

SEQ ID NO: 1965358 - RNA, 14 nt, Human
cagagacuccugca

SEQ ID NO: 1965359 - RNA, 13 nt, Human
cagagacuccugc

SEQ ID NO: 1965360 - RNA, 20 nt, Human
cagagaccaucccugaaggc

SEQ ID NO: 1965361 - RNA, 19 nt, Human
cagagaccaucccugaagg

SEQ ID NO: 1965362 - RNA, 18 nt, Human
cagagaccaucccugaag

SEQ ID NO: 1965363 - RNA, 17 nt, Human
cagagaccaucccugaa

SEQ ID NO: 1965364 - RNA, 21 nt, Human
cagagaccaucccugaaggcc

SEQ ID NO: 1965365 - RNA, 21 nt, Human
cagagcaaccccuggacccca

SEQ ID NO: 1965366 - RNA, 22 nt, Human
cagagcaaccccuggaccccag

SEQ ID NO: 1965367 - RNA, 23 nt, Human
cagagcaaccccuggaccccagc

SEQ ID NO: 1965368 - RNA, 15 nt, Human
cagagcaaccccugg

SEQ ID NO: 1965369 - RNA, 18 nt, Human
cagagcaaccccuggacc

SEQ ID NO: 1965370 - RNA, 20 nt, Human
cagagcaagugagacccugu

SEQ ID NO: 1965371 - RNA, 14 nt, Human
cagagcaagugaga

SEQ ID NO: 1965372 - RNA, 16 nt, Human
cagagcaccuuagaca

SEQ ID NO: 1965373 - RNA, 18 nt, Human
cagagcacagcagccccu

SEQ ID NO: 1965374 - RNA, 20 nt, Human
cagagauggucauauuuaaa

SEQ ID NO: 1965375 - RNA, 22 nt, Human
cagagauaguggggagacuucu

SEQ ID NO: 1965376 - RNA, 15 nt, Human
cagagaguggcuccu

SEQ ID NO: 1965377 - RNA, 18 nt, Human
cagagaguggcuccuccc

SEQ ID NO: 1965378 - RNA, 13 nt, Human
cagagaguggcuc

SEQ ID NO: 1965379 - RNA, 14 nt, Human
cagagaguggcucc

SEQ ID NO: 1965380 - RNA, 19 nt, Human
cagagaaugaaagggccca

SEQ ID NO: 1965381 - RNA, 15 nt, Human
cagagaauucucuua

SEQ ID NO: 1965382 - RNA, 20 nt, Human
cagagaagugacgguuccua

SEQ ID NO: 1965383 - RNA, 20 nt, Human
cagagaaugaaagggcccag

SEQ ID NO: 1965384 - RNA, 21 nt, Human
cagagaaugaaagggcccaga

SEQ ID NO: 1965385 - RNA, 16 nt, Human
cagagaaaugucuguc

SEQ ID NO: 1965386 - RNA, 16 nt, Human
cagagaccaucccuga

SEQ ID NO: 1965387 - RNA, 14 nt, Human
cagagaccaucccu

SEQ ID NO: 1965388 - RNA, 13 nt, Human
cagagaccauccc

SEQ ID NO: 1965389 - RNA, 17 nt, Human
cagagacacaagccuuc

SEQ ID NO: 1965390 - RNA, 16 nt, Human
cagagacacaagccuu

SEQ ID NO: 1965391 - RNA, 15 nt, Human
cagagacacaagccu

SEQ ID NO: 1965392 - RNA, 14 nt, Human
cagagacacaagcc

SEQ ID NO: 1965393 - RNA, 22 nt, Human
cagagacaaauauuucuagaca

SEQ ID NO: 1965394 - RNA, 21 nt, Human
cagagcagagaccaucccuga

SEQ ID NO: 1965395 - RNA, 19 nt, Human
cagagcagagaccaucccu

SEQ ID NO: 1965396 - RNA, 18 nt, Human
cagagcagagaccauccc

SEQ ID NO: 1965397 - RNA, 17 nt, Human
cagagcagagaccaucc

SEQ ID NO: 1965398 - RNA, 15 nt, Human
cagagcagagaccau

SEQ ID NO: 1965399 - RNA, 14 nt, Human
cagagcagagacca

SEQ ID NO: 1965400 - RNA, 13 nt, Human
cagagcagagacc

SEQ ID NO: 1965401 - RNA, 22 nt, Human
cagagcaccuuagacagucccu

SEQ ID NO: 1965402 - RNA, 21 nt, Human
cagagcaccuuagacaguccc

SEQ ID NO: 1965403 - RNA, 19 nt, Human
cagagcaccuuagacaguc

SEQ ID NO: 1965404 - RNA, 18 nt, Human
cagagcaccuuagacagu

SEQ ID NO: 1965405 - RNA, 12 nt, Human
cagagcagagac

SEQ ID NO: 1965406 - RNA, 11 nt, Human
cagagcagaga

SEQ ID NO: 1965407 - RNA, 23 nt, Human
cagagcaccuuagacagucccug

SEQ ID NO: 1965408 - RNA, 15 nt, Human
cagagcagugggccu

SEQ ID NO: 1965409 - RNA, 17 nt, Human
cagagcagugggccugg

SEQ ID NO: 1965410 - RNA, 20 nt, Human
cagagcagugggccuggcca

SEQ ID NO: 1965411 - RNA, 21 nt, Human
cagagcagugggccuggccag

SEQ ID NO: 1965412 - RNA, 22 nt, Human
cagagcagugggccuggccagc

SEQ ID NO: 1965413 - RNA, 12 nt, Human
cagagcagucug

SEQ ID NO: 1965414 - RNA, 19 nt, Human
cagagcaguugagaggaca

SEQ ID NO: 1965415 - RNA, 17 nt, Human
cagagcauuccagucag

SEQ ID NO: 1965416 - RNA, 18 nt, Human
cagagcauuccagucagg

SEQ ID NO: 1965417 - RNA, 19 nt, Human
cagagcauuccagucaggc

SEQ ID NO: 1965418 - RNA, 22 nt, Human
cagagccaccccuaaagagaua

SEQ ID NO: 1965419 - RNA, 22 nt, Human
cagagcauuccagucaggcucu

SEQ ID NO: 1965420 - RNA, 20 nt, Human
cagagcauuccagucaggcu

SEQ ID NO: 1965421 - RNA, 21 nt, Human
cagagcauuccagucaggcuc

SEQ ID NO: 1965422 - RNA, 15 nt, Human
cagagcccaccuugg

SEQ ID NO: 1965423 - RNA, 17 nt, Human
cagagcccaccuuggcu

SEQ ID NO: 1965424 - RNA, 19 nt, Human
cagagcccaccuuggcuca

SEQ ID NO: 1965425 - RNA, 16 nt, Human
cagagcccacgccccc

SEQ ID NO: 1965426 - RNA, 20 nt, Human
cagagcccaccuuggcucaa

SEQ ID NO: 1965427 - RNA, 21 nt, Human
cagagcccacgcccccacugg

SEQ ID NO: 1965428 - RNA, 20 nt, Human
cagagcccacgcccccacug

SEQ ID NO: 1965429 - RNA, 19 nt, Human
cagagcccacgcccccacu

SEQ ID NO: 1965430 - RNA, 17 nt, Human
cagagcccacgccccca

SEQ ID NO: 1965431 - RNA, 20 nt, Human
cagagcccagacccuggagg

SEQ ID NO: 1965432 - RNA, 14 nt, Human
cagagcccagaccc

SEQ ID NO: 1965433 - RNA, 23 nt, Human
cagagcccacgcccccacuggug

SEQ ID NO: 1965434 - RNA, 12 nt, Human
cagagccugcag

SEQ ID NO: 1965435 - RNA, 21 nt, Human
cagagccguaaaaacugaagu

SEQ ID NO: 1965436 - RNA, 20 nt, Human
cagagccguaaaaacugaag

SEQ ID NO: 1965437 - RNA, 10 nt, Human
cagagcccug

SEQ ID NO: 1965438 - RNA, 14 nt, Human
cagagcccugcucc

SEQ ID NO: 1965439 - RNA, 15 nt, Human
cagagcccugcuccc

SEQ ID NO: 1965440 - RNA, 17 nt, Human
cagagcccugcucccuc

SEQ ID NO: 1965441 - RNA, 13 nt, Human
cagaggaaggaga

SEQ ID NO: 1965442 - RNA, 13 nt, Human
cagagccugcagu

SEQ ID NO: 1965443 - RNA, 23 nt, Human
cagagccguaaaaacugaaguuc

SEQ ID NO: 1965444 - RNA, 22 nt, Human
cagaggacaguauuugugggga

SEQ ID NO: 1965445 - RNA, 13 nt, Human
cagaggaccagca

SEQ ID NO: 1965446 - RNA, 15 nt, Human
cagaggacacagaga

SEQ ID NO: 1965447 - RNA, 17 nt, Human
cagaggacacagagaag

SEQ ID NO: 1965448 - RNA, 19 nt, Human
cagaggagagaggaccccc

SEQ ID NO: 1965449 - RNA, 15 nt, Human
cagaggagagaggac

SEQ ID NO: 1965450 - RNA, 13 nt, Human
cagaggagagagg

SEQ ID NO: 1965451 - RNA, 16 nt, Human
cagaggaccagcacac

SEQ ID NO: 1965452 - RNA, 20 nt, Human
cagaggaccagcacacuccc

SEQ ID NO: 1965453 - RNA, 18 nt, Human
cagaggaggcgaggaggc

SEQ ID NO: 1965454 - RNA, 11 nt, Human
cagaggcagcc

SEQ ID NO: 1965455 - RNA, 20 nt, Human
cagaggagagaggacccccu

SEQ ID NO: 1965456 - RNA, 20 nt, Human
cagaggagaacuugcugccu

SEQ ID NO: 1965457 - RNA, 21 nt, Human
cagaggagaacuugcugccuc

SEQ ID NO: 1965458 - RNA, 16 nt, Human
cacgccagauucuuuc

SEQ ID NO: 1965459 - RNA, 17 nt, Human
caccucucccuuggauu

SEQ ID NO: 1965460 - RNA, 14 nt, Human
caccucucccuugg

SEQ ID NO: 1965461 - RNA, 13 nt, Human
caccucucccuug

SEQ ID NO: 1965462 - RNA, 17 nt, Human
caccuccuaaaaggccc

SEQ ID NO: 1965463 - RNA, 18 nt, Human
caccuccuaaaaggccca

SEQ ID NO: 1965464 - RNA, 22 nt, Human
caccuccuaaaaggcccagaga

SEQ ID NO: 1965465 - RNA, 19 nt, Human
caccuccuaaaaggcccag

SEQ ID NO: 1965466 - RNA, 20 nt, Human
caccuccuaaaaggcccaga

SEQ ID NO: 1965467 - RNA, 16 nt, Human
caccuccucccacugc

SEQ ID NO: 1965468 - RNA, 14 nt, Human
caccuccugccucg

SEQ ID NO: 1965469 - RNA, 22 nt, Human
caccuccucggcuggcugucca

SEQ ID NO: 1965470 - RNA, 13 nt, Human
caccuccugccuc

SEQ ID NO: 1965471 - RNA, 11 nt, Human
caccuccugcc

SEQ ID NO: 1965472 - RNA, 20 nt, Human
caccuccccuugccagcugc

SEQ ID NO: 1965473 - RNA, 22 nt, Human
caccuccccuugccagcugcug

SEQ ID NO: 1965474 - RNA, 16 nt, Human
caccuccccuugccag

SEQ ID NO: 1965475 - RNA, 17 nt, Human
caccuccccuugccagc

SEQ ID NO: 1965476 - RNA, 18 nt, Human
caccuccccuugccagcu

SEQ ID NO: 1965477 - RNA, 19 nt, Human
caccuccccuugccagcug

SEQ ID NO: 1965478 - RNA, 14 nt, Human
caccuccccuugcc

SEQ ID NO: 1965479 - RNA, 15 nt, Human
caccuccccuugcca

SEQ ID NO: 1965480 - RNA, 14 nt, Human
caccucccccaucu

SEQ ID NO: 1965481 - RNA, 21 nt, Human
caccucccccaucucuucugg

SEQ ID NO: 1965482 - RNA, 11 nt, Human
caccuccccca

SEQ ID NO: 1965483 - RNA, 17 nt, Human
caccucccccacuccca

SEQ ID NO: 1965484 - RNA, 21 nt, Human
caccucccccacucccaacca

SEQ ID NO: 1965485 - RNA, 17 nt, Human
caccgccuccuacagcc

SEQ ID NO: 1965486 - RNA, 13 nt, Human
caccgccucuucc

SEQ ID NO: 1965487 - RNA, 15 nt, Human
caccgccucuucccg

SEQ ID NO: 1965488 - RNA, 16 nt, Human
caccgccucuucccgc

SEQ ID NO: 1965489 - RNA, 17 nt, Human
caccgccucuucccgcc

SEQ ID NO: 1965490 - RNA, 21 nt, Human
caccgcagacaggaccaggga

SEQ ID NO: 1965491 - RNA, 18 nt, Human
caccggcuggccuggccc

SEQ ID NO: 1965492 - RNA, 17 nt, Human
caccggcuggccuggcc

SEQ ID NO: 1965493 - RNA, 20 nt, Human
caccggcuggccuggccccu

SEQ ID NO: 1965494 - RNA, 14 nt, Human
caccgggcacucag

SEQ ID NO: 1965495 - RNA, 16 nt, Human
caccggcuggccuggc

SEQ ID NO: 1965496 - RNA, 15 nt, Human
caccggcuggccugg

SEQ ID NO: 1965497 - RNA, 14 nt, Human
caccggcuggccug

SEQ ID NO: 1965498 - RNA, 13 nt, Human
caccguccccucc

SEQ ID NO: 1965499 - RNA, 15 nt, Human
caccgugccuggcca

SEQ ID NO: 1965500 - RNA, 16 nt, Human
caccguccccucccag

SEQ ID NO: 1965501 - RNA, 20 nt, Human
caccgugccuggccacgccc

SEQ ID NO: 1965502 - RNA, 15 nt, Human
caccgggcacucaga

SEQ ID NO: 1965503 - RNA, 22 nt, Human
caccgggcacucagaagacacu

SEQ ID NO: 1965504 - RNA, 15 nt, Human
caccgggccacagag

SEQ ID NO: 1965505 - RNA, 18 nt, Human
caccgggccacagagaaa

SEQ ID NO: 1965506 - RNA, 13 nt, Human
caccgggccugga

SEQ ID NO: 1965507 - RNA, 15 nt, Human
caccggggccucgga

SEQ ID NO: 1965508 - RNA, 20 nt, Human
caccuguaauuccagcacuu

SEQ ID NO: 1965509 - RNA, 18 nt, Human
caccugggcgucaucugg

SEQ ID NO: 1965510 - RNA, 16 nt, Human
caccugggggccuggc

SEQ ID NO: 1965511 - RNA, 11 nt, Human
caccugucugc

SEQ ID NO: 1965512 - RNA, 14 nt, Human
caccugucugcucc

SEQ ID NO: 1965513 - RNA, 15 nt, Human
caccugucugcucca

SEQ ID NO: 1965514 - RNA, 20 nt, Human
caccugucugcuccagcucu

SEQ ID NO: 1965515 - RNA, 21 nt, Human
caccugucugcuccagcucug

SEQ ID NO: 1965516 - RNA, 23 nt, Human
caccugucugcuccagcucuggc

SEQ ID NO: 1965517 - RNA, 15 nt, Human
caccuggccucugca

SEQ ID NO: 1965518 - RNA, 14 nt, Human
caccuggccucugc

SEQ ID NO: 1965519 - RNA, 13 nt, Human
caccuggccucug

SEQ ID NO: 1965520 - RNA, 12 nt, Human
caccuggccucu

SEQ ID NO: 1965521 - RNA, 19 nt, Human
caccuggcccucucugaag

SEQ ID NO: 1965522 - RNA, 16 nt, Human
caccuggcccucucug

SEQ ID NO: 1965523 - RNA, 17 nt, Human
caccuggcccucucuga

SEQ ID NO: 1965524 - RNA, 20 nt, Human
caccuggccucugcacuccc

SEQ ID NO: 1965525 - RNA, 19 nt, Human
caccuggccucugcacucc

SEQ ID NO: 1965526 - RNA, 18 nt, Human
caccuggccucugcacuc

SEQ ID NO: 1965527 - RNA, 17 nt, Human
caccuggccucugcacu

SEQ ID NO: 1965528 - RNA, 23 nt, Human
caccuggccucugcacuccccug

SEQ ID NO: 1965529 - RNA, 21 nt, Human
caccugggacagggagcagcc

SEQ ID NO: 1965530 - RNA, 19 nt, Human
caccucugcacaagcugca

SEQ ID NO: 1965531 - RNA, 18 nt, Human
caccucugcacaagcugc

SEQ ID NO: 1965532 - RNA, 19 nt, Human
caccucucucacuccuuga

SEQ ID NO: 1965533 - RNA, 18 nt, Human
caccucucucacuccuug

SEQ ID NO: 1965534 - RNA, 17 nt, Human
caccucucucacuccuu

SEQ ID NO: 1965535 - RNA, 15 nt, Human
caccucucucacucc

SEQ ID NO: 1965536 - RNA, 16 nt, Human
caccucuuccuggccg

SEQ ID NO: 1965537 - RNA, 17 nt, Human
caccucuuccuggccgg

SEQ ID NO: 1965538 - RNA, 15 nt, Human
caccucuuccuggcc

SEQ ID NO: 1965539 - RNA, 23 nt, Human
caccugaagacucauucuucugu

SEQ ID NO: 1965540 - RNA, 14 nt, Human
caccugaagacuca

SEQ ID NO: 1965541 - RNA, 15 nt, Human
caccugaagacucau

SEQ ID NO: 1965542 - RNA, 15 nt, Human
caccugcuggaguga

SEQ ID NO: 1965543 - RNA, 12 nt, Human
caccugcugcuu

SEQ ID NO: 1965544 - RNA, 20 nt, Human
caccuggaauauauaaccag

SEQ ID NO: 1965545 - RNA, 19 nt, Human
caccugcuucucugcccag

SEQ ID NO: 1965546 - RNA, 16 nt, Human
caccugcuucucugcc

SEQ ID NO: 1965547 - RNA, 18 nt, Human
caccugcuucucugccca

SEQ ID NO: 1965548 - RNA, 23 nt, Human
caccugcggugcuaucuccccca

SEQ ID NO: 1965549 - RNA, 13 nt, Human
caccugcucugcu

SEQ ID NO: 1965550 - RNA, 14 nt, Human
caccugcucugcug

SEQ ID NO: 1965551 - RNA, 12 nt, Human
caccugcucugc

SEQ ID NO: 1965552 - RNA, 15 nt, Human
caccugcauucuucc

SEQ ID NO: 1965553 - RNA, 15 nt, Human
caccugcagcucccu

SEQ ID NO: 1965554 - RNA, 16 nt, Human
caccugcagcucccuc

SEQ ID NO: 1965555 - RNA, 11 nt, Human
caccugacagc

SEQ ID NO: 1965556 - RNA, 18 nt, Human
caccugacagccccuccc

SEQ ID NO: 1965557 - RNA, 19 nt, Human
caccugacagccccucccu

SEQ ID NO: 1965558 - RNA, 15 nt, Human
caccugaguuccuga

SEQ ID NO: 1965559 - RNA, 23 nt, Human
caccugcagauucuaggaccugu

SEQ ID NO: 1965560 - RNA, 11 nt, Human
caccugcagcu

SEQ ID NO: 1965561 - RNA, 12 nt, Human
caccugcagcuc

SEQ ID NO: 1965562 - RNA, 14 nt, Human
caccugcagcuccc

SEQ ID NO: 1965563 - RNA, 20 nt, Human
cacauauugauuuccguuaa

SEQ ID NO: 1965564 - RNA, 23 nt, Human
cacccugugauggggcccugccu

SEQ ID NO: 1965565 - RNA, 22 nt, Human
cacccugugauggggcccugcc

SEQ ID NO: 1965566 - RNA, 21 nt, Human
cacccugugauggggcccugc

SEQ ID NO: 1965567 - RNA, 20 nt, Human
cacccugugauggggcccug

SEQ ID NO: 1965568 - RNA, 18 nt, Human
cacccugugauggggccc

SEQ ID NO: 1965569 - RNA, 15 nt, Human
cacccugugaugggg

SEQ ID NO: 1965570 - RNA, 12 nt, Human
cacccugugaug

SEQ ID NO: 1965571 - RNA, 11 nt, Human
cacccugugau

SEQ ID NO: 1965572 - RNA, 15 nt, Human
cacccugugcagaag

SEQ ID NO: 1965573 - RNA, 19 nt, Human
cacccuuccaucugauucc

SEQ ID NO: 1965574 - RNA, 15 nt, Human
cacccuuggagcucu

SEQ ID NO: 1965575 - RNA, 16 nt, Human
cacccuuggagcucug

SEQ ID NO: 1965576 - RNA, 20 nt, Human
cacccuuggagcucugaguu

SEQ ID NO: 1965577 - RNA, 18 nt, Human
caccgcagacaggaccag

SEQ ID NO: 1965578 - RNA, 17 nt, Human
caccgcagacaggacca

SEQ ID NO: 1965579 - RNA, 15 nt, Human
caccgcagacaggac

SEQ ID NO: 1965580 - RNA, 14 nt, Human
caccgcagacagga

SEQ ID NO: 1965581 - RNA, 13 nt, Human
caccgcagacagg

SEQ ID NO: 1965582 - RNA, 12 nt, Human
caccgcagacag

SEQ ID NO: 1965583 - RNA, 20 nt, Human
caccgacuagacacacaaag

SEQ ID NO: 1965584 - RNA, 18 nt, Human
caccgaaaacguggcugc

SEQ ID NO: 1965585 - RNA, 15 nt, Human
caccgaaaacguggc

SEQ ID NO: 1965586 - RNA, 13 nt, Human
cacccuuguucca

SEQ ID NO: 1965587 - RNA, 22 nt, Human
cacccuuucuacuuccaagacu

SEQ ID NO: 1965588 - RNA, 21 nt, Human
caccgaaaacguggcugcuuc

SEQ ID NO: 1965589 - RNA, 19 nt, Human
caccgaaaacguggcugcu

SEQ ID NO: 1965590 - RNA, 22 nt, Human
caccgaaaacguggcugcuuca

SEQ ID NO: 1965591 - RNA, 17 nt, Human
cacccgugguggcucaa

SEQ ID NO: 1965592 - RNA, 16 nt, Human
cacccguguuuguaaa

SEQ ID NO: 1965593 - RNA, 23 nt, Human
cacccgguccccacuuuauugcc

SEQ ID NO: 1965594 - RNA, 19 nt, Human
cacccggugaccucuagcc

SEQ ID NO: 1965595 - RNA, 22 nt, Human
cacccggugaccucuagcccug

SEQ ID NO: 1965596 - RNA, 19 nt, Human
cacccgcuaagagggaggg

SEQ ID NO: 1965597 - RNA, 12 nt, Human
cacccggccccu

SEQ ID NO: 1965598 - RNA, 13 nt, Human
cacccggccccug

SEQ ID NO: 1965599 - RNA, 14 nt, Human
cacccggccccugc

SEQ ID NO: 1965600 - RNA, 16 nt, Human
cacccggccccugcug

SEQ ID NO: 1965601 - RNA, 17 nt, Human
cacccggccccugcugg

SEQ ID NO: 1965602 - RNA, 18 nt, Human
cacccggccccugcuggu

SEQ ID NO: 1965603 - RNA, 21 nt, Human
cacccggccccugcugguuca

SEQ ID NO: 1965604 - RNA, 15 nt, Human
caccccuuccugggc

SEQ ID NO: 1965605 - RNA, 16 nt, Human
caccccuuccugggca

SEQ ID NO: 1965606 - RNA, 19 nt, Human
caccccuuccugggcacac

SEQ ID NO: 1965607 - RNA, 14 nt, Human
cacccgacuccagu

SEQ ID NO: 1965608 - RNA, 16 nt, Human
cacccgacuccagucc

SEQ ID NO: 1965609 - RNA, 20 nt, Human
caccccucaacaccucugca

SEQ ID NO: 1965610 - RNA, 13 nt, Human
cacauauugauuu

SEQ ID NO: 1965611 - RNA, 17 nt, Human
cacucagagcagucugu

SEQ ID NO: 1965612 - RNA, 21 nt, Human
cacucagagcagucugugacu

SEQ ID NO: 1965613 - RNA, 12 nt, Human
cacucagagcag

SEQ ID NO: 1965614 - RNA, 13 nt, Human
cacucagcaccac

SEQ ID NO: 1965615 - RNA, 14 nt, Human
cacucagcaccacu

SEQ ID NO: 1965616 - RNA, 15 nt, Human
cacucagcaccacuc

SEQ ID NO: 1965617 - RNA, 16 nt, Human
cacucagcaccacuca

SEQ ID NO: 1965618 - RNA, 18 nt, Human
cacucagcaccacucaag

SEQ ID NO: 1965619 - RNA, 22 nt, Human
cacucagaagacacugaugggc

SEQ ID NO: 1965620 - RNA, 24 nt, Human
cacucagaaaagacgcaccagccc

SEQ ID NO: 1965621 - RNA, 21 nt, Human
cacucagaaaagacgcaccag

SEQ ID NO: 1965622 - RNA, 18 nt, Human
cacucagaagacacugau

SEQ ID NO: 1965623 - RNA, 19 nt, Human
cacucagaagacacugaug

SEQ ID NO: 1965624 - RNA, 19 nt, Human
cacucacauuuauucugcu

SEQ ID NO: 1965625 - RNA, 20 nt, Human
cacucacauuuauucugcuc

SEQ ID NO: 1965626 - RNA, 12 nt, Human
cacucagaagac

SEQ ID NO: 1965627 - RNA, 16 nt, Human
cacucagaagacacug

SEQ ID NO: 1965628 - RNA, 17 nt, Human
cacucagaagacacuga

SEQ ID NO: 1965629 - RNA, 16 nt, Human
cacucaaaucuuaaga

SEQ ID NO: 1965630 - RNA, 17 nt, Human
cacucaaaucuuaagaa

SEQ ID NO: 1965631 - RNA, 18 nt, Human
cacucaaaucuuaagaaa

SEQ ID NO: 1965632 - RNA, 20 nt, Human
cacucaaaagcugggcaggu

SEQ ID NO: 1965633 - RNA, 14 nt, Human
cacucaagaccaaa

SEQ ID NO: 1965634 - RNA, 22 nt, Human
cacucaagaccaaauggaaaca

SEQ ID NO: 1965635 - RNA, 19 nt, Human
cacucaaaagcugggcagg

SEQ ID NO: 1965636 - RNA, 18 nt, Human
cacucaaaagcugggcag

SEQ ID NO: 1965637 - RNA, 17 nt, Human
cacucaaaagcugggca

SEQ ID NO: 1965638 - RNA, 15 nt, Human
cacucaaaagcuggg

SEQ ID NO: 1965639 - RNA, 20 nt, Human
cacuauguugcccaggcagg

SEQ ID NO: 1965640 - RNA, 21 nt, Human
cacuauguugcccaggcaggu

SEQ ID NO: 1965641 - RNA, 15 nt, Human
cacuauguugcccag

SEQ ID NO: 1965642 - RNA, 18 nt, Human
cacuaucccggcugcccu

SEQ ID NO: 1965643 - RNA, 19 nt, Human
cacuaucccggcugcccuu

SEQ ID NO: 1965644 - RNA, 16 nt, Human
cacuauguugcccagg

SEQ ID NO: 1965645 - RNA, 17 nt, Human
cacuauguugcccaggc

SEQ ID NO: 1965646 - RNA, 18 nt, Human
cacuauguugcccaggca

SEQ ID NO: 1965647 - RNA, 19 nt, Human
cacuauguugcccaggcag

SEQ ID NO: 1965648 - RNA, 14 nt, Human
cacuauaauguaag

SEQ ID NO: 1965649 - RNA, 18 nt, Human
cacuauaauguaagcucu

SEQ ID NO: 1965650 - RNA, 14 nt, Human
cacuauagccuagg

SEQ ID NO: 1965651 - RNA, 21 nt, Human
cacuauagccuaggugacaga

SEQ ID NO: 1965652 - RNA, 17 nt, Human
cacuaagaacaccugca

SEQ ID NO: 1965653 - RNA, 21 nt, Human
cacuaaauugacacuuaaaaa

SEQ ID NO: 1965654 - RNA, 16 nt, Human
cacuaacaugauuugg

SEQ ID NO: 1965655 - RNA, 11 nt, Human
cacuaaauguu

SEQ ID NO: 1965656 - RNA, 12 nt, Human
cacuaaauguua

SEQ ID NO: 1965657 - RNA, 13 nt, Human
cacuaaauguuaa

SEQ ID NO: 1965658 - RNA, 14 nt, Human
cacuaaauguuaaa

SEQ ID NO: 1965659 - RNA, 14 nt, Human
cacuaaccacgcug

SEQ ID NO: 1965660 - RNA, 16 nt, Human
cacuaaauguuaaaga

SEQ ID NO: 1965661 - RNA, 19 nt, Human
cacuaaauguuaaagaugu

SEQ ID NO: 1965662 - RNA, 20 nt, Human
cacuaaauguuaaagaugua

SEQ ID NO: 1965663 - RNA, 23 nt, Human
cacuaaauguuaaagauguagca

SEQ ID NO: 1965664 - RNA, 15 nt, Human
cacuaaccacgcugg

SEQ ID NO: 1965665 - RNA, 16 nt, Human
cacuaaccacgcugga

SEQ ID NO: 1965666 - RNA, 17 nt, Human
cacuaaggugugcucug

SEQ ID NO: 1965667 - RNA, 16 nt, Human
cacuaagucucuuuuu

SEQ ID NO: 1965668 - RNA, 20 nt, Human
cacuaagucucuuuuuuaca

SEQ ID NO: 1965669 - RNA, 21 nt, Human
cacuaagucucuuuuuuacaa

SEQ ID NO: 1965670 - RNA, 22 nt, Human
cacuaagucucuuuuuuacaaa

SEQ ID NO: 1965671 - RNA, 18 nt, Human
cacuaaggugugcucuga

SEQ ID NO: 1965672 - RNA, 18 nt, Human
cacuaaccacgcuggacc

SEQ ID NO: 1965673 - RNA, 13 nt, Human
cacuaagaacaaa

SEQ ID NO: 1965674 - RNA, 20 nt, Human
cacuaagaacaaaagaagca

SEQ ID NO: 1965675 - RNA, 16 nt, Human
cacucccugcaaccug

SEQ ID NO: 1965676 - RNA, 13 nt, Human
cacucccugcaac

SEQ ID NO: 1965677 - RNA, 12 nt, Human
cacucccugcaa

SEQ ID NO: 1965678 - RNA, 19 nt, Human
cacucccgagacggcacug

SEQ ID NO: 1965679 - RNA, 22 nt, Human
cacucccgagacggcacugaga

SEQ ID NO: 1965680 - RNA, 22 nt, Human
cacucauugaccugaggcccuu

SEQ ID NO: 1965681 - RNA, 20 nt, Human
cacucauugaccugaggccc

SEQ ID NO: 1965682 - RNA, 19 nt, Human
cacucauugaccugaggcc

SEQ ID NO: 1965683 - RNA, 18 nt, Human
cacucauugaccugaggc

SEQ ID NO: 1965684 - RNA, 16 nt, Human
cacucauccccucacu

SEQ ID NO: 1965685 - RNA, 15 nt, Human
cacucauugaccuga

SEQ ID NO: 1965686 - RNA, 22 nt, Human
cacucagcucuuggcuccacug

SEQ ID NO: 1965687 - RNA, 16 nt, Human
cacucaguccauagca

SEQ ID NO: 1965688 - RNA, 17 nt, Human
cacucccugcaaccuga

SEQ ID NO: 1965689 - RNA, 16 nt, Human
cacucccguuuucggu

SEQ ID NO: 1965690 - RNA, 13 nt, Human
cacuccuaccugg

SEQ ID NO: 1965691 - RNA, 14 nt, Human
cacuccuaccuggu

SEQ ID NO: 1965692 - RNA, 13 nt, Human
cacuccuccuagc

SEQ ID NO: 1965693 - RNA, 18 nt, Human
cacuccuccuagccaccc

SEQ ID NO: 1965694 - RNA, 12 nt, Human
cacuccugcucu

SEQ ID NO: 1965695 - RNA, 14 nt, Human
cacuccugcucugc

SEQ ID NO: 1965696 - RNA, 15 nt, Human
cacuccugcucugcu

SEQ ID NO: 1965697 - RNA, 16 nt, Human
cacuccugcucugcuc

SEQ ID NO: 1965698 - RNA, 11 nt, Human
cacuccugcuc

SEQ ID NO: 1965699 - RNA, 21 nt, Human
cacuccuucacagaugggugc

SEQ ID NO: 1965700 - RNA, 14 nt, Human
cacuccuucacaga

SEQ ID NO: 1965701 - RNA, 23 nt, Human
cacucugagacucgcgacaaugc

SEQ ID NO: 1965702 - RNA, 12 nt, Human
cacucugagacu

SEQ ID NO: 1965703 - RNA, 12 nt, Human
cacucuccuugg

SEQ ID NO: 1965704 - RNA, 14 nt, Human
cacucucucuuguu

SEQ ID NO: 1965705 - RNA, 14 nt, Human
cacucuggcagcuc

SEQ ID NO: 1965706 - RNA, 13 nt, Human
cacucuggcagcu

SEQ ID NO: 1965707 - RNA, 12 nt, Human
cacucuggcagc

SEQ ID NO: 1965708 - RNA, 13 nt, Human
cacucuggcagca

SEQ ID NO: 1965709 - RNA, 14 nt, Human
cacucuggcagcac

SEQ ID NO: 1965710 - RNA, 16 nt, Human
cacucuggcagcaccg

SEQ ID NO: 1965711 - RNA, 22 nt, Human
cacucuggcagcaccgccucuu

SEQ ID NO: 1965712 - RNA, 18 nt, Human
cacucuggauucagccuu

SEQ ID NO: 1965713 - RNA, 19 nt, Human
cacucuggauucagccuuc

SEQ ID NO: 1965714 - RNA, 22 nt, Human
cacucuggauucagccuucuuu

SEQ ID NO: 1965715 - RNA, 13 nt, Human
cacucuaagaugu

SEQ ID NO: 1965716 - RNA, 16 nt, Human
cacucuaagauguuau

SEQ ID NO: 1965717 - RNA, 18 nt, Human
cacucuaagauguuauau

SEQ ID NO: 1965718 - RNA, 19 nt, Human
cacucuaagauguuauauu

SEQ ID NO: 1965719 - RNA, 21 nt, Human
cacucuaagauguuauauuuu

SEQ ID NO: 1965720 - RNA, 13 nt, Human
cacucucagaggc

SEQ ID NO: 1965721 - RNA, 14 nt, Human
cacucucagaggcc

SEQ ID NO: 1965722 - RNA, 15 nt, Human
cacucucagaggccc

SEQ ID NO: 1965723 - RNA, 16 nt, Human
cacucucagaggcccc

SEQ ID NO: 1965724 - RNA, 17 nt, Human
cacucucagaggcccca

SEQ ID NO: 1965725 - RNA, 22 nt, Human
cacucucaggaaaugcugaccc

SEQ ID NO: 1965726 - RNA, 14 nt, Human
cacucuacuuagca

SEQ ID NO: 1965727 - RNA, 18 nt, Human
cacguacacacacauaca

SEQ ID NO: 1965728 - RNA, 19 nt, Human
cacguacacacacauacac

SEQ ID NO: 1965729 - RNA, 16 nt, Human
cacguaaugaaacuug

SEQ ID NO: 1965730 - RNA, 19 nt, Human
cacguaaugaaacuuggau

SEQ ID NO: 1965731 - RNA, 14 nt, Human
cacguacacacaca

SEQ ID NO: 1965732 - RNA, 16 nt, Human
cacguccucgcucccg

SEQ ID NO: 1965733 - RNA, 13 nt, Human
cacgugacagccg

SEQ ID NO: 1965734 - RNA, 19 nt, Human
cacgucuauuucaucagaa

SEQ ID NO: 1965735 - RNA, 23 nt, Human
cacgucuauuucaucagaacagc

SEQ ID NO: 1965736 - RNA, 12 nt, Human
cacguuucuaaa

SEQ ID NO: 1965737 - RNA, 14 nt, Human
cacguuucuaaagg

SEQ ID NO: 1965738 - RNA, 23 nt, Human
cacguuucuaaaggcuaccuuug

SEQ ID NO: 1965739 - RNA, 13 nt, Human
cacguuuuaagga

SEQ ID NO: 1965740 - RNA, 14 nt, Human
cacguuuuaaggac

SEQ ID NO: 1965741 - RNA, 15 nt, Human
cacguuuuaaggacu

SEQ ID NO: 1965742 - RNA, 16 nt, Human
cacguuuuaaggacug

SEQ ID NO: 1965743 - RNA, 14 nt, Human
cacguuuugaaaua

SEQ ID NO: 1965744 - RNA, 22 nt, Human
cacguuuuaaggacugacugag

SEQ ID NO: 1965745 - RNA, 18 nt, Human
cacguuuucaucucuagg

SEQ ID NO: 1965746 - RNA, 12 nt, Human
cacuaaacucug

SEQ ID NO: 1965747 - RNA, 16 nt, Human
cacuaaacucugaaua

SEQ ID NO: 1965748 - RNA, 22 nt, Human
cacuaaacucugaauaagcacu

SEQ ID NO: 1965749 - RNA, 13 nt, Human
cacuaaacaaaga

SEQ ID NO: 1965750 - RNA, 22 nt, Human
cacguucuuacuaguuucccuu

SEQ ID NO: 1965751 - RNA, 19 nt, Human
cacgugguccuaaucuucu

SEQ ID NO: 1965752 - RNA, 16 nt, Human
cacgugguccuaaucu

SEQ ID NO: 1965753 - RNA, 19 nt, Human
cacguguggccuguucuuc

SEQ ID NO: 1965754 - RNA, 16 nt, Human
cacgugggcuccccuc

SEQ ID NO: 1965755 - RNA, 17 nt, Human
cacgugggcuccccucu

SEQ ID NO: 1965756 - RNA, 18 nt, Human
cacgugggcuccccucuu

SEQ ID NO: 1965757 - RNA, 19 nt, Human
cacgugggcuccccucuuc

SEQ ID NO: 1965758 - RNA, 21 nt, Human
cacgugggcuccccucuuccu

SEQ ID NO: 1965759 - RNA, 15 nt, Human
cacgccuagccucac

SEQ ID NO: 1965760 - RNA, 16 nt, Human
cacgccuagccucacg

SEQ ID NO: 1965761 - RNA, 17 nt, Human
cacgccuagccucacgc

SEQ ID NO: 1965762 - RNA, 20 nt, Human
cacgccuguaauccuagcac

SEQ ID NO: 1965763 - RNA, 19 nt, Human
cacgccuguaauccuagca

SEQ ID NO: 1965764 - RNA, 18 nt, Human
cacgccuagccucacgcu

SEQ ID NO: 1965765 - RNA, 23 nt, Human
cacgcgugcacacaccagagccc

SEQ ID NO: 1965766 - RNA, 15 nt, Human
cacgcgugcacacac

SEQ ID NO: 1965767 - RNA, 16 nt, Human
cacgcgugcacacacc

SEQ ID NO: 1965768 - RNA, 21 nt, Human
cacgcgugcacacaccagagc

SEQ ID NO: 1965769 - RNA, 20 nt, Human
cacgcuggaccuugaacugg

SEQ ID NO: 1965770 - RNA, 19 nt, Human
cacgcugacuacagggccg

SEQ ID NO: 1965771 - RNA, 22 nt, Human
cacgcugccuucgguacccacc

SEQ ID NO: 1965772 - RNA, 16 nt, Human
cacgcugcucugcccc

SEQ ID NO: 1965773 - RNA, 17 nt, Human
cacgcuggaccuugaac

SEQ ID NO: 1965774 - RNA, 14 nt, Human
cacgcuccuuccuc

SEQ ID NO: 1965775 - RNA, 22 nt, Human
cacgcuccuuucugaucuucac

SEQ ID NO: 1965776 - RNA, 12 nt, Human
cacgcuccuuuc

SEQ ID NO: 1965777 - RNA, 15 nt, Human
cacgcuccuuucuga

SEQ ID NO: 1965778 - RNA, 16 nt, Human
cacggcucacugcagc

SEQ ID NO: 1965779 - RNA, 17 nt, Human
cacggcucacugcagcc

SEQ ID NO: 1965780 - RNA, 19 nt, Human
cacggcucacugcagccuc

SEQ ID NO: 1965781 - RNA, 20 nt, Human
cacggcucacugcagccuca

SEQ ID NO: 1965782 - RNA, 17 nt, Human
cacgcugcucugcccca

SEQ ID NO: 1965783 - RNA, 21 nt, Human
cacgcugcucugccccagcuu

SEQ ID NO: 1965784 - RNA, 15 nt, Human
cacgggggccaagga

SEQ ID NO: 1965785 - RNA, 21 nt, Human
cacggguaaaucuaguaccau

SEQ ID NO: 1965786 - RNA, 19 nt, Human
caccuuagacagucccugc

SEQ ID NO: 1965787 - RNA, 18 nt, Human
caccuuagacagucccug

SEQ ID NO: 1965788 - RNA, 16 nt, Human
caccuuagacaguccc

SEQ ID NO: 1965789 - RNA, 14 nt, Human
caccuuagacaguc

SEQ ID NO: 1965790 - RNA, 23 nt, Human
caccuuagacagucccugccaau

SEQ ID NO: 1965791 - RNA, 21 nt, Human
caccuuagacagucccugcca

SEQ ID NO: 1965792 - RNA, 22 nt, Human
caccuuagccugcccuccuuuc

SEQ ID NO: 1965793 - RNA, 19 nt, Human
caccuucaguuuuuguguu

SEQ ID NO: 1965794 - RNA, 22 nt, Human
cacgaauauugcugauggugca

SEQ ID NO: 1965795 - RNA, 19 nt, Human
cacgaauauugcugauggu

SEQ ID NO: 1965796 - RNA, 16 nt, Human
cacgaauauugcugau

SEQ ID NO: 1965797 - RNA, 16 nt, Human
cacgacugcccggcag

SEQ ID NO: 1965798 - RNA, 17 nt, Human
cacgacugcccggcagg

SEQ ID NO: 1965799 - RNA, 13 nt, Human
caccuugacaggg

SEQ ID NO: 1965800 - RNA, 13 nt, Human
caccuucccaugc

SEQ ID NO: 1965801 - RNA, 14 nt, Human
caccuucccaugcc

SEQ ID NO: 1965802 - RNA, 19 nt, Human
caccuucccccucccccag

SEQ ID NO: 1965803 - RNA, 15 nt, Human
caccuugacagggca

SEQ ID NO: 1965804 - RNA, 16 nt, Human
caccuugacagggcac

SEQ ID NO: 1965805 - RNA, 18 nt, Human
caccuugacagggcacac

SEQ ID NO: 1965806 - RNA, 21 nt, Human
caccuucuauagcaucacuua

SEQ ID NO: 1965807 - RNA, 12 nt, Human
cacgauuucugu

SEQ ID NO: 1965808 - RNA, 14 nt, Human
cacgauuucuguuu

SEQ ID NO: 1965809 - RNA, 16 nt, Human
cacgauuucuguuuag

SEQ ID NO: 1965810 - RNA, 17 nt, Human
cacgcacuucgggaggu

SEQ ID NO: 1965811 - RNA, 18 nt, Human
cacgagucagucgccuuu

SEQ ID NO: 1965812 - RNA, 17 nt, Human
cacgacuucuguuucac

SEQ ID NO: 1965813 - RNA, 15 nt, Human
cacgagagcgcagca

SEQ ID NO: 1965814 - RNA, 18 nt, Human
cacgagagcgcagcaucc

SEQ ID NO: 1965815 - RNA, 23 nt, Human
cacgagcagacacccuuggagcu

SEQ ID NO: 1965816 - RNA, 18 nt, Human
cacgcccccacuggugac

SEQ ID NO: 1965817 - RNA, 17 nt, Human
cacgcccccacugguga

SEQ ID NO: 1965818 - RNA, 15 nt, Human
cacgcccccacuggu

SEQ ID NO: 1965819 - RNA, 13 nt, Human
cacgcccccacug

SEQ ID NO: 1965820 - RNA, 23 nt, Human
cacgccagauucuuuccugaggc

SEQ ID NO: 1965821 - RNA, 22 nt, Human
cacgccagauucuuuccugagg

SEQ ID NO: 1965822 - RNA, 20 nt, Human
cacgccagauucuuuccuga

SEQ ID NO: 1965823 - RNA, 19 nt, Human
cacgccagauucuuuccug

SEQ ID NO: 1965824 - RNA, 15 nt, Human
cacgccacugcacua

SEQ ID NO: 1965825 - RNA, 13 nt, Human
cacgccacugcac

SEQ ID NO: 1965826 - RNA, 12 nt, Human
cacuucuucugu

SEQ ID NO: 1965827 - RNA, 14 nt, Human
cacuucuucugucc

SEQ ID NO: 1965828 - RNA, 15 nt, Human
cacuucuucugucca

SEQ ID NO: 1965829 - RNA, 16 nt, Human
cacuucuucuguccaa

SEQ ID NO: 1965830 - RNA, 20 nt, Human
cacuucuucuguccaagcag

SEQ ID NO: 1965831 - RNA, 13 nt, Human
cacuucuuucccu

SEQ ID NO: 1965832 - RNA, 15 nt, Human
cacuucuuucccuuc

SEQ ID NO: 1965833 - RNA, 17 nt, Human
cacuucuuucccuuccu

SEQ ID NO: 1965834 - RNA, 19 nt, Human
cacuucuuucccuuccucc

SEQ ID NO: 1965835 - RNA, 21 nt, Human
cacuucuuucccuuccuccau

SEQ ID NO: 1965836 - RNA, 20 nt, Human
cacuugaacccgggaggcag

SEQ ID NO: 1965837 - RNA, 21 nt, Human
cacuugaacccgggaggcaga

SEQ ID NO: 1965838 - RNA, 23 nt, Human
cacuugaacccgggaggcagagg

SEQ ID NO: 1965839 - RNA, 16 nt, Human
cacuugacaucaacug

SEQ ID NO: 1965840 - RNA, 20 nt, Human
cacuugagaauuacccuuuu

SEQ ID NO: 1965841 - RNA, 21 nt, Human
cacuugaaccauaguuacugu

SEQ ID NO: 1965842 - RNA, 17 nt, Human
cacuugagaauuacccu

SEQ ID NO: 1965843 - RNA, 19 nt, Human
cacuugacaucaacugcau

SEQ ID NO: 1965844 - RNA, 13 nt, Human
cacuugaguccag

SEQ ID NO: 1965845 - RNA, 19 nt, Human
cacuugaugacccccaacc

SEQ ID NO: 1965846 - RNA, 23 nt, Human
cacuugaguggagguuuauaguu

SEQ ID NO: 1965847 - RNA, 13 nt, Human
cacuugcagacuc

SEQ ID NO: 1965848 - RNA, 15 nt, Human
cacuuggucugugag

SEQ ID NO: 1965849 - RNA, 18 nt, Human
cacuuucuagccagagga

SEQ ID NO: 1965850 - RNA, 20 nt, Human
cacuuucuagccagaggaga

SEQ ID NO: 1965851 - RNA, 19 nt, Human
cacuuucuagccagaggag

SEQ ID NO: 1965852 - RNA, 17 nt, Human
cacuugggggcucagca

SEQ ID NO: 1965853 - RNA, 18 nt, Human
cacuugggggcucagcaa

SEQ ID NO: 1965854 - RNA, 19 nt, Human
cacuugggggcucagcaag

SEQ ID NO: 1965855 - RNA, 19 nt, Human
cacuuggguccaggccuac

SEQ ID NO: 1965856 - RNA, 20 nt, Human
cacuugggggcucagcaagg

SEQ ID NO: 1965857 - RNA, 21 nt, Human
cacuugggggcucagcaaggc

SEQ ID NO: 1965858 - RNA, 22 nt, Human
cacuuggaguuugcauucuuau

SEQ ID NO: 1965859 - RNA, 22 nt, Human
cacuugccgcgucgcccuccca

SEQ ID NO: 1965860 - RNA, 24 nt, Human
cacuugcagacucuacagaggcca

SEQ ID NO: 1965861 - RNA, 14 nt, Human
cacuugcagacucu

SEQ ID NO: 1965862 - RNA, 18 nt, Human
cacuugcagacucuacag

SEQ ID NO: 1965863 - RNA, 19 nt, Human
cacuugcagacucuacaga

SEQ ID NO: 1965864 - RNA, 22 nt, Human
cacuugcagacucuacagaggc

SEQ ID NO: 1965865 - RNA, 16 nt, Human
cacuucccuacaugga

SEQ ID NO: 1965866 - RNA, 20 nt, Human
cacuuccaggggaaccugcc

SEQ ID NO: 1965867 - RNA, 20 nt, Human
cacuuccauaaucuggacuc

SEQ ID NO: 1965868 - RNA, 12 nt, Human
cacuuccagggg

SEQ ID NO: 1965869 - RNA, 14 nt, Human
cacuuccaggggaa

SEQ ID NO: 1965870 - RNA, 17 nt, Human
cacuuccaggggaaccu

SEQ ID NO: 1965871 - RNA, 17 nt, Human
cacuuccgucacauccc

SEQ ID NO: 1965872 - RNA, 17 nt, Human
cacuucugacucuuccc

SEQ ID NO: 1965873 - RNA, 22 nt, Human
cacuucugccauauucuguugg

SEQ ID NO: 1965874 - RNA, 13 nt, Human
cacuucugccaga

SEQ ID NO: 1965875 - RNA, 17 nt, Human
cacuucugccagauguc

SEQ ID NO: 1965876 - RNA, 23 nt, Human
cacuucgggaggucgaggcagga

SEQ ID NO: 1965877 - RNA, 21 nt, Human
cacuucgggaggucgaggcag

SEQ ID NO: 1965878 - RNA, 12 nt, Human
cacuuccuugcc

SEQ ID NO: 1965879 - RNA, 20 nt, Human
cacuucuaaguugaguauau

SEQ ID NO: 1965880 - RNA, 21 nt, Human
cacuucuaaguugaguauauu

SEQ ID NO: 1965881 - RNA, 23 nt, Human
cacuucuaaguugaguauauuau

SEQ ID NO: 1965882 - RNA, 21 nt, Human
cacuucagcugacuuuucugu

SEQ ID NO: 1965883 - RNA, 12 nt, Human
cacuucagcuga

SEQ ID NO: 1965884 - RNA, 14 nt, Human
cacuucaggcucuu

SEQ ID NO: 1965885 - RNA, 15 nt, Human
cacuucaggcucuuc

SEQ ID NO: 1965886 - RNA, 16 nt, Human
cacuucaggcucuucu

SEQ ID NO: 1965887 - RNA, 20 nt, Human
cacuucaggcucuucuccuu

SEQ ID NO: 1965888 - RNA, 13 nt, Human
cacuucauugaaa

SEQ ID NO: 1965889 - RNA, 23 nt, Human
cacuucaggcucuucuccuuuca

SEQ ID NO: 1965890 - RNA, 17 nt, Human
cacuucagggcagauuu

SEQ ID NO: 1965891 - RNA, 18 nt, Human
cacuucagggcagauuuu

SEQ ID NO: 1965892 - RNA, 19 nt, Human
cacuucagggcagauuuua

SEQ ID NO: 1965893 - RNA, 23 nt, Human
cacuucagggcagauuuuaguuu

SEQ ID NO: 1965894 - RNA, 21 nt, Human
cacuucagggcagauuuuagu

SEQ ID NO: 1965895 - RNA, 22 nt, Human
cacuucagggcagauuuuaguu

SEQ ID NO: 1965896 - RNA, 13 nt, Human
cacuucaaaacaa

SEQ ID NO: 1965897 - RNA, 22 nt, Human
cacugugcugagucugaaggcu

SEQ ID NO: 1965898 - RNA, 21 nt, Human
cacugugcugagucugaaggc

SEQ ID NO: 1965899 - RNA, 20 nt, Human
cacugugcugagucugaagg

SEQ ID NO: 1965900 - RNA, 17 nt, Human
cacugugcugagucuga

SEQ ID NO: 1965901 - RNA, 21 nt, Human
cacuguggaacugcuauuuuc

SEQ ID NO: 1965902 - RNA, 15 nt, Human
cacugugcugagucu

SEQ ID NO: 1965903 - RNA, 13 nt, Human
cacugugcugagu

SEQ ID NO: 1965904 - RNA, 22 nt, Human
cacugugcguggggcucccgcc

SEQ ID NO: 1965905 - RNA, 15 nt, Human
cacugugccaugugc

SEQ ID NO: 1965906 - RNA, 16 nt, Human
cacugugccaugugcc

SEQ ID NO: 1965907 - RNA, 18 nt, Human
cacugugccaugugccag

SEQ ID NO: 1965908 - RNA, 22 nt, Human
cacuguucucugcccuccaaga

SEQ ID NO: 1965909 - RNA, 21 nt, Human
cacuguucucugcccuccaag

SEQ ID NO: 1965910 - RNA, 19 nt, Human
cacuguucucugcccucca

SEQ ID NO: 1965911 - RNA, 17 nt, Human
cacuguucucugcccuc

SEQ ID NO: 1965912 - RNA, 16 nt, Human
cacuguucucugcccu

SEQ ID NO: 1965913 - RNA, 15 nt, Human
cacuguucucugccc

SEQ ID NO: 1965914 - RNA, 14 nt, Human
cacuguucucugcc

SEQ ID NO: 1965915 - RNA, 13 nt, Human
cacuguucucugc

SEQ ID NO: 1965916 - RNA, 18 nt, Human
cacuguguauauuugauu

SEQ ID NO: 1965917 - RNA, 20 nt, Human
cacuguguauauuugauuua

SEQ ID NO: 1965918 - RNA, 21 nt, Human
cacuguguauauuugauuuau

SEQ ID NO: 1965919 - RNA, 14 nt, Human
cacuguguauuguu

SEQ ID NO: 1965920 - RNA, 21 nt, Human
cacuguuaucauuuuuuccug

SEQ ID NO: 1965921 - RNA, 14 nt, Human
cacuguggugucug

SEQ ID NO: 1965922 - RNA, 15 nt, Human
cacuguggugucugu

SEQ ID NO: 1965923 - RNA, 13 nt, Human
cacuguguauauu

SEQ ID NO: 1965924 - RNA, 14 nt, Human
cacuguguauauuu

SEQ ID NO: 1965925 - RNA, 15 nt, Human
cacuguguauauuug

SEQ ID NO: 1965926 - RNA, 16 nt, Human
cacuguguauauuuga

SEQ ID NO: 1965927 - RNA, 17 nt, Human
cacuguguauauuugau

SEQ ID NO: 1965928 - RNA, 18 nt, Human
cacuguccuccaagccag

SEQ ID NO: 1965929 - RNA, 17 nt, Human
cacuguccuccaagcca

SEQ ID NO: 1965930 - RNA, 14 nt, Human
cacuguccuccaag

SEQ ID NO: 1965931 - RNA, 16 nt, Human
cacuguccuauuauau

SEQ ID NO: 1965932 - RNA, 10 nt, Human
cacugucugu

SEQ ID NO: 1965933 - RNA, 13 nt, Human
cacugucugucug

SEQ ID NO: 1965934 - RNA, 18 nt, Human
cacugucugucuggucca

SEQ ID NO: 1965935 - RNA, 13 nt, Human
cacugugaagagc

SEQ ID NO: 1965936 - RNA, 13 nt, Human
cacugugaagaga

SEQ ID NO: 1965937 - RNA, 14 nt, Human
cacugugccaugug

SEQ ID NO: 1965938 - RNA, 17 nt, Human
cacuggccccugagauc

SEQ ID NO: 1965939 - RNA, 18 nt, Human
cacuguacuugcucuuga

SEQ ID NO: 1965940 - RNA, 15 nt, Human
cacuguacuugcucu

SEQ ID NO: 1965941 - RNA, 19 nt, Human
cacuguacuugcucuugau

SEQ ID NO: 1965942 - RNA, 20 nt, Human
cacuguacccagucucaaag

SEQ ID NO: 1965943 - RNA, 23 nt, Human
cacugcaaccuucgccaccuggg

SEQ ID NO: 1965944 - RNA, 14 nt, Human
cacugcaaccuucg

SEQ ID NO: 1965945 - RNA, 22 nt, Human
cacugcaaccuucgccaccugg

SEQ ID NO: 1965946 - RNA, 18 nt, Human
cacugcacagugcaucuc

SEQ ID NO: 1965947 - RNA, 19 nt, Human
cacugcacagugcaucuca

SEQ ID NO: 1965948 - RNA, 21 nt, Human
cacugcacagugcaucucagc

SEQ ID NO: 1965949 - RNA, 22 nt, Human
cacugcacagugcaucucagcc

SEQ ID NO: 1965950 - RNA, 23 nt, Human
cacugcaaccuccgccucuuggg

SEQ ID NO: 1965951 - RNA, 14 nt, Human
cacugcaaccuccg

SEQ ID NO: 1965952 - RNA, 16 nt, Human
cacugcaaccuccgcc

SEQ ID NO: 1965953 - RNA, 22 nt, Human
cacugauuauaguacugacaga

SEQ ID NO: 1965954 - RNA, 22 nt, Human
cacugcaaaaccagguuuuguu

SEQ ID NO: 1965955 - RNA, 13 nt, Human
cacugcaaccucc

SEQ ID NO: 1965956 - RNA, 14 nt, Human
cacugauccagccc

SEQ ID NO: 1965957 - RNA, 15 nt, Human
cacugauccagcccu

SEQ ID NO: 1965958 - RNA, 16 nt, Human
cacugauccagcccug

SEQ ID NO: 1965959 - RNA, 16 nt, Human
cacugauauauuuaaa

SEQ ID NO: 1965960 - RNA, 14 nt, Human
cacugaugggcaac

SEQ ID NO: 1965961 - RNA, 18 nt, Human
cacugaugggcaaccccc

SEQ ID NO: 1965962 - RNA, 24 nt, Human
cacugaugggcaacccccagccug

SEQ ID NO: 1965963 - RNA, 23 nt, Human
cacugagaccccaggcuguuagg

SEQ ID NO: 1965964 - RNA, 18 nt, Human
cacugagagagcgcagcc

SEQ ID NO: 1965965 - RNA, 17 nt, Human
cacugagagccuuuuug

SEQ ID NO: 1965966 - RNA, 21 nt, Human
cacugagagccuuuuugaaag

SEQ ID NO: 1965967 - RNA, 23 nt, Human
cacugagacagcccgggcucugc

SEQ ID NO: 1965968 - RNA, 19 nt, Human
cacucuggcagcucagaga

SEQ ID NO: 1965969 - RNA, 17 nt, Human
cacucuggcagcucaga

SEQ ID NO: 1965970 - RNA, 16 nt, Human
cacucuggcagcucag

SEQ ID NO: 1965971 - RNA, 15 nt, Human
cacucuggcagcuca

SEQ ID NO: 1965972 - RNA, 21 nt, Human
cacucuggcagcucagagagg

SEQ ID NO: 1965973 - RNA, 20 nt, Human
cacucuggcagcucagagag

SEQ ID NO: 1965974 - RNA, 15 nt, Human
cacucugggcuccag

SEQ ID NO: 1965975 - RNA, 14 nt, Human
cacucugggcucca

SEQ ID NO: 1965976 - RNA, 23 nt, Human
cacucuggcagcucagagagggu

SEQ ID NO: 1965977 - RNA, 17 nt, Human
cacucugggcuccagag

SEQ ID NO: 1965978 - RNA, 16 nt, Human
cacucugggcuccaga

SEQ ID NO: 1965979 - RNA, 15 nt, Human
cacucugucgcccag

SEQ ID NO: 1965980 - RNA, 16 nt, Human
cacucugucgcccagu

SEQ ID NO: 1965981 - RNA, 19 nt, Human
cacucugucgcccagucug

SEQ ID NO: 1965982 - RNA, 23 nt, Human
cacugacauuguuggccaaagcc

SEQ ID NO: 1965983 - RNA, 18 nt, Human
cacucugucgagccuggg

SEQ ID NO: 1965984 - RNA, 12 nt, Human
cacugacucugg

SEQ ID NO: 1965985 - RNA, 13 nt, Human
cacugacucugga

SEQ ID NO: 1965986 - RNA, 14 nt, Human
cacugacucuggaa

SEQ ID NO: 1965987 - RNA, 22 nt, Human
cacugagacagcccgggcucug

SEQ ID NO: 1965988 - RNA, 19 nt, Human
cacugagacagcccgggcu

SEQ ID NO: 1965989 - RNA, 17 nt, Human
cacugagacagcccggg

SEQ ID NO: 1965990 - RNA, 14 nt, Human
cacugagacagccc

SEQ ID NO: 1965991 - RNA, 13 nt, Human
cacugagacagcc

SEQ ID NO: 1965992 - RNA, 12 nt, Human
cacugagacagc

SEQ ID NO: 1965993 - RNA, 20 nt, Human
cacugacugaacuguaaugu

SEQ ID NO: 1965994 - RNA, 13 nt, Human
cacugcccacugg

SEQ ID NO: 1965995 - RNA, 17 nt, Human
cacugcacguuuucauc

SEQ ID NO: 1965996 - RNA, 18 nt, Human
cacugcacguuuucaucu

SEQ ID NO: 1965997 - RNA, 16 nt, Human
cacugccucuuccucc

SEQ ID NO: 1965998 - RNA, 23 nt, Human
cacugccuccccaaggcccccug

SEQ ID NO: 1965999 - RNA, 14 nt, Human
cacugcaccgggcc

SEQ ID NO: 1966000 - RNA, 15 nt, Human
cacugcaccgggcca

SEQ ID NO: 1966001 - RNA, 23 nt, Human
cacugcacagugcaucucagccc

SEQ ID NO: 1966002 - RNA, 16 nt, Human
cacugcaccgggccac

SEQ ID NO: 1966003 - RNA, 18 nt, Human
cacugcaccgggccacag

SEQ ID NO: 1966004 - RNA, 19 nt, Human
cacugcaccgggccacaga

SEQ ID NO: 1966005 - RNA, 18 nt, Human
cacugcacuauagccuag

SEQ ID NO: 1966006 - RNA, 18 nt, Human
cacugcuaagaauauuug

SEQ ID NO: 1966007 - RNA, 20 nt, Human
cacugccuucgauacaccgg

SEQ ID NO: 1966008 - RNA, 22 nt, Human
cacugccuucgauacaccgggc

SEQ ID NO: 1966009 - RNA, 16 nt, Human
cacugccugccuuaag

SEQ ID NO: 1966010 - RNA, 20 nt, Human
cacugccugccuuaagugag

SEQ ID NO: 1966011 - RNA, 14 nt, Human
cacugccugccuua

SEQ ID NO: 1966012 - RNA, 15 nt, Human
cacugccugccuuaa

SEQ ID NO: 1966013 - RNA, 12 nt, Human
cacugcucuggu

SEQ ID NO: 1966014 - RNA, 20 nt, Human
cacugcucugaugaagagga

SEQ ID NO: 1966015 - RNA, 15 nt, Human
cacugcucucaccuu

SEQ ID NO: 1966016 - RNA, 23 nt, Human
cacugcucucaccuugguuccug

SEQ ID NO: 1966017 - RNA, 15 nt, Human
cacugcugcccagcc

SEQ ID NO: 1966018 - RNA, 17 nt, Human
cacugcugcccagccuc

SEQ ID NO: 1966019 - RNA, 13 nt, Human
cacugcucucacc

SEQ ID NO: 1966020 - RNA, 14 nt, Human
cacugcucucaccu

SEQ ID NO: 1966021 - RNA, 16 nt, Human
cacugcuuccagugag

SEQ ID NO: 1966022 - RNA, 15 nt, Human
cacugcuuccaguga

SEQ ID NO: 1966023 - RNA, 14 nt, Human
cacugcuuccagug

SEQ ID NO: 1966024 - RNA, 13 nt, Human
cacugcuuaacuu

SEQ ID NO: 1966025 - RNA, 12 nt, Human
cacugcuggcug

SEQ ID NO: 1966026 - RNA, 13 nt, Human
cacugcuggcugc

SEQ ID NO: 1966027 - RNA, 14 nt, Human
cacugcuggcugcc

SEQ ID NO: 1966028 - RNA, 15 nt, Human
cacugcuggcugccu

SEQ ID NO: 1966029 - RNA, 16 nt, Human
cacugcuggcugccuu

SEQ ID NO: 1966030 - RNA, 21 nt, Human
cacugcuggcugccuuagaac

SEQ ID NO: 1966031 - RNA, 21 nt, Human
cacugcuuccagugaggcucu

SEQ ID NO: 1966032 - RNA, 20 nt, Human
cacugcuuccagugaggcuc

SEQ ID NO: 1966033 - RNA, 19 nt, Human
cacugcuuccagugaggcu

SEQ ID NO: 1966034 - RNA, 18 nt, Human
cacugcuuccagugaggc

SEQ ID NO: 1966035 - RNA, 22 nt, Human
cacugcuuccagugaggcucug

SEQ ID NO: 1966036 - RNA, 20 nt, Human
cacugcuuuuggucugugug

SEQ ID NO: 1966037 - RNA, 17 nt, Human
cacuggaacacuaauga

SEQ ID NO: 1966038 - RNA, 21 nt, Human
cacugcuuuuggucuguguga

SEQ ID NO: 1966039 - RNA, 18 nt, Human
cacuggacucaccucccc

SEQ ID NO: 1966040 - RNA, 15 nt, Human
cacuggacucaccuc

SEQ ID NO: 1966041 - RNA, 18 nt, Human
cacuggcaaugguaguuu

SEQ ID NO: 1966042 - RNA, 17 nt, Human
cacuggccacaguuguu

SEQ ID NO: 1966043 - RNA, 15 nt, Human
aaaaaauauuuuccu

SEQ ID NO: 1966044 - RNA, 12 nt, Human
aaaaaauaucua

SEQ ID NO: 1966045 - RNA, 20 nt, Human
aaaaaaugcugaacauugca

SEQ ID NO: 1966046 - RNA, 22 nt, Human
aaaaaaugcugaacauugcaua

SEQ ID NO: 1966047 - RNA, 22 nt, Human
aaaaaccguguuugucucuucu

SEQ ID NO: 1966048 - RNA, 18 nt, Human
aaaaacagauuuggaaag

SEQ ID NO: 1966049 - RNA, 18 nt, Human
aaaaacucaaccaaaugg

SEQ ID NO: 1966050 - RNA, 22 nt, Human
aaaaacucaaccaaaugguaca

SEQ ID NO: 1966051 - RNA, 21 nt, Human
aaaaaauucagugaugugccu

SEQ ID NO: 1966052 - RNA, 14 nt, Human
auuaaauauauuuu

SEQ ID NO: 1966053 - RNA, 15 nt, Human
auuaaaucauacucc

SEQ ID NO: 1966054 - RNA, 18 nt, Human
auuaaaugaacaucuaua

SEQ ID NO: 1966055 - RNA, 18 nt, Human
auguuuucaaauguucuc

SEQ ID NO: 1966056 - RNA, 12 nt, Human
auguuuucagcu

SEQ ID NO: 1966057 - RNA, 19 nt, Human
auguuuucagcuaggaaca

SEQ ID NO: 1966058 - RNA, 20 nt, Human
auguuugcugaacauuggag

SEQ ID NO: 1966059 - RNA, 17 nt, Human
auguuuuagcacagcgu

SEQ ID NO: 1966060 - RNA, 22 nt, Human
auguuuuaucguccagugacuu

SEQ ID NO: 1966061 - RNA, 12 nt, Human
auguuuucaaau

SEQ ID NO: 1966062 - RNA, 13 nt, Human
auguuuucaaaug

SEQ ID NO: 1966063 - RNA, 15 nt, Human
auguuuucaaaugga

SEQ ID NO: 1966064 - RNA, 15 nt, Human
auguuuucaaauguu

SEQ ID NO: 1966065 - RNA, 22 nt, Human
auguuugccucugccucugaca

SEQ ID NO: 1966066 - RNA, 15 nt, Human
auguuugccuucugc

SEQ ID NO: 1966067 - RNA, 19 nt, Human
auguuugccucugccucug

SEQ ID NO: 1966068 - RNA, 13 nt, Human
auguucugggaca

SEQ ID NO: 1966069 - RNA, 13 nt, Human
auguucugcuuuc

SEQ ID NO: 1966070 - RNA, 11 nt, Human
auguucuggga

SEQ ID NO: 1966071 - RNA, 12 nt, Human
auguucugggac

SEQ ID NO: 1966072 - RNA, 20 nt, Human
auguucuccagucauuaugu

SEQ ID NO: 1966073 - RNA, 17 nt, Human
auguucuaagaagugaa

SEQ ID NO: 1966074 - RNA, 21 nt, Human
augugugauucaaugccucug

SEQ ID NO: 1966075 - RNA, 13 nt, Human
augugugcccagc

SEQ ID NO: 1966076 - RNA, 14 nt, Human
augugugcccagcu

SEQ ID NO: 1966077 - RNA, 15 nt, Human
augugugcccagcuu

SEQ ID NO: 1966078 - RNA, 20 nt, Human
augugggcuaguugggcuuc

SEQ ID NO: 1966079 - RNA, 16 nt, Human
augugugagugcaugu

SEQ ID NO: 1966080 - RNA, 11 nt, Human
augugaacagu

SEQ ID NO: 1966081 - RNA, 21 nt, Human
augugaacaguuguguuugaa

SEQ ID NO: 1966082 - RNA, 23 nt, Human
augugaacaguuguguuugaagc

SEQ ID NO: 1966083 - RNA, 22 nt, Human
augugaaacuggauuaaacuua

SEQ ID NO: 1966084 - RNA, 15 nt, Human
augugaaacauguuu

SEQ ID NO: 1966085 - RNA, 14 nt, Human
augucuuuucuugc

SEQ ID NO: 1966086 - RNA, 13 nt, Human
augucuuccugga

SEQ ID NO: 1966087 - RNA, 23 nt, Human
augucaaaaguagaacuuuguau

SEQ ID NO: 1966088 - RNA, 15 nt, Human
augucaaaaguagaa

SEQ ID NO: 1966089 - RNA, 17 nt, Human
augucaaaaguagaacu

SEQ ID NO: 1966090 - RNA, 20 nt, Human
augucaaaaguagaacuuug

SEQ ID NO: 1966091 - RNA, 22 nt, Human
augucaaaaguagaacuuugua

SEQ ID NO: 1966092 - RNA, 21 nt, Human
augugaauuacuaacuucuaa

SEQ ID NO: 1966093 - RNA, 22 nt, Human
augugaauuacuaacuucuaaa

SEQ ID NO: 1966094 - RNA, 13 nt, Human
augugaauuacua

SEQ ID NO: 1966095 - RNA, 14 nt, Human
augugaauuacuaa

SEQ ID NO: 1966096 - RNA, 16 nt, Human
augugaauuacuaacu

SEQ ID NO: 1966097 - RNA, 17 nt, Human
augugaauuacuaacuu

SEQ ID NO: 1966098 - RNA, 18 nt, Human
augugaauuacuaacuuc

SEQ ID NO: 1966099 - RNA, 20 nt, Human
augugaauuacuaacuucua

SEQ ID NO: 1966100 - RNA, 20 nt, Human
augugaaggaccuucacucu

SEQ ID NO: 1966101 - RNA, 18 nt, Human
augguaugcacaauucca

SEQ ID NO: 1966102 - RNA, 19 nt, Human
augguaugcacaauuccau

SEQ ID NO: 1966103 - RNA, 14 nt, Human
augguauccagaau

SEQ ID NO: 1966104 - RNA, 19 nt, Human
auggucaccaaaucagcug

SEQ ID NO: 1966105 - RNA, 15 nt, Human
auggucauauuuaaa

SEQ ID NO: 1966106 - RNA, 17 nt, Human
auguaauuaaguacuau

SEQ ID NO: 1966107 - RNA, 15 nt, Human
auguaauuaaguacu

SEQ ID NO: 1966108 - RNA, 15 nt, Human
auggucggaaaacau

SEQ ID NO: 1966109 - RNA, 12 nt, Human
auguauuuugug

SEQ ID NO: 1966110 - RNA, 13 nt, Human
auguauuuuguga

SEQ ID NO: 1966111 - RNA, 14 nt, Human
auguauuuugugag

SEQ ID NO: 1966112 - RNA, 15 nt, Human
auguauuuugugagu

SEQ ID NO: 1966113 - RNA, 16 nt, Human
auguauuuugugaguu

SEQ ID NO: 1966114 - RNA, 17 nt, Human
auguauuuugugaguuu

SEQ ID NO: 1966115 - RNA, 19 nt, Human
auguauuuugugaguuugu

SEQ ID NO: 1966116 - RNA, 20 nt, Human
auguauuuugugaguuuguu

SEQ ID NO: 1966117 - RNA, 23 nt, Human
auguauuuugugaguuuguuucu

SEQ ID NO: 1966118 - RNA, 17 nt, Human
augucaaaaauauuuag

SEQ ID NO: 1966119 - RNA, 23 nt, Human
augucaaaaauauuuaggaauuu

SEQ ID NO: 1966120 - RNA, 23 nt, Human
auguaauuaaguacuauguauca

SEQ ID NO: 1966121 - RNA, 21 nt, Human
auguauucauauuuguacuuu

SEQ ID NO: 1966122 - RNA, 18 nt, Human
auguauucuguaaaagaa

SEQ ID NO: 1966123 - RNA, 17 nt, Human
augcacagaguuguuac

SEQ ID NO: 1966124 - RNA, 18 nt, Human
augcacagaguuguuaca

SEQ ID NO: 1966125 - RNA, 15 nt, Human
augcauauauauaug

SEQ ID NO: 1966126 - RNA, 16 nt, Human
augcauauauauaugu

SEQ ID NO: 1966127 - RNA, 17 nt, Human
augcacaaacagaggcc

SEQ ID NO: 1966128 - RNA, 16 nt, Human
augcacaaacagaggc

SEQ ID NO: 1966129 - RNA, 16 nt, Human
augcacagaguuguua

SEQ ID NO: 1966130 - RNA, 19 nt, Human
augccucucucaggccaaa

SEQ ID NO: 1966131 - RNA, 15 nt, Human
augcaucuuugaugu

SEQ ID NO: 1966132 - RNA, 16 nt, Human
augcaucuuugaugug

SEQ ID NO: 1966133 - RNA, 19 nt, Human
augcaucuuugauguguug

SEQ ID NO: 1966134 - RNA, 21 nt, Human
augcaucuuugauguguuguu

SEQ ID NO: 1966135 - RNA, 16 nt, Human
augcaugaaguaauau

SEQ ID NO: 1966136 - RNA, 17 nt, Human
augccucucucaggcca

SEQ ID NO: 1966137 - RNA, 20 nt, Human
augcauauauauaugugugu

SEQ ID NO: 1966138 - RNA, 16 nt, Human
augcauauuauuuuau

SEQ ID NO: 1966139 - RNA, 12 nt, Human
augcaucuuuga

SEQ ID NO: 1966140 - RNA, 13 nt, Human
augcaucuuugau

SEQ ID NO: 1966141 - RNA, 20 nt, Human
augcaucuggcucaccgggu

SEQ ID NO: 1966142 - RNA, 13 nt, Human
augcauauuacug

SEQ ID NO: 1966143 - RNA, 14 nt, Human
augcauauuacugu

SEQ ID NO: 1966144 - RNA, 17 nt, Human
augaugccaugaggaac

SEQ ID NO: 1966145 - RNA, 16 nt, Human
augaugccaugaggaa

SEQ ID NO: 1966146 - RNA, 15 nt, Human
augcacaaacagagg

SEQ ID NO: 1966147 - RNA, 17 nt, Human
augcaauuuuucuuucu

SEQ ID NO: 1966148 - RNA, 13 nt, Human
augauguuuuuaa

SEQ ID NO: 1966149 - RNA, 17 nt, Human
augauguuuuuaaaauc

SEQ ID NO: 1966150 - RNA, 17 nt, Human
augauuaaaaauaucaa

SEQ ID NO: 1966151 - RNA, 22 nt, Human
augauguuuuuaaaaucuuauu

SEQ ID NO: 1966152 - RNA, 14 nt, Human
augauuaaaaauau

SEQ ID NO: 1966153 - RNA, 18 nt, Human
augauguuuuuaaaaucu

SEQ ID NO: 1966154 - RNA, 19 nt, Human
augauguuuuuaaaaucuu

SEQ ID NO: 1966155 - RNA, 20 nt, Human
augauguuuuuaaaaucuua

SEQ ID NO: 1966156 - RNA, 21 nt, Human
augauguuuuuaaaaucuuau

SEQ ID NO: 1966157 - RNA, 16 nt, Human
augaugcucuuuccca

SEQ ID NO: 1966158 - RNA, 24 nt, Human
augauguuuuccaugaguccccug

SEQ ID NO: 1966159 - RNA, 19 nt, Human
augauguuaguuuuccuua

SEQ ID NO: 1966160 - RNA, 17 nt, Human
augauguuaguuuuccu

SEQ ID NO: 1966161 - RNA, 16 nt, Human
auggcuguggagugug

SEQ ID NO: 1966162 - RNA, 19 nt, Human
auggcugugccucugccug

SEQ ID NO: 1966163 - RNA, 20 nt, Human
auggcugugccucugccugu

SEQ ID NO: 1966164 - RNA, 18 nt, Human
auggaaacagaggaccag

SEQ ID NO: 1966165 - RNA, 20 nt, Human
auggaaacagaggaccagca

SEQ ID NO: 1966166 - RNA, 12 nt, Human
augcugcccugu

SEQ ID NO: 1966167 - RNA, 16 nt, Human
augcugccccugccuu

SEQ ID NO: 1966168 - RNA, 12 nt, Human
augcuuguacau

SEQ ID NO: 1966169 - RNA, 13 nt, Human
augcuuguacaua

SEQ ID NO: 1966170 - RNA, 14 nt, Human
augcuuguacauaa

SEQ ID NO: 1966171 - RNA, 15 nt, Human
auggauuuccagcca

SEQ ID NO: 1966172 - RNA, 18 nt, Human
auggcugugccucugccu

SEQ ID NO: 1966173 - RNA, 23 nt, Human
auggauuggguaucaaaaugaau

SEQ ID NO: 1966174 - RNA, 16 nt, Human
auggaggaaaaccaag

SEQ ID NO: 1966175 - RNA, 22 nt, Human
auggaggaaaaccaagccgugg

SEQ ID NO: 1966176 - RNA, 18 nt, Human
auggaggaagaacugaaa

SEQ ID NO: 1966177 - RNA, 20 nt, Human
auggaggaagaacugaaagg

SEQ ID NO: 1966178 - RNA, 22 nt, Human
auggaggaccacgucuauuuca

SEQ ID NO: 1966179 - RNA, 17 nt, Human
auggaggagaguguuua

SEQ ID NO: 1966180 - RNA, 16 nt, Human
augcucuuuacuucau

SEQ ID NO: 1966181 - RNA, 12 nt, Human
augcucuuuccc

SEQ ID NO: 1966182 - RNA, 15 nt, Human
augcucuuucccacc

SEQ ID NO: 1966183 - RNA, 21 nt, Human
augcucuuucccacccagccu

SEQ ID NO: 1966184 - RNA, 22 nt, Human
augcucuuucccacccagccug

SEQ ID NO: 1966185 - RNA, 23 nt, Human
augcucuuucccacccagccugg

SEQ ID NO: 1966186 - RNA, 14 nt, Human
augcugaaaauugc

SEQ ID NO: 1966187 - RNA, 22 nt, Human
augcugaaaauugccuuucugu

SEQ ID NO: 1966188 - RNA, 17 nt, Human
augcugaacauugcaua

SEQ ID NO: 1966189 - RNA, 23 nt, Human
augcugaacauugcauauaacuu

SEQ ID NO: 1966190 - RNA, 11 nt, Human
augcugccccu

SEQ ID NO: 1966191 - RNA, 15 nt, Human
augcugccccugccu

SEQ ID NO: 1966192 - RNA, 11 nt, Human
augcugcccug

SEQ ID NO: 1966193 - RNA, 23 nt, Human
augaccuuucaauaggaaaaacu

SEQ ID NO: 1966194 - RNA, 22 nt, Human
augaccuuucaauaggaaaaac

SEQ ID NO: 1966195 - RNA, 21 nt, Human
augaccuuucaauaggaaaaa

SEQ ID NO: 1966196 - RNA, 20 nt, Human
augaggcagcacgugcacaa

SEQ ID NO: 1966197 - RNA, 17 nt, Human
augaagguuuuuguaaa

SEQ ID NO: 1966198 - RNA, 18 nt, Human
augaagguuuuuguaaag

SEQ ID NO: 1966199 - RNA, 22 nt, Human
augaagcuuuuaugugaaacau

SEQ ID NO: 1966200 - RNA, 19 nt, Human
augaaguuuuuuuuauaca

SEQ ID NO: 1966201 - RNA, 21 nt, Human
augaagguuuuuguaaagauu

SEQ ID NO: 1966202 - RNA, 23 nt, Human
augaaaaaauauauaucaaauau

SEQ ID NO: 1966203 - RNA, 19 nt, Human
augaaagacuguacaaagu

SEQ ID NO: 1966204 - RNA, 17 nt, Human
augaaagacuguacaaa

SEQ ID NO: 1966205 - RNA, 16 nt, Human
augaaagacuguacaa

SEQ ID NO: 1966206 - RNA, 13 nt, Human
augaaagacugua

SEQ ID NO: 1966207 - RNA, 14 nt, Human
aucuauauuuuaca

SEQ ID NO: 1966208 - RNA, 17 nt, Human
aucuauauuuuacauaa

SEQ ID NO: 1966209 - RNA, 21 nt, Human
aucuauauuuuacauaaauuu

SEQ ID NO: 1966210 - RNA, 21 nt, Human
aucucccccagccccauccuc

SEQ ID NO: 1966211 - RNA, 22 nt, Human
aucuggaccccaucugugaaua

SEQ ID NO: 1966212 - RNA, 22 nt, Human
aucugcuuuuuaaagaaugcuc

SEQ ID NO: 1966213 - RNA, 15 nt, Human
aucuggacuccucug

SEQ ID NO: 1966214 - RNA, 16 nt, Human
aucuggacuccucugu

SEQ ID NO: 1966215 - RNA, 17 nt, Human
aucuggacuccucuguc

SEQ ID NO: 1966216 - RNA, 18 nt, Human
aucuggacuccucugucc

SEQ ID NO: 1966217 - RNA, 19 nt, Human
aucuggacuccucugucca

SEQ ID NO: 1966218 - RNA, 18 nt, Human
aucuccuuuguauucugu

SEQ ID NO: 1966219 - RNA, 16 nt, Human
aucuccuuagaaaagc

SEQ ID NO: 1966220 - RNA, 16 nt, Human
aucucggcucacugca

SEQ ID NO: 1966221 - RNA, 15 nt, Human
aucucguauagaagu

SEQ ID NO: 1966222 - RNA, 19 nt, Human
aucucguauagaagucuuc

SEQ ID NO: 1966223 - RNA, 14 nt, Human
aucucggcucacug

SEQ ID NO: 1966224 - RNA, 15 nt, Human
aucucggcucacugc

SEQ ID NO: 1966225 - RNA, 17 nt, Human
aucucugcuuuggaaau

SEQ ID NO: 1966226 - RNA, 17 nt, Human
aucuugaauuguaagga

SEQ ID NO: 1966227 - RNA, 22 nt, Human
aucuugaaggaaaaauucaaua

SEQ ID NO: 1966228 - RNA, 18 nt, Human
aucuugaauaauguaaga

SEQ ID NO: 1966229 - RNA, 14 nt, Human
aucuucuuuauaau

SEQ ID NO: 1966230 - RNA, 18 nt, Human
aucuugaagacuuuucuu

SEQ ID NO: 1966231 - RNA, 17 nt, Human
aucuugaaggaaaaauu

SEQ ID NO: 1966232 - RNA, 18 nt, Human
aucuugaaggaaaaauuc

SEQ ID NO: 1966233 - RNA, 20 nt, Human
aucuugaaggaaaaauucaa

SEQ ID NO: 1966234 - RNA, 22 nt, Human
aucuucugaacuuggcgcugcc

SEQ ID NO: 1966235 - RNA, 16 nt, Human
auccagaaagaaaacu

SEQ ID NO: 1966236 - RNA, 10 nt, Human
auccagaaac

SEQ ID NO: 1966237 - RNA, 19 nt, Human
auccagaaacuuguucuuc

SEQ ID NO: 1966238 - RNA, 20 nt, Human
auccagaaacuuguucuucc

SEQ ID NO: 1966239 - RNA, 18 nt, Human
auccagaaagaaaacuug

SEQ ID NO: 1966240 - RNA, 15 nt, Human
auccagacccggcug

SEQ ID NO: 1966241 - RNA, 19 nt, Human
auccaggacccugccaggc

SEQ ID NO: 1966242 - RNA, 20 nt, Human
auccaggacccugccaggca

SEQ ID NO: 1966243 - RNA, 22 nt, Human
auccaggacccugccaggcaca

SEQ ID NO: 1966244 - RNA, 23 nt, Human
auccaggacccugccaggcacag

SEQ ID NO: 1966245 - RNA, 21 nt, Human
auccagaaacuuguucuucca

SEQ ID NO: 1966246 - RNA, 11 nt, Human
auccaggaccc

SEQ ID NO: 1966247 - RNA, 13 nt, Human
auccaggacccug

SEQ ID NO: 1966248 - RNA, 15 nt, Human
auccaggacccugcc

SEQ ID NO: 1966249 - RNA, 18 nt, Human
auccaggacccugccagg

SEQ ID NO: 1966250 - RNA, 15 nt, Human
aucccauuuaaaaaa

SEQ ID NO: 1966251 - RNA, 13 nt, Human
auccccaagccug

SEQ ID NO: 1966252 - RNA, 14 nt, Human
aucccauuuaaaaa

SEQ ID NO: 1966253 - RNA, 11 nt, Human
auccccuuccu

SEQ ID NO: 1966254 - RNA, 18 nt, Human
auccccuuccuaccaccc

SEQ ID NO: 1966255 - RNA, 15 nt, Human
auccccuguagagug

SEQ ID NO: 1966256 - RNA, 16 nt, Human
auccccaagccuggca

SEQ ID NO: 1966257 - RNA, 11 nt, Human
auccuccaggu

SEQ ID NO: 1966258 - RNA, 23 nt, Human
auccuccaggugcacaagcucca

SEQ ID NO: 1966259 - RNA, 12 nt, Human
auccuccagggc

SEQ ID NO: 1966260 - RNA, 13 nt, Human
auccuccagggcu

SEQ ID NO: 1966261 - RNA, 15 nt, Human
auccucccaccucag

SEQ ID NO: 1966262 - RNA, 15 nt, Human
aucggcauuuguuuc

SEQ ID NO: 1966263 - RNA, 20 nt, Human
auccucccaccucagccucc

SEQ ID NO: 1966264 - RNA, 18 nt, Human
auccucccaccucagccu

SEQ ID NO: 1966265 - RNA, 19 nt, Human
auccucccaccucagccuc

SEQ ID NO: 1966266 - RNA, 19 nt, Human
aucaccaacgucugugcca

SEQ ID NO: 1966267 - RNA, 18 nt, Human
aucaccaacgucugugcc

SEQ ID NO: 1966268 - RNA, 15 nt, Human
aucacauguggacuu

SEQ ID NO: 1966269 - RNA, 21 nt, Human
aucacagccucugaaaaccaa

SEQ ID NO: 1966270 - RNA, 13 nt, Human
aucacaggcuggg

SEQ ID NO: 1966271 - RNA, 14 nt, Human
aucacaggcugggc

SEQ ID NO: 1966272 - RNA, 15 nt, Human
aucacaggcugggcu

SEQ ID NO: 1966273 - RNA, 20 nt, Human
aucacaggcugggcugggca

SEQ ID NO: 1966274 - RNA, 21 nt, Human
aucacaggcugggcugggcac

SEQ ID NO: 1966275 - RNA, 22 nt, Human
aucacaggcugggcugggcacu

SEQ ID NO: 1966276 - RNA, 23 nt, Human
aucacaggcugggcugggcacug

SEQ ID NO: 1966277 - RNA, 21 nt, Human
aucaccgaaaacguggcugcu

SEQ ID NO: 1966278 - RNA, 19 nt, Human
aucaccgaaaacguggcug

SEQ ID NO: 1966279 - RNA, 14 nt, Human
aucaccgaaaacgu

SEQ ID NO: 1966280 - RNA, 19 nt, Human
aucagcacgauuucuguuu

SEQ ID NO: 1966281 - RNA, 20 nt, Human
aucagcacgauuucuguuua

SEQ ID NO: 1966282 - RNA, 23 nt, Human
aucagcacgauuucuguuuagau

SEQ ID NO: 1966283 - RNA, 14 nt, Human
aucagccugugcca

SEQ ID NO: 1966284 - RNA, 23 nt, Human
aucagcgccggccuccagaacuu

SEQ ID NO: 1966285 - RNA, 18 nt, Human
aucagccugcuccagcug

SEQ ID NO: 1966286 - RNA, 17 nt, Human
aucagccugcuccagcu

SEQ ID NO: 1966287 - RNA, 19 nt, Human
aucagccugcuccagcugu

SEQ ID NO: 1966288 - RNA, 20 nt, Human
aucagccugcuccagcuguu

SEQ ID NO: 1966289 - RNA, 16 nt, Human
aucaugugaaaucauu

SEQ ID NO: 1966290 - RNA, 14 nt, Human
aucaugugaaauca

SEQ ID NO: 1966291 - RNA, 18 nt, Human
aucaugugcgucagucca

SEQ ID NO: 1966292 - RNA, 22 nt, Human
aucagcuggucaaacaaacucu

SEQ ID NO: 1966293 - RNA, 18 nt, Human
aucagcugagccuucuga

SEQ ID NO: 1966294 - RNA, 15 nt, Human
aucaugugaaaucau

SEQ ID NO: 1966295 - RNA, 15 nt, Human
aguaucuugaagacu

SEQ ID NO: 1966296 - RNA, 12 nt, Human
aguaucuugaag

SEQ ID NO: 1966297 - RNA, 11 nt, Human
aguaucuugaa

SEQ ID NO: 1966298 - RNA, 14 nt, Human
aguaucugugaacu

SEQ ID NO: 1966299 - RNA, 16 nt, Human
aguaucuuuuuauuca

SEQ ID NO: 1966300 - RNA, 16 nt, Human
aguaugaauaaagaca

SEQ ID NO: 1966301 - RNA, 15 nt, Human
aguaugaggcauuug

SEQ ID NO: 1966302 - RNA, 16 nt, Human
aguaugaggcauuugu

SEQ ID NO: 1966303 - RNA, 12 nt, Human
agucaacaguac

SEQ ID NO: 1966304 - RNA, 19 nt, Human
agucaacaguacccugguu

SEQ ID NO: 1966305 - RNA, 23 nt, Human
agucaaauguaauguggcuucug

SEQ ID NO: 1966306 - RNA, 22 nt, Human
agucaaauguaauguggcuucu

SEQ ID NO: 1966307 - RNA, 14 nt, Human
aguaugguggcugg

SEQ ID NO: 1966308 - RNA, 19 nt, Human
agucaaacacuugugacuu

SEQ ID NO: 1966309 - RNA, 22 nt, Human
agucaaacacuugugacuuuug

SEQ ID NO: 1966310 - RNA, 17 nt, Human
aguaugggacuggccuc

SEQ ID NO: 1966311 - RNA, 20 nt, Human
aguaugggacuggccucugc

SEQ ID NO: 1966312 - RNA, 17 nt, Human
agugaagacuccagaaa

SEQ ID NO: 1966313 - RNA, 14 nt, Human
agugaagacaauga

SEQ ID NO: 1966314 - RNA, 16 nt, Human
agugaagacaaugacu

SEQ ID NO: 1966315 - RNA, 16 nt, Human
agugaagacuccagaa

SEQ ID NO: 1966316 - RNA, 15 nt, Human
agugaagacuccaga

SEQ ID NO: 1966317 - RNA, 20 nt, Human
agucugauucccaagcucug

SEQ ID NO: 1966318 - RNA, 14 nt, Human
agucugcauauauu

SEQ ID NO: 1966319 - RNA, 16 nt, Human
agucugauucccaagc

SEQ ID NO: 1966320 - RNA, 18 nt, Human
agucugauucccaagcuc

SEQ ID NO: 1966321 - RNA, 17 nt, Human
agucuggaaugcagugg

SEQ ID NO: 1966322 - RNA, 20 nt, Human
agugaacuugggccacugug

SEQ ID NO: 1966323 - RNA, 18 nt, Human
agucuggaaugcaguggu

SEQ ID NO: 1966324 - RNA, 21 nt, Human
aguccuggcaugggaaugaau

SEQ ID NO: 1966325 - RNA, 20 nt, Human
aguccuggcaugggaaugaa

SEQ ID NO: 1966326 - RNA, 22 nt, Human
aguccuggcaugggaaugaaug

SEQ ID NO: 1966327 - RNA, 15 nt, Human
agucugaaggcuggg

SEQ ID NO: 1966328 - RNA, 13 nt, Human
agucugaaggcug

SEQ ID NO: 1966329 - RNA, 16 nt, Human
agucugaaggcugggu

SEQ ID NO: 1966330 - RNA, 17 nt, Human
agucugaaggcuggguu

SEQ ID NO: 1966331 - RNA, 12 nt, Human
aguccuguaaug

SEQ ID NO: 1966332 - RNA, 18 nt, Human
agugaccauacuaauuau

SEQ ID NO: 1966333 - RNA, 18 nt, Human
agugaccauugcaugccg

SEQ ID NO: 1966334 - RNA, 16 nt, Human
aguggcuggaucugug

SEQ ID NO: 1966335 - RNA, 13 nt, Human
aguggcuccuccc

SEQ ID NO: 1966336 - RNA, 17 nt, Human
aguggcuccucccggug

SEQ ID NO: 1966337 - RNA, 21 nt, Human
aguggcuccucccggugccca

SEQ ID NO: 1966338 - RNA, 23 nt, Human
aguggcuuaaaacaacacucaca

SEQ ID NO: 1966339 - RNA, 18 nt, Human
aguggcgaaaucccugcu

SEQ ID NO: 1966340 - RNA, 21 nt, Human
aguggcgaaaucccugcucac

SEQ ID NO: 1966341 - RNA, 23 nt, Human
aguggcgaaaucccugcucacug

SEQ ID NO: 1966342 - RNA, 17 nt, Human
aguguauuuuuuuacua

SEQ ID NO: 1966343 - RNA, 18 nt, Human
aguguauuuuuuuacuaa

SEQ ID NO: 1966344 - RNA, 16 nt, Human
agugggagcugccugu

SEQ ID NO: 1966345 - RNA, 15 nt, Human
agugggagcugccug

SEQ ID NO: 1966346 - RNA, 14 nt, Human
agugggagcugccu

SEQ ID NO: 1966347 - RNA, 14 nt, Human
aguguauuaaauga

SEQ ID NO: 1966348 - RNA, 17 nt, Human
aguguauuaaaugaaca

SEQ ID NO: 1966349 - RNA, 18 nt, Human
aguuacacuaaaagguga

SEQ ID NO: 1966350 - RNA, 13 nt, Human
aguuaaucuauaa

SEQ ID NO: 1966351 - RNA, 16 nt, Human
aguuacagacaaagcg

SEQ ID NO: 1966352 - RNA, 14 nt, Human
aguuacagacaaag

SEQ ID NO: 1966353 - RNA, 12 nt, Human
aguuaaauaaau

SEQ ID NO: 1966354 - RNA, 13 nt, Human
aguuaagccuuug

SEQ ID NO: 1966355 - RNA, 23 nt, Human
aguuaaagggaagaaaacacugu

SEQ ID NO: 1966356 - RNA, 14 nt, Human
aguuaagccuuugg

SEQ ID NO: 1966357 - RNA, 18 nt, Human
aguuaaggagaaucaugu

SEQ ID NO: 1966358 - RNA, 21 nt, Human
aguuaaggagaaucauguuuc

SEQ ID NO: 1966359 - RNA, 22 nt, Human
aguuaaggagaaucauguuucu

SEQ ID NO: 1966360 - RNA, 18 nt, Human
aguuaaaagcacaaagga

SEQ ID NO: 1966361 - RNA, 21 nt, Human
aguuaaagaagacauuugcca

SEQ ID NO: 1966362 - RNA, 13 nt, Human
aguuaaagggaag

SEQ ID NO: 1966363 - RNA, 17 nt, Human
aguuaaagggaagaaaa

SEQ ID NO: 1966364 - RNA, 18 nt, Human
aguuaaagggaagaaaac

SEQ ID NO: 1966365 - RNA, 18 nt, Human
aguucauaaauuuauggu

SEQ ID NO: 1966366 - RNA, 20 nt, Human
aguucagguaacaggcagau

SEQ ID NO: 1966367 - RNA, 17 nt, Human
aguuacagacaaagcgu

SEQ ID NO: 1966368 - RNA, 19 nt, Human
aguucagguaacaggcaga

SEQ ID NO: 1966369 - RNA, 16 nt, Human
aguucauucagggccg

SEQ ID NO: 1966370 - RNA, 14 nt, Human
aguucauucauauu

SEQ ID NO: 1966371 - RNA, 15 nt, Human
aguucauucauauua

SEQ ID NO: 1966372 - RNA, 16 nt, Human
aguucauucauauuac

SEQ ID NO: 1966373 - RNA, 17 nt, Human
aguucauucauauuaca

SEQ ID NO: 1966374 - RNA, 23 nt, Human
aguucauucauauuacaauauuu

SEQ ID NO: 1966375 - RNA, 22 nt, Human
aguugaaaaucuuauaauuuaa

SEQ ID NO: 1966376 - RNA, 11 nt, Human
aguuguuugau

SEQ ID NO: 1966377 - RNA, 13 nt, Human
aguuguuugaugc

SEQ ID NO: 1966378 - RNA, 20 nt, Human
aguuguuugauucagacagc

SEQ ID NO: 1966379 - RNA, 16 nt, Human
aguuguguuugaagca

SEQ ID NO: 1966380 - RNA, 14 nt, Human
aguugaagacagag

SEQ ID NO: 1966381 - RNA, 23 nt, Human
aguugaaaaucuuauaauuuaaa

SEQ ID NO: 1966382 - RNA, 17 nt, Human
auaaaacuuuuuaaaau

SEQ ID NO: 1966383 - RNA, 21 nt, Human
auaaacuuuaccuuuuuuaua

SEQ ID NO: 1966384 - RNA, 16 nt, Human
auaaacuuuaccuuuu

SEQ ID NO: 1966385 - RNA, 24 nt, Human
auaaacuuuaccuuuuuuauacau

SEQ ID NO: 1966386 - RNA, 20 nt, Human
auaaacuuuuuucuuacugu

SEQ ID NO: 1966387 - RNA, 15 nt, Human
auaaaacuuuuuaaa

SEQ ID NO: 1966388 - RNA, 11 nt, Human
auaaaacuuuu

SEQ ID NO: 1966389 - RNA, 15 nt, Human
auaaaggaaucuagc

SEQ ID NO: 1966390 - RNA, 18 nt, Human
auaaagcuguguggcagu

SEQ ID NO: 1966391 - RNA, 22 nt, Human
auaaagcgaaaaacucaaccaa

SEQ ID NO: 1966392 - RNA, 15 nt, Human
auaaagcaggcagaa

SEQ ID NO: 1966393 - RNA, 17 nt, Human
auaaagcagacaggugu

SEQ ID NO: 1966394 - RNA, 14 nt, Human
auaaagcagcguuu

SEQ ID NO: 1966395 - RNA, 18 nt, Human
auaaagcagcguuucuau

SEQ ID NO: 1966396 - RNA, 19 nt, Human
auaaagcagcguuucuaug

SEQ ID NO: 1966397 - RNA, 20 nt, Human
auaaagcagcguuucuauga

SEQ ID NO: 1966398 - RNA, 13 nt, Human
auaaagcagcguu

SEQ ID NO: 1966399 - RNA, 12 nt, Human
auaaagacaccu

SEQ ID NO: 1966400 - RNA, 19 nt, Human
auaaagaauaggacuuguu

SEQ ID NO: 1966401 - RNA, 23 nt, Human
auaaagaauaggacuuguuuuug

SEQ ID NO: 1966402 - RNA, 15 nt, Human
auaaagaauaggacu

SEQ ID NO: 1966403 - RNA, 22 nt, Human
auaaauuuugaaaaguaauauu

SEQ ID NO: 1966404 - RNA, 18 nt, Human
auaaaggauuaaugucaa

SEQ ID NO: 1966405 - RNA, 13 nt, Human
auaacaacuuuuu

SEQ ID NO: 1966406 - RNA, 14 nt, Human
auaacaacuuuuuu

SEQ ID NO: 1966407 - RNA, 13 nt, Human
auaacaaagaacc

SEQ ID NO: 1966408 - RNA, 23 nt, Human
auaacaaagaaccuaacauuuau

SEQ ID NO: 1966409 - RNA, 22 nt, Human
auaacauagaauugcaaucuau

SEQ ID NO: 1966410 - RNA, 12 nt, Human
auaacauagaau

SEQ ID NO: 1966411 - RNA, 16 nt, Human
auaaggccucauccuc

SEQ ID NO: 1966412 - RNA, 15 nt, Human
auaaggacuuccuga

SEQ ID NO: 1966413 - RNA, 14 nt, Human
auaauguaagcucu

SEQ ID NO: 1966414 - RNA, 20 nt, Human
auaaugcgugcauaccacuu

SEQ ID NO: 1966415 - RNA, 21 nt, Human
auaaugcgugcauaccacuuu

SEQ ID NO: 1966416 - RNA, 18 nt, Human
auacaccacuacauucug

SEQ ID NO: 1966417 - RNA, 11 nt, Human
auacacacgcu

SEQ ID NO: 1966418 - RNA, 14 nt, Human
auacacacgcugcc

SEQ ID NO: 1966419 - RNA, 15 nt, Human
auacacacgcugccu

SEQ ID NO: 1966420 - RNA, 21 nt, Human
auacaccacuacauucuguua

SEQ ID NO: 1966421 - RNA, 23 nt, Human
auaccauuauauguucccccugu

SEQ ID NO: 1966422 - RNA, 16 nt, Human
auacacacgcugccuu

SEQ ID NO: 1966423 - RNA, 20 nt, Human
auaccauuauuaucaaguag

SEQ ID NO: 1966424 - RNA, 13 nt, Human
auaccauuuccgu

SEQ ID NO: 1966425 - RNA, 15 nt, Human
auaccauuuccguaa

SEQ ID NO: 1966426 - RNA, 19 nt, Human
auacaccacuacauucugu

SEQ ID NO: 1966427 - RNA, 20 nt, Human
auacaccacuacauucuguu

SEQ ID NO: 1966428 - RNA, 12 nt, Human
auaauuaacacu

SEQ ID NO: 1966429 - RNA, 18 nt, Human
auaauuaacacuuaaggu

SEQ ID NO: 1966430 - RNA, 19 nt, Human
auaauuaacacuuaagguu

SEQ ID NO: 1966431 - RNA, 23 nt, Human
auaauguauucauauuuguacuu

SEQ ID NO: 1966432 - RNA, 15 nt, Human
auaauguaagcucua

SEQ ID NO: 1966433 - RNA, 15 nt, Human
auaauguauucauau

SEQ ID NO: 1966434 - RNA, 18 nt, Human
auaauguauucauauuug

SEQ ID NO: 1966435 - RNA, 19 nt, Human
auaauguauucauauuugu

SEQ ID NO: 1966436 - RNA, 12 nt, Human
auacccaccccc

SEQ ID NO: 1966437 - RNA, 11 nt, Human
auacccacccc

SEQ ID NO: 1966438 - RNA, 18 nt, Human
auaccugucccccugaca

SEQ ID NO: 1966439 - RNA, 17 nt, Human
auaccugucccccugac

SEQ ID NO: 1966440 - RNA, 12 nt, Human
auaccuguugcu

SEQ ID NO: 1966441 - RNA, 15 nt, Human
auaccuguuuaaauu

SEQ ID NO: 1966442 - RNA, 17 nt, Human
auaccuguuuaaauugc

SEQ ID NO: 1966443 - RNA, 13 nt, Human
auaccuuaaaauu

SEQ ID NO: 1966444 - RNA, 15 nt, Human
auaccuuaaaauuug

SEQ ID NO: 1966445 - RNA, 16 nt, Human
auaccuuaaaauuuga

SEQ ID NO: 1966446 - RNA, 17 nt, Human
auaccuuaaaauuugaa

SEQ ID NO: 1966447 - RNA, 18 nt, Human
auaccuuaaaauuugaaa

SEQ ID NO: 1966448 - RNA, 19 nt, Human
auaccuuaaaauuugaaac

SEQ ID NO: 1966449 - RNA, 21 nt, Human
auaccuuaaaauuugaaacau

SEQ ID NO: 1966450 - RNA, 22 nt, Human
auaccuuaaaauuugaaacauu

SEQ ID NO: 1966451 - RNA, 23 nt, Human
auaccuuaaaauuugaaacauug

SEQ ID NO: 1966452 - RNA, 14 nt, Human
auaccuuagaaggu

SEQ ID NO: 1966453 - RNA, 14 nt, Human
auaccuugcuuauu

SEQ ID NO: 1966454 - RNA, 21 nt, Human
auauacuuguuuuuguaaaga

SEQ ID NO: 1966455 - RNA, 15 nt, Human
auauagauuaaauca

SEQ ID NO: 1966456 - RNA, 17 nt, Human
auauagagucauuguaa

SEQ ID NO: 1966457 - RNA, 18 nt, Human
auauagagucauuguaau

SEQ ID NO: 1966458 - RNA, 19 nt, Human
auauagagucauuguaaug

SEQ ID NO: 1966459 - RNA, 22 nt, Human
auauagagucauuguaauguug

SEQ ID NO: 1966460 - RNA, 19 nt, Human
auauacuuguuguuuaaug

SEQ ID NO: 1966461 - RNA, 20 nt, Human
auauacuuguuguuuaaugu

SEQ ID NO: 1966462 - RNA, 14 nt, Human
auauacuuguuuuu

SEQ ID NO: 1966463 - RNA, 18 nt, Human
auauacuuguuuuuguaa

SEQ ID NO: 1966464 - RNA, 20 nt, Human
auauacuuguuuuuguaaag

SEQ ID NO: 1966465 - RNA, 17 nt, Human
auaguaugguggcuggg

SEQ ID NO: 1966466 - RNA, 18 nt, Human
auaguaugguggcugggu

SEQ ID NO: 1966467 - RNA, 13 nt, Human
auaguauuugaaa

SEQ ID NO: 1966468 - RNA, 14 nt, Human
auaguauuugaaaa

SEQ ID NO: 1966469 - RNA, 18 nt, Human
auaguauuugaaaacaga

SEQ ID NO: 1966470 - RNA, 19 nt, Human
auaguauuugaaaacagaa

SEQ ID NO: 1966471 - RNA, 20 nt, Human
auaguauuugaaaacagaaa

SEQ ID NO: 1966472 - RNA, 22 nt, Human
auaguauuugaaaacagaaauu

SEQ ID NO: 1966473 - RNA, 14 nt, Human
auagguuuggacaa

SEQ ID NO: 1966474 - RNA, 12 nt, Human
auagguuauuuu

SEQ ID NO: 1966475 - RNA, 17 nt, Human
auagguuagauauagag

SEQ ID NO: 1966476 - RNA, 15 nt, Human
auagguuuaauaauu

SEQ ID NO: 1966477 - RNA, 21 nt, Human
auagguauaaguggugugugu

SEQ ID NO: 1966478 - RNA, 15 nt, Human
auagccccucucccc

SEQ ID NO: 1966479 - RNA, 16 nt, Human
auagguccuuuagaaa

SEQ ID NO: 1966480 - RNA, 17 nt, Human
auagguccuuuagaaac

SEQ ID NO: 1966481 - RNA, 14 nt, Human
auagguuagauaua

SEQ ID NO: 1966482 - RNA, 18 nt, Human
auagcagcuuauucacaa

SEQ ID NO: 1966483 - RNA, 16 nt, Human
auagcaguagucuuuu

SEQ ID NO: 1966484 - RNA, 20 nt, Human
auagcaucacuuaaaacacg

SEQ ID NO: 1966485 - RNA, 15 nt, Human
auagcaucacuuaaa

SEQ ID NO: 1966486 - RNA, 16 nt, Human
auagcaucacuuaaaa

SEQ ID NO: 1966487 - RNA, 17 nt, Human
auagcaucacuuaaaac

SEQ ID NO: 1966488 - RNA, 18 nt, Human
auagcaucacuuaaaaca

SEQ ID NO: 1966489 - RNA, 17 nt, Human
auagcauaugacaaaug

SEQ ID NO: 1966490 - RNA, 18 nt, Human
auagcauaugacaaaugu

SEQ ID NO: 1966491 - RNA, 19 nt, Human
auagcauaugacaaauguu

SEQ ID NO: 1966492 - RNA, 20 nt, Human
auagcauaugacaaauguuu

SEQ ID NO: 1966493 - RNA, 22 nt, Human
auagcauaugacaaauguuucu

SEQ ID NO: 1966494 - RNA, 23 nt, Human
auagcauaugacaaauguuucua

SEQ ID NO: 1966495 - RNA, 13 nt, Human
auagcaucacuua

SEQ ID NO: 1966496 - RNA, 18 nt, Human
auagcccaggauauauuu

SEQ ID NO: 1966497 - RNA, 20 nt, Human
auagcccaggauauauuuua

SEQ ID NO: 1966498 - RNA, 21 nt, Human
auagcccaggauauauuuuau

SEQ ID NO: 1966499 - RNA, 21 nt, Human
auagccaaggccaaaggaagc

SEQ ID NO: 1966500 - RNA, 15 nt, Human
auagccaaggccaaa

SEQ ID NO: 1966501 - RNA, 23 nt, Human
auauuaugaagcuuuuaugugaa

SEQ ID NO: 1966502 - RNA, 22 nt, Human
auauuauauuuggaugcagagu

SEQ ID NO: 1966503 - RNA, 15 nt, Human
auauuauauuuggau

SEQ ID NO: 1966504 - RNA, 16 nt, Human
auauuauauuuggaug

SEQ ID NO: 1966505 - RNA, 13 nt, Human
auauuauaucaga

SEQ ID NO: 1966506 - RNA, 16 nt, Human
auauuagaaaacuuug

SEQ ID NO: 1966507 - RNA, 17 nt, Human
auauuagaaaacuuugu

SEQ ID NO: 1966508 - RNA, 18 nt, Human
auauuagaaaacuuuguu

SEQ ID NO: 1966509 - RNA, 20 nt, Human
auauuagaaaacuuuguuag

SEQ ID NO: 1966510 - RNA, 12 nt, Human
auauuauauuug

SEQ ID NO: 1966511 - RNA, 13 nt, Human
auauuauauuugg

SEQ ID NO: 1966512 - RNA, 14 nt, Human
auauuauauuugga

SEQ ID NO: 1966513 - RNA, 19 nt, Human
auauuuacuucuuauacau

SEQ ID NO: 1966514 - RNA, 13 nt, Human
auauuuauugacu

SEQ ID NO: 1966515 - RNA, 16 nt, Human
auauuuauugacucuu

SEQ ID NO: 1966516 - RNA, 18 nt, Human
auauuuauugacucuuga

SEQ ID NO: 1966517 - RNA, 19 nt, Human
auauuaccacagacauacu

SEQ ID NO: 1966518 - RNA, 22 nt, Human
auauuaccacagacauacuaac

SEQ ID NO: 1966519 - RNA, 17 nt, Human
auauuacuguacauggg

SEQ ID NO: 1966520 - RNA, 21 nt, Human
auauuacuguacaugggacua

SEQ ID NO: 1966521 - RNA, 14 nt, Human
auauuagaaaacuu

SEQ ID NO: 1966522 - RNA, 15 nt, Human
auauuagaaaacuuu

SEQ ID NO: 1966523 - RNA, 21 nt, Human
auaugcuuauacacuuacacu

SEQ ID NO: 1966524 - RNA, 13 nt, Human
auaucauucuaaa

SEQ ID NO: 1966525 - RNA, 15 nt, Human
auaucauucuaaaga

SEQ ID NO: 1966526 - RNA, 17 nt, Human
auaucauucuaaagaua

SEQ ID NO: 1966527 - RNA, 14 nt, Human
auauccacacauuu

SEQ ID NO: 1966528 - RNA, 20 nt, Human
auaucccuuggacauuuuau

SEQ ID NO: 1966529 - RNA, 22 nt, Human
auaucccuuggacauuuuaugu

SEQ ID NO: 1966530 - RNA, 23 nt, Human
auaucccuuggacauuuuauguc

SEQ ID NO: 1966531 - RNA, 19 nt, Human
auauauuuuuuucugaaau

SEQ ID NO: 1966532 - RNA, 14 nt, Human
auaucaaaagacac

SEQ ID NO: 1966533 - RNA, 16 nt, Human
auaucaaaagacacag

SEQ ID NO: 1966534 - RNA, 16 nt, Human
auaucaaauauauuca

SEQ ID NO: 1966535 - RNA, 17 nt, Human
auaucaaaagacacagg

SEQ ID NO: 1966536 - RNA, 13 nt, Human
auaucaaauuaau

SEQ ID NO: 1966537 - RNA, 18 nt, Human
auaucaaauuaauugugu

SEQ ID NO: 1966538 - RNA, 19 nt, Human
auaucaaauuaauugugug

SEQ ID NO: 1966539 - RNA, 20 nt, Human
auaucaaauuaauuguguga

SEQ ID NO: 1966540 - RNA, 21 nt, Human
auaucaaauuaauugugugaa

SEQ ID NO: 1966541 - RNA, 22 nt, Human
agguggagcguucaccagugac

SEQ ID NO: 1966542 - RNA, 13 nt, Human
agguguuugaaaa

SEQ ID NO: 1966543 - RNA, 22 nt, Human
agguguuugaacagaggccaca

SEQ ID NO: 1966544 - RNA, 14 nt, Human
agguguuugaaaau

SEQ ID NO: 1966545 - RNA, 15 nt, Human
agguguuugaaaaua

SEQ ID NO: 1966546 - RNA, 17 nt, Human
agguguuugaaaauagu

SEQ ID NO: 1966547 - RNA, 15 nt, Human
agguguuugaacaga

SEQ ID NO: 1966548 - RNA, 22 nt, Human
agguuaaaagaccauaagcaaa

SEQ ID NO: 1966549 - RNA, 11 nt, Human
agguuaaaugu

SEQ ID NO: 1966550 - RNA, 12 nt, Human
agguuaaauguu

SEQ ID NO: 1966551 - RNA, 13 nt, Human
agguuaaauguuu

SEQ ID NO: 1966552 - RNA, 14 nt, Human
agguuaaauguuuu

SEQ ID NO: 1966553 - RNA, 17 nt, Human
agguuaaauguuuugua

SEQ ID NO: 1966554 - RNA, 18 nt, Human
agguuaaauguuuuguaa

SEQ ID NO: 1966555 - RNA, 19 nt, Human
agguuaaauguuuuguaaa

SEQ ID NO: 1966556 - RNA, 22 nt, Human
aggugcuaggaacacuccuuca

SEQ ID NO: 1966557 - RNA, 19 nt, Human
aggugcuaggaacacuccu

SEQ ID NO: 1966558 - RNA, 17 nt, Human
agguggaauuauuuuaa

SEQ ID NO: 1966559 - RNA, 21 nt, Human
agguggaauuauuuuaaaaga

SEQ ID NO: 1966560 - RNA, 17 nt, Human
aggugcucaaaaugcaa

SEQ ID NO: 1966561 - RNA, 23 nt, Human
aggugcuaggaacacuccuucac

SEQ ID NO: 1966562 - RNA, 16 nt, Human
aggugcucaaaaugca

SEQ ID NO: 1966563 - RNA, 17 nt, Human
aggucuguuugcuguug

SEQ ID NO: 1966564 - RNA, 23 nt, Human
agguucccuuugacgccauccca

SEQ ID NO: 1966565 - RNA, 13 nt, Human
agguucccuuuga

SEQ ID NO: 1966566 - RNA, 22 nt, Human
agguucccuuugacgccauccc

SEQ ID NO: 1966567 - RNA, 14 nt, Human
agguucaaagauau

SEQ ID NO: 1966568 - RNA, 15 nt, Human
agguucaaagauauu

SEQ ID NO: 1966569 - RNA, 23 nt, Human
agguuaggcaguauaaagaauag

SEQ ID NO: 1966570 - RNA, 20 nt, Human
agguuagaaauaaugucaaa

SEQ ID NO: 1966571 - RNA, 23 nt, Human
agguuagaaauaaugucaaaaau

SEQ ID NO: 1966572 - RNA, 19 nt, Human
agguuaggcaguauaaaga

SEQ ID NO: 1966573 - RNA, 21 nt, Human
agguuaggcaguauaaagaau

SEQ ID NO: 1966574 - RNA, 22 nt, Human
aggucuguucuuuccaaaguac

SEQ ID NO: 1966575 - RNA, 23 nt, Human
aggucuguucuuuccaaaguaca

SEQ ID NO: 1966576 - RNA, 14 nt, Human
aggucuguuugcug

SEQ ID NO: 1966577 - RNA, 15 nt, Human
aggucuguuugcugu

SEQ ID NO: 1966578 - RNA, 16 nt, Human
aggucuguuugcuguu

SEQ ID NO: 1966579 - RNA, 18 nt, Human
aggucuguucuuuccaaa

SEQ ID NO: 1966580 - RNA, 13 nt, Human
aggucugaguugu

SEQ ID NO: 1966581 - RNA, 20 nt, Human
aggucugaguuguuacccca

SEQ ID NO: 1966582 - RNA, 23 nt, Human
aggucugaguuguuaccccaagc

SEQ ID NO: 1966583 - RNA, 16 nt, Human
aggucccuaauaaagc

SEQ ID NO: 1966584 - RNA, 15 nt, Human
aggucccuaauaaag

SEQ ID NO: 1966585 - RNA, 13 nt, Human
aggucccuaauaa

SEQ ID NO: 1966586 - RNA, 11 nt, Human
aggucccuaau

SEQ ID NO: 1966587 - RNA, 12 nt, Human
aggucccuaaua

SEQ ID NO: 1966588 - RNA, 17 nt, Human
agguacaaccuguucug

SEQ ID NO: 1966589 - RNA, 23 nt, Human
agguaaaucagacuaugaaguuu

SEQ ID NO: 1966590 - RNA, 23 nt, Human
agguaacaagaugagaacagaua

SEQ ID NO: 1966591 - RNA, 19 nt, Human
agguaaucgaccugccucg

SEQ ID NO: 1966592 - RNA, 21 nt, Human
agguaaucgaccugccucggc

SEQ ID NO: 1966593 - RNA, 18 nt, Human
agguaaaucagacuauga

SEQ ID NO: 1966594 - RNA, 12 nt, Human
agguaaaaaguu

SEQ ID NO: 1966595 - RNA, 20 nt, Human
agguaaaagcaucacaugaa

SEQ ID NO: 1966596 - RNA, 12 nt, Human
agggucccuggg

SEQ ID NO: 1966597 - RNA, 12 nt, Human
aggguccugggg

SEQ ID NO: 1966598 - RNA, 15 nt, Human
aggguccuggggaac

SEQ ID NO: 1966599 - RNA, 21 nt, Human
aggguccuggggaaccugacc

SEQ ID NO: 1966600 - RNA, 23 nt, Human
aggguccuggggaaccugacccc

SEQ ID NO: 1966601 - RNA, 11 nt, Human
agggucccugg

SEQ ID NO: 1966602 - RNA, 21 nt, Human
aggggccucuuaugggcuggg

SEQ ID NO: 1966603 - RNA, 20 nt, Human
aggggccucuuaugggcugg

SEQ ID NO: 1966604 - RNA, 19 nt, Human
aggggccucuuaugggcug

SEQ ID NO: 1966605 - RNA, 19 nt, Human
aggguaucaggugcugcca

SEQ ID NO: 1966606 - RNA, 15 nt, Human
aggguaucuggugac

SEQ ID NO: 1966607 - RNA, 21 nt, Human
aggguaucaggugcugccauc

SEQ ID NO: 1966608 - RNA, 21 nt, Human
aggcccuucucuccagccccu

SEQ ID NO: 1966609 - RNA, 20 nt, Human
aggcccuucucuccagcccc

SEQ ID NO: 1966610 - RNA, 13 nt, Human
aggcccuuccucu

SEQ ID NO: 1966611 - RNA, 15 nt, Human
aggcccuuccucucc

SEQ ID NO: 1966612 - RNA, 17 nt, Human
aggcccuuccucuccac

SEQ ID NO: 1966613 - RNA, 18 nt, Human
aggcccuuccucuccacu

SEQ ID NO: 1966614 - RNA, 23 nt, Human
aggcccuucucuccagccccugg

SEQ ID NO: 1966615 - RNA, 22 nt, Human
aggcccuucucuccagccccug

SEQ ID NO: 1966616 - RNA, 19 nt, Human
aggcccuuccucuccacug

SEQ ID NO: 1966617 - RNA, 21 nt, Human
aggcuagaaccaccugccuau

SEQ ID NO: 1966618 - RNA, 23 nt, Human
aggcuacuguaaggcaaucaugg

SEQ ID NO: 1966619 - RNA, 21 nt, Human
aggcgugagccaccgugccug

SEQ ID NO: 1966620 - RNA, 12 nt, Human
aggcuaaaaugu

SEQ ID NO: 1966621 - RNA, 13 nt, Human
aggcuaaaauguu

SEQ ID NO: 1966622 - RNA, 14 nt, Human
aggcuaaaauguuu

SEQ ID NO: 1966623 - RNA, 15 nt, Human
aggcuaaaauguuuu

SEQ ID NO: 1966624 - RNA, 16 nt, Human
aggcuaaaauguuuuc

SEQ ID NO: 1966625 - RNA, 17 nt, Human
aggcuaaaauguuuuca

SEQ ID NO: 1966626 - RNA, 18 nt, Human
aggcuaaaauguuuucag

SEQ ID NO: 1966627 - RNA, 19 nt, Human
aggcuaaaauguuuucagc

SEQ ID NO: 1966628 - RNA, 16 nt, Human
agggaccucucccagg

SEQ ID NO: 1966629 - RNA, 15 nt, Human
agggaccucucccag

SEQ ID NO: 1966630 - RNA, 13 nt, Human
agggaccucuccc

SEQ ID NO: 1966631 - RNA, 23 nt, Human
agggacagaggggguggccuccc

SEQ ID NO: 1966632 - RNA, 22 nt, Human
agggacagaggggguggccucc

SEQ ID NO: 1966633 - RNA, 22 nt, Human
aggcugucucagauaaauuaug

SEQ ID NO: 1966634 - RNA, 21 nt, Human
aggcugucaauuacaggaagu

SEQ ID NO: 1966635 - RNA, 20 nt, Human
aggcugucaguguuuggugc

SEQ ID NO: 1966636 - RNA, 20 nt, Human
aggcugucaauuacaggaag

SEQ ID NO: 1966637 - RNA, 13 nt, Human
aggcuguauccca

SEQ ID NO: 1966638 - RNA, 18 nt, Human
aggcuguaucccaugagc

SEQ ID NO: 1966639 - RNA, 13 nt, Human
agcugaaauugaa

SEQ ID NO: 1966640 - RNA, 16 nt, Human
agcugaaauugaaaag

SEQ ID NO: 1966641 - RNA, 19 nt, Human
agcugaaauugaaaaguua

SEQ ID NO: 1966642 - RNA, 12 nt, Human
agcugaaauuga

SEQ ID NO: 1966643 - RNA, 15 nt, Human
agcucuuuuccuaga

SEQ ID NO: 1966644 - RNA, 14 nt, Human
agcugagcaggugu

SEQ ID NO: 1966645 - RNA, 21 nt, Human
agcugcgguccacccaggagc

SEQ ID NO: 1966646 - RNA, 23 nt, Human
agcugagauuauaggcaccuacc

SEQ ID NO: 1966647 - RNA, 12 nt, Human
agcuccuucugu

SEQ ID NO: 1966648 - RNA, 19 nt, Human
agcuccuuccuagccuugc

SEQ ID NO: 1966649 - RNA, 13 nt, Human
agcuccuucuguc

SEQ ID NO: 1966650 - RNA, 20 nt, Human
agcuccgcuuucuacccagc

SEQ ID NO: 1966651 - RNA, 21 nt, Human
agcuccgcuuucuacccagcg

SEQ ID NO: 1966652 - RNA, 23 nt, Human
agcuccgcuuucuacccagcgag

SEQ ID NO: 1966653 - RNA, 19 nt, Human
agcuccggcguguguucag

SEQ ID NO: 1966654 - RNA, 18 nt, Human
agcucccgcuccgggcuc

SEQ ID NO: 1966655 - RNA, 20 nt, Human
agcucccucaaagaggcagu

SEQ ID NO: 1966656 - RNA, 21 nt, Human
agcugcucagggaaaagcagc

SEQ ID NO: 1966657 - RNA, 19 nt, Human
agcugcucagaucccacuu

SEQ ID NO: 1966658 - RNA, 16 nt, Human
agcugcucagggaaaa

SEQ ID NO: 1966659 - RNA, 21 nt, Human
agcugcuacucgugagcgcca

SEQ ID NO: 1966660 - RNA, 23 nt, Human
agcugcgguccacccaggagccc

SEQ ID NO: 1966661 - RNA, 18 nt, Human
agcugcggugucucccug

SEQ ID NO: 1966662 - RNA, 21 nt, Human
agcuucuggugaccuuccaag

SEQ ID NO: 1966663 - RNA, 22 nt, Human
agcuucuggugaccuuccaaga

SEQ ID NO: 1966664 - RNA, 19 nt, Human
agcuucuguugcugccuca

SEQ ID NO: 1966665 - RNA, 17 nt, Human
agcuuccagcaggaggg

SEQ ID NO: 1966666 - RNA, 19 nt, Human
agcuuccagcaggagggac

SEQ ID NO: 1966667 - RNA, 18 nt, Human
agcuuccaauuuuccuuc

SEQ ID NO: 1966668 - RNA, 12 nt, Human
agcuuccagcag

SEQ ID NO: 1966669 - RNA, 13 nt, Human
agcuuccagcagg

SEQ ID NO: 1966670 - RNA, 14 nt, Human
agcuuccagcagga

SEQ ID NO: 1966671 - RNA, 16 nt, Human
agcuuccagcaggagg

SEQ ID NO: 1966672 - RNA, 18 nt, Human
agcuuccccaguagcugg

SEQ ID NO: 1966673 - RNA, 12 nt, Human
agcuucccuccc

SEQ ID NO: 1966674 - RNA, 15 nt, Human
agcuucccucccugc

SEQ ID NO: 1966675 - RNA, 16 nt, Human
agcuucccucccugcu

SEQ ID NO: 1966676 - RNA, 18 nt, Human
agcuucccucccugcugu

SEQ ID NO: 1966677 - RNA, 14 nt, Human
aggauuauuggaaa

SEQ ID NO: 1966678 - RNA, 20 nt, Human
aggauuaaauaauguaaaua

SEQ ID NO: 1966679 - RNA, 18 nt, Human
aggauguucugggacaca

SEQ ID NO: 1966680 - RNA, 14 nt, Human
aggauuaaauaaug

SEQ ID NO: 1966681 - RNA, 17 nt, Human
aggauucacaccccacc

SEQ ID NO: 1966682 - RNA, 14 nt, Human
aggauucacacccc

SEQ ID NO: 1966683 - RNA, 17 nt, Human
aggauuaguuuagaaca

SEQ ID NO: 1966684 - RNA, 15 nt, Human
aggauuaguuuagaa

SEQ ID NO: 1966685 - RNA, 16 nt, Human
aggauuaguuuagaac

SEQ ID NO: 1966686 - RNA, 18 nt, Human
aggauuaguuuagaacag

SEQ ID NO: 1966687 - RNA, 22 nt, Human
aggauguucuagcauggcugcc

SEQ ID NO: 1966688 - RNA, 22 nt, Human
aggauguacaaggacagccccu

SEQ ID NO: 1966689 - RNA, 15 nt, Human
aggauguucugggac

SEQ ID NO: 1966690 - RNA, 16 nt, Human
aggauguucugggaca

SEQ ID NO: 1966691 - RNA, 13 nt, Human
aggaccucaggug

SEQ ID NO: 1966692 - RNA, 22 nt, Human
aggagaagucuucuauuuauuu

SEQ ID NO: 1966693 - RNA, 23 nt, Human
aggagaagucuucuauuuauuua

SEQ ID NO: 1966694 - RNA, 16 nt, Human
aggagaaugaaaugua

SEQ ID NO: 1966695 - RNA, 23 nt, Human
aggagaauuaaguccuacuuuua

SEQ ID NO: 1966696 - RNA, 17 nt, Human
aggagaaucauguuucu

SEQ ID NO: 1966697 - RNA, 19 nt, Human
aggagaaucauguuucuuu

SEQ ID NO: 1966698 - RNA, 21 nt, Human
aggagucccugccaucauguu

SEQ ID NO: 1966699 - RNA, 23 nt, Human
aggagucccacuccaagccagca

SEQ ID NO: 1966700 - RNA, 21 nt, Human
aggagucccacuccaagccag

SEQ ID NO: 1966701 - RNA, 22 nt, Human
aggagucccacuccaagccagc

SEQ ID NO: 1966702 - RNA, 21 nt, Human
aggaugcuuguacauaaugcg

SEQ ID NO: 1966703 - RNA, 23 nt, Human
aggaugcuuguacauaaugcgug

SEQ ID NO: 1966704 - RNA, 21 nt, Human
agcuuuucccuuuuuuuaagu

SEQ ID NO: 1966705 - RNA, 20 nt, Human
aggaauccagacccggcugc

SEQ ID NO: 1966706 - RNA, 21 nt, Human
aggaaucaugugccaagcaga

SEQ ID NO: 1966707 - RNA, 17 nt, Human
aggaauccagacccggc

SEQ ID NO: 1966708 - RNA, 18 nt, Human
aggacccugccaggcaca

SEQ ID NO: 1966709 - RNA, 19 nt, Human
aggacccugccaggcacag

SEQ ID NO: 1966710 - RNA, 21 nt, Human
aggacccugccaggcacaggc

SEQ ID NO: 1966711 - RNA, 22 nt, Human
aggacccugccaggcacaggca

SEQ ID NO: 1966712 - RNA, 23 nt, Human
aggacccugccaggcacaggcag

SEQ ID NO: 1966713 - RNA, 14 nt, Human
agagcccaggccuc

SEQ ID NO: 1966714 - RNA, 13 nt, Human
agagcccaggccu

SEQ ID NO: 1966715 - RNA, 15 nt, Human
agagcccaggccucc

SEQ ID NO: 1966716 - RNA, 16 nt, Human
agaggaaggagaggag

SEQ ID NO: 1966717 - RNA, 21 nt, Human
agaggaacagcacuggggagu

SEQ ID NO: 1966718 - RNA, 12 nt, Human
agaggaccagca

SEQ ID NO: 1966719 - RNA, 20 nt, Human
agaggacaguauuugugggg

SEQ ID NO: 1966720 - RNA, 16 nt, Human
agaggagagaggaccc

SEQ ID NO: 1966721 - RNA, 15 nt, Human
agaggagagaggacc

SEQ ID NO: 1966722 - RNA, 19 nt, Human
agaggagaacuugcugccu

SEQ ID NO: 1966723 - RNA, 20 nt, Human
agaggagaacuugcugccuc

SEQ ID NO: 1966724 - RNA, 17 nt, Human
agagggaugcauggaga

SEQ ID NO: 1966725 - RNA, 12 nt, Human
agagggcacaga

SEQ ID NO: 1966726 - RNA, 22 nt, Human
agagggccauugaacucugaga

SEQ ID NO: 1966727 - RNA, 20 nt, Human
agaggguggugaccucugcc

SEQ ID NO: 1966728 - RNA, 22 nt, Human
agaggguggugaccucugccug

SEQ ID NO: 1966729 - RNA, 19 nt, Human
agaggguggugaccucugc

SEQ ID NO: 1966730 - RNA, 19 nt, Human
agaguggggauaugauuua

SEQ ID NO: 1966731 - RNA, 23 nt, Human
agaguggcuccucccggugccca

SEQ ID NO: 1966732 - RNA, 11 nt, Human
agagugggagc

SEQ ID NO: 1966733 - RNA, 19 nt, Human
agaguggcuccucccggug

SEQ ID NO: 1966734 - RNA, 14 nt, Human
agagugugccugaa

SEQ ID NO: 1966735 - RNA, 13 nt, Human
agaguuacuugau

SEQ ID NO: 1966736 - RNA, 21 nt, Human
agaugaaauaaagacccaggg

SEQ ID NO: 1966737 - RNA, 14 nt, Human
agauggcugugccu

SEQ ID NO: 1966738 - RNA, 21 nt, Human
agauggcuggaagggguccag

SEQ ID NO: 1966739 - RNA, 14 nt, Human
agaucuucuguggg

SEQ ID NO: 1966740 - RNA, 19 nt, Human
agauauaugcucugcaugu

SEQ ID NO: 1966741 - RNA, 17 nt, Human
agauauccacuuaccug

SEQ ID NO: 1966742 - RNA, 17 nt, Human
agauauccucugcuuaa

SEQ ID NO: 1966743 - RNA, 18 nt, Human
agauauccucugcuuaaa

SEQ ID NO: 1966744 - RNA, 19 nt, Human
agauauccucugcuuaaaa

SEQ ID NO: 1966745 - RNA, 14 nt, Human
agaguuacuugaua

SEQ ID NO: 1966746 - RNA, 17 nt, Human
agaguuacuugauaagg

SEQ ID NO: 1966747 - RNA, 16 nt, Human
agaguucagggaagau

SEQ ID NO: 1966748 - RNA, 18 nt, Human
agaguucagggaagauaa

SEQ ID NO: 1966749 - RNA, 23 nt, Human
agacagagucucacuguugccca

SEQ ID NO: 1966750 - RNA, 15 nt, Human
agacaaccaaguaug

SEQ ID NO: 1966751 - RNA, 15 nt, Human
agacagcccgggcuc

SEQ ID NO: 1966752 - RNA, 14 nt, Human
agacagcccgggcu

SEQ ID NO: 1966753 - RNA, 22 nt, Human
agacagcccgauccuccccugg

SEQ ID NO: 1966754 - RNA, 21 nt, Human
agacagauacuccuccaaggu

SEQ ID NO: 1966755 - RNA, 15 nt, Human
agacagauacuccuc

SEQ ID NO: 1966756 - RNA, 22 nt, Human
agacgcugugcugcccugccca

SEQ ID NO: 1966757 - RNA, 18 nt, Human
agacggagucccaccuug

SEQ ID NO: 1966758 - RNA, 12 nt, Human
agacagcucuua

SEQ ID NO: 1966759 - RNA, 11 nt, Human
agacagcucuu

SEQ ID NO: 1966760 - RNA, 12 nt, Human
agacagcugccu

SEQ ID NO: 1966761 - RNA, 21 nt, Human
agacgcugugcugcccugccc

SEQ ID NO: 1966762 - RNA, 16 nt, Human
agagcccacgccccca

SEQ ID NO: 1966763 - RNA, 23 nt, Human
agagagggugaguccuccagaac

SEQ ID NO: 1966764 - RNA, 17 nt, Human
agagcccacgcccccac

SEQ ID NO: 1966765 - RNA, 13 nt, Human
agagcccacgccc

SEQ ID NO: 1966766 - RNA, 19 nt, Human
agagcccaccuuggcucaa

SEQ ID NO: 1966767 - RNA, 22 nt, Human
agagaggguggugaccucugcc

SEQ ID NO: 1966768 - RNA, 20 nt, Human
agagaggguggugaccucug

SEQ ID NO: 1966769 - RNA, 21 nt, Human
agagaggguggugaccucugc

SEQ ID NO: 1966770 - RNA, 13 nt, Human
agagagcgcagcc

SEQ ID NO: 1966771 - RNA, 20 nt, Human
agagagcgcagccgccuuca

SEQ ID NO: 1966772 - RNA, 22 nt, Human
agagagcgcagccgccuucaca

SEQ ID NO: 1966773 - RNA, 10 nt, Human
agagaaaaga

SEQ ID NO: 1966774 - RNA, 11 nt, Human
agagaaaagaa

SEQ ID NO: 1966775 - RNA, 21 nt, Human
agagaaaagaaaaaaaaagaa

SEQ ID NO: 1966776 - RNA, 12 nt, Human
agagaaaagaaa

SEQ ID NO: 1966777 - RNA, 13 nt, Human
agagaaaagaaaa

SEQ ID NO: 1966778 - RNA, 14 nt, Human
agagaaaagaaaaa

SEQ ID NO: 1966779 - RNA, 15 nt, Human
agagaaaagaaaaaa

SEQ ID NO: 1966780 - RNA, 19 nt, Human
agacuggaagcacagcuuc

SEQ ID NO: 1966781 - RNA, 17 nt, Human
agacuggaagcacagcu

SEQ ID NO: 1966782 - RNA, 16 nt, Human
agacuggaagcacagc

SEQ ID NO: 1966783 - RNA, 15 nt, Human
agacugccacaagga

SEQ ID NO: 1966784 - RNA, 22 nt, Human
agacugccacaaggaagaaauu

SEQ ID NO: 1966785 - RNA, 11 nt, Human
agacugccagc

SEQ ID NO: 1966786 - RNA, 12 nt, Human
agacugccagcu

SEQ ID NO: 1966787 - RNA, 13 nt, Human
agacugccagcuc

SEQ ID NO: 1966788 - RNA, 14 nt, Human
agacugccagcucu

SEQ ID NO: 1966789 - RNA, 18 nt, Human
agacugccagcucuuccu

SEQ ID NO: 1966790 - RNA, 22 nt, Human
agacugccagcucuuccuagcu

SEQ ID NO: 1966791 - RNA, 16 nt, Human
agacugcuccugagcc

SEQ ID NO: 1966792 - RNA, 17 nt, Human
agacugcuccugagccc

SEQ ID NO: 1966793 - RNA, 19 nt, Human
agacugcuccugagccccc

SEQ ID NO: 1966794 - RNA, 20 nt, Human
agacugcuccugagccccca

SEQ ID NO: 1966795 - RNA, 21 nt, Human
agacugcuccugagcccccag

SEQ ID NO: 1966796 - RNA, 23 nt, Human
agacugcuccugagcccccagcu

SEQ ID NO: 1966797 - RNA, 17 nt, Human
agcacagacccugcccu

SEQ ID NO: 1966798 - RNA, 14 nt, Human
agcacacucauccc

SEQ ID NO: 1966799 - RNA, 22 nt, Human
agcacaccaaucuuacuuugua

SEQ ID NO: 1966800 - RNA, 20 nt, Human
agcacacucauccccucacu

SEQ ID NO: 1966801 - RNA, 23 nt, Human
agcacacuugacaucaacugcau

SEQ ID NO: 1966802 - RNA, 19 nt, Human
agcacaccaaucuuacuuu

SEQ ID NO: 1966803 - RNA, 21 nt, Human
agcacaccaaucuuacuuugu

SEQ ID NO: 1966804 - RNA, 19 nt, Human
agcacagacccugcccugu

SEQ ID NO: 1966805 - RNA, 18 nt, Human
agcacagacccugcccug

SEQ ID NO: 1966806 - RNA, 20 nt, Human
agcacagacccugcccugug

SEQ ID NO: 1966807 - RNA, 20 nt, Human
agcacugaaaguauguuuua

SEQ ID NO: 1966808 - RNA, 16 nt, Human
agcacugaaccuggga

SEQ ID NO: 1966809 - RNA, 18 nt, Human
agcacugaaccugggaaa

SEQ ID NO: 1966810 - RNA, 13 nt, Human
agcagcguuucua

SEQ ID NO: 1966811 - RNA, 21 nt, Human
agcagcuccuuccuagccuug

SEQ ID NO: 1966812 - RNA, 22 nt, Human
agcagcuccuuccuagccuugc

SEQ ID NO: 1966813 - RNA, 14 nt, Human
agcagcucuccccu

SEQ ID NO: 1966814 - RNA, 12 nt, Human
agcagcucuccc

SEQ ID NO: 1966815 - RNA, 19 nt, Human
agcagcugacuuucaaagu

SEQ ID NO: 1966816 - RNA, 20 nt, Human
agcagugcaugcugucccuu

SEQ ID NO: 1966817 - RNA, 19 nt, Human
agcagugcaugcugucccu

SEQ ID NO: 1966818 - RNA, 12 nt, Human
agcagugcccag

SEQ ID NO: 1966819 - RNA, 13 nt, Human
agcagugcccagg

SEQ ID NO: 1966820 - RNA, 18 nt, Human
agcagugcaugcuguccc

SEQ ID NO: 1966821 - RNA, 14 nt, Human
agcagugcccaggu

SEQ ID NO: 1966822 - RNA, 16 nt, Human
agcagugcccaggugg

SEQ ID NO: 1966823 - RNA, 20 nt, Human
agcagugcccagguggcugu

SEQ ID NO: 1966824 - RNA, 23 nt, Human
agcagugcccagguggcugugga

SEQ ID NO: 1966825 - RNA, 18 nt, Human
agcagugggccuggccag

SEQ ID NO: 1966826 - RNA, 22 nt, Human
agcagugggucaugaugcucuu

SEQ ID NO: 1966827 - RNA, 21 nt, Human
agcaguuaugugaccucacgu

SEQ ID NO: 1966828 - RNA, 21 nt, Human
agcaguucuuaacccaguguc

SEQ ID NO: 1966829 - RNA, 22 nt, Human
agcaugagacuauguaaaaaua

SEQ ID NO: 1966830 - RNA, 23 nt, Human
agcaugccuggauggggcugcac

SEQ ID NO: 1966831 - RNA, 20 nt, Human
agcaugccuggauggggcug

SEQ ID NO: 1966832 - RNA, 23 nt, Human
agccaagugugguagagugugcc

SEQ ID NO: 1966833 - RNA, 23 nt, Human
agcaugacagaaaauauguauua

SEQ ID NO: 1966834 - RNA, 18 nt, Human
agcaugacagaaaauaug

SEQ ID NO: 1966835 - RNA, 21 nt, Human
agcaugacagaaaauauguau

SEQ ID NO: 1966836 - RNA, 14 nt, Human
agcaugacagaaaa

SEQ ID NO: 1966837 - RNA, 14 nt, Human
agcaucgcacucug

SEQ ID NO: 1966838 - RNA, 19 nt, Human
agcaucgcacucuggcagc

SEQ ID NO: 1966839 - RNA, 19 nt, Human
agcaucgcuuaggagaagu

SEQ ID NO: 1966840 - RNA, 22 nt, Human
agcauccuggcacccggccccu

SEQ ID NO: 1966841 - RNA, 23 nt, Human
agcauccuggcacccggccccug

SEQ ID NO: 1966842 - RNA, 20 nt, Human
agccagcaggcucucaggcc

SEQ ID NO: 1966843 - RNA, 17 nt, Human
agccagcaggcucucag

SEQ ID NO: 1966844 - RNA, 19 nt, Human
agccagcaggcucucaggc

SEQ ID NO: 1966845 - RNA, 18 nt, Human
agccagcaggcucucagg

SEQ ID NO: 1966846 - RNA, 13 nt, Human
agccccagugccc

SEQ ID NO: 1966847 - RNA, 14 nt, Human
agccccagugccca

SEQ ID NO: 1966848 - RNA, 15 nt, Human
agccccagugcccac

SEQ ID NO: 1966849 - RNA, 14 nt, Human
agccccauuaacug

SEQ ID NO: 1966850 - RNA, 15 nt, Human
agccccauuaacugc

SEQ ID NO: 1966851 - RNA, 17 nt, Human
agcccucacccuggggc

SEQ ID NO: 1966852 - RNA, 13 nt, Human
agccccauucugc

SEQ ID NO: 1966853 - RNA, 16 nt, Human
agccccauucugccug

SEQ ID NO: 1966854 - RNA, 16 nt, Human
agccuccgcuucccug

SEQ ID NO: 1966855 - RNA, 17 nt, Human
agccuccgcuucccugg

SEQ ID NO: 1966856 - RNA, 18 nt, Human
agccuccgcuucccuggu

SEQ ID NO: 1966857 - RNA, 20 nt, Human
agccuccgcuucccugguuc

SEQ ID NO: 1966858 - RNA, 14 nt, Human
agccuccuccagcc

SEQ ID NO: 1966859 - RNA, 22 nt, Human
agccuccgcuucccugguucaa

SEQ ID NO: 1966860 - RNA, 20 nt, Human
agccucccgaguagcuggga

SEQ ID NO: 1966861 - RNA, 18 nt, Human
agccucccgaguagcugg

SEQ ID NO: 1966862 - RNA, 19 nt, Human
agccucccgaguagcuggg

SEQ ID NO: 1966863 - RNA, 14 nt, Human
agccucccacagug

SEQ ID NO: 1966864 - RNA, 18 nt, Human
agccucccacagugcugg

SEQ ID NO: 1966865 - RNA, 22 nt, Human
agccucccacgacugcccggca

SEQ ID NO: 1966866 - RNA, 21 nt, Human
agccucccaaagugcugggau

SEQ ID NO: 1966867 - RNA, 17 nt, Human
agccgugccuucagcuc

SEQ ID NO: 1966868 - RNA, 15 nt, Human
agccgugccuucagc

SEQ ID NO: 1966869 - RNA, 16 nt, Human
agccgugccuucagcu

SEQ ID NO: 1966870 - RNA, 21 nt, Human
agccgggcgugguggugagug

SEQ ID NO: 1966871 - RNA, 21 nt, Human
agccgccaugcuccuggccca

SEQ ID NO: 1966872 - RNA, 13 nt, Human
agccgcuggggcc

SEQ ID NO: 1966873 - RNA, 16 nt, Human
agccgccuucacagca

SEQ ID NO: 1966874 - RNA, 17 nt, Human
agccgccuucacagcag

SEQ ID NO: 1966875 - RNA, 22 nt, Human
agccgcggugcccaaccacacu

SEQ ID NO: 1966876 - RNA, 13 nt, Human
agccgcuccagag

SEQ ID NO: 1966877 - RNA, 18 nt, Human
aauccaagcaaaugugaa

SEQ ID NO: 1966878 - RNA, 17 nt, Human
aauccaagcaaauguga

SEQ ID NO: 1966879 - RNA, 16 nt, Human
aaucucaaauuucuaa

SEQ ID NO: 1966880 - RNA, 15 nt, Human
aaucucaaauuucua

SEQ ID NO: 1966881 - RNA, 13 nt, Human
aauccagccugcu

SEQ ID NO: 1966882 - RNA, 19 nt, Human
aauccagacccggcugcgu

SEQ ID NO: 1966883 - RNA, 17 nt, Human
aauccagacccggcugc

SEQ ID NO: 1966884 - RNA, 15 nt, Human
aauccaaugaaauga

SEQ ID NO: 1966885 - RNA, 17 nt, Human
aaucucaaauuucuaaa

SEQ ID NO: 1966886 - RNA, 18 nt, Human
aaucucaaauuucuaaau

SEQ ID NO: 1966887 - RNA, 22 nt, Human
aaucucaacaugucuccuacug

SEQ ID NO: 1966888 - RNA, 19 nt, Human
aauccaggacccugccagg

SEQ ID NO: 1966889 - RNA, 23 nt, Human
aauccaggacccugccaggcaca

SEQ ID NO: 1966890 - RNA, 16 nt, Human
aaucucuucuguguuu

SEQ ID NO: 1966891 - RNA, 11 nt, Human
aaucucuucug

SEQ ID NO: 1966892 - RNA, 12 nt, Human
aaucucuucugu

SEQ ID NO: 1966893 - RNA, 19 nt, Human
aaugaagguuuuuguaaag

SEQ ID NO: 1966894 - RNA, 20 nt, Human
aaugaagguuuuuguaaaga

SEQ ID NO: 1966895 - RNA, 22 nt, Human
aaugaagguuuuuguaaagauu

SEQ ID NO: 1966896 - RNA, 15 nt, Human
aaugaagguuuuugu

SEQ ID NO: 1966897 - RNA, 23 nt, Human
aauacuuugcagcacagcugaga

SEQ ID NO: 1966898 - RNA, 13 nt, Human
aauacugcuugaa

SEQ ID NO: 1966899 - RNA, 22 nt, Human
aauacuguacaaugacuuuauu

SEQ ID NO: 1966900 - RNA, 14 nt, Human
aauacuguuauucu

SEQ ID NO: 1966901 - RNA, 15 nt, Human
aauacuguuauucuu

SEQ ID NO: 1966902 - RNA, 16 nt, Human
aauacuguuauucuuu

SEQ ID NO: 1966903 - RNA, 18 nt, Human
aauacugaaccacuugua

SEQ ID NO: 1966904 - RNA, 18 nt, Human
aauacugauggaauuuuu

SEQ ID NO: 1966905 - RNA, 20 nt, Human
aauacugaaccacuuguaga

SEQ ID NO: 1966906 - RNA, 21 nt, Human
aauacucagggaaagcauuua

SEQ ID NO: 1966907 - RNA, 23 nt, Human
aauacucagggaaagcauuuaaa

SEQ ID NO: 1966908 - RNA, 13 nt, Human
aauacugaaccac

SEQ ID NO: 1966909 - RNA, 14 nt, Human
aauacugaaccacu

SEQ ID NO: 1966910 - RNA, 15 nt, Human
aauacugaaccacuu

SEQ ID NO: 1966911 - RNA, 13 nt, Human
aauacucuuauau

SEQ ID NO: 1966912 - RNA, 22 nt, Human
aauacucuacccucuuagaaaa

SEQ ID NO: 1966913 - RNA, 20 nt, Human
aauacucuacccucuuagaa

SEQ ID NO: 1966914 - RNA, 14 nt, Human
aaguugcuggaaag

SEQ ID NO: 1966915 - RNA, 16 nt, Human
aauauauaucaaauau

SEQ ID NO: 1966916 - RNA, 13 nt, Human
aauagacaauuua

SEQ ID NO: 1966917 - RNA, 18 nt, Human
aauauacauguuuaugua

SEQ ID NO: 1966918 - RNA, 20 nt, Human
aauauacauguuuauguaaa

SEQ ID NO: 1966919 - RNA, 14 nt, Human
aaucaccgaaaacg

SEQ ID NO: 1966920 - RNA, 19 nt, Human
aaucacauucgaguguuuc

SEQ ID NO: 1966921 - RNA, 17 nt, Human
aaucaaguauuauaaac

SEQ ID NO: 1966922 - RNA, 15 nt, Human
aaucaccgaaaacgu

SEQ ID NO: 1966923 - RNA, 20 nt, Human
aaucaccagggccaaaagcu

SEQ ID NO: 1966924 - RNA, 21 nt, Human
aaucaagagccuuaaaacauc

SEQ ID NO: 1966925 - RNA, 22 nt, Human
aaucaagagccuuaaaacauca

SEQ ID NO: 1966926 - RNA, 13 nt, Human
aauauuauauuug

SEQ ID NO: 1966927 - RNA, 17 nt, Human
aauauuauauuuggaug

SEQ ID NO: 1966928 - RNA, 19 nt, Human
aauauuauauuuggaugca

SEQ ID NO: 1966929 - RNA, 17 nt, Human
aaucaagagccuuaaaa

SEQ ID NO: 1966930 - RNA, 19 nt, Human
aaucaagagccuuaaaaca

SEQ ID NO: 1966931 - RNA, 21 nt, Human
aauauuagugaccucagcuuu

SEQ ID NO: 1966932 - RNA, 13 nt, Human
aauauuaaaaagu

SEQ ID NO: 1966933 - RNA, 16 nt, Human
aauauuaaaaagucuu

SEQ ID NO: 1966934 - RNA, 17 nt, Human
aauauuaaaaagucuuu

SEQ ID NO: 1966935 - RNA, 19 nt, Human
aauauuaaaaagucuuuua

SEQ ID NO: 1966936 - RNA, 21 nt, Human
aauauuaaaaagucuuuuaaa

SEQ ID NO: 1966937 - RNA, 20 nt, Human
aauauuaaaaagucuuuuaa

SEQ ID NO: 1966938 - RNA, 22 nt, Human
aauguuuuuuuuuaaagacuuu

SEQ ID NO: 1966939 - RNA, 20 nt, Human
aauguuuuuuuuuaaagacu

SEQ ID NO: 1966940 - RNA, 15 nt, Human
aauguuuuuuuuuaa

SEQ ID NO: 1966941 - RNA, 19 nt, Human
aaugcgugcauaccacuuu

SEQ ID NO: 1966942 - RNA, 18 nt, Human
aaugcgugcauaccacuu

SEQ ID NO: 1966943 - RNA, 16 nt, Human
aaugcggccuuuucau

SEQ ID NO: 1966944 - RNA, 22 nt, Human
aaugcgcaggcuggcccugccc

SEQ ID NO: 1966945 - RNA, 21 nt, Human
aaugcgcaggcuggcccugcc

SEQ ID NO: 1966946 - RNA, 23 nt, Human
aaugccuuacccucauguucuua

SEQ ID NO: 1966947 - RNA, 13 nt, Human
aaugucaguaugu

SEQ ID NO: 1966948 - RNA, 15 nt, Human
aaugucaguaugugg

SEQ ID NO: 1966949 - RNA, 17 nt, Human
aauguccaguaagauca

SEQ ID NO: 1966950 - RNA, 23 nt, Human
aaugcuauaacuauguugauaaa

SEQ ID NO: 1966951 - RNA, 15 nt, Human
aaugcuaugucauuu

SEQ ID NO: 1966952 - RNA, 16 nt, Human
aaugcuaugucauuuc

SEQ ID NO: 1966953 - RNA, 17 nt, Human
aaugcuaugucauuuca

SEQ ID NO: 1966954 - RNA, 18 nt, Human
aaugcuaugucauuucau

SEQ ID NO: 1966955 - RNA, 15 nt, Human
aaugcugagguuaug

SEQ ID NO: 1966956 - RNA, 13 nt, Human
aaugcugauuuaa

SEQ ID NO: 1966957 - RNA, 15 nt, Human
aaugcugacccaugg

SEQ ID NO: 1966958 - RNA, 17 nt, Human
aaugcugacccaugggc

SEQ ID NO: 1966959 - RNA, 22 nt, Human
aaugcugacccaugggcaggag

SEQ ID NO: 1966960 - RNA, 23 nt, Human
aaugcugacccaugggcaggaga

SEQ ID NO: 1966961 - RNA, 21 nt, Human
aaugcuaugucauuucauguc

SEQ ID NO: 1966962 - RNA, 15 nt, Human
aaugcugaaaauugc

SEQ ID NO: 1966963 - RNA, 18 nt, Human
aaugcugaacauugcaua

SEQ ID NO: 1966964 - RNA, 20 nt, Human
aauggugucaguauccaggc

SEQ ID NO: 1966965 - RNA, 22 nt, Human
aaugcuggagaaaaauaucugu

SEQ ID NO: 1966966 - RNA, 15 nt, Human
aaugugaaaagaaaa

SEQ ID NO: 1966967 - RNA, 17 nt, Human
aaugugaaaagaaaaau

SEQ ID NO: 1966968 - RNA, 15 nt, Human
aauguuuaagcagaa

SEQ ID NO: 1966969 - RNA, 20 nt, Human
aauguuuaagcagaauugga

SEQ ID NO: 1966970 - RNA, 21 nt, Human
aauguuuaagcagaauuggaa

SEQ ID NO: 1966971 - RNA, 22 nt, Human
aauguuuaagcagaauuggaaa

SEQ ID NO: 1966972 - RNA, 19 nt, Human
aauguccaguaagaucacu

SEQ ID NO: 1966973 - RNA, 20 nt, Human
aauguccaguaagaucacug

SEQ ID NO: 1966974 - RNA, 22 nt, Human
aauguccaguaagaucacuguu

SEQ ID NO: 1966975 - RNA, 22 nt, Human
aauguuuacagauccccaagcc

SEQ ID NO: 1966976 - RNA, 12 nt, Human
aauguuuacaaa

SEQ ID NO: 1966977 - RNA, 15 nt, Human
aauguuugccucugc

SEQ ID NO: 1966978 - RNA, 16 nt, Human
aauguuugccucugcc

SEQ ID NO: 1966979 - RNA, 12 nt, Human
aauguuucuaag

SEQ ID NO: 1966980 - RNA, 18 nt, Human
aaggucauuuuuuuuaag

SEQ ID NO: 1966981 - RNA, 19 nt, Human
aaggucauuuuuuuuaaga

SEQ ID NO: 1966982 - RNA, 18 nt, Human
aagggacgcuacccggga

SEQ ID NO: 1966983 - RNA, 21 nt, Human
aagggaccagggagaugccac

SEQ ID NO: 1966984 - RNA, 18 nt, Human
aagggagcuggcuccagc

SEQ ID NO: 1966985 - RNA, 16 nt, Human
aagggaggcccagcgc

SEQ ID NO: 1966986 - RNA, 21 nt, Human
aagggaauagaaauguuugcu

SEQ ID NO: 1966987 - RNA, 21 nt, Human
aaguagaagucuuagauguau

SEQ ID NO: 1966988 - RNA, 21 nt, Human
aaguagaacuuuguauaguua

SEQ ID NO: 1966989 - RNA, 23 nt, Human
aaguagaacuuuguauaguuaug

SEQ ID NO: 1966990 - RNA, 17 nt, Human
aaguaggggaagaauaa

SEQ ID NO: 1966991 - RNA, 19 nt, Human
aaguaggggaagaauaauu

SEQ ID NO: 1966992 - RNA, 20 nt, Human
aaguaggggaagaauaauuu

SEQ ID NO: 1966993 - RNA, 18 nt, Human
aaguaucccuacuguaau

SEQ ID NO: 1966994 - RNA, 23 nt, Human
aaguaucccuacuguaauuugug

SEQ ID NO: 1966995 - RNA, 17 nt, Human
aaguaucccuacuguaa

SEQ ID NO: 1966996 - RNA, 15 nt, Human
aaggugauaaaauca

SEQ ID NO: 1966997 - RNA, 20 nt, Human
aaggugaggagcuugaaacc

SEQ ID NO: 1966998 - RNA, 20 nt, Human
aaguagaagucuuagaugua

SEQ ID NO: 1966999 - RNA, 19 nt, Human
aaguagaagucuuagaugu

SEQ ID NO: 1967000 - RNA, 17 nt, Human
aaguagaacuuuguaua

SEQ ID NO: 1967001 - RNA, 18 nt, Human
aaguagaacuuuguauag

SEQ ID NO: 1967002 - RNA, 22 nt, Human
aaggugauaaaaucauaaguau

SEQ ID NO: 1967003 - RNA, 14 nt, Human
aaggugcaggcagg

SEQ ID NO: 1967004 - RNA, 14 nt, Human
aagucuccaaaguc

SEQ ID NO: 1967005 - RNA, 13 nt, Human
aagucucaaggua

SEQ ID NO: 1967006 - RNA, 20 nt, Human
aaguccuuugagcuccuggg

SEQ ID NO: 1967007 - RNA, 22 nt, Human
aaguccuuggcuugccauuuuu

SEQ ID NO: 1967008 - RNA, 18 nt, Human
aaguccuuugagcuccug

SEQ ID NO: 1967009 - RNA, 16 nt, Human
aagucgguuaaaaugg

SEQ ID NO: 1967010 - RNA, 22 nt, Human
aaguccucuuuucugagaggac

SEQ ID NO: 1967011 - RNA, 21 nt, Human
aaguauccugagagcccagaa

SEQ ID NO: 1967012 - RNA, 22 nt, Human
aagucccuguaauuguuguuug

SEQ ID NO: 1967013 - RNA, 18 nt, Human
aaguccucuuuucugaga

SEQ ID NO: 1967014 - RNA, 18 nt, Human
aaguccgcagaagcccug

SEQ ID NO: 1967015 - RNA, 19 nt, Human
aaguccgcagaagcccuga

SEQ ID NO: 1967016 - RNA, 19 nt, Human
aaguccuacuuuuaaagaa

SEQ ID NO: 1967017 - RNA, 20 nt, Human
aaguccuacuuuuaaagaau

SEQ ID NO: 1967018 - RNA, 16 nt, Human
aaguugaguauauuau

SEQ ID NO: 1967019 - RNA, 18 nt, Human
aaguugaguauauuauaa

SEQ ID NO: 1967020 - RNA, 19 nt, Human
aaguugagcuaugacuuaa

SEQ ID NO: 1967021 - RNA, 20 nt, Human
aaguugagcuaugacuuaac

SEQ ID NO: 1967022 - RNA, 16 nt, Human
aaguugagcaaacauu

SEQ ID NO: 1967023 - RNA, 16 nt, Human
aaguugagcuaugacu

SEQ ID NO: 1967024 - RNA, 18 nt, Human
aaguugagcuaugacuua

SEQ ID NO: 1967025 - RNA, 12 nt, Human
aaguugaauuuu

SEQ ID NO: 1967026 - RNA, 20 nt, Human
aaguugacucugcucuugca

SEQ ID NO: 1967027 - RNA, 21 nt, Human
aaguugacucugcucuugcau

SEQ ID NO: 1967028 - RNA, 15 nt, Human
aaguguacuggauuu

SEQ ID NO: 1967029 - RNA, 19 nt, Human
aaguggaaaaauagccugc

SEQ ID NO: 1967030 - RNA, 21 nt, Human
aaguggaaaaauagccugccu

SEQ ID NO: 1967031 - RNA, 15 nt, Human
aagucuccaaagucu

SEQ ID NO: 1967032 - RNA, 14 nt, Human
aagucucuuuuuua

SEQ ID NO: 1967033 - RNA, 15 nt, Human
aagucucuuuuuuac

SEQ ID NO: 1967034 - RNA, 16 nt, Human
aagucucuuuuuuaca

SEQ ID NO: 1967035 - RNA, 18 nt, Human
aagucucuuuuuuacaaa

SEQ ID NO: 1967036 - RNA, 20 nt, Human
aagucuguugauuaaagaug

SEQ ID NO: 1967037 - RNA, 20 nt, Human
aagcggcccuaagggagugu

SEQ ID NO: 1967038 - RNA, 21 nt, Human
aagcgcccuggcccccacaug

SEQ ID NO: 1967039 - RNA, 21 nt, Human
aagcgauucuucugcuucagc

SEQ ID NO: 1967040 - RNA, 13 nt, Human
aagcgcccuggcc

SEQ ID NO: 1967041 - RNA, 14 nt, Human
aagcgcccuggccc

SEQ ID NO: 1967042 - RNA, 15 nt, Human
aagcgcccuggcccc

SEQ ID NO: 1967043 - RNA, 19 nt, Human
aagcgcccuggcccccaca

SEQ ID NO: 1967044 - RNA, 12 nt, Human
aaggcagggagg

SEQ ID NO: 1967045 - RNA, 18 nt, Human
aaggcagcuguugucucu

SEQ ID NO: 1967046 - RNA, 21 nt, Human
aaggcagcuguugucucuucu

SEQ ID NO: 1967047 - RNA, 22 nt, Human
aaggcagcuguugucucuucuc

SEQ ID NO: 1967048 - RNA, 15 nt, Human
aaggauguucuagca

SEQ ID NO: 1967049 - RNA, 15 nt, Human
aaggauugcuacugu

SEQ ID NO: 1967050 - RNA, 22 nt, Human
aaggacuuccugauugguuucu

SEQ ID NO: 1967051 - RNA, 21 nt, Human
aaggacaguccuauuuagaca

SEQ ID NO: 1967052 - RNA, 13 nt, Human
aaggacuuccuga

SEQ ID NO: 1967053 - RNA, 21 nt, Human
aagcugugugcucuccaagcc

SEQ ID NO: 1967054 - RNA, 13 nt, Human
aaggacacuagaa

SEQ ID NO: 1967055 - RNA, 13 nt, Human
aaggacagccccu

SEQ ID NO: 1967056 - RNA, 19 nt, Human
aaggacagccccuccucca

SEQ ID NO: 1967057 - RNA, 18 nt, Human
aagcuguguggcagucug

SEQ ID NO: 1967058 - RNA, 18 nt, Human
aagcuggucccacucagu

SEQ ID NO: 1967059 - RNA, 21 nt, Human
aagcuggucccacucagucca

SEQ ID NO: 1967060 - RNA, 15 nt, Human
aagauguucuggaua

SEQ ID NO: 1967061 - RNA, 20 nt, Human
aagauguucuggauaccauu

SEQ ID NO: 1967062 - RNA, 12 nt, Human
aagauguuauau

SEQ ID NO: 1967063 - RNA, 14 nt, Human
aagauguuauauuu

SEQ ID NO: 1967064 - RNA, 22 nt, Human
aagauguuauauuuuucuuaaa

SEQ ID NO: 1967065 - RNA, 16 nt, Human
aagauguuauauuuuu

SEQ ID NO: 1967066 - RNA, 18 nt, Human
aagauguuauauuuuucu

SEQ ID NO: 1967067 - RNA, 13 nt, Human
aagauacugaaau

SEQ ID NO: 1967068 - RNA, 18 nt, Human
aagauaccuuaaaauuug

SEQ ID NO: 1967069 - RNA, 19 nt, Human
aagauaccuuaaaauuuga
